United States Patent 7,504,490 (NUCLEIC ACID AND AMINO ACID SEQUENCES RELATING TO APERGILLUS FUMIGATUS FOR DIAGNOSTICS AND THERAPEUTICS) - sequence listing, part 4

SEQ ID NO: 14454 - DNA, 1962 bp, A.fumigatus
gccaattcttaccggcaacggcgtcatccagttaccgtccagttcccggctctggcatccctgacactggctcacctcacgagaaatctgggaaacggactcgacaggacactcctcggactctccctggttctggttttcctccgacaaagcgacgagtcaccgtatgtgatctatcttggtctcctgctcccgcttcttctccaccttccgttcataacccaccatatttctcttgcgctacttcatcctctttctcttgactcccccgccggcagtccatggattgacacttggcagacaccggagccaccagtgaccgttgacctgacccgtgagctttctcacgtgtcttcgccagcggcccccgacaccgatctgaaatctactggaatggcttctcggacggacaacttctccctctcctcggttactgggtcctctgtccggcacacagccatggttagatcgcagagtcagcagactccggtctctcaccgaaaaccactggccccaggtgtcttgggacatcggcaatattacggacctcaacattggcagattcgacttgaccatgtcaacgaatatacgccgtccgaatatgcaaagcagtgcttggatgactttcaggaccggtcaaacgtatctacgctgtcgctggccctttctgcggatcctgctttgaatggaatccagcatcaactgcaaatatcaacaccggagtttccgataaaccccaatggtttgtcgaatcaatctctggccaatcaaccagcgccactggcatcagcagcagttgagatgaccaggagtaccactaccgattccatatgtggcggattgggcatgatcagatttgactccgccggaccaaatcttacccccagctaccccttctccatgccctcgactgaattcatgccctctgtttcccctataaatgttccaatccatgactacccaagtcagcaagccttgcagcccgtcacctttcccttcactgactctgctcctcttccattttcctgctcagcaccctcctcaacttcattctacccccctccctcttcaaatgtcccagaaacccctgctacagagatgaagccttccatgtctgctgaaagcaacaactcggctgcctctcagcagtcaagagcggcgcgaaggactcaagaacaaatcgcgcagggtacgcgacctattgcaccgaaacttgagtcgcgcaatacctctccagggaagccggtggagcagcacaagatgattcgtatctcatcatccgatggcacttcgaaagaagtcgcggctatccctaaggcctcgatacaacggcctccgcgcccgaaaacatattgccacatgtgcaatgaccagccagatggcttccatggggagcacgagctgcgaagacacattgagcgggtgcactcagtggtccgtaaggtttgggtctgtgtggatatatctccaggcaagacttttctggccaactgcaaggcctgtcggaatgggaaacggtatggtgctaattacaacgccgctgcccatctccgtcgtactcacttcaatccgtgtcagcgcggaaggggaggacgtgggaaagacagtgagaagcgaggcggtaagggtggcggcaatcatccgccgatggaagtactgaagcactggatggtgcagcaagaggaatttgttcttgagaatgcccagaatgctgttgaccaggagacaatagggaaagatctggcttctgtgccactgtcagcatcgaccgatgaggtggtcttcaacgggttgccttcggcaccagctgacagccaccctcaagtaggtatggaggccaatatagcccaagggtacgaaggctattctgacctccaaacgatgactgtgggcccgtctcttgagacggcgtgttattttgattctcagactctaccgcctgagatcgactcgtatgtatga

SEQ ID NO: 14455 - DNA, 348 bp, A.fumigatus
gttcgattaactttcggtgatgttgattttcacctggttgctgaccgatacacagaggctggcattgaagtcaacgaagaagttgttctcatgactacaaagggtgaagccatcgccattggcattgctcaaatgtctactgttgaactttccacttgcgatcatggtgtcgtagctaaggtcaaacgttgcatcatggaacgtgatctctaccctcgcagatggggactgggccctgtagctctggagaagaaaaagctcaagtcagctggaaaacttgatgtaagttgctgggttccacctccaacatttggtttttgtggtttttggtacgctgaccagccctaa

SEQ ID NO: 14456 - DNA, 555 bp, A.fumigatus
ttttcatgcgccaaaagaccacacagcaaatcgaagctgataaaggggaatttgataaggttcgcaggagaattcagggtaattgagaccaagccaagttttgctttcgaggacgtgctgactgtcatttctttgactaaagctccctcagacgccgagtttcgccataagatcaaaccgaccaaggacttattatttcgattttcagcactcacattcaacgcgcactccattcaccttgacacatcgtatacccaaaacgtcgaaggttacccagctctccttgttcacggcccactgactctcactttgcttcttacggtcttgcagagctacttggtggagtctaatcgcgcaatcagggagatagaatatagaaatctgtgtcctttatatgttgatgaggacttaacaatctgcggtaagcccagggccgacaagggaagcggggcttgggatatttggatcgaaggacacaacggtggtctggctgtcagaggcactgtaaagacagacaagtgtataaatttgcgcgaagatagacgtgatcagtaa

SEQ ID NO: 14457 - DNA, 204 bp, A.fumigatus
  unsure (201): Identity of nucleotide sequences at the above locations are unknown.
gggatcctgtctaagttggacgacaggacgcttactgctctgacatttgctcaatcagctctggtttatggtggcctgctgagcggctatatgttgttgttcattccgaggctgctatatagcttccgcctcagtatggagatttattttcacttttcttctgacaggaccgggcctttccttcatattcgatctttactntag

SEQ ID NO: 14458 - DNA, 183 bp, A.fumigatus
acttttatgctctctcctgaagcctgttctgatttctaccttggaagtagctttgatcaggtacacaatgctgatttttcgaagatcacagcaggttacttcttaagtggcgtaatcttcacctctggtgagcctaacctggcggaccgtgttctcacgcgtgctaatttgcaacagctctga

SEQ ID NO: 14459 - DNA, 666 bp, A.fumigatus
aaccatggcgtgttttgcagggcggagaaaactggacacagtggaactctcgacccgaaggtcaccggttgcttgatcgtctgcattgaccgtgcgactcgcttggtcaagtcccaacaaggtgccggaaaggagtatgtctgtgtcattcgtctccatgacaagattcccggtggtgaggctcagttcaaaagagctcttgagaccttgactggcgctctcttccagcggcctcctctgatttctgctgtcaagcgtcaacttcgtatcagaacgatccatgaaagcaaactctacgagttcgacaatgatagacaccttggcgtgttctgggtcagctgcgaggctggaacttatattcgaaccctttgcgttcacctgggtcttttacttggtgtcggtgctcacatgcaggaacttcggcgtgtacgaagtggagctatggacgagaacaatggcctcgtaactcttcatgatgtcctggatgcgcagtggatgtacgataaccagcgggacgaatcttacctgcgcagggtcatccaacctctcgagtcgctactcacaacgtacaagcgtattgttgttaaagacagtgccgtcaatgctgtgtgctatggcgcaaagctcatgattcccggtctcttgcgctttggtaagttcgattaa

SEQ ID NO: 14460 - DNA, 399 bp, A.fumigatus
gttgctgggttccacctccaacatttggtttttgtggtttttggtacgctgaccagccctaagaaatatggccgagcaaatgaggacacccccgccaaatggaagaccgaatacaaggattacagcgcccccgaagaagcttccgctcatgctgcatctgaatcgacagctaaagaagacgtggctgctgccctagctaccgaacaagacgaggcgccttcttcgccccagtccaagatggatgtcgatgaaaccaaggaagagaagaaacgcaagaggcatgagggcgaaacagcagaggaacgtgcagagcgtaagcgcaagaagaaggagaagaaggaaaagaaagaacggagaaaatccaagcaggagaaggaggacagtgatgacagcgactag

SEQ ID NO: 14461 - DNA, 258 bp, A.fumigatus
cttgagctttttcttctccagagctacagggcccagtccccatctgcgagggtagagatcacgttccatgatgcaacgtttgaccttagctacgacaccatgatcgcaagtggaaagttcaacagtagacatttgagcaatgccaatggcgatggcttcaccctttgtagtcatgagaacaacttcttcgttgacttcaatgccagcctctgtgtatcggtcagcaaccaggtgaaaatcaacatcaccgaaagttaa

SEQ ID NO: 14462 - DNA, 261 bp, A.fumigatus
acgtcccctgatactctcctcttcctcgtcttccatgaccgcgccgatacgcctctctatatcgaccaaaactttttcctccccttggtggcctttgactattacgtcccgaatcgtttcaatgcagacagcccgactgccatcaaggagaggactgtgcatcaatgggaatctaaccctaccaccagcccaaagacgcctgataaatggcggtcctgggaaatgcaatgtatcagtaccgtcagggagtatttgagatag

SEQ ID NO: 14463 - DNA, 1998 bp, A.fumigatus
gtatccttcattcttcctcgtcaatcaactgacaagatgtacttctctccacatgccagttcgtcagcatacgagtctcagaagttttcaaaacaaaaaactgtaagtcctagaaagcagcaacactttcaggcggaaaaaggatcaacacatacacggaattcctccacaggcttatcagtatacagcattgagtccaaagagataccgatttggttcagtgtgttcttcggaaagcccagtctgctgtcgccgcagttggacaatgctcggttcgatgctagaatttccgagcgggtctttggaccttccagcacgcccgctaacagtccctccaaatcctcttttagaacgagcgtctcaagtaacgtctccctgccacgacctggtctgcttgaagagacacctgtcatccgcgctatactctcgttgtgccactctttcgagggtgaaatactgaactgcgtgacagatggttgtacaatctgcggaaagggtccagctcaatcgctagtacatcatccgctgtgcgccactcgatatggctatgttgaactatcagattttgtggagatgcacaagctagtctcaactgtggcgtctcatacatcgcatgttaccaggagggacgaaatcgattggagtgtcggagatgtgatgagcgacagaccatacatctgctcactagcggttccaatttgttcttcggaaggagaatgccatagagcagcgagaaggctgatggagatgtacattgatggcattaaagacggcagcgttaagccgaaggctttggacaaattcgagaccccagacagaacgagtttaccacaacgccggagtgtgacatcgcaacgcagctttcggctgaatgccacaaaaaaagaagattattctgtaagcacgctttgcctgaggagcccatcaatcgaaactctcgggagtcctagtgctcagccctacaagattggagctaccatgtttgttggaagaccgagtctgcagctcagcggcacgccgagacgtggtcagctaggctgttcagtcttctcctctacttggtcaggcgctgctcttcctggagttgccaagaacgaggcagatgacgccgttttctattgtcgtattgcggctttctatgagagtcatatccttagctctgtgagttaccgttgcgcagtatgttctgaagtcgcaccagcaaggagcttagtgcatcggcccttactttttactcaaacatatagatctggcttgcagaatgagtctgagcggcggctgatcgtgaagctctctcaatttgtacaaggccgatggtcgtacccagagatgaatgctgtcatgggaggcacaaccgacgcgcatattttcgacctcattgtaccaatctgtgaaagcaatacgctttgcgcagaagtggctcgaacctctgcccgcgagttcgtcaagctactattaccttccgacatggcacttatttttccagggttagacccagatactgatctctccttgatggaagatgaggcagcggatgaatattgctacaagcccgaatatgccgagatcttagtccacagaatcggatgtgatctgttgacaataacctgcgaggagcgagacgaggaccctatggactgttcattgaccattaccaagctccgacgatggtacgaactcgcttttgaggaagaaaatgccaaacgcctttacctcgaagacattgggtacaagagaaccggcgaccgcagtgaatcagacagcgacgacagcgaaatcgaagacgatctggtctgggtctacgctctgaacgatcccgatgattcttcctcgaggcgaaacagcgctcggttgtctaatcgcgaactgacaagacaagactcggccattagaacgtttgaaaaacttgcactctttcagcccacacttagtctggagttttggaaagtttgggaagctatgaagtcttcggatcataagcatgctagccctcactga

SEQ ID NO: 14464 - DNA, 708 bp, A.fumigatus
  unsure (488): Identity of nucleotide sequences at the above locations are unknown.
cataacatcatcaatctcagagaagatatcaaactatgtcagcaaaaagggaagaccatcctgatttctatcggcggagcagcatcacctgaactcggtttcgcttcggaggcggcagccatcgaagccgccaacaagatgtggcagatcttcggacccgtggacgcggataacacggcataccgaccattcggagatgcagccatcgatggctttgacttcgattttgagaccagcgttacaaatattgtgccctttgccaatcaactacgccgcttgatggatacttctgcgggcagaagatactacctaactgttgcgccgcagtgcgtgttccccgacgtagcagatcaggagatgcttaatggggccgttgcgtttgatgcgatttgggtgcagttctacaacaattactgtggcgtgaatgcattctcttttggcacaatgcagcaggacgcttttaactttgacctctgggacgcatgggntaagagccagtccaagaacaaacaggtcaagttcttcatcggtctgccaggaaatgtggttgcagctggaactggctatgttggtgccgagcagcttagggagattgtcgcttggagcaaagcattctcgagcttcggaggtatcatgatatgggacgcaagctcgatggatgcgaatcaaggatatcttgaatcggtgaagaagacgctcatcggatga

SEQ ID NO: 14465 - DNA, 1233 bp, A.fumigatus
  unsure (1227): Identity of nucleotide sequences at the above locations are unknown.
tctactcatctgcgcttccaatcccaaggtcacttttcctgttttcaccccactgatcttcctttcttcaccttgtccgactcgttccaacacaacatcatgggaaagaaggctatccagtttggcggaggtaacatcggccgtggcttcgttgctgagttcctccatgaagctggctacgaagtcgtcttcattgatgtcgtcgacaagatcattgatgctctgaagagcactccttcatacgaggtcactgaagtcagtgaagagggcgagaaaaccaagacaattaccaactaccgtgccatcaattccaagaccaacgaggaggacgtcgtgaaggagattggtactgctgacgttgtcacttgtgccgtcggccctaacgttcttaagtttattgctcctgtcatcgccaagggtattgatgctcgtaccgcgtccaagcctgtcgccgtgattgcctgtgagaacgccattggcgctaccgataatctacgcggcttcatcgagcagaacaccgataaggaccgtctcagctctatgagtgagcgtgctcgtgtcgccaactccgctatcgaccgcatcgtccccaaccaaccccctaacgccggcctcaatgtccgcatcgagaaattttacgaatggacggtggagcagactccttttggcgagttcggccatccggatatccctgctattcactgggttgacgatttgaagccctacatcgaacgcaagctcttcaccgtcaacaccggccatgccaccactgcctactacggtcacatgcgcggcaagaagatgatcgctgacgctcttgccgacgccgagatccgccagactgtccacaaggttttggaacagaccgcaaagctcattacaaccaagcacgagatcaccgagcaggagcagaatgagtatgtcgacaccatcgtgaaacgtatgtccaatccattcctggaagacaacgttgagcgtgtgggacgtgctccccttcgcaagttgtctcgaaacgaacgcttcatcgggcctgcctcgcaactcgctgagaagggcttgccgtttgatgcactgttgggctcgatcgagatggctcttcgcttccagaatgtgcccggcgatgaagaaagcgctgaattagccaagatccttaaggagactccgccgaagagaccagtcataaccgccgggctgatagatcaagatttgcgttccaccccccacccntcggct

SEQ ID NO: 14466 - DNA, 645 bp, A.fumigatus
ttcagcgctttcttcatcgccgggcacattctggaagcgaagagccatctcgatcgagcccaacagtgcatcaaacggcaagcccttctcagcgagttgcgaggcaggcccgatgaagcgttcgtttcgagacaacttgcgaaggggagcacgtcccacacgctcaacgttgtcttccaggaatggattggacatacgtttcacgatggtgtcgacatactcattctgctcctgctcggtgatctcgtgcttggttgtaatgagctttgcggtctgttccaaaaccttgtggacagtctggcggatctcggcgtcggcaagagcgtcagcgatcatcttcttgccgcgcatgtgaccgtagtaggcagtggtggcatggccggtgttgacggtgaagagcttgcgttcgatgtagggcttcaaatcgtcaacccagtgaatagcagggatatccggatggccgaactcgccaaaaggagtctgctccaccgtccattcgtaaaatttctcgatgcggacattgaggccggcgttagggggttggttggggacgatgcggtcgatagcggagttggcgacacgagcacgctcactcatagagctgagacggtccttatcggtgttctgctcgatgaagccgcgtag

SEQ ID NO: 14467 - DNA, 366 bp, A.fumigatus
tttcagcccgggtttggttgtctgtctgccctaattgttatgatgtccctatcctttacatacttgtctcctgacagtgcctttattgtgtccccgcacttttcatatatattccgcgcgctttatttacttatcacgacatcgctgatttcgcgtcgtgtcctggtcactggcccgccctatttctcttccaatttcgtcactttatgcatgcttgaactcgtttatcttgttctcgattttattctgccatcgacccggttcattcttgtgatctatctctcctccggttttctcgtaatcgctcactccgactttgtgactttcgtctcatatcctcctcatgctatttgttgcatgctccat

SEQ ID NO: 14468 - DNA, 300 bp, A.fumigatus
gacggctggaggcggctactcggcagccgattacacctatgtccttcctcagacgaggtgagtttctacattgtgtatactccccatgtggatgatgctaataacggcgataaggtctacaattggactgagctccggccagactccaagatccggcatacctggatcgcttttgattgccttgactcgcccaacactctgctgatcggcgagttccaggagggtgacgcttcaactctcatcctcctggtcaaatatcccctggactatacacacgccggctgcgcaagaccggcttga

SEQ ID NO: 14469 - DNA, 1182 bp, A.fumigatus
cttagagaagacatatcccattttgccatgacgcaccaggcgcaagctgtaaatgcgcccgtgtcgagtgcactgccctcgggaaacatgcgccagcggtcgcgacaggcatgcgcgccctgccgccaacgcaaaagaaagtgcgatgggaaattcccgtgctcggcctgtacaggctatggatatgactgccagtttctggacgactctgtgaactctgtcaaaagaaacgcagacgcagtctcgtcgttgccattgccctcgacgaaggctgctcgtttgtcagaggtgacagcaaaaagcctgggaggcagctccgtaatttcttcttcctctcatggcatccttgatccttcaaagctcaggtatatgggtcgacacgcatcggttgcgtttcccatgacggtcggcctcgagttgcaggctgcaaaacccccgcgcctgcactcttttgcgtataaccctggagttcgcaccgagcccagctgtggcgtctcttttaacttgactgcctttatctcctgggacaaagtccgaagtttgatggatgtgtactcctccaccgtccatcccgtgtttggactgctggacatggagcggctgtaccaccgatgcgaggagcattggcacgggaaagcacaaggcctgggcctggaggcgctcatcagcggagtcattgctctcagctctctcttctccgggtttctcagcgaagaagaagagacgagagtcatgctgcatgcgaaggagatcctggaagatgcctcagttagccggaaaccctccattgacaagatcgccgggtggatcttgcgtaccatctatgtgcgagcgaccagtcggccacactcggcttggatgtgtagctgcaccctgatgcatcttgttgaagctgcgggcctccaccagccattagacgcggtcattctgacaaccggaagtagtggcagaaaggcgttggaggatatcaccgagacacgggaccgcattgcccaggttgctcagtgtttgaatataatcatagcctacgactatgggcggtccgtgatagaccttggattgacgtggaagagagactcgaagagcgatgcgccatctaacgacctgacacctcagttgttcagtctaatcggggctgtccccctcgacaacaatgctgatccggctgccaagcggggatga

SEQ ID NO: 14470 - DNA, 249 bp, A.fumigatus
atttcctggttatcccagagattcacggtcggcaaagtctgccccgccatctgcttcttatgggcagtggttgtcccctgtaccccggcttgcacaaattataccggtatgctcattaaccggttcatgcttgggcttattgaaagcggagtgtcgcccgcctttatgctatgcaccggtatgtggtatactcactccgagcaagtgtttcgttcctcactatgtagtccttcagcggggctttcttaa

SEQ ID NO: 14471 - DNA, 300 bp, A.fumigatus
aataggaaatcatcagctggctacaacctcaacgccctatttactggctctgagggtacgttaggcatgattacagaaattacactcaagctcgcaccgatcccggaaacccagagtgctgcagttgctactttttcttccgtccggaacgcagtagcatgcgccacaaagattatgcgccaggggattccagtcgctgccgtagagcttatggatgaggtacagatgcaagttatcaacaagaacggcggtgcgggggggagactctgggaggagaagcccacgctaatgttcaagtaa

SEQ ID NO: 14472 - DNA, 582 bp, A.fumigatus
gtggacaaaataacttcctggccggcttatacattccttgctgaaagacagataggttttcgggtaccgagcagtctgtatccgctgatattgcgagagtcgaaaaaatcatctctcaggaaggaggcagtgcgttcgagtttgcgcggacagagaaagagatgcgtaacctatggtctgctcggaaggaagccgtgtgggccatgtgtgcacagaggccggagggcacgcaaatatggtccaccgatgttgccgtgccattatctagcctacccgagatcattggtcagtctgtctattgtcgttgagtatacgtggaaaatgctaatggtctgtgtgctgccagaattatcgaaaacggaatcgagttcattgggattgttttccagcgtcctggggcatgttggcgacgggaatttccatcaagcggtcatgtacgatccaagtgacccgtcagaggcgcatggagtacgcgaatgcgtcaggaaaatggtccgcagagcggttgagatggaagggactgtctccgtacgttacgtcccagaagccttcattttatcattgattgacaggcttttctag

SEQ ID NO: 14473 - DNA, 186 bp, A.fumigatus
gaaattctattttggacttcagaacagcttttgacgcagatagtcccctttggtgctggatccagcgtcgagggcaacttcaccactccacattcgggaatcagtatcgatttctctcagatgaacaagatcattgctcttcacgaagacgagtgtgtctctccgcgttggttagaaggtatttag

SEQ ID NO: 14474 - DNA, 189 bp, A.fumigatus
cacgcgaggcaaagcgccatgaaaaagctgattgaacttggaagcggaacaaacgcagtcagatacggtacgatgaaggactgggttatcaatcttacggtcgtcctggcagatggctcggtcatcaaaactcgacaccgaccacggtatcgtgatccccgccacccgcgacactggtcaatcagttaa

SEQ ID NO: 14475 - DNA, 264 bp, A.fumigatus
aagacagataggttttcgggtaccgagcagtctgtatccgctgatattgcgagagtcgaaaaaatcatctctcaggaaggaggcagtgcgttcgagtttgcgcggacagagaaagagatgcgtaacctatggtctgctcggaaggaagccgtgtgggccatgtgtgcacagaggccggagggcacgcaaatatggtccaccgatgttgccgtgccattatctagcctacccgagatcattggtcagtctgtctattgtcgttga

SEQ ID NO: 14476 - DNA, 732 bp, A.fumigatus
aagaaaaggcaaaaggtctattcagcttcgtcatcagtgtcggggggcttgggagtacccttgggagattgcaacctatggagagttagcagtctgcagaaagtcaaaagtcacaagataaggaggagcataccattcaaggtgacgcaatctacggcgcgcctcgcgctccttcagttgagcacgagtcatcttcttcttcttcctggccttgaacttcagttcgccttgatcttcggcgccagagttgacagccgagggagcggcgctggtagccgccgagttggcgacggtgctgccgggctgaggagaactggcggcgctgtcctcgaagcggtcgagagcgacggcggtgttggtgcgagcgacaatgcgaccatcggcgatgtgcaactgctcggggcacagggcacccacgaactcttcgttgtgggaaatcatgacgacacctcccttgaagtcacggatggccactgccagaccaccgagagagtcacggtccaagaaattggtcggctcgtccagcaccagcaagtgcgggttgttccacatggcaccggccaggacaaccttgaccttttgaccaccggagagaccggagatctggttgtggttggcaatctcagggtccagaccgatatcctcaaagtgtttcgagatcgccttgggttcaaggactcggaaaccgaggccctcacgggaggattcgtgatcgtcaaactcctggactag

SEQ ID NO: 14477 - DNA, 1386 bp, A.fumigatus
cttgaagaagccaagctcgaccaaggtctcacgcgagatcatggtattgtgcttgggaagaaggccgacccatttgacttcgtactggaaggtcttcttccacttctgacgacccatgatggcttcgatgcggcgagggccccggccgtctccgaggtcgaccggcttctccatctgcgccttgtcctgctccgtcagaattcgggtctgcttgaggaagacttcgcggtcgtctccgttggcataacgccattgcaggtactggctgggagtcttctcgagatgcatttcaacgtgctccagagcgtgctgcttgatgtatccgatccgaaggttggggtgcttctcaacctttcctgtctggggaatcgtctcacccgtcaacatcttgatgaaagtcgatttaccagcaccgtttccaccaatgatggcgacgcgagacgagagggaaagcgagagggaggcgtcaaccagcgacggcttgctcgcaccagggtaggtataagagcagttggtcattcgaaggatggagcgggtgttggacttgatgccggacaggatcccggggggagggaacttgaattgcaccatgctggaggacagggtgtagtagctcttggcttcgggcttctgcttgacaaaagcggccaggttgcccttgtagtggaccagcttctttccttcgtagtggtagatgtcggtgcagacctcgtccaagaatccagagtcgtgactgacaataagactggtgatgtcagtgtgcttcttcaggtactcctgcagccacttgacgttggcgacatcgagatggttagtcggttcgtccagaagcagcacatcagccttcatgagcatagcacgggccaaagccagcttcatcttccaaccaccagagagggacccaacacgctggttctgtcttccctcggggccatcggtaaatccgaattcgaggagaatacggctaatgtgttcttgtccggcttcggcaatcttggggtccttggacacatattcgatgatgctcagatcggcgtcttcgccctgattgtgctcgacgaagcacgtgcggaccacatcctgcggagggaacccctcgagcttctcattggcaatactgcgcatgagggtagacttgccggcaccgttccgaccacagaggccgtagcggtggcccttgagaagacgaaggttcgtgtgagaaaggagaagcattcctccgtaagcgagggagaagttggcgttgacaatctccacctcgttggggtcgtcaggaacgggcttgccaaacttgccggtgatctccctcgaataaaatgctcctggacggcccgagtcgacagcctccgtgcttgtcatccttgggaagagtccccgaaagataag

SEQ ID NO: 14478 - DNA, 531 bp, A.fumigatus
tcaggcccggcggatattgttaaattcccctccttgtgtctacaggacggtcctcaaggattacgatttgcggaccatgtgtctgcctttccggcgggtattacaacggggtctacgtggaatcgagagctcatgcgcgagcgtggcgtcgctatggggcgagaggctcggttaaagggtgtgaatgtcctgctaggcccctcgatgggacccctgggaatgatgcctgcgggagggcgcaactgggaaggattcggttctgaccctgtgctccaagctgtggctgcggcagaaaccatccggggtattcagagcaatggagtcatggcgacggcgaagcattttgtgatgaatgagcaggaacatttccggcagccctttgagtgggggattccgaccgctttatcgtccaacgtgggcgaccgtgccctgcacgaagtctttgcatggccgtttgccgagagtattcgagccgacctggctaaccgtgatgtgctcgtatcaaatggtgaacaacagccaaccctgtga

SEQ ID NO: 14479 - DNA, 2043 bp, A.fumigatus
cttatctttcggggactcttcccaaggatgacaagcacggaggctgtcgactcgggccgtccaggagcattttattcgagggagatcaccggcaagtttggcaagcccgttcctgacgaccccaacgaggtggagattgtcaacgccaacttctccctcgcttacggaggaatgcttctcctttctcacacgaaccttcgtcttctcaagggccaccgctacggcctctgtggtcggaacggtgccggcaagtctaccctcatgcgcagtattgccaatgagaagctcgaggggttccctccgcaggatgtggtccgcacgtgcttcgtcgagcacaatcagggcgaagacgccgatctgagcatcatcgaatatgtgtccaaggaccccaagattgccgaagccggacaagaacacattagccgtattctcctcgaattcggatttaccgatggccccgagggaagacagaaccagcgtgttgggtccctctctggtggttggaagatgaagctggctttggcccgtgctatgctcatgaaggctgatgtgctgcttctggacgaaccgactaaccatctcgatgtcgccaacgtcaagtggctgcaggagtacctgaagaagcacactgacatcaccagtcttattgtcagtcacgactctggattcttggacgaggtctgcaccgacatctaccactacgaaggaaagaagctggtccactacaagggcaacctggccgcttttgtcaagcagaagcccgaagccaagagctactacaccctgtcctccagcatggtgcaattcaagttccctccccccgggatcctgtccggcatcaagtccaacacccgctccatccttcgaatgaccaactgctcttatacctaccctggtgcgagcaagccgtcgctggttgacgcctccctctcgctttccctctcgtctcgcgtcgccatcattggtggaaacggtgctggtaaatcgactttcatcaagatgttgacgggtgagacgattccccagacaggaaaggttgagaagcaccccaaccttcggatcggatacatcaagcagcacgctctggagcacgttgaaatgcatctcgagaagactcccagccagtacctgcaatggcgttatgccaacggagacgaccgcgaagtcttcctcaagcagacccgaattctgacggagcaggacaaggcgcagatggagaagccggtcgacctcggagacggccggggccctcgccgcatcgaagccatcatgggtcgtcagaagtggaagaagaccttccagtacgaagtcaaatgggtcggccttcttcccaagcacaataccatgatctcgcgtgagaccttggtcgagcttggcttcttcaagctagtccaggagtttgacgatcacgaatcctcccgtgagggcctcggtttccgagtccttgaacccaaggcgatctcgaaacactttgaggatatcggtctggaccctgagattgccaaccacaaccagatctccggtctctccggtggtcaaaaggtcaaggttgtcctggccggtgccatgtggaacaacccgcacttgctggtgctggacgagccgaccaatttcttggaccgtgactctctcggtggtctggcagtggccatccgtgacttcaagggaggtgtcgtcatgatttcccacaacgaagagttcgtgggtgccctgtgccccgagcagttgcacatcgccgatggtcgcattgtcgctcgcaccaacaccgccgtcgctctcgaccgcttcgaggacagcgccgccagttctcctcagcccggcagcaccgtcgccaactcggcggctaccagcgccgctccctcggctgtcaactctggcgccgaagatcaaggcgaactgaagttcaaggccaggaagaagaagaagatgactcgtgctcaactgaaggagcgcgaggcgcgccgtagattgcgtcaccttgaatggtatgctcctccttatcttgtgacttttgactttctgcagactgctaactctccatag

SEQ ID NO: 14480 - DNA, 387 bp, A.fumigatus
ccgatggtgccatctgattcgtggtttccgtcgccaaagggagggacgctcaagcactgggaggagagttataagaaggcgcagagcttggtccgcaatatgacgctcgtcgaaaaggtcaatatcacaactggaattggctggcagatgggactgtgtgttggaaacactggtacgttggttgactgtgactacggattcatactgattgatcaggcccggcggatattgttaaattcccctccttgtgtctacaggacggtcctcaaggattacgatttgcggaccatgtgtctgcctttccggcgggtattacaacggggtctacgtggaatcgagagctcatgcgcgagcgtggcgtcgctatggggcgagaggctcggttaa

SEQ ID NO: 14481 - DNA, 345 bp, A.fumigatus
atgagcaggaacatttccggcagccctttgagtgggggattccgaccgctttatcgtccaacgtgggcgaccgtgccctgcacgaagtctttgcatggccgtttgccgagagtattcgagccgacctggctaaccgtgatgtgctcgtatcaaatggtgaacaacagccaaccctgtgaaaataacaaactcttgaatgggatcctccaggatgaactgggggtttcaaggattcgtgcactcccgactgggctgggcccaccggtttgggcatcaacagcgcccctggggggcctcctacttgaaccttgcccgggagtacggtctgcctttgggttggaacgg

SEQ ID NO: 14482 - DNA, 192 bp, A.fumigatus
aacctccacagctttgtttccacgaccattgtgtcggtgccatgcactttctgtgacagtaatagtgacagcaacagggaggaatatatggggtatatatgggtactaaacaaatcatatatgggtttgcctagcttggcattcacatactattctgtcgtgtgtagattagactgcatagactctcactga

SEQ ID NO: 14483 - DNA, 225 bp, A.fumigatus
tatgtgagaatcgtcccattcatcgtctcgaaaatgactcaagtagatactggaactgcatttggcaaggacaccatcggcggatcccaattcgacactctaattggccaaccattcctggagaatgtcactcttcaatctctcaagagaatgatcgatgtttcaaagtccctgccaactttcttctcattcgtcgtgacaggatggggaatcgtgtatccatag

SEQ ID NO: 14484 - DNA, 183 bp, A.fumigatus
cttccctccaggtctggagaaggaaatgccctcataacgaatgccgtgcattatgcttccaagcatggcatcattctgtcacttttcatagggtggcggggtccgcgtccagcgaaactgccgctcagactcagtgacttcattatctataccttgggatcttcagcacgaggcggccagaac

SEQ ID NO: 14485 - DNA, 1590 bp, A.fumigatus
ccaagtgaagatatcactcttatcacaccccccgccagtcaagctccattagaagctgctctctcgcaaaatcctcacctcacatctcttccagcaccttcaccttccgttctcgctccctcaggcctcaccctgacgacgggtaccgcggagctgctgcgtctccccgaagtccaatcatgcatcaagtccgatttcctccttctcccctgtgacctcatttgtgaattgccaggagaatccctcattgaggcatggatggtcacccaaagcgccctgggtggctctactatcagcggcggctggaactccaatggacccaagagcattggaatgggtggtgaacaaggcggccgcaggggtggtcttggagtttactatcagactaggggacgggaagagagtgtcaagggtgaggtgacggattttgtggctaccgcaccgttagagcaggaggaggcgcccgcagtctctcataattcggacggcccagtctcgatccggtatgggctgtcaaagctagtgctctcgatacctatggatacactaaaagaacagatggaagagcaaaaagcgcttctcatccgtcactcgttagtgaagaagcacgctcgggtgaagatgttgacgacctaccgcgacgcccacatctacgtatttccttactgggtcaaggagatggctgtgctgaacgaaaagtttgagagtgtcggagaggatcttgtcggttggtgggccaaggctgagtggcagaagggtctagcggagaagctgcgactgcgcgaaatcttcgagccggagggacataaagccacagagagtggcagtctggatggcgagcatatcgaagaggaaatcgatctcaaagcgatgagcaccaccaaagcgggagccggcacatcacgcgacgctttgtcagacgatccctcagaggccgtgcaattcgcgtctcgggtgaagagatccggtactgatttaagcaccgcgccgccggagccatccaaaggcaagctcacggtgcccccgttactggcatatgttcactcctcgctgccgtctgcaccactggtcagacgtgtggatacatcggctctgcttctgtccgtgtccctccgtcttgccaaactcgagtcgatagaggaggttggccgcacagcggcgtcccctttcgctcatagccaaaaggtcgcctacccggccggcgtcgctcagcggtgcacggtcaccaaggccgactgtcttctcgccgataatgtcacggtggaggaaaagtgtgtcatcaaggaatccgtcattggcgctaactgtcacatcgccagcggtgcccgcttgacacgctgtctaatcatggatggcgccgtgattggcgaacgctgtcaactgactggttgcattgtgggccgacggagtcagatcggccgcgagagtgtgctcaaggactgcgagatccaggatggaaacatcgtccccgaggagacagacgcgaagaacgaaaagttcatggtctttgagggtctggatgacgaggacggcgaaggaatggaagtttccgaagaattcgacgacagcaacgacgagctaggtttttga

SEQ ID NO: 14486 - DNA, 204 bp, A.fumigatus
agccagcatttcgtaatgccacactcaattcctgtgcctccgacgggcttccaggccctcattttgtgcggacctggcgtctctctcaacacattcacctccaatcctgaagaatttcccaaagcattgttacccatcgcgaatcgtcctatggtgtggtatcctctggattggtgctatcggatgggcataacaagtgagtaa

SEQ ID NO: 14487 - DNA, 708 bp, A.fumigatus
accccctaccgccggagggaccgaacaggaggaaagatcctggacaggaacccacggaaaggaaaatcaccctcgccacagaagcttccaacaaagaagtcgggaggagtgggtatcataggcggtaaaaagcagatcaagcagaagtttcaaacacatccaccgccgtgtccgccacgagatttcgcatcccatgagcacaaggcaacggactcgggtacagaccgagacactcaacccttgcagtatcatcatcgaccaccagccgctctcaaacccagcgcaagtgtaacaactgcatcgaaaccacgcggcctaggcgtcatcggaggcaagaagaaagaacaatcaccacagcagattcctcagccttccctctcgccggaagcgcaagaagttctcacttcagagccaaagcaaaaacacgggggcaagctgggtatgatcggagataaagcccgcaagaccactgaggttttcccagctgcctctcccaagaatcgggccgagacgacgacatcgccgcctccagcaaagtccgagagcggcgaggtttcccggcgaggtgctgtaaagcgatcttcttcgccagtgaaaccaccgccacaggagacggagcaggagcgcgctgatcgcaaacgagaggaactgaaaaggcagcttgaagcgaagagcagggctccggcgaagaagaaaaggagattctaa

SEQ ID NO: 14488 - DNA, 2250 bp, A.fumigatus
gcacagacttgggggatagtcaaatttgctgttattcaggagcttgaatccggggccagggcgcaagaacaggccccggaaagaggctcacgcaatgtcaagaaaaagctctccaaagaggggcagcatgccgagcgacctcccgcctgggaagatgggaggactgacagattgagaaaccgcttgttcagaggggtaatggaaacagatgcatcaaagcattccacaactgaaattgaaagcacgtcaaacatcaccacacctctcgcgcgacccttaccggactcacccgtcgagtcactgcatagtccgcactcgcaaatgacctctgtgaacgatgacgcggcggatattgagcccttaccgccctctgttctgagctctaaccaaggcaccatgaacacgatgaactcgaacggttggtcgtcaatgtcagatgtcgagccccattccataccccaatttgaaaaacgccattcagatgcaggcgagagttctctcagttcgttcgaaaacccgccacgggaccttgctggaacatcggcaattcaaagtccggaaagtgaccaaagatcagcaccgcgggccattaatcgtcaggcggactggcgtcttcgaaaccaccccgattatgtcaaaggagcgtcagaagacgagtttgaccagaaaatggaggacaaaagggcagcgattcgtgattacaagctctttcctaagaaggtcttatcgcttgagtcccatatcgagcccccaagaccaccgcctttccaccgacatgaatcctcggagagctttccaatgttctcagaatctacaggaagctcacacccttccaaatcactggctacatctttttcctctgcggcacgactgtacgatagctcgaagattgctgaagcggacgaatccgtcattgaggactatcctcgcgagcatgagaatctagagcttgctcacaccccggtattgaacgaacaggcggttcaggatgacggattgtttcaagaaagtgtcattgatgctagccgtgttcatctggaacgtccttcgagccctccgcaacttctaacggagtctagtcccctgcagattcctaaggacagttcaacatcggccaagaatgcaccggatttacgatctgtaccagagtcgaccgaggacctttccgacatcgttattcctctcagcccaaacctgagtgggaacaagccttggagtccagaaatgctgctgaaagaagcgatcaggtataatcacagcagcacgcatgttgatatacagtctgctgcccatcttcttcagaaactctgcatactcttcggagaatgcgagaaacttctcccaagggaggagtgtgagctcatcttcaaaacttaccatgagcacctcgttcgccagtcgatgtacctggaggctgccgagcttcgacttttgtgtgtaccatcatacccagcggtgtatgagtatgcccagacaaatactttcataaatgtgttctgcttcacatgcaagcgaccatacgagaatccgaaacaggataaccgcagctgttaccaatgcaacaccccgcaagaaccttgtgccatttgcatgagcgttgacccaccggccgactggattacagagcagatctcatcatttgccgataccgaggagcactctgaggctacctcacatttgctatcctcatcgcgatcctcactcaagacagagcagatccctctctccgagttgcagcgtttggatggtgcattgctgggtgattacactgctcctcgaccaatgggctccactctctggacctggtgtcaaggttgcggccatggaggccacatggcttgtattaccacgtggctgagcgacccttccctcagtgaagggggttgcgctacccctggctgtatgcacgactgtggaccaggaccacgccgtgagttcaatcgggccgttttgcaggatgtatccagaaagcgagacgctgccagcagaaaagccggattggggttcgtcaaacgcgacccatgggcaaaaggcgagagcaaagcggtcgaaaaggtccgtggtatgctcggtgttgccacatcaggcggaagcactgttgcacctgtgtccgccaatataggggccgcgtcatcttctggcacgatgtcacctaagaaagtacgattggtgacaccgattgagcaaggcaagcgacggagtggtccgtcgcgggcgagcaccgggggcagtagcggaatcaacatttaa

SEQ ID NO: 14489 - DNA, 843 bp, A.fumigatus
  unsure (802): Identity of nucleotide sequences at the above locations are unknown.
tctcttgtcttacaattgcccagcaattgtttctacagcacaatggctaccccaatcctcatctcctacaaccccacctctgcctcctccggtctctccctctcccagatcgcctatttcggccgcgtcctcatcaaggtctcctctctcagtcaagctgaggagtttctgcgtcagaatttccgtctcctcgatgtctacgtcgacgctaccgacatcacttcctctggtgacattgtcgatatcctaaatgccggtgccgccaaagcattcatttccctcgatcaattgacctcgctgtcccaagagcaatccgttccgtcgtcgcgactcgtcgtttatacctcctccgacagtcaggttgatgcctttcagtcgtgggttggcgaggatgctgaaagaaaggaagccggaatatgcaccgagtctgccgacgtcaagaccgtggccgacagattgggcttgaatcttgaggctcagaacctttaccgcacctacaccaccagcacagttaccgaggacgctgtgaaggaaacattgaagcagggtgccgtcagcattgtctcggccgacgccctcaccctcgatcacaaaaatcccagcggcaagatcgccgccgccgcactggttgccgctcgtgctgttgcggaccagagcaacggcctgtacgcgacttcggtgactgatgagcggggagtatgtctgggccttgtctggagcagcgacgaaagtatcgccgaggctctccgcactggcaccggtgtctaccagagccgcaaacgggtcttcaccgggggctgcnagggcgatcagtttctaatccaaatctgggctgggatatcc

SEQ ID NO: 14490 - DNA, 279 bp, A.fumigatus
ggaggaccacgacttctccgtgcctatctttctctcgtctcggggttctgtattctttcgttggtcggtatcatgcatttaccctctttgtccgtggctctggccctggtgagctcgtctctggcgttgcctcaagcggttctgcccgagaacgatgtctcgtcacgcgcggcggccgtcaaagaggccttttcccatgcctgggatgggtatatgaaatacgcttttcctcatgatgagctgctccctgtttccaacagctatggcgattcaaggtag

SEQ ID NO: 14491 - DNA, 573 bp, A.fumigatus
  unsure (383): Identity of nucleotide sequences at the above locations are unknown.
cctggggatctatgtagaaacggatggggtgcatctgcggtcgatgccctgtccaccgcaattgtgatgcgcaacgcgacgatcgtcagtcagattctggatcatattgccaaaatcgactactccaagacttcggacatggtgagtctgtttgagaccaccattcggtacctgggcggcatgctgtctggatacgacctgctcaaagggcccgcggccgacctcgtcgaggaccgcactaaggtggacatgctccttcagcagtccaaaaaccttggagacgtgctcaagttcgcctttgatacgccgtcgggtgttccgtacaataatatcaacatcacgtcggatggcaatgacggcgccacgaccaacgtgctggcggntacggtgacattggtcctggaatgtacccgtctgtccgatctgacgggagaccaagagtatgccaaactcagccaacgggccgagtcctatctacttgcgcctcaggctagctccggcgagccgttcccttgcctcgttcgcagcgcgaacaacttccagacaggtcagttcacccacgggtttcgttag

SEQ ID NO: 14492 - DNA, 540 bp, A.fumigatus
tacagtctcagagcagagttaaagccataccagcttgtaggtctgtctttcttggtatatctgtgccgcaatggcgtcggtggtattcttgccgacgaaatgggtctaggcaagacgcttcagactttgagcctcttccaatttttgaaagaaagagatggtggatattcaaacagaaattcgccctttcttgtcgtgtgtccgctaagcatccaggaaaaatggttgagggaaatcgaaaagtgggcacccagccttcgagcagtgaaataccatggcaccttcgagcaacgggacaacgtgaagaagatggtgtctgcccagaaaaagcccagcattctcagagttccgacagacattgtggacattgtgatcacaacatacgagaccttgatctcggagatcaactggttctcaagggtcttcgtttggagaggcgttgtccttgacgagggccacaggattaagaacagtcgttcgaagagatcgttggtccttaatcgcatcaaagcagagatgaagctcgtgctctccgggtaa

SEQ ID NO: 14493 - DNA, 1137 bp, A.fumigatus
gaaaagtcagtcctcatgtttccgtcccatttgcgcattactgacattaggcagtgctgcattcatccttatctttttgccgacgcgattcccagtccgtatgaattgggagagcaccttatacatcaatctggcaaattcttagttctgaagaagcttcttcaatattacgtgacgaccgagacgaaagtcattgttttctcaaactttgatcaatgtctcaacctatgcgaggacctagtcatgatgctccaaggcagcaaccgagccttcgaatacgcccggctcgacgggagaaccactgggccatggcgcaaggtcatggtgcaccttttccagaatgacccgagatacaaggttttcctggtttcgattagagcgggcggggaagggcttaatttgaccagctcctctgtggttgtattcttggatgaggattggaaccctcaagtgatgcgacaggccgaggcacgagtgcatcgaattggacagacccggccggtcgttatttataagctccgttccgcaggcacagtcgaagagcagatgagccgtcggctcgtcaaaaaagcctacgtcgcagacagagtgaccgagaacatacccgctcattgccccgggaatgattaccttgagatgctcaaggctgaagaggcgagcatgtctcagaactcgacggatacatttggcttgccgtcgcctgttttcatggatcagacgttcttgtcccagcaacaaattgatacaaacgaattgtcccagtgggacatgagcaccattctggccaagtgttcaagtacccaaaaggacggagggctctccccttgtctgaccgttgagcaagaacaactctggctcgagaaggccgacagagtcaggacaaattttttcaacggggtgacgattgatacaagcggacgccatcatacagtatatgctgaagaagagagcagcaatcttctccgctctaatcgtcgcattggtaaggaaaggacggtcatgatcgatggctatgcagtgagcaaggaaagcctgagggcctctggtgaagaaccgacgtccactaatgagtgtgcctcacccacaaacaaatttacccgtcttcaccacggggctggaaggagccgctcagttggg

SEQ ID NO: 14494 - DNA, 501 bp, A.fumigatus
gcacttgttgccatacgcacttgtttccccataaaccgttcagcctgtgtttgtatttcgtcaagaatgacaaacagtccagccatgacgcgaatcccacgacacctaggcgagcaagccgaaagccgcaagcgccgcaccggcaagcgcaatgagaccaatgtccttgtgctgggtgacggcggccccggtagtggtgttggtggtcgaagcagcagacgaggtcgtggagccagtggtagaagtgggagaagtgggagacgtgggaggagtagtagaagtggttgcagtggcagcggtctgggaggcattagactcggtggaagaaccagaagtggctgtagaggatttagaggccgtgccagtggcagattgagttgtgttggcgcagctgggagactgaggcatgttggtcacaccggcggttttacatatccggttcgcaaactcgacggcggctgtgggaaagaatgggtgagcatcttctgtagggtatcgtag

SEQ ID NO: 14495 - DNA, 570 bp, A.fumigatus
caattacgccaggaacggggcaagcggatggccttatcgaatgttgccgtgttcggcgctgccttcctcacaccggttttggctggcaagatcacacactcgcttagttggcaatggacgttttacctagtggcgatctttactgccgcttgcctgcccctgacattcttcctgataccagaaacggctttcagacgcgccgaccatttcaacacagactttgagcatgtcggcgaccgccttgatggaagccactcacatacacaactgcagcccgctggatatgcgacttctgaattgagccagatatctggagagcaaaagcaatccgtacttgggaccaacgagaagccgcaaggggagccctctcgacgagaagatggtgtcagtcaggaacctacactccctcgcaaggccacgtactgggaaactctcaagctattcaatggacggaaaacagacgaggactttttcacactgcttttgagaccctttcccctattcttccatcctggtatcctctgggtaaatcctccctcccacagtttcatatatgaggcctatgtctga

SEQ ID NO: 14496 - DNA, 288 bp, A.fumigatus
  unsure (154),(272): Identity of nucleotide sequences at the above locations are unknown.
ctgccacaggcttgcttgatacaaggcgttctcattggttggactgtctttatcggtgttgtcctggctgccatcttcctgggacctcctctatggttcaacgaggtgcagacaggatacctctatacaggtgccttcattggctctatcttangcctgatactgtctggcatcctgtcagattcgttgaacaaggtcatgataaaacttcaacaaaggcaatacaaccccgagttccgtattctgctagttatcttccaactgatcttcancggcactggcctctaa

SEQ ID NO: 14497 - DNA, 312 bp, A.fumigatus
cataccttccgaccctcactccctatcagtatgggtctaggtgtgctcgaggacaaggtactcgaccatgtccctggtaagttccattgtctggtctacatctttacaggaagacttgtacaatcgaaatcaccatttctgaacatttggctaggcacttcctatatcctcgaagatgaaagggatgataataccgctctcgattcgcgcctcaagtacgatcgctccggcgacgttcctattcttctagtaccacagccaagcgatgacccgaacgatcctctggtaggtagaagaagctatggttggtaa

SEQ ID NO: 14498 - DNA, 558 bp, A.fumigatus
aattggccggtatggtggcgtgatctgatcctattcgcgctttgcttcgtttcagtcctatgtgcaacaaccagctcgctcatggccgccaacactgtgaccattgctcttcactatgggaagagtttcacgtccgttgctctcctcactggctaccacctctgtggtgtgggtgtcgctggtgtgctaattgttccgactgcacgagtgtggggcaagcgacatcttttcatcctgggaaatattctgatggtcgtgagctgcgcatgggctgggggcagcggccagaattatcagagccttctctgggcccggatcatccaaggagtcgcattggctccattcgaagctttgacgaatgcttgtgttggtgatctattctttgtccatgtaggttccatctgcgctacctcacggatctcgtctgacaattacgccaggaacggggcaagcggatggccttatcgaatgttgccgtgttcggcgctgccttcctcacaccggttttggctggcaagatcacacactcgcttagttggcaatggacgttttacctag

SEQ ID NO: 14499 - DNA, 540 bp, A.fumigatus
agtgcatctgcaccgattcgtccttcatttctggtatttcctgctgcgttctccaatcatgcggtccggaccagcagcagggtaagttctcgttcttgctgttctcgaaactctgcacgcctacacatggcccttgattctcctctacgataccctacagaagatgctcacccattctttcccacagccgccgtcgagtttgcgaaccggatatgtaaaaccgccggtgtgaccaacatgcctcagtctcccagctgcgccaacacaactcaatctgccactggcacggcctctaaatcctctacagccacttctggttcttccaccgagtctaatgcctcccagaccgctgccactgcaaccacttctactactcctcccacgtctcccacttctcccacttctaccactggctccacgacctcgtctgctgcttcgaccaccaacaccactaccggggccgccgtcacccagcacaaggacattggtctcattgcgcttgccggtgcggcgcttgcggctttcggcttgctcgcctag

SEQ ID NO: 14500 - DNA, 474 bp, A.fumigatus
ccaacatgcctcagtctcccagctgcgccaacacaactcaatctgccactggcacggcctctaaatcctctacagccacttctggttcttccaccgagtctaatgcctcccagaccgctgccactgcaaccacttctactactcctcccacgtctcccacttctcccacttctaccactggctccacgacctcgtctgctgcttcgaccaccaacaccactaccggggccgccgtcacccagcacaaggacattggtctcattgcgcttgccggtgcggcgcttgcggctttcggcttgctcgcctaggtgtcgtgggattcgcgtcatggctggactgtttgtcattcttgacgaaatacaaacacaggctgaacggtttatggggaaacaagtgcgtatggcaacaagtgctcatattgtgacccaatgtccgcgtcttcaccacggggctggaaggatccacgctggtcca

SEQ ID NO: 14501 - DNA, 939 bp, A.fumigatus
cgaatgacaaaacccgcttttctagagctccccgctggagctcaactcacatacctcgctgagggtggggccaatatcatttatcgcattgcatcagctccctcaccctgccataccggccccacggacacttatagctcttctgggccccatttcattgttcctccagagttcaagggaaaattacttcgtcttcgaaaggaaacaaagacaggaatctcataccaggagattgcgcgtaatttcgatagaaccatccgcccattgttcagtcctgacgaactggtggaccaggagcttgtgtaccttccgagtggacttgtgcaacgctgcaatgagcaactaagcgcggcggagcgcaatggcgaacgccccaagaagcgtcaaggcgtgtatctttcggtcacagagccatttgggcttctggttaccgatatgacgacttttgctaccccgaataccgtgcttgcggaattaaagcccaaatggctcctgcagtcaccatcagcgccagtcaatgcacggagatgtcgcacgtgcgcattgcgggacatgaagaattaccagagtcggagagcaggtgggtctgaagagatctcgttttgtccgttgaacctggtatcggacaagtttgagaatgtcctgcgcgcagccaagtacgtcaagggctgtgaggaccaaaccaggctggcaaggattctctatcgcaaccctacattgcagaaactcttgacgcatcagaaggctatgcgtgacgtgggactacatgggccttcggcgcagtctcgagagcagtctcttgcgatgactttgcgagactgcacgatgtttataaaggtagcccattcgactccctctatgtgtacgagacgattggcttacagtattagattccgcgtgacgagatggggccagtggaagtccgccttggagacttag

SEQ ID NO: 14502 - DNA, 219 bp, A.fumigatus
  unsure (212): Identity of nucleotide sequences at the above locations are unknown.
taccgattctttgacatagagggtccctgggacaaggtgcaccaggtcattggtcaggcacatatgctattgcaccaacagggtatcgttcgaatccagaccgatatccgggttgggtcgaggtttgttccctgcttttcctaccctgttgacttgtggtggtgccagctgactcgattttctgttccaggactgaacaggaacaatcattntgaggga

SEQ ID NO: 14503 - DNA, 1011 bp, A.fumigatus
aacctggacagtatggacgaccaccaacatggccacgtgccgtatgtactgttactgcttcactacctggaaaagtggaaacaagcccatgacggcaaggtgcgttcaaattacaaggagaaatcagagttcagggagtttgttcgggctagtgccaggacgaataatgccgaaggaggcgaagagaactatgacgaggcagttgctgcggtactgaaatcattgaatccattcagtttgcgcggctcaatccgtgagattttcgagatggaccagtgcaagaacctcaaacagaactcagctgaattctggctcattgcggcagctgttcatgaattttaccaaacgcacaaggtgctccctctgcctggctcgctacctgacatgaaagctcaatcggccgactatgtctctcttcaaaatatctacaaatcgaaagcaagaaaggacgtggaagaggtaacagcaacagtcagaaggctcgaagctcagttgggaccacgggcggccgtcattcccgacaaagatattgagatattttgcaagaacgctgctcacatcaaagttattcatggccgtgatatccctcgcatcaacggcgacgcgcagactctgaaagcgatcacagataacctcagctcttccgaagcacttgttccgatcttcattgcctgtcaaattctggatgacatcgtgaccgacattcaggaatccaatatcgctgatgtatctcttgatgacgagtccctgtggaatacccacattcaacaagtcatcagtaatcttgcctccgatcctactgctattgacgaacgagcacgggagaagatcttggaagctacgcaagagttgagactcacagaaggtggggagctacataacatatccgctctcacaggtgggctagtggcgcacgaagcactgaaggtgatcacaaggcagtatgtgccactggacaacacatgcatatttgatggcgcccggagtcgcaacgagatgtacaggttgtga

SEQ ID NO: 14504 - DNA, 279 bp, A.fumigatus
gtgcactgtgctcaaaccaactccctcgtatctaacaaagtctctagctggcctttcatgatgcactggacctggacagcccaggttttcctgactttgcatacgcttgtcttcctgatgaagatgcactcatacgcgttctacaatggacatctgagcgaaacgcagcgtcgactggcttcactagacaaacctggcttggtctcagtcgatacagcggtgcgatacccagacccggcaccgagcggacacccgacacaccagcacagcaatcatgcg

SEQ ID NO: 14505 - DNA, 240 bp, A.fumigatus
ctagaagcgcagctatcaaagaagaaagtcgtcgacttccattcatcgattttattcccgggtagtgcgtcgacaggtttcttcgccgccctctcttcttctagttttcctgtctcttctctaatcgtcgcaaccccctccatcctcctctcttcctccccgttcgggggtccttgcgaccgccatgacatcccgtacgtgtttgccctccatgatcccccccacccacaccccttttga

SEQ ID NO: 14506 - DNA, 309 bp, A.fumigatus
ttcgggagtccggtcagcaaacaccagacaccagcacctttaaatttcagtcggacaaccagctcatacatgatactttgcaggagaaacaatgtcgccaaactactctatcttttcactcttggggaacgaacacactttggtcagattgaatgcctgaagctgttggcgtcccaccgattcgccgacaagcggctggggtacctgggtaccatgctgctcctggatgagaatcaggaagtgttgacgttggtgaccaactcattgaagaagtgggtcttccgtctcaacctctgcttgctgctctag

SEQ ID NO: 14507 - DNA, 1446 bp, A.fumigatus
gaagtgtcctggctgacaggatccagtgatctcaaccattccaaccagtatatcgtcggtctggcgctatgtgccctgggtaacattgcttccgtcgaaatgtctcgagatctgttcaccgaagtcgagtccctcctctccacagccaatccctacattcggcggaaggcagcattatgtgccatgcgtatctgccgtaaggtgccagacttgcaagaacatttcctggagaaagccaaggccttgctgtcggatcgaaaccacggtgtgctgttgtgcgggttgaccttggtaatagacatgtgcgaggcagaggaggccgaggaagggcaagagggcgtgattgagatgttccggcccttggcccctggtcttgtgcgggccttgaaaggactgacgacttccggttacgctcccgagcatgatgtctccggcatcacggacccgttccttcaggtcaagatacttcgcttattgaaagtactcggaagaggagatgcagcaaccagcgagttgatcaacgacattttggcccaggtggctaccaacaccgattctaccaagaacgtgggaaatgctatcctttacgaggccgtcctcactattcttgatattgaggcggattctggtttgcgggttttgggtgtcaatattctgggaaaattcctctccaacaaagataacaacattcgttacgttgcactcaataccctgaataaggtggtagcgatcgagccgaatgctgttcagagacaccgcaataccatcctggaatgtctccgggacccggatatcagcatcaggcgacgagccctcgacctgagcttcatgctgatcaatgagtcgaacgtgcgtgtcctcgtccgggaattgctcgccttcttagaggttgccgacaacgagttcaaaccagccatgacaacccagattggtatcgctgctgaccgctacgcccccaacaagcgctggcatgtcgacaccattcttcgcgtcctcaagctggccggtgcgtacgtcaaggaacaaatcctgtcgtcgtttgtgcgcttgatcgccactactccggaactgcagacgtactgcgtgcaaaagctctacacatccctgaaagaggatatctctcaagaggggttgacgcttgcggcaacctgggtcattggtgaatatggtgacagcttgctccgtggtggtcaatatgaggaggaggaactcgtcaaggaggtcaaggaaagcgacattgttgacctcttcaacaatattctcaacagcacatacgcgacgcagaccgtcgtcgagtatattacgacggcatcgatgaagctcacggtacgcatgacagatcctgcgcagatagagcgtctccggcgcttcctcaacagccggaccgccgatctgagcgtggagattcaacagcgcgcggtcgaatataccaacctcttcggttag

SEQ ID NO: 14508 - DNA, 324 bp, A.fumigatus
tcgtcgcaaccccctccatcctcctctcttcctccccgttcgggggtccttgcgaccgccatgacatcccgtacgtgtttgccctccatgatcccccccacccacaccccttttgagctggcaacggaatcactaatcaatccctaccgcacatgcgggctcggaacagttaaacaattcattcggaatgtccgatcggccaagacgattgccgatgaacgagcagtgatccaaaaagaaagtgccgctattcgtgcgtcgttcagagaagagagccatgattcgggagtccggtcagcaaacaccagacaccagcacctttaa

SEQ ID NO: 14509 - DNA, 198 bp, A.fumigatus
ttaacacagagatataggcctctatctagcttctttataaagagtactagtactgctgctaggctagataattccctaatccaccccttcttaagtattttattaaggtatttacatagagcctctagctctagctataatatagtaaataaggggctatatagcagtgacttcctattaagtagctatatcttatag

SEQ ID NO: 14510 - DNA, 273 bp, A.fumigatus
gacggccaggatcagcccaccttcggacacttcccggtccatatggtcgagcatatcagcgagcatcgctacccggccgaggaagtcgacacgtcgtcttctcccatggtctttccctgggacaggatgaaggatcggaaggaagagacggagggtaatagggccactcagcgctatcttaaagacgaaggtcgagaaggtaagcccgcttccggcgctatgcgctccttcctgcacattgggctaacggagggggggggaaacggtcagtga

SEQ ID NO: 14511 - DNA, 615 bp, A.fumigatus
  unsure (559): Identity of nucleotide sequences at the above locations are unknown.
caggaacctggtgctcttgcaggcccatcctcgaatatcgcctttttgcggcacctgtcccgcgcagtgtctcaccgcaaaattagccaaaaggaaatcaatacgcccctgatcgaccaaactgcctatgatggcggcgtcgtcagcgccactcggccgccatcaccgttgtcgggctgcacacccacatccgggcagcccgggctcgtgacaaatcttgccttgccatcgtccgaggagactttacagctgattcgccggtatttttatgagacgggattgctgttcccgtacatccaccccccgacctttcttgagacatatgacgaattcaagaacaatgccaagaaagtccgccgaacctggttaggcctactgagcatcatgctggccatggcgaaggtgaccgccgtgtccggccatgccccggcggaatcacggatcaaagagtccaccgtctactatcgacaggcattgaacctgtgccggggcgagatgctccgagggacgactctggaagtcggtgggttgatactctcctctgccgaccttagcgtantatcaactgacctctcctgcagtgcagtatctcctactcatgggccaatatctcca

SEQ ID NO: 14512 - DNA, 372 bp, A.fumigatus
gcccgcttccggcgctatgcgctccttcctgcacattgggctaacggagggggggggaaacggtcagtgagtcgtgttctgggaggcagtgcagagaggctgaatgcgggcacgtcgtccccgcgccggcaagacaccctgtccgctgtttaccatgtcatcaccggcaagggttgctctgaggtcggagatcaaacgctagaatggaaggcgggagacactttctgtgtaccctcctggcatgcctaccagcattttgctgatccgggcgaaactgtctatctctaccgcttcgacgataagccgatgatcacggcgctgggcttctatcggtcagcggaggatgattctgaggaactaatctctgactga

SEQ ID NO: 14513 - DNA, 294 bp, A.fumigatus
tttcgagttagactgcagctaatagaggaatggatagatatatccatggaccacaaatatatacctagtcaggcgacccgtagcattctagccatgccactaggatatttatacatttcatttattatcattattggtatcattattactattttcatttacgtatctgtcagccctagcggccgagtggcggcaggtcctgccggcggctgggtaggccgctactatcttataagcactagatctatggtaggcttaattgtccctctacccccgcagatatacctagtataa

SEQ ID NO: 14514 - DNA, 288 bp, A.fumigatus
atagcatcctccctgtctaatacaaggaaagacaaagattacatttgttatcaagtgatctactacttcctatactaccctgacttaataccctatccttctatcgttcctaattcttgcctagtcaacaggctgatctaccctgccttgtggatcatcttttaccatgaggtaccattcccaggcaagaaattgcacattacgcaactaaaggtaataaacttcgtcagagcacgcccgtttcagtcagagattagttcctcagaatcatcctccgctgaccgatag

SEQ ID NO: 14515 - DNA, 354 bp, A.fumigatus
tggtctcctgttcacgcgatgacgaccgttcaagtttacaaagccggtagcatccggggcatcatcacctctaggaacagtattagtccgaccctagttagcattacgggcctaccctttgacgcatcaagcggtacttctgtagcagcctcctatatgcaaatagcaagatggcatcaatgctaccccagcaaccaaaccaaccgcaacaccgacgcagacatgagctactcctgtggaaaatttgtggtcattgagttggtagtagcttcttcggaagtggttgttgtaactgtgaaagctcattgtaactacatggatgcaagacacctggtaggtaaatctgctatgtag

SEQ ID NO: 14516 - DNA, 789 bp, A.fumigatus
tgcagctccaagccaaagggcggcaagccagcaccacccaaacccgatgccggcgagacaggaagcaagaagcgccagggcgatacaactgaagacacaaagcagtcttcgcggaagaagattgctgggtcttcgactccgaccgaggctgataatggtgcgacatctaccgcgtctaatctgaagattctgccgggggagaaattgtcagactttgttgcgcgggttgaccgcgagatgcctatatcggggatgaagagatcggggaagccggcgccggcggacctacctaagctgcgcgaggggcggcagacgaagcacgagaagcgccttcgtcgattacaggagcagtggcggaaggaggaagcggagatcttggagcgtgaggcggccgagcgggaggagcgggaggccgagttggaggaacagttggagttgtggaaggagtgggagatggaggctgcgcaggccaaggcaaagaagaagggcgctgccgcgaaaagaaagaagaagggcgatggtgctctggatgatgatggcccggatccgtgggcgaagctgaagaaacgggatcggatgaacaaaccggcgaaccccttcgaggtggttcaggcgccgccgcaattgacgaagccgaaggaggttttcaaggtccgcggaggagctcgagtcgatgtcgcgaatgttcctgctgccgtgggaagtttgagacggagagaggagttggcgagcgagcggaggactatcgtggaggagtatcggcggttgatggctgaaaagcgacgttga

SEQ ID NO: 14517 - DNA, 183 bp, A.fumigatus
cgattagatctgccgctaaccacggaggaaaaaaagttcgccgaaccatctcaagcttcggtttctatcaaccacaaccacaaccaacagaataacaatccaccatgcctcacaagcataagagaagaaaaaatgacgcgaggtgcgtatcaaagtacatataatatcatatacctccgctaa

SEQ ID NO: 14518 - DNA, 291 bp, A.fumigatus
tcccaccacagcatctacgacctcccacccaccctgattgcgaagcctctcccgactcgcgatcccaacgccccaaaaaccaaaggcaaaaagcccgcacccaagtctaaagccccaaagaagaaagaaagcctctcggcttttgcccgtcgcaaatccgagctggatgatgacaccccgcgcgccttccgtcggctgatgcagctccaagccaaagggcggcaagccagcaccacccaaacccgatgccggcgagacaggaagcaagaagcgccagggcgatacaactga

SEQ ID NO: 14519 - DNA, 1617 bp, A.fumigatus
  unsure (30): Identity of nucleotide sequences at the above locations are unknown.
gtgaagactgaaggtccatgtcgctgccgnttgagaccgagaaagggtcgcttagatcttacagccaagcaacggtctagcaagctgtctttcgaagatatttctgttggcatgattcttcccggacgagtcacgaaggtcacggagaagcaggttatcatgcaactcagcgacacggtcgtgggtgcggtcaatctgattgatctggccgatgactactcgaaggcaaaccctaccgtttaccataagaacgatgtgctacgtgcttgtgtggtgggtgttgacaaagccaacaagaagatttccctctctctccgcccgtcgaaagttctaagttcctcccttccggtccaggatcccgaaatcacttccatgaagcaactcaaggtcaatgatgtggttcgaggatttgtcaagagagtcgctgatagcggtctctttgtgactctgggccacgatgtaacggcctacgttcgtgtctctgacctgtcggattcctacctcaaggagtggaaggactccttccaagtcgaccagttggtcaagggacgggtgactgtcgttgatcccgagcaaggcagattgcaaatgagtctcaaggaatctgtcttggatccagaatacaaggcaccgatcacgatgcatgacctcaaagtcggtcagtttgtcactggtaaggttcgcaaagtagaggaattcggcgccttcattgtcatcgatcggtccgccaacattagcggtctatgccatcgtagtgaaatggctgacaaacgagttgacgatgcccgcaccttgtacgaggaaggcgacctagtcaaagccaagatcatcaagatcgaccgtgagtcagggaagatctcattcagcttgaaggcttcccacttcaaggatcatgatgaggaagatgaaagcggcagtgatgaggagggtgactccaacggcgtcagcctagatggtatgggcggtgtcgacgtagaaggtagtgacgattccgaggacgacgacgatgatgatgaatctatggggggcgtcgatcttgaggaagacagtgagagtgatggtggggagagcgatgaggatgtggagatgaccagcgcacctgttaaaagagacgggggcctcggtgcaacaggctttgactggagcggaaacgtcaaagacgatgagaacgaagcgatgcagtctgattccgacgatgaagacaactctcggaagaagaaaaagaagagccgcaagcctgagatccaggttgatcggactggcgagttggacgccaatgggcctcagtcggttgccgactacgaacggctcctgctcggtgagcctgactcttcgcttctctggctgaagtacatggccttccagttggagctcggcgaggtcgagaaagccagggaaatcgccgagcgtgccctccgcaccattagcatcggccaggacaccgagaagttgaacatctgggtggctttgctcaacttggagaacacatacggcaatgatgacagtctcgacgaggtgttcaagcgcgcctgccagtacaatgatacgcaggagatctacgaccgcatgacgagcatttacattcagtcaggaaagaatgaagtgagtcacccctga

SEQ ID NO: 14520 - DNA, 591 bp, A.fumigatus
atgctgacccaattgaccttacagaaagcggatgagctcttccagactgccctcaaaaagaagatctccaacacgcccaagttcttcctgaactacgcaagcttcctgtttgatagcatggcggcgcccgatcgtgctcgttctctgcttcctcgcgcactccagtctctgccctctcatacgcacgtggagcttacctctaaattcggtcagctggagttccgctcgcccaacggagacgttgaacgtggccgaactgtgtttgagggcctgctctcctcgttccccaagcgagttgacctgtggaacgtactcctggacttggaaatcaagaatggcgatgcggagcaggtccggcggcttttcgagcgcgtccttggtatccgggatgccaagaagggtgctgctgctgctgttgctactcccacggatgctagcaagaagcttcgtccaaagcaggccaagttcttctttaagaagtggctgtcgtttgaggagaagctggcagctgctaatggcggcgatgagaagatggtggaggagattaaggccagggcggcggattatgtcaagtctctgcagaacgcatga

SEQ ID NO: 14521 - DNA, 801 bp, A.fumigatus
gcattaccctcgcagactggtgccggtactgcagcctcggtccacggccaggccgacctcgggatctgcaccttgaacgacatgcgtgccaatgctgagatgctcgccaacatttcgccctccactcccgtcatcgctgacgcagataccggttacggtggcccaattatggtcgctcgcacgacagagcaatactcgcgctcgggagtcgccgccttccacattgaggaccaggtgcagaccaagcgctgtggacatctcgcaggcaagatactggtagacaaggagacgtacgtgagtcgcatccgggcagcggtacaggcgcggaagcgcatgggcagtgacatcgtcgtgatcgcgcgaaccgacgcgctccagggctatgggtatgaggagagtgtggcacggctgcgggcggcgcgggatgcgggtgcagatgtcggcttcctcgaggggattacgtccaaggagatggcgcggcaggtcgttcaggatctggcgccgtggcccatgctgctgaacatggtcgagcatggggcgacaccgtcgatttcagcggatgaggccaaggagatggggttccgtattatcatcttcccctttgcggcaattgggcctgctctgaccgctatccgcgagggtatggagaagcttaagagggatggtctgccggggttgagcaaggagttgacgccgcaaatgctgttccgcacatgcggtttggacgagagtctcaaggtagatgcagaggcaggaggagcagcgttccagggcggagtggacttagaggataaggagtag

SEQ ID NO: 14522 - DNA, 1584 bp, A.fumigatus
gtgttaattgcaggtagctgtcaagttgatggagcgtcggctgacaatcataggtattcttcagactcgaccttttctgcgaatagacccgactcaggtcatcgtgttacttcgtccatttattctcgggacacattcgaccacagtcgccagcgctcagttacctgggaccatcagaacgatggcaggttttttcgagacccagaaactgcctcagaaaatctgagtgtagagatttcacctccggattcgcctatgtctattggtcgtacatatcacagtcgaggtagctcacgtgtctcttctctcgagtttgagtcaaatccgacgtccaacggagaacacaacatcacgaagttcgcaagccatttgccaatcccacgtaagcgggcgggctctgcgcaaccccacaacagaccgtcgacgcaaggtctctcagatcagaatcgcacagcacgatgggatggtttcacagatggaccgaccacaagccactcagataggtttgcacccaacctttccacagatatctcctttgaatcacaacatacgggatcaagcaacgcttctagatggatcaagggccatggtcattcaaaagagcagaacacagagggccggcaacggtcaccctcaaaaaatgataatcctttttctctagcagtacgtgaaccttggaagggtccgagcgggcgatctgcgatgataaatccgatccaggagaagccaaaggagagatcatcatcacgtgttcatcattcaaagaataacgatcgcaacgatcgatcaaaggaaagtgactgtgcatctccagactattcatacctcggtttcgtcccgtcggtagtcacaacaattactggaggcgcagatgatgccctgggaccggacaaacgccagcctagcaaaagtcgccagcaaccatccattgcgaagaaaccgatcagtgcgactagcgatgtcccaccccgaatcgaaattccagtgcccactttggaaaccaccctcgctgagttgaagctgtccaccggagatcaggctgatgcacccgtcagccgcttcagtgcaaccacctgtgccacaacggagagcgatagccctacacctagtcgtcgtgagagtgttgatgcggcttcccagtctacagagaacgcaccctcaatcatgtcccgcaaaagacccattcccagtgccatggctccggggaagaaaccaagcaggaagccaaccccgtcccaggctgacaatggcaaggacctccccccatgtccaccagaacaacaatctcaaaaccgcattgagatgctggaagcaaggagggacaaccttgcacggcgtagggcaaacattaacacaattattcacgaactgacccaggtcatccagcctagctccatcgcttacgacatggctgcccgcgacgaggtcaaaaagactgtcgccagtctcaacaacgaattagcggatatcaggagagaggagcatgagattgggatgaaactattcagactttggaagaaacgcgacgagaaaaacttgtatggtggagacagcggcttatgggtaaagcgggtgaccagctga

SEQ ID NO: 14523 - DNA, 363 bp, A.fumigatus
  unsure (248): Identity of nucleotide sequences at the above locations are unknown.
atttctgctttgccgttagtccccccccccccgttaataagctacttttcctctctttttaaaaatttttttttgatcggccatttcccccacatcgctgcgatctttgtctttcatttggtcaagcgactgtttccaacaatttctctttctaagactctctacacaatgggtggtgcaaagcagagaaggtacgtcgtccctctcccgtggataatgcgatacagtcaactaagttatttctcagncggcagggcaaaacttttgaaggcccccaagaaggggaagaaggagcttgatgaggaggatctcgcctttaaggagagacagagagccggtatgttgtccacttgtggtcgctga

SEQ ID NO: 14524 - DNA, 570 bp, A.fumigatus
catgctttccaaagacctcatattcatgagtacttgcaggaaatgcacgaggaagtgttctctcattatgactgcatgaccttagcagagatgtcctgcggcgtctccgctcctgaagctgttcggtatacatcgcgattcaatgctcgtcccgaactaaacctagtcattcaattccagcatgtagagctcgactgccacgatggcgacaagtggatgctgcgggaatgggagctccccgagttgaaacgaattatcaacgagtggcaagaaacattggtcaaaaatgggggatggaacacagtctggatggagaatcacgatcagccaagaggcatctccaggttcactaccaacagtccgcgatttcgggccatgtgtgctaaattgctagctttatggcagttcacgcttcagggcacaaacctcatcttccaggggcaggagctagggatgatcaacccgggactcttttcggaagatatgaatcaagacattgagacgatccagtattggaaggcgtacgtatcacttattctggccaggcacattgtccgattactcacataa

SEQ ID NO: 14525 - DNA, 225 bp, A.fumigatus
ttttggggaagaaatgagttggaaaactactctgtgttgcgggaagagaaaattctgatgaagggggagaaaaacataattctcaactatgggtgggacaacacccttttaaccactcttctcttttgggcccccatcttgatttcttccaaaacaccaaaaaagtttgggattgaatggattctccccccaattttcttcctttgttgtctgccctccttcccc

SEQ ID NO: 14526 - DNA, 258 bp, A.fumigatus
caatgcctcggtccgggaaaaaggatcatgccatcaaccccaaccagatcgcaattttcatccccagcaaagccgcgggagagtcctgtttcagtggaaacgcagcgctacatggctcggatgcgccgcatggagcgcgaagaagacgctagtttgcaacggctcaacgagcagctgcaggcgatgattaaggaagggaaacaagccttgggaactcgcgttgaggtggacgatctagatctagacgaggattattga

SEQ ID NO: 14527 - DNA, 231 bp, A.fumigatus
tctttctcggaatgcgctcacaactcaagacactctttctatattgatacccctaagcgttcatttacctttcaaattttgcacgattactatcagatgaccactgttctgttgcggtacctcattcctttcgttgttgttttgcggtcaagcggcctgtttaagtcggacctacagcccagagaacttcagagtccctccctcgcttctgctcagcggttgtacttttga

SEQ ID NO: 14528 - DNA, 210 bp, A.fumigatus
acaagacaaatccaggatactgttatgctggacaatatgaagatcttttctttgatgggcaagatgcccgttgaaggtcttcctcaatatcagttttccttcctcactcaatcacgagaacccttcacaccttgccttggcagagacgggccgcagcgagtcacagacggtaacgcgaggctcacaatatctgctacaggtacaatctaa

SEQ ID NO: 14529 - DNA, 330 bp, A.fumigatus
ctcctgcgcacggatcctagtaagcctaccacattctcgatttctcgcgatctcacggcctggtacaacgctttcgggagctctcacaatatcgtcgcccacgaggagacgaacatgatctacgcagttggaacgactaggtctcatagctgcgctggaggcctgtggatggtggatgtttccaatcccgcgaaaccaatatcacccggctgtgtgaaccaggacggctatgtgcatgacggtaagccgttgcctgctctgatcgttccgtgccatactaacagccacagcacaatgtgtaatctacaaggggcccgacaagaagtataa

SEQ ID NO: 14530 - DNA, 351 bp, A.fumigatus
tacgcggagagaaaaagatatctagacaacatgaagttcacagccttctcactgttgtccctggcatgtgctgctgtggcctcccgagaaggggaagcggccatggaccgcctcatgtctgtcaaggtcgaggagagagagagattcagggctgaaggtcttttcgatgccaaccagtatcctgatttgggaagtcagaagtgcgtcaatgggaaagcaggagagtattcgtgtgagaatgtcgaccttcttggcttcctcagtcatcaggctatgggcagcaagacccgtgagggcaatgacatctggggtatgcttttgactgagaatatctctaacaaggctcactaa

SEQ ID NO: 14531 - DNA, 639 bp, A.fumigatus
tcgttccgtgccatactaacagccacagcacaatgtgtaatctacaaggggcccgacaagaagtataacggacgcgagatctgcttcaactacaacgaggattcgctgaccatcgtcgatgtctccaacaagaaatccccggtgcaaatctccaagactccctacgctggctctagctacactcatcagggctgggttactgacatggaggacatgtcgtatctgctgcttgatgacgagctcgacgagaaggacggcactggagtggccgccaacgggcatactacaacctatgtctttgacatccgcaatcttgccaaacccaagcatactggaacgtaccagtcccccgtcaaatcgatcgaccacaaccaatacgtgctcaacggcctctcttacatgtccaactacagcagtggcctgcgcatcgtggatgtcagatctgtcactcaggatcccactggtgccaagttcaagcaggttggcttttttgactgccaccctgatgatgacgccgaaggtggcaaggttcagtttgttggaagctggagcgtttatccttacttcaagagcggcaacattctcctgaacagcattgaacggggtgttttctctttgaagtacactgggcctaagtga

SEQ ID NO: 14532 - DNA, 267 bp, A.fumigatus
aattatgatattctaggattgtatgtcttgatttttagtacgacttcgtcattgaccttctattataatcgtcacacaatgggatatgcagtctcccagggtaccgggccctatccggcgaccgtcggggcaccctgtttaagggcctgctcgacaaggattacatacttagattgtacctgtagcagatattgtgagcctcgcgttaccgtctgtgactcgctgcggcccgtctctgccaaggcaaggtgtgaagggttctcgtga

SEQ ID NO: 14533 - DNA, 1176 bp, A.fumigatus
ataacagctttctcagaaatatactcatcaacccggccatctggaagctgcctcattggaagagagatcacgccgttctttctattctgcaaaatggagagccctatagatggaaggatagctcggagtgcgcggcaattgaactgccagtcagaaagggaaactggattgatcgaaaaagagcacctcacaacagagacgggatcaactttgtctagcttcagcgatgaagatagtgaattgagtctcggtcatcaacagggcagtagaggcagaagaagggtttctcgaaagtatcacgcgagggctcatggtcattcctggttttcacaacgttctactcggcctgcaacacaacgggaccatgtgcctcaggtctctcaccagagagtcagagctaattctcattcactacactcactgctgccttcccacgtctcactctcatcttccctcttcttctctcctccttctccttcctcttacccatcttcttcaacattctcgcaatcatcgccgtctacctcaccttctccgttaccatttaccaaacgagcaaagactaaagcaatgactcaaggttcgcgacctagaagtacacttctgcgggagcggaagcgttctttgcagccctcaagacagcaagttccgtcccaggccccgagttcagggcagcatgtaccacctgtgaccccacaacggagtcaatggcaacagataccgcaggttctgcagcacccatccacaatcttgtgtccatggagactgtgggagtcggtggctgtgcacgtcttcaacataccgagggaagcagacacatattgtctttggcaagcattcagcaaagagggacatgtgttttcgatagacatctttgaagactttcatggaaatagagaatccaggggaaagattcgcttcaagtcagcagactcacctctccattctataaattggcctaacccgttcagcagaccaccccctcagaaagatttctggtgccatgggacgtaccccatcacactctcagatgggaaaccgacattcgtctcaattaccctcgatctcaaacggccagatgttcagattcagagtcctcttcgtcctaatacgatgtatcctgctgaggtggtgggtctaagcacctttccttactgtacaatctttcaacgctga

SEQ ID NO: 14534 - DNA, 765 bp, A.fumigatus
catgtctttgagagaatcagattcttggtatcggcaggacttcggtggaacacaacccagatgagctatctaactctaccccgggagcttaaatcgatcgagaccagtgatcgatattggtacgttttggtgattaacttcgaattttacttcttcctccttcaattcgaaactaatggctttaccctaggccgctggaacgcgtttagaataacatatcccgaagctctcagcaagaaagatgaggaaagattcgaattgttttgcaacattttgaacgactacaatattgccattgagaatactacccggttctcagtgttggaccagacgcaggaaagacctccaccaatttggagatggattgacttcgcagacctacaaggctccaagaagatagtatcttctgtggaagaattaggagatgaaacttatgttcatttgcctttccctgtgcggtaccagctcgaggtctgtttatcccacaattacctttctgagtttaccatgagccgcgaattcgcggtcaaattgctcaacctaggggaatccgaagcagttaagcttctggaacatgtggctatcaaggaagaagtctatcatgaccccatgaaaatcttcgatctcaagttcgccaaaggttcaactcgcgctaagataccatcttactgttgctacatgcggtcagccagaattacacctaccacgatctactataacactccatctgttgtcttcacccccgggctggaaggaaacgcgctg

SEQ ID NO: 14535 - DNA, 201 bp, A.fumigatus
cgtctgctctcgtacatgcttgttccagcctcttttatccgttccgatagacagtataagaccttactctatagctcatcctcccatctctctttatccttttataagataatcttcctaaaaattgcggtgtcagaacaattcatcaggcatacaaaattgcgtgttcaaagtataacagctcactggtatgtctcttag

SEQ ID NO: 14536 - DNA, 306 bp, A.fumigatus
tactacgatcaatctgttgcgatgttccgaatcctcgaatcacaggcgccggccaaacaaacggcaacggacacaatcaacactttgagcagtagactccaaagtgcgactttactggaggatcgacgtgcggcaatacagggactaaggagcttctcgaagctttatccggcctctgtcgcatctggagcgctacgaccgttgatcaacagcctgagaaatgaccgagaagatgtggacacgatcaaggtggtcttggagactttgttgatgctattctccccagatgagagcagtgtgcgttga

SEQ ID NO: 14537 - DNA, 357 bp, A.fumigatus
ctaatgaggcgaaagcgacaagacaatatcaccgcacttctcgatctccttgatacgcgggacttctactctcgtctgtattcgctgcagttgatgtttcagatctcaagtgcccggccagaaaggacacaggaatgtatactaaccgccccgctgggtattcccaggcttgtcggtgccctgggggatagcagggaaccaattcgtaatggtaagctgcaccgggtttggattttctataatgctcgagtgactcatcgtacgtgcgcgttttacagaagcattacttttactcattgcattgacacctgcctcggaggaatttcagaaactcgttgccttcgaaaatgcctttga

SEQ ID NO: 14538 - DNA, 2025 bp, A.fumigatus
gcgttggctacatgcgccgatttgatccgcggaaactcgtctctgcaggagagattcggggatattgaggtcttttggggtcgacagcccagtcaagatggcgttgtcaatggggacaaagtcgcgaacggtgttcagcgtgtaaacgtaatcgaagcattgcttaaattgagtcttgaaccagccccaatacaggtacttgatgcccggctggccgcaagcgagtgcatcaaggcattctttgcaaatcatccgggaattcgcgtccacgtgttgcggagagcgattgatggacatctcagcgggcaggatcaaattccgaatatcatgactgttctgctcgtgccgcctgatgctcgaggaaattccgatccttaccaagtgtggattgcgtctgtcttaatgttccacttgctgtttgaagatgctgaggcaaaggcgatagccatgcaagtgactgagggcgatgctgaaagcggcgaagaagtaatcacctgcatccaaacaattctgggaaacctaatcacaggaatgaaaaggggcgatgacgagagaatcacggtaggctatttgatgttgctgtgcgggtggcttttcgaagagccagatgctgtcaatgattttcttggagagggaagcagcgttcaaagcttattgcaagaaactaagcatcgcggtgtctccaatgtaattatgcccggcctgacaacgattttattgggaatcatctacgaattttccacgaaggactcgcctattcctcgggctacgttgcacaagttactgctcgaccagctaggcagagagcagtatattgacaagatcactcgcttcagagaatcgcccatggtccgggacttcgaggtcttgccacagacggtgggaggacagtttgacgcgggactacctgatattttctttgacaggacattcattgattttatcaaagataacttcagccggttgattcgggcaatcgatcgcgaacccgggcttgagatatcggtcatcacaaatggcattcagcgaggagtttcgcgagaactggttgattcgctcagggctgagctcgatgaacgaagccaagctgtgcagaagctcgaatctgacttactgaatttacgaaaccaacttgagcaagagcagctcgaacatagaaaattcaaggacctgagcatctcagaggcctccaaaatacggcagattaatgaatcgttgcaacgaaatcatgaacaggagttggcgagattagaagaacaacacaattatgccaagaacgaattgctgaaacagcatggcgatcagcttcgagctatcgacaaccagctcaaggaaacctccgctgaatatgagaggagaagccagaaagtcaaaaagctgcacgatacggaagtcgctgatcttcagaagaaactccaatcgctggaattggagcttacccgcgtcagggaacaaagtgcagacgaaattggtggcttacaatcgacgattcaaacgatgaggtccgaagcagaccaaagcaaaggacagcattgggcccaggtagcggagcttgaaagcacaatccaaagtctacgctcagaactagacgaaaacaaggcgaaccatgccgatcaggtctctaatctcagcgacacgattcggaggctacagtctgaacttgacaaagccaaagaaggacacgaggctgagcttgctgaccttagagcgaaggctcagaccgtgcagtccgaacttgacacagccaaacaagaacatgagactgaaatcagtggccttagagtcaaggctcagtcgttacagtcagaactcgactctcgtacggaaaggtccaaggaagatctccaggctgttcacgacgactacttatctaagctttcagagctggaaaagcgggtgaagctggctgagagcaaggcagaaaaagctgaagcagatgcgctcaaatctgctgaaacgctcaaggaggtccaggcacaacttggaaagaccaaggctgaagttgacgagaaggatgaagctcgc

SEQ ID NO: 14539 - DNA, 564 bp, A.fumigatus
ctcatcgtacgtgcgcgttttacagaagcattacttttactcattgcattgacacctgcctcggaggaatttcagaaactcgttgccttcgaaaatgcctttgacgtgatattgtccctgatcgagaatgagggtggtttgatacatggattagaggtcgtggaagattgtctatctttgctagccaatcttctacgactcaatatatcgaaccagtcatacttccgagagaccggctgcgtgagaagattggcgaaactcctagctgatgtcaacaaagacgaggatccagctgaggacattccacactggacgcatggtcagcgcgataagaatatctggggtttactagttatcatccagctgttcctcactaagggtgggattaacactcccgccaatcagatggctttatggaataatggtgtgatggagcaaatattgagcgcggccttcggccagaagttcaatgttaacgtgacatccaaggtttgtgcttttgagttttccaggtacgactcatcggttgacctatctaggcgttggctacatgcgccgatttga

SEQ ID NO: 14540 - DNA, 228 bp, A.fumigatus
gccaccaatttcgtctgcactttgttccctgacgcgggtaagctccaattccagcgattggagtttcttctgaagatcagcgacttccgtatcgtgcagctttttgactttctggcttctcctctcatattcagcggaggtttccttgagctggttgtcgatagctcgaagctgatcgccatgctgtttcagcaattcgttcttggcataattgtgttgttcttctaa

SEQ ID NO: 14541 - DNA, 537 bp, A.fumigatus
gacagacgcaatccacacttggtaaggatcggaatttcctcgagcatcaggcggcacgagcagaacagtcatgatattcggaatttgatcctgcccgctgagatgtccatcaatcgctctccgcaacacgtggacgcgaattcccggatgatttgcaaagaatgccttgatgcactcgcttgcggccagccgggcatcaagtacctgtattggggctggttcaagactcaatttaagcaatgcttcgattacgtttacacgctgaacaccgttcgcgactttgtccccattgacaacgccatcttgactgggctgtcgaccccaaaagacctcaatatccccgaatctctcctgcagagacgagtttccgcggatcaaatcggcgcatgtagccaacgcctagataggtcaaccgatgagtcgtacctggaaaactcaaaagcacaaaccttggatgtcacgttaacattgaacttctggccgaaggccgcgctcaatatttgctccatcacaccattattccataaagccatctga

SEQ ID NO: 14542 - DNA, 330 bp, A.fumigatus
tctactgtcgccatcatgggagttccggcattgtttcgatggctttccaacaaataccccaagatcatctccccggtcattgaagagttgccgtacgaagtcaacggcgaagaaattcccgttgacatcaccaaaccaaaccccaatggagaagagatggataatctctacttggatatgaatggtatcgtccatccatgtacccatcctgagggcaagcctccaccagcgaatgagcaggagatgatggtggaaatcttcaagtacactgaccgcgtggtgaacatggtccgtcccaggaagcttctgatgattgctgttggtatgtga

SEQ ID NO: 14543 - DNA, 294 bp, A.fumigatus
gccgctctcctcgtcactgtcctcatcctcctcgtcatcatcataatcactcgagtcgtcggccgagtctccacccaaccagtcctcgatatcctcgagatcctcgtcgtcctcaagatcactgacatactccacctcaccaacgccctcttcctcttcatcctcaatctcttcaccgtcgtcgagatcctcatcccgctcaccctcacctgtgcgctccagaccgcgcaggacctttttccagatcccctcctcaacattaagcggccggtcaccgtacgcgccgctccgtaa

SEQ ID NO: 14544 - DNA, 450 bp, A.fumigatus
tcactcgagtcgtcggccgagtctccacccaaccagtcctcgatatcctcgagatcctcgtcgtcctcaagatcactgacatactccacctcaccaacgccctcttcctcttcatcctcaatctcttcaccgtcgtcgagatcctcatcccgctcaccctcacctgtgcgctccagaccgcgcaggacctttttccagatcccctcctcaacattaagcggccggtcaccgtacgcgccgctccgtaaccgctcaatcagctcacgctcaatcgcccgctcaaccttggccgcagactccgccttgcgctctctcgtctcctccctccgccggatcttaggcgccagcttcggcacaatcttctcacccagccgctcttcctccttagcgatcttccgcatccgaatagccacctgcgtcagccgcgtgagacgctgcttgcacttatga

SEQ ID NO: 14545 - DNA, 945 bp, A.fumigatus
atttacgcacgtactaatcccgcacgatccaggacaactaaaggccaaaacttctgccgcaatgaatacaatgtcagcggtctctgcaatcggcagtcctgcccgctggccaactcccggtacgctaccgtgcggtcggatccggagaccggcgtcatgtacctgtacatgaagacgatcgaacgagcccacatgcccagcaagctctgggagcggatcagattatcgtccaactacgccaaggcgctcgagcagctcgacgagcggctgatctactggcccaagtttctaattcataagtgcaagcagcgtctcacgcggctgacgcaggtggctattcggatgcggaagatcgctaaggaggaagagcggctgggtgagaagattgtgccgaagctggcgcctaagatccggcggagggaggagacgagagagcgcaaggcggagtctgcggccaaggttgagcgggcgattgagcgtgagctgattgagcggttacggagcggcgcgtacggtgaccggccgcttaatgttgaggaggggatctggaaaaaggtcctgcgcggtctggagcgcacaggtgagggtgagcgggatgaggatctcgacgacggtgaagagattgaggatgaagaggaagagggcgttggtgaggtggagtatgtcagtgatcttgaggacgacgaggatctcgaggatatcgaggactggttgggtggagactcggccgacgactcgagtgattatgatgatgacgaggaggatgaggacagtgacgaggagagcggctcagaggaggcgtccagcgatgaggagacaaagaaacccaagcctggggccaagagaaagcgtgctgcaccacaagtgaagcctcggaagaggggtcctcgggtcgagatcgaatacgaaaccgaaggagcgggcaaggagagcatcctggcttag

SEQ ID NO: 14546 - DNA, 264 bp, A.fumigatus
  unsure (7),(10),(11): Identity of nucleotide sequences at the above locations are unknown.
ggggggnttnnttatagtttgcactgcccttcagccccgggtgaagacggctacggggccgtcaatggattcccagctgcacctaatagcttctcggacagttttaatgccgatgctgccattgaggagcttgacaacattcgcctacgagaaattacagggaaggctatatcgggatctttattgctcatgttgaagtggttcaagagatctcgtaagttacaagttcgaggcctatgtgacatggtctctaacaggctgtag

SEQ ID NO: 14547 - DNA, 891 bp, A.fumigatus
agaactagggtaggtgctcgtcaaatactgatcacggttaagtcactaactctgagcagtttctttcacttttgtcatgttcattctgatcaaccgccgaattcagccgataactcagaggaggactcgtcaccgagtgatgatgaagctgtgcccccgcctattcttcggcaccgtcgtgacacggatcctggcacctcctcagtgcgaccaccgtctccccaggaggctctccctgagctggtagaaggcgctcatcgtcctgaagttgacgaattgggattcccgacagcccctccgccgaaagagcccatcacggtgttctcgtttcggaacttcttctctgccatcaattacctccacatcatgcagaagatcacccgcgacaaggcacacagatgtctgctcctcgttcagtacaagtccagcaccatcttacgaaaggggctcaagattcctgatcctcacttgcgattctacaccctgaaattgttcaagtctcaggtgccctactgtggccgcaagtggcgccagagcaacatgcgcgtgatcactgcaatctatttatactgccgcccagagctacgggatgactggctggctgggtcggatattgacgcagaagtggaggaggcattgcccctggaacaagccctcagagggctgacacactggtggcacctacgtcgatacaaggacgtgatgggcggcggagaaggagcgtccatgatggaagaagagcgggacttctttgtacgcgagttggaagctatgggttggggatttgcaggtgaggaaatgatgaatgaggaagcggaaatggctgccaacggggtcatgatgaatgggacggaatgggacggtggccccttgcagatggaaggatggtga

SEQ ID NO: 14548 - DNA, 195 bp, A.fumigatus
ttgatttccttccttcctagtgggagcgtccgtttggctaatcctctatttggtattcaggttcaccaaattcaatcgggccaggtgattgttgatctgtgctctgttgtgaaggaattggtggaaaacagtcttgatgctggcgcaacatcgatcggtaggatcatagagaaccatcaaagatatgcccggtga

SEQ ID NO: 14549 - DNA, 315 bp, A.fumigatus
agtgttgacatgctcattttggtcctggacatagaggtccgtttcaagaacaacgggctggactcgatcgaggtacaagacaatggaagcggaatatcaccagagaactacgagaacgtcggtaagctttcctttggtgaatattccaaatctgatcttgaagttttgcttacctttggtagctctgaaacattacacatcgaaactctcgtcttacgaggatctctcccgcttacacactttcggtttccgaggcgaagcactctcgtccttatgcgctctagccgatttccgcatcgtcacggcccaagctaa

SEQ ID NO: 14550 - DNA, 1299 bp, A.fumigatus
aggtccgtttcaagaacaacgggctggactcgatcgaggtacaagacaatggaagcggaatatcaccagagaactacgagaacgtcggtaagctttcctttggtgaatattccaaatctgatcttgaagttttgcttacctttggtagctctgaaacattacacatcgaaactctcgtcttacgaggatctctcccgcttacacactttcggtttccgaggcgaagcactctcgtccttatgcgctctagccgatttccgcatcgtcacggcccaagctaatcaagctcccaaggcgactaagctcgaattcgaaacatcggggaagctgtcgaagacccaaatagtcgcgggtcaaaagggcacaacagcctcggtggagggtctgttcaaaaagcttcccgtccgccgccgggagctggaaaagaacatcaagagagagtatgggaaggttttgaatctgctccatgcctatgcttgcataagcacgggggtacgcttcagcgttcggaatacagtgggaaaaaatcggaatgtgatggttttctcgacgaatggcaaccagacaacaaaggagaatattgccaatgtctacggcgcaaaaacgctactggcgctcatcccgctggacttgaccttggagtttgagccatccgctgcaggtaggcggacagctgaaggtgagcttcatacaatccaggtcaaagggcacatctctcgtccggtatttggtgaaggaaggcaaacaccggatcgtcagatgttctttgtgaattctcgaccctgtggtctgccgcaaattgcaaaggcgtttaatgaggtctacaagtcattcaatgtgtcgcagtctcccttcgtctttgcggacttgcatatggatacaaatgcctatgatgtgaatgtgtcccctgataaacgcacaattctgttgcatgatgctggggcgttgatcgattccctcaagcagtctcttacagagatgttcgaagcgactgatcagactgttcctctatctcaaatagctgactataagcaatctggtcctaaacagcagctggggacactgcaggcagtcgcccctcgcagggttttgagcgagaaggaagctattacaggagagcaaggccattcccccgataaagaagacacagaatcgagtcaactgagctcccaggagaagctgaaaagctttctgagcaaccttggttcacgacagggacgagcgactccatcctcgtctcctgtccgcagaggaggagtcggagcaactggactcgactgcaacgccgagtacccctga

SEQ ID NO: 14551 - DNA, 1011 bp, A.fumigatus
gcaaccttggttcacgacagggacgagcgactccatcctcgtctcctgtccgcagaggaggagtcggagcaactggactcgactgcaacgccgagtacccctgacggtcgggctgaatccttaaccaagacagtcgataatgaattattcgtttcagagggtgggacgccatcccctgaaacttcccaactccctaaggtgacggacgaggagcaagaatccccgcgagacgccgtagagcagtctacgccacggggtggttctgagctctatggacatcacaccccttcaactcaacccgatctacttgaggagacacccaatgtcatacagaacgccttcgatcgaatgcgtcccagacgtatgcccgctgaagttgccaccatcaccattggcaacaagacaattacgtccatggtaggaagtggaatgcctagaaaaaggaccggggattcaattcaaaccgccggtggaagatcagtccgcaagaggaggatacacactccgtctcgttccaatatatttggcaaacatatgagggcctttgcagctccaggatcgcagatacagcaagctagcagcgttgaggccgaggaggaggacgaggacgaggaggaacgagcggaagatgaagagatcatggacagtgtttctgaagacggctcccgttcatcttgcccgtctgataagcacgacgatcgctccgcagaggtatcggatgatgaggtcaacgagtccggagctacagctgcggagatgatgaatgatgaggagaagaagaaacacgaggaagccgaggtgcagcggctcattcgacaagcagaggaaaaagccgtgttgcctcaggagaatagtatccaccgtgcgaacaagctgaacaagggggccggtcatcgtgactccacaacacatctgatgagcaccgttgacgggtcgctccctaagattgagagccagatgaagaaggttcagcacagcctccgttcctacagaaaggatgtggacaattct

SEQ ID NO: 14552 - DNA, 855 bp, A.fumigatus
  unsure (81): Identity of nucleotide sequences at the above locations are unknown.
agccggtcgccatcaccgccagccgggcgccatgatgacgattcggctagccggcagtcttacgatgacagaccccctagnaggttgaccaatgctacagaccctacggcaccattaacaggaacggggctgggaaccgcggttctggcgaccggttattctgatgactttgatcacgctcttacccctcaaactgaccgacatcactctcgtgattatgatgatcatgaacagggacaccacaggcgccgccgtcggtcgcgtagatcatcaagacggagaactgagagtgattctgatggatacacatcagacgaagatcttaagaactaccaccgcgaaccttcagctcggcggcaacccggtggttccgactcatcttctggtggacgcaaagacccgggatcgcagtatttgacggtcgagaaggcacataggcgcaggagctcacgctcgcggcgtcatggggagaatggctccctaagaaatgagacgagtggacgcgaatcggccagcagccaggaggatttgaagaaaagcaaagatccggacgctcctccaaaggggattctgaagccaccccgagacaaatttcccgaggagcctaaccctgtcagggagggagtggcaccactgaaagatgcccataaaaagggaatccctcctggagcgcgatggaccaagatcgatcggcgattggtaaatccagccgctcttgaagctggaaacgagcgttacgaagaaagacctgattatgtcattgtcctgcgtgtgttgaccaaggaggagatccagaggtacgccgccaggacgcaggagatccgaggtatgtgctgctcatcgacatggtattga

SEQ ID NO: 14553 - DNA, 255 bp, A.fumigatus
agcccacgcaagaacagaatgtatcttgtgagaaatagatttttcaatgtgtctctctgccctgccttaaacctgaccaatactagcccaccaaaagcaaacattacctcgcgcctgaccgagctacgcttgcctgaaggatatctaggtcctcatgactccttccgcaaaccggccatttcggaatcaatacagaatagctcacgagaaccagctcaaggatggttacatcatgcaactggacagctttactga

SEQ ID NO: 14554 - DNA, 3156 bp, A.fumigatus
tccttctctctcgctcctaacgtcacaaacatcatgattaccccacacaaggacgatagccgcttccgaatccagaactacagcagtgtgaatcctgatgctctccgtcgtgttcgggaggatccaaaaatgtgttctgccattgactttggtcgaatgtgcgtcaccgtgggtctgtccttcaacaaggaatctcaagtgtggactataccggataatcggcttaatccactacctatcagcgaggaagccgggccgtctcgcatctggaatgactttactttccaggaaatcgggaaggcggacgagtttgttgacatcgaagcgataatcgagaatgacccctcaaaaccccagaccttgatctctggcattgcacctccccatcccttcctcactgcagacaaggtcaagcaagtcaaccagtgggttgtggaaagggctgagatgcagccaactgagcatgaacccgagcccgagcccgagcctgagcttgagtctgattttgagccccagcccgaatatgagggccgcgacattcaccagcttaaactcaagcgcgaaacagcaattatccctcaaagcaaaagaccacctggtatgaagacgcgaaaggccgcaataacggccaaagttgcgccgccatccgagcaatctctggcaactgagaccaaacctgtggccatcggtctcaaggagacgactgccaacccccgtaagcgttggactatgctgtacagttccggagccgaggatgcaagtccggatgacagtgacgcgcttaactctggaatttctaatttgaatgataccctcgagcttcctggcgactttctggaattcgcaaagccccaaacttccgaaaacaaagtacgtcttcccggcaacttcgacgctggcaaatatggtctcaaccagtcttcacgccaaacttctaaagagggaaagcatagtccaagcttcaagaaaattgtgcaagtcaagtcaaagaagaattcaggcgaccctaacgagctgatcgacgtctttgagcccggaaataatactgtcgttggcactctctctcgaatcccgttcaatcagcctccattaattcccgacagcctggtcaatgaatctacctcgaacacccgaaagatgtgtttgcaggagacgtctgattcaaattccaagaacaccaagaatggtctcttaagctgcgggatgggcgatcatagcactccttctggctctggcagcaccgaatctatgtttgggcgtgcagcagcaggtgacgaaaatcaccaggagcaggaaaacagattatcatttctgaaaaatttccttcaagagcggacagacaatatttcctatcatggcggttatggtcaaacacacacctccaggtatgagttcaacaagctgctggtgaaagaaagcctggcaaagcttgaaacggttcatcgagaccaagatagacaagggtctgatgaaacaagcaccagagagttctatcgtaccatgggtcacaagacggcaaagccgacaaataaagctaagagcaaatctgaaattaaatcgaaaagacaggccacgcttgaggatgcttggggattcttcaaaaagccagtgaagaaaccctcagcagttgcgcagactctgaaaacaacgcggcaaagcatccaggagagcgaaagagagacagttcatatggcgagcagaaagaacgagttggctgcagagccagcagaaaatagcatggctcgagatgtcgagaacttattcgaagcattgaagcaaacattggaagctgctgaatactttcaaggatccctgaacttggaagtccatctcggactgatactgataccacttctgccaaagacttgtagtgaaggctcgaccatctatttgaccgaatggacgaagatcttccagtcacaaactggtattccctctccgacaaccagatttattagccgacttacgacctctggcattgatattgattatctggttgatctgaagacagctacacctgaagggaaaaggcgcatttttgagcaggacttcagagaatacagcgtgttctacgagttccactgccacactcgaaccggtcaggtgctcgtcctatctgtggatgagcaagggaaattcaacattaaaaatcccaactttgggcttggtgctgtcaatttgcactttccacaccaagtctgggatgcaagtatcgtccttagtggtaccccaaacgatgctgccgttgaccaagagtttgaggaggcggcgaagtacatcattgagcacctgtgggttcgaccagatacctcgctggtgcagatcttcacacgactacctccaggcgacaagataacgattgagaaagtatacatgaaacgttggacgcgccatcgcttcatccatcctccgaagagcatcattgccgccaacggcgccagtcatatcaggagcaatagtgctagaatagtggagactgacttgaatagcaactccgctgacaggcgccagacttccgcggaaaccgaagcagagactatggagaatcaagatatctttcttcaagtcatggaggtgcaagatctttgtattggatccagtccgtccgacgttcgggcggtgacagcctgctgtgtttcgctacctgaaatgatgggaagcggccgccaatggtatgaagcgtcccttgtgagctcggctatcgaagccattctgagaacgaatgcgaaccttgaaattggagaacgaactgacgaatggcggagttctgacctgctgggaagagatgccgtcctccttgatgggaatgcggcaaagcccgacggcccgaatacgccactcagccctgtagccaaggccattggcatcgctggcctcggagatcttctgcggttgacaaaaactgttgttgaggaaatggacggtgtcggattctggggccacggtttggaccatgattcagtccaggcgccatcgatcaccggctccgtgggcactctagatcagatggttcgacttgagccaagaagcttggatttcgatgatttcgaaagcatcaaaaaattcggaagcgtcatggccactacattgactaagaagtcttctggtgggtcttccgcgaaagacaaggagcaacttgaaatcgactactggtaa

SEQ ID NO: 14555 - DNA, 2412 bp, A.fumigatus
  unsure (53): Identity of nucleotide sequences at the above locations are unknown.
gggcacaaggttttaaaccccgggggcaagaataaaagaaccggtttgggggnggaaataacccccaaagccccttgccttttcccattaggggcggaagaagaacatgggggcttgttttcaaccgaagagagaccacgggcgagaaaaaaaggcatcttagaaaaggggttaacgtcgaacagtcgagaattttgccttgcgactgaacgagccgtgcagcgaagcgcgggaaacaaggagaactatgctttggaacacattattgaagtcgcgaacaagaacccggaaatctgcgttgtgctagacggacaaggtcatatgtctgcatgggctttggaggatgttgggtccaaggccaagtcaaacatggccgctttcaacattcttcatgtcgaaaacattgatttctccttcatgtctgccctgtccgcggaggaggattatgctcagttatgtgcttttcagaccatcccactgggagactcaatctctatcattgtccatcatttcgatggcaggattgagtggtttgaatcgcaagttgatgttctgtttgatccaacgccgcgcaaaaaccggatcgccctgaaagcgtcttggaccggacatactgatcctatcaagaagatcgttcgaaatgcagctggagacacgcttgtatctcgaaccaacgagaacaaggccacgatctggaagcaaaggtggagacatggtcggtcggttttggtccggaagagctggctctactcggacgagcacattcatcgtagctgcgtcatcgaaagtggtgactttctggtcaatcttcatcattacggcatctctgtctgggatgtccgctcttttcatgcccgaaagatcgcttctcaatcgttcgaactctcgagcaagccgctctgcgtccttccattaccgacagcggataagagcggtaacgccgtctacatcgcaacaatcggcgctgatatgaatgggatagcgtgggagatacgtttgccgactggcaaatctcggatcaacggtgtttcgccagctgcacagtgctcactgcggaagttttgcacgttcaatcttggtctcgacgaggacatgtcgtacatcttgcccgtcgaccctgcaggacctcaaaaaacagtatcgggatttttcgacctcttttctccggatatagcgttgtcgtataccacgcgaggtgtcattcatacctggactgccaaggtcgaccagcagagcagccaggtggagttcttgctgacctcgaccgtcgatacgggcattgagaatccgtccctcgccagtgggagctctaccaagaaggcagctcttgttgacgcggatcgcactcatctgaccatctgggatacaaacggtgcgcaactggagtttgaggaacatttcgcccagcacgatgtcattcgcgatctcgattggacatctacgccagacaagcagtcagtcttggcaattggtttcccgcataaagtcatactcctgtctcagttgcgctatgactatctcgatgctcgtccatcctggacgcagatcagagaaatctggatccgggacctgacacctcatcccatcggtgattcatgttggcttagcaacggtcaccttggaatcggcgctggaaatcagctctttgtttacgataatgagattgatgccagcgaccgcttagtttcacagctccgcataccctcccgcggcctgtcttcggttgacttgttcgaggttgttagtcgactaaacggtccgctacctgtctttcacccacagttccttgcgcaatgcatcctcagtggcaaaacaaatgtggtacattctgtcttgacgactctgcatcggaaattgaaattttacactgagggcgacgacattgatggctttttggaaaggccgctggaagacttttacgtggagcatgacattccgcagcaagcatcttccaaacatttacaggcctcgtacgccgatctggatctgagtgagacttccaatgtgatggacgaaaacgcggccgcggcattgaatgagaatctctctcgcttcgcatttccgcaactttcaagccatgagcagttccgcctagttgatacaattgaatgcgttgccacggttgaaaagcaccgacggtcaatggatgacaatgctgctcgctatcttttgttctttcgacagcacatgctaagaagaagtcagggcgtcgcgaacaaggatactgtttcatggagagagatcgtctgggcgttccatagcggcagccaagatatcctgtccgatcttgtgtcaagacagtacggcggcaagatgcaatgggcgtcggccagggaaagtggtatctttatgtggctgacagactttaatgctattgtaagcaatccccgacgtcaccggttgcaaggatga

SEQ ID NO: 14556 - DNA, 312 bp, A.fumigatus
agagctaacacagaacagcgagcgcagttagagctcgtcgcgcgcaatgagtataccaagacggaggataagaaccctgttgactgttccttgttctatatcgcgctcaagaaaaaaaatattctacagggtctgtggcggatggcaaattggcaccgcgaacaaggtgctactcaacggttacttgcgaatgacttccaagaacctcgatggaagactgtagctctgaaaaacgcttatgccctgcttgggaaacggaggtttggtatggtcttcctgcacacgccccgaattgaagtaagccttctctga

SEQ ID NO: 14557 - DNA, 282 bp, A.fumigatus
gccttctctgacattttcccagagtacgccgcagctttcttccttcttgcagaccagctgcgcgatgcggccaacgtctgtttgaacaaggtcggggatttacagcttgcaattgctattacgcgtgcgtacgaaggagacaatgggcccattttgagagaaatcctggaagagagggtcttgcccgaagccgcatctgacgggaatcgatggatggcttcgtgggccttttggatgctaggccgccgcgacatggctgtccgctcattgattgtaagatga

SEQ ID NO: 14558 - DNA, 411 bp, A.fumigatus
tcacctgttgagaccttgatcccttctacgccttcatctcctgggagccctggctcaatctcactacaagcgaagtcatttttatccaacgatcccgccttggtcgttttgtacaaacaactccgggaaaagaccctgcaaacactgaaaggggcttctcaagtgtcagcccgagcagaatgggattttatcatccgcaatgcccgcctgtacgaccgcatgggatgcgaccttcttgccctggaccttgtgcgccattgggagttcctcagcgtgcctcccccaccgaagacgttgaaagacgtcacgcacaagctgcaggaaaacggcgtcgattaccgaaagatgcttcgacgacgaagcagatcttgtggtcgcagatattcacactcgggctggcggtccaagtag

SEQ ID NO: 14559 - DNA, 393 bp, A.fumigatus
ctcgattatgaatcagccattcggcaccaggacgagccgggtgtccttcgatctcgcgactacttcaacactttgatcaaggaacagattgataagggcatcaagccctcacggattgttctgggtggcttctcccaaggagctgccatatctgtctttactggtattacctgcaaagagaagctcggcggtgtcttcggtttgtccagctatcttgttctcagtgacaagctcaagaattacattccggagaattggccgaataagaagacgcctttcttcctcgctcatggcttggaagatgaaatcgtgctgttcgacttcggtgatctgtcggcgaagaagatgaaagagatcggcttggaggatgtcactttcaaatcttatccgtga

SEQ ID NO: 14560 - DNA, 654 bp, A.fumigatus
caatcaagcacaggcggaatcacccaagagctggaaatcaagggccacaaattcgtattcgtcaatggacgactaaactccccgcctgaagctggtccgtatacaatgacaagaatttcaatctgctacaactctagtcctctaacccaaatcacagaaatcgaaggcattctggacggcccgttctactgccactacccccgcgacatttaccccggagaagacctcgcccgagcattcgagtacactctcaacatcatcgagaagcaaggcccctttgatggcgtgatgggcttctcgcagggcgccgcgcttgcatgtgctcttatagcccaccatgccaaaaccaattcgaagcctctcttcaaggttgccgtgtttatctgcggtgcgacaccgtacgaaagctctgggcttaaagagcttgtggccgaggacgggaaataccccgtcacgatcccaacgacgcacatagtgggtaggcaagatccgtattacaagggaagtatgcatctgtacggcatatgcgacccatctaaggccgttttttacgaccatggttcaaagcatcatatccctttcgaccaggcgaatactgctgccatggtatccgccattgaaaaatccctgaatcgggctttgaataacgagtag

SEQ ID NO: 14561 - DNA, 624 bp, A.fumigatus
cttggggagtggatttgcagtctggctcacaaaggttgtctagttaaggaagtatcacatagtcctcgtcggctcgatatttgcatagcattcaacagcgccctaggttcctctctcccatcaggggcgtcctcagagatcgtctctgcattcgacttggacaaagatcacgtcccacttgtcctcctcaactcagtctaccttgctgggtttgcagtaggcccattagtttttgggccgctgagcgagtatctgggccgacaacccgtgctcatcgggacgtatattggttacaccatcttcacgatggcatgtgcgctggcgcctacatatgcttctctacctgcttttaggtctttgtgcggaatacacgccgctgctcctaaagcggtgcttggtgggttgtattcagatatatacgacgaacacggggaacggggaacagctatgggtttcttcatgctcatgagaacattagggccgcagctcagccccattatatcgggctacgcggcgctgttgtcatggcggcgggtatttcgggtcgcgttggtgatagctggaggtgggatgcccgttgtcctgttgctaccggagacatacgggcctgttctggttaattga

SEQ ID NO: 14562 - DNA, 951 bp, A.fumigatus
atgattgaagcttcttgtcttttttctcccttactgcttctgatttccagcgccatatcaaataacctgatgatgaagtgtttggatccgcgcgtgactctactttccaagaacctgtttagagcaaatagctacgccatgcattcgaccacccccgtcgagagaaatccatcatccactttacgagatcgggtacacattcttgggcttgggagcatcggaacttttgttgcccattcagtctctgaaatccccaacgggccgtcggtgattctcctgctgcatcggagatctcttctcgaccactatcgccagaataggaatcagatattttttgagtcacggcatggagtccatcaaagctccaccggctatggacttgagatgacccaggacaaccagtggtatcctgtgtcagatgaatcgccgtcggattgccccatcacaagccacatatccaacctcatcatctgcgtcaaagcaacacagactgtctccgcgctgcgacccctcgtgcatcggctgaactcgacctccaacatcctctttcttcaaaatggctctggcatgattgaagaagtcgacgcgcatctcttccaggacccattaacgcgaccaaattacctcatcggtgttatctcgcatggcgttacacttaacagtcctttcaatatcacacatactggattctcggcgacgtctatcggtcctgtcccccgggatgatggaaggtacgcggccatttcagacttgcgatccaattatcttctgcaaacgctgcccttgtcaccgacacttaacctgaaatcgtacccttacaccgaaatattgcaagtgcaactcgagaaactcgcagtcaatgctttctgcaacccgctatgcgcgctcaatgatgccaaaaatgagtttctctttcagcgtcccagacacgcgacgggctatcctgactga

SEQ ID NO: 14563 - DNA, 441 bp, A.fumigatus
aatcgtacccttacaccgaaatattgcaagtgcaactcgagaaactcgcagtcaatgctttctgcaacccgctatgcgcgctcaatgatgccaaaaatgagtttctctttcagcgtcccagacacgcgacgggctatcctgactgagatctcgaatgtagtacttgccttgcctgagctgaaaggcgtgcaaggattggaagaacggttttcagtcgccaggctcgagaagacagtgaatgatattatcgccaaaaccgcgaatacgacatgctcaatggtatgggatctccgcgccggacgggagacggcgatccaatttatcaatggaagctggagtcggatgggaaaaatggttggggtggacacacctgtaaacgatgctttggttgaacagattcagatgagaggccgagaaaatctagagatgagcgaccaataa

SEQ ID NO: 14564 - DNA, 357 bp, A.fumigatus
cccagcctgtatagaatggttgtctcgctcttctggcttggctgggcctccctttcagtcgtgaacccaattgtccccatggtggccggttttttcttcgcaattggcttcctcttcttcatcgcaatgctcaactatctcaccgacgcgtaccagcagaactcagcttcggcgcaggcagcagctagtaccattcgctcaattacagcctgttctttgccgctggctacgaagagcatgtacggaaatttagggatccattgggcgaatttcgctgttgggatttgttgccttggcgatggcggtgattccgttcattttcgtcagatatggagaatcgttaaggcggaagagtaa

SEQ ID NO: 14565 - DNA, 201 bp, A.fumigatus
ttctttcctccttattgttcctcaaaccattctgttgacacccatgacaacctatatgttattctgggagataaaaactctttcacacttcaaacccgctcatcctctaccatttcctctcccttgatttcttaccttattgccaccagggaatttccctttcccacccgaacactgcatattacggtcctttttcccgcc

SEQ ID NO: 14566 - DNA, 189 bp, A.fumigatus
agcgcgtgttaccgtgacaataccgaacgtggttattttactccccacaaaactggaattaattctttcctccttattgttcctcaaaccattctgttgacacccatgacaacctatatgttattctgggagataaaaactctttcacacttcaaacccgctcatcctctaccatttcctctcccttga

SEQ ID NO: 14567 - DNA, 576 bp, A.fumigatus
tcacccgaatctgttaagttattttgtaacccggctaaccacttccaggtcgacgacgaagtcggcttcattcgcttctaccattccctctcttcggacggcaacgatgagacaatccgagtcttcgaccgcggcgattggtactccgcacatggcgccgaggccgaatttatcgctcggacggtctacaaaacgacctccgtgctccgcaacctgggtcgcagtgagactggcggcctgccttccgtgaccatgagcgtaaccgttttccggaatttcctgcgcgaagcactcttcaaactcaacaaacgggttgaaatctggggctcgaatggagcaggcagaggccagtggaagttgatgaaacaagccagtccggggaacctgcaggacgtggaagaggagctgggcagtgtgggcggacttgccatggaatcggcgccggtgattctggccgtaaagatttcagccaaggcgtctgaggcgcgaggtgtcggggtgtgtttacgcggatgcgactgtccgggaactgggcgtaagcgagttcctggacaacgatgtctattcgaactttga

SEQ ID NO: 14568 - DNA, 1578 bp, A.fumigatus
ccgtcagcgatctccattgtcagtctcgctcgacccattcacagagctatattcaatgtgaaaaccccacaccttcccctggtggtagtttactattttgcatacctaccttaccttcctattaaccacatatgctcctaccttactatcatatcttttaatcccaccattagtacaaaggaaaccgcgatgccgcgcacctcaagacaaacccgccttccccgagggcaggttggtattcagagctttgcaagagcaactaaaccaagctgctcaacgctgcaagacaccaaaaagcctgctgctgcacagctccccgtctcgccttccaagaaaagaaaactcaatgagctcgaaaacgtcgactgcgccacaggagagccccgccagacaaccattccggaagaagctggcacgccttccaaaaccctccgcttcagtcaactgtgtgtctcgacgccccggagcggtcactatgcgtgttcaaagactgaggcgtcgcctgcgcctgcgccgccctcctccccttcgaagcgtgggggtgccagagtcaaacgctctaacagtctgatagtcgtggagcgtccggcttgtgtggaggaattcttgagtctgcattcggcttttctgaaggcgctggcgattcactctgcgcataatggggcaacgaccgcggcggatttgcgggaattccttcaagcggtcgagcggatgtggaagaagcggaaggttgtggttaaggatctacagcggttgatatgggcttgggagcagggagatgagggcaatggcccaaggtaccggcttgcgaattacgggcttgggaaggtgtgtttggaacgggcgcctgtcaatagagaacggttggaccggttcgatgaaaaggagttacaagaccgattcgagcgggtggtggacctgctgtgggagaaggctgtggacgcggctgatggggatgagagccaggtggatttcttcgagacgctgggcgtctcacccgttcacgagtctctgactcccttcactacgtttcgaaagggccagcagcggctgcaggatttgaagggtggagtgatcaagctgaagactgagaagctgcgagcggactcgcagcctgaaaccccggccaagccgctggacgcgacgaccacgcgtcggaaggggcttctggagcggattaagagcaaggaactccttcagtcgaagttgccgccgccgccgtcgaaggaaacgctgcttcggcgcgctgctgctgaacgcgcagaggaagtcgtcgccgttctggctctgcttcggcctgtagggtatgtgggcagcgggccgaaagctgttctggctgcccagaagaaaccgttccagttggagatgattgtgcagaacgttcaggactctctacggaacccaatatcatcaagggaggtggaaatgtgtgtggaacttttggctcgaccagacattgctggacaatggattgaagtcgttgccgtgaatcaaattaagtcggtggtgctgaagtcttgtgccagcgtttatcccaaggagatcggtgcgaaggtcagcaagttggaattggattag

SEQ ID NO: 14569 - DNA, 207 bp, A.fumigatus
atgatggttcttcatatgaccctccgatctctttctttttggatgttttgtgtcgttttcgataccactggagcaaacctgcatgtccggcattactttgcattatcaggaagcatcatgtacattagcgctgcatttattacctacatatacatcctcaagtccactacgataatggaaaacatcaattcagggcaaaactgttga

SEQ ID NO: 14570 - DNA, 318 bp, A.fumigatus
  unsure (159),(173),(186),(208),(214),(237),(272),(274),(284),(288),(302),(305),(311): Identity of nucleotide sequences at the above locations are unknown.
agatttcagccaaggcgtctgaggcgcgaggtgtcggggtgtgtttacgcggatgcgactgtccgggaactgggcgtaagcgagttcctggacaacgatgtctattcgaactttgagtcgttgattattcagcttggcgttaaaaagtgcctggtgcanatggatacaaatangaaagatgtgganctggggaagattctggctatcnccgacnactgtgggatcgctatctccganaagaccgtggcggacttcgggggtgaaggatatcnancaggttctcnctcngctgctcagggacnaancgttcngcggcca

SEQ ID NO: 14571 - DNA, 363 bp, A.fumigatus
  unsure (315): Identity of nucleotide sequences at the above locations are unknown.
caaaacgttatgtctctaatagatccatctcgaacaacaacaccccgtatgaggcagcccacgattccaacgggcttgaaacttggcagcttttcagtcttcaacgccagctctggaaccgctctcgccgatgtcactccggaagatgacagtattcatgtttactacgacggttctaacgatagtatcctggggaaagtcgatgattctaactcaggttggtatgacagcgccttctcccagtcgggcatgaccggaagccaggttgccgctattatctgggtactgacagccggttggatatacgtatgtctntccagtagccataatttgtgccagcggtgtcggagtattagtatgtga

SEQ ID NO: 14572 - DNA, 747 bp, A.fumigatus
cttcagtgcaagtctgtcgtaaacaaggcgagaaccaagccacacctcaaggtcatgtgcggcttctctcgacgatttgacgagtcctaccgtgacgtatacgacaagatcagccaaggactcatcggaaaaccttcaatcctccgcagccagacctgtgataagtatgatccttcgggattttatgttgcatactctgcgtggtcggggggtgtcttcgtggacatgtccgtgcacgacatcgacctcactctgtggttcttcggtgatgacgtggtccccaagactatctctgcatatggaattaccgctgtgcaaccggagctgaagaagttcaacgactatgacaatgctgtggggattgttgaattccacaacggcaagatagcatactactattgctctcgcatgatggcgcatggccaagaagacaccacagaaatcattggcaccgagggcaagttgtctgtgaactccaacccgcagcggaacctggtgaacttctaccattcgggaggtattactcgtgaggctccctccaatttcataggtcgcttcggacctgcgttcgtgacggaggccaatgaatttaccgccgcatgcttggataacacgccactcccgatgaagctaagtaacgccgtcaaagctgttgagattggtgcatacctccaggaggctttggttacaggcaagcagattcactttgacgagattggaaggcgggtggagagagcccagatttga

SEQ ID NO: 14573 - DNA, 447 bp, A.fumigatus
attctcataccgatatataatatattccctacgtgcttgcaatacttcaaacctgataactccacgcagccagacatcgtcgacgggatgcatctctatagtatcacaccttggctactcacctcgctctgtaccctggtgtctccgctttacacagacacaggccaacgggggcgcgtcattcaccagccagccctgcctccctcatacccgctggcagtaagaaatccatatctgtcagcatggttgcccagccaccgggtacagatcctaccgtatgccgagccacagttctgggccggccaggaccttggctggtccatcatggtgcgtgttgatgatcagacttatagtttgatgggcgtgaaggaccctgggaacgacgtccaaccggctgttgtgcagggcgcggagtatacggcgactcattcggtgttcactgctagt

SEQ ID NO: 14574 - DNA, 906 bp, A.fumigatus
gtggcttggatctattgctcggatagggctgtggtgctgattctgaaacggagtagagtgtctgcggcacctagttctgctggctccaagtcctgcgatacggtagacctcgggtaccagtgctcccctgcgacttctcatctatggggccagtactcgccattcttttcgctcgaggacgagctgtccgtgtcgagtaagcttcccaaggattgccggatcaccttggtacaggtgctatcgcgccatggagcgcggtacccaaccagctccaagagcaaaaagtataagaagcttgtgacggcgatccaggccaatgccaccgacttcaagggcaagtttgcctttttgaagacgtacaactatactctgggtgcggatgacctcactccctttggggagcagcagctggtgaactcgggcatcaagttctaccagaggtacaaggctctggcgcgcagtgtggtgccgtttattcgcgcctcaggctcggaccgggttattgcttcgggagagaagttcatcgaggggttccagcaggcgaagctggctgatcctggcgcgacgaaccgcgccgctccggcgattagtgtgattattccggagagcgagacgttcaacaatacgctggaccacggtgtgtgcacgaagtttgaggcgagtcagctgggagatgaggttgcggccaatttcactgcgctctttgcacccgacatccgagctcgcgccgagaagcatcttcctggcgtgacgctgacagacgaggacgttgtcagtctaatggacatgtgttcgtttgatacggtagcgcgcaccagcgacgcaagtcagctgtcaccgttctgtcaactcttcactcacaatgagtggaagaagtacaactaccttcagtccttgggcaagtag

SEQ ID NO: 14575 - DNA, 231 bp, A.fumigatus
tacggctacggcgcaggcaaccctctgggaccggctcaggggatagggttcaccaacgagctgattgcccggttgactcgttcgccagtgcaggaccacaccagcactaactcgactctagtctccaacccggccaccttccccgttgaacgctaccatgtacgtcgacttttcacacgacaacagcatggtttccatcttctttgcattgggcctgtacaacggcactga

SEQ ID NO: 14576 - DNA, 378 bp, A.fumigatus
  unsure (114): Identity of nucleotide sequences at the above locations are unknown.
tctccaacccggccaccttccccgttgaacgctaccatgtacgtcgacttttcacacgacaacagcatggtttccatcttctttgcattgggcctgtacaacggcactgaaccnttgtcccggacctcggtggaaagcgccaaggaattggatgggtattctgcatcctgggtggtgcctttcggcgcgcgagcctacttcgagacgatgcaatgcaagtcggaaaaggagcctcttgttcgcgctttgattaatgaccgggttgtgccactgcatggctgcgatgtggacaagctggggcgatgcaagctgaatgactttgtcaagggattgagttgggccagatctgggggcaactggggagagtgctttagttga

SEQ ID NO: 14577 - DNA, 600 bp, A.fumigatus
aatggcatccatgtattcccttgcaatgatctcctttccacgggcgcactgctaaggtctaatagggctccaatatccggtggccaatatcactgggtatccgaatttgcacctcccagttgccagtgcatattgagctacataaccggctgggtctgtgtgcttggatggcacactggaattgccggatgttgctatacagtcgccaacatgatggttggagtggtcgccatcaattaccctgatacctacgtctataagccatggcatgtcacactactggtcattgcagtagcgctggttgcgttgttgttcaacaccttgctggcgcaggaactgcccttgattgagggcattatcttggttatccattgctttgggttctttggcattttgattcccctttgggtgctttcgccgagaccgaccgcatcagaagtctctggacccatccaagatcgaggcggctggggaaataacggtctggcttgtctggttgggttggtcggatcgatttatgccttgatcggtgcgttcaagtatcccaagacacgcgaagtgtgtcatctgctgacgataagtacaattcaaaggccctga

SEQ ID NO: 14578 - DNA, 615 bp, A.fumigatus
tgggatgactgtggtcatcatggccatgcagttctgcgcagccatcagcaacgttgccaccacatctcgccaggtctatgcttttgcacgagacaatgggcttccattctcgaatttttggtcaacggtcggtgttttcctcagcgagtggtggatggcgttgatgactactcgcaggttaacccgactttcatcgtccctttgaatgcgttatgcatgagcttggccattgtctctcttctttccctgaccaatattggatcgtccgtggctttcaatgccatcatgtctctaggcacggcagctctccattcctcatacatcatctccatcgcctgcgttcgcctgcgtcgatggcacaatcagcctctgcctcccgcccgctggagaatggggagattcactccctttgtcgacaccgtctctattctggttctgatcatcatatgggtctttagcttcttccctctaaccgagaaggtcgattcaacaacgatgaattggagcgtcgtgatattcggaggcgtcattctgctctctctggtgtattaccaattacatgcgaaaagggtatataaagggccggtgacaagagtgaatatgatggccggatga

SEQ ID NO: 14579 - DNA, 249 bp, A.fumigatus
  unsure (103): Identity of nucleotide sequences at the above locations are unknown.
aagtatgtccatgtgactctcctcaaatggctggtttggctcatctacaatgatagtgtgacctccggaggccagtgtgctctagatgcatccgattccctanagagtgtaggtatgactccagctttgttgctgttcggagtcactgtaggaaatcatctccagtgcgtggcaagccgagaaacccatcaccagccaaaaggagcgtcataccactccgagcatcgctcaatcctttggcatgtctga

SEQ ID NO: 14580 - DNA, 204 bp, A.fumigatus
gacgggagaaaacacaagcatgacccctgcaaggcccagcttgataggatgacgagcactataccgttccttagcacaattgactgccgggagaacttctgcactatggtggtcaatcaattctgcaccgacacttgttttctattctctcttttcaacatgcacaactacaattcgcggttcttttgtttgttggtcgactag

SEQ ID NO: 14581 - DNA, 417 bp, A.fumigatus
tgtgatgaattagctgaagagatccgtgacgcatcacgagtcctcccccttggcagattctggacacttatcctcaacggatgtacaggcttggtcaggatcattaccatcgctttgtgcgttggggatattgaccatgtggtggaatcccagacaggtttggcattgatccaagtcttcctcaactcgacaggatccgtcagagccgctagtgggatgactgtggtcatcatggccatgcagttctgcgcagccatcagcaacgttgccaccacatctcgccaggtctatgcttttgcacgagacaatgggcttccattctcgaatttttggtcaacggtcggtgttttcctcagcgagtggtggatggcgttgatgactactcgcaggttaacccgactttcatcgtccctttga

SEQ ID NO: 14582 - DNA, 1356 bp, A.fumigatus
  unsure (47): Identity of nucleotide sequences at the above locations are unknown.
tgtgacctccggaggccagtgtgctctagatgcatccgattccctanagagtgtaggtatgactccagctttgttgctgttcggagtcactgtaggaaatcatctccagtgcgtggcaagccgagaaacccatcaccagccaaaaggagcgtcataccactccgagcatcgctcaatcctttggcatgtctgacatctcccgactctcactttctcatgcatcactttgttactcagacaattcgggttcttttccctcttgccccgcctgtctttggccagactttggtggccactgcgatggagacgccgcatcttctgcacgcacttctcgcagcctcgtgcagtcattacgctcggcttgtccagaagccttcagctcatcaactgacagtcttgaaatttaccaacctcgcagttacgggtcttcgtgctgcactggctgatcctaccgagactctcaggcctgaaaccgccatgacagcgatggtattatgtaccaatgatgtgtgtaatggcaatgctcgaacttggaaggtccatttgtctggggtaacgcaattactcacggccttgcttgcgaggcagaagacagctgacggtgatcctgacccgttttttctgtgtcttctcaagtggttcgctgctctcgacatcctggcgggtctctcaggcacacatgaaggatgtgtcaacgatgggcagtactggaacctgactcggaaccccaattgcggcaatggccacgttgatgagatctgtggctactcaactcagctaatgcctttgctggcgcgaatcggacagttggcgcggcggaacgtgcatgagcagtcaatattcgaaacctatactgaaccatcctctgccctttccgaggaattgacgcatgatgcgcaggatctggagacgagaatactctccattgccaaccaggtcccgtcggctgccacgctcgcctttcatgatcaagtactcgcatccgaactgcacaatacacacctcgcctttatccactccgcacttttacatctctatcgccgggtcgaactgctaccaaagagtcatcccaaggtcagggcgcaggttacggccattctctacaacgttcaggccatcaaaccattctctcctgccaatgccctcatcctgtggcctatttttagcgccggttgtgagaccgatgatcttcagggacgtcaggctatccaaacaaggatggcgaatatgcagacaatgggcctggggaactttactagagcaagggacgctcttgctcgttattgggagtcaggcgcatcctcgcgctgggacgtctactttgcacagtctgggctggaactagttctcttttga

SEQ ID NO: 14583 - DNA, 237 bp, A.fumigatus
atcagtggccatctcgttctaggtgcgtcctttgcagagaattttcagtctaagaaggccgatgactcaactacctctctggaatatgaaccgcatattccaacccctgttaggctgtttgataaagacagctcaaggttgggccgcacgtcccaagaagccaacactgcccatcgtatgacactcatcctcgagaagggctattgttcttgcactggccgaataatattaatgtct

SEQ ID NO: 14584 - DNA, 927 bp, A.fumigatus
agaagagaacttcgacaaaccgcacgccctgcagctcttccagaacccctcgatgcgggccagccatctgaagctcacccttctcgagacagacgaagaagcctactcgaaagcgcagtggcttgccagctgcgagcccagcccctcgctctttttccattgtctggtcgacctttgcgccatcacccaggccgtcatcaacaaggtttacagtatccaaggtctccgcgacacagccagccaactcgaacagcgcgtccgcaaatactccgcaaaactggacgcctggatggcccagctaccccccgtctaccgcttcacctcacagccacatccacacgatactctgcaccttcccgacgacggctttatgcgcgaacgcgtctgcctcgcgatcgcctactacagcgctcgcatcaccatcagccgaccctgtctcagccgttcaaaccccaagtcctccaaagaatcctcctccccttccgcctccccagacgcacccaatccaaaatctacctcccgctcaatgtccaccactaccactaccaccaacgaacccagctgcgggcccaacgacagcagcggcaacaccagcggcaccacaaacaacaacaccaccggcagcaaccgccgcacaagcctctccgcctcctgtctccgcgccgcctgcaccctcatctccatcctccccgagacccccgaccccgcctggctcctccgcttctccccctggtggagcatcctccactacctagtgcaagctaccaccgcccttttgctgggtttggcgtcgtctaccccccttcccgagaccgccgcccccgacaccgcggccgtcatccgctgcaccaagaagtccctccgctggctgcatgctatgggggcggtttatgccgcgagtcggagggcgttcatcctttgcgatag

SEQ ID NO: 14585 - DNA, 2625 bp, A.fumigatus
agcctgtctctcgatgtatctgcatctgccatggaagacttctccgatgtctatcaatctaccgaactgaatccatctgccgagagtaacagcgtcagcttcgaacccgaccagcctgttccgaacggtctcccgtccgctttacactggcaaggcttgtccttgagccctggcacacctcaatctggctactatctatatcccaatcaatacgacaggcctgcgtttccgcaccagtcctccacctcatcctcgggaagagatgggactgctgcaggggtgggcccgggtgtggctaaggtagcgatcccccgagctgcgccgtacagcatccattcgcagcgtcgccggtcggcgcgagcctgcgagccttgcagacagcgcaagatcaagtgcgacggcaacaagcctgtttgtcgacaatgtcacgagcaccatgtcacctgttcctatctggaagtgaagcgggtgcgcgatcagaagcagttggagatcttgtcgcaccaagtcaaagcgtacgagagtttactgcgggatttggagatggaggtggacgcgaacgctgcgcgacgcattaggaggactctcaagacttccagccgcggcgacaaagaggacggtgcgctatcggacagctccagctcgtcggccgggtcgctcaacgccatcgacctggtcgaagaggacctgaaccgcagccacaggacgcgagcgtccgggtactttgggaaaaactccgaggtgtcctggatgcagaagctggaggacgaagctgagaaccgtagtcgcatgttcgacgggaatttcgagactccgggtctcgaagagcaacaacacctgcagcagaagaacgatgtctccatcgcgacgatgagttaccacctcgatgatctgagtatcccgcttatggacgatgtcgacccgtatgacctgccgccgaaggagctcgcggaccggttcttcgcggcgtacatggagtcggtgcatccggggttcgaggtgattaggaagaccatctttgcgacccagtaccggcagtttttcagtcagccgtccaagccgccgcgacgatggctggcgatcttgaatatgacctttgccttgggttgccggtattgtctcttgttgaacgataccgccaatatcggaaacgatgaggactgggacgacctcgtctactttaaccgcgctcggaaactgtgtctgggcgagaccgcgctctttgatcataccgatctacagcagatccaggtggagatattagtggccctgtacctgctgaccttgggccaaatcaaccgggcctccaactttgccagcatggccttccgctccgcgctgtcgctgggaatcaacctgcggtttgaggacgaccgaacgcaccacgcgtccaaggaagcccgcagccggctgtggtggtccatctacgtggttgagcatctcctgacagccacgacaggacgcgcttcctgcgtcagcgaaagcctcagcgccgcaccgctccccgttccctttgaagaagagaacttcgacaaaccgcacgccctgcagctcttccagaacccctcgatgcgggccagccatctgaagctcacccttctcgagacagacgaagaagcctactcgaaagcgcagtggcttgccagctgcgagcccagcccctcgctctttttccattgtctggtcgacctttgcgccatcacccaggccgtcatcaacaaggtttacagtatccaaggtctccgcgacacagccagccaactcgaacagcgcgtccgcaaatactccgcaaaactggacgcctggatggcccagctaccccccgtctaccgcttcacctcacagccacatccacacgatactctgcaccttcccgacgacggctttatgcgcgaacgcgtctgcctcgcgatcgcctactacagcgctcgcatcaccatcagccgaccctgtctcagccgttcaaaccccaagtcctccaaagaatcctcctccccttccgcctccccagacgcacccaatccaaaatctacctcccgctcaatgtccaccactaccactaccaccaacgaacccagctgcgggcccaacgacagcagcggcaacaccagcggcaccacaaacaacaacaccaccggcagcaaccgccgcacaagcctctccgcctcctgtctccgcgccgcctgcaccctcatctccatcctccccgagacccccgaccccgcctggctcctccgcttctccccctggtggagcatcctccactacctagtgcaagctaccaccgcccttttgctgggtttggcgtcgtctaccccccttcccgagaccgccgcccccgacaccgcggccgtcatccgctgcaccaagaagtccctccgctggctgcatgctatgggggcggtttatgccgcgagtcggagggcgttcatcctttgcgatagcttcataaggaggattgcgcccagtttgggtgttgacgtgggcgatctgcccgatgtggcgcagttgcctgccttgtctacgccgaatcctgccaatgcgactactccgagttttacttttatgccgggtggcaatggtaatggaaatggaggagaggcgtcggatgccgcgtggggttga

SEQ ID NO: 14586 - DNA, 684 bp, A.fumigatus
agctcacccttctcgagacagacgaagaagcctactcgaaagcgcagtggcttgccagctgcgagcccagcccctcgctctttttccattgtctggtcgacctttgcgccatcacccaggccgtcatcaacaaggtttacagtatccaaggtctccgcgacacagccagccaactcgaacagcgcgtccgcaaatactccgcaaaactggacgcctggatggcccagctaccccccgtctaccgcttcacctcacagccacatccacacgatactctgcaccttcccgacgacggctttatgcgcgaacgcgtctgcctcgcgatcgcctactacagcgctcgcatcaccatcagccgaccctgtctcagccgttcaaaccccaagtcctccaaagaatcctcctccccttccgcctccccagacgcacccaatccaaaatctacctcccgctcaatgtccaccactaccactaccaccaacgaacccagctgcgggcccaacgacagcagcggcaacaccagcggcaccacaaacaacaacaccaccggcagcaaccgccgcacaagcctctccgcctcctgtctccgcgccgcctgcaccctcatctccatcctccccgagacccccgaccccgcctggctcctccgcttctccccctggtggagcatcctccactacctag

SEQ ID NO: 14587 - DNA, 453 bp, A.fumigatus
atacatgttcactgcctcaggaggcccgacaaagaaagtctggaaaagatcccgtgcccacgcaattgtgtgttcgattctgttggggaagctcttcaatgtgcacatcgggaacgacttttctgggggatcctgagagctcgagtaggattcggtgatatggggcagaatgacctgagtgttgcctttcgtaccaagggtaccgctttcaagaagaggtttgcggaagaaaacacagcgacgatcaacataagttcttgcgtcaacgttgtccaaagcgttggtcacgccatcaagagcttcccaaaattcctcgttgaaaatgtgttcggtgtcgggtcctactcggtctcggagtgtcacgattttacctttcaggtccgggttcattgcctgtgccgcagcagaagcgcattcacttttgagcttcccaacatctttagaacgaaataa

SEQ ID NO: 14588 - DNA, 2454 bp, A.fumigatus
  unsure (1926): Identity of nucleotide sequences at the above locations are unknown.
aacccatccatgggattcgtttccaccattgaccaagaaggcctggtttcttgcggtggaccaaactcgccatgccttgaagatggggattacgtgacatttactgaagtccagggtatgaaagggctgaacaactgcgacccacggaagatcactgtcaagggtccttatacattctcaattggggatgtctcgggccttggcacgtatcaaggcggtggtatcttcacgcaggttaagatgcctaagttcgtcgatttcgagccattcagcgaacagctcaagaagcctgagctcatggtctctgactttgccaagttcgaccggctacagcagctacacatcggagttcaggcgctccacaagttcgccgaagctcacgatggtcaatacccgcggcctcacaatgacgatgatgcccaggaagtgattaagattgcgaatgaacttgcatcaagccaagaagagaaggtggagttggacgagaaaattattagagagttgagctaccaggctcgcggagatctcaaccccttggccgctttctttggaggtgttgcagctcaggaagttctaaaggccgtctctggaaagttcaatcccattcatcaatggctctacctcgactccttggagtcgctgccgacgtctgtcacccggtccgaagagagctgcaagccacttggcactcgctacgatgggcaaatagctgtcttcggcaaggaattccaagacaagatcgccaatctcactcagttccttgttggtgcgggagctattgggtgcgagactttgaagaattgggccatgatgggtcttggaactggtcctaagggcaagatcttcgtcaccgacatggatcagatcgaaaggagcaacctcaacagacaattcttatttcgttctaaagatgttgggaagctcaaaagtgaatgcgcttctgctgcggcacaggcaatgaacccggacctgaaaggtaaaatcgtgacactccgagaccgagtaggacccgacaccgaacacattttcaacgaggaattttgggaagctcttgatggcgtgaccaacgctttggacaacgttgacgcaagaacttatgttgatcgtcgctgtgttttcttccgcaaacctcttcttgaaagcggtacccttggtacgaaaggcaacactcaggtcattctgccccatatcaccgaatcctactcgagctctcaggatcccccagaaaagtcgttcccgatgtgcacattgaagagcttccccaacagaatcgaacacacaattgcgtgggcacgggatcttttccagactttctttgtcgggcctcctgaggcagtgaacatgtatctatcccagccgaattacattgagcagacgctcaagcaggctggaaatgagaagcaaactttggagcacctccgggactttttagtaaccaacaagcctacttcgtttgatgattgcattatctgggcgcgccagcagtttgaggctcagtacaacaatgcaattcaacaacttctctacaacttccctcgggactccaagacctcgtccggtcaacctttttggtctgggccgaagcgggccccaacacctctcaagttcgatagctcgaacccaactcacctagcattcatcgttgctggcgcgaatctccacgcctttaactatggaatcaagaaccctggggtagacaaagagtactacagaaaggttgtggacaacatgatcattcctgaatttgtaccaagatccggcgtcaagattcaggcggatgagaatgagcctgatccgaatgctcagcagtcttcgtcccttgatgacagtcaagaaattcagcgtctcgttgagtctctgcctcctcccgaatccctcggcggattccgcttgaatcccgttgaattccagaaggatgacgatacnaaccaccacatcgacttcatcaccgccgctagcaatctccgcgcggacaactatgatatgccccaggccgaccgccacaaaaccaagttcattgccggtaagattattccggccattgccacgactaccgcattggtaacaggcttggttgctctggagctgtacaagatcatcgatggcaaggatgatattgagcaatacaagaacggcttcgtgaacctcgctctcccgttctttggcttcagtgagcccatagccagtccaaagggcaagtacttgggcaagcaaggtgaggtgaccattgatcgactctgggaccgttttgaactcgacgacattcctctacaagacttcctcaagcatttctccgacctgggcttggagattagcatggtcagctccggcgtcagtcttctgtatgccagtttttacggcccatctaaggtcaaagaccgacttcctatgaagtatgtattaccctttacacatcgctcccgagtatcgactaacgttatttgcttaggatga

SEQ ID NO: 14589 - DNA, 294 bp, A.fumigatus
gctctgtcgcacactatggccgaggacacccctgctgactccaggaccgaagttggcgaggcgcctgtcgagcgcgctccttctgctgtggccaaaactgcgcccgtggaatcagctccggaggcgtccaaggagcaagagacagagaaggtcaatggcacccaggaaaagccatcaggtaagaatttttcagtaccattgttgtgtgacctgcactcttccccgtttttctttttttctttttttgggaaggggcagggtgtcgctcagtttcgcttttcatctgagacttga

SEQ ID NO: 14590 - DNA, 525 bp, A.fumigatus
gagaactttccctgtgatgttcctggaaacaaacgagttgtaagtatcatgtcgggcttgtctatatccatggagtgggcggctaatgcgaaacacagcgcttggattcccaacacagacctgactccgctcgatcccgcctcgtgcagagacgtaccagagaagggcaaatcaaaacaacttcttgctgcttatgccgtagccgcggaaggtcatgacttgcaatactttaaggagctgctggctgatcatcagcgcgcattgcagcaggagttggaagagcaggaggcccaacaggccgccaaggaagcggccaaggctgaaagggaagccaagaagaacaagcggaagagcatggacattgtggacgacttggaggatattgacatggaagatgcgggcgagcccaagaagccgaagagctcgaagaagcgtaagaaggacgcagaaaccgatggcgaagccgaaaaggtaaattatgactctccaatactcgttgtcacttttacactgtcgtcggactaa

SEQ ID NO: 14591 - DNA, 600 bp, A.fumigatus
cttaaacgattagttctgtttgttcgccatagacttcagaagggcttcatttcgcgtgatcagcctcccaaggaggaggagatgactaccatgtctaactactttacgagacttgagagggttgctgatgatctcgaggtctcgatcatccgtgcgaccaaaatcaacaaggtcctcaaaatgatcgtgaagcttaattctattccccgagatgaggagtttcagttccgtcgccgtgctatcaacatcttgtccaagtggaagaatgtgctcgatgccgataccacgacaacaccggccgaaccaaaggctaacggagctcataaagaggacagcgttgaaacaccagcaaagactgaaaccgaaggagagaaagaggaagaagagatcaaggcagccaagcaagattcagcggaaccacaggatgagtcaatggttgacgctgacgctgctttggagaaggcagaagctcctgaaccagccaaggaagcttccgaaaaagaagcccacaaaattgaagaggccaccggtgccaatgtgaccgaggagaaaccggcggaagagaaggcagaagagaaagctgtcgaagcagcagcgtga

SEQ ID NO: 14592 - DNA, 267 bp, A.fumigatus
cctgctaaaacacccaagactgccaccaagttgaagttgacaacccccaagactccgacaagcgagactgagaagaaggccactggcgcaagcaagtctaaacagacagcgagcagcaagaaggctggcaaaggtggtgtcagtgacgagggcgaggaggacactggcgcggcgccgaaggagccagaaaagcaagtcgaccagggggaagccaaggaaagaaaacagaaagaaggtagggtcgacctatccgaaaacccgtcatga

SEQ ID NO: 14593 - DNA, 228 bp, A.fumigatus
  unsure (200): Identity of nucleotide sequences at the above locations are unknown.
ttatggcttcactgtccatcaggcgaggctagtgtctctgaagagaaaaaggaatcgactgatacttcggccgaaaagtccaaggcacctgcagaggctgctgacgcgaaggaaccggaagcgaccgccgcggcgccggcagaatccgaggctcaagaagctcctccatcttccaaaaaatctggaagctcgaagcgcanatccgctagcggtgttcccggaacataa

SEQ ID NO: 14594 - DNA, 243 bp, A.fumigatus
gttttggcattcttgctcactttccgtctggctggaattcctactgatatctcctatgtgccttttccgccgccgatcgatgagtggagactggaatactcaaaaagccttcgaaccccttttcttacgaagggtgtcttgtctcttattattgtctctgtctatcgcatgtctatctttcatatttcacagatcaatgacactgggtcttcacccggggctggaaggaaacgcgttcacaga

SEQ ID NO: 14595 - DNA, 465 bp, A.fumigatus
gtattccagtctccactcatcgatcggcggcggaaaaggcacataggagatatcagtaggaattccagccagacggaaagtgagcaagaatgccaaaacttaagtaacaggcgcattattgtaagcgtaagaggtacaaagagagaaatcagtgaaggcatacggacaaccatatgtgcctatgttcacgctgctgcttcgacagctttctcttctgccttctcttccgccggtttctcctcggtcacattggcaccggtggcctcttcaattttgtgggcttctttttcggaagcttccttggctggttcaggagcttctgccttctccaaagcagcgtcagcgtcaaccattgactcatcctgtggttccgctgaatcttgcttggctgccttgatctcttcttcctctttctctccttcggtttcagtctttgctggtgtttcaacgctgtcctctttatga

SEQ ID NO: 14596 - DNA, 1932 bp, A.fumigatus
gttgtggattccgatgaagatcagaacaactctgcacaattactgaaacccccaacgtcaagagcaaaagccggtcccagagatccgccaaatcctgtcgctcagtcgttgaagctcttccctgacacaatgcctcctcgtagttcaagcaagggagcttggcgcatccccaacaatcgaataagaggcaaaaatgcgccaatttctgccaaattctccgacagtcagcagattcctgcaactgtcgcttcgaaaagagagacagacaacgtcaaaaactcgataaaaggtacctcggaatgccagggcgatcctcaaaggtcataccactcaggcaaggcgtcgacaacgcggccaaggaaaccctgtagcgaaccggcaatgagtccaatacatccagaatttccgcggttgaagaatacacgtcgccctgcatcgttaccaatgggcaccatagactcattccctctgccagctcccttgagacctctaccatcactgcccgaacagcctcctgctctcagcactgttcgccaccataacaccccggtcatcaaagcagcaactcggacgaatcgcgaccactcgggcgcctttccaaccaccacatccaataaccgctcagacgctgaacactgccacttgaatacacaatttgcgctccctcagttgagcttggttggggacgacttgcccgccagcgagcagggtaagtctgtcgaggaggcaccgcccaatcatccggagtcttctgggaaagcggaagaaaatcaggcggagaggttgcattcactcaagttcagagacatgatggcaagccgtatcagcctcgacgaggcgagaaagggcgatggaatcaattcgccggcatctccaatgagctccgggtccgaccatgaattgcgaattggctacgagaacgaacatcttgtacgcacatcagtccaaaaggaagcaactccacctgctcctctgtctcctcccctttccccacctcccgctccaccacttgtgaagtctgccgaacaactgccgttcagcaggcggcatgtcagctcggccacagctatcatgagagcatcgacagagaggagagagccatctcttcccgcttccgaccgaagcgctacggtgcaccgaagtaagaggacgcggagcattgatgtccttcacgaattggtggctagtgaacagcacacttcgaaccgagccgggtctccgctcccttcttcggatgatgagtgcatggataagggtacatttatgtgtgagctacgccaagactccaaccgatatcaacggaaggtagcctcaagaaagtcgagcaatcattgtctgagccgacagcgtggtccaaggaagtccagtatcccagatcagagcggccccttgacgccgcgaaggcaaagaagccgcatttcggaggagacactctcatcattgctaggctcatcgagtccgtaccattctcacgaccctcgcgataggcgtgacaaagctgcccacactctcgtccttctagaagggcgcattgaacagctggagcgccagaaccggatccttcaggcggcccttttcgcagctttggatttgggtgtcaagcccaatgcggaagccctgcttgggggttcaacgacatcgctgtccgcctccgcaaattcttcaagtgcggagacgtcttccccatcctcgactcaacgagcttccaaactacctggtcgcgcagtagcaaatggaagacgatcactcatgaagaaatcccttcgtcgcccggaaagttggattgacagccctggcgccagtctgcagagcgattatcaaagtgatgacgatgtcagtgtccgagaccttgaggaaatgattgaagacattgaatttacttgctcatcggataagccaggttccgatagggtgcggattggtcgcgattaa

SEQ ID NO: 14597 - DNA, 243 bp, A.fumigatus
catctggcaatgtcaccaaaggcccgcgtgctcttagttggagcgggaggaattgggaccattgccgcactcaatcttgagcgcggaggactggccgaagtcacctgtgtcttgcggtctaactatgaagccgtcagaagccggggaattgaaattatctcgtgcgagcacggtcatataaagaattggcggccgactgcaggtttgcaatcttccttgtacggaatggtatgccgtggctaa

SEQ ID NO: 14598 - DNA, 867 bp, A.fumigatus
  unsure (664),(849): Identity of nucleotide sequences at the above locations are unknown.
cggagcactctagttctgaatgtgattcctcgcgtctgtagcgaggaccatagtaccctcttcgactatattgtctgcaccaccaagaacatcccaggcgtcacaccctcgatatgcgagactattgcccctgcagtgaggccaggccatacagtgattgtccttatccagaatggactaaacatcgaaaagccattcctgtcgcgtttcccgcagaacgtcattctctcgggggtgagccgatgcgacgctcatgaaatcgcccacggagtgatcgaacagaaagaggacgatgacctgcacattgccgcctttcacaacccgcttcttgaccaaagaacccagcaaaaagccgcagagcggtttgtgcagatctacggtgccggaagcaaaaccaacgtgcgacatgagccaaactgggagcgagatcgctggagcaagctggtgtacaatgcccacttgaaacccatctgcgcgctgacggggtcaatacaggagatctccagattgcggggagtgctctcgatcgcctggttatttcttgctatgcaggaggtggtgaaaattatccaaggctgtgggggtggaacctacctgacgatatcattgagacgacgattcgtaagaatccggtggagaggaagattgctcatagcatgcaaanagacatggaaaaggtatgtgcacacttatttctccataactttgggactcataattagcagggcaatctacttgagcatgaaaatctcatcggcgaggtggtccgcgaagctcagaaacaaggtgttgccatacctgtcctgtctgttctgtacgagctctgctctgctattcaatggcgggtgnccaaggagagaggcatga

SEQ ID NO: 14599 - DNA, 1293 bp, A.fumigatus
tcggccatcagtctatataaatgtccgttcctcggacaaacaaaatatctacaacaccatacagaagaccaactgaatccaaaatgtcctcgacagcaaataagaccaaaccttcatccccatcttcttcaagtccccggggacccaaaaaagtccctcacacaaaacaaagcatggatatatggcaaaaaaggcttcgacaaagcctgggacgccctcgataaagtcggcgcccccgtcaaccggctaagcaacaaactcggctccgaagccttctggcccatgacgctcgacaaagaaagcgaaaaggccgctcgcatcctgcacagtttctgcaaggaaggggtgtacgttgccaacgatgcgaccgtagcaacccgggaacagacccctgacaagaagattgacaaaccacggggtaaacccaaggttctgcagaagattcctgcggaggtgatccgccaggcgaaggggattgccatcttcacggccatgaggacggggttgtggtttagcggtgctggtgggagtgggatcctcgtcgctcgcctgcccgagacgggggaatggagtgcaccgtccgggatattgctgcatacggctggtgttggcttcctggctggcattgacatctacgactgtgtcatggtcatcaacacgtacgaggcactggaagcgttcaccaaagtgcgagtgacgctgggaagcgagatctccgtcgcggcggggccggttggcatgggaggggtgctggagtcggaagtgcacaagcgacaggctcccatttggtcgtacgtcaagagtcgcggcttctacgcgggggcacagattgacgggacgattctcattgagcgcaatgacgagaatgagcggttttatgggcgcaaggtgactgtcaaggagatcatggccgctcacgtccggacagagaacgcgtctgtcaggatgttgatgcatactcttcattcagcccaaggtgacaagcagtttgatcaaactccctctggagttgctgtaccgacggggccgagtccgagtgatttcgcgcccgaggatctggcagattcgaatctcatggcacaaggggcattggtcactccggctcagacggctactgaaacgcctgctaccttcaacgaccgttctgtacctgtcgatggcgtccagaacgaggagaccgtcattgcgcagatggagagcatggggttcgctagaatcgatatcgatcgggccatgagagcggcgtcgttcaaccccgatcgcgctgtggagtatctgctgaatgtgagctga

SEQ ID NO: 14600 - DNA, 267 bp, A.fumigatus
agccaacgtattgaggcgatgccccgcgatagccagcacagccatcgcgtcacgcaccgaatcatcacgcatcactggggcaagtgggtggctcacacgcttattattgcttgtctgctatcaaatgtatgcctgtcctacgcagctgccggtgatgtcgatggctttatctttctgcctggttcgcatgatcggccatcagtctatataaatgtccgttcctcggacaaacaaaatatctacaacaccatacagaagaccaactga

SEQ ID NO: 14601 - DNA, 387 bp, A.fumigatus
cccgtcaagcttgtctctcaactgtacagtccagaaaatgcgggcaatccagctgagatcaagtttatccaggagcgtttgcagtcgcttcagaaaggtcctgaggcatggttgattgctaatgatctgctcagtgctaatagcactgatatgagattttttggcgccttgactttcaccgtcaaaatcaaccttgactggtatgtgactcattggaatgtctatggagtccagctttctgacattgttgcaggcagaaactcaaccagcatgatgttgaagagcttcttggtcggttggttggccactatgctgtacttgtcaactcaggcgagcgccctctcgtcattcgaaagctggccacaaccttgggaaccatcttcctga

SEQ ID NO: 14602 - DNA, 279 bp, A.fumigatus
agaaatagtgtcgaaggaaaggccagcgaagagatcgtgcttggttctgatttgctccaacttatctgcggcatcaacttcgtcaagaacagtctttttgttaaccagctcgttttcaagccacgcaaagtattcgatcaacgcggcaccgtctcggatatggcaggccctcatacccgcaagctctacttcattcttgatagctttagcgtcggcaataggactccgggtctcctccacatgctcctcgcctcccaagctgaggctaagtgcccatga

SEQ ID NO: 14603 - DNA, 900 bp, A.fumigatus
  unsure (835): Identity of nucleotide sequences at the above locations are unknown.
gaggaagcgagtaagcatcacccactcaaatttgactacgttcaactaagagatgatagcattccttacaatccagtgttcttcgcatacgccattattacccctacaaaggccgagctttacatcgacgatgacaagatcaccccagaagttgtagctcatctcggtcaggacgtcgtgatcaagccatataactctatctttgcagacgctaaggcactcagtgaagcaagaaggaaagaagctggggaaacagcctcaaagtttcttctgtccaacaaagcatcatgggcacttagcctcagcttgggaggcgaggagcatgtggaggagacccggagtcctattgccgacgctaaagctatcaagaatgaagtagagcttgcgggtatgagggcctgccatatccgagacggtgccgcgttgatcgaatactttgcgtggcttgaaaacgagctggttaacaaaaagactgttcttgacgaagttgatgccgcagataagttggagcaaatcagaaccaagcacgatctcttcgctggcctttccttcgacactatttcttcaactggacctaatggcgctgttatccactacaagccagagaaaggcacttgctccatcattgacccggatgctatctatctttgtgactctggggctcagtatctaaatggaaccacggacgtcacgagaacttttcattttggaaaacccaccgagcttgagaaaaaagcttttaccctggttctcaagggtctgaatgccatcgatactgctgttatccccaagggcactagtggctttgcactcgatgctcttgccaaacagtatntgttggaaagaaggactggatatcttcatggcacaaggcaatggtgttggctcatacctggttag

SEQ ID NO: 14604 - DNA, 207 bp, A.fumigatus
ctgcgggacaaccctgaacttacaaccatattcatagagttcatctctggcttttccggatctgcaggaacggccatcgtgtccatgaccaaggctgcactgtcgacggacggacgatacttcaatcaggcttccaagcaactcgatagcaactgggagctgctaaagagaggagttgagaatgttcccacttggcaagaatggtaa

SEQ ID NO: 14605 - DNA, 309 bp, A.fumigatus
aacgatatagcgggtgcacggagtcttgaagaaactttaaagaggaacggctcatcgctggtcggtatttcgcagaacctggtcgacctggtttggggcaaagacagaccggcacccccacgagagaaggtcagggttcatccggataagttctcgggaaagacattccaggagaagattgcggatttgcgcaaggagttggagaagaagaagacagctggattcgttatatgtaccgccacccgaccctccagcctgaaaccaactgcagtattgatggctaacaaggagcctagctatgctggatga

SEQ ID NO: 14606 - DNA, 210 bp, A.fumigatus
ctgatttgggaatgcagggatttggccaagtttatcgccagcaaccgtatcgcgtgcaccatcgaccgagtgaatggaatcattgagacgaaccggcctgacgacaagaacaagcagtatgctgatttggtcaagcatggtgatgccctcatcacgaagcttcagaagtacggccaggctgtgcggctacgggggagcgaacgaagctag

SEQ ID NO: 14607 - DNA, 675 bp, A.fumigatus
cgcggttccttcgacccccgtggtgaagatcttaaggcctacaagggcctccatctgctcactgttcgctcctacaacctcgcggctcctcttctcctcgatagtctatctacatttacaagctacgagctgtgcagttattctgccctggtcatctattcggtcctcgcgggctcgttgtcgctcaagcgagtagacttcaaagcaaaggtcgtggacgcccctgaaatcaaggcaatcctcggagctggggaggacaggttggctgctctgactggcgagatctccgctggagaaggtgctcgggatgaggagatgaaggatgcatcggtatctacggctactccaggcaccgccaccaccgcaatcaacttgaccaccttgggaacaggttctggccttcaggccgagacagaagcccccattgacttttcgcctctcgccaacttggttgatagcctttacagcggcaactaccggacatttttccgggcattggcggccgtggaagataattttctcacgcaggatcggtacctgtatgagcaccgggcttggttcgttcgcgagatgagactccgggcttaccagcagctgtttcaaagctaccgggtggttgggttgaacagcatggcaaatgcctttggcgtcactgtcgacttcctggatcggtaa

SEQ ID NO: 14608 - DNA, 504 bp, A.fumigatus
tcgcgaatgatcacagaacccaccatgaccgtgccatataccaccaagcggaccgcttctgatctcggccctcgtcgtctccgtgccgataatatcaatcccaacgtcaaggcggccaagtatgctgtccgtggtgagcttgccgtcaaggcggaggaataccgtgtgagattggccaagggagacaagtctttgccctttgacagtgtcattttcgccaatattggcaacccccagcagctggatcaaaaacccatcaccttcttccgtcaagtactaagtcttctcgagaacaccgcattgcttgaaaaaccggaggtcctgcggtcgtctttcggctacaaccaggacgtcattgaccgggctaagaagcttcttgcggacattcagagcgtcggtgcctacagtcacagccagggagcaccagtaattcgggagagcgtggccaaattcatcgaagagcgtgatggcttccccgccaacccgcaagacctgtacctctgc

SEQ ID NO: 14609 - DNA, 780 bp, A.fumigatus
  unsure (761): Identity of nucleotide sequences at the above locations are unknown.
ttgttgtcaatctgctctgtactaactgactggaccaccagttccatgatatccacaaaccatccagagaacatggaacggaaacggcgcaacggccagctcccctcctgcgagccatgcaggaagtcgaagctggggtgcgaccatacgaggccgatatgtaaccgctgtgtccgccggggtcgaacagaggagtgcttttatcacccttcccccctcacgaaaccccgccaaagcaatgcaacagtacagagcagaaaccaagtcccgggcgcaagttacagtattcgcgacttgtctgtatcctccacagtctctggatcctcagcagcgcaccgcccttctgccctcacaaaaccccgcgagagcaaggcagcagcgattcgaaaacccaggcaaaaactaacacataggccaagccaaaaccagagtagcccgaacgcaaacgtcagcgtcaatgcgagtgtctcccccatcggcactcactccgtgtctgtgtccgtatccgcatcggtctctgcctcacccctgacgattggcgagtcgcacgcatgggagaagcggccatttgccaaccccggttttttgggactaactagctactctgacaacgtcacggggtatgctgcagtcttggaccacgcgatgcggccgcacggcagcgggagttccccttcgggatcgatcgcagcggcggtcgactcgaggcaggtggagctgggagcgcaggtgctaatgctcttggaccatttggcgctctntgaagagctcctggagaaa

SEQ ID NO: 14610 - DNA, 267 bp, A.fumigatus
tttgatctccgcagaataccgactacttctcacctatctccagattatatcacagtaaccgcacagatggctactcacgcagactcagtgcatccagcttgcaaggtcgtgctatctaagaacgtcgcaaatagcctcgttgcggaagtccaggaaggtgtcaagaccttggagaagccacctcatcttgtcggattcctggctaacgatgatcctgcggcattgatgtatgcccagtggactgataagacatgtcaagaaaagtga

SEQ ID NO: 14611 - DNA, 282 bp, A.fumigatus
gagatgtccccatcacaccttgtatatttactatacttcctgttactttccctcaagtggacacatactgattcttctgggggtgcagctgccaatcacatggctcagcaaatggctagtatgaaccctggcgcaggagtcaatccgctccaacctggccaggatccagacaaactgtaccagagtgaagcggagaacttggaagtcacggagttctttagcattctagacgggattgaggagagagtcctacataactatgcctcaaaggaaattcgctga

SEQ ID NO: 14612 - DNA, 600 bp, A.fumigatus
  unsure (380),(415),(521): Identity of nucleotide sequences at the above locations are unknown.
tacagtggattccgttattctttgcgccaagtgtcccgcgacgatatcgaagatgctattctggctgccaatgccgactcagacgttgacggcatcatcgtatactaccccatcttcaataatcgccaagaccagtatcttcagcagatcgtcgacgtatccaaagatgtagaaggtctcagccatcgttacatcttcaatatgtaccagaatatccgtttccttgaccctgaaaccaagcggcagaagtgcattcttccttgcacccccctggccatcatcaagatcctcgagtacctcaacatctacaatacgatcctaccgtacggaaaccggctgtttggacacacaatctgcgtggtgaatcgctcaaaggttgntggccggccactcgccgctcttgtggcgaatgacngagcttgtgtctacagcgtggacataactggtgtccaaaaatttactcgtgagggtctcaaaaagcgtaggcacgaagtcgtggatcttggaagaaagacattcanggatgtagcccccttgtgcgaatgttgtcatcacgggtgttcccagcgaatcgtacaagttcgacacaagcctccttag

SEQ ID NO: 14613 - DNA, 408 bp, A.fumigatus
tgctctgtgaagatattgacaggtattcttcgccattatgcaacggttttgatgaccacccccccgaaacctccggcgacgctcgccgaatctaaagagcgtctttcgcttatgcgaggagtcaacctgcgtaacaatgctcccgcggtgctatcgcgggaaggcttcgagatgcgaaagaactacctgatctcttcatacaaaagcggtgccttccttaaagacccttccagccgcggtcagccacctgcgaatccaatgaccgatcctgctggcatggaggccatgatgggaatgatgaaaggaaatatgatgatgatgatcccacagaccttgatcatgagctggattaatgcattcttttcgggatttgttattcgtatggttacttctttgcaacggagttga

SEQ ID NO: 14614 - DNA, 321 bp, A.fumigatus
cctcgtttgtgcgctaacggagtcggcacagtgaaactgcccttcccgctcacaatccgattcaaatcaatgctccaatccggtgtcatgacccgtgacctggatgtccgatgggtatctagcctttcgtggtacttcttgaatttgttcgggcttcaatcagtctttggcttcatcctcggcagcgataacggtgagagatgtccccatcacaccttgtatatttactatacttcctgttactttccctcaagtggacacatactgattcttctgggggtgcagctgccaatcacatggctcagcaaatggctagtatga

SEQ ID NO: 14615 - DNA, 252 bp, A.fumigatus
ttttgggagcacaagttgctgattcacaaaggcgaggtaagccacttagacgaaccaatgttaatgctaactgtttcttactttgaacctcagcaatgcgagggatatattcttttggcctacagctatatcactcaatttgacctggtctcctgttccctcttaccgtgggccgaatgcggcgtctgctttatcgataagcgagcaatcttttccgtccccaaaatttgtcaatgcccctctgtagtttga

SEQ ID NO: 14616 - DNA, 267 bp, A.fumigatus
cccccttgtgcgaatgttgtcatcacgggtgttcccagcgaatcgtacaagttcgacacaagcctccttagagaaggcgccgtctgtgtcaacttttctagcgagaaggtatgctttcgatattgtctaaatgccatctgggattcaggcgagttaatgtaccgcacagaacttcggcccagaagtaaaagagaaggcatccatcttcgttccttcaatcggcaaggtgactattgtggtgctgctccggaacctcttggtgagtga

SEQ ID NO: 14617 - DNA, 201 bp, A.fumigatus
agctgctctagcatatccccgaaattgatttcaatcgagatcaaagctcataatggcaacctcagagcccaaggtgccggtttactccatcaacggttagtcctctatactccaaacagctacattgagctttactttggttcctcatacaggacacggtatgcgaatcccttgataacagtcgctaacaaccatatttag

SEQ ID NO: 14618 - DNA, 273 bp, A.fumigatus
atttcaattcggtcatctgtgaagaaacattcccctctctacaagctccgcgttcagtacacgtcgccctccaacaagattctccaagaaaaggagatcgatgccccatttatgaactggttttccgcggacggaaccttccaccctgaaccactgcgacgctggctttccaccgagattgaggtgctacggcttgcggctaaggaaacagagaggaaaactggcggagttggaagtgttgtaggagtgcaggataccaagaacaagaagtaa

SEQ ID NO: 14619 - DNA, 318 bp, A.fumigatus
caaccatatttagatctgaaatcaaccacagatgatgcccttgtcccgtatttgtgtacccttcctcaaccgtatacctttaaacaagaccactctaaatccaatgtccgattcctccttggctacagcgcagtcgccatcgctgcattcactttctacgctgatcgcaaacttggatgggaagcaactacctccccgtgggttatagcagcagtgtgttcatactttatcctgaacaccggcctcacattctggatatgggctgttgaagctggcgaggtttttcgtggcaagcgagagtcgggtgaaacggtatag

SEQ ID NO: 14620 - DNA, 210 bp, A.fumigatus
ctgggattgccgacaagattacatgccatccggcttgaactgaataactgccttgcacacgaaagattctatgacgtctatttggacactatcctagtccatactctcgagtactttctatgcagcaagaccctcggacaaggagacacttttgtgagagtaagtcacctcgatatgtttaagaagcttgacatgaaggccttttcataa

SEQ ID NO: 14621 - DNA, 195 bp, A.fumigatus
gtcggcattggcagccagaatagcatcttcgatatcgtcgcgggacacttggcgcaaagaataacggaatccactgtatcaatgaacttctacgttagctacgctaaggtgactcagaacgatgctatgccatgctccgagatcgcaatcgaaggagtgggaaagataagagacaggacggcgcaattgacgtaa

SEQ ID NO: 14622 - DNA, 1119 bp, A.fumigatus
aggccgagcgtcgctgatgcatgtgcatgccatgtgtgcgctcgttgcaaggtaagtcagtcaatgctcaagcagttgcggaaactgaccaatggcagattttcgaagaatactgtcttcaatggtgttgctccagagtcacgtggtaagctctatgcaggcgaggccattcgcttattccaggagagagtaaactatcccagcttagaaacggtgcagggtgcagttctcctgggacatctcgtagggggagaaggagatgcgcaggcgaagcaggcctacatcggcatcgcccgcacacacgccgaagtgctctctctatgggccatgccgccaaactctaccgttgtacaccgagaagagcggaggcggacgtggctttccattcggattgcggacccgtggactatcattgacatgtctgtgaactcgggggcttctctccagaacctcaatgtgctccccgaggtagacgatgtggcgtttcacacgtatgacccggaactcttgcgagaggtgcccgttccatcctcgtcgagatgtgacatgtgggcgcagatggccgggacgttggacatatacacccgaatcagcgtccttctaacgcgactcagtcgtggagtcatcgcctttgacgcctacctcagcgaggtccccttgttgaaggagtgtctggacggatgggtgcggggattgcctccaacattggcctatagctccaagaatcttgcgttctttgctaaacaggggctgggacgtaatttcctcgccatgcatattgtctaccatcatttccgacaaatgcttttctttccctctctggatgcacgagcagttcgggatgcagcatctactgcagacggcattgctcaatgcaggaaaagcgccaatgcgatctctgaaatcattgactgctccacaaaggcggacgattgccagctcgactacttcctttacgggcacgtggccatcgtcagctcttgtgtctacatgcagattctgatgctgagcgaggagttgtcggagctgagtaccgcacggcaacgcctagtctcgaattttgaatacctgatgggattgaaaacgcattggcctgctattcggcagtcggtgagttag

SEQ ID NO: 14623 - DNA, 351 bp, A.fumigatus
gacggagtctctaaaagttctcttcgctcgtcggtctctatctcccctttgtccacccacgaccccttagcttatgcttgtccccccctctcccgccgcaccgattcatccactcgcatatcctccctgactgcccgcttagaatgttacgtcgtttgcctctatcatatcacgctgtcacctcatcacgttaccttccgttcgcgccactattctgcgactttcttctccattactctttatcttaccgacacatcctcctacctcaccttgtacatagtccactctcttttattatcggcactggcgtaccatatcccaaccttcctcacttgtccctacatgtccaca

SEQ ID NO: 14624 - DNA, 210 bp, A.fumigatus
cgcggcgcactaagcgagtttgtccgcacggattctgcccatctcgaatcgaacgccgcgagaaatacagccctgcgacgacgacaactttccaaccccccttcgaacccaccctccggcacactccttctcgacaccgacaagggccattctacacatcatggcttccgtcccgagtgtgcaatgcttcggcaagaagaagacgggtaa

SEQ ID NO: 14625 - DNA, 291 bp, A.fumigatus
gtctacgagcctctcctgatcgtcggcgctgacaagttcgccggtgtcgacatccgtgtccgtgtctccggtggtggtcacacctcccagatctacgccatccgccaggccatcgccaagtccatcgtcgcctactaccagaagtacgtcgatgagcactccaagaaccagctgaagcaggcctttgttcagtacgaccgcacactgctcgtcgccgacaaccgtcgtacggagcccaagaagttcggtggtcgcggtgcccgtgccaggtaccagaaatcctaccgttaa

SEQ ID NO: 14626 - DNA, 423 bp, A.fumigatus
acacgtctcgcatactctcgcacatggcactatatcgacgtcggctctgatccgcgctcgcttggtcgcctggcttcctccatcgccctgttcctcatgggcaagcacaagcccatctacgacccttcaacagactgcggtgactatgttgtcgcggtaggctgcagtgacctgcgaaccacgggaaagaagcgcttccagaagaagtactacacgcacaccacgcggcccggtagcctacgaagcatgacaatggaccagatgtttgagaaatggggcggtggtgaggttctccggagggccgttcgggggatgttgcccaagaaccggcttcgggataagaggttggctcggttgaagagtgagtctttgggtctttgctgttcgaatgtactacgcaaagtgagactgttgctgacttga

SEQ ID NO: 14627 - DNA, 213 bp, A.fumigatus
ctctatatttgctgtgctattttagggccgatttaccagcgcatgggtgggagttttgtgacttatttgtttttttccattccaactatcctcacctattttctctcctccaaactttcctcctacatgtctgctacttttgtccttttccctcctacatcttcccactgctcctcccttgaaccaccctatcccccatgttccctgggatag

SEQ ID NO: 14628 - DNA, 651 bp, A.fumigatus
  unsure (11): Identity of nucleotide sequences at the above locations are unknown.
aagttctcccnatattcgagcccagaaaatataagccctcggccacctttcagaattttgttcggcggccggcgggtctatctcccgctggcggtccccggcaagggaaggtattctcgtctcaaaacaaatgtgctgaaccagcacggatgggtggaaagttgcatcgctttcaatcacagctacacagacagtggaatcttcgtattctccgcttcgtgcagtcttacccgtacgaccgagatgcttgaagtcatgtgccgcgaactgcaggcactgactctcgacacgggctacagcgccttgcagccacaggaggtcaaccgtgcgaagaaccaactgcgctcttcactgttgatgaacttggaatcccgcatggtggaattggaggatctcggccgtcaagtccaggttcatggccataaggttggcgtcaaggagatgtgcgaccgcatcgaggctctgaccgtggatgatctccgtcgcgtggcccgccatgtatttggaggccatgttcagaacaagggccagggcaccggtatcccgacggtggtcttgcaggaaggtgagctggaagggtacaaacttcgtcctttcccatgggaggaaatccaagaacggattgcacggtggaagctgggaagaagatag

SEQ ID NO: 14629 - DNA, 336 bp, A.fumigatus
catttcaatctaaccttagagtctgaaatttccgttgaatccgacctcgatgttgaaggcgagaccctgtacgagcgtgtggccgctctgaaagatatcgtccccccgtcaacccggcgccaaatctcctccaccgtctccacactcacctcgttcacaaagtccagcatctccttcagtggaaaggcgctctggattctcagcaccagtgctttcctccttggcgttccatgggcgcttgcctacgccgaagaggagcagtacgtccaaatggagcgtgagcagggaatgatcaaaggtgctaacgaggtatgtttacggatgtttttcttttaa

SEQ ID NO: 14630 - DNA, 1851 bp, A.fumigatus
ccaagtctagcaccccgggattactcccaatacgcgaagacgttcatcagcacttttgcgccggagattctcaagggatatttgcaggagattgacaagtgggtgtcaaagggacagtggctcagcaaccctgctcttgcctacaccttgatcttcctggaagagtgcgtcaagcctaaggcgatgtgggagcacctgaagccgcacatggacaacttgatcgctcacttcatattcccgatcatgtgccaatcagacgaggatattgagctgttcgaaaccgacccctcggaatatcttcaccgaaagttgaatttctacgaagaagtttcggcgccggatgttgcggccacgaatttcttggttgcgctcacgaagaaccggaagaaacagacttttgcgatccttacgttcgtcaacagcgtcgtcagcaagtatgaatctgctccggatgatcagaagctgccccgagagaaggaaggtgctcttcgcatgatcggttcactggcctctgtcatcttgggtaagaagagccccatcgctaatcaggtcgaatacttcttcgttcgtcacgtcttccccgaattccgcagtcctcatggcttcctcagagctcgcgcttgcgacacccttgagaaattcgaacagctcgatttccaggaccctaacaacctcatgatcatttaccggaatatcttggaatcgatgacggatcctgaactacccgtccgagtggaggctgctcttgctctgcagcctctcattcgccatgacattatcagaacgtcgatgcagcagaacataccccagatcatgcagcagcttctcaagctcgccaacgaggttgacgtggatgctctggccaatgtcatggaagacttcgtcgaagttttctcagctgaactgacgccgtttgctgtggctctcagcgaacagctccgtgatacgtacatgcgtatcgttggtgaattgctggagcgaaatgctgccaagggcgaagaggacacatatggagactttttggacgataagagcatcactgctttgggtgtactgcagaccatcggaacgctcatattgactctcgagagcacccctgatgtgctcctacaccttgagaccattctcatgcctgttatcagcatcacgcttgagaacaagctctacgacctctataacgaggtctttgagatcattgacagctgcaccttcgcgtcgaaatccatctcacctacaatgtggcaggctttcgagctcatccacaagaccttcaaggcaggtgccgagttgtatctggaagatatgctgcctgcccttgataactacgtcgcctatggctcggaaatgctggttcagaaccctgcgtaccttgcggcggtcgttggcatggtcgaggatatcttcagggacgagaaggtcggaggtgtcgaccggatatgtgggtgtaaacttgcagagaccgtgatgttgaatctgcgcggctacattgaccagtacatccctctcttcattgagctcccaatgcgcgtcattgaggccggggaggctaggacgaagtcctaccgccttcacctgatggaaatggtaatcaacgccatttactacaaccctgtcctcagtctgcaagttctagaatccaagggctggacgaacaagttcttcagcacgtggttttccaacattgacaacttcagacgtgttcacgacaagaagctgtcgattgcagcgatcagctctctgctcactctgaaggctggagacgttcctgctagtgtgcagcaaggttggcctagacttcttcagggagtcaccagactcttccagaccctgcctgcagcaatcaagagttag

SEQ ID NO: 14631 - DNA, 189 bp, A.fumigatus
gagaatcacattaaccgtattctccaggcacagaagttcggctcctttgctgacgacgatgatgacgagcttgatgaggaaagtttgcttgagacgccactggacaagattgaaccatacggcatgttcaagcatgtgttcatgggtatgttgacttccgctaatgtagtatggtgcgttttggcttaa

SEQ ID NO: 14632 - DNA, 213 bp, A.fumigatus
gagcacatcaggggtgctctcgagagtcaatatgagcgttccgatggtctgcagtacacccaaagcagtgatgctcttatcgtccaaaaagtctccatatgtgtcctcttcgcccttggcagcatttcgctccagcaattcaccaacgatacgcatgtacgtatcacggagctgttcgctgagagccacagcaaacggcgtcagttcagctga

SEQ ID NO: 14633 - DNA, 198 bp, A.fumigatus
ggtgtgttgggcccaatgttcggccgaatgcaaatatatttacctaggtgttattgtcttacttccctagttaaggtggtttccactggaggtctatccgacataacaattggtaatttgcgattggacatgacgtatgaatctatcaatatgggaatgatgggtgcgaatggaaattcggcaatgacggaaatataa

SEQ ID NO: 14634 - DNA, 2514 bp, A.fumigatus
agacaggaacatcgtttgcaatccacgatgagagcaaagagagacctacgcacgcagtgccgaaacgaaaaggagagagcacaatcacagctagagtttcgagtcgcaaatcctcattgctttgctcaaccagcccatagattccgtccgaaagtcagcttcacctcgagttctccatctaaagcacagctccagaaagaagaagccaagcaccagaaacagaacatagatgccagtgcaaaggcaaacaggtcattattaatgcgaatcaacagcggaggagtcgaagatgaacataaagataaacttaaacgagaagtgcgccgcaatacggtcttcatccccccagacgataccacaatcgccagcgtgtttatgagtctattcagtccactcaagtccgacaacctcgatcattatgttccagaggacacagagattaacagtctggaatcacagattgtgcggaaacgacaagcaaagacaacaatggcctctggtcgaaagactccactgcaacctagtctgaaagtggtgcaacgaagtgccatgaacatcgatatcgctggcaagatcaccggaaaggagaatattcctccaggggaaatgatcttcagttccaatgataaaggtctctggaaatcgaataccgaagacaaattcttaaactcagaatcgcctagaatcctatcagacaaagcccgtccatttgcaaaccccgtgacggagcgactggcgaaagtggccaccaaccaagggctaagaagatctgtgcctggggagaaacgatataatgctagggcatctgtaaacggcatcggcagtaaaatggacggtatcgtcagaagcaggtcgagacttgaaggcgctgccgttctgtccgcttccaggaaaacacccctttcgaatgcgttcgaacagtccaaaacttacaaaatgaacgcatcactagtcaagaaagagacggcaatgaccgattttgcgctcatatccgacgatattgtcagcccagcgatgtatgaggaccgttggcttgtgcatcaggaaatagtaataacgcagttaatcaaccggttattcgatcgaacgaacggtcaggtgagatatgatgatcctgcagcacgcagacatgagcttcttcaactgtatcaaagcgggccttttgtcgaacttcataagcgattgcaagcgtcgttgacgtatggctctctcggtataccaaaagatgctctaacacaaacaaagcgtttgaaacatgacttgggtatgaagcggaagttcttggatatttggttggaaacgtacgaccttcgagcactgagagcagctgccgagacggttaccggaagaagagttgagaatgagtccctcgatggagactctcatcatttctcggttgaaacgactgcagataaggaaaaaatccttagacgaaaactggaacgattcttggatgtcttcttggtgcaaaataaagatatggatcgtgattcgcaggaccttagccacgcgggctcagatatgatttcccaagcatatcgccgcactgtccttcggagtatcatgatagttatccttttggacaaggcgagattgtgtccaggaacagtacttcccagttgcctttttaggttctcgtcatctttcaagtcttccacagcggttatccaagcactagcccgtcttctgctgccagcatcgggtgacattctgagatcactcaaacatttggactgtcacttgtcatatgaacagcatcaactgcaagagtacgagtatcaactgagtaatcttgcggttgacctcagggacggtgtgagactaactaggattgtggaattgctcctttattcatcagcaggggctgtggggggatcagtgccgccactggataatgatcaatggccgctatcgagacgtttaaagttcccctgctcgagccgcacagtgaagcagttcaatgtacagattgctttggatgctttgaggttggcaccagatgctgcgccgctcgttcgtgacgttcgcgccgaagacatagttaatggccaccgcgagaagacgattgccttgttatggggtttggtcagtagatggggtctttcggagctcatcgactgggatgatatgaggaaagagattgacagactgagacagaaggctacatcacagctcggatacggacaggtcaacgatgcaaatttgttcaaggagaagagtcctaaagacggtattacagacgacaacgaagctattctattgctcaaggaatgggcaatcatcttggcgcatctgagtggctttcagttggagaatctcagcacaagctttgcggatggaaggatctacgaggctatagtgaacgagtacgaagaatatatcctgggcaatgttgcatcgagtcctggccaaaagccaacttcgttggcagcccgtctaagagcacttggctgcagttctcagtttggtgagcttatctccagattgcagcccagggcaacagctaaccgatga

SEQ ID NO: 14635 - DNA, 285 bp, A.fumigatus
gcccgcgtggctaaggtcctgcgaatcacgatccatatctttattttgcaccaagaagacatccaagaatcgttccagttttcgtctaaggattttttccttatctgcagtcgtttcaaccgagaaatgatgagagtctccatcgagggactcattctcaactcttcttccggtaaccgtctcggcagctgctctcagtgctcgaaggtcgtacgtttccaaccaaatatccaagaacttccgcttcatacccaagtcatgtttcaaacgctttgtttgtgttag

SEQ ID NO: 14636 - DNA, 405 bp, A.fumigatus
  unsure (134): Identity of nucleotide sequences at the above locations are unknown.
accgatggtggttgcgactacaccttcgactgcaccggtaacgtcggtgttatgcgcgccgccatggaagcctgccacaaggattggggcgagagtatcatcatcggtgttgcagctgctggccaggagatttntaccagacgtaagtgtgtgccccatcatttagtggcgatgtactcacgatcaatagcgttccaactcgttactgaccgtgtgtggaaaggatgcgctttcggtggtattaagggccgtacacagctgcccggtctggtcgacgactacctgaacggcaagctcaaggtggacgagttcatcacccaccgtgagccgctctccaggattaacactgcctttgagcagatgaagcagggtgactgcatccgctgcgttgtcgatatgtcgtag

SEQ ID NO: 14637 - DNA, 516 bp, A.fumigatus
aagagggacagccaccgctgcccttcaccctatacaaatcaacctcaaacccaccagacaaagaaacaaaagcaaaagcgccaaaatgaccctagaaatccccctcccagaacccttcgcctccatcccccgctacacgctcaccctcggcccctcccccatccacctcctccccaacacctccgccgatttgcacaccaccatctacgcccagcgcgaggacctcaactccgccctcgtctacggaggctacaaaacccgcaaactcgagtatcttctcgcggacgccctcgcccaaaacgccacgaccctgctctccatcggcggcgtccaatccaaccacacccgtcaggtcgccgccgccgccgcacacgccggtctcaccgcccgtctcgtgcaggagcactgggtcgactggaacgacgcccattacgaccgggtaggcaatatccagctgtcgcggctgatgggcgcggacgtgcggctgcatccagcggggttcggcatcgagcataa

SEQ ID NO: 14638 - DNA, 1158 bp, A.fumigatus
gataccgacctgcagtataaaagagggacagccaccgctgcccttcaccctatacaaatcaacctcaaacccaccagacaaagaaacaaaagcaaaagcgccaaaatgaccctagaaatccccctcccagaacccttcgcctccatcccccgctacacgctcaccctcggcccctcccccatccacctcctccccaacacctccgccgatttgcacaccaccatctacgcccagcgcgaggacctcaactccgccctcgtctacggaggctacaaaacccgcaaactcgagtatcttctcgcggacgccctcgcccaaaacgccacgaccctgctctccatcggcggcgtccaatccaaccacacccgtcaggtcgccgccgccgccgcacacgccggtctcaccgcccgtctcgtgcaggagcactgggtcgactggaacgacgcccattacgaccgggtaggcaatatccagctgtcgcggctgatgggcgcggacgtgcggctgcatccagcggggttcggcatcgagcataaagagagtctgcgccagttgctgggcgagtgcgaggcgcgcggcgagcgcgcgtactacatcccggcgggtgcgtctgaccatccgctcggcgggctggggtttgcgcggtgggcgtttgaggtggcgatgcaggagcgcgagatgggggtgttcttcgatgtggtggtggtgtgtgcggtgacggggagtacgtttgcgggcatgattgctgggtttaagttgctggagcgggtgcagcctggtagtagaaaaaggcgggttatcgggattgatgcgtccgcgcggccggcggagacgagggcgcaagtgatgcggattgcgcggagtacagctgcgaagattggtttgaaggaggaggatatctccgaggaggatgtggttctgaatgcgaattaccatgagggggtttacggggtgcctggcgaggggaccatcaaggctatggagtatgccgccagcaaagatgcgttcattacggaccctgtgtacgaagggaagagcttcgcggggttgatcgatttggcgaagaagggcgagtttgcggggaagacggtgctttacgcccatcttgggggtcagccggctttgaatgcgtatagcgagattggtcgggcgaagtag

SEQ ID NO: 14639 - DNA, 993 bp, A.fumigatus
ggagatggccgagatgaagcccttgcccagtatctactaccccgacttcattgctgccaatcaggaagaccgtgcagacaatgtcatcgagggcaacaaggcttcctgggctcacgtcgagcgtatccagcaggacatacggtaagtgcatcaagtgcctcctgtcaccgagatgctaacatagtcaatagtgacttcaaggctcagaacggcctggacaaggtcattgtcatgtggactgccaacaccgagcgctacgctgatatcatccccggcgtcaatgacactgcagacaacctgctgaacgctatcaaggccggccaccaggaggttgccccctcgaccgtttttgcggtggcctgtatcttggagaacgttcctttcatcaacggatcgccccagaacactttcgtccccggtgccatccagcttgctgagaagcacggagccttcattggtggtgacgacttcaagtctggtcagaccaagatgaagtctgctctggttgactttttgatcaacgcgggtatcaagctcacctcgatcgccagctacaaccacctgggtaacaatgacggcaagaacttgagctctcagaagcagttccgttccaaggagatctccaagtccaatgtagttgatgacatggtcgctgcgaaccacctcctctacaaggagggcgaacaccccgaccacactgttgtgatcaagtacatgcctgctgtcggtgacaacaagcgtgctctggatgagtactacgccgagatcttcatgggtggccaccagaccatcagcttgttcaatatctgcgaggactctctgcttgcttcccctctgatcatcgacctggttgttatcgccgagatgatgactcgcatcacctggaagtcagcggatgacgaggagtacaagggattccacagtgttctcagtgtcctcagctacatgctcaaggtatttaacctcctatccttcctcgggcacatagactaa

SEQ ID NO: 14640 - DNA, 1152 bp, A.fumigatus
acatcgaagtcttgctctcgctttgaacgagatttaatggcagttatccacagcacatatgtcccagatcaatacaccttgaagtccttaagatcagtgccgatgctacttcgcccgaccaatctcgctatacgcattcaaagccggctgacccccaagatgggcgtaaagcaccgtcttccccgcaaactcgcccttcttcgccaaatcgatcaaccccgcgaagctcttcccttcgtacacagggtccgtaatgaacgcatctttgctggcggcatactccatagccttgatggtcccctcgccaggcaccccgtaaaccccctcatggtaattcgcattcagaaccacatcctcctcggagatatcctcctccttcaaaccaatcttcgcagctgtactccgcgcaatccgcatcacttgcgccctcgtctccgccggccgcgcggacgcatcaatcccgataacccgcctttttctactaccaggctgcacccgctccagcaacttaaacccagcaatcatgcccgcaaacgtactccccgtcaccgcacacaccaccaccacatcgaagaacacccccatctcgcgctcctgcatcgccacctcaaacgcccaccgcgcaaaccccagcccgccgagcggatggtcagacgcacccgccgggatgtagtacgcgcgctcgccgcgcgcctcgcactcgcccagcaactggcgcagactctctttatgctcgatgccgaaccccgctggatgcagccgcacgtccgcgcccatcagccgcgacagctggatattgcctacccggtcgtaatgggcgtcgttccagtcgacccagtgctcctgcacgagacgggcggtgagaccggcgtgtgcggcggcggcggcgacctgacgggtgtggttggattggacgccgccgatggagagcagggtcgtggcgttttgggcgagggcgtccgcgagaagatactcgagtttgcgggttttgtagcctccgtagacgagggcggagttgaggtcctcgcgctgggcgtagatggtggtgtgcaaatcggcggaggtgttggggaggaggtggatgggggaggggccgagggtgagcgtgtagcgggggatggaggcgaagggttctgggagggggatttctag

SEQ ID NO: 14641 - DNA, 834 bp, A.fumigatus
catactgtgtttgtaggcgtcaccacccgttcaacggcaggcgctcatcctctcgtggtggggcaccggatttttcactctacatccaataagtcactcgacctttcagcaatttccgacgcaatggctccccatgctacctcggatgctgttgccaatggcgccgtgaacgggtcggctcgtaccaccaccgctcctcttttcaccgtcaactcgcccaatgttgagtacactgacaacgagattaagagtcggtatgcttaccataccactgacattactcgcaccgctgagggtaagatggttgccactcccaaggtgaccaactaccagttcaaggtcgaccgcaaggttggcaaggttggtatgatgctggtcggctggggtggaaacaacgggtccacggtgactgctggtatccttgctaatcgccggcgcctcgtctgggagacccgcgaaggcgagcgcgctgccaactactatggttcccttgtcatgagctcgaccgtcaagctaggtactgattccaagaccggtgaggagatcaacattccgttccatgatatgctcccgatgatccaccccaatgatcttgtcattggcggttgggacatcagcagtatgaaccttgccgatgccatggatcgggcgcaagttcttgagccaaccctcaagcagctggttcgtaaggagatggccgagatgaagcccttgcccagtatctactaccccgacttcattgctgccaatcaggaagaccgtgcagacaatgtcatcgagggcaacaaggcttcctgggctcacgtcgagcgtatccagcaggacatacggtaa

SEQ ID NO: 14642 - DNA, 312 bp, A.fumigatus
gatcgaccagcagcagcaaaagtgtctggaggctcagttcagcgctcgtgctggcgagacggaggagcagaccatggagagaatccagaacgaccccgaggtaagtcacttcagcctttttcattgattttggcattggttctaacatgctgcgaccagatcatgtcgatcctccaggatccagtcatgcagagcatcctccagcaggccaagagcgaccctgctgccctgcaagagcacatgaagaacgtccaggttcggacgaagatccagaaactcatggcggctggtgtcatccgtctcggtcggtaa

SEQ ID NO: 14643 - DNA, 1083 bp, A.fumigatus
agacagagggcaacaaggccttctctgctaaggactaccctactgctatgtacgtattacgtatccatgctaccccgctcgtttcaacgaggctgcacgggattcacgagaaagaagactaacctttttgtgccccggaacagtgagaagttcacacaggctattgagcttgagcctagcaaccacattctatactccaaccggtcagctgtctacgctgcgcagtcagattaccagaaagctctggacgatgccaacaaggccatcgaaatcaagccggactggtcgaagggttacagccgtaaaggagccgcttgccgtggtctaggtgacctcttgggtgcacacgatgcctacgaagaagccctgaagctcgatccgagcaacgaccaggctaagtccggtctcaacgctgtgaagagagccatcgatggagaagctcgggccgacggtgtcaaccctgccgctggcttgggaggaatcttcaacgatcctcagatgttccagaaattagccagcaaccccaagacctcccaccttcttgcagacgccgactttatggcgaaactccagcgcctccagcagaaccccaacagcatgagcccgcaggagatccaggatccccgtttcttgcaggttatgagtgtgttgctgggaatcgacatgagctttggagctcccccggaggccgctggttcctctcgagctgctgcagaagctgaggaggacgtgccgatgcccgatgcgaagcccgctgctgccgaaaagaagaaggagcccgaaccggcaccccagcctgagcctgagcccgaggatgaggagacgatcgcgaagaagaaggcccaggaagctggtgatgccgagaagaagatcggcaacgacttctacaagaagaagcaattcgatgaggctattgaacactacaccaaggcctgggagctcaacaaagacattacatacttgaacaacatcggtgctgccaaattcgagaagggtgatctccagggtgccatcgagatctgtcagaaggccgttgaagaaggccgcgaacttcgggcagatttcaaggtcatcgccaagtga

SEQ ID NO: 14644 - DNA, 672 bp, A.fumigatus
gttttgcagacttcgtcttttcgtctgactcagctaactatgtgtcttcaaagggccttcgcgagaatcggtaccgcttatgaaaagcttggtgatttcacacaagctattgaatactaccacaaatccctcactgaacaccgtactcccgatgctctcaccaagctccgtaacgcagaaaaggccaaggtcaaggccgagaaagaggcctacattgaccccgtcgaggcagaaaaggctcgcgagctcggccagaagaagttccaggaggcggattggcccggtgctgttgaagcctttaccgagatgaccaagcgcgctcctcacgaccccagaggattctcgaaccgtgccgctgccctcatcaagcttatggctttcccccaggccgttcaggattgcgacgaggctatccgccgtgatcccaagttcattcgcgcctatattcgcaagtctcaagccctggttgccatgaaggaatacagcaaggccttggatgcctgcacggaagccgcagagcaagacgacggaacacacacccgtgagatcgaccagcagcagcaaaagtgtctggaggctcagttcagcgctcgtgctggcgagacggaggagcagaccatggagagaatccagaacgaccccgaggtaagtcacttcagcctttttcattga

SEQ ID NO: 14645 - DNA, 450 bp, A.fumigatus
gttcctttcattagccttggcttctcaggtgccgggagtatgtctcaacaagccgagcccaagataacagcagaccccgaggtccagcaatcgcccatctacaatggccaaggcaccgaggaggacccatttatagttgaatttcaaaaggatgatccaggaaacccatggaactggtctcagttcaggaaatggttcatcacggcgattgtgaccttctcggtctttgccatcacctttacatcttcagcatacgctgcttctgcaaacgagctcattgcagacttcagtataagcacagaggtgtttaccgtcggcctctccctctttgttcttgggtttgcaattggcccagcagtatggggtcccttggtaagcagcatcctatctgaagcccttaacagacccgctgacagtccatttctctttagtgagtctccttcatcttag

SEQ ID NO: 14646 - DNA, 1272 bp, A.fumigatus
ccgtgcctcgttagatccgaactatacggaagacaagctctctggatcgtctcgcacgtcgccatggtagccttcatcggaggttccgctggaagtcacaatgttgccaccctcctggtgctgcggttcttcagcggcacatttggcggctcgccgctggtcaactcgggcggtgcaatcgcagatatcttccctccagctcagagaggcctcgccatgacactgtactgtgtcgcaccattccttggccccatccttggccctatcgtcggcggattcgtctccgaaaacgttggatggagatgggtgcaaggcgtgtgctgtatcttcatcggggggattggtatcatcggcgtcatctttgtcccggagacatatgggccagtgctcctgattaggagggcaagccgactctctcaagcccatggtaaggtctacatcagtattcttgaaaagaaccagggcaagaagaaaccgtcggaagtcttccagcgagctctcatacgaccctgggttctgctcttccgcgaaccgatcgtgctggtggcctcgctctacatggccatcatctacggcaccgtctacatgttcatgagcgccatgcccatcgtctacaacgaacaacgtggctggagcgagggcatcggcgggctcgccttcatgggtatcgctgtcggtatcatcatcggactagcctacgccatctacgataacaacagacgctacgcaaatctgctactgtcaaacgcagccacggccgaatcgcgcctcccacccgccatcgttggcgctgtcgccctcccagtcggcatgttcgccttcgcctggaccaataccccccggatccactggtccgtcagcatcatcctctccgcgcccttcggcttcggctgtgtcctcgtcatcctgccgatcgtcaactacctgattgatgcgtataccatctacgcggcgtcggttcttgcagccgctgccatcttccgctcgattgtcggggctgtgtttcccttgtttacgacccagatgtatggcagtcttgggattcactgggcgagttccctgccggcatttctgacggtcgcttgcatgccgtttccgtttgtcatgtatcgctacggtggggcgctgaggatgaagtgcaagtatgcgttcgaggcggcggggatgatgaggcggatgcagatgcagcaggtgcccgctccagccaaggaagaggaagattccccttctgagtgggggacggcaagatttgggctcgacgggtgtcagtga

SEQ ID NO: 14647 - DNA, 954 bp, A.fumigatus
  unsure (140): Identity of nucleotide sequences at the above locations are unknown.
ccttgggatattgtgaatttcaaggccagactccggtctgctgttaaccaatgtttctcccagccgtacatccagctgggacgaagagtcgtccgtgtggaaaccgacgttgtgatgctcacgcatctcatcctttactntaccacgtccgtccccagtgcactctacctgtactatcacttcacttggacccatggcgtcctccactggatcatgcagtcgtactatgtgggaacatacacgctcatgatgcaccagcacatccacatgggcggaatcttagccaagcgtttctggctcgttgactcgctctttccctacatcaccaatcctctcatgggacatacgtggaactcgtactactaccaccacgtcaagcatcatcacgtggaagggaatgggccggacgatttgtcctcgacggtcaggtaccaacgagacgagctgtccgattttctgtgctacctcggccgatttcttttcctcgtgtggtttgagcttccgagctacttcttccggaaaggccaggtcctccaaggtctcaaggcggcttcctgggagatcggaaactacctcttcatctacggcatgtatcgctttgtgaacgctcacgcaacgctcttcgtcttcatcctccccttgtttctcctccgattgggcttgatgatcggcaactgggggcagcacgcctttgttgacgagacagaccccaactcggatttcagatcgagtatcaccctgattgatgtcccggtacgatttcctgcctcctatttgactactgccgctgacaatagcagagtaatcgcttctgcttcaatgatggctaccacacctctcaccatctcaacccccgccgtcactggcgcgagcacccggtggcgtttctcaagcaaaaagaccgctacgccagcgagcatgcgctggtcttccgcaatatcgactatctcatga

SEQ ID NO: 14648 - DNA, 693 bp, A.fumigatus
  unsure (61),(66): Identity of nucleotide sequences at the above locations are unknown.
attattacgaaccacaagcctcatgggaggctcatcacttcacgatctgcacttggagcangtcanagggtctgctcagcgcagcgtagttgctctggaagcttaatgaagcttgaagaaggtgatttcgatcacaacggcaccaatagctcaaatcgtgccgcgggcaatcgtacccgagaaccattggctgccaaagactccctgcggctcaggattactgatattctcagggctctgagcggaagagccgacccggagggcgcccccgtgcaagagccgcaggcccccgtggaccctctttccccgtttcaggtgtcgatgccgtttgccaatgtccccgatgggtttcatgacctggacgtgctgccgatcctctccaacggtctcagccccaacttttggcaattcttggacttccccccgccaccattcgattctcacccaaaggaggtctcgttggctacccagggagacccgcctggcgcctttggactgggtccttcgcaatttcccgactcatatagtagcactcctcgcactcgtatgacccacacatctccgtctctgcagagtgaatcaatcggcctgggtggaggcagtgactccgccacaactccctctagcgctgatgcctacgttgccgccaagttttattacgccatgggtgatgggacactggctcctatgtag

SEQ ID NO: 14649 - DNA, 195 bp, A.fumigatus
tggctcgggctggtgatagatcatgcgactgcttgccggggctatgcaggggttaactctctgattcttatttatgccgtttctttcgttatcgcagccccccacggttatgctgcctataattactgggggaaaagcagactagcctttcttttcaccacggagctggacggatccgcccttagtgtatccaac

SEQ ID NO: 14650 - DNA, 207 bp, A.fumigatus
caaatcttcgaacgcgccatggatacagcgaatgaagacttggatttgacctatcgtgacctcgctatccgggaggagcaggatctgggacactgcgtgggcggcatggaaatacgggttgttcatcgccgtggacgactcgttgagaagacagacggcggccaactcgcttgggatcccgtctatgccgctctcggggaagggtga

SEQ ID NO: 14651 - DNA, 993 bp, A.fumigatus
gcatctcgaccaacgaaatgccacggcgggcatgaacgagcccgagaaaaaaattccttctcgggctccgcatgtacgaacttcgcaaaaacacggcattcgacctcctcaacgacaggtgcaaatgccacatccgcgaaggaccagacggcaaaacgcacctccgcggcgagacggagacgctcgccgacggcaaagtccgcgtgcgcccgatcgtcacaaaggcgtgctcgagctttgacgagttccacgcgcagttgctggcggggattgggcgccgcgcgacggggtcgtcgacggtgcatgatcagagttcccggacgcatgcggtgttcgaggtggagattgtcacgcgggcgctcctggtatgcgagggacgcggtggtggagccgcaatcggagcttgttcctgttgggaagcgcgcgacggatgtctatctggaggagaatttgaaggggttgatccggatgccggatggcacgtttgcgcccaatccggagtatcagatcaaccaggcggcgattgatgaggccgaggcgaagaaggcggagttcgagtcgtatgtccggaaggctgaggaacacgtggaggctgtcaaacgatcatgtcgccacatgtgtctgggtgggaaattcgtctttgtggacttggctggctcggaatactaccacgacaagcgcactgtttcgacttgtcgagcgaagcagacgccgcaggagcagcaggaagggaggcagatcaataccgatcctctgtccttgaaggaggtcatccgtgcgatggcccagaagcagagtcgcattccgtttcggtcctcgccgctgaccatggtcctgcgtgagcatttcttgacaggtgagggggatggcgggttttcggcgatgattctgacggcatcgccctcgtcggagcagtacacggcgacgattgacacactgaagtatggaaacctgattggcgtggctggagagcatggcaagggacgtaaatag

SEQ ID NO: 14652 - DNA, 684 bp, A.fumigatus
cttaaattcaagttgataccctgttcaagtgctccagaacgggcaaaaaagataacaagcatgcaatcgatcaaagtcttcgtccgctggcgtcctctcgcgccatccgaggccaacaccccagaaatcgcccggacacagcacgcgcatcccaccagcaacacctcggcgctctcactcaccccaccgccagcgcacaaactatcccgtccctggaaaagcgagtcggcgtttacccgcatcttcaccgcatctgacaacaacaaagccgtcttcgaggctgtcgtagccccgaccctcccccgcgtcttgaacgggcaatcctgcaacttcttcgcctacggccactccggcagcggcaagtcgcacaccatcatcgggtatgacttcgagcaccccgacgagttcgggctgtgcctgtcggccgcaagagcgctgtatgagcatctcgaccaacgaaatgccacggcgggcatgaacgagcccgagaaaaaaattccttctcgggctccgcatgtacgaacttcgcaaaaacacggcattcgacctcctcaacgacaggtgcaaatgccacatccgcgaaggaccagacggcaaaacgcacctccgcggcgagacggagacgctcgccgacggcaaagtccgcgtgcgcccgatcgtcacaaaggcgtgctcgagctttga

SEQ ID NO: 14653 - DNA, 492 bp, A.fumigatus
acgagcccgagaaaaaaattccttctcgggctccgcatgtacgaacttcgcaaaaacacggcattcgacctcctcaacgacaggtgcaaatgccacatccgcgaaggaccagacggcaaaacgcacctccgcggcgagacggagacgctcgccgacggcaaagtccgcgtgcgcccgatcgtcacaaaggcgtgctcgagctttgacgagttccacgcgcagttgctggcggggattgggcgccgcgcgacggggtcgtcgacggtgcatgatcagagttcccggacgcatgcggtgttcgaggtggagattgtcacgcgggcgctcctggtatgcgagggacgcggtggtggagccgcaatcggagcttgttcctgttgggaagcgcgcgacggatgtctatctggaggagaatttgaaggggttgatccggatgccggatggcacgtttgcgcccaatccggagtatcagatcaaccaggcggcgattga

SEQ ID NO: 14654 - DNA, 912 bp, A.fumigatus
cgaagttgtgttgacaatgcaggcgttttttggcgccaagcttcccgggttcgagcctttcggactggacaagatcaccgtggacgtcatcaacaacaagctaactcacgcgcttggtatgtgacgttggggtgtgctgcagaggtgcctcttgctaactcaactgtgcaggtagccttactacctctctttccagagagtccgcagctgtgctcaaggagtcattgcctccgaaatctgatggtatgtccttccagtaggcacatttgcccctctgacatgacagcagagtggcaatccctggtcttcgctcaagagattccatacatagttgcccgattgtcgtcccttgtgtttatgggagagaaggtctgccgtgacaaggaatggctgcatgtgtctgtcaactacacgatcgacgcattcggcgctgcgcgcgaactcagactctggccctcggttacgcaacctctggtgcactggttcctgccgtcaacacgacgagtgcggaagcacattagcgttgcgaagaagatcgtgcagaaggagatcgaaaagcgagaattgatccgacaaggcaagctcctggaatacagtcctccgaagcccaacgatgccctcgactggttcagagaagttgctgccggtcgcccgtatgacataacgaaaagccagatcactctttctctggcagcgatccacactacttccaacctgttgacgaacatcatgtacgacttgatagcctaccaagaatacatccagcctctccgggacgagattgttgccgtcgtgaaggaggaagggtgtctgaagaagaccagccttaccaagctgaagctgatggatagctttataaaggaaacccagcggctgaaccctgtcagcattagtaagagatttgctacctga

SEQ ID NO: 14655 - DNA, 288 bp, A.fumigatus
tcctatcctatgccgttccttctcggagttgtgtctaatgaggacagtcgctccttcctcatctttgtgaatacaatcttgatttcctcttcacttaattctctcttccattgcacgagaacttcactatatttaacagcttacacccaatactgtttgatcctggactcgccggatagcaatttctctagtctactaacctgcagactcatccaactcattcctgtcctgcacaggctttttctccttaaggctcacgactacgaccaagatggattcaggagatga

SEQ ID NO: 14656 - DNA, 504 bp, A.fumigatus
cctgcagactcatccaactcattcctgtcctgcacaggctttttctccttaaggctcacgactacgaccaagatggattcaggagatgagcatatcacatactcctcagaaggactttccgagactttgatggagctgtccattagtcataataccgaagccaaactagctatcagagaatattaccgcaagcaggatcatggacagaaagattcttggctccaaaagccggagataccaacacctgaagagattctcccgtcatcttcagacgaagattgtgtggagctcatgcctaacaggatagatggtccctggacctcgaaagactcctacctcagggcacactatgaactccttcgagaggatgctgttgctccactgcgagatgctgtggcttacttccgtaatgacccgcagatggtggactcccaagctgtatcgatatacgagaaggtcagccagttttcattcttgcttcatatccttaggaaagtcgaatag

SEQ ID NO: 14657 - DNA, 1491 bp, A.fumigatus
tcccgcgttaggtttcctctagcagatcacatatgcggcctggatcccgatgttaatgccccggattatgtcaaagaattccctactatggacatcgagtcagttactaccgacgaagaaaaaaagatcaacctcttggaaggctggccagaatcaccaacaggcgatctcgaccagtcacagtgggcagctctgaagcatatccttaccaaaaaattagcgattatccaaggccccccaggcacagggaagacacacgtttctgtggttgcgttgaaagttctgttgtctaatatgcatcctcatgatcctcctatcatagtttcatctcaaacaaatcacgccttggatcaacttctgcgacacatttcggttttcgagaaggactatattcgcttaggaggaagaagcaacgaccccgaaatcaagaagcgcactctgtttgctatcaggcaaaatgagccggcgatcacagtccagggcggtatgtatggcccggcaatgaggaaacacaagactctggtggctgcaatcgtggaattgctggaggctttcagtcaagcagacgatggaacacctctgtcttcaaagctctttgcgaagcacgggctgctgagcgcagagcaatgcgattccctcgcaaagggagctaagggttgggtccgtcctggtgctgaagaagataccgatcctctaattgcatggctcggagaccaagtggtaaaattccaggtaacatacacgactgagaactttggctttgacgaagacgaggtagaccttgaatatgaacagctcaaagaactcgaggcggagcaagggattgaagaggacgagtacgaaaatctgagaggacaattcatctttctgcgcgaagcgatgtgtggattggttccttccagtgttcccgaggcagccaatttggaccacctggggcactctgatatgtggaaggtcccgctcaaagcacgtggagtggtttatgatgcactacggagacagctcaagatgatgctcttggaacaatttcgaaagctcgtcgctgcctacaccaagaattgcgaagatcttcggattggtaagtgggagagagaccacctcattctccggaaggccaggatcattggtatgactgcgacgggcctcagcaaatatagggccttgatttcgagtgtgaaaccaaagacaattctgattgaagaagcagctgaggtcattgaggccccgatagccgttgcctgtcttgactcgctccaacacatgatacttgtgggcgaccaccaacagctcaagggtcagtgcgcagtgcaagaccttgaaggtgaaccttttcatttggatgtgtctatgttcgaacggcttgtgaagaacaaaattgggtacgttactctgaggcgccaaaggcgcatggtgccggaaattcgccgcctgttggaacctatatacggggaactgcaagaccatcagagtgtcttccggcgtccaaaagta

SEQ ID NO: 14658 - DNA, 1224 bp, A.fumigatus
cagatacagtacgaggcattctgggccgatccgtccgatgtcccaatcctatgggtcggactacttttcggtatgatctgccttgcctgtctagcatctgatccgcccgatggaaccgaggtcgagcaacagtctctccaggtgaatctgtaccgcgaaaaaattgtgcaatgtttagtcatgggcgaatataccaagtgcggcccgtacgccttggaaactgtcatcaactatgtctatgtggaattctgcatctctgtcgacgccgacaaggacatctggtttctgctcgctttggaagtcaacctcgcccggcgtatgggttaccaccgtgacccatgccacttccccggcatttcccctttccgaggtgagatgcgccggcggctatgggccacggtactaatgagtgatattctcatctccaaccagatggggatgccacggatgatctccgactggcagtacgatactgctgaaccgcggaatctcaacgatgcagatttcgacgaggataccgtagagttacctcaatcgcgacccgaaactgagcacaccacggccctgggtatcatcgcgcgcaggcgcatgttgaaggcgctgggcatgatcgcggacctcacgagcgcagtgcagccctgcagctacgcagaagtgatgcgagtagacaagctcttccatgaagcggccgcgagtattccgccgccactgcagatgaagcccatggcagctagcgtgacggactctccacaggtcattatggccaggctgttcatcaggcatatgttttacaaaggacaggtcatgctgcaccggcggtttctttacatgcggtccccatctcagaatgaggatatttatgagtattcccgcaaggcgtgtctcgatgcctcgctggaagctcttgcgattcaacacatactcgacgaggaaacctgccccggaggccagctacacacgatgcgctggcgagtcacctctataatgaaccaccaatttctcacggccaccatgatcctgtgctcgttattgtatcacgaacagacactgcagcgggaagatgagatccgcggtgcgctgcagagggcgaggacagtatggatgcgcaggtcctcgacttctaaagaagcaaagaaagccactgaagccatcaatatcgtgctttccagaactggaaaagatcaagaaggggatgtgtcttcacgccgggagaaagatacgcgt

SEQ ID NO: 14659 - DNA, 690 bp, A.fumigatus
agcgaggctgacttttccattttctgcagatcaaagtgtgaccgtcaaaagccttgctcgttttgctcggctcgcggtcaagtatgtacatacgctgaaaatcatccaacgacgggctcgccaaagccgtctccaactgctgtgcctactctccatgaccggcttgtacagttggagcgcttggttacatccatgatgcccaagtcctcgaatgagaaacccaatgctagttcgtctgctgaggtgtgtatgccaccagtgccctcaaggatcactccggcagaaactatgccgataaatacaccagttgatggacgatctgagagtgggagcatgcgaattactgaatcagagcttcgttacgttggaggcgaacactgggttgccatattggacggtatcgccgacctgaaagaccacttggaccgcgaagaacagctgcggctagctcagagttccgaccgggttgagaacgagcatggggtcggcaatagcagtgaaccatttgcaaggacccggtctaatggtgcatttctgctgtatggatgccgccgcgcgacgtcacgcgatgaaatactctcggcattgccaccaaaaaacgctgtcgatcggtacatctctcgctacttcaactatttagatcttgtgtcgtcttgtagggacagttccatccactgctgcaaagtctaa

SEQ ID NO: 14660 - DNA, 210 bp, A.fumigatus
ttgctcttaacaaacattggtgccagagctgtcatcatgtctaagtccgagtctacgaaccagcgggagaaaggcattgacagtgagctggaagaggccaacattgtcgactggggcggccctaacgatcccatcaatcccaaaaactggccaaagcacagaaaatggacgcatattgtcatcatatccctcctagcactcaccacgtaa

SEQ ID NO: 14661 - DNA, 558 bp, A.fumigatus
ggtgctgtgtctgagtgttcaccttggcgtaggaatatggctccgacaatgtgcgcacctggaattagtggtatctctgcagacttggacattacttccagcgccgtcagtacccttgctattactctgtacgtgcttggattggctattgggcccatgttcatgtctcccgtcagcgaggtgtacggacgcgtgcccgtataccatgctgccaatattattttcgtcgccatgattattggtagtgcgctgagctggaatcttgctcaattcctagtcttccgattcatatcgggctgtgctggcggcaccccaatggctctaggcggagggactattgcagacatcaccactatagagcaaagagcagttgcgatggcgttttttagcatggggccacttgcaggaccggtatgtgttattatgaattcgtttttcgacttccaaataaccagtccgatctcgttcaggtccttggtcctgttatcggaggttcctcgctgcaagcacaggctggcgttttctaccacaggggtcgaggcatccgcgctatgcgta

SEQ ID NO: 14662 - DNA, 1020 bp, A.fumigatus
tggccctgcccatgtaccattcctttggcgatttctggaccaacatctttccccatccggtacggagagcccttgtccgttcttccgcggttcgacatctccactttcctggacgccgtcggccagcaccacatctcggagacgtatatggtccccgccatggtgcagattctgagccggtcctccctgccggtggccgagagcctggcctccctgcgctacgttgggatttcgggagcccccatcgacgggttctccatccagcgattccagcgcctcctgtcgccggacgccgtcgcaggaaacctgtgggggatgaccgaggtgggagtggtgttccagaatcgctaccgagtgcccttgcagttcggcagcgtggggactctgctgcacgggtacgagctgcgctttgttgatccggccacgggcgaagacgtcgccggcacgccagactctccgggggagttatatgttcgggggccggggctcctcttggggtataaatggcggacagatgacaaagacgagcagggatggttccgtacgggggacatggtgtatgcgcgagacgggaattactatatcatcgggcggacaaaggatctcatcaaagtgcgagggcaagtacccgattctctcaattcctggacatcccattcaactaacaggttgtgtgattcaaggtactccgttgcgccagcagagatcgaagggattctactaaaagaccccggtgtcaaggacgcagctgtgatcggggtcatgctcccagacggcagcagcgaggtcccccgagcatacgtcgtccgtgccggcatatctcccgagtcgacggcggatcaattgaccgatgtagtccaaacccagttggccagctataaagctctggatggaggtgtcgtctttgtggacgagatcccccggacgggcatcggcaagccccatcgagcgagactctcacagctggatcgcgaacgggagaagcttgcctctattttgggtgtctctgtgcctgcatag

SEQ ID NO: 14663 - DNA, 1560 bp, A.fumigatus
aggtcttctggggtacccggaagtgagtttggcaagggagccccttggagaggggggaaacgggagcccctccttggggagatgttcgcgacgaacaagcgccaggaggacgacgatgaggagaacgaagaggatcttgattcggaagaagaggaggaacagatcaagcagtcgattttgaaggaagatcagggcgaggagttcaactctacccagctacgaaagtatcaactggaacgactgcggtacttctacgcgatcctgacattctcgagcaaggatgttgcgaaacatgtgtacgactccgtggacggagctgagtatctatccagtgccgacttctttgacattcggttcgtaccggaggacacggacttctccgacgacaagccgcgcgacgaatgtgaacggatcccggacggataccaaccgaatgagttcgtgactgatgcgctgcagcacagcaaggtcaagcttacatgggacgcggaagacaaatcgcgcaaggaagctcaagcccgagctttcagaggcagtcgcaaggatattgacgagaatgatctgaaggcctatcttgccagtgacagttctgatgacgagggagaagaagaggcggtggaagttgtggatactacaaagggagacgggtctagcacaaagatctccaagaaagaggaagagcggcagcgcctgcgggctctcctgggcttaagtacagagcctctcaagtcctccaaatcgtctggtcctgtcggcgaaatggaggtcaccttcacgtcgggcttggcaggagagcccaaacgcgacaccattttcgagaacgagcctgagagagaggagactacgatcgagaagtatatacggaaagagcgtgagcgcaagaagcggagaaaggagaagctgaaggctctgaagcgcggggaaactcaaggggaggcgaaggctgatgccaacggggacgatgtatcgtctgcaggcgagggacaagctgcgcacgaagacttgggcttcaacgatccgttctttgacgatccggatggcaaggccactgctgccgctcgtcgcaaggaggagaagcgtaagaagcgtgctgaacgcgaggccgaggaggccgcgaacgcggcgaagcgggccgaactggaactcctgatgctggacgacaagaaatcagaaatcaaacactttgatatgaatgagattgagaaggcgcagaaacaagcccgcaagaagaacaagaagaaggcaaaggaccaggctcaaacagtcaatgacgatttccagatggacgtcagcgaccctcgtttcgcaaggctgttcgagagccacgaatatgccatcgaccctaccaacccgaagttcaaacccacaccgggcatgaaagcactgctggatgaagggcgcaagcgacgaagggatcgggacgaccgaggggacgaagaagtaagcacctcgcgtgataggaagaagaaaaagcagaagcagagcgctgcaggcaacgccggctcggatgatttgaaaaagttggtggacaaagtgaagcggaacacgcaacagacatga

SEQ ID NO: 14664 - DNA, 1200 bp, A.fumigatus
  unsure (1029): Identity of nucleotide sequences at the above locations are unknown.
atcatcatgttgggccgtctgttgagcagtgcggcatcaacattgaaccctgctgcgtactcgaatagaaacgctacccagctggaatccgtgactgaagaagaacacacatctggcctccttttcccggatgcgagcctgctacgacggtcgaatacccatgcctatccgttacatagcacattcaattcgccgaacgcgtatgctgccggtgcctacgacgatcgaggtggcgtggaactagatcccgtcaaggacttccgggtgataattgcacagaacgcgcttggcgacagggatgcgtgtgtgttgttagatactcgaacgaactcgtctgacgtgacgtcaagccctcacgattcagaaccgtacgtgctcgacaattctgggacgagacatgttcgcacactttccagtctctcgcgggctcctcggcgcggatatccccctccttcgtcggccgctgattcgagcccgttttctgtcgctgcggaatcccgcagatcgccgcccatgagttctggtgcttttgcccgcgctcgcggccgcagctctacattgtcgcctgcaggtggggtgaatgaagccggccgctcacgtcattcggccgagaacaatgactctggtctgttgaactgcatttttggcagcagtgcgttcagctatcggggctcttcgaccaagatgcatatcatttctgcagatgaggattcaggtagaacttcaagcgaatcgccagcaacccgtaactcgctctcacgcgcgtatacaacgggaagttcctctggtttcatgggtgcatcgcggggctccgaacccaagcctccatccaaagtcaccattctactgacgcggatgttcagtgtcaacttgccggaggcaggtgacacgtctgatcggcccgaccacccgacttccatgtaccaagagtcgctaccggaaaacgggttcccattccccgatgttaccaagcgtaaaaagatcaaggagaagaaaactccgatgtatgcggtggcgattacaatccanattccgctcctctctcgtaatacaggacggcccggttcacgcttcagtacgcaagccaccgactcacccaaggcgcggatgtcgtgctcgttggactcagaccatcgctggcgcggcggctttcttgatgatagcctgtcgcttgcattctcttccggcaggtttggatga

SEQ ID NO: 14665 - DNA, 225 bp, A.fumigatus
gaatgtgctgaaatctcatgttactgggactttgtcccgtggatgactgccgttatagaaaaggaatctaggggaatcaggatgtatgatagattgtcaacaaagatggagaatacttttattacacctgcaaagatgatgtacaatattgtggtatatatcctgaatatcctgaatcccactatgcttgtgtcttgttcgctagagaaaatcaaaccaaggtga

SEQ ID NO: 14666 - DNA, 555 bp, A.fumigatus
  unsure (52),(55),(105),(306): Identity of nucleotide sequences at the above locations are unknown.
ctctctccctaccagggcatcaacgacttcatcggctgggctacccactctntcntgctcgtcccttacttctcgtggaagattacccacgcccgccaccaccgntacaccggccacatggagaaagacaccgtcttggtgccgtggacggacgagcagctcgcgaagaagaggaatgtgcgcatcgagcagctcaaacacttcgctgaggagacccccctcgtctcattcctgcagctcatcggtcaccagctcggtggctggcagctgtacctgctgaccaacgccaccgccggggcgcagagntggcccgagggcaagcccaagaccggcccggcgagccacttcaaccccgtcggcgcgctgtggactccctcgcagcgtctgtccatcgctatctctgatctaggcctgctgatcatggctgccgtgctgtactacgccagcacccagattggggcgtggaatgtcgtcctgctctactttgtcccgtacctgtgggttcaccactggctgagtgtgtcctcccttcttttattttccctcggtgtctga

SEQ ID NO: 14667 - DNA, 363 bp, A.fumigatus
gcagtcgccatcacatacctccaacacacccacccctccgtcccgcactacacccctgaagcgtggacctacaccaagggcgctctcgctaccgtcgaccgcacaatgggtttcatcggccgccatttcttccacgagattattgattatcacgtcgtgcaccacctcttcagccgcatccccttctacaaggccgagcaggccacctgggccatccagcccctgcttggagcgcagtaccacgaggagaaggaacagagtttccttggttcgttggttacgaccttccggaagtgcatttatgtttctgccacggggcagccgggtgtgctgcactttgtgaaggctgatgaggggaattaa

SEQ ID NO: 14668 - DNA, 261 bp, A.fumigatus
ctttgccagtattgcggacagtatctccgcagatataaccaagaatttgagaagtgtgctgcggacggaggggagaccaatctatgccaggatcagaaagcaatgcaggctatcgggacttgcctgaaagagaacatgatgcctatggcgctgggtgagatggaacagctctcgatgtttatcacaacggatatgtgcgacaagatgaatgcttatctcaagggccggagctttgggaaactgtcattcctcaagtgctag

SEQ ID NO: 14669 - DNA, 219 bp, A.fumigatus
atgaccgtcgtgaacacacacggccccgctgcggcgtcctccaaggaagagtcacttgtgattttgatgcaactaccccacgggcattaccttccctggggattttgcgataaagagagaccgctttgcatcccacacactgccacctcctctgatggcaaatacgtcgcttttccagctgatgcttctaattctgaatctacacacttcttctgctga

SEQ ID NO: 14670 - DNA, 1884 bp, A.fumigatus
  unsure (7),(17),(18),(19),(21),(22),(26),(27),(28): Identity of nucleotide sequences at the above locations are unknown.
agcgccngtggttggannncnntggnnnatcgagcccccgtcggatccttccagccccgtggtgaagacggatactttgcatcgaagagccccaatttcatgcagtatatattcagatggaaactaacggttcctttgcctattcctaaaatccaatttatcgtggagattggcgatgaccttgtatacacatcttccgtattcgatcagatgaagttgccttgcctcccgtcgcgcgtcagctgggtggaaatgttttcctccatcttcgatactgctgcctatcgagttctgcgagacgagattgaagtggatcttggtccaacagcaaacatgattctcagcaaggccatgtctcgggtatgccgctacaagggaaagacaggcggaacagggttcccagacagacaggatctctacgatggggggaacacccaggagcctcagctgatcaattgtgtccgaatctttgagggatatcgctcaaaatatgttcccaaatccaagtatctgcacaaagttcttgaagtcgaaaacttggagcttacagaccgtgcctcacctacttctgaatggtcttatgaatctgaatttgagaaattattctcttatccttttgtctcatcatataagccatgtctccaggtttcgcgtgaagagctgtcagcattggctttgattctggggatgaatctatgcgtctgcgaaagccacaacccatattcactgcacggcgaaggggcttttggaatatcagcatcagcaacattgagccatgatatgcactggcagttaaggttcgtgcggacatcgaggcggccgaggcatgatccttcagctggcagtggctattcgactctctttgctaagtatctagcatgcggcgctatcccatttgcacgaggaaatagtgaaaatgattcaaaatggatcaagtctgtctacatacaagatctcaacaagttcgaggaaggaggatatttcaaggatctcaaggatgacgattgcctgccagacgctctagaatacctatcacgacttcccacctctgagacaacgatgctctggccccatttgcttgagacacaatcaacaaaccgtcacaaggattggggcttggtaaaaacaattgataatcaaacaacagggacttggtgggacgctgttgctggaattccatttggcggcctggtaccacagacgacgagagaaataaagcaagcggtccaattcacagtctctgagctaccaaccgtcttagacatcactactcgttgcgaaagtgacagtttgctcaatgagcttgagatgctcatcaatgaatcacatcgccaacatgagtcattaaacctatttggcaaccatgtccacgagagagcaaaatcactggataccgatatcaatttcgtgaccaaatgttacgatactagagacgctgcagctgtctttgggcgatacatgactctgctagagcacctcagtgctacttgctttcctggtgggtccgcgaacgatttggagtcactgcatggacaagtttctgcatacctgaaaagaagctatcggacatggatagcaagtgattccaaaaaggataccaaagatgtattacagaaactcggtatagtaatcaaaggtgtccggcgagcgtatgaagaaacgagaacactctcgcctgatcaaacagcaaaagtgacttgctgcctcattgccgcttgggcagagaatgtgcaagaaattaatctaggactgcgacggcggagtcaagactcgattgcaaatcatggccggatagcgaatggagagatgatcaacgatcaaggccggcaattggatcataccacttatatggaagatctgccaccaatcatagcactgtcatga

SEQ ID NO: 14671 - DNA, 207 bp, A.fumigatus
  unsure (163),(175): Identity of nucleotide sequences at the above locations are unknown.
gacacaatgctcttctcccgcgtggccccagtagccctactcgtcgccctcgcgacgtcctccatgggcgcggtcagcgccaagcaggctatcgaaagcatgaatgccctccaaaataccgtctctgatgcccgcagaagcatcgaggggatggaacggcggncttctaagcgtnattcccgtcgccagcaaacttcaggaaggtaa

SEQ ID NO: 14672 - DNA, 834 bp, A.fumigatus
gatattcttacaagtgctctcgcatcaggcttgtgcgatagtgttgctgctgctgtcaaccaaggctccaggaatccttcgccggtgactcaagacgtggttgagaacttaagtctggacgtactacatcgagacaatcggtcattgacgtttccctctatacttctgggtcaccgcagtcagcagcagactctcaaggatcttcaatcgatgatcgttcgtctcaatagctccgagtctggaagtgagattacaaggtccatcatcggtcaaatccaccgcgcctctggagacgcagtggtggctccgttctggttagccctgaactttttgagaactggttcgcagctcacgtgcattctcgacgatttcatatctttagatcatattgaaatatcggtccagagtctaagcagtaaggccatgatcgaggagctatattactactcgttgcctcttctagatcaacccctggcggagacctccagggattggcgaatttctgctctcgcactagaagcggttgctcttcaagcacagcaactcggcgaagcatttcgcccggagctgatggatgcgctatatcctgttctccagctgctcgcatcaggaaactctacccttcagaggcatgctatggtatgccttgacatcctcaccaattcttgcaagtacgaggataccagcaccatgatcattgaaaacgtcgattatctggtgaactcagtggcattgaaactgaataccttcgatgtctcaccttacccgccgcaagttctcttcatgatggtaaaattgtgtggtgctcgattgattccctatttagatgagtag

SEQ ID NO: 14673 - DNA, 573 bp, A.fumigatus
  unsure (473): Identity of nucleotide sequences at the above locations are unknown.
gtcgactcaatgttaggcattctggatatgtaccatggataccccaaagttgtggaaacaatgttcaagactctggcagccatcgtcgaggaaggcacgaaaaccccgtcactcctcgcaatcaccaatggcgacctcaagcccatcgatcatcggaagcggcaatacgagagactgctggtgcccactgtggcagaggatttggctgcccgtagaacaaagcgagccaggtatatggatgaagacttggaggacgatgaagaaagagtgtcacatccgaaacagccctggaaagcagagcctgagaaggtcgagagcttggacgctgacaacctctctgacgtcttgaacgcggatgaatccgaggagccactccctcctcctcgacagccggaggatgaggagaagccgctcagtaaatcacacacgattcttctacacattgtcaagtcaataccctcgcatctgacttntccttcgccctaccttcgtcggtccttattgtccaaccctattcagggtttcccgggccctggcgcaaaacgaggacaggtttttgccagtcatcaatga

SEQ ID NO: 14674 - DNA, 408 bp, A.fumigatus
gcagacggtccatcaggctccccgtcttcatcagcatcctcaaggacgagggaacgcttcaaatcgtcaggcagctccttggcacgagccttgacggcctcctcagaaacgtcaacagcccattcgtcgtcttcaatgtctttctcggcctctagggcctcagcctcggtcttgatacggcgagtgagttcatcgtcgctattggcttccaaggcaacatcctcgacttcaccgttgtcggagttgctgtctccagggctgacattgtcaccgttggtaccctcctcggccttcttattcttgcgggctcttctggcggccttgtccttcttccctcccttggtagaagcacggtcgcggagaatgaaggtgctcagcttcaaacggggatcaacatcggtgcgctga

SEQ ID NO: 14675 - DNA, 1287 bp, A.fumigatus
tcatcttccacaaccgtcaaaatggctaccgtcaacattcgtcgtgatgtcaccgatcctttctatcgttacaagatggagcgcctccagtccaagattgaaggcaagggtaacggtattaagactgtggtcgtcaacctgaactcggtcgctcagtctttgagccgtcctccatcttatgtgatcaagtacttcggatttgaactaggtgctcaggctaacgccaagcccaccgatgatcgctggattatcaacggcgcccatgatgctgccaagcttcaggattacctcgatggcttcatcgccaagtttgtgctttgcaagaaatgtaagaatcctgaaacggatgtcatcatcaaggacgacaagatcatccttgactgcaaggcctgtggtcagcgcaccgatgttgatccccgtttgaagctgagcaccttcattctccgcgaccgtgcttctaccaagggagggaagaaggacaaggccgccagaagagcccgcaagaataagaaggccgaggagggtaccaacggtgacaatgtcagccctggagacagcaactccgacaacggtgaagtcgaggatgttgccttggaagccaatagcgacgatgaactcactcgccgtatcaagaccgaggctgaggccctagaggccgagaaagacattgaagacgacgaatgggctgttgacgtttctgaggaggccgtcaaggctcgtgccaaggagctgcctgacgatttgaagcgttccctcgtccttgaggatgctgatgaagacggggagcctgatggaccgtctgcctacgatctgcttggcagctggattctcgagactgcatctgaaaatggcggcgtcactgccgttagtgatgtcgacatctacaagaaggccaaggagttcggcattgagaacaagcacaagactgttgctgtccttgctcagaccatcttcgatgagaaaattgtcaaacagattcccgcccgcgctgctttcctgaagaagatgatcacttctgagcgccacgagaaggccttcctcggcggtaccgagcgttttcttggcaaggatcaccctgagctgatctctctggtccccgccgtcctcctgggttattatcagcacgaccttgtctccgaggatgtgctcaaggcatggggttccaaggccagcaagaagtacgtcgacctggcgaccagcaggaaggttcgcaaggctgctgaaccgttccttgattggcttgagaatgctgagagcgatgacgaggaaagcgaggatgacgaataa

SEQ ID NO: 14676 - DNA, 363 bp, A.fumigatus
aggctgggtggcctccttcctttttcttgcaatccaaacggcacagacggacaggaatatactcgcctagtcaccatcatcttcctctcatccacggccgctctatttgccgacacttacctctgccgtgtcttcccactattttgggaaatgttggtgaatcttgaccagattgagttttaccatggcccaagtcaccagccgggcgtctatcagtgcaaagtcactgcctccagagcataccccacggcctttccagcattctttcccgactatgttaaccttcggcccggaatcctgtgggacactcctaggacaagaaccgccattgaccggcatgactcatcagtggaacatatttga

SEQ ID NO: 14677 - DNA, 708 bp, A.fumigatus
gcagtgaaaaaaggactccccacagcagccgtggttgcttcaacgcccaagtccgagctctccgcctcgtatgacgttatcgtcatcggcgccggattcgccgggctaacagtcgctcgcgaccttggattcaaggggaagaaggtgcttcttatcgaagctcgcgatcggatcggcggtcgctgctggacagtcgacaccggggagaccgccaagcttgagatggggggaacatgggtgcattggatacagccacatgtctttagcgagctacagagatgcgatttggatgagtttgtggaaacagtggcgttccccgagaattgcgagtcggtcaaaaaggcgtcccggcaggatcccgccgtcgcccatgatccagccgagggccaggcgatgatggagcagctggaaggcctaatggccaagttcttcgacattgatggccaaggaggacggagcgttattccattccccttcaacatggcctccagcaccaagcacaatcctgaatatctcgaactggataagctgagtattgccgaccgcgtcgcacaaatgccggactgcgatgaagagcaaagagccgtactcggtgcgcaggccgcttccttttacggcattgcgcccgagaagggggcattcactgaagtgcttcacacacaggccctctgcaactttgatccagccatgactgaaatcgcaacgatg

SEQ ID NO: 14678 - DNA, 447 bp, A.fumigatus
cagcgaccactagcgttcaacctcctcgaaatcatctttctggtccttcccttcgagtggtggatgccgcgcgagcactacgccaagctgaatgaggtcatcatgggtattatctactcaccactcttactcatcatcgcaacgctcgagacccgcgaggcacaccggatccggtggaatcgtcgtcagggagaagaggatgacgatgttgttcacgagtgggaggatgttgctgagcaagttgactttgatgtggacgacacctggagacaggccgtgcgggacaccaccccagatccgaatgcagagaactgcaccttggagatcattcagctgcgggagcagatcaaagaactcacagctgtggttcatgcgttcatcgagaagaaggatacagaggagcacatgagggagcaatccagttccaatcagggtgacgcggagtag

SEQ ID NO: 14679 - DNA, 1197 bp, A.fumigatus
acatcaacgctgctaatcggtctagtggcatgtggtgtgtattcaattacaagactgctcaagggcagtcctgccagttcgcaacttgcattaaatagcgcgatcccaaccaacagcatgactgacaactccctccccttgctctatgcaggagaacacttggatacagtcgcaggattcccaacactatacgcattcagtcctgcaaatcacgacaatcccctgatggtgttcataccgggtggcggtcataatgcccgcatctcatatggtggtcatcctggaagtcgcagtgaggacttcttagcacactggctaaataagttgggctacggcctacttgccatctcgtacccgctccagagccagccggacgagatcatggccgcaacatcaccagaatttcgtatccgtgattggggtcttcaagcagcagaggtaaccaagacggtgattgagaggcatggcctgtcgcccaaggtggtgctcgttgcttggagtatgggcggccgggtagtggttccctatacgcaagcagcgaaagcacgagggttgaccgtcgagctatttgtgagtcttgcggctactcctggactggcggcttctcggcccaacccgcctggtatcaaaatgacgtccgaggggtatgctgcattggataggatgccggagcttttcctgagccaggtccgtgagcagaatattctagagtctcgtgtcattattccagacgacgtgtatctccgtgactactacggctgtacgcctgtcggcttgctcggctttggcatgagctattctcccgagcgcgggtttgttgaagatcgatatacatcaacggaagatgccgacgcgaacaactttcgtcagtggcctttgatttctgctctgcatggtgacagcatcctggatggacggcatgtacttgcggacaaggccacctggggatttatgcaggtgcagcagcttgtgagcactgtcgaagatcgaggttacagatcgctgaatcctgagcgctgggaggaggttgttaagctggtccactcacgaccggagaatatgtgccggcagattcatggtaatcactttttcttcctgggggagcagggcgctcgtgagacggcggctgccattgttgaacagctgaaagaagctcggatcttcatgtcgacgcttgacactctgcttgtgccctga

SEQ ID NO: 14680 - DNA, 204 bp, A.fumigatus
cgggggatagttttgctcaacatcctgattgccctctacaatagcgcttatgaggatatctccggcaatgctgtggacgagtacatggcgatcttcgctctgaagacaatgcagtttgttcgagccccagacgaaaacgtcttcattcctcgtgagttttcctgttgttctgccgactgggctttaactaacagcgaccactag

SEQ ID NO: 14681 - DNA, 186 bp, A.fumigatus
acaagtggattacgtggctgtctctggaccatatccccgcacctctctaaatcaacgacaaccgcttcttcagccttttccaccttagacatcaacgctgctaatcggtctagtggcatgtggtgtgtattcaattacaagactgctcaagggcagtcctgccagttcgcaacttgcattaaatag

SEQ ID NO: 14682 - DNA, 204 bp, A.fumigatus
ccgcaagactcacaaatagctcgacggtcaaccctcgtgctttcgctgcttgcgtatagggaaccactacccggccgcccatactccaagcaacgagcaccaccttgggcgacaggccatgcctctcaatcaccgtcttggttacctctgctgcttgaagaccccaatcacggatacgaaattctggtgatgttgcggccatga

SEQ ID NO: 14683 - DNA, 651 bp, A.fumigatus
ccacatctcaggttcttgggctggtactactacgccgccgaaaaccataacacttttgccgtcgcgcgacggaccatgacccttggcaacttcgccgcattcctcatcttctgcttctacccctgcatgccgccccggctgcttcccgactcctatggcttctacgacaccgtccgccaagagcacgcagagagcgtctgggtcggcgggaaatctgtcaaccagttcgccgcgatgccgagtctacatttcacctacgcatttgtcatcgggtgtaccttcatctaccactcgggcctcgtgcacagactccagggccgacctgtccgcaagtccccgttcacgcagatcttcttcatcatcatggcagtcgtgtaccccttgctcgtgctgagtgtcatcatcgcaacggcaaaccactactggcttgacgcgactgtcgccaccttcacggtcactatctgcttcttgggcaaccgggtcctgctgctcctcctcccggtcgagtactgcatctgctgggtgttacggcttgcgaagcctgtcccgacgacgggcgatcgacatctgcacaagtggcgccagtcgcatggggatgtgcccttgctggccgagcaggattctgaccggttctcggattcggttgtttaa

SEQ ID NO: 14684 - DNA, 315 bp, A.fumigatus
cccttggcaacttcgccgcattcctcatcttctgcttctacccctgcatgccgccccggctgcttcccgactcctatggcttctacgacaccgtccgccaagagcacgcagagagcgtctgggtcggcgggaaatctgtcaaccagttcgccgcgatgccgagtctacatttcacctacgcatttgtcatcgggtgtaccttcatctaccactcgggcctcgtgcacagactccagggccgacctgtccgcaagtccccgttcacgcagatcttcttcatcatcatggcagtcgtgtaccccttgctcgtgctga

SEQ ID NO: 14685 - DNA, 1140 bp, A.fumigatus
ttatactattccagtatgaccaagccacagccacctccaatcctcgatttctctgtcttctatggccatgacagccaagcaaaagcccagctcgtgcagcgagtgcgcgaatgctgtctgaacaacggcttctttcagatcaccggccacaaagtctcgccagagttgcagcaacggacgttcgactgcgccaaacgattcttcgacctaccacttatcgaaaagaagaagattgagcgaagtaagaattacccttggtaccccgctgacaagcaactgacattggcaggccccgatgccttcaaccgtggctacgaagccttccagtcacacatgtcccagccaggcagcgctcctgaccggaaggagggccttttcctgggcccagaccttgcagaggatcatccgtactgtgttcagaagaagctgaattgcggaccaaaccggtggccccagggactcgacgacctagaagagttcaaactcgtctcgatggaatattatgccgctctgtttcagctggcaaaggatgtcgttgctgtgctcgccctcacaatggattatgaggagacattctttgatcccctgaccgagggcgccatcgccacgctacgatatctgcactatccacctcaacccgtgggtgacgctgaggcggggctggggactggtgcccatcgggactacagttgtatcactctgctcctgcaagacggaactggcggccttcaggttttggatgagcccaccggacaatggctggatgtgcgttgctctctctcgaatggaaaccttgtccaatgcgttgcttactcgtgcaatctccaggttaaaccagtccccggggcatacatcgtcaatctggctaatgtattcgcgcgcatgacaaacggacactacaaatctgctctacatcgggtggtcaataagtctgggttggagcgctattcgatcccgttcttcttcactggcaacccggactatgtgtgcgagtgcttgtcgcgattccggaaagagggagagccggtcagacatcctcctgccacggtgcatgaggtggttgcggaagcagtgagaggcaccgtcgagagagcaaaccgttataatgcggaacgtcaggggatccacgcggcgcagtaa

SEQ ID NO: 14686 - DNA, 207 bp, A.fumigatus
atctcctatacgaaaaagagccactcctggatcgtctttaccctaacaggaaattctgacatcggacatcggccgcagaagatgccgattgcctgcattaccaaattttccggccgtcggggtaccactctagataagtttaggactttcctggcctggcggaagccccaaatacgaggacgaacctggaaaaccaagagccaatga

SEQ ID NO: 14687 - DNA, 549 bp, A.fumigatus
tccatctggagagggggacagcgagaaaattctgatataaaatctcgagagctgtccttgtgtagtcagtttgtcagtttgccagttttcgcagttgaggtgaacataaggtggaacttctggcatctttcttttttcgcttggaaggatcagtttgcgcggatatatcttaccttactcatcgcaccccgacataagcgagtcaaaatggcagcgtcagcgtccagcgtcacggacgtcgacatcgagaacgtcccgaaggaaaaactggacgtcaaagaaaccgagaaggagcctgatttcgaataccctgctctctccaaagtcgtcgtcatcatccttggtctgtatctcgctgtcttcctggtagccctcgaccagaccattatcggagtcgccatccccaagatcaccgatcagttcaagagtattgaagacattgcctggtatggcagtgcctacttcctcacatcgactgcgctgcaaccgtcgtacggccgcatctataagatctttagtgttggtttcctcccgtgctgcatgtgctga

SEQ ID NO: 14688 - DNA, 729 bp, A.fumigatus
cggtggaggatctcgatgcacaacctggtgcagctcttgcgtcgcaaacgcggtaaccaactgtggaggatgtcccctgatgaatcggagcatgcggcaagagctatggtacagcagtcattgatggacgactccttgcacccgtcgagatcctcatctgctactcggccgcagcgtacaggtgatgcatttagcatacccgatgtgccaacaagcgccccacggacacctgctccagaaacaggtcatgctgccgagcaaggatcgaccttagaacttccttcagctccagcgactattgcctcttcgtcaatcccgaatctcccagacaaatctgcaagcctgggcgctcaccatcccgctgatcccaactctaattcgttccattcctttcctccacctgccaaccttccaagtcctccagctgcattcaaccagcccagccatttctataatcaacccaagccaagcgcctgggctccttcaccacctgcacaaccccatacagaaccggcaccagtggtttcgcggccggtccagcagccagcatcagcggctgtacccacagtctcggcttcaagtcaaagcaattcgcaggggatagatgaccaggccattgccctagcgcaaaagcatgcccgttgggccgtgtccgccctgacatttgatgacgttgacacagcgatcaaagaactcagaaactcgttgaaatatctgggggcagagtaa

SEQ ID NO: 14689 - DNA, 303 bp, A.fumigatus
tggacgaacctcagggttggattacgattgacacattgcaggcaaactgcagacactttccaggctgccgctacttttcttgaattgtgtcaaatttggaaccccctcgaacccgaaattgctgcgaaaatcaaatttgccaagtaccatgcactgagaattgtgaaggcgatcaaggccggagaggatcctaacgcaacaaatccagtcatcaaggaagaccaccaggcggaagggccggcagtaacggtggaggatctcgatgcacaacctggtgcagctcttgcgtcgcaaacgcggtaa

SEQ ID NO: 14690 - DNA, 1011 bp, A.fumigatus
aaaaaaaggctttggttctttgcaaagcaccttcggcaagtcccagccggcaaaagaaagggtccttcccccaaaagctggtgggaaaagttcaaagctaaagaacaacctaatgggggcccaaagtctcggaaagggctcaatcgcaaaaaagcgattcagagaggccctacacgtttgactatcgattcagctctagcttttgctgtgcagtccccttctgtgctttctcccacgtcaccgaccgggtttgcatcgccgtcaccgttgtctcccatcatgaatccagaacacatgcgcaaggagcttgcaaaaagcctagatgagcttgctgaggagtatcagcacaaacacgcgaaaagcaccacctcgctcgatacgaattgctcgctttctgccagtgtgactagccccacatccacattggtatcggacagtccattcacacctgtcagtcagtcgcggggatcgctcgcagacagccagtcgaataggccacgaagccagacgcttccaacaggcaccctcgacccatctttgatatctacagaagaatcgtccgatcattcgctctctaaagcggctttgcagcagtcgttgtctatcacaacccttgagtcacctctcgaggatgagcacaactcgaagaagggccccggtctcgatacatcatccaataccatcaagcgcaatcgcagcaaccctgagatcaaggcaaagcccatgtacccgccctccttttccaaatctacaactgtgtcaccaattagttccccggggtctccaacgcaggatgaggcacgaagagctcttgagcttgtggtgtcctatttcgagcaccagccaacgggactcggcgcacaggaattcgtaaccattgggaaattgatggagagacttgagctcgccagggcccagcaaactgctctccccggtggtctggcgcgcattgatgaacttgaagatgctcctcaattgaccaagaaacgaagcattcacaacctgggttaa

SEQ ID NO: 14691 - DNA, 237 bp, A.fumigatus
attgagaattacttacggaacaccattagagacttcttcagggttcctagtgtctatgaattttcaagcatcctgtatctcaggaaggaagctgacgtaggccaaagcgaccaaacaatgacctttcgcttggatgttgacatgaagctgttcgacgctgtcgctgaacaaccatctaaagatgatgacagccattccaacgtggatcagcttggacctgctctagtccgtatgtga

SEQ ID NO: 14692 - DNA, 462 bp, A.fumigatus
  unsure (231): Identity of nucleotide sequences at the above locations are unknown.
gcaaagctgctgtcctcctcctggcgctcaacgtcagcgccagacccatcgaggagcctcctgcgcagacaacaacgcccgccgggtatggagactataaggattatggctcctatggcaagtacggtgactacggtcactacaagcgtaacgaggagcccagccccacgaccacatgcaccgaaacagaaactcccactccagcagactacggagactacggagactacngcaactatggtcaatatggggactatggtcactacaagcgtggcgaagaacccactacaaccaccacaaccaccactgagaacccaagtccctctccagcaaactacggaaactatggtcaatatggggactatggtcactacaaacgtgacaaagagcccaccgcaaccaacactgagacaccaattccctctcccaatccccgccgacttaggcaactatggagaataa

SEQ ID NO: 14693 - DNA, 438 bp, A.fumigatus
tcagaccccagcaatgctataatctgcgagtcgtttccttttctcgatgtcacgatgctgaagttatcgatcatgtccatgaccgtgctactgttcttccagtccagaacgacacacgcaacaggcgcggttcctacagccatgactccatcctcgacggcccctcacgctacgcataccgtcaaagtaggtccaaaagaaaaccctcatcaatactcgccgcacaacatcaccgccgccgtcggcgatgtcatcgtcttcgagttctacccgcgcaaccactccgtcgtcaaggcggactttatggcaccgtgtgtgcctgctgcaggagaaatcttctattccggacagttcaatacctttaaggaaaataaccatgggcaactggaaggagaggttagtgtatcgcctatgtcgagatcacagctaacgttttag

SEQ ID NO: 14694 - DNA, 618 bp, A.fumigatus
  unsure (358): Identity of nucleotide sequences at the above locations are unknown.
agcagtgcactagctataaagcctgctacccttgtccgtccacaaggtcttcttcatttcctgtcacagagcaaactcttctcttcatcctcaacaaccctatcatccagcacgatgcatctactgagcaaagctgctgtcctcctcctggcgctcaacgtcagcgccagacccatcgaggagcctcctgcgcagacaacaacgcccgccgggtatggagactataaggattatggctcctatggcaagtacggtgactacggtcactacaagcgtaacgaggagcccagccccacgaccacatgcaccgaaacagaaactcccactccagcagactacggagactacggagactacngcaactatggtcaatatggggactatggtcactacaagcgtggcgaagaacccactacaaccaccacaaccaccactgagaacccaagtccctctccagcaaactacggaaactatggtcaatatggggactatggtcactacaaacgtgacaaagagcccaccgcaaccaacactgagacaccaattccctctcccaatccccgccgacttaggcaactatggagaataacggcacctaccgccaagtatgggggataa

SEQ ID NO: 14695 - DNA, 807 bp, A.fumigatus
  unsure (266),(290),(445),(472): Identity of nucleotide sequences at the above locations are unknown.
gtcctcatagggaaaaaaaaaaaaaaaaaacaaatggcgcgctccgagtcagataaggatatcgatgccaactacggcctactcaacaatgatgaagcccagaattggagtcatgatgagaagcctcgaacgacatcgcatggacaatggctcaaggccttgctctatatcgccacagtgatcgtttcgtgcttggttggactcttcatcgggcgtcaagtgcaatacctcgataggccctgtgctcgtcatgtctctcattatgntacgtcccacattttcgggattgntgagaactccataattaacaaaacagcacctgttacctcggacgtcgacataacgttccaacctcagcggttcaatggctcgctgctcaaggagaacatttaccgccaagatgccagtccagaggtcgacgcagcatgggaggcactaggtgtanactgtaagatggattaccccgggatanacgagataccaaccgtgagcagatcgaagtttgcgtgttcctgccgaagtagcagaaaagtccggactggcgcgagaccaggtcaagatcaaccagaagtatggaggagggtatccagcgaatgtagagggtttccatcatctacattgtctagtatgtcttctttcaattatctcaagatgaaggctgaccagtgtagaatctactgcgccaaacgctctactacaactacgattactaccacaagctcggtcaaggggctttcaagaacgacgattttatcgtccgacggcacgtgtgtacgtatttcataccgcagtttctgcgcagagtaa

SEQ ID NO: 14696 - DNA, 252 bp, A.fumigatus
cattcgctagcccactgtctggacatcctgcgacagcagctcatgtgcaccattgacactggagtcctgggccaagtttggatccatcccgatcacccagaggcgtacgtggacttcaacacagagcatcagtgcaaaaactttgaagctatccgccagtatgctgagaagaatcagctgccggcacagattccaaaggatttcttggagccacctaagccaggtgatagagtctatgatgagattccatag

SEQ ID NO: 14697 - DNA, 198 bp, A.fumigatus
aatctactgcgccaaacgctctactacaactacgattactaccacaagctcggtcaaggggctttcaagaacgacgattttatcgtccgacggcacgtgtgtacgtatttcataccgcagtttctgcgcagagtaaggctgacattcgctagcccactgtctggacatcctgcgacagcagctcatgtgcaccattga

SEQ ID NO: 14698 - DNA, 258 bp, A.fumigatus
attcggaatgttcaggactgtgaaaagctcattgagaattttggcagtgtagcgcttctgcgtaaagacaatacattttgttcctgtggtatcattgaagtgtttgctaagttccatgcggagacgctgcactttagggctgagttcacctgggagctcgggatcagtgaaaaagtagttcttgactgtttcactcgcttctctgatgcgtataatatctttgaaaacagcaccatgttctgccttcatggtgtttga

SEQ ID NO: 14699 - DNA, 447 bp, A.fumigatus
cccgttgtaggatcgggaaagacattgatcgccgtgcttttgctgaggcatactatcttgaatgagctggacgatcgcgcgaatgggaagacgcatcgtgtgtcgttctttctggtatttgtcttgcttgccttggggaggtgtatactaacttggtgcaaggttgacagcgtcacactcgcatatcaacaggcggcggttttgcgcaataacattgaccagaatgttgcgcacttctttggagccatgggcactgacctatgggataaacggacatgggataagcatttgcagcggaacatggtgattgtttgtacagcggagatcctgaaccaatgcttgctcaattcatacgtaaggatggatcaaataaaccttctgatctttgatgaagctcatcatgcgaagaaagatcacccatatgcccggtttgtggaacacttttga

SEQ ID NO: 14700 - DNA, 804 bp, A.fumigatus
cagcttcgccaatcgacacaaaaggcgacatcacagaagccgcatcgtatgttctcagccggtgagcaaggtgatatcggactaaccagttgtaggagactagagacttttttggatagtcgaattgccacaacgtcaaagatcacactcttacgagaagttgtcagtcgcccgatagagaaagtgtgggcgtacaacaggcttgagccacctttcgcaacagaactttataagctcatggatactcgttatggcaatatcaaggtactcgaaggagtctatagatttgcctggaatgcgagctcggaattgggaaaatggtgttcagacagagcatggtggcatgccttggcagatgatgtgttgcctaaacttgagggtaacatcaacaagcttatcgagtcaaacaccatgaaggcagaacatggtgctgttttcaaagatattatacgcatcagagaagcgagtgaaacagtcaagaactactttttcactgatcccgagctcccaggtgaactcagccctaaagtgcagcgtctccgcatggaacttagcaaacacttcaatgataccacaggaacaaaatgtattgtctttacgcagaagcgctacactgccaaaattctcaatgagcttttcacagtcctgaacattccgaatttacgtccaggggttctcataggcgttagacccggcgacatcggtggcatgaacattacgtttcggcaacagttccttgctctggtgaaattcagaacaggagagattaactgcttggtgagattcacctcaaaaatgctctaa

SEQ ID NO: 14701 - DNA, 1491 bp, A.fumigatus
gaaaaccacgagaaattgacgtttcattcagacgacgcggggtccgcttgccgcggcgcgataaatatgaagatcgccaggctcagcatggacgcgcaggacaagacgcgatttgaaatacatgggaagtcatctgtcaaatatcatctcaaagcgaaccatgttgtggaggctaaacgctggttctggactctgaacaacgccatacaatgggcgaaagacgaagcaaaggaggaacagaaacgccagacaagacatgctgaggcacttcgccaggcaaagatggaccagatcgaaggccggagtccaacagaggctgcaactgaatccccgaacctggccgccagcaagtcaaatgggaaaggtctagcacctccttctctaagcgtgccaagtggcaacacttccaaactcaccacatatgggtctcgtacgacccttgacagtgtacctgcagatgaggaagtctcaatacacggttcttacgaccagagtgttttgcaaaacgaagtcaatcgggtggtcagtcatgtaactagccatctggatggcgaaggcgacgaggacgactatggtgaatacgcgtctagtcgtgatatcagtccttccgataaagatgcgctgaacatcacggcgcaatctgcaaaacttcaactcgagattctggccaatgtcgtcgctgcgttgcaagccgagaaatcgaaggatccgaaccttccaatctcggaccccaccgttggccaagcccttgtagcgtatgaggcagctgtaagcagcctggaaggtctggtccaaaaccttctcaaaatatcgcgggatcgcgattcttattggcaataccgacttaaccgagaggcttatcttcgcaaaatgtgggaggaaagcatggcgcgcattgcacaggagcacgaagagctgcaatcgaagatgggagaatccgaagagaagcgcagacgtaccaagcgagctctcaaagaagctctggaaggcgtgtccgcacataccagtcgtcgtggtagcaaggttgcgtctcgcatacaagtctctggggaagacagccgtgttggcggagatgaagcaaaagaactaattgcacagcccatggaatacatgacggaaaacgaggagaacgagtctgggaagtccctacgtcggaagaggtcagccctatctcgcatcagcagcctgtacgattctggatcggacgacgatgatgagttttttgatgctatcgacgctggggagatagaagtggaagacatgactacttcgaaagtgatggagaaagaaaaggaaaagccagaattagaaagcactgagcctcgagctgcgaaacgggacgagatagtcccctctttcaagggctacgaagagcctgtacggacaagacttaagctggacaacgacaatagaccgaaaatttctttgtgggtaagtgattgcgagtacatgcttaagttaggattcaaacaatctaaggtgatgctttag

SEQ ID NO: 14702 - DNA, 369 bp, A.fumigatus
ggaattctgaaatccatgattggcaaggacatgacaaagatgactttaccagtatctttcaatgagccgacatcattgcttcaacgagtagcggaggacttagaatatgctgaccttctggatatcgcggctgaccgatccgactcgatggagcgattggtgtatgtagctgcttacgcagcgagcgaatatgcttcaacaattggccgtgtggcaaagcccttcaatcctcttctcggagagaccttcgaatatgctcggcccgacaagggatatcggttcttcattgagcaggttagccatcacccaccgattggcgcagcctgggctgagtcaccgaagtgggattactgggtaagatttgaataa

SEQ ID NO: 14703 - DNA, 189 bp, A.fumigatus
  unsure (90),(91),(119): Identity of nucleotide sequences at the above locations are unknown.
gcatgtgtactcaacagccgtccattcagccccgcgacagtcgacatgcctggcgagtatacctgcggacgctgtctgcaggccctccanncgaaggtttctattcaaggttctacgtntcgattgcaaactgtgatcaattcgccaggaccacgcagctcccccctcttcgttctcccgaaagtttag

SEQ ID NO: 14704 - DNA, 276 bp, A.fumigatus
tcaattcgccaggaccacgcagctcccccctcttcgttctcccgaaagtttagttcgcagaaccaaccattgctttgcaccccgatcctcccaggggcaattgaaacggacatcatgcccatctttgtcgccttcatctgctgcgtctccaacggcaaggcagctaacgcaccgagcctcgtccacctcttcgagccaagcacaggagacaagagctttgctgaaaccaaacaacctctttcaccctttctcgaaatcccctgcacccgcgattag

SEQ ID NO: 14705 - DNA, 822 bp, A.fumigatus
ataactctctcctgtgacaccgtctccttctttctaaacttctttccacagggagagtccgctcttaagtcgaagttctacggcaaatcattcgatatcaacctccttggaacctggtttctgaaactacgtcccgtatcaggcggagaggagctttacacatggaagaaagttacctcgtctgtcattggcattatcacaggcaatcccactgttgacaattatggtctgatggaaatcaaaaactggactaccggcgaggtttgttacctggattttaaaccgagaggctggaaggcgtcttctgcgtatcaggtgactggcaaagtcgttgatcgcgacggaacgccgagatggagtattggtgggcgctggaatgataaaatctacgcacgccatactcctgggttcgaagcgcaagtgtccggtcaggaccccgaatcggctaagacattcctggtttggcagagccatcctcgaccaagtggaattcctttcaatctgaccccctttgttatcacactgaatgctcttccagaaggcttgagagaacatctcccgcccacagacacgcgactccgccctgaccagcgtgcaatggaagacggcgagtatgacttggctgccaatgaaaaacatcgggttgaagaaaagcaacgggcgaagcgtcgggagagggaggctaagggcgaggagtaccgccctcagtggttcatcagggctaaatgtccgatcactggagaggaatattgggcgcacaatggaaagtattgggaatgtagagaaagacatgactggagtgcgagcgaagatatcttctga

SEQ ID NO: 14706 - DNA, 1020 bp, A.fumigatus
  unsure (130),(131),(159): Identity of nucleotide sequences at the above locations are unknown.
tacaacggcattctcggcggccagaaattacagcttctaagcatgtgtactcaacagccgtccattcagccccgcgacagtcgacatgcctggcgagtatacctgcggacgctgtctgcaggccctccanncgaaggtttctattcaaggttctacgtntcgattgcaaactgtgatcaattcgccaggaccacgcagctcccccctcttcgttctcccgaaagtttagttcgcagaaccaaccattgctttgcaccccgatcctcccaggggcaattgaaacggacatcatgcccatctttgtcgccttcatctgctgcgtctccaacggcaaggcagctaacgcaccgagcctcgtccacctcttcgagccaagcacaggagacaagagctttgctgaaaccaaacaacctctttcaccctttctcgaaatcccctgcacccgcgattagacagcgtgcggcattcatcaaacagaatgctttttgtccgcatcctagtcatcaacaaacccgcgtagcgctctcgccccacgatcctgaatctcggaagagccccaaaagcgcactgcctccggcccactctcactttgagtgccccgactgtggcgttcccatctactgttctgaggaacactggatggatgatttcgaggcgcacctggaaatctgtgacaccatcagacaaatcaacgaggatgaccacgaccttcattcggggcgctttttccccgagttcacctacccagggccgcaggacgacaactttgtcattaacatgaccaattgggacactttcctttatacacgggaatttgatgcgatcaatcatgaccgaagcatgcgacaagtgactagaatgcttacgtacccgctgacgatcggaagtgttctgcatgagctgagtccttacagcattcgaaagggaggccgactcactaccgaagggctaaagagcgttagcggtaagctgcacctttcggtgctcagccagttacctgtaaattgtccaagtagctga

SEQ ID NO: 14707 - DNA, 819 bp, A.fumigatus
gcctgcactaagatatacttgtacccctcattctccccattctctcctcattcttcctccgtccttcgtcaatcttcgaatcttcgttatccactacatagcagaatgtcgaaactctctgattaccgtctgttgtgcttcgatgtttatgggaccctagtcgattgggaatccgggatcgtgaacacctttcaaccaatcctcgacaagaacaattcgtctatttcacgcgagcacctcctgagtgtctaccatgagctggagcatgagcaacaagctcagacacctgacatgccatactccaaactcctaaccaagattcatcccaaactggcccaccgcctctcgctcgccccgccgaccgaggaagagagtatcgcatttggcgaatcagtcggcacatggcccgcctttcccgacactgtcgatgctctcaagcgtctatcaaagcactacaaactggtggttctgtccaacgtcgaccgggaatcattcgccaagacgaacgcggggagtctgcagggcgtcaagttcgatcgcatcatcaccgcgcaagacgtgggctcgtacaagcctgacatgcgcaatttcgaatacatgttgaagacagtacaggccgagctgggggttgacaagagtcaggtcctgcagactgcgcagagtcaattccatgaccaccagcctgcctccaaagtcgggatcaagtcggtgtggattgtaagaccaggagctgttatgggcaacaccaagcatactatctacgactggaaattcgacacgctgggtgatatggcccatgctgtagaaagcgggcaatga

SEQ ID NO: 14708 - DNA, 723 bp, A.fumigatus
ttagcgccttgctccctgctactgtcctctctctccaacacacagaggtacaagccaacattccaccattcaagtcttcgactaaccattcaggactctctcttccccgccagatgctggcccgacccctgcgccggcatcaccttccaaaacgacacctacgtctgcggggaccctcgcctcggtcccgtcgtcctacctcagaaattcccactcaataacgagctgcgcacctacgcgcggttcggcgccctctgcccggccgagttcctagacaaatgggccaccgatgtcgctccaaacgggacatatatctaccctcctgccaatgggttcgccctcgacacagaggagcaacccatcctcggcaacgcgaccttaccggttggcatgaagcttgaccgtttcggatcggagtatggcacctttctggcgccgctgggagcgccgtacatcgagcgctcgttgccgccgagtaatctcaacacgtttgacgggatgtatccgtacaactatcacgtgtaccaggtgaccaaggagtttgtcgtcggactggggcccattgcgccttggtttgagcagccagggatggggacgcagttcgtgacatataccaatgtgctgggattgatcgatgatggttacttgcgacggttggatgagagcgagtatgatgagaaggtggaatactcgaatccgtatactccggggccgaatcagtag

SEQ ID NO: 14709 - DNA, 555 bp, A.fumigatus
  unsure (401): Identity of nucleotide sequences at the above locations are unknown.
tatcagatctacggagtactttccggggcctccctcatggagaccgcggcggaggtgattctgcgacccgtccctcccctcacccaggtaaacggtacgcgctatgtctccaactcatctgaggttatctccttacggtttttccatgaatggcagagctttacacaggatgttctcgaagcatctgcttctttagatcttagccatcccgttccgtacacggatgatgtgtcagaaaactacgtcgttggaagcgaacttgggttaatcggaaggttctccaagaatgtctgtgatccagtttcgaaggtgtttgccactacttgcctctctcacttgaagttcggtgattatcagtccgctgcaggaccaacggacacaagtcaagtacctggtatcantatgttcaatacaacaggaccacctcgccccgcggctgtcggcgaactcaagtctttctggacagttgaactcgaggactattcaattcgcgaaggctaccagcggttaattggcatccagcatcacattggtaagtccagttacaccttatga

SEQ ID NO: 14710 - DNA, 384 bp, A.fumigatus
agtgttcgatttatttccttgaaacattttaaatacggggttgagttctatcattcattgcccgctttctacagcatgggccatatcacccagcgtgtcgaatttccagtcgtagatagtatgcttggtgttgcccataacagctcctggtcttacaatccacaccgacttgatcccgactttggaggcaggctggtggtcatggaattgactctgcgcagtctgcaggacctgactcttgtcaacccccagctcggcctgtactgtcttcaacatgtattcgaaattgcgcatgtcaggcttgtacgagcccacgtcttgcgcggtgatgatgcgatcgaacttgacgccctgcagactccccgcgttcgtcttggcgaatga

SEQ ID NO: 14711 - DNA, 1359 bp, A.fumigatus
ccaaaagtgaacgcggccgacacacgctccgaattgactagacgaaagacaaggctccaccgggatatcctacgatcacacttacacgctaattcatccgttctccagtcggcggggtcatcccatgcccactgcttctatttcaaacaaaatctagttttaaaaccagatgcaccacaaggaaattttcatggttggggtcccgaaacagtcccgttgttgagagaccagtggagcgccctatccgagaccagagatcagagtgagagaggaaggcagagtcctcgagggtcgaaccgtgatagagggagggacagattccgcgacagagagcgtcgtcgccggtcgaaagggaacgggcgtattcccccgttacggtcgccgccaccttcgcgttctcaaccccagtcagagcttggaggacctcgttcatatcgtgaaatctctcccaataacacctctccgcgtggttcatccggtctgccgtactctgaagccagacaacgccagaatcaagatcatcgccaatttgtcgacccccagcctttggaaggcgagaggccgaccggaagagattatcgaagggacaactctccatctgcacctccaccattcaagcgaaagagaacacagagtccgtcgccagtgagacccttctcacctcgacaagaccctagccatcaccatccagcctcggagcagtttgacgaattcgatcggggctaccctcataaaaaacgtggacgatatccggggcgtggcagggcgcgtcgaaggtctcctagaagaggaagagaccggcgtaggaaggaatcggatcgcttcaagggcctcaagtcccctttacgtggccccaggtcaccgaggcacccccgtgagcgatataacagcccggaccctgccgacgacatcgaccaagagtatcatcatcgatcgccttctcgctattccattaactcagctggttcgagattttcagcgacctcgcgtcacagcttcagagttgacgcaacaatgaatcctaggccaattcagtctgcgatgaacaattccttcagatcttcatcgccccctcgaccagttcccagcttcaatgctgaaattaccggcgtccctacagaaggagaccccaacgcgcgtgaaacgtttcctttcaatggagagcgggcattgaatgccaatgataaccagctctctcacccctcacgactacaggcggatacgagtcaatactccacttcaccaaagtacggcccatcaagtaattcctatcagggatcccctcaatctacatcacctcaccctggaagacgtgggggtctgactgggcaatcccctcatcaaaagccgcgagggtga

SEQ ID NO: 14712 - DNA, 324 bp, A.fumigatus
agacaggcatatgtgcgctggcagtatattccccgggcacatgaagcgggtttgtttgttttcggcgtgccacccaatgaggtcggttctctacagtgggaaggatacggccgaatggcaagaaatgccaaaattcagcgaccagacgagcttgttttgagagagatcaaggaccggaacctcgacatgcagcgtatgtatgtggacattattctatccgataagcttgagcccaaggaggatgtgtcaccatacaggtggcatgaggagatcatgaaggagtttgagaacttgccgtggatgcaggtcgtgaatgtgaaatga

SEQ ID NO: 14713 - DNA, 327 bp, A.fumigatus
tgtttgttacatttgggatggtcgttgattgccagccgggcagtcctcggcactaccctgacccagcccaccatgtccgttgctccgcacatcaacaacacgtaccaagacgttgaattgcaacgacgttgcctggggagactgagctctacatggcaattttgtgctctcaatttgattctagcgctctatcacacattccagaaacccacgtttgtttcaatgatcattcaccaggtatgcttctcacatgattgcattcaagatgtgaggactgctagtacaacgactagcccacagatcaagtccacaggcagtctatcatga

SEQ ID NO: 14714 - DNA, 201 bp, A.fumigatus
agaacaactacgcacattccgaagcagttgcgtgatgtagctttctcgattatccagagatctactcaaagcgacctgtcctcggctctttcggatgaacctaactcgcattcgtatatgatgcctccgctcactcatacataccaggctgatatgaccaagctcttcaaaagtcgagggcagagattgtatcttatatag

SEQ ID NO: 14715 - DNA, 843 bp, A.fumigatus
  unsure (808): Identity of nucleotide sequences at the above locations are unknown.
acatcgcgtctgtctgacttttactttatagccgccaaactcgtgccaatgggcttcacaaccgccacagagatgcacgccagacgaagcgagcttatctcaattacgacagggtccaagcaactagatacactattgggaggaggcatcgaaacagggtcgatcaccgagatcttcggagagttcaggacagggaagagtcaaatctgtcatacgcttgccgttacttgtcaactgccgtttgatatgggtggaggtgagggcaagtgtctctatattgacaccgagggaactttccgtccggttcgtctattagcggtggcccagcgttatggactggtaggggaagaggttctggacaacgtcgcctatgctcgagcctacaattcagatcatcagctccaactactcaatcaggcatctcaaatgatgtgtgagacccgtttctcacttcttgttgttgactccgcaacctccttgtaccggacggattttaacggtcgtggtgagctgtcgtcccgacagacgcatctcgccaagttcatgcggaccctgcagcgactggcggatgaatttggaattgctgtcgttattaccaaccaagtagtcgctcaggttgacggtggtccaagtgcgatgttcaatcccgacccgaagaagcccattggtggtaacatcattgcgcatgccagtacaaccagattgagcttgaagaagggtaggggcgagaccagagtttgcaagatctatgacagtccatgtctacctgaaagtgactgtctctttgccatcaacgaggatggaatangagatccaacccccaaggatctggagaatgattag

SEQ ID NO: 14716 - DNA, 552 bp, A.fumigatus
  unsure (550): Identity of nucleotide sequences at the above locations are unknown.
tgcgaaagtgttatactaacctctctatgctttgaaggctcgcattggactcctttgacatttgacgagagaacctggggggcgtcgattcgcggtctcgtccgatggcatgcgcaacccacgatcaagtaccagggacgcaaccttgatgtaaacgcggccaatgcgattgccactacctccgaccaaacttatgcattcgcggtttgcttgaaccatactctgaagatatggaacctcgctacgaacagactagccgccactaaggatctcttaaaccgaccagtacaacagcaggaatccgcagcatactcattaaaccccgccgaatcatcattcattcgtgtgtttaatgtggagagagctctggatggcggttatcgctactacatagtcacctactcgccctttgaggatgggcgcttcaaattctgggctgtcaaaggaggcctgacgtcgcagctggtcgtcgaggacctctttcctgacgctgcactgacgccgttggacccagaccctacaggcagcatgttctggagtatcgctgatntc

SEQ ID NO: 14717 - DNA, 450 bp, A.fumigatus
gcgcaagatttgcacctcgcaagtcccatccagaccgagagcttccaagtcggcagggtcaaagtcaggcggaggcagaagaaaaggtgtaggtcgggtaggtttccgctgccgcaggatgtagttccagcgctgcacaaaatgccgcgtgagatcccgggcaggctgaccgacaacgtgcatcgagatgtcatgccatggcatcctgggtatgacattacggtcatacatctcctcgtacggcttgtccagatcgtaaaagtcctgaatccgcgggttcgagtaatccttaccgggccagagttggcagtggtctgcgtccttgggtccatcgggcgtctcaaagccagtaggcttgtcgtcagtgagaagatgttgcggagtgtcccaccttccgaaacaaaggtcgattccgccaacgaaagccacggtatggtcgatcaggcataa

SEQ ID NO: 14718 - DNA, 3552 bp, A.fumigatus
  unsure (3432),(3477),(3478),(3492): Identity of nucleotide sequences at the above locations are unknown.
gggaaataccgggggggggggccaggaccttttcccggtttcccctgggaagggccctttccaaaatatttagaggagttccgaggtcttgaaaagtggagatggaagttgaagaagacggaaggcgggaatggagactgcccccggaagcgaccagcggcaatgagaggttctggagggagaaagcagcaacaaggggcaacgccgactgtcaggaggtatatccccggagacaatcaagcattaccaataccggagggggagaccaatggtgggcattcaggtgcagcggaacctggccagtcgacgaagcgggagccatatcccgagagacagcggaagaaacttgaagcctatctacagaagatgattcgtttcttgattttcaaggcggatagcaaccgtttgtgtaaatttctggaactgtctgccttgggtgtccgccttgcatccgaaggcagctatcatggtaaagagggatacctgattatccaatcttctaaaggcctcgattttcgacgggcgctgactccagccatggtgaagaagcggcattcaccaaaatggtttcttgtccgacacagctaccttgtttgcgttgattcgcccgaggagatgaatatctacgatgtgttcttggtcgacccgtttttcaaactacaaacccaaaagatcagtttacgaaatcagaaagcgaaggagcttgccaagtccgctaaagagtcagccaggcacccacagcatcacacgctgaggctggaaaactcggagcggaaactcagactgctggccaggaacgagcgtcagctccatcaattcgaggactctatcaggttcatggtcaataatactccgtgggtgaagccgaacagatttgacagttttgccccagtgcgccagaattgttttgcacagtggctggttgatgcgcgcgaccacatgtggatggtgtcgcgagcgatcaaccaggccaaagacgtcatctatatccatgactggtggctcagtcctgagctctacctgcgacggccagcagccatcagtcaaaaatggcggctggatcgacttcttcaacgcaaggcccgtgaaggggtcaagatatttgtgatcatgtatcggaatatcaactctgctatccctattgactcggaatactccaaattctcacttctcgaccttcatcccaacatcttcgtacagcgctctccgaaccaatttaggcagaacacatttttctgggcgcaccatgagaaattatgcctgatcgaccataccgtggctttcgttggcggaatcgacctttgtttcggaaggtgggacactccgcaacatcttctcactgacgacaagcctactggctttgagacgcccgatggacccaaggacgcagaccactgccaactctggcccggtaaggattactcgaacccgcggattcaggacttttacgatctggacaagccgtacgaggagatgtatgaccgtaatgtcatacccaggatgccatggcatgacatctcgatgcacgttgtcggtcagcctgcccgggatctcacgcggcattttgtgcagcgctggaactacatcctgcggcagcggaaacctacccgacctacaccttttcttctgcctccgcctgactttgaccctgccgacttggaagctctcggtctggatgggacttgcgaggtgcaaatcttgcgctcaagcagtatgtggtcgactggtacgccggacgttaccgagcacagcatcatgaatgcatacgtcaaactcatagaggaatcggaccattttgtttacatcgagaatcaattcttcatcagcacctgcgagatagacggcagaaagatcgagaatctaatcggagatgcgttggtggagcgcatcattcgagcccacaagaatcaggaggcgtggcgtgccgtcatagttatcccattgatgccaggcttccagaatactgtggacagcgagggaggaaccagcgttcgcctcatcatgcagtgtcagtatcgcagcatctgccgcggggagacttcaatctttggcagactgcgtgcgctgggaatcgacccggaagattacattcaattcttcagtcttcgggcctggggcaagattggaccgcaaaagcagctcgtcactgagcagctctacatccatgccaagtgcatggttgttgatgatcgggccgccatcattggatctgccaatatcaatgagcgatcgatgctgggctcgcgagactctgaggtagccgctgttgtgcgtgatacggatatgatatggtcctccatgaatggccgcccgtatcttgtcggacggttcccgcataccctgcgcatgcggttgatgagagagcatcttggtatcgatgttgacgagctgatggagcattcgatagcaacggaagaagaactgcgaaagatccagattgccgaagaaggcagcagatcaccggagaatgctgacaaggctgactccgagtccctgatgatggagagacaggatgagagggatatgattgagcgtcggcatcggatacaagacgagtttctctccagatcggaagacttgcacagtttcaatcacgatgtagactgggaacaagggaacaatcccaatcttaaggcgaacagaaagctcactgcggatccaagggtgacctccaacgcggaacataagaaagacgtcgatgggcatggggtagatcatctggatatcgctctagaagccgggctggccgacggtcgcgattcgcaaatgctcgaagactccgttgaggttctggtctcgcctatcgctagtgagggcaaaggcaccatccgacaacccaagctggcctcgcagcggaacactcaaccaggcagccccattgctagagaatcgagccgcgaatcaccctcaactacggttcatgacgccgatccaactccagtgcttgatggattaccagctgcccgtcatccggctctgccagggaccaatactgaaaacgacaatggcctcctgtcgccgtcatcagatataaccgatgcggcgaagtatccacacccactgatcccagatctcaagcacatcttcattgacaaggactgcatgagagaccctgtgattgacatcttctacctggacacttggcaagcagtggccgagaagaacacaaaaatctatcgggccgtctttcgttgtatgcctgacagcgaggtcaagtcatggaaagaatacaaggagtacgccacatacggagagcgcttttcagaaatgcagagtcagcacagcgccaagatttctcatccaagccccccaaaaaccaacgggagctcccggggacaaatacagcgcagctggcgcaggtatgcggtcactttgttgctcactcggatcgagcggcgaagtccacgcgacggaacacaaggggtcacagangccccgacgagaagagagaggctcgcgaaggtggacgcgatgcanntgatcgaatgcagnccgatcttgcccaagcagaaacattatcgtcaattgacgagaggactgcccttgaagtag

SEQ ID NO: 14719 - DNA, 882 bp, A.fumigatus
agcgcgtttccttccagcctcgtcgtgaagacgcggcggtggctacgggacagacccgggccgcccctggcttcttcaaaaggagcagcgaggaacagccggtggcgcatctggctgcggctgattgggtttgcgtggaagtcgttgtggaagacggccaaagtagcagtcaagctccgagaagtgatcatcttcctcattgcctggttccttctttcagacgcaatggcgacggtgtccggcacggccattttatttgcgcgcacagaactaaagatgagcacgacagccgtcggactactgtctatcacagctacgctgtcaggcatggccggggcctttctgtggccagtggtttcgcggcggctccgactgaagtccaaccatactattatgctctgcatcgcgttgtttgaggttatacctctttacggcatgcttgcttatattcctctcttcaagaaatggggcgtggttgggctccagcagccatgggagattttccctctggggattgttcatggcctcgtatctggtggactgtcatcctactgtcgctcctttttcggtctacttatccctcctggtagtgaggccgcattctacgctctatatgccgctacggataaaggaagctcgtttattggccctgccatagtaggaatgctgattgatgctaccggtcaggtgcggtccggctttttcttcattgcggtcctgatcctccttcccataccgctgatctggatggttaatgcagaaaaggggcggcaggacgggttagctatggcagatatattagaaaagtcgcatagagagcatgcctccgagtatggaggcccttcggaagaggccgagggactgctggctcgcgatatatag

SEQ ID NO: 14720 - DNA, 264 bp, A.fumigatus
atcaatgccaaaggcatagctatcggattgcacgcactgtcactgcaagagatcatcagtctgaaacccgccgtctattatctgagttggcggctcagacgcttaggcctacaggctagaatcccagcctactcctcccagcttctgaggggcgatttccgcgttccagattatcgccgtcacgaactatcacttagtgatcattacgaggccgtgtacggagtacctgagatgacccaaacttcgggtctttccccaatctga

SEQ ID NO: 14721 - DNA, 1797 bp, A.fumigatus
  unsure (8): Identity of nucleotide sequences at the above locations are unknown.
ctttttcnacgtcttcatggagaccctttgttccacacttttgccgaggagctgctctcacacgttacacgcccgttttacgatatgctgcgattgtggatctatgatggtgagctttcggacccgtaccaggagttttttgtcgtggaaccggaattcagacccaacacggacccacgacggcttgcgaccagtgtctgggaagataagtataaactggatgacgagatggtaccgtcaatcatcacgcaggactttgcgaagaaagtctttcttatcggcaaatctttgaacttcatcagatacggatgcggggactctggatgggttgaggcctactctaaaaaagcgtccaaagagctgcactatggtgatacggctagcctcgaggcatcgatcgatgaggcctacaaaacgactatggcgcgcctcatccacctcatggccgaaaagtttaagctgttcgaccacttgcatgcgctcaagaagtatctgctcctgggccagggcgacttcatcgccttgcttatggaatccttggcatcaaacctcgatcggcctgccaattcacaatatagacatactctcaccgcgcagctggagcatgccattcgtgcttccaacgcgcaatacgatccgcccgacgttctccgccgcctggatgcccgtatgttggaactcagtcacggcgagataggatgggactgctttactctcgaatacaagatagatgcgcctgttgacgttgttatcacgccctggggctccacccaatatctgaaggtgtttaatttcctgtggcgagttaagcgcgtcgagtttgccctgggcagcacttggcggcggtgtatgaccggcgctcgcggagtcttaggaagcgtcagcgacaaagtcggggccgactggaaacgggcgaggtgcgtcatcgcggaaatgattcattttgtttgccagcttcagtactacatcctctttgaggtcatcgaggccagttgggatcaattgcaggcagaaatctccaagccagggtgtacgcttgatgatttgattgaagcacataccaaatacctcaactccatcacgcacaagggtctgttaggttcgacatcctcatcccgcaccgcatctggccacaaacaagaggagggcttcttgactcagctccatcaaatattgaagatcatgctggcgtacaaggatgccgttgatgggctctattcattttccgtggcagagtttacacgaagacaagaactcagtgcgaaaatagaaacgcgcactgctcaggggcgctggggcattactgagcgcgatctcctaccttcccggcgtccacaaggacataagaactcaatatcatcatttcccccatcaatggcccaaactccaactgtcggggttgatggcgatgggttcgataccccgggatctctcgccggccaagagctttctgccgacgaccacatgctggcatcccttcgcacacgactgcgcgagctctctgcagagttccgctccaggctgaatgtgctactgggcgatctagcctaccaaccatatgtcgacatgcgcttccttggagtcgtcatgaacttcaacgatgtctacgaaccagtccggaggaggaggacggcaacagccagcaccaaggacaaggagcgggcaaggcgaaaggctgcagcatctaccgcgcctggaggcagcggcgaggcagggtcccaaaaggaagccagaagggagaggaaggacacctcgggagccgagcatagcggtaatggaagtggaaccgggccatga

SEQ ID NO: 14722 - DNA, 1119 bp, A.fumigatus
ttcactcttcttgcatcatttgcagtatctctaatcaagcgtgcaatatactcaattctccaatcccacctgacgtccccgagaacaccgcttacgctccccatgtcgagcgaggaatcggcgcagccgtcgcatgtttccgcgtcaaaaaaggcaggccgcaagctcaagcacgcgaaggatacatctgcactagaagatagtgaggacaaggaggttgttcagaagcacaagaaaagcaaagacaagaagaaaaagaacaagtccagcaatgggcaggtcaccgaggacgccgcagtgacggccgaccctagcgaaaagaagcagaagcagaaagagaagaagagcaagaagcggcggcttgaggaggagagtgaccggggggagaaaggcgttgccgagccagggtctgagtctcagcagcggcgcaagaagaaaagggtatctttttcggcagatacggtgatgcgggacgctgaggagagcgagagtgagagtcgacccgatgttaaggatgatttgaaaagtaatggggacgccgaagagggtcaggctccccctgttacggaggaacaggttgacgcggatgacgagggcgagaagaaaaagaagaaggagaagaagaagaaaaagaagaaggatagatctggtacggctgcttcggatactgcaccgaagtctcacgagtctcctattctttcgtatctcaatctataccaccagaaccgatccgcttggaaattccagaagaatcgcgagacgcatctatttaaacacatcctgtctttggaacatgttcctgagagctacaacgccgctcttctttcttacctcaagggactgaaaagcgagggtgccaggcaacggctacgccaggttgctgaggaggttgtgaaaactgaaatggaagaggatctggcaaaagaacaggaagcggaaacggaaggcaaggtcgagtctgacacgacaggctacaacaaggccgtggaggcttttagaacacgcttgtcgcaaggcaaagacgattttgaagagattgagacacctgattcactggacggagaacaactggcgcagctccagagacgtcttaaccgccggtcgacgacaacgtacgag

SEQ ID NO: 14723 - DNA, 189 bp, A.fumigatus
aggaaattaacggctgtaagaatatatcggatagtcgttctggccatgccactactcatgtctctcttggaagcagtggtccagctggtcaagactgatcccaagaggaggatttaccagacaagtatggacattatgatcctctggttgcggagtctggaaggtatcgatcaatggtctcacgcatga

SEQ ID NO: 14724 - DNA, 2430 bp, A.fumigatus
tgtacacactgcagctttagcaagggagaaggcagacaaagactgcaaccagtactccaattcaatcgaatggctcagcaaccatcccgtcataccgtggaatggatcaagcagcagcaggctgaagcgggggtcgatgtccgaaaggcacttaagctacggaaaaaactgccgctctggctggatgactctccattcgacagagtccctgaacgagttccattacccgagtctcgcgacggatcttccacatccagtgacccgggagacagagatggaaatgcagcgaagtcttccctggaggcgattgaccgcgatgataccttcatccagccttggttaattccattgccgccatcactgccaccgtcaccaagacagcagttagcacaatggctggcggccaaagaatcgaaaagagaaacacccttaccacggcaaccctaccgtctcgtgctcgaccgcgcagaaagcgtattcgatcacattaagcgcggaaatatccgcaaaaatccgcgcctgcagagaacctccatcacgctatacgagtactacgatgatagtaccgcgacgagggtggagattgacactgctcaagagatcccccgcttctgcggcatgcgggagggattgaaagggcgcgtgtttcttgttgaagatctgtccacgaaaactattaacaccttaggggagacatttgggattacccccgagttctccgaggagcacctgttgaactctgggtacggtggtgcgaagtatgacgatccaccggcgcggtcgtggaagacggcgcggttgaacaagccgtatgtgtcgctccagtggtttcggccggtatatcgtcgtccaccgttgttttccaatcgcgaccgggaaaaactgcttgatttgcagggtaatggattagagtatatctcaggcaattccagcatcagtctcaaagccgcgacgaatatatttcgcgccgagtgggatctgcgcgttgatccacgccggacggcaaaggagatgggcgagttcgggttggtagaacgggcgtcgatttggaagaagcaagacgagaatatggagtatgaaacaggtaagctcctacgttcgttgggaaatcactgggagactgactggatggcagtcatcgtgttgcttgatcctctaccaacgatcagcattagtcatgatctgacgcttcggatcacaaaggagactatcgccgaatctggtggcagtgacaatcgagttaccggaaatagcaatggaatggagaatcgaatcttaataattgagggtgataataccagcgagggttttgcaattcccattgaaaacccacggcgtgaggagacgtcacgtccggtgttggactggctgctcaggcggcgcagaccagaagttgataggaggaaggtccacgtgaggacgagctttcaggttttagtcaagcagatggccccccgaaaacccattacaatcgacctggaggaggcccttctgacaggcggcaattccttgagcaagctccaagaagaactcaacgagacaaggtccactcggcaggcaatgcatgacatagccggagacaatacagcgcccatacatgtactgcaaatcttgtttcagaccattcaccaagacacctcgactttgcttggggtgctcaaccagatccttagcgacatagaggttgatatcctcgacgacacgaagatggaagaccgactggcatcgtggcggcagctcatcagtaaggccgagggagagctcttggaactcaaaacatcaaccaagagctttgtagctttccttggtttcaagttcccagccgagacctctgcagcaacctcagacgacaagccaggcattataagggacgtggtagatctcttccaggagattgatcaaatgctcaccaaactccggcatgcgtctacatccctgacatccaatatgggtcttctagacagtcgacgctccatcgacgaagcgcacgctgtcacgcgactcactgaactggcattcctcttcatcccgctgtcattctcgtcatctatctttgggatggagatcgagccatttaaagacccggtcccgctgtggaacttcttcgttgtagcaattagcgtcacagcttttgcgtacctgatgcggctcacaatgcgtagtcaatggctgggaaatctgaagcagagcgtgaagcaggatgtgagacgatacgcagagcaaaacggcatgccagtgcaagtacggtctttgtcgatgctgttactgttgcaatggtttggaagcatactcgagcggagcagcaaagccacctggtcctggattggcaggaagggccgtatggcagggatcgggttatggagagtggtcgggttcccagtcactgtcttcaccacggggctggaaggtgccgtgcgaagggccgtccaa

SEQ ID NO: 14725 - DNA, 1239 bp, A.fumigatus
ccatccttatcatcaactttgcagtctttctttcatttgacggatctgcacatacaggacgaggtttatatgcatgtgtccaaaattacagaaagggacctcgttctactccgccaatactgcatatatggtccgaagctgatttcgcttactgctcgttactcaacagctcgacctttgggagcgactcaggaagcggctatgttcaagaaggccgtgaaagaccactccgcaggtcctgtgaagccgcttcagtccaatctatttcgcagcaatggcatcgtgcagccgaagccaaccccacccctacaatcaataggcgttaaacgaaaaatcgagatgagcagtgctggggattctgcattagggaccctacacagtgctgtttacttcgatgagaatgatttcgatgatgatgtagacttggactccgaaggacccgaacccttcattccgccgacgaaaattgtgagaccaagcattgcggaccagtctactgtgacctcgaatgccaattcaacgggaaacaacgtttcacaaagtgcggaaagagtcaccgttgatttgatatcctccgatataaaatatcctgaattacctcctgtctccaacgatcacgttcccccgtccagtagcgttcagattccatggtcgtcctcgccccctcaccacctccagcaaccgaatagtagtcgaacattaccatggctcaccaagaacgacgaattgtcaaaggttgaggggtataagaagccagaaacccccactcgtcccaagtccactgctatctggaacaagtccgccagtgcgatcaaggaagagcagaaagagctgcggcgacagcataagaaaaaccaaaagggcgatacaaactttaagcaacttcagactcgtccaaaaattgcgtccttatttcttagtgatgagcagcgtcatgtcctcgacgcggtcgttaaccaaggcaaaagcatattctttaccggttctgcaggtacgggtaagtccgtgctgatgagagaaatcatcaaacagttacggagtaaatatcgaaaggagccggatcgtgtggcagtcacagcttctactggtcttgctgcctgtaacatcgagggtgtcactctgcacagttttgcaggaattgggctgggtaaagagcctgttccagagttggtcaagaaagttagacaattctctgcctctgctttgttcatattcgttgacggtcaaattacagattaa

SEQ ID NO: 14726 - DNA, 195 bp, A.fumigatus
tcatgtccaatgtatgtaaaagcagactcatgtagaattctgttcttcaatggtgctgttacattaaagaatatctacagtattcagcagcgtcagactacctcaatgaaaggaaagcgtgtttgggcttttggagagagacatttcagaagcggaaaactgcgcttgacaatgatgccttatcaatgcggataa

SEQ ID NO: 14727 - DNA, 642 bp, A.fumigatus
gagaaatcatcaaacagttacggagtaaatatcgaaaggagccggatcgtgtggcagtcacagcttctactggtcttgctgcctgtaacatcgagggtgtcactctgcacagttttgcaggaattgggctgggtaaagagcctgttccagagttggtcaagaaagttagacaattctctgcctctgctttgttcatattcgttgacggtcaaattacagattaagagaaatcagaaagcacgcaatcgctggcttcggacgaaggtgctcattatcgatgaagtgtcgatggtcgatggtgacttgttcgacaaactcgaagaaatcgcccggagaatccgaaataatggccgccctttcggaggcatccaactcgtcgttactggcgatttctttcagttgcctccagtacctgaaggtagtagccgagaggcgaagtttgcctttgcagcggctacttggaatacgtcgatccagcataccattctcctcacacatgtttttcgtcaaaaggaccctgagttcgccgaaatgctcaacgaaatgagattgggtaaactcacccctcggacaatcgaaacgttcaaatcattgtcccgtccgctgaactttcatgacgctcttgaagcgactgaattgtaa

SEQ ID NO: 14728 - DNA, 852 bp, A.fumigatus
catctcattctcagatttcctactcgtcaagaagtggaacaggccaatagcgcacggatgagcaggctctctggcgagacaatgacgtttcacgcagttgactcagggacaatccaagatgtccaatttcgagaaaaattgttggcgaattgcatggcaccacctgtcatacacctaaagaaaggtgcgcaggtaatgctgatcaaaaatatggaagattctcttgtcaacggctccattgggcgagttgtcgccttcatggatgaagcgacattcgaatactatcgcgacaatgagagcgagtttgccgatgggcgagatgctgggagtgacgatgagagactaaaccacgcccgcaagaagctgaagggccttggtaacaaggatggaggcgttgtggcaagtcgaaaatggcctcttgtttgtttcgtccagccagatggaacggagcggcacttgctctgccaaccagaggcttggaagattgagcttccgaacggcgaagtgcaagcccagcgccaacaggtaccgttgatcctcgcttgggcactgtcaatccataaagcgcaagggcagactttgcagcgcgtcaaggtcgaccttgggcgggtatttgaaaaaggacaggcttatgtcgctttgagtcgtgcaacctcgaaagctggtcttcaagtcaccagattcgacccgcgcaaagtcatggtacatcctaaggttacggaattctactcaaaccttgttagtattaccgatgctcttgctccgaagagctcaaagcctcgcgagcatcaggaagttgatgaagacggtcaattggaagatgaagagctcttgcagcatctatacggttga

SEQ ID NO: 14729 - DNA, 1632 bp, A.fumigatus
caaatcaatggaggtgtcgttggtatcgacaactccaaccagcaggtcaacttcaagaacatccacttcaatggctgcacaactgccttcagagcgtcggggggccacactgctctgcttcaaggcgccacattcgagaactgcggagtgggcattgacatgaccagcaacggactgggaagcttggtgctgcttgactcgacctcggtcaactcggggactacgatcaagtttcacgactcgtccaatgatggtgggaaccgcaacagccaaatcctgatcgagaatttgactcacgacaatggcaaccccatcgccgaagacagcaagggcaacgtcaaactggccaacacttctcatgttgacacgtgggtctgggggaatgtcaccccaggccaatacgaaacaggaactagcttcaacaccaaccgtcccaacgtgctgctgtctggaggcaagttcttcatgaaagcgcagccgacatatgccgagtacgctagtgaccagatcgtcaatgtcaaggccgtcgcaggccacaccgtcaaaggggacggctacactgacgactctgcttctctcaacgccattctggccgataacgcggccagctgtaagatcagctacttcccatacggtgtgtacatcgtcaaggacacgctgatcattccgccgggctctcggatcgtgggagaggcgtggtcggtgatttccggcgcgggcaacgccttcaagggtgcccgcaatccgaaggctgttgtccgggttggcaacccaggcgacgtgggcgttgccgaaatccaggacatgcggttcagcgtgtcggaggtcctcccgggagccaagatcctcgaagtcaatatggccgggagcgctccgggcgacgtgggcttgtggaacacgattgtcacggtcggcggcaccgccgagacgagcatctcgaccgggtgcacgaaccaggacacctcccagtgcatggcagcgtacatggtgatgcatctgaccaagagttcgtcggcgtatatcgagaacttttggggctggacagcagaccacaacctggacggcgggtcggggtacactgtcatctcgaccggtcgcggagtccttgtcgaatcgaccaaagggacatggctgacgggcactggctctgagcaccactggctgtacaattacaatttccacaacgcggagaatgtctatgcgggtctacttcagaccgaaagtccgtacatgcagagcagcggtgcgactcagacggcgcccgcgccctggaccgcggactcttctgttggcgatccagacttctcctggtgtgccggcggcgaccagaagtgccgcacagcgctggcgaccaacgtcgacggcggcaaggacgtgctcctgtataattccgcggcgtgggcgttcttcgatggcgagtggtacggagactacgggacccaatgcagtggaaactgccagagcaacatgatgcgggtgagcaacaaccccgagaacctggtgtggtattccatcaacacgcgcaagacgaacgtgatggtattggacggacagtcgaatccgaccgagtattatcaccccggaggatgggaggccatcattcaagcataccggcagttttctagccactga

SEQ ID NO: 14730 - DNA, 975 bp, A.fumigatus
atatccttcctcatctatttgtctcggcgtacattggctcatcatcttgctagcatgcgtggtctcctcttactgaccacgctggccagcacgctaaccagcacgctggccacggcctcatctgcagccgttggggctcgtgctccttcctgcagcggtcctgtcaagagctctccatcaacctactggctcgttgaacaggaccacatcggaaatccgcgcggatatgcccctcatgcaggagggaactacaactaccccgtctggcgcaatgttctggattatggtgccaaaaatgacggctctggcgaccagactgcgagcttgcaaaaagccatcaacgacaatggcagcggtggaagtcgtgaaaactccggcgtcactcggtatccggctcaggtctatcttccgagtgggacataccagctggggagcgcactcaacctccgagttggcacgctcattgttggagacccaattaacccgcctgtgatcaaagcggtggccgggttcaacggcaacacactcgtcaatggatacgattccaagaatggtcccccggagaccagcttcatgacgctcatgaagaatgtggtgttggacaccactgctctccgacctgatactcgcattacggctctgcagtggggtgtggcgcagggtgcaggtctgactaacgttcagatcaacatgccgaattattccaccggtcataccggtattcacgtccaggcggggtccacgatcgctataaccgatgtggttggtctctctctcgtctgcgccgtgtggtcgtcagctgacaaatatagcaaatcaatggaggtgtcgttggtatcgacaactccaaccagcaggtcaacttcaagaacatccacttcaatggctgcacaactgccttcagagcgtcggggggccacactgctctgcttcaaggcgccacattcgagaactgcggagtgggcattgacatga

SEQ ID NO: 14731 - DNA, 1296 bp, A.fumigatus
acccgcatagacattctccgcgttgtggaaattgtaattgtacagccagtggtgctcagagccagtgcccgtcagccatgtccctttggtcgattcgacaaggactccgcgaccggtcgagatgacagtgtaccccgacccgccgtccaggttgtggtctgctgtccagccccaaaagttctcgatatacgccgacgaactcttggtcagatgcatcaccatgtacgctgccatgcactgggaggtgtcctggttcgtgcacccggtcgagatgctcgtctcggcggtgccgccgaccgtgacaatcgtgttccacaagcccacgtcgcccggagcgctcccggccatattgacttcgaggatcttggctcccgggaggacctccgacacgctgaaccgcatgtcctggatttcggcaacgcccacgtcgcctgggttgccaacccggacaacagccttcggattgcgggcacccttgaaggcgttgcccgcgccggaaatcaccgaccacgcctctcccacgatccgagagcccggcggaatgatcagcgtgtccttgacgatgtacacaccgtatgggaagtagctgatcttacagctggccgcgttatcggccagaatggcgttgagagaagcagagtcgtcagtgtagccgtcccctttgacggtgtggcctgcgacggccttgacattgacgatctggtcactagcgtactcggcatatgtcggctgcgctttcatgaagaacttgcctccagacagcagcacgttgggacggttggtgttgaagctagttcctgtttcgtattggcctggggtgacattcccccagacccacgtgtcaacatgagaagtgttggccagtttgacgttgcccttgctgtcttcggcgatggggttgccattgtcgtgagtcaaattctcgatcaggatttggctgttgcggttcccaccatcattggacgagtcgtgaaacttgatcgtagtccccgagttgaccgaggtcgagtcaagcagcaccaagcttcccagtccgttgctggtcatgtcaatgcccactccgcagttctcgaatgtggcgccttgaagcagagcagtgtggccccccgacgctctgaaggcagttgtgcagccattgaagtggatgttcttgaagttgacctgctggttggagttgtcgataccaacgacacctccattgatttgctatatttgtcagctgacgaccacacggcgcagacgagagagagaccaaccacatcggttatagcgatcgtggaccccgcctggacgtga

SEQ ID NO: 14732 - DNA, 198 bp, A.fumigatus
aggcacctggatagtctctatcctggtcactgtctaggcactctggacggagtaatggagtacagtccatcagggcacgcaggaaacagccagctgaccaatcagagccattctgcaggcgctcatctccgtcacatttattttggccaatcagaggacaagctcctgcatctcaatcagaacgcctcccccagataa

SEQ ID NO: 14733 - DNA, 372 bp, A.fumigatus
  unsure (349): Identity of nucleotide sequences at the above locations are unknown.
cacattggtctcctagatcaaataggcagcgctgtggagggcttcatctggcccaagtctctctgggacttcactacaagaaatctcaacggcgctgtaaaatctaccccgatactccaaatcctcaacctcataatgggcctacttggcatcgcatgggaatggccgttgaacctcctcgctggaaccctaccacaccgcagcatcgaagtgcgactcatcatgtaccctctgagcgctctcctcgctgcccttctctaccagtggaagatccccgccacctactatctgatcggtattgccgtcaacttctgggcgttacctgaatgccaggttaagctggtgttcnaatccccgttgtcccttatctga

SEQ ID NO: 14734 - DNA, 642 bp, A.fumigatus
acaatgtcacctccccttgtacccctagcagagatcccgactgtctcgctgttgtacaaactgggccgtctagtcccatactctgtcccatttgccaagccgtcaaactcattcaacaatatcatctcactcatccgaaacgacatcactaagctggagaacgtcgattgcattgtcaatgcagccaatgaatcgcttcttggagggggaggtgtggacggagctatccaccgcgctgcaggaccagacctcctgagggaatgtcggacgctgaagggctgcaggactggcgatgccaaaataacatctgcctatgaacttccatgcaagaaagttattcataccgtgggaccaatctatcattttgagctgcgaaagggtgacgatagacctgagatgttactgcggagctgctaccgtcgaagcttggagctagctgtcgaaaacaacatgaagagcattgcttttgctgcgataagtaccggcgtctatggatatccaagcagcgaggcggcctttgcagctcttgatgaggttcggaagtttctggagagacctggtaatatcgagaagctggaaagaatcattttctgcaacttcgagcgaaaggatgaggtagcctatgagcaagccatcccgtga

SEQ ID NO: 14735 - DNA, 729 bp, A.fumigatus
cgttcacaactcacaagcacaccaactactaacatgcctccacctcagccctcaccagaggggccacttacaggcaaaacgacctcaagattcagagtcctcgcaccggaaatagccaaaatacgatcatccaaatcacctgttccgccgaccacagaaccctccgcctccgcctccgcctccgcaaatgcctcgccctcactcccccaaacacaaacgcctacaccaccgcagtcatcacctcgtcccaagcgaccatctctctcctccctcttccgccaacgctacgcgaccctcccaacacccatccgccgaaccttccgcgtcctccgcatactagcacccatcgtccccatcgggatcttcttctccgaacatgtcctccaagtaatgtgggtgcggggcccgtcaatgacgcccttcctgaacaaggactacgaaaccatgcatacgaagagcgatatggtgctggtgaacatgtggccgttcggcggggcggggtggccgtgggagcggaaacggaggttggaacgcgggatgattgttacctttcggtgggttgttcgctttcccctctactctgtttcagactctgcttctccggatatggagctggaatatgctgacggtatggttgtgctaggtcgcctgctaatcctaaacacaccgccatcaagcggattatcggtctccccggtgatcggattacgactcgtgaaccgtgcatga

SEQ ID NO: 14736 - DNA, 390 bp, A.fumigatus
cggtatggttgtgctaggtcgcctgctaatcctaaacacaccgccatcaagcggattatcggtctccccggtgatcggattacgactcgtgaaccgtgcatgaaggcgtcgcagattgtgccgttcaatcatgtctggttggagggtgatgcggaggatccgaagaagtcgcttgacagtaatacgtatgggcctgtgagcattagtctcattacgggccgagtgattgccgtgttgaggccgcagtttaggtggctcaactggcaagattgggagaagggggttgttgaaggtgatgaggatcacagatttggggagaattatcgccaggatgtccggcaacgggtgttgaaggaggctgtcaagttggaaagacctcagatagaataa

SEQ ID NO: 14737 - DNA, 798 bp, A.fumigatus
tctgaaaaatgtgaacgaggattggccgcttattcggggcaagttgcaactggagtactactccgataccaaggtttgtttgtcgacacttctttggccttgctggattccactgacggaaactcaacctgcctaggccgaagccgaagaaatatcttgaagtacaaccgtgcttctccctcatcaatggtgacatgtgctctgcgccccgcaggtatatacggtgagaaggacacgacatttaccttcaaggtcctggagcacgcggccaaagcatccccgaccgttttgcggatgcagctcggtgataacaacaacttattcgacttcacatacgttggcaatgtcgcctactctcatctgcttgccgcataccgtcttcttgccactcagacgcgctacgagtccgggcaaagcggccccctagaccatgagaaagtagacggtgaagctttcaacatcacaaatgactctcctgtgtacttttgggacattactcgcgctgcatgggcgctggctgggaaggttgtggagcctaaccaggtgtggcagctttcagaggatcttctggggcccgttggcgccgtactcgagacggtatttggtcttattggcaagactccccgtttgacaaggcgtattgtccggtactcatgcatgactcgctactactcctgcgagaaggccaagtaccgactcgggtacagtccaatcgtctcggtccctgagggactctcccgtgcggtgggatatgtgctggcacgcgaacgactcgagtccgaaaagaaggggctgtga

SEQ ID NO: 14738 - DNA, 432 bp, A.fumigatus
gctgatttgttctcctgtctactttgtttgtctcgaccagtgataaaaatgcggtttcctatccccttggtcagcttcttgggtttgttcacaagactacaaagctggatagacggtttctccgatctgtgggaaagcacattgattaatgatgagacgtttgactatgtcgttgttggtggaggtactgctggtgttactctcgcggtccgtctagctgagcagaaactccgtgtcgcactcgtcgaggccgggaaaacatacgaactcaggttcccaatagcagctatccctggtgccgccagtataggtgtgggctctgatattgagtctggaacgccaatcgattggaaatttgtggctagaaatgtcactggtgctaatcaccgtgacatccattatcccagaggcaaatgtcttggaggatcgtaa

SEQ ID NO: 14739 - DNA, 648 bp, A.fumigatus
  unsure (70): Identity of nucleotide sequences at the above locations are unknown.
ttgcccctgatgcctcagaagcggcctactttggagctgggctctgttctggtggtcggaggatgcggtnttctgggctggcacattgtcgatcaattgctcaatttcccttcggagaccgatgccagcgttgccctcccgaaaccagaaggggactctcgattcgataatcctcggttggccgatcggtaccccagatgcgttgcgaaggtctccgttctcgacctgcggacagccaacaatcgcctacccggtgcacagtactacgacggcgacatcacatccgaagaatctctgctggctatcttccgcaaagtcaagccggacgtcgtcattcatacggcgacggcaaacgttttggaaggaaataaggagctgctgcgcaaggtcaatgtcgatggaaccaagacgttactggaggtcgcgggcggtgatcgtggcgactggggtggaaagtgcaaggcctttgtgtatacgagctcggcctccgttctgcacgacacacagagtgatctgaaaaatgtgaacgaggattggccgcttattcggggcaagttgcaactggagtactactccgataccaaggtttgtttgtcgacacttctttggccttgctggattccactgacggaaactcaacctgcctag

SEQ ID NO: 14740 - DNA, 549 bp, A.fumigatus
ccaacccgtcggttcccacttcgttcaaccaaagcaaagaagagaatgctggcaagctacaccatatactgtcagttgtcatcccccgtacgcctccaacatactaacctactcagaacaacaactgactctctcatcaattgggcccgtcaaggctccttgtggcccctctccttcggcctggcctgctgcggcgtcgagatgatggccgcctccatgccccgatatgatcaagaccgacagggaatcatcttccgcgcctcaccccgccaagcagatgtcatgctcgtcgcgggaacggtgaccaacaagatggcaccggcgctgcgacagctgtacgaccaaatgcccgatccgaagtgggtgattagtatgggaagttgtgcgaacgggggcgggtattatcatcactcttatagtgttgtccggggcgtggaccggttggtcccagtggatatctatgtgcctggctgtccgccgacgccggaggcgctgctatatggcatcctgtttttcaccacaggggccggggccatccgcgcatgcaat

SEQ ID NO: 14741 - DNA, 1281 bp, A.fumigatus
acaaccgcatggatcacccaatgtgtgaagcaaaggcagacgctcaaccccttcctgccaataggacacaaagccttccctccgagaagagaatggcttccgaagaaccagagcccacccatgatgctaaacgaatcaagacctcagctacaacaaggaggattgctttcccagagaaggcatgccagggccctggaaccgttgtggagtgttctaattgctctgcagcctgcagttttagaagaacgaaatggagagattgaatttcgagttgtcatcaacaatgatggttctcgcgacagtacaattatccttacaggcctcaaatgcctgtttcaaaagcaactgccaaagatgcccaaagactacattgcacgtctcgtctacgaccgtacccatttgtctatcgccatagtgaaaatgcctctggaggttatcgaaggaataacgtttcgggaatttcgggaccgtaagtttgtcgaaattgttttttgcgcggtctcatctgatcagcaggtgaaaggctatggagcgcatctgatggcccatttaaaggattatgtcagagctacttcccctgtgatgcattttttaacttacgccaataactacgccacaggatatttccaaaaacaaggtttcaccaaagagatcactcttgacaagtctgtctgtgtggggtacatcaaggattacgaagggggtacacttatgcaatgctccatgatccctcgaatacggtatcttgaagttggccgtatgctcctcaagcaaaaggcaactgttcaagctaaaatgcgtcttttgagcagcaatcacattatccatccgccacctccgcaatgggccaagggcgtagttactcccatcgatccactctctattcctgccattcgggcaactggctggtccccggacatggatgcattatcgcgagaaccacgccatgaaccttatttcaacgagtttcggcgatttctcaatcaaatccaaaaccacaaacaaggatggcctttcctgcaaccactcaacaaagatgaggttcccgattattacaatgtcattacatcaccaatgcacctgtcgactatagaagaaaagttggagcgtgatgactatgctacgccaaaagaacttgtccacgactttaagttgattttcaaaaattgtcggcagtataatgacgcaacgacagtgtacgccaagtgtgctgtcaagctggagaagtacatgtggagtctgtcttcaccacgagggtggaagcatccgagcggtgctcag

SEQ ID NO: 14742 - DNA, 234 bp, A.fumigatus
ttactcccatcgatccactctctattcctgccattcgggcaactggctggtccccggacatggatgcattatcgcgagaaccacgccatgaaccttatttcaacgagtttcggcgatttctcaatcaaatccaaaaccacaaacaaggatggcctttcctgcaaccactcaacaaagatgaggttcccgattattacaatgtcattacatcaccaatgcacctgtcgactatag

SEQ ID NO: 14743 - DNA, 1065 bp, A.fumigatus
ccgcgctgcagtcttcccatcggaggagtctcgctcgccgtcatcctgtttgtcctccgactccccgacaagaacgacttctccggcagtcccatcctcgaacggatccagcagctggacctcataggcgccggtctactgatccccgccatcatctgcctcttgctcgccttgcagtggggaggaaacaagtacccctggaacaattcgcggatcatcggcctgttcgtcggcttcggcgtcatggctatcctctttgcattctcgcaggtcaagttggctgacaaggctaccctgcccccgcgcatgttcaagaaccgcagcgtccttgccgccacgctctttgctctgttcttcggcggtgctttcttcgtcctggtctactacctgcccatcttcttccagagcgtcaaggattcctccgccatgaagtccggcatccaactcctgcctctgatgctagccaccgtcgtctcctcgatggtcatgggcggcgccgtcaccgccgcgggctactacacgccgttcctgatcggtagcaccgccatcgccgccatcggagccggtctcgtcaccatgtacgagatcgacatctccacgggcaagtggatcggctaccagatcgtcctgggcgccggcgtcggtgccggcttccagattcccatgacggccgtccagactgtcctgcccgcagaggatatccccatcggcacggcggcggtcatgttcttccaaacactgggcggcgcgctgttcatcgcggtggcccagtccgttttccagaacggcctgatctccgggttggccaagtatgccccgaccgttgacccgacggcgattgtcaaggcaggcgccacggagatgagaaccgtgctgacccaactgggccagttggatcagctcatgaacgtgatcaaggcctacatggacggattgcgggcttcatatcgtgtcagtttagcgctggtgctggtcgcgtttttggccagcttgttgatggagtggaagagcgtcaagaaagcgaataatggggagaagaaggaagtcatggtggctgctatttag

SEQ ID NO: 14744 - DNA, 513 bp, A.fumigatus
tccacagcagacatgatcccaaggattttacgcctcatcgtccttgcgatatggtcagcagaggccgtggcatcgcccgtccgttcctccgaccaggaccacagcaatgtcaatcatggcaagatccttactcacgaacctgaatacgatcccctgtgggagaagtacggcctaaacaagtcgcaagaatttaagtactttcatgaaccaggtaatgatgatatcctgggacactacgatacgcgctttttcacagaaccggttccggacaaagagcgctccgagaccatgacgcatatgattcgcgcctatctcaacttcttcaatgagcgtggcctggagacgtggattgcgcatggaaccttactcgggtggtggtggaatggcaaggtactttttgcgcctagaagtttagggactgtagctaatgccggcgacgggggtgtaggttctaccctgggattgggacatcgacacacaagtgctggataccaccctgctgcgcctggctga

SEQ ID NO: 14745 - DNA, 282 bp, A.fumigatus
ttcagtccctcagaatgtaacactccgcctgcattcatttcttcaaccgcggattccctcttatccctctatcactccttgccttgtcacccctatcaccaactggcctactccagcttcaagtggatcatctcccttggcgcccccccgttctgggagaacggtggggagttgtcggatcaaccactgggaactgacttggaccattgcgccattgcgatgcttccaactttctactcaaactatctattctctgatttgacctcgtctagtccttcttag

SEQ ID NO: 14746 - DNA, 453 bp, A.fumigatus
gttctaccctgggattgggacatcgacacacaagtgctggataccaccctgctgcgcctggctgaccagttcaaccaaaccgtcgtccactacacggctgccgactccagcgtggagcggagctacctcctggacgtcaacccctgggctcgacagcgcgaacgcggccagggactcaatattatcgatgcgcggtggatcgacaggcggacgggtctctatattgatatcacaggactgagtaggctggaaccggagaaacccagtctatggcaggataaaaacgaccacaagtatcagacaggggacatttaccccctgcgcaagacgacttttgaaggagtaccggccaagatccccttcgactacgactctgtcttaatcaaagaatatactcaggaagcgttgacgagcaccaaattccacaagtacgtatcctccggaattttttga

SEQ ID NO: 14747 - DNA, 318 bp, A.fumigatus
gccctttccagcttgccagaaaaaaaaatactgaccgcgctgcagtcttcccatcggaggagtctcgctcgccgtcatcctgtttgtcctccgactccccgacaagaacgacttctccggcagtcccatcctcgaacggatccagcagctggacctcataggcgccggtctactgatccccgccatcatctgcctcttgctcgccttgcagtggggaggaaacaagtacccctggaacaattcgcggatcatcggcctgttcgtcggcttcggcgtcatggctatcctctttgcattctcgcaggtcaagttggctga

SEQ ID NO: 14748 - DNA, 867 bp, A.fumigatus
agcatctggacccagtcaggacgagagcagggttttgagtgggtactgacactttcagatggatggcgccgccaaagaagcatgatccaaagcgcgatcaacatcacctccatcaataaataccagagtctgatggacgatgaagccacgttcaccgtgaacgcactgctgcagtccccggactcgtttcatggcgagttcttgcgatattcctactccgtgttgacgagctcgttgctcggcttctcagtccgcagtccatcggaccctttcatccaccacaatgaaaccttcacggccgaactcatgaactctttccgtcctgactgcttcccgagcaacgtgttccctgtgctccggaaactgcccatgtggcttctgcccagcttgagaacgatggaaaggctccggaaagagtatgtgggcgagatgtgggcgttcaggaggaagatcgagaagctcgtcaaggagggctcggcgacagagtgcatctataaacattttctcctccaccgggatcagtatagcgtcaccgaggaagagtcggttcacacatttcaggccatgattgacggtgggacccgctcgccccacaacaacctgctaacattcctcttcctgatgatggagtttcccgagtggcagaagaagctgcaagaggaggtcgacagagtcgttggcagggatcgaatgccgagctatagggacattcctaacctgcctactgtgagagctattgtcaaggaaacagtccgatacagaagtattgtcgcagaaatgggcattggccattgcctgcaaacggacgacatttacaagggctacttctttgaaaaaggcactgtattcaacgctatatttgcgtaa

SEQ ID NO: 14749 - DNA, 183 bp, A.fumigatus
ccggtctcagtcactaaatccaaagatacaccggatgtccagtcccacgtcattgctgcagatgctacggggttacgggattatgggatgtggttcggcaaagatgtgcctgaatcgctcgaagcctatgcgagtgtcaacatgtgtcctacatggccgctgcgattggagcagaatgtttaa

SEQ ID NO: 14750 - DNA, 195 bp, A.fumigatus
aagatagcttttagaacaaagtttagacattttaaatacctaattatactatttagattaaccaacacactagcattatttaaaaggtttattaaggaagtactatataaggttctatactactttatagtagtctacctaaataatatcttaatctttttagagaatattaaggaggttctacaagagctttag

SEQ ID NO: 14751 - DNA, 267 bp, A.fumigatus
ttcctaagctatagaatccctaacactacattatactgtcctattagtataatattaaagtttagatatttaatatatcctaatataactattaggactggtcctaatttaattataattaagagagttcctaaattttctctatttagacctataattagttcaggcactatctttatttttcctagaatccctagcttccttataaaggctaggtttataaagttgcctattactcctaagttaatcattactttagctaattaa

SEQ ID NO: 14752 - DNA, 1392 bp, A.fumigatus
cacaacctccaggtcacagactttctttcggaacatcctggtggtgccaagatcattctcaagctagccggcaaagatgctaccgaggaatatgatcccatccatcctccaggcattctcgaggagaacctcaagcctgaggcattggtaggaaccgtcaatccagatacgttacccaagatacaggcagagccttccccagcggtagccgaggagagccaagggcaggtccccatggaagcactcctcaacatggacgatattgagcaagtagccacaaagaacgtcagcaaaaaggcctgggcctactattactcagcatccgatgataaaattaccaagcggttcaataccgaggtgtatagatccatcattttacgaccaagagtgttcatcgactgcacgaaatgcgacttggatacctcttttcttggacacaagctgggaatgccaatatatgtgtcacctgctgctatggctcgcctgggtcacccagcaggcgaggcaggcattgcagaggcgtgccgcagcttcggagccatgcaaattatctccaacaatgcatccatgacaccagaacagatcgtcaaggatgcggctccggatcaggtcttcggatggcaaatctatgttcagatcgaccgcaagaagagcgaggcgatgctggcacgcatcaataagctgaaggcgatcaagttcattgttctcacccttgatgctcccgttcctggtaaacgagaggacgacgagcgaggcaataatgttgctgcttcaatgcccgttcccagtgctgcgaaagcggcagacaaagccgcggatggtactccgattgtgagccaacctggtggtgttggaaagcaattatttgccggaacggacccatctctcacttggaaggatactttgccgtggttggctaagcacacagatttgcctattgttctcaagggtctccaaacgcatgaggacgcctacattgcgtcgcttcacactccgcaagtgaagggtatcatcctgtcgaatcacggcggccgaacccttgacaccgctcctcctgcggtccatactctgttagagatccggaaatactgccctgaggtcctccacaaaccccatgtttgggtaaatgggggcatccgacgccggcacacatgtggtggaacgccccttgtttggggttgccaaggctgtaacgaatcggacgggctggccctttgggggttggggacccggtggcgttccatcgtggttaaacgttccactgcccaagtatgttctacccctccggggataatccaaaaaccgggtatgctgaactttttttcccagtccttggccgaacgaaaacccaaaacttccctgccggcggcctgggtgttccacaggggttaa

SEQ ID NO: 14753 - DNA, 498 bp, A.fumigatus
catacaaattccttcacttggtttagccatgtccatacgcatcgtttgactttgtattacggcgttgtcttgtggtatgactctgacgtgtaccagcgtcgcgcagctgaccgctatcgtctccggatgcaccgtgcccggacggtcgctttaacatccgatgagattgtcgaagtacgagccgcgcaacggacatttgaaggcgcctatgtccggacagcgctgtcacagttctcatttgccctcgttgtcctcaagatcttcaccagcgagttctacagcaccggtgctctctttgctatctacggaacaggcgtactcatcatcggtcttttccgtcgtcagcagggaaaccgacagttcttttctgaactcggagaagacggggttcctcgtcacaaattcaagacgagtgggaacgcagtgctggtccttacagccctgagtgtggctgcgtatgcaaccctcattgcgctgactgtgcggctgggccgataa

SEQ ID NO: 14754 - DNA, 276 bp, A.fumigatus
aggtgtgctaatcacgactcctgcgattgcgtgaagatcaaaaatatggacaaaggaggagaaatggcacaacaagaaaaggaaatgacaaagtcggaggaattgtacccgacaggctacctacttagcagatatacacttgttgtccgattgtccaagttattcaaagccaccatcttcgaactttacggggtccccatccaatcgttcggacaagaggccgacgtgggggcgtgggggcaactccatcaatcccgtcgagttttgtctggctga

SEQ ID NO: 14755 - DNA, 210 bp, A.fumigatus
aaagaacagtcgcgcctacccaccaataagtatcatcggccgattcttcatatgcttcagttcgcccatgccagcgtgcttggcttttttgcgcttaaccgccatcccgatcagatcaaggagctctcgctctctctgattgacctccccgccctggtcctggatgcgagcggccgcttccgcagactcaagaagctgcagttcttttag

SEQ ID NO: 14756 - DNA, 498 bp, A.fumigatus
  unsure (439),(447),(450),(469),(471),(472),(486): Identity of nucleotide sequences at the above locations are unknown.
ttcctccacttagtcatgccgtcacctgcgcctcttccccctcactttacctggggctttgcaacagcagcctaccagatagaaggtgctgttgatgaagatggacgagggaagtccatctgggataccttctgccacctggagccctcgcggaccaagggtgccaacggcgatgttgcctgtgatcactatcatcggtatgaagaggactttgacctactcgcgcgatatggcgcgaaagagtacagattctcgatttcctggtcgcgtataatccccctgggaggtcgagaggatcccgtaaacgaagctggtgtcgcattctacaataagctcattgattcgctgctggcaagaggcatcacgccatgggtgaccttgtaccattgggacctgccgcaaacgctgcatgataaatacgggggctggttgaatgtcnttaaatcnccnaaagattttgagagatacncnngggtctgttatgancggttcgggtga

SEQ ID NO: 14757 - DNA, 738 bp, A.fumigatus
aaggacttcttctcctccgtgcccaatctcaagcggatcttcctctgttttgctaccgcagtcttcagtcagagttcgggcaaccttctcgtgtcaaactatctgacgcagatcctgaaggacaccggcttgaagaccgagtttgagataaccctggtgaacggcatggtcaccttgtggcagtatattgtcgccatcaccgtgaccttgatcattgaccgattcaagcgacgcttcttcttcctcacaggctccggaggcgtgctggtcacattcatcgtgtggaccattgcggcgcagcgctacctggaaaccggctcgttggcggcgggacgactcgtgctcgcctgtatctttgttttccaggccttttacacccttgcctggaccaatttgatcgtcacctatcccttggagatcgtgacgtatcagatgcgcgcgaagacgtgggcctttgtcttgctgaccatccaggtgtcatccatttttggcggctatgtcaatcccatcgggctgaaaaatatcggctggaaattttacatctattactgtgtatgggtcgccatcgtattcgccgtcgtgtatttcttctttgtggagactgctgggccgacgctggaggagttgacgtaccttttcgagggccaagaggagaagaagcagttggcgcggaagattgaggagcttaagcaggatgttcatgtatcagagcatgtcgaaaagcttaggggcctgtag

SEQ ID NO: 14758 - DNA, 1437 bp, A.fumigatus
gaaacccacaatgcaactttgtttggggcttcttcgaggctttcccccttcctaaatgcaggacacggatttttccatcgaaaagtccttcttgcgccgaaacctctgctcaggatgagtgagtctctcctggccacgcggcgagtcgcctttcggctctccccgcgcagctatcgccagctagtaccaagagctcgtcaacacagcagaatcgccacggcagctgtagaaccatcgacaacaagccacgacactacgtaccctctcaacccttcctcgccctcctcaccgtccgcaagatggacagcccttcgatccgccagacccttctccgacttcctcaccgacggcttcaaccgccaacatgactacctccgcatcagcgtcaccgaacgctgcaacctccgctgtgtatactgcatgcctgaagaaggggtcccgctctccccacctgcgcacctcctcaccaccccggaaatcgtgtacctgtcgtcgctgttcgtgtcgcaaggcgtgaccaagatccggctgacgggcggcgagccgacagtccgtaaggacatcgttccgcttatgcggtcgattggcgagctgcggcggaacgggctgcgggagttgtgtctgacgacgaacgggatctcattgcatcggaagctggaggatatggttgaggcggggctaacgggtgtgaatctcagtctggacacgctggacccgttccagtttcagattatgacacggagaaaagggtttgaggcggtgatgaagagcatcgagcgcattctggagttgaaccgggctggtgcggggatcacgttgaagatcaactgcgtggttatgcgggggatctacgatcgcgagattcttccgtttgtggagctggggcgggacagtcccatcgaggtgcggttcatcgagtacatgccctttgacgggaataaatggagccagggcaagatggtctcgtaccaggagatgctggcgatgatccgggagaagtacccgtctctggagaaggtggtcgggcacaagaatgataccagcaagacgtaccggatccctggcttccagggccgggttgggtttatcacgagtatgacgcataatttctgcggcacctgcaatcggctgcgcatcaccagcgacgggaacctgaaagtctgcctgttcggcaatacggaggtgtcgctgcgtgatatcattcggaaggagaatgatggtcagccgattgatgaaactacactaaaagaactgcagcttcttgagtctgcggaagcggccgctcgcatccaggaccagggcggggaggtcaatcagagagagcgagagctccttgatctgatcgggatggcggttaagcgcaaaaaagccaagcacgctggcatgggcgaactgaagcatatgaagaatcggccgatgatacttattggtgggtag

SEQ ID NO: 14759 - DNA, 570 bp, A.fumigatus
gactggtctggcaccaccatgctgatagaaggcttagatagtgaataccacagaaatacgacatcagccaatatcccccttcatctcctgcccctgcatacctcgccgttcaaactccaggctcgtcactatcataagcgcagcaataacagcgcccccgactctcgtcccgaacacaagccagaaccagctccagcagctccatcgtcaccatcaccgtcccttccaacaacctccgaccccgacctcccgcacctcaccccttcccaaaccgtgcacatgacccagatcaccgaaaaacccatcacagctcgatccgcaacagcaagctgcctcgttcacttctccaacgcacgaccacacgagctcctccgcaagggcctcaccaagaaaggcgacgtgttcagcgtcgcccgcatcgcggggataatggccgccaagaaaacgccggacctgatcccgctttgccatccgagtattgggattacgggagtggaggtcgatgttacgcttgttgatcctgctcctctgtcttcaccacggggctggaaggatccgcggtggcgcaat

SEQ ID NO: 14760 - DNA, 597 bp, A.fumigatus
  unsure (474): Identity of nucleotide sequences at the above locations are unknown.
tcgatgacgaacggcatgcaggtcttgcaatcctggcaagataggttcggccacccgaccggttccaaattgggattcttcggtgcggccaacgcaattggaggtgtcattccttttatctttctcggctggattggagacaagttcgggcgacgtcttcctacagccttgggatcggtgatcatcatcgtcggggtcctcgttgagttctttgccacctcgttggacatgtacattggtgggaagatcgtgctgggcgtgggctcctcgctcatccagatgggcgcccccgtgctggtgaccgagttgtcgcatcccaaagaacgagtgcaaatcaccactttctacaacacctccatcgtactagggtatgtgattggtgcctgggcgactttcgggtgctaccgcatcagcagccaatggtcctggaggctgcccaccctcatccagatcatcccatcggcctatcaattntggcttcatctgggtttgccccgaaatccccctcgatggcttattgccaaagggtcggttgcaggaaagcacgcgcgattttggtcaaataccacggagaatgtgatcccacctccgagctag

SEQ ID NO: 14761 - DNA, 294 bp, A.fumigatus
gaggatgcgagcaagtcctgcaattttgagccgatctacgctggtgcaccgacttgtgcatcttcttataccgtactctatcctctgaaagacacaagggctctccatacaatggctcccgctgctgcccatgctaccgatggcatcttatcgacaatcgacctgaagtcaattccctctttctggcgtcggaagaatggtattttactctacttcctgctcacctcgtccctcctggcgagtgcagctctaggcattgatggggtgagtgaaactcccgtctcccgttcttag

SEQ ID NO: 14762 - DNA, 951 bp, A.fumigatus
gcttcagattcagcaatgaaagaggatgaaggacgggaatctccattgcttaaccattatggtccagatgggagagaatctcaatcgttgctctcgggacctccgaccaaagaaaccaatgggacaacccatccctttacaaacagtcctcccctgacctctccttctgctcctcctggttcgcaccaatatcgatcatcgatatctcagcccgctccagatgggcaacgtcgccctcgtacaatgaatcgtgttcggtttgatattgaggaagaatcggaagaggaaagtctcccgaatggacaccctcgcgactcggaggactcgtggctggaggaggaggattatgcgcggccaaatacgagccgatcgggaagaaatggcagaggtcagatggttcctcttttaacggatatagaggcccctagtgtaacccttgccacctctgatgatttcttccctgaggaacaccttgagaacgcgaggccgaggagcggaatgcggatggccttcatgaatatggccaacagcattataggggctggtatcatcggacaaccctatgcgcttcggcaggcgggcatgacgatgggagttttgctcttatgtgcgctcacagtcgcagtggactggacgattcgtttgattgtggtcaattctaaattgagcggcgcggattccttccaagcaactatgcagcattgtttcgggaaaagtggtctcattgcgatctccgtcgctcagtgggcttttgcctttggcggtatgattgcattctgcataattgtgggtgatactataccgcatgttttcagctctctatttccttctctccgagatatgtccttcctctggctcctcacagacaggcgagctatcattgttctttttgttttgggagtctcatacccattatctctgtaccgggatattgccaaggtgcgattctaa

SEQ ID NO: 14763 - DNA, 213 bp, A.fumigatus
ctggctaaggcgtctgcgttagcgctcgtaagtatgttggtgattgtcgttgctgtaatcacacagggttttcgagttccctcagaatctcgtggcgaggtgaagaacctactttttctcaactctggtttcttccaggccgtgggagttatatctttcggtaagtttgcattgcccaaaggacctgaagttctaatgtctaacaggccatag

SEQ ID NO: 14764 - DNA, 219 bp, A.fumigatus
ccgtccaaagaccacaatagtctcttgatttatggttctctcaagaaaccaaccatggaccgcttcgcaaaagtaacccattactcaaccgccgtctccctttgtatgtgcttggctatgggtatctcaggcttcctcttcttcggatccaagacccaaggcaacgtgctcaacaacttcccttctgataatgtaatggtcaatatcgcgcggctgtaa

SEQ ID NO: 14765 - DNA, 399 bp, A.fumigatus
caccaaattgtccgcagttgctttggcctgaatatgcttacaacgctgccccttgaagcctttgtttgtcgatcggtcatgacgacctactacttccctgacgaacctttcaatatgaatcgacacttaatattcacgacatctctggtagtaacatctatggccatggcattgttcacttgtgatcttggggctgtattcgagctcattggagccacaagtgcagctgctttggcgtacatatttcctccactttgttatgtgaagttaagcaatgcgagttggaaatctaaggttcctgcatatctgtgtctcgcctttggtatcacagtcatgggagtcagcctgttgcaagctgttgcaaagatgataagcagtgagtttggacctagacgttga

SEQ ID NO: 14766 - DNA, 2007 bp, A.fumigatus
ctttttacagacgcggcgagagagttccccggtgactcttgggaggctcatgaagccaatatggttgccaatgccatcatggacgcttttatagcgggccacggaagccgggactccatcaaggaggctcgcagaatcgctcagaagtatcttggggataaggtcgactcgtctgatgtttatgagacggatacccagcccattgtctacgccatcgggcactgccatatcgactcctgctggctctggccttgggcggagacaaagcgcaaggttgctcgctcatggtctaaccagtgtgacctgatggaccggtatccagagcaccgattcacttgttctcaggcacaacagtttaagtggctagagcagtattacccttcagtctttgaccgcgtcaaacgatgggtaaagaagggccatttccagccgattggtggtagctgggtcgaacacgacactaacttgcccagcggagagtcgttggtacgacaattcatttacggccaaaggttctttgaaagccgctttggcgagcgttgcagcaccttctggctgccggatacattcggctactcaagtcaaatccctcagatctgccggctggcgggcatgagccgcttctttacccagaaactcagctggaacaatatcaacaacttcccgcacactaccttcaaatgggttgcgcttgacggcagccaggtaatgtgccacatggccccgtctgagacctacaccgcagaagcacattttggcgacgttaaacgcagcgtgacccagcacaagtcgctggatcatgacaacacttcgcttctggtgtttggaaaaggagatggtggcggtggccctacctttgaacatctagagaagctgcgccgctgccggggtctaagtgacaaggttggcttgcttccgcgcgtgaagatgggagactcggtcgatgatttcttcacgaggcttgagcaaaaggttgcaaatggaacagagtttgtcacctggtatggcgagctctactttgaactgcaccggggcacatacactacgcaggcgaacaacaagaggaacaaccgcaagtctgaatttctgctgcgcgaactagaatatctgtcgactctcgcatcccttaccaagacaaacggcgagtacaattatccaaagaatgatattgatgatatgtgggaaggtgtgcttctatgccagttccacgattgcctacccggaagctctattgagatgtgctacgacgattcggacaagctgtatgcgcagatttttgagacgggtgagcgggccagacaacaagctctcgaagcgcttgggtttcccgataacagtgccggcaagagtcttgttgccatcaacacgttgccttggtttcgctcggaaattgtcaaaatcccggatgagttcgtcgcgttgacaggctcacggtatgctctagcaagaggagatcctggcctcatccaatgccaggttctagatgctaaacgaaagcccaccgtgacggtagcagagatacgacctggcattttccgtcttgacaatggcaagttgagggtcgatgttcaggatggcgtcattacttctttgtatgacctcgaagccgagcgagaagtcatcgccaagggaggcaaggcgggacagctcgtcgtctttgacgacaagccgctttactggcaagcctgggatgtggaagtttaccacctcgattcgagaaaagagctccaggcgggaaagacctccatcgcagaggaaggcccgcaccgtgtcagcgtggccaccacaatccaaattagcgaccagagctgggtcaagacgacaatcagcctggctgcggcggtggatgaccagccctcttatgtcgagtttgagagcgaagtcgagtggcaggagaccatgaagttcctcaaggtcgaattccccgtggacattaccaacacagaggcatcgtacgagactcaatatggaatcaccaggcgaccgacgcattacaacacaaggtaa

SEQ ID NO: 14767 - DNA, 636 bp, A.fumigatus
ttttctaaccgaaacagctgggacatggccaaattcgaggtctgctgccacaaatgggccgacctgtcagagtacggctacggagtctcgatcctcaatgactccaaatacggctttgcaacctgcggtaacctgatgcgtctctcgcttctgcgtgcccccaaagccccagacgcccatgccgacatgggccgccatcatattcgctacgccattctcccgcatgctggccccctggatgcccgcaccgtccgcgcgggatacaatttcaacagtcctcttatcctgcgccgttgctccggcatgcaatccgctgacgtgttcagatccatcgctgtcaggggctcacagtctctcatcttggacgtggtcaagcgcggagaggacgatgaagacgtttctcggggcgagctgcccaagcgacccgggaaaagcatcatccttcgtatctacgagtcgctgggcggtagatcgaggggtacgatccacgccaagttcccggtcaaggaggcttggaagtgcaatgtgcttgaggacaatgaggagcggttggaggtttgcaagggcgaggacgacgtcgcagtcaagattgagctgcgagcttttgaggttgccacctatcgcttgcagctgtaa

SEQ ID NO: 14768 - DNA, 1296 bp, A.fumigatus
tctgtgctactgcctcaaaccggttccgacagggacctaccagcgcccctcaactttggcgccaacccagctgccgattcccccatcaaaagccatgaagaaattccagtgattataccttcgaacagcgcagaaacttcgccacaggacacggagagcgatcggttgcgaaaggagataattcgctccttgagccgggaaaccacgccctcggcggaaaccgagcagcaagcttctaacaaggcgcagactgctcggcaagacacagagaccagtctgccagacagtctgatacccagtgaatacgaaaaatactggagcgagcaagtcgaatcaagccctcaggatttaagaccgccagccgctgtctacggtgcttctcagaatgtcccgcagcaggatctgtacaccagttcgcctatgagtgcttcggcgcccactgctcctactcaacctacttcagaacctaagttgaaccgacggttctcgtgggaatcatcgtcagaggaggaggtacctcccgtggacttgcaggcggcttcaccgtcagctatcccgatttcaggacaacttcctgaggccaacgatgcggctgagccagcgccagagactgccgccaacgagtcggaggtggcaacggatagaggtcccgaagctgacgttcaacagacgcctgagaagcctaaactcaccctagtgactcctgctgccatggaaaatagccgcgactcgaatgagaactacctgccggaagtcgtcaatcgtcaaagtttagaggagcgatccccattgcccgagcccaagatgccgcccacggttgagccgacattgttgggcttccgggacataatggggatacaatcctccgatgagcgagtgcgagctttcgaccgtacccgggatcagttcgcgacgatcgatactggcctgaaaaattggttacaggtggtgattcgtgcccatccggagcacatggatgtggtggagcagagcaggaaggcctcctctatcgagcctaaagcggtcgtatccaaagggaaattcccaaagttgtcgtctcttggacacttcacctcatcgaaccaagatggccatccgtctggaccgggccacgcacgacgcccatctgcgccgcttggttcgatcatgaataaacaacaggttgagcaacgcggaaaggacctgttacatacggcgggagccctgggcggccgagcaggggaggccgccaagggtctcttcgccaagggcagaaataagctgaaaagaggagagtcagaaaaggtagatgcttaa

SEQ ID NO: 14769 - DNA, 300 bp, A.fumigatus
ctacctcatgactatcagatcttcctacgattaaatgctgaacggccctgtgtagaggtctgtccagtttgcaaatcgtcccgctacttaaacccggatatgcgatttctcatcaatccagaatgctaccataagatgtgcgagtcatgtgtggatcggattttctcctcgggtcctgccaactgccctgtcgcgggatgccataggactttgcgaaagaatcgattcagaaagcagacatttgaggatatcggagtcgaaagggaggtggatatacggcgccgagtgatgtcgatgtag

SEQ ID NO: 14770 - DNA, 873 bp, A.fumigatus
gccgcgctaatgtcattcagtctgaatcgccgcgaggaggagttcgactcgaaacgggcctgggatgatttccttgaacaacgtgaagaaattatcgcaaatctcgtccatggtacagacgtagcgaagacggaggcagatctccagaaatacgcgcaagagaacatgaactctattcgggccaaccgtgctctcgaagtccaggaggcgacttctttccaagaacagcagacacaggaacaagagctcgcacgaatccgccgggaggaagcaagacaagaatacgaaaacgagcgacgagaagttatcgctggccgagaagactatctcgctcggctcgcatcagggaaaccaggcgatgccgccaccatcgcccgggagagccacaaagtcctcctcaagaaatcatctgcgcggcgtagcgaggaagagcgaatccgtcagaagcaggcagccctgcgcagctcggagctcaagaaactcggccaggctgcaaccactgctgaccgcgccggtccagcagacacaggtctcatcaagggtctcaagaagattaagaccccggagcccgagaaggcctacgatccatttggcggtttcatacccaataagcgcgactactataccctgcgcgatcactacccatccagttaccttgacccaatcaggcaggacacccgaatgcaggctggcgggtacgatttacgtgaatattattctcgtaccctactcgaggcgtttgcaggcttaggatgctttatcgatgaggaagtatctaaacgcgatgctacgagcaaacttgcgaacgcaaagcctgtggccactgagggggcagcaatggctgctgtatccagctctaaggtagcaacatga

SEQ ID NO: 14771 - DNA, 1449 bp, A.fumigatus
ccatcctctggatgtgcagctaaactgtggatttcatatagggccaatccctccccgtcacgttcggctagggattcctcaatctgttctgagcaagtgaataacccacagccgcccgatcgcatcgaacatatcaggcgtcaattattagaaactacagactgggctgctgtgagagctgcacagcctctcaaaatatcgttcacaccagtcgaagaggtagagcacttcggcaaaagacgaagattaaccgaagccgaccgaacgagaatagctgccgtggaaaacggggctgtgccatatgagattcccaagtctcgcagggctccccgacagaatatatcatcggatcgacttgggattgaaggtttagagattaagataaatgggcagcggtgccatactggcgaaagcattctcaaagagcgccacgagaacttttcctcacagccaatgctccttgatggagatgtatcaatccgtcccgaccaaggctcggatccgtcagtacagccatacagtgacgccaaggcatggagcgcaaaagcagactcggttgacagatcattatattgtcagcggaaatcagcttatcctaagtcatctatacattctatcgccatttcacgatctcgtctctctggagctgccatcccgggtcggataccatccagcaggaaccgcagtgaactgatccaaacatccgggttttcgggtcaggatttgggagcgtcaatcttggcgccccagaggcaccatgagagcaacagagtccatcaatcatccgggtcaatcatacaaaatcgcttcacaattgacgatcagatagctgccgagaagggaaggtgctcgaatgatgggataataataacgacacgtccagatcgccatggaggcccgcagcttgaacagcgcccgttttcacagtcctcacaatattcacgctccctcggtcaatcattcggccaccatgaacatgaacatgcagcagcagtcacgcggtcaccatctggatggcttccagagccaaggtacagtatacgacggccattgagccagaaagtcaactctctttattcattggggccagacactccttgcggaaattcgcgggctagacagtgtgcatcaccgatggtgatattcggccaacctatagatgttgcaaggaatcaagcaagtaatggaacaacagactggatgccgactccctggaactctgcagtcaaggaaccgaaagttactccgttaactgaggatagtcacgcgacatcgatctatggatttgccagccaaagtccggacaatacaacggacacccaaggctcctcacagatcagtcacacaggtattggtgataatggacgaatcaatataatcgatagaatttacactggaactccaattttagcaacagcaaccctggatccgtgcgcagcttttctgtag

SEQ ID NO: 14772 - DNA, 276 bp, A.fumigatus
gaatttctcacatgggtcacctctaggaaatatccacactttgaccaaagtgaaattttttcccttcaggatgcattcagaaaattggatgttgacgataaggggtatctggacgaggctactgtgatcaaggccacccagcagtccgaacgtcagccgtacgacgtcgtgcgtcaggctttgaaggaagtcgatctcgatagctctcgtcgagtcgagctcgaagattatgtagatgttcgtgtttgtatcttcatcgctaccgggaccatgtga

SEQ ID NO: 14773 - DNA, 708 bp, A.fumigatus
aaaagtattcaacagctcatttcaagactccgctctactccagcgcaaaatagagcaactgccggcccgagtgcggctccagggatacccgagattggaatgggtgtggctcgacacgtctccaaaggcagcgtaggaggacgtattcacgttcagggctcctccgcgaacgtcactcatactatcaatgaagatgagagaactgagttcaccagacatatcaatgctgtccttgctggggatcccgatattggccatctgctaccattccccactgacacttttgagatgtttgataaatgcaaggacggattggtcctagcaaaactcatcaatgacagcgtcccagatacaattgatgagcgtgtcctgaataagcctgggagaaagatcaaggacctaaatgcattccatatgactgagaacaataacattgtgatcaattcggccaagggaattgggtgctctgtggttaacatcggaagcggcgacatcatagaggtccgcgagcacctgattttgggtttgatttggcaaattatccggcgaggtcttttgggaaaaattgatatcaagcttcatcccgaactctatcggcttcttgaggacgacgaaacgctagaccagttcttgcgcctccctccggaacaaatcttgttgcgttggttcaactatcatctgaagaatgcaaagtgggacaggaagtag

SEQ ID NO: 14774 - DNA, 468 bp, A.fumigatus
tgcagctcgctgacctgtcacagggtgacaaacttttccactgatgtcaaagacggtgaaaattacgctgtcctcttgaatcagctggctcccaatctgtgttcgagagctccgcttgagactcggaacctgcttgagcgagcagagcaagttctggccaatgcagaaaaactaaactgtcgaaagttcctgactccgtcgtcccttgttgctggaaaccccaaacttaaccttgcatttgttgccaatctgttcaacacgattcctggtctcgacccaataactgaggaggagaaactcgaggttgaggatttcgacgcagaaggagaaagagaagccagagttttcaccttgtggttgaactcgctcgatgtccaaccccccgtcaactcgttgtttgatgatcttcgagatggtaccattctacttcaagcttacgacaaagtgatccctggcagtgtcaactgg

SEQ ID NO: 14775 - DNA, 219 bp, A.fumigatus
cgtttcgtcgtcctcaagaagccgatagagttcgggatgaagcttgatatcaatttttcccaaaagacctcgccggataatttgccaaatcaaacccaaaatcaggtgctcgcggacctctatgatgtcgccgcttccgatgttaaccacagagcacccaattcccttggccgaattgatcacaatgttattgttctcagtcatatggaatgcatttag

SEQ ID NO: 14776 - DNA, 402 bp, A.fumigatus
agcttgatatcaatttttcccaaaagacctcgccggataatttgccaaatcaaacccaaaatcaggtgctcgcggacctctatgatgtcgccgcttccgatgttaaccacagagcacccaattcccttggccgaattgatcacaatgttattgttctcagtcatatggaatgcatttaggtccttgatctttctcccaggcttattcaggacacgctcatcaattgtatctgggacgctgtcattgatgagttttgctaggaccaatccgtccttgcatttatcaaacatctcaaaagtgtcagtggggaatggtagcagatggccaatatcgggatccccagcaaggacagcattgatatgtctggtgaactcagttctctcatcttcattgatagtatga

SEQ ID NO: 14777 - DNA, 216 bp, A.fumigatus
ccaggactccgcttctctcccctgaaccgccttaccatcaccgataatgatgccattatcaataatcatgccttgagatccgtatatttacccccaccatcctgtagttggacgctctcgttgaagctagagttctgtttcaatattgaattgatcatttacgagcagaactactccgtataccgcatcagtcctctatgctcgatagtccgctga

SEQ ID NO: 14778 - DNA, 207 bp, A.fumigatus
ggatctgatacagtgggtgatcacctgacgcccggtcccacctgccgcccaatttccctcacagactttcaaaatgaccaaacttcaactgctcataactccactaatataactctaattaaagcagctttagaagtaattaaattattagaactaggtgaattaattaattatactttctttgcaaacaagtatggtgttagctag

SEQ ID NO: 14779 - DNA, 516 bp, A.fumigatus
gtcgactccaactccgcaaccttggcatcaagctcggtcttggtcgactccaacgccgcgactttggagtcaagctcctcctttgtggaggccagttcggcttccttcgattctagttcagtcactttagagtcgaattcagactgcagggcgtcatgcttttcgtgtagttgttgtttctccttctcgtattctgtcttcatcgtcgtttgctggtcgagtaattccttctcccgagctgccaaagcttcaggtgccgctttctcatcttcggctttgatttcctcaaatagctcaatcaactcttgccttctgatttgcaagagcttccgccctctcctccttctgacgttccaattcttgctcgtgcgcctcctgcgcttctttgatgttcgtcttcagagtagcgacctgcccttccagttcagacttcgtttgcaagagctcctggttgaacttttccgcctccgccaggctctcttcaatgtccttcctcttctcctcgaggttgcctag

SEQ ID NO: 14780 - DNA, 624 bp, A.fumigatus
ggaccatatttgcgtcctactcctcgcggctcaatagatcctcattatgtgtcggcctaccaagccatccgggatatggggttgccaaatgggcacggtgtgaatgacaggggaacaatttcaccccctcaagagcagcatgacgagcctcttgaactcctgcaaagaatccaagaggctatcccggacatcaaccgcttgcttgatgggtacaagaacacaaaaagcaagcttgcagctcgggaggctgagtttaagcagatggaaactcagcatgaacaggcattgatgcacaaggatttctacatcgaagcactgcagaatcagatgagaaaagcagcgaacgagagtgcggaggaagcaacaaaattgaagaacaccataaacgaactcagaatggaactaggcaacctcgaggagaagaggaaggacattgaagagagcctggcggaggcggaaaagttcaaccaggagctcttgcaaacgaagtctgaactggaagggcaggtcgctactctgaagacgaacatcaaagaagcgcaggaggcgcacgagcaagaattggaacgtcagaaggaggagagggcggaagctcttgcaaatcagaaggcaagagttgattga

SEQ ID NO: 14781 - DNA, 936 bp, A.fumigatus
gatgttggtaacgctataaatgtacctgttctgataagaatctcaaaatctagtttggattgtttcgaccagctctctcgtcttatcgtttccttgtccaaggagcatttcacgtacctcccgattgatcctcccaaggacatcttgtctaagattcctccggagctaccgtcgttccttgataatacgccagcatcgcgggagctgcgttcggcatatgtacagcatgtcatctcgaaaactttgacctaccggatcttccagccgtttttgttcactctgggcaggcgatatgacaaagcggacactttcttccagatgctttcgatggacattcgccgcaagtccgtcagacgggaagcattctggcgacaacagacattaaaggcggcgtataccacgtcggatgcgaaacagtcgatcaacgtcgtggctgcggtgattgtcgatgaaatcatcgatcttatcaaacatttcgccgacccacgacatctcgattccctgctcatcggcgtgcgcaagatcgtcaaactcgcggccgagacctggaggctcgctcgtgtcgaacgagaactgataatagctagccttccggctccagatgccgaagctgtatctaatgacagctgggatgagtacggggccccaaaagagcgcaacgtcagtttggggaatgaccccagccgacatgtcatcttgcggactttcccccagattacccgagaggctgcacacgaggatttcgccgaggatgaggaaaaggccagtccttgcacgtactcgaggggaactgtcttgtactctgactcccctgttgtgatggctcgtcttcaggagcttgctaagaagtcaactgaaacactggccagcggagaggattcgccacgtcgcggctcaagaggatcgctccgctcagtggaagtcactgctcactga

SEQ ID NO: 14782 - DNA, 723 bp, A.fumigatus
agacgaacatcaaagaagcgcaggaggcgcacgagcaagaattggaacgtcagaaggaggagagggcggaagctcttgcaaatcagaaggcaagagttgattgagctatttgaggaaatcaaagccgaagatgagaaagcggcacctgaagctttggcagctcgggagaaggaattactcgaccagcaaacgacgatgaagacagaatacgagaaggagaaacaacaactacacgaaaagcatgacgccctgcagtctgaattcgactctaaagtgactgaactagaatcgaaggaagccgaactggcctccacaaaggaggagcttgactccaaagtcgcggcgttggagtcgaccaagaccgagcttgatgccaaggttgcggagttggagtcgactcaggccgagttaatctccacaaaggatgcactcgatgcaaagcagaaggagctggatcagaaggaacaacggtggactgatgaacgtactgagttggaggctcggatttccgccaaatgtgaagagctggccaactgcgagcgcgagaacaagaaactggaggaaaataacctgctcaaggagcagcagctagaacatgcagttgaggggatgcgcgccacaatcgacaatttgggcaaggattgtgacaggctgaggaagacactccacagtcttggagaagcaactgacctcaagagcaccaagggagactcattcttgtaa

SEQ ID NO: 14783 - DNA, 417 bp, A.fumigatus
gcgagcggatcacgcaaccgagcggatcaccaaacgcgttttgacttctatttcaaaagctgcagtgctcagccagccactatgccaccaaaagcgcgtataaactcaaaaaattcagttgagcaggagggaagggtcctacttgcagtatcagctttgaaaaataaggaaattctcaatattcgtgaagctgcgcgtgtctataatgtgccttatactaccctccagcggcgcctaaaggggcatacttttcaagctgaattacgcgtaaatggccataaaatgactcagaatgaagaggattcacttattagatggattctatctatggatcaacgtggagcggctccccgaccgtcccatgtacaagaaatagcgaatatcctgcttgcacagcgtggtttaactcctacctag

SEQ ID NO: 14784 - DNA, 231 bp, A.fumigatus
ttctctaggcgctataaccaccagtgtgctaaatgtgaagacctaaagattatcctagaatggtttaattatatccagatcacaataatgcagcatgggattacactggaagatatctataactttaataaaactggctttgcaatgggcttagtagctactactaaggtagttataagagctaagatgcttagtcagcccttccttatccagctagggaactgtgaatag

SEQ ID NO: 14785 - DNA, 285 bp, A.fumigatus
tttgatcaaatctgcactgagaatgatattattctaatctgtatgcctgcacattcatcacatctcctccagcctctaaatattagctgtttctctcctcttaagcgtgcgtatggctgcttgattgaggataagatgcagcttggtttcaaccatattaataagtttgatttccttgaggcctatccacaagcttgtacggcaatcttttcagcagataatattaaaagtggctttttagcaactggattaatactactgaatccagattgggtgcttagttag

SEQ ID NO: 14786 - DNA, 654 bp, A.fumigatus
ttccatccgtacacaattgtcataatgttgcggaggttctcgtcgaccttcaagaagaagggggatcgcgagtccaagcagaatggcactgcatccagcagcagtgccgccgtcgccaacaccaacaataacgacaacaagcgtcactccaaaatctctgcggcgcgcaagtcatcgtctgatgacgaccgtaatgagaagaagggcaattccgtctctccttttgagaaatacgcatccgttctccatgcttcgcgatctcccattcccaaccagactggggatggggcctacctcgagcatgagcatacgaccagcttactgcaggatgccaggcatcttggctttaaggacttcaagaccctgaaggaggtcatcgagagcaaacttccggggggacagctgatagatgacaagaccatgttaatggagcgcatcatccaggtaagatggcccactgctaacacaggacgactggaccaaaatgctgaaactatatttactcaactcgtagctggtcagcaggcttcctcacaactcaaagcatcgcgaggagctaacaaacgccttccttacggagctgtgggattcgttgcctcaccctcctctctcgtgagtttgcgaacgacctctacccttggtggcgtttgctaa

SEQ ID NO: 14787 - DNA, 186 bp, A.fumigatus
tatttggccgcggccgaaattggaggctattttgaacccctaaaacatgattttattactaaatctagttattcttgcgctgcggacattgcaattgcctatggcctagaatatggcagtcactgcagcgtgggggtccccattgagggcgttgttctgtatctactacctgctctggagggatag

SEQ ID NO: 14788 - DNA, 201 bp, A.fumigatus
atccaatgcaaaccatacctatctgttcgaggcccggaggctggctgtcaagagatgcacttactcgtcaagctgaattacagtcatcacatccctaggttctctttggtacagggatcaaggagatccactctttctaacaaagatgttcagcagctatttgtccctgcggggtatgcgtttctgagttttaccatttga

SEQ ID NO: 14789 - DNA, 1575 bp, A.fumigatus
tttgtgactgcgcccgaaatgtcacctcctgctgtttccgtcgtcatctcccctcccactgtcgacttggactcctacgaaccctttgacgggcaatacactcgcactgtggacgagatcctctcggacgaacctagcttcgacgcctcatccgacgcatgcaatagtggcatctccatggacgggtcaaatggctctttacaacgagagcgtgcgatcagtcgagcctccgttggcaaaagaactggtcccaagaagtcgccttacttctcgacgggccagatgtctcagcggcgtatcggatcgaagaggagtattacccgaattgatgtcgacgaagacgacgacgaagacgacgacgatgacgatgacgaggacgaggacgaggacgacatcacccctgctacgtctgtcgaatctgtgaaaatccaggtggtcgataacaacatcgaggacgagcaccatgataataaaacatatgctaaagccaatgggaatgctgtcgacgatgacatcgctgaggaagatattgttttcgcttcagttggaccagaaatgcaggctcgcttgctgaatttcattgcatcgcattcatttatgcgtaatggttcatatcctgtcaggcggtccaaaaggcggacctttgtgtgcgaactctatgagcaagcgaaatcgactggaatggacgagtactcgatcgacaggttgacaaactacgtgaggaagacatatctcgaactatatggaaaagactatgtcgatacccaaggctcagaatttggtgacgagattgacgacgttggggggaagagaagaaggtccttgaacgactccaaaaaggatcggaagaggaagcggttgaatggcgacgcagctaaacagaaacataagaagagcagatcgcaatcttcgcaggagaagcgtactacgtcaacggctgactcgcacaacaattccaagcgtgaagtaatcgaccttgaggccgagtatcctcttgcggacttctctgctagtgccacggagcccgaaggtttcgagagcaaatcgactgcggaagagttacccaggagacgtccaagcatcagcaagcagtccggtcgttcgtcgaatgacgacagatcgaacgatctctctttgatcacgccggagaaccgcaacaacaaagcaagcgtctctattccttctaggcactctctgcgctcccctgccaattccaaagatgaacccatttttctggaaagtgactcagatggacccagagactcggctacagctgtcccaaaagcacattcaacgaatcctattcattcggataagccaacaacgcgcgaggagagtatcgccagggccaagaaagagaagaatcacagaaagcgccggagccgcaggaggaaaagagccgagagatatcgggagaacctgaaggactctcaaattcaaaaccttgcagctgaagatcgtcacattgaagaggatgctacgaccaacaagttcggtcagaaggacagtggtgatatcagacttgagaaggacgttctcatccttgatgaccctttttgggctctggatttttaa

SEQ ID NO: 14790 - DNA, 330 bp, A.fumigatus
ccctttttgggctctggatttttaagcaccgatgattcgcaaagtgtgaccgccagcgatgaggtgacgtcaaaatattttacgagccctcagcaagtggatggtttggcgtcgagtgtccccagccagatacccactacctattttactagttctgttcgagattacgaacctattcctgagaaagctcggcagaaatatgacgaggttggcctctcatttgacatgctggcctctgactcggagtcggacctgagtgatgtgcagagtgacgatgggcatctggatcatgatgcttttttgcgtgacgtgatacaacgcccgtcctaa

SEQ ID NO: 14791 - DNA, 234 bp, A.fumigatus
agctttattaatacaacaaacaagcgtacaaagaagggggagaaatggatacttatatttaatagccatggctcttatctcactgttaaattcttgcaactttataaagataatagtattattctctttagattccttccttatacaacacatctttaccagcctttggatggtaagccattcttaagctataagcaacacttttattatataaataataagctatcttactag

SEQ ID NO: 14792 - DNA, 192 bp, A.fumigatus
  unsure (94): Identity of nucleotide sequences at the above locations are unknown.
ttgagaaataatagaaattctagaaaggatataacatttaaagcttttattattgagatgatattttttattaagatggcagggtcgcgcgtancgcgaccctatagactaaggcttagtcttactaagccgctacgtcgaaggggtcagttaatctatgctcgcttcctaaaggcaatggaatcttcatag

SEQ ID NO: 14793 - DNA, 1575 bp, A.fumigatus
  unsure (1541),(1542): Identity of nucleotide sequences at the above locations are unknown.
ttgcgtgatggggtcttggccgggtcgaatgaaggatccaaatccaacctacaaaggggtgagtcacttatattcagttgttacccttgtcttccagctctctccctagtgactagtgactctaaaaaattgcttaatgcgcagaggaggaaaggggacattcggccctctagcactgtggagctggatcttcatgccgatccactgggtccaggtccagtcaccacgtcgttcttaagttttccccacaggaggttatctcaacctggtacctcgggaggtcacgatgattatgcagagcgcaacagtgttgtgagcagactcctacgcggactggctgggtctcatggcggttcctttagggacacggatgctgatgttttgccatctccaacaaacccaacagagcactcggataatctacaggaggaccggggacaggattggaagtcgcaaggtccccaccagcccagcgaagctcgtgaccatgtaccgtcaattgggcccagggccgcaagtgggcggctgatcgaacaattggaggctgtctctgctagaagacttcgggcgcgagaaatgcgggttgctctacgctacaagcgagaagatgagggaaagcatagagccgcactgatgaagagactcaacttgcttcttgcgcaagatcaccagctcaccgacttgattgaagggcttgagtcggccacggaatcttacttggacctggagcaagcatatcattggatggaggacgagctggatcaggatgaatatgcgctcatccagtctatgcagcggttcgcgaaatcaatgcgtgagtcgccaccaggactatccaagataaccattcaggctgaatgcaacgcctccgatgatagcgcacgctcgcttcatgacgagcctctggaatacccacctgccgtgtttgattacctctcacgagttggagatgcgcggatactacaagagcgcttggtggagcttgattcacagtggtacaccatcgttgacaaacaaaggctacgaagctccctcaatattgctctggatgaggagtccttacaattcttgcggtcatacgacgggtcaaagacgcaaatccggaaggaactccacgagacaattctggacattgtccgtctccaggctctctgcaacgaacaaggactccggcccgaagagtacactggagacatggatttcccatatggaatgggtcttggtgaggtcgcatttcaacccgaggatcctctgaagacatcggcgattgacgacccttcccccttctacgaatcagggcctgctaaagtcagcagtgccatgttcatcaacaagtggcttctacaccagctccggcactcgtcggtagagatctcgcgcctcaaagccgccccagaacttcggcagttgtcggatgaagggtgggacgatgcgaatatcagtcgcttagccctgaccatgtggttctcggacgatacagtccgaaactcgccgcagactttatcccaagctgatgattatgactacacgggcgcgtcttnntacacgaccaggaaggaagctatagcgtccgca

SEQ ID NO: 14794 - DNA, 195 bp, A.fumigatus
caactgaatataagtgactcacccctttgtaggttggatttggatccttcattcgacccggccaagaccccatcacgcaactacaacagatcaggtagtggaagcttcctttatgcttacatcttctgggcccaggagactgagcaaaagagtgaacaaaaggagattgactgtgtatcaaaatctgtctcctag

SEQ ID NO: 14795 - DNA, 1128 bp, A.fumigatus
cctgggagagaagactttcgaagaagcttgccgagatatcgaaccaagatagcctcgcagctcagacaagctgctcttgttgaacatcagccaaaacagatcccgactcgtttagccgtgtcctccatgatctcatacgttcatgatcgcatattgaccccagagatgatgcgagccatgatcatcctctacattgggcctcataaccggcccgatttcagcacggactttctcttatcgcctgtcctagctcccgagagccttcttactaggtttcccaaaacctacttcattacaggggaacgagatccactggtcgacgacacggtcatcttcgctggcagaatacgccaggccaaattacaccaattccgggagagacaggaactagggcttgaaaaatcccatcgggaattcaatgaaaaggaccatgtggaggtctccttattacccggagtgtcacatggattccttcagatggccggatttttccctgacagctggaaacacatcaacaaatgcgctacgtggatccagaacctcttcgacacggatgaggtcaagaaatcgtcttccagccttttacagacgctctacgatacttctgttgataacaagaatctggccatagaaacaaatgggaaagcgggtccccggaaccacaagcggagcctgacaggtgagtcctctgcagacgaggacaggcccttggagatgagcatcggcagaatgacccctttgacacctgcgcacggcaatctcgactcaaacgagactcggcaatccaaggaagacatgccgtcacagaagccatatcagtttcgtcgggaggctactagcaccgctgattgcagacctggctcaaaaaatggaatccgaaatagaagttcatccaggggccgaaaggactcatccagcgggctcggtagaagacggcgtctcgccccgaccaagctcactctgcctgtttccgacgacatgtccgataacctggaaagccccgtacgccttcgcaaacgagaaagaagtatccacagccttcctagtcacgaggatctcttggatcgcagaatgaacggcttagcgggcgggctgatgggaatcggggagggagcgcagacgccttga

SEQ ID NO: 14796 - DNA, 1149 bp, A.fumigatus
ctgacgcctggatgggacatcagggtctatatttcggccatcctgggtctcagcacaatggtcgttgcattcgcgagtagtatcttctccgccgccatgcccgcagtgatgcagatatatggtatcagccgggaggtatgcacccttggcatatccctctacgtcttcggattcgcattcggcccgttgatcttcggccccttctcggaggttaagggcagatacatgccgcttatagtctcgatgttcggcttcacaatattctcgtttgcaaccgccgtctccaaagacctccaatccctgttcatccttcgatactttactgggttcttcggttctggcccgcttacactcgccggagcatcattcgccgacatgttctcgccggagcagcgagggattgccatcgtcatgttctgcttgatggtcttcattggtcctctcgctgcaccctttgtgggaggcttcacggtcatgaactcctcgctgggctggcgctggacggcatatattcctggtattctagggggggccgtgctactgctcctagtcgtgttcctggaggagacctaccagcccgtcatcctggctcggaaagccgatcggttgcgccgcgaaacaggcaactgggcacttcacgccaaacacgacgagctgcgtcttgatcctagatccattctgacagagtatctctccctgccactgaagatgctcgttctcgaccctatcgtcacgtgcatgtgtgtctttgcgtctttcgtttacggcctgctttatctcttcctgaccgcataccccactatcttccagaagattcatggaatgaacccaggtgtgggcggcctgccctatctgggggtgattgtcgggcagctcctaggcgccgttggcatcgcagcgacccaaccctgggttctgcgcaagctggagcaaaacggtggcgtgatgatgccagagtggcgtcttcctgtggctatcccgggtgcagtcgcattctctgcagggcttttctggctgggatggtcgggatacaagcagagtatccactggattgtgccaactctgtccgggctgctgacgggatttggattgttgaccatgttccttccctctcttgcttatctggtagaggcccgtcctcagaagtga

SEQ ID NO: 14797 - DNA, 828 bp, A.fumigatus
atcgccaccgcggatccttccagccccgtggtgaagacgtcgtggaacaagggaaccactccatatctttgggcacttcagaagttggtccggccccggttgacgagttatggccctcgagccatccgcattcctcgccctaaacaatctatttacaccgagccgacgaatgcatggctatattttgacggaccgctaagcgcgctgaaagatcagacatgcgtgatcctggatattccgggtggtggttacgttgccatgaacccgcgcaactcggaagaccgactcctcgcctgggcagggaagaccaaactgccgatattgagtctagactacaagaaggcaccggagtatccttatccgtacgctttgaacgaatgctacgatgtctaccacatgatcatcaccacgcgcggccgttgcctgggactgagtggagtcacgcggccacgtattgtggttactggagatagtgctggcggaaacttagctgtcgggacggtcctgatgattctgcagtcagggactgaggatgtgatgccacgcccaaatggtctggtactggcgtatccctccttgaacatgcgagttgagagctggatgacggaggagcagatgtcgttgatccaggataaaagcgctcgccggacgaataagaacatcttgcagagaaagaatatggattatcagaggctgacgccatttgcatcgcctggaccatctacggaagaactgaggcaggagttcttgtctgacgcgggcttggaggcaggtgacctgggagagaagactttcgaagaagcttgccgagatatcgaaccaagatag

SEQ ID NO: 14798 - DNA, 411 bp, A.fumigatus
gtctcctccaggaacacgactaggagcagtagcacggccccccctagaataccaggaatatatgccgtccagcgccagcccagcgaggagttcatgaccgtgaagcctcccacaaagggtgcagcgagaggaccaatgaagaccatcaagcagaacatgacgatggcaatccctcgctgctccggcgagaacatgtcggcgaatgatgctccggcgagtgtaagcgggccagaaccgaagaacccagtaaagtatcgaaggatgaacagggattggaggtctttggagacggcggttgcaaacgagaatattgtgaagccgaacatcgagactataagcggcatgtatctgcccttaacctccgagaaggggccgaagatcaacgggccgaatgcgaatccgaagacgtag

SEQ ID NO: 14799 - DNA, 339 bp, A.fumigatus
ggcatattgtctcggatacaaccctcaagctgcctcgggaaagggaaagtaagtgctgatggtcggcttgttgcatcgatcaaggcaggggatctgactcttttctcagagcatttgtctccggaccagggtattatgcagacattgtatgcttctccagccaatggtatatccacaactcagcaggcttacagaccattgcagggagagattgccatcaagtcgggaactgacgctgtaccgggtcaggaccggaatgtctatacctggtttgatcaccctttccatcgaactggaaaggatttgtctaatgtgatgcagctatggctccgggactga

SEQ ID NO: 14800 - DNA, 594 bp, A.fumigatus
gaccgactgtctagcgttcagtacaacgggaaatattgtaccctactaacctccctattggcctctggcaactttggcaccccaatcacagcagccctacaacacgcaggcttcacagtgaccattatcacccggtccgaatcgaaggcaacattccttccggatattccggtaatcacaaccacttacactctggagaacctcacatcatcgctagcgggacaggatgcagccgtctgcgtggtgggtcccggcgggatcggcgcacaagtcaccatgatcgatgccgccgaggctgcgggcgtgaagcgcttcatccttgatgactttggctggggtgacaatcccaaatccttccccgagttcaacgccattcatgcgcaacgccgtgcgggatgggatcatgcgaaagcgaaagcagagagcaatcccaactttacatacaccgggattagcattgggaatccgattgattgggtaagtgatagcactggatctcatactctcgcctcacagctaaccagctctcaaggcgttgaagcgcttccctgcgatggggttcgatatagcgcactgctcggccgtcatctatga

SEQ ID NO: 14801 - DNA, 282 bp, A.fumigatus
tgcagctatggctccgggactgacgatactcccggaccagtcatccccttccacggatgctgctttgagattctgactcgcgttctcaccggctccaccgacagctcaacaatcgatatgaaagtcctgtacaatgtgatgacagagttgtccaacgaatcctcctccgctctgcgactgaactatggcgacgacattcggcgggcgcaaggccggtactgggagtgcatccccggcgcagaggcaagcagcaacgatcaagtcgcatcgtcctcaaactga

SEQ ID NO: 14802 - DNA, 600 bp, A.fumigatus
actatggcgacgacattcggcgggcgcaaggccggtactgggagtgcatccccggcgcagaggcaagcagcaacgatcaagtcgcatcgtcctcaaactgaccacttacagtactgcacgattcatccaaccgagacatctggttgggacgactttctcaaaaccgacatgaccaccgatagcaaattcaaaaggtcattctggcaattcgatttcaagggccgttcgcccgccagccccttcggcaagctccccctcgaactggtgtatcagatctgctcatacctgcccggggattcgctgaaggcattgactcaggcatccctgagcattcaggttgtcactcaggacaactggttctggaagcgattcatccagtgggatatgccatggttctgggaattttactcgtcgcagaaccccagggatttgcccgccgacgtcaactataagcgtctgtacatgtggctcgacaagatgaccgctgctcgctacggcatggatgacctggcccttattggagtggcgaaccgccgacgcatctggggtgtatgtgaagaactggccagtcagtaccacaaggctgtggcagcatcgtga

SEQ ID NO: 14803 - DNA, 207 bp, A.fumigatus
ctatggattgagtcccgtgttcccacgggaagcgtatcaagtggagatgcaatggaggatgaggttgagattttgacgggggacggagtgatctatctctgctctctgaacagggtggagtgtatttattactatcaggcccaatggagccatctggactcggtggtcacgcacacacaggtggaaaattcgaaaagatttcggtag

SEQ ID NO: 14804 - DNA, 186 bp, A.fumigatus
  unsure (3),(4),(5): Identity of nucleotide sequences at the above locations are unknown.
gcnnnagacgtgatattccaccgcgcgtgtagagcttttatcttgtatcggcaacattatcaagccgcagtagtggctcaaaatccagggcttgcgaacccggatatatccaaaatcattggagagcaatggaggaaactcccgcaagaaaccaaggatgaatggaaggctcttgctgaggtatga

SEQ ID NO: 14805 - DNA, 1491 bp, A.fumigatus
  unsure (1334): Identity of nucleotide sequences at the above locations are unknown.
ccttcatcacaggaagaaaaagctcgtcaccagcagcagtacccagaataccggtaccaaccccgtcgctatggccgggatggaaattcccgtgcaaccggctctggcattagccacagccctccgggctctgcagtctgcaaccgatgtggtggtcgagtgatgaccccacctgtgtcgccagatgcccctttcacacccagtgcatctgcagcatctccacatcccgatatggtcatggctcgaagttatcaacgtcgggctagagattctgacagacaaccaaatcccatccgagtagacaatcatggcgattcttgtcctcctcgtcaaataccatatgaagaggctggttgtcgatccccagactcgaagcgacgccggttcaactcccaggtaaatttgaaaccaaatgtccatcgagaccgaagccccgagtccgcatatccaatgtctccttataccccccgcacggatggacccaacactcggactttgaatcaaattgtccatccttcgaggacggctcgatataacagagaccatccaccgcatgatccaagtctgaagcttccaccactacagaccacagtgccgctcccaggctccgtgatgcctataactccgttccctcacgatggattaagtctcgaggccaccgtcatgacgatccccttcctcaacaaaatcaaagttcttgctaagatatcccctccgctcattccgtccttccgtgacaattccatcccgcagcgaggagtcgtgattgctgttgacgggcaagatcctgcacaagtaaaagcagtggtcgattatctcaacgctgtcttccagaaggaaggaaaatacaaaccccgcgtgtttgaaggccccgaggtccgctcgcgggagagttactctgcagctggacagatgggcgatgccactgtcgattacctcaacaccatttcggtatggcatcgtatttcggacgacattgtgagcttcgtgaagcccacgcgggagccctcagaatcaaagccggaggatgatgactccgcctctgagatttcccccaaaaccatcatccccaagacagctggtctgaagataagctctccggctcaatcgagcgagaacggatcagaatcagcctcgtcaatttccggctctggcctctcaccagtccccattgcactcgtcccccgttaccaactcactaacgcagatgcattcgcgtgttctgtgccgatcaacgactcgtacgctccattggatcactggcagtggatggcatctctctggcgagcgtgcgttggggcggacatcactgtctacatccgggattgcgaganagacgaattgggtcggtacggaggcaacccggtcgaggtccgtttgcaagatgcacgtactgtggtggtgcgcagactagccggctcccagaaggaactggaagaaaaagctttgaagcgtgtttgttttgagattgaggatttcctcacccagtga

SEQ ID NO: 14806 - DNA, 297 bp, A.fumigatus
cactccacaatttttcaggtctatgtccccactgtttttgagaactacgtcgccgatgtcgaggtcgatggcaagcatgttgaacttgctctttgggatactgctggtcaggaagattatgaccgtcttcgtcccctttcataccccgactcccacgtcatcctgatctgcttcgccatcgattcccccgattcccttgacaacgtccaggagaaggtgaacgatagcccaggcgtccctttcttccaccaaggaagaaagggggaagtgattcatgcacgcatacacaggggctga

SEQ ID NO: 14807 - DNA, 192 bp, A.fumigatus
gagtttcttaacaggatactttggatgtcttccaggacaggaaataggtggtcgaaattatatcctcctgtatccagcttaaatttgtcccccaagtattgcccattcactctgggtcgtgatctggagctcttcatctggggcatcagcttctctgatacctcacatgtcagcacgaacataattctatga

SEQ ID NO: 14808 - DNA, 264 bp, A.fumigatus
ccaaaagagacccttggtatagttgctggtcaggagctacctcgtcgaggtcgatgtatgcactacggtaaaagctatcggtggtttaggtatttcccttccctctcttgcaagtttttggctacctcgtttacttactctttcaacaggttcagctgttgtgcaaaggttttcccatgtgacaagtacgtcagcccttcccaggaatacctgcctgaatttgccacagccattggctgtaacccatccctcatactcgactaa

SEQ ID NO: 14809 - DNA, 228 bp, A.fumigatus
gtgccacgacgcagcgacagatcatccaaacgaacatgcaaatcgcatgatttggtaagtacatacatctcttccggaggcaacaccttcttacacctcctagtggtttctgttcaagagaacaagtctaccgccccgagaactgcggtatatgccgtgcagttctcgtcggaaaagcaggaagcggtttctgggaaggaggaaagggtaccaggaacaaggttctga

SEQ ID NO: 14810 - DNA, 1038 bp, A.fumigatus
  unsure (119): Identity of nucleotide sequences at the above locations are unknown.
ctgtctacatgccactcagggttgggaatggagccagtgactccagttacgtgcaaaacaatgccgaaattccccaaccatatcatgcagatgggtagttgcagcaatcaccaacagcntggactagattttgatatcatttatggaccagtagtggtggaagtgatgatcaaactcttttttacacccattgcagtgcggtatttggaagtcgaacaggcaggcatggtgactgcctatcttcacgccttccttgagaaatgcgcaattcatatgcgccaacctactggttctgagcagaaatggaacgcctgcaaagtcctcaaggcccactatagactacgccaatccgccttcttatgggatgagaaattcgacgacagaatagcattgattgggttcaaacgagtggtggaggatccctgcgtttatcaacgaggagatgatgacgatgcatttctactaatctacgttgatgacacgctcctcacatctgcaacaacggctggaattaaacgaatcaaatcatggttagggagtcttttcctcttagaagccctgcctgctggcagacgcccgaccattgttcggggctggcagccgttgtcagatagcttcgtagcagtccgttctctctcctctagatatctagccatattatcattatcttcctttctcttcagctccatgacttggagagttgtgaacgatttgccgttgaagaccatgccacgatttgattgcggaaggaactgcgtgctgcggttgcgagcgagaagctcgcctttggaagccggtgccccggcattccgctgctcagtgcatcgactggtctctaagagggcacatgggccggatgggagggagagtgcgattacaggtcgttcgtcttctcatgtatctaatggtaacgattggatcagggttttgttttcccgtgccttttacctggctcaggagactaccctccagttagccattggactctattacactagctcaaagtcgtaccggcgagatgctactatgacatgttga

SEQ ID NO: 14811 - DNA, 618 bp, A.fumigatus
atgggacggccaggacagcaacaccgtcctcagtaccctgcacagacgcccaatggacagacgccagccatcaaacaagagccgggctattcatccgccccccaacccaatatgactaattctcagacagatggtgcaggggccgatgctttatcagattggaaagcggaggttgcacggagacgcgaggccgcggaacgccagaacggcgagggtgatcggttcctacgcgaacatttgagacagcgtatgcttcaattcgagggaggtggactacttatgcctctagatgagcgtcagtcctcttcatcaacgtcgagacgggaacgtcaccttactgatgcccattctgctgtcggaatcaactcgatcgcgaactctgcccagcctcaggcgcagtttgatggccctggtggcgacgatgacagggaggaagacgacgaagatgccatcaattccgaccttgacgatccggatgacctggttgctgaggatcatgatgctgaagattctgttggacaggtcatgctctgtacgtacgataaagtgcagcgcgtcaagaacaagtggaagtgtactctgaaggatggtatcctaaccacaggcggcaaggagtaa

SEQ ID NO: 14812 - DNA, 315 bp, A.fumigatus
catggtcacaacaatcaacaattgcatgataacgcagatggtactttctcgattgtgaatccagagacatcgacaccatatcctggtactcttggtatggaaaaggaaaagccgtaccgctgcgaagtttgtgggaagcgctacaagaacttgaacggtctcaagtaccacaaatctcattccccgccatgcaatcccgattttcagcttgctgctggtcgcaatctggcattcggtggaggtgttatgcaggggcagaacatcaatgtggctggggctggcctccccggtatcggcgaagaaggtcttctatga

SEQ ID NO: 14813 - DNA, 1173 bp, A.fumigatus
ctggacctcccggttcgctttcggccatctccctctttccattcctcttcccatttgcccaaactggaagccaacttcatgcgtgatttctcctgctgtggcatcactctccccactcttcatgatctgttgcagcactacgaagaggcgcatgctaccaagtcacctcaacagagtcatcgtccaagccagactgatgggcgagctgcgcttgctgctgccgcgatggcgcagcaacaaaaccaacagatgaacaaccaaagtcgaggtctacaagcggatagaggtggggatttacagcgaaaattgagtccgaacccgcagcttcagccacactctgacctcgacactattgacgatatggagctggatgacgctatgggggacagtgatccgacgacctcacaattattctcgtcccagacgcagaacaacacgcaaaatggattcggaaattctaatcagagaggtccccagctcaatctgtctatgcttccgagtcatcagggttttaaaggctcccaaccaggaacgccagttccgtctggccacccactatcattgcagaataatcccacggtttcctcggttaacacaccaacactcatggcgaatccactccagaattcgcagttcagaaacacgccggattcttcggcacctggaactcctgcagaactcgacgaaaacgtgattagtggttttggtgacttgggtatgcagaataatgctctgctacaaggtcaatcgcagttcagatttgctggtaacaatgacatggtagacctttgcattgacgaaccggcgaaacgtctcttcagccctactggagggatcaatacttctaatgcgcacttcaagcttagtggagcgcaatatggtcctaacagtgaaatcgctcgacggatacgggaacaacagctgttggcaggtgtccccgacaccacagctttgcttcccaatgaagagcccaagcccttcagatgccccgtcattggatgtgagaaggcgtataagaaccagaacggtctcaaatatcacaaagctgtaagtgactctgtctggaaagttaccgtttggtatggagctttggtcgctaatgctttcgcttgtagcatggtcacaacaatcaacaattgcatgataacgcagatggtactttctcgattgtga

SEQ ID NO: 14814 - DNA, 237 bp, A.fumigatus
gacaattctccacaccaatccattgccgcattccaccgcgcgtttcatcgggatatctcgtctctagagctcgagatgaacgatcacgatcgctttagccagtcatcctatggcgacccgagatacctgtcgtccgcctccttcgaggcccctccggccaaggttctcatgaacggctatcgcgagacctttgagccccaatatgcggagaaattgcgatacaatccagtgcgttga

SEQ ID NO: 14815 - DNA, 429 bp, A.fumigatus
ttaccttctgccccatcctttgccgtctggagtcatggtatttcagtcgacctgtccgtgtcgcaagcatccaagatgcctgcaggtcactacgcagccgattcccaagatggtattctatcaccagacccgttgtctatggtgactgtgtacaaggtgtataaacgacgattttgggggctggctcaactagtcttgctgaatattgtcgtcagctgggacgtaagtgcgcttttcgaacaacagacgcagagccagaatttggctaacgtttacatgatcctgagaaactcagtggctcaccttttcttctatatccaccaccgcatcgcagcattttggtgtctccgaatccgccatcaattggttgagcactggctatctctttgccttttgcgtagccagtccagtcgtcatcctcactcttaa

SEQ ID NO: 14816 - DNA, 237 bp, A.fumigatus
actgttcgaaattactccgctgatgaaacagtggtgctatgcgacgtactaacccagccaattggcagtatgaagattgcaagcggagcagaatatctaattccacaagtagcttcggaggactccgtatctagcctgatttaccccacagtcgatcacacgcgccctcttggtcactttatctggtctgtcgttgactcggaacacgttcactatcaatatataactacgtactaa

SEQ ID NO: 14817 - DNA, 207 bp, A.fumigatus
gaaactcagtggctcaccttttcttctatatccaccaccgcatcgcagcattttggtgtctccgaatccgccatcaattggttgagcactggctatctctttgccttttgcgtagccagtccagtcgtcatcctcactcttaacaaaggcggccccaaacctgccatcactatcacctccgcgtcttcacacgcgccgggccgaagg

SEQ ID NO: 14818 - DNA, 375 bp, A.fumigatus
aacactagggatttccccggagataaatggagaaaggtttgtggcaaggagatttcatttcaaggggcggaggatccaagggtgaggagaaaccttttgcattttggaaaaaaagggtggggggaaaccaaccctgtttcagggtcccgcccccgccgggtaatccgggaaaaccttcccccggccctggaaagacgtttaaacacccccaaagataggttaaacccttgggcaaccttttcgggggaaatggagaacccgggtggggggggggcaatttgccgtcatttcttcgggagggagcgaggcaagctagccgagagaatacccttgttcaggggtcataccgcagtcgttctggacaccgactggtga

SEQ ID NO: 14819 - DNA, 477 bp, A.fumigatus
tttctgcgcaggaagatcgggcacgtgctcttcaaccccgccgcagaaaacatccttgcgaccgcctctggcgacttcactgttaagatttgggatatcgaagccggtgcctccaaattgacgttgaacttgggcgatattgtccagtctcaagcgtggagcgctaatggttccctgctggtcaccacctctcgagacaagaagctgcggatctgggatgttcgtcaggagcgacccgctcacgaaacccaaggacactcgggtgcaaagaacagtcgtgttgtatggctgggagagcgcgatcgcgttgcgacaactggtttctccaagatgagcgatcgccagctggcgctttgggatattcgtgcccctcgcgaacccatcaacggcttcaagactctcgactcgatctctggtgtttgcatgccgttctgggacgatggcacccagtgcctgtatctggctggcagagggtga

SEQ ID NO: 14820 - DNA, 252 bp, A.fumigatus
tcaaaacaggcctctcccgtcgtccccgaacgaagcacccctaccgtgcccacccctaccaccacaactccccctccatcagcaggctcgactcttcaggctggcgccgctgttgccgcggacgccgtccagcgcgaggtctcggccatcaaagacctgctcgcagagcaaaccaagatcattgcatcccaggcggagcagatgcagaacctgactgcggagatcgagtctctcaaggccaagctgggctag

SEQ ID NO: 14821 - DNA, 1308 bp, A.fumigatus
tggttccctgctggtcaccacctctcgagacaagaagctgcggatctgggatgttcgtcaggagcgacccgctcacgaaacccaaggacactcgggtgcaaagaacagtcgtgttgtatggctgggagagcgcgatcgcgttgcgacaactggtttctccaagatgagcgatcgccagctggcgctttgggatattcgtgcccctcgcgaacccatcaacggcttcaagactctcgactcgatctctggtgtttgcatgccgttctgggacgatggcacccagtgcctgtatctggctggcagagggtgagtggtgattccttcacgatgttcagtcgacacgggtctgtactgatcaccactagcgacggcaacattcgctacttcgaattggaaaatgacaagttcgagttccttgctgagtacaagtccgccgatccacagcgtggtattgctttcatgcccaagcgaggtgtaaatccccacgagaacgaggtcacccgcgccttcaagactgtcaacgacagctacatcgaacctatctccttcatcgtccctcgccggtcagaaaacttccaagacgatatctacccccctactgtcggtctgaagcccgctatgggcccctcggaatggttcgctggaaaggaagctatcccgcccaagatttccatggccagcgtttacgaaggcgagggtctgaaggaggtcacaggtgtacaagagcagcctactcctactacgagtgctcctgaacccaagcccgccgaacctgtcgctgcaaagaaggtcgctgaacccgtgccgacgcccgcacccgttgtcaagccggaggtgtccatgaaggagcaaggcgcttcgatggccgcgatggtgaacaagttcgccgacaaggaagatgatgccgagccagtggatgatgattccagctttgaggaaattcccaagccaactgagcgggctgctcgttccgcggacaacgcgtcgccctccattaagaccagcccatggcaacagaaggaagaggccaagtcgcaggccagtcctgctccggtaagcttgtttcctctaaatcccccgcagccaagaactaatcaaaacaggcctctcccgtcgtccccgaacgaagcacccctaccgtgcccacccctaccaccacaactccccctccatcagcaggctcgactcttcaggctggcgccgctgttgccgcggacgccgtccagcgcgaggtctcggccatcaaagacctgctcgcagagcaaaccaagatcattgcatcccaggcggagcagatgcagaacctga

SEQ ID NO: 14822 - DNA, 381 bp, A.fumigatus
tccaggcgcaagtctaggcgcatatctgtaactgacaaagaaagtctcttagccatgtacggatcgcattctcactcgcattccaccggtccaccacattcaagtccttctcaaccagaatggcgtttacctgcgacaactcaacaccagcactcctcatggtccgcgggttctgtggcaccgcccccgcccccttctccttctgcgcctactgcagctcctccatatcatcctaatacgtacggatccatctccaatatatcacctggcacaggtggggcacccgtgtttggtgctcccagcggcccgaatacaacgtcatggggagtgagatataagcatcaggtcctggcgcctccgccgctacctgtgagtatctga

SEQ ID NO: 14823 - DNA, 462 bp, A.fumigatus
tcctgcgcaagttcggtcaccgactctcggctcccctggccatcacaagcctccaccaccacctcctcctgggtacggctcacagcctccgtccttcgagaatcatcagcagtggacaacaggcgcttcacatccatcccagcaagctactgcgcctctaccgcctccccctccacctccgccaattccccagagttaccagactcaacccacaccgttagacaaccagacatggcaacagccgaaccaccctgcttacgcaggatttccctccagtcaaactcttcaggtatcgtcctactcagcctcagcacatgcgaccgaacccagctcagggcttcctcaaagcatgagtcctccacctcccgcccgacagcttccgcctgcagagcaaccttggtcccagaccttgccaaacgagcatggaaccgctccgccagtaccacccaagactggtcctaa

SEQ ID NO: 14824 - DNA, 2379 bp, A.fumigatus
ccccgattcccaagtgtaacggagcatcagcaccataatcctgcgcaagttcggtcaccgactctcggctcccctggccatcacaagcctccaccaccacctcctcctgggtacggctcacagcctccgtccttcgagaatcatcagcagtggacaacaggcgcttcacatccatcccagcaagctactgcgcctctaccgcctccccctccacctccgccaattccccagagttaccagactcaacccacaccgttagacaaccagacatggcaacagccgaaccaccctgcttacgcaggatttccctccagtcaaactcttcaggtatcgtcctactcagcctcagcacatgcgaccgaacccagctcagggcttcctcaaagcatgagtcctccacctcccgcccgacagcttccgcctgcagagcaaccttggtcccagaccttgccaaacgagcatggaaccgctccgccagtaccacccaagactggtcctaatgtgttcccagccaatcatggcttggggcctggaaccccgtccgattgggagtacctggcatctactcccggggcaggagtgggcgtcgagacacccgaacgcaagcagaatcatccaatccattcctcgactgtacccgactcacttccaagtcagccagcttcctttacgcctgaatccagtaaccaacacactgtatctactccaccaacgacgacctcaccgtctgcgcagcctgcataccctcagcagcatcatgacagcgggtcaccagttagtccaagcactacgccggatatgcgtgatccgccccgtcctgttagggtaaatagtagcggcaccgaatgcagtattgtctcggcgactgaagcgtctgaaagtatcgatggcgttatcgaagcttggaatcaaccgatcactgcacagatcaaatccactgtcgaggaatctcgggagagtctggcctcagggcctgaaaccaggtcctcaacacaggggtcgagcccagtcgatatcacacaacagaagcaggaattcaaggttcctcggaaggaagtcccgtcgcgctcggctacccctgcgtcgagcagtgccgcaggtgaaactagtggtgggagaccgaacacagcgagcccgcagcccaaaccacaagatccctatgaagatctagactcttggtccaagtcatcgttggcacgttatgtagcgatgctgcgaaaagaggaggttgctgattctgacgaggagcgtttcaagatattcacggccttcatggccaaggaaacaaaactgcgtgagatcttgtacaacatcgaacctgaacagaacaagaatcaagatgggccacagtcgttaccgaaccggcatgattcaacatctcctcccgtcgagtcgggcttgattccagtccaatcagcagagggttatgatgcggaaattgcttctaacgatgcccttggggaatccagagatggccgctatagtccaggagggcgtccaattcttccccaactgcacccgccccaaacgtcgggtttgcacagatcagcctcgcagcctaataccttcaaggcaaaggtaaccagagatttctcgtcgagtgctcaaaatccaatctcgcgggctacatccgtcccgccctccatgaatgacaagacattctccccgttagcaacaaaccctccgcagcccatttacactccctttcgatacactgagggccctcaacgtggctcagatgaccttacctttgaccgccctgcgtaccaggcatactctgcgctgcgtcaagcgtctgcagaaagtggtcgtgtaatgtcgaacgcgcccaacgcaccgaacaggaacaggtcgagcactgtgacatcttcagtggctcaaaaagacttcgatgaaactttcatcgggcttatccgagagaaaagtgtcgcttatagaaataaaacttctccacgggcatcctcgccccctccactaccagcggcttttacgcaaggaaagagtggcagtccgatcgatgacctgcgttcgatggtctcatcgccattagctaagcagtctgaaagcttatggcacgttacaaccagaagggatttggagaaatactcggatgacttcaactacattcgcgaggccgtcaatacttgggaggcttcaaccaaggctcgtcgcgaaaagactgaccgagagcgtacgcgacggcaggaggagtccgagaagcatattgatgacttattcaaccagaaggaaattggctatgccgatatcaactttctggaagaagagtttcgccagaacgaagcgcgagtgcagctggacgaagagcagacaggagttggatcttcacacacaggcctggaaggacatgcgatcggggtt

SEQ ID NO: 14825 - DNA, 198 bp, A.fumigatus
ggccagactctcccgagattcctcgacagtggatttgatctgtgcagtgatcggttgattccaagcttcgataacgccatcgatactttcagacgcttcagtcgccgagacaatactgcattcggtgccgctactatttaccctaacaggacggggcggatcacgcatatccggcgtagtgcttggactaactggtga

SEQ ID NO: 14826 - DNA, 2298 bp, A.fumigatus
caagttaggtttctctgggccacactgctactcgactgcatttgcatggagcagacagacgaggcaattctccaggcccttgaaagccttccgcaaagcctttcagaaacatttaggcgagttctacagcaaactggtgtctcaaacatccagcatcgccgcaggattgtgcagttggttatggctgcgcgacggcccctatcagtgggggagctatgtgaggcactcagtgtcattcccggtgacacggcatgggagcctgcacgacaaatcaataatattcatgcggcccttgcaagttgtaaatgcttgatcatcatagacgaagaagagcagactgtcagatttgcccaccatagtgtcaagcagttctttattgctcggggcgatgaaccagaaaatctgaatcccatcaacccagacgaaacaaataaagaaatgggccgggtcattctaacgtatctcaactacgggattttcgaccgtcaagtatctcgcacagtcgttccaacaatgtctgctgtggatgtgccaactcgaatcgtgagcagcgtcttcagagactccgttaacaccaaaagagtcgccctggaactgctcaagacccgcaaaaatggcaaatgcgacataggccaaaccttggccgagacggccatggcgcaacggagatctccagcggagagccatccctttttggcttatgccaaggactattttaggtatcatattctaggggtctggaattgtgagaaggaaatgggacagctgtggcaaggcctcttggcgcgaaattctcttgatgtaagtatagcttcagttcaacatcctgagctgacacacactgacaagagccagttgcggattaccgattggctgcaatatgagttgcagcaacggcgagtgaccggcctcgatggagagtttgttccttgtgatgttctgagccagctagtcacataccgtgttgtccgcaaggtcctcgaggagactgggttttacggatacggcgcatcgacactggcgcatggtatcctcaccgaccgccagcgatggtttgcgatccttgtggacataggaatcaatcattatcttggggcccactttcagtcgtcgatgattcagtctccgctaacagaccgcgatttccccatttcgtcggtgcaatttctcgagaaatacaagtcgaacatctctcagaccactggatcgctcactgttccaccggggtctaacattccgagcagctcacgacctgtcggtccgatggagaccgatagatggatggcattggctgagttgttctgcctccgacagcaccagtaccttgcccctatacttcaagaaggtcaacactataactcggaggacgggattatgccgttcttgccggttggaaacttcttctataatcacgactatggatccctagttgttgaagttcaccctgcgcaccatgactttcctccagcttatcgcggtggcgaagacgttgatggtccttacgttgtcgcgctttggcccttctctaaggccatggatgagcctccgtttcttctgttgtctcaagggggcttttgggatgtcccgtggcatctgctccgagcagttgcatcatatcgtccgcagcaacagagcggaatattacctttcgagacgatgcgtctgattttccccgtcgttggcccgagcatcgctgacgtttggcagcaaagcttgggtacggatatgcactcctctcgacggttcctcagattctgcctgtcacaaatgactggcatcgccgaggctcttgtcttcgtcattcaaaacgatccagaagagtggtatatctcactacgcaagattacgccacgcagcattcaatggtgcaagtactcacgctccacattccagtggggaactctgcggctggatctacggaccctgatagcagatccaattgagcgcgcccctcggcaatctgagaaggcgtatcgtgccccgcatgaggccaaggggaagaatggatcgaaacgcgactgtgtctggaggctgggatgcatatattttgaattccttatttgggctgtgatgggatcgacagggcttcaagaattccgcgaggctcggggaggatccaatgctccgttctattcacaaacggactctgaccatcatcatccaggattcgaattgtccccggaggtttgccgctgggcggacatgctgctcaacgagcccgagcttccgccggaggttcgtcggtttcgcgaatacctcctacgggatattcgcccagggggcaaggaccgcgtgaag

SEQ ID NO: 14827 - DNA, 1521 bp, A.fumigatus
atgttgactcaaagcgcttcttacctggagaaaatctcaatgctgtttatgaacgcaggcagaagtgctccccgatatcaggatatggccttgctttaccctcgctcgaagcgactgcgggatgcactatgcgagtatttcattgtgattttgaatatttgcaagcacgctgtggattttctgcaaaagtccccattatcgcagttcacatcggctatatcggactcttgtttggtgtctttcgagaaggaccttcaacagtggtcagttgtcatcgtggaagaagttactttactgtcaagtcaaagcctccaagaggaggcgagggagaattctcggtttcggcagatcatggttaaattgtctgattctcggaatcggtgccagcaagtggctctcagaatccggatacttgacgcttgttccacatatgactaccagacgtcctggaagcaggctcgaaaacagggcacaacaacctggttcgcgagcactagtgagtaccaaagatggaagggcacgccttcctcatgcgccctactatgcaccggcaaactggggtcgggcaagacaaccttgctggcaaacgtggttgatgacctgttttgttcagcttcgaaggggtcagttgcgtactttttctgccgattcgatgtctcggactcgttgactgcgaggactatcatcggatgtcttgcacgacaactcttagcgcaacagcctattgacctgacgaagatcgataatttctggaacaattcacttgcggaccccgacgagcaagcgattgtcaagtttgtacaaaaactactttctgtggatccgatttacagtttggttgtggatggactcgatgagtgcccggaaaaagagggaaagatgacgttagagatactgcagcagttgcaaaagcacttgaaaattcgtatgtgcctgtcattcaggcaggacgcgggggatcatgccaaagtcgcagctggcattctgaatgcgcagtggacactgcctatccccgagaacaaccccgacatcgatgcttacatcgacgccgagctacgtgagcgcctcgagtcagaaaggttgtgtattagaaatccggctatcattctgtcgatccaacatgccctggtcactggggcccaaggaatgtatgtatcccccctacaccactgcctcaaccggctgcaatcaatgactacagggtctgacaagttaggtttctctgggccacactgctactcgactgcatttgcatggagcagacagacgaggcaattctccaggcccttgaaagccttccgcaaagcctttcagaaacatttaggcgagttctacagcaaactggtgtctcaaacatccagcatcgccgcaggattgtgcagttggttatggctgcgcgacggcccctatcagtgggggagctatgtgaggcactcagtgtcattcccggtgacacggcatgggagcctgcacgacaaatcaataatattcatgcggcccttgcaagttgtaaatgcttga

SEQ ID NO: 14828 - DNA, 690 bp, A.fumigatus
ctacaatcgcttttctcactcttagtccggccacttgatgaatgggcctctgcccgcacccagtcccttcctctctccgctctcaaaggggctgttgttggcatcgatgcgtcgcactacatttcccagcatcttctccaccactcgacccgcgagcctttgctggtcgctttgggcggcttcccgtttgcgctgaagaccaatattgagagagagttacagagtttcaaggaattgggtgtggcatgtcttttcgtcttcaatggcctagagtttgggaagaaggaccagcgaccccatgtgcagacagagtcattgcgagcttttgagcaagcctgggagctttatgaccaacaacaggcggatcaggtagtcgacgcattcagtggcgcgggtaagacgccctttctgcatcctcgttattcctgtttactggtttgcgctgacaaaactccgcccgccccaggcacaccgcggcctgaatccctttacaggttcttgcagcgcatcctgtaccaaaatggcgttgattttatcgtggcgccgtacagtgccgcagctcaggtaagaaagcgaccatcggagaaattgactcgcaagggctcggtttcttacttctcatttctgatagctttcctatcttgccaagggctccaaccccgtcatcgatgcggtctttgggccctctga

SEQ ID NO: 14829 - DNA, 222 bp, A.fumigatus
ccagggattttcttgaacttaaatggttctaattatcaaaagctgctatcatcgcaggacgaaattcttgccaacgtctactggaggttcctgcagttgcgaggctacatagatgagaagcaccgactgacctcatggggtgtctgcctcgaccaagcgctttccgtccttgatcccgccgatatcttacacgccgcggctggaagatacacgttcccccaa

SEQ ID NO: 14830 - DNA, 483 bp, A.fumigatus
tcatggaatgtggatggcaaggtcgcgcctatggattgggagaacgccccgtccgatatgcatgagctgatcggccagcgattgcctgaagaaatttacttttacctctccaagggtgtccttggcccggaaattcctaactatctgacatctggcgaggtccgaatctcccttccattgggagttgaagataccgaaatatatcgccaaactgtgagcagcacgctcactccaatcaggactcaatccatctgtttactctcgaattcccttcacaggttctaccagactaaagtgatcaatatacggacatggtttgacgaaaagtcagacaagtccatcacactgaagacgcttccatctgtcaaggaaaccatccaggcgtggaagatccgctctgaccagctgcctgagggagtaaagaagctacaggtcggttcaaaatgttacctgcatgccaaatatgtattctctgaccattga

SEQ ID NO: 14831 - DNA, 183 bp, A.fumigatus
tcgaaagctttctttgcctctcctgccgaggagaaggccacttgctgtattagtcctaatgtttgtcctacccaattctcaacgtatatcgaccgttacatgacactgatgctggtcgcgtgcagaatcgtggctggtcaggcatgcacatcgaaactctcgatccagagcatcaaagggtaa

SEQ ID NO: 14832 - DNA, 225 bp, A.fumigatus
atcaaaatggaacagacttccacggtgggaccgcctattgaactccccatcatcgacatatccaatcccaacgaccccaatgtgggtaaggccatgctcgacgcagccgccaagtacggctttctgtacgttgacagcaaagggaccgatttcgcggccgaggatgtgaaaagagcctttgagctggtagattgcccccgatcaacagtccatcaaattcattag

SEQ ID NO: 14833 - DNA, 189 bp, A.fumigatus
gaccttactcacattttgaagtatctgactaacgatagatcgagccggtcctcttggagcttcattttccgaatcaggatcctcacgcttcctccaggtcaattggccggcaacctagcccggacgcaacaatgcactacaaatgctatcctcttaagtgactcaaaccagtctatttctcgagtctga

SEQ ID NO: 14834 - DNA, 198 bp, A.fumigatus
cctaagcgcggtacctgccagccccggtcggtgaagacaggcgttgctgcatatgtgactaaggatgacgcacgagaagcgcagagagccgaatcgttcgtgtacggaggccagaacccctcgggcgggatggcagctcagatgcaggtgagcggaatggcgggttgggcgtgggtaatcaaactaacaaactgctaa

SEQ ID NO: 14835 - DNA, 432 bp, A.fumigatus
ataatgcggttatggagtgtctatcatgatcataccatctcactctacgaatctctagtcaacatgctatcattaggcttggcgctcttgttctcagggacggcagcccttgcctcccgggacaccttctatccgcctctgaatcacaccacattcatcaccaacgcctcctacggcacgtatggcggcatctacactgctcccgctgatagtgctggctcgccgtccgccgatgatgtctacaattactgttccatgcctcatccgcgcggtgagacctactctctgccgccccctgttgcaaaccattccatcaaggctaagctggtataccttgaatacttgcagcgccatcaacggcggactccgtacaacatccttcctggaggagaggtaattcgccggtctacaattgcgccgactcgtcgctaa

SEQ ID NO: 14836 - DNA, 954 bp, A.fumigatus
ttcgccggtctacaattgcgccgactcgtcgctaacttcattcaggatcaagaatacaactgcgacagcgtcgatccgcatgtctacgtcgcgccagcttcgcagcacccgtcgccagtggctgtctatggtcaaacctactcagacccgtccaacccctatcttgccacctatgcgaacgggacctgccagtacccccaactcactctgggcggcttcctcgacggctaccagcacggccgtgatcttcgggccgtctacggccgccggctaggcctcatccccccagtcccggaccagaagagagtctggttccgctccagctcctcggccctgacgcagggttccgctggcgccgtcctacgcggcctctggccagagtaccacaagccgatcccagtgcaccagcaagcctccgccgtcgacacagtcaaccggggatttccctgctccgcgcgcagcgccctcctatctgcaattcaatccactgccgaatggaacgagcatctcaatgtcacacaggccctccgtgatgaactcgcagccatgttcgacgcgcaggacgagtctgcctggacctccaacttcgaccacttcgcggacaatttccaggcccgcctgtgtaatgggtacaggctgccttgccgcgtccaggaccagacgcagtgcgtgaccgcggcccaggcgaatgaggtcttccgcgctggtgactgggagtataattacatgtggcggcgaaacgcaaacgcgacacggtacatccaggtcatcgagggtttgttcattggggagatagtacggaagttcgaggcagtcgcagaaggtgcatctaagctggcgtatagccataactttgtgcatgatggggacatctcccctattctgggcgcgctggggatcaccgcgatgcggtggccggggatgggctcgaatatcgcatttgagatttggtaa

SEQ ID NO: 14837 - DNA, 183 bp, A.fumigatus
actgcagcatttcctgaaagaattactactgtcactattcatctcaagctaaacttgttcttgagcgactctagcttcataagtgtggtacgcaatcaaaccaacaacaccagcggcattgatgagacagaaaaagcggccgaggatcgggtatgcgcagtcttgtttcttacattttactga

SEQ ID NO: 14838 - DNA, 213 bp, A.fumigatus
ttctttcaggaaatgctgcagtttatgtctgaatcagaacgagaaggaaattcttggagaggcaactcaattgggcccgatgattactccgatcagacacaaaaccaaacgaagcacgttttgttcctgtttaacaaacaacgcaataaacatggagaaaaggcaactgttcaacgtcctaaaactgattactacaccttgattatcatttaa

SEQ ID NO: 14839 - DNA, 252 bp, A.fumigatus
ttatcatttaatccaggggtctctttcactatttcacgaacagagttcagcaagcgtagcatgtttgatcttcattctccctccctgccacgcgtcttccctacatcagggtgggaagtcatagacccttctctacctattgaagaggagaccattccaacataccgggtagaaaaattctatcccgtttacatcggtgaggttttcaaaccatcgatatcaagtagtgggcaaattgggctatggatctag

SEQ ID NO: 14840 - DNA, 888 bp, A.fumigatus
gggctcaggatcgcgatcaagttatggctatggtttgctttcctcagtctttatattttcaatatccggataatcatccatcgtccacactgctgggaatgtagcccgggtctcagccattccccatcgttcgtcatgtcattcccgcccatcgaccccatgtcatctgcaagtcagcctctctcatctccgtcttcgtcgagtaacccctctggatatattaaaagcacctccgtcgaccatgcagccaaccctcgtactcacaccgcacatgacccgcccagcattcgtagctgtgtgacttgtcgaagaagaaaggtccgctgtaataagaggaccccgtgttccaattgtgtcaaggccggtatcgaatgtgtctttcctccacctgggagggctcctcgcaagtcgaaacgacctcatgatgcggaacttttatcccgtttgagacgtcttgagggagtcattgagcacctcagcgggaagaagtccggggctgtagagccattgtgcactgtatcttcgctctcacaacaggaacctggatctgcgtctccgcaggaaggtagacagacgacacctcagacgcagggtgtccaggctgggaaatgcccgtttgtcctagactccgatccgaaggctgttaagccacgaaacctggaacatgactttggacggctagtcatcgacgagggacgcagtcgatatgttagcaaccggttgtgggcgagtcttggggatgaggtcagtgtttttcgcttcaatccgcaagcttttgtgctaatgcttatggcaacagatagaggagctgcaagacattttggacccttcatcgtcagaagaggaagatcatccttcgcctggatcctcgtcgactctgtccactaa

SEQ ID NO: 14841 - DNA, 1869 bp, A.fumigatus
tgcttatggcaacagatagaggagctgcaagacattttggacccttcatcgtcagaagaggaagatcatccttcgcctggatcctcgtcgactctgtccactaatcacgacggattcctcttcggatactactctctttctcattcacttcgcagttatcatcctccgcctcccaaagttccagtgctgtgggacatctacctggataacgttgcgccgcttatacctatgtttcataagcccaccgtacgaaaacttcttacggatgcagctcagaatccgaacttcctggacaagaattccgaagccttggtcctttcagtctactatgttactatagtcagcatgtcgcctgaacaatgcttctccattctgggcgatgatcgtgatacagcggtaacccgataccggttcgcagtcgagcaggcattgtccaaagccggtcttctcaatacgcagagcctgatgctgttgcaagctgctgtactctttctgattggtgtgcggcgtgaggatgacactaaatttgtctggaccatgacagcggtggttctgcgcctggctcaaggtatcggcctgcatcgtgacggaacaaactttggcttgaagccctttgaaactgagatgcgtcggcgactgtggtggcatatttgcttgctggatatcaagtcagccgaagagcatggtactgatgcacaaattcaggataggatgtttgatactcgccttccgctgaatatcaacgacgatgatatcacactcgatatgcaggagccacccgaggagcgtgtagggttcaccgaaatgaccttttgcttggttcgttgcgagattactgccgcactcaaaaggatcagttccatgtgtcctaccaaccttccccatcccgagaacacacaacaacccgcggactcttgtgcaaaattgattcaggaggtcaacaaacggattgaggagcgatatacccaacactgtgacatgaacgtgccagtacaatgggtctgcgccactgttgctcgtctgattttggccaagctttggctcatagttcatcatcctatgactcgaaaagatccggcggctggcaatttgaccatagcgtctcgtgagactttgtttgtcacctcggtcgagattgcagagtttactcggctgctgggtcgagatcagaccactgccaaatggagctggctttttgtgacaaatatgcaatggcatttgattgcctttgtgctgtcagagctttgtgttcgcccgctcagcccactcactgatcgtgcatggcaggtggtgagttcattgtatgaaacatggggcttaactgcaaaacataggaagggaatgctctggcggccgctttcccggttaatgaagcgggtggctgccttccgagagcagcagcagcagcagcaacaacaacaacagggcttacagaacacttccgatcccagctctgctccgagcctattcacaccttatcaccctggtgtctggcagagtgctgtccagccttacctggctggtggtgtccctcaaattcgagacctttcggtcccagggagtgttcagcccgcgagccagcctatcgctgggccgactttcgatgccgaaatcgtgcccgagctctttcccaatgtcacctggccggcactgccggattctcaaagcatgagcgcaaaagacccattgagtacagccgcaccgatcgagatatcagaaaatttcctgggtcctaccacgacaagccaagatcctgcccttcaacaaaactgggaagcgtgggatcaagtgatgcgcgactttcagatggatgttcaagaagcgcaaacaagccatccactaggcaatatttcggactggcttgcttga

SEQ ID NO: 14842 - DNA, 498 bp, A.fumigatus
gccgatccatcgctgaaggctaccactggcctcatccttgttcccacccgagagcttgcggaacaagttcagagtgttatcatcaaattttctgcattttgcggcaaagatgttcgctccgtgaaccttacgcagaaagtctccgacgctgtgcagcgcacgatgctcgccgattacccggacctgattgtatctactcccgctcgtgtgattgccaacctgggtacttcagctctgtcattggaaaatttgacgcaccttgtaatcgatgaagcggatctggttctgtcgtatggttatgatgaggatatcaatgcattggcgaaggcgatcccccgcggtgtgcagacgttcctcatgagcgcaactctcacgtcggaagtggataccctgaagggcttgttctgtcggagtccggtgattctgaagttggaagatttggaggatgaaggtgctggtatcagtcatctcgtcgttaggtatggtctattgttctga

SEQ ID NO: 14843 - DNA, 195 bp, A.fumigatus
ctggaaaacacttggaaaagcttaaccacagccaattcctcaagcccttgctttgactggctactccttctgccactagatagggtttatattatttcacctggcaacggtactgaaagttattcaactagtatacataatacagcaactaacaatgtgcaactggaaggagatatgatgcttactgctatgtaa

SEQ ID NO: 14844 - DNA, 393 bp, A.fumigatus
atagtggagaaaatactgccgcgggaatctcaccgcccgacagaatttcttgaaactgtccgaatgaggaaaactttccagcctgtagtatcctacaatcaagccagcttcaaaggcccttctcaacggcttttggaactctgcgtcgtcaatatgaaacgcaagcttgatgccaatgatgtcccttcaacagaggttgaagaggaaaagaacacaaaagatgcggacaacaccgatttcgagagcctcaatctcgatccccgactccgccaagctttgatcaaagaacaattcacgaagcctactcccgttcaatctaaggccatcccgctcgcacttgagggcaaggatattctaggtaagcacagagcttcggtatgcgctatggtttga

SEQ ID NO: 14845 - DNA, 864 bp, A.fumigatus
ttcgcatcgcggtccgcccaggccgtggtgaaaacaccgagtgacaaggagcgcgccaaagcggacaccgtacctgccagctggccaacacaggggagagtggaatttcacagcgtctcggcccgctataagcccgaaggtccagacgtcctgcgaaacgtctccttcgtggccaatcctggcgaacgcatcggcatcgtaggccgaacgggcagcggcaagagcacccttggcctctccctgctccgcttcgtccatcttacctccggcagcatcacaatcgacggcctggatatcagccagatccacctacatcgcctccgcacaagcgtcaccctcatcccgcaagaacccgtccttttctctggtgacgtccaatcaaacctggacccattcggagaagcgagcgagacggagctgcactctgctctatccgcctgcacctctatccaagtgcacggcagccccgccggagaagcgggcaccaacaaaccaacaacccgcgccctcaccctcgacacccccatcgccgccaacggcgaaaacttcagccagggccagcgacaggtcctcagtatcgcgcgcgcggtctgccgccgctccaaggtcgtcctgctggatgaggcgactgcgtccgtggaccacgagacggacatgcacatgcaaaagctgctacggagcatgttccccgactcgacaatcatcgcgattgcgcatcgcctgcggacgatcatggattatgaccgggtgctggttatggctgaaggcgagatcattgagtatgttcatccctctctgtcttgtttatcatgggtttgttcacagaggctaactttggaagaaacgattcccccgcgaatttga

SEQ ID NO: 14846 - DNA, 297 bp, A.fumigatus
agtaacatactgtttggcttgctaacaattagtcaaggttccttgcactacgcaaaggcatttggggaggcatcggtcgagtcgactgagactgatgccgtgcattgggttgcctcttgcaccaagcttgtgactactgtggcggtaatgcagtgtgtcgagcgcggtctgctggacctggatgaagacatcgccaatgtcttaccggagtgggacagccctcggatcctaacgggcttcgacgaggacgataatcctatcttttggccggccaccaaacctgttaccctacggtag

SEQ ID NO: 14847 - DNA, 630 bp, A.fumigatus
gccgaacgggcagcggcaagagcacccttggcctctccctgctccgcttcgtccatcttacctccggcagcatcacaatcgacggcctggatatcagccagatccacctacatcgcctccgcacaagcgtcaccctcatcccgcaagaacccgtccttttctctggtgacgtccaatcaaacctggacccattcggagaagcgagcgagacggagctgcactctgctctatccgcctgcacctctatccaagtgcacggcagccccgccggagaagcgggcaccaacaaaccaacaacccgcgccctcaccctcgacacccccatcgccgccaacggcgaaaacttcagccagggccagcgacaggtcctcagtatcgcgcgcgcggtctgccgccgctccaaggtcgtcctgctggatgaggcgactgcgtccgtggaccacgagacggacatgcacatgcaaaagctgctacggagcatgttccccgactcgacaatcatcgcgattgcgcatcgcctgcggacgatcatggattatgaccgggtgctggttatggctgaaggcgagatcattgagtatgttcatccctctctgtcttgtttatcatgggtttgttcacagaggctaa

SEQ ID NO: 14848 - DNA, 489 bp, A.fumigatus
tcgacaagaaaaacatacagaatcacagtggggtgtccaataacttcaaactgcgacactgctttgaattcgttcgaaatggcgattccgcttcctcaagttcactctgttgtggactgtgcttctttcaaccggaccgtgctgcccttcctgtctcagttgacaacgcttcctgcgcagctgcaagtggccgcctcaacaaaagatgtggactctttgaaagatatctatctttcgacaaacccgtttatatcggcgctcgggttcactttggttttgtgggtgctcttcgctgtggcagcggaattcaaccgcaactattcgcaggttgatcggttttggagtatcctgccgtctgtgtatactgtgcactttgtcgcttgggcgcgcctgtggggtatcaagaatcagagcttggataccatcgctctcatcactttgctctggggtgtaagtatattaaagcgaggactttgtatctgccgctga

SEQ ID NO: 14849 - DNA, 402 bp, A.fumigatus
gttttgaaacttaccaaccaaagctgcctcattgacacagttagcaatgtcagcaccagcgaagccaggtgtcaaagcagcgagtctgccttccagataatccatatcctccttggtcacaatcttcttcagatggacgcggaagatctgtttccggccctccatcgttggtcggtcgatagtaatgtgccgatcaaagcgtccaggccgcatcaaagccttgtccaagacatcgggtctgttggtgccagcgagaacgacaacttgttccgtagtgttgaaaccatccatctccgtcaggatctggttcagggtgctctcccgctcatcattacctccactgaagctctgtttagctctagatttaccaatagcatcgatttcatcaatgaagatgatgca

SEQ ID NO: 14850 - DNA, 738 bp, A.fumigatus
atccgactgacgttcaactactggcgcaagggagggtatcagatcggttctgaggactaccgctgggagatcgtgaagtctcatattaacaaccgcttcttcctcttcctgttcaacgttacctttatcagcctcattcagccgttgctgcttctgctcgtgacggcgcctacctacaacttcattctcctctcgcgcctccctggagctgaaccgttcggtctccccgaccttgccttctcgcgccttgcattcttcttcctcatcatcgaatacttcgccgaccagcagcaatggaacttccaaagcgcaaagaaggagtaccagaagacagctcgcatccctgatcagtacaagggccaattcactcccgaggacctggagcgcggcttcgtcgttagcggcctctggtcactgtcccgtcacccgaattttgtcgcagagcaagccatctggcttactctgtacctgtggaactgctaccgcaccggcagctacatccagtggactggtctgggcattttgggctacatgctcattttccagtcaagcacccggctcaccgagtcgatcagtgcaggcaagtaccctgagtacagcgagtatcaggcgcgtgtcggccgcttcattcctcgcttttctgtcaagcccaagtacaatggcagtaagaagaagacctctcggtccaagactgagccggcaggcactgcgacgcaggagggcaagaaaagtcagtga

SEQ ID NO: 14851 - DNA, 693 bp, A.fumigatus
cggcgcctacctacaacttcattctcctctcgcgcctccctggagctgaaccgttcggtctccccgaccttgccttctcgcgccttgcattcttcttcctcatcatcgaatacttcgccgaccagcagcaatggaacttccaaagcgcaaagaaggagtaccagaagacagctcgcatccctgatcagtacaagggccaattcactcccgaggacctggagcgcggcttcgtcgttagcggcctctggtcactgtcccgtcacccgaattttgtcgcagagcaagccatctggcttactctgtacctgtggaactgctaccgcaccggcagctacatccagtggactggtctgggcattttgggctacatgctcattttccagtcaagcacccggctcaccgagtcgatcagtgcaggcaagtaccctgagtacagcgagtatcaggcgcgtgtcggccgcttcattcctcgcttttctgtcaagcccaagtacaatggcagtaagaagaagacctctcggtccaagactgagccggcaggcactgcgacgcaggagggcaagaaaagtcagtgatgggagatctccaatgcatgatttctgtcgattgatttttgttacttttaatctctggggtactgggagactgaaatttcttgatatatatatattgttagttttgagtggaatttga

SEQ ID NO: 14852 - DNA, 456 bp, A.fumigatus
tgcatcatcttcattgatgaaatcgatgctattggtaaatctagagctaaacagagcttcagtggaggtaatgatgagcgggagagcaccctgaaccagatcctgacggagatggatggtttcaacactacggaacaagttgtcgttctcgctggcaccaacagacccgatgtcttggacaaggctttgatgcggcctggacgctttgatcggcacattactatcgaccgaccaacgatggagggccggaaacagatcttccgcgtccatctgaagaagattgtgaccaaggaggatatggattatctggaaggcagactcgctgctttgacacctggcttcgctggtgctgacattgctaactgtgtcaatgaggcagctttggttggtaagtttcaaaacttaagtctgtgggtgtccagtaatgttaatttttctttcatcagcggctcgtga

SEQ ID NO: 14853 - DNA, 381 bp, A.fumigatus
tgccagtatcaatctaaactgactcaatccacaggatcatgtcaattccccaccctgggttttgttgttgatcgatatctacgagtgaagaatttcaaaccggagactttctggggaatcaaagtggtgcatgtccaagaaaggaaaaaggtcaacttcttgtggaggagagtccatcttttcgacagggcggccgtgaccgtcatgctggaaaggtgtctgctagcaaagaccgctaaagtcacaaaagttaaccaaaaacccacgagcaaatggagacctctgccgttaacgacggtggacttacagatgatggggagcaggtaccttcgcatggacagttcggcggtcatgaaggtatgtcattgtacgatgtgctga

SEQ ID NO: 14854 - DNA, 570 bp, A.fumigatus
  unsure (386): Identity of nucleotide sequences at the above locations are unknown.
gtctgtgggtgtccagtaatgttaatttttctttcatcagcggctcgtgagaacgcggagtccatcaccatgaagcacttcgagcaggctattgagcgtgtcgtcggcggtttggaaaagaaatcacttgtgctctctcctgaagaaaagcggacggttgcttaccacgaggctggacacgccatctgtggctggtatttccgttgggctgatcccctgctcaaagtctcgattattcctcggggccaaagagctctgggttacgcacagtatctgccagcaggtggtgacacatacctgatgaacgtaaaccagctgatggatcgcatggctatgactctgggaggtcgtgtcagcgaaaagctgcacttcgacacggttaccancggcgccagcgatgatttcaacaaggttacccgcatggcaacagccatggtaaccaagttcggcatgtcgcccaaactcaaatacatctactacgaggaggatcctcaacagcagctttcacaagcccttctccgaggacaccgctcgggagatcgacagcgaagtccgccgcatcgtcaatga

SEQ ID NO: 14855 - DNA, 249 bp, A.fumigatus
caacgcggacgagcgctctcattggacagaatgcttaccgctttgggcaaaaacaatgggggcgatgatatgactgcctcaggcgttaaggctctcaggcatactggcagacaggcagaaatctactatctccgtttctggaagtcattcgcgtcttttgcgcgtcttggttgtttctcaactcgaagacgcaatgatgtcgggttcatgacaaaagttggcaacaagggcggatcgggtatggcataa

SEQ ID NO: 14856 - DNA, 258 bp, A.fumigatus
atatctatacacggtaacaaatatgtgaagaactatttatttgaattcaatttcggtgacccctggggcacctgctcagtcacaatgaccagcgtcctgggacatttgatggccctcgactttgagagtcaatacaaaagctggctctcatgcccacctggcgcactctttgaagctcctgtgcgcgaatttgtggaagaagtatgcaatatcagcttcttttcggtcgtcaagggcctggttatgggcatctcttga

SEQ ID NO: 14857 - DNA, 183 bp, A.fumigatus
gacaataagccaatcgccgaaaacatcaaggagcaggccaggatgtccaaggctctatttatctggaccgactgtgatcgagagggagagcacatcggtaccgaagtccgcaaaaaagccaaagagggaaaccagcgtattctggtcaaaagagctcgattcagcaacacagagagggcgtga

SEQ ID NO: 14858 - DNA, 243 bp, A.fumigatus
agtctcatcaatggcgcgttcaaaactcctcgttctgggcgccacaatgaccgcgcgcatccacctatccacccagtatgctgggtctcaccaagtgcactgaactctgacgaaaagaaggtctacgagtttgtggtcaggcgattcctcgcatgctgctccgatgacgcgaagggtcaaagcaccgagattgagatgcccttatggagtgccttccacaggcgcagtaaatccgcgcaagcg

SEQ ID NO: 14859 - DNA, 381 bp, A.fumigatus
ccaagttcggcatgtcgcccaaactcaaatacatctactacgaggaggatcctcaacagcagctttcacaagcccttctccgaggacaccgctcgggagatcgacagcgaagtccgccgcatcgtcaatgaggcatacaaccaatgccgcgctctactcactgagaaaaagaaggaagttggcattgtcgccgaagagctcctggccaaggaagttctcagtcgtgatgacatgattagactcctcggtcctagaccctatcccgactctggagagttcgccaagtactttggtgccgccaatggacagaccattgctcctccggaacctacgccgccgattgaaggaggttccgagagtggtgctaaaccgccctcgtag

SEQ ID NO: 14860 - DNA, 618 bp, A.fumigatus
tggccctcgactttgagagtcaatacaaaagctggctctcatgcccacctggcgcactctttgaagctcctgtgcgcgaatttgtggaagaagtatgcaatatcagcttcttttcggtcgtcaagggcctggttatgggcatctcttgaaacacgcagcaaggttaactctgtgtataggacaataagccaatcgccgaaaacatcaaggagcaggccaggatgtccaaggctctatttatctggaccgactgtgatcgagagggagagcacatcggtaccgaagtccgcaaaaaagccaaagagggaaaccagcgtattctggtcaaaagagctcgattcagcaacacagagagggcgtgagtatatatggattaagctttttttccatcggcaatgctcaccccataacaggcatgttctacgcgctgctcgggccctcacagatgtggatgagaaccaagcgaatgcagttgctgccagaattgaactcgaccttagaattggtgctgcatttacgcgactgcagagtcttcaactgcagcgtatgtgtgctgatctgtcaaataaactcatcagttacggtacgtaccttctacaatatatttattataaataa

SEQ ID NO: 14861 - DNA, 204 bp, A.fumigatus
ttgagaaacaataccctgatactaactggggcgaatacgcccgagggtaagagttctctaaaggtgacattctctgacattactgactttctcaactatgaagtctcatcaatggcgcgttcaaaactcctcgttctgggcgccacaatgaccgcgcgcatccacctatccacccagtatgctgggtctcaccaagtgcactga

SEQ ID NO: 14862 - DNA, 1380 bp, A.fumigatus
cgacgggactctctacatgacgaaacatcccttgattggggaaggaaatcacttgaggaccctgggatttacatccggcgtccccttgcaaagaacatgttccggttgatccatgacgaacggaatcatcaaggcattgataagtgctggctttcacttgatgggtttacgctgtaccaaggccgccgtatgctacgtcagtacattgaacactgtccggtttgtttgcagaacaagatccgccatcacaagccatatggaagcctccaacccttgcaggtcccgcttgctccgtttgagattattactatggatttcatcgtgggcttacctgacgacaatggctatgatcaactgttggtcgtcgttgacaaattcagtaaacgcgttggtctcatccctggtaaatcaacgtggaccgctcaggaatggggatctagcgtcttgcggtatttccaggaacatgattggggaatgccccgtttctttatctctgatcgtgattccatcttcatgagcaagttctggaaaggctatttcaccgcgctgaaagcacgctggctgtactcagcagcattccacccacagactgatggtcagactgaacgtgttatccaagtcattgaagtcatgttgcgccattcctacactaccgctgaacgacctgatctgttccgctggacgatggatctaccgagtatcatctccacaatcaatgggtcaccgaatgaatctacaaaggccactccgcaccgactgctcttcggtattgacctccgccaaccatggcagctactgaagcaattcgtcaagcaagacttctcagtacgacttgatgctgaagaatccatgaagtacgcatccatacgcatgaaagagatctacgatcggaatcataaaccaatcgaattccgcgttggtgatcaggtctatgtccgactgcaccgtggctattccctaccaactaagcgagccaatcgtaagctccaattgcagaatgatggaccgttccgcgtattggaacgcgttggaagactcgcctaccgtatcgaactaccctctacatggaagatccatccggttttgtccgtcgcccaccttgaacgtgcgccggccacccccgatccgttccaccgtgagttaccgaagcctcccgcggtcgtcgacgccgaggtctaccccggtgaggatgacatatacgaagtcgaacgcttgctggacaagcgtaccgttcagcgtggacgcaaacgtaccccttatgtggaataccttgtgcggtggaagggatacggaccggaagacgaccaatgggttcgtaaagatgatcttcaaggttctctcgaactcattgaggcattcgaacgtaaccgtcctatgtaa

SEQ ID NO: 14863 - DNA, 741 bp, A.fumigatus
cgattaagcatcaaaattgtgacagagtacctgactagtacgtataggactcagctgccgtcttctgatgaaccccaaacgagacgatcctactttaccggcaccgcacgcacccttggcggtgatgacaccccaagccgggtcatcgaaagcccgagtgcacctacactacagagaccccagcgagtacaaagaacgcttcacttctgggcggacggattctccgtcgatgacggtgatctctttcgttcagatgacccacgaaatgcggaaatccttgacggcatccgacaaggccgtgccccgctatcgatcatgaatgtacaaccaggtcaagaagttgacgtcgagatcaagcagcatgaggaaaaatacgtcaagcctaagccgaaatataagcctttctctggaacagggcaacgacttggcagcccgactccggccgtcagaagtcaagccccttctgaggctcccgcccctagtcagccaagcgcagagtcagtcaagcctgacgtggatgagtcgcagccgatcgtgaccctacaaatccgacttggtgatgggactcgccttacatctcgattcaatacatcacataccattggcgacgtctaccagttcgtttccgctgccagcccatccagccaaagcccgcccttgggttttgatgaactaccttccccaacagggaccttacagaccaaatctggttggcctttggtgaaccaaccccaggtttaa

SEQ ID NO: 14864 - DNA, 900 bp, A.fumigatus
cgacagcgccgtgcattcgccactggcaaggcaatcaacgctcctactgattgtgagactgaagcattccgtcagttgcaatccgcatgtgacagtccgcttttccgtgcccatttcgacccccttaggcgcttgtacgccgacctcgacgcatcatatgaaggttttggtgttatggcatatcatattcagatcgacgaccaccacactaatctttcgattccgcccgcgcgtacggttattcaacccatcttgttccttagtcgaacgcttaccagcgctgaatcgcggtactggccaaccgagttggaagtgtcctgtcttgtatgggctctccggaagctccgccacatgattgaatcatcccgtcaaccaacagtcgtctataccgaccatgcttctactgttggtatttccacgcaaacctctatgaacactgtcgcgcttgaacggttaaacctacggttgattcgtgcatctcaatatattcagcagtttagactgcaggtgtttcaccggcctggtaaatcaaacacagtcgcggacgcgctgtcccgtctcacaacaaaacaaaacaagaacattaagtataacgaacctgatctcgactctattgatgcttactttaccgaccatgggtacactgcgtcgtccatccaactatccacccagctcaagaaacgcataatagaagggtactgcgatgatccacggaccacacgcatcattgaggtccttcggcataaccgaacgtccgacttactaccgtcctaccctaccgattggaatgacgacgggactctctacatgacgaaacatcccttgattggggaaggaaatcacttgaggaccctgggatttacatccggcgtccccttgcaaagaacatgttccggttga

SEQ ID NO: 14865 - DNA, 213 bp, A.fumigatus
tttcaatatctgagtctcgtgtttttcagaggttacattcttatttaccccaagctcagcgctcgatcgctgaaccgagctgtcaattcatatccttccaagatggagcgtaaccccgccgagaacgatgaggtggtttctcagttctgtgcaatgactggcactcgtcccgcagaggtatatcccttcaagctaattccgtgtgatgcctga

SEQ ID NO: 14866 - DNA, 423 bp, A.fumigatus
gaaactctttcgctgacatctatatcaaaggcgcaagagtacctggcagcgaatgggtgggatatcgaggcagcggtgacagaattcttcgcggaacaagacgaagccatgctaggtgcgaacacggctggtggtcggtctcttggaggcgcagaatcagcggcatcagcaggtcggtcattaggcggcagctcttcccagtccggaactgctacgccgaagcaatcttcctcttcatcgcgcaaacccacctctaagaagagatttgcaaccctcggggatttcgcatctggaggcggcgatttctccgatgaagatgacacagagaatcaagatttctttgctggtggtgagaagtcaggactagctgtacagaatccagatgacctcaaaaggaagatcatcgagaaagccagaaagtga

SEQ ID NO: 14867 - DNA, 273 bp, A.fumigatus
tccaacattcaacaacacattagattttcattatacttatacaaaatgcccttatcccaagaaaatcacatgcaaatggctatctctgcctataaaacacaaaaaattaaattaaaattaaaagctgctaaagtatttagcatatctaaggctaccctttaccatcagcttaaaggaataaaagcatatatagaaacacatgctaatagctataaattaacagctatcaaagaggaggttcttataaagagagtgctagatgcagataagtaa

SEQ ID NO: 14868 - DNA, 360 bp, A.fumigatus
gattacctttccagttcagatccaaacattcgaggtgttgtcatatctgcattccggtatactcttacagattcgcgaggcagttacaacgatgtgttgagacctctgattgtcccgcttctggtcaacatgctcagtgaccgcgatcttggcaaccaccgcctcgctctgacaacacttaattccgccattcacaacaagatgaatatcatcctgcctcaccttagcgaactgctcccggcggtctttggcgacacccaggtcaaacctgaactcatccgcgaggtgcagatgggtccattcaagcacaaggttgatgatggcctagagctgcgtaaggtatgttatcctgcatattga

SEQ ID NO: 14869 - DNA, 1794 bp, A.fumigatus
aggagtatgattgattttgagcccagcatcggtacctcttccgcaatcagcacgccagtcatcgctccatcgtcgcccacaaccggtcctcaggctgagctaagcaggtcggttccggttatcgtccagagtctggtgaaaatgtggaagtcggcttcggtgcctttgaaacaagccataattgtcctactgaagagcttggctctcgtgcgctatggcggtctagcagatcatctgcaacagatcgaagatcccattgctgatgtcctgaagtcttcatccacaggcagtgtgacttcaaccgttggccccgctgtcagtgccggagccctccaaaccgaaacactgagtctcgtcgctgctattgccgaaactcatacatccgatgcacttctgcccttcctgattgccttaattccgggagtgatcggtgctgtcaacgaccggaactacaaggtcagcagcgaagctcttggagctgtcgagcaaatcatcaaagctctgaccccccctcgtgtcactgcaagttctcctgatctcgtctcgcagttagaaaagctgtacgatgagattctctcccgtattacagacacgagtgccgaccttgaagttcggcagcgagccattcatgtctttggtgtcctcctggcacgtacgtctggggagaagggcgctgatttcctatcaccagatcggcggttaaagggtctttctgtcttggtcgatcgcttgaggaatgaaactacacgtcttgcatctgtccgtgccgtggatgacgtagccgtcctctgcaccaaggagacagacgttaccgcatcctgggtcagcgaggtgactgtggaacttggtgcccagctacgcaagtcggaccgcgttctgcgtggtgcgagcctagaaactttgcgtagcttggccatgaacccaagtacacgggcccactacgatggaaagacaatgaaagagctggaggattgccttctacctctaatcagcgctgatgactttcattttcttgcaccctccctcattattttggcaaaactcatacccggtaatgcccagcttcttgtcaatgaaggcttggtctctgctctatgctctattgttctcgctccactcgttggcacggtgctcaaggcattacttctgctggtgaaggttatcggagaggaaggtgctggagctgaattgatgcagaagctcctccgggacgtgggcatcaacggcgacccctccgtggttggaagagcgattggaactctgcttgtccatggcggttccaaattaggcgttaaaatggaggacttcttgactgaattacaaactgcgcaggacgctcagcggaaatgcctcgcactggccatcattggtgagatcggtcttcgcatgggccctgcgtgctccttaactccagatctttttatcacccatttcgaatcgaagtctgataaggtcaggctcgctgctgctacggctcttggaaatgcggcggcaggtaacgtgaagacttacatgcccattatcttggatggtcttacgaagtcaaaccctcgaagctatctgcttctgcactccgttaaagaattacttcaacatcccgagattgttcgccctgacgtcgctcctattgctgtcaagctatggcaagctctccttctggtgtcagaagaagaggacaaccgtgctgtgggagcagaatgcattggtcgtctggcattaattgatccggtggcttacatcccccattttcaggtaagctttacgtcctttcccaaatctctttcgcttttctga

SEQ ID NO: 14870 - DNA, 486 bp, A.fumigatus
agctgcgtaaggtatgttatcctgcatattgatgcatcatctcagtttcaccggactaacattcatcagagcgcctacgaaacactttatgcctccttggacaccgcgttctccgtcgctcatgtttccgagttctttgaccgtatcctagccggactcgaagacgagcaagatatccgcaccatatgcaatctcatgacctcgaaactcatcccaatcgcgccagaagaaactcaacgctacctcgaccagctttcggaacgttactctgccgtattatcctttaagcccaaggataatgcagtgaagcaggagctcgagaaagcacaggaggcctccatgggtatcctcaaggtgacgcgagagctaagcaaggcatttccaaatgctgaggtctccggtgatcatcacaagtggaaagcttatatggaatgggttcgaaagacgtttgctacccagctcaagagcctcgagacggaattctag

SEQ ID NO: 14871 - DNA, 285 bp, A.fumigatus
cgaggaatcgttgagcgataccaattagcattaatgacaaacaagcatatcttcttcattgaatggtctttatttatcagtcaatttttgaccatcctaaacgtggtccattgcaatgttacgtgttctcgttgtggcttcagctgctcgcatacgtattatgttgtcaagattgcctattggatcctgctcgtgctacagacgatatcgacatttgttactggtcctgatagattcaaaaggctacagttggcatccagtcattactatttgtcaagccagtag

SEQ ID NO: 14872 - DNA, 489 bp, A.fumigatus
ttcattagttcctttttccatcagacactgctgcagatgcttgttcgaggaaacgtattcgccagaatgtcgcctgatgagaagcatgaacttgtcgaaagacttcagtccttggattattgttgtgggttctgtggggacggagctaatgactgtggtgcattgaaagccgcagatgtcggtatatccctttctgatgccgaagcatccgttgcggcgcctttcaccagtcgtcaattcgatatatcttgcgttccacaactgatcaagtcagtgcctacccatttctcattcgaagtagatcttttgctaagccaccagcagggaaggacgcgctgctttggttaccagcttctgttgcttcaagtacatgagtttgtactccgcaatccaattctcgagtgtcagctttctttacacgtcagcatcaaaccttggcgattttcaggtaagtatagtaagcacttctcagggtcgtcgtctcgctaa

SEQ ID NO: 14873 - DNA, 249 bp, A.fumigatus
cggttcgaagtgggatggactggcccgcatccagtgctttcccgcaagcgaccaaccgcaaatcttgtgtcacggaaagtgttaactcccctactcggtcagatatccatatgcatccttactcaattcgtggcattcaagactgtccaatcgcaaccatggtatgttagcatgtatataaatcttcaccggaagcctgattttaaccattcacaggtttcaacctccaagaatagacttaaacaatag

SEQ ID NO: 14874 - DNA, 351 bp, A.fumigatus
aagagactacaccacattagttgttacacggtggtaccgacccccggaacttctccttcaacttcgacgttatacaacagctatcgatatgtggggtgttgggtaaatcttctgctcttgctgtcgtcttcagttattactaaccattataggtgcgttttcggcgaaatgttcaaggggaaaccgattcttgctggaagcagcgatctcaaccaaacccagttgatattcaatcttgttggaacaccaactgaagaaaacatgcccggttggagttctctacctggctgcgagggggtgaaaagctttgggtataaaccaggcagtctacgtgaggtattcaaagagtaa

SEQ ID NO: 14875 - DNA, 261 bp, A.fumigatus
gccaccagcagggaaggacgcgctgctttggttaccagcttctgttgcttcaagtacatgagtttgtactccgcaatccaattctcgagtgtcagctttctttacacgtcagcatcaaaccttggcgattttcaggtaagtatagtaagcacttctcagggtcgtcgtctcgctaacagtttcagtttctgttcattgacctggcactcattttgccgattgcaatatttagtaagcattctaaaacatcttcaatactaa

SEQ ID NO: 14876 - DNA, 519 bp, A.fumigatus
atcttcaccggaagcctgattttaaccattcacaggtttcaacctccaagaatagacttaaacaatagcaatatagagaactccgaaaatacggcgctgtttttaatatcaatcttccaatatatatttacgagcatcgttctgagcgtgggaccaccatttcggatgccaatgagggcgaacagtgagtgttacatccttagtgttcggattgaactgactaaatggatagaacccctgatcgtcacaattgtcgttgacacaatcgtgtcaagctacatgctcttcgatccaccggaatggattatcgaaactatgcagctgacattcatatccaggggtttcgcgttttggctttttgcactcgctaccagcacattcctactctcgtgggtcaccgaacgcaagttctttcccctactctcccgggcaattggtcatttgaaaacacggctacgcccgggaaaccgtaagcagcgccgtcaatataaagtgctgcttgatgaaatggaaacatga

SEQ ID NO: 14877 - DNA, 195 bp, A.fumigatus
ttttcatgccttatcaaaacactgattactagaagggaagtttacaaggcacgttcaaagaaagatgggtctattgttgcactaaagaagattctcatgcacaatgagaaggatggtgtcaggtcattcgatcattcacaacattaccagaggctgatagaatcgatcccagtttcctatcacggcccttcgtga

SEQ ID NO: 14878 - DNA, 228 bp, A.fumigatus
cccgttatagctgccaacttgttgataagcaacaacggcgtacttcagattgcggatttcggcttagctcggccatatgatgagcctccacctgagcccggaaagggcggaggggaagctaaaagagactacaccacattagttgttacacggtggtaccgacccccggaacttctccttcaacttcgacgttatacaacagctatcgatatgtggggtgttgggtaa

SEQ ID NO: 14879 - DNA, 252 bp, A.fumigatus
cttagtacaggggatggacgcaaaaaaccaagcatgtacatggtgactccttatatggagcatgatctttcggggctgttggagaacccggcagtgaatttcactgaacctcaaataaaatgctatatgcttcagcttcttgaaggacttaaatacctacacggtgtattccttccccttttccatacgaccggagaccgttctaactcacggttacagaaccgcattctacatcgagacatgaaaggttag

SEQ ID NO: 14880 - DNA, 192 bp, A.fumigatus
atcattcagtaccaagagcgtaacagggttcatttggcgaagcctttctgcatcagtacttacaaggacgagcttatcatcgtcggtacaatgctcgatcctctgttcgagccgctcgaaagtcaggactccggcttctctttcttgaagcacatcggtcccaaggatgaccctgtttatgcccttcattag

SEQ ID NO: 14881 - DNA, 348 bp, A.fumigatus
atcgatgccgaaccggttgctgagatacgccctttccttcacttcggcaactttctgtcgttcaatttccaccttctcgtcctctatgtactccttgagggctccacggccactgctgctgaatcgttgaccctcagcagtgatgtcgctacccctgtggccgcggcgaagtcgacgcttcctactcttgtattgatctgcgcccgaggagctaaaagcccagtaccgcaggtgcgttcccagagcgaccatgcctctcaacacagtcggatccggatcaaggcatatggctccacatgcgaagaagttattgccaactccatgcatggaggcttccgcttgcactaa

SEQ ID NO: 14882 - DNA, 249 bp, A.fumigatus
  unsure (49),(140): Identity of nucleotide sequences at the above locations are unknown.
gaatccgacttcagcaaaagttctacaacgccaacggccgagaagatcnccggcatcaagctgagcatcttggctagcggcgagtccaataccccgggtgctcacagctccggatctacttctgcttcttccagctccgncggcagctcgtcttccagctctgacaaggagagtgcagcgggcacgatttccgtgcccttcgttggcctcctgtctgcggcctcgttcatggcgttcttcatgctgtaa

SEQ ID NO: 14883 - DNA, 2991 bp, A.fumigatus
  unsure (35),(42),(45): Identity of nucleotide sequences at the above locations are unknown.
ctctccggaactctgcgcggatcttgcagcttcgnagtcaantcnaaaatggccttctgccggtacttcccgggtccatacgctgtggaaaatggcgcccgtctctctgcaacggacggctcggataacgtggattcaaataagcggtacttctcgagactgactgcgctagcttcgtggagaagcgagtacattctgaggacccgcttgttaagatcgctttcaaggggcaagccagctcaattcgaaccttccaagaaatatggtacggttcgagctgccaatgtacgtaatggcagcgctgtagccacctacacttcacagcttatgtaccccgtgagtcacctcggtgcttctttcggtgcagaagataccaggaaagaaccacattttattcatggtgcgtcggagcagggaattgcatctgctagcgacccttcgactgtcaaagtcggtacgtggggcttgtctgatcatcaaatgttccggcattttgcggacttgtttgctggcgatggtgaatatggccttggatccggcgacattgttgggcaacccaactgcatggacgtcagtcagccatatggcatgatctatggcgaaggttgtccgcaaggtcgcagttactttatctcgactacggagcagcgtggccgtttccttggacttgtggaatcgagctcccaaccgcaacagggcgtccctgcgctcaacccggcaacaacttcaatcactgctgtctggatcgccaagtccgcgcacatccttaaaatgacgggaggcttggttggaatgctatctggctcatctgtcggtatccttacagcctacgcgctcggacctcatcctacttatgagaagcggtttgagagaggacaagtcacggctaaatgggctatctgcccgggagtccccatcattggtatcgctgttgatgacaactattccaaaaatcgctcctctcgtggcaggatatgggcaacggttcttaacgctcttggagaggtgttctacctaacagaaatacctcgacaacccgatattgcagcaaagttaagcgcggaggaaattgatcagcttgcttggaaaactggtagaagtgttcgatgggagctcatagaactgagcaagcggactgcgcgaccagacccgttcaacagggaccctgtcgatggaagctacagccctaggtcgtcgtcagactcaatgaagctggatgaacaacagatagcggccgaaaccaaggagattgaacgttttctgaaattcagacccaaacatttccgaaaggtttgcaagggctgggatatgagacgtgatttaaaagtcgactttgctggtgatgacggccttggtgccggtgaatcaatcatggttattactcgaggcgctggtgaaggtgaaaaagcctcgattcgcaggttcactagaacaatgttgaagtccgatctgccagcggcttctggaacccttcctcatattactggtgatgctacgttcaggtccctttttggtggacctagccatacacctatcccatcctccgcttcggacgcgagtagtctgcctccgtccagaacttcgagttaccttagtgatacagtcgtctgctcggttgcaaacacagaatggcgcatgtcagactttggcttcggtgaccgaaagtccatccgaattactacaagcgccttggattcttccacttatgccgtcctgacggctgacgaggatccactactcgggatgtctggtggctcggggttctcatcggccatgtcgtccccattgccgcacttgaagcagtcgtcctcgaaccctgaaattcccggaagccgaggacgatacctcgctgttggcaccgccacaggtctggtgttcgtatgggatatacgggcgccgtcggccaagagtaccgatattatcaactccgtgtcgccactcaggatcatccaaactgactcaccacaggtgtcatgtgttgccctgacatccctatatttggtgcacggtggtaacgacggacttgtgcaagcatgggatcctcttgcgtctaccacacgtcctattcggacaatcaattcacgattttcttctagagctcggcgccgcttagtgcaagcggaagcctccatgcatggagttggcaataacttcttcgcatgtggagccatatgccttgatccggatccgactgtgttgagaggcatggtcgctctgggaacgcacctgcggtactgggcttttagctcctcgggcgcagatcaatacaagagtaggaagcgtcgacttcgccgcggccacaggggtagcgacatcactgctgagggtcaacgattcagcagcagtggccgtggagccctcaaggagtacatagaggacgagaaggtggaaattgaacgacagaaagttgccgaagtgaaggaaagggcgtatctcagcaaccggttcggcatcgatctattaggatcggatgtcagcgaggaccagcttctcgcctacgcacaattactgagcgaagaagctttcgctagtgaagctctcaagcgcggtgaagcagtggttagctcggtggttagcacctctccaagtgacactatcggtcgcaatgatagttctgtcgcagcagacgactattcgtcctcatcctctccgtaccaggacaccatcgatgatgatcttgcacctgatattgctgaagctatccgcctgagcttgctcgacgaaggaccttcgcaagaaaaatctccttatcctgttaagttctcgagaaagcttcagtcgagttacggtaacatctcaccatgcgaattatcaggtgctgaaagcagccgccagcgagagcttgacgatctggagcttgccatacagttgagtcttgcggagagtcagagtgtcgggcaaccagagagacagcaagacagggaatatcctttgttgagtacattctcaccagcgtctgacaagggtaaaggcaaaggaagagctttgtag

SEQ ID NO: 14884 - DNA, 507 bp, A.fumigatus
ttgtcaatagacgttcaggaaattatcgtaagaggtatgaatatgctcacctgccagcatcgccgtgcaagcccagcccccctggcatctctcgtacatcctgctcaggcttgcaaagagatcttccctgttcacacgcgccttcttggtctcgctgagctcatcggcaaagatgttcagcatcagctcactatcgctatcagtgttgatgtggcggtgggcctcaagatccaagtatcttttcaactcgggagcattgatgaggtttccgttatgggccaggcaaataccgtaggggctgttcacataaaagggttgagcctcggcattcgcgctgcttccagcagttgggtatctcagatgtccaatgcccatgaagcctggaaggtccgccactctcgcaccatcattgaaaaccttggctgccataccattggccttcaactggtagatgcgaccacctgccgcgcacgttgcaatacccgcagcatcttggcctcgatctag

SEQ ID NO: 14885 - DNA, 237 bp, A.fumigatus
ctgcattgcttcactcctttgcaaacgtttcggcttgtgttactctctaatattccgatcatcatgttctcgtcatatctttctgttctcagtccttacactccttatattcccttccttgcccaagttcctattttccagcaactgctagttgactttgtttccacgaaacctttggtaattctgaatagctcaaaggccttcctcctccagttctacctgctgccgtggagatga

SEQ ID NO: 14886 - DNA, 285 bp, A.fumigatus
ctcaaaggccttcctcctccagttctacctgctgccgtggagatgaaccgtcctacaaacgattcgctccattcccaagagcctccacagccctcagagcccatatgtctcgatgacagtgacgataactcaagcgtctgtgacacagacagtaacactgacagcagtgtgactattgataacgatcctgatcgatcgtttttccttgacgacgaaaaatttcaccctgggggcggccggcggaccccaacgcctttccacataggacctcaaactcaccaagac

SEQ ID NO: 14887 - DNA, 564 bp, A.fumigatus
gtatttggacgatacagagcactcccccgagcatcgagactaatccttaatcttcaattactagatcgaggccaagatgctgcgggtattgcaacgtgcgcggcaggtggtcgcatctaccagttgaaggccaatggtatggcagccaaggttttcaatgatggtgcgagagtggcggaccttccaggcttcatgggcattggacatctgagatacccaactgctggaagcagcgcgaatgccgaggctcaacccttttatgtgaacagcccctacggtatttgcctggcccataacggaaacctcatcaatgctcccgagttgaaaagatacttggatcttgaggcccaccgccacatcaacactgatagcgatagtgagctgatgctgaacatctttgccgatgagctcagcgagaccaagaaggcgcgtgtgaacagggaagatctctttgcaagcctgagcaggatgtacgagagatgccaggggggctgggcttgcacggcgatgctggcaggtgagcatattcatacctcttacgataatttcctgaacgtctattga

SEQ ID NO: 14888 - DNA, 723 bp, A.fumigatus
tttcctgaacgtctattgacaatcatggtagggttcggtatcctcggtttccgtgactcatacggtatccgtcctctggttcttggttccagaccctccctggacggccccggcacggattacatgatggcctccgagtcggttgccctgcaccagcttggattcagcaacttccgtgatatccagcctggtgaagccgttatcatcgaaaaaggtggggagccggtcttccgccaggtggcgccgaagaaggcatatgctcccgatattttcgagtatgtctacttcgcacgtcccgattccgtcatcgacggtatcagcgtttaccggagccgtcagcgcatgggtgatcgccttgccgcaagaatcctcgatgttctcggacctgaaattgtcaaggacatcgacgtcgttatccccatccctgaaacctcaaccacatcggctgcagcggttgctcgttatctcgacaagccttactgccagggcttcgtcaagaatagatatgtttttcgtaccttcatcatgcctgaacaaaagactcggcaaaagggtgtccgtcgcaagctgaacgccatgcaagccgaattcaaggaccgaaatgtccttttggtagacgacagtatcgtgcgcggtaccaccagcagagaaatcgtcaccatggcgagggaagctggggctaagaaggtttacttcgctagttgcgcgcctgagatcacgtaa

SEQ ID NO: 14889 - DNA, 2001 bp, A.fumigatus
accacccttatagtggtccttggcggcgctggtgaaaacgtgcctactagtcgtgccaccgcgtccaaagctctcggctcacttatcgagaaactcggagaggatgcactacccgatctcattcccaacctcatgactacgctcaagtcggatactggcgccggtgatcgtttgggatccgcacaggctcttgcggaggttctggcaggtctaggaacgacaagactggaagagacactgccaacaatcttgcagaacgtctcaagctccaagccagctgttcgggaaggcttcatgacactctttattttcctgcctgcctgctttggaaacagctttgcgccatatcttagcaaggttattcctcccattctcgcgggattggcagatgatgtcgactccattcgggagacgtctctcaaggctggtcgtctgctggtcaagaacttctcttccaaggctatcgacttgcttcttccggaacttgaacgcggtcttgcggacgatagctaccgtatcagattgagctctgttgaactggtgggtgacctgctcttcagcatcacgggtatcacagccaaggcagatgcggaagaggcagaggaagaggctgctcaagccggacagtccctgctcgaggtcctcggcgaggagaggagaaacaaggtcttgtctgctctgttcatttgtcgctgcgatacttctggtcttgtcaagagcgcagcgatggctgtttggaagtcgcttgtcgcttcaccgaaaactctcaaggagatggtgcctactttgtcgcagttcatcattcggcgtcttggttcatcaaacatggaacacaaggttatcgccagcaatgctcttggagaccttatcaagaaggctggcgagtccgtgctcgctactttgctgccatctctcgaggaaggcctccgtacgtcacccgatgtggatgtcaagcaaggtatctgcattgccctgagagagctcattacctctgcgtctcctgaagccctggaggactacgaaaagatcctcatctcaaccgttcgggttgctcttgtcgatagtgacgaagacgtccgtgaagcagcagcagaagccttcgatgcactgcagcagattcttggcaagaaggctgttgaccaggtcttgccccatctcctgatgcttttgagaaacaacgaggatgctgagcaagcgctgtcagcactactgacgctccttaccgagcaaacaagggctaacatcattttacccaacctgatcccaaccttgatcagttcgcccatctctgccttcaatgcaagggccatcgcttccttggctgaggtggcaggttcggccttgacgcgtagattgcccgcgattctcaactccttgatggacaacatcctttccactacggacgaggagcatcgggaagaactgaacagcgccttcgatgccgtcttggtatcggtggatgagttcgatggtctgaatgtcgtgatgaacgtcatgatgactcttctgaaacacgatgaccacagacgccgcgccagcgctgcgctccatcttaacaagttcttctctgaagctgagatcgactactccaggtactaccaggatctgattcgtgtcctgctcatttccttcgacgacagcgataaggaagttgtcaaggcagcttggacagcactcagtggcctcacgtctcacatgcgcaaagaggaaatggaagtcctcactattccaacacgccaggttcttcgacaagtgggtgtgcctggagccgatctgccaggtttcagcttgccgaagggtatcactgccattctaccaattttcttgcagggtcttctcaacggcaatgtggaacagcgtacgcaagcagctctggccattggcgatatcatcgaccgtacgaatgcaaactcgttgaagcttttcgttactcaaatcactggtcccttgatcagagtggtttctgaacgttcagtggatatcaaatgtaggttgatatga

SEQ ID NO: 14890 - DNA, 303 bp, A.fumigatus
ccagaattgattacaggtacaaagacagatgatatgggcgtcaagaatgcgatgatgaaggcactacaagaggtcgtcggcaaagctggcgcaaatatgagtgaggcttcgaagaatgctatccttgcactcattgacgatgatgctagcgatcagactggtaagttgagatccaaaattgacgaggtcaacgttgcagagctaacttttcaagcagatggtgttgctatcacgaatgccaaattgcttggtgcgctggtgaaggtgcttcccgcgtctaccgcaagcccactgatcaagtag

SEQ ID NO: 14891 - DNA, 267 bp, A.fumigatus
ccaggattaggtgctatcttcttcacgcttaacaagcttcttgagaagatcccgatggcagtcaagccattcctgcctcaactgcaacgtacgtttgcgcgaggtctagccgattctaccagtgagacactacgcaacagggctgctaagggtcttggaatcttgattaccttgactccaagggtggatcctctcattgcaggtaggtcaattagattgtgcgataaaatgatagcagcgttgatactaatccttgaccagaattga

SEQ ID NO: 14892 - DNA, 387 bp, A.fumigatus
tttctgttacagcctttcattgccgagaacagcgtcctcgcggccgggaagttccttttgatcgaggacgagagtcgcaatttcgagacgaacaaggccatcttcgaagcgctagcgccctgcatacaggcgggcgtgcctcctgatgttcgccgtctcactttggtggtcttgagaacggtgagccgacttcatcccgaactgacacggcctcatctggctctgcttgcaccaccgattttcagctgtgttcgcgatgtcatcattcccgtcaagctcgctgctgaagctgcgttcctgtcactcttctcggttgaggaatctgaaagtgctgttttcgacaagtatatggctgggcctggggctgaacttcccccctggacctaa

SEQ ID NO: 14893 - DNA, 417 bp, A.fumigatus
gaggtctgcaattttttttttttctgcacgtacctaactaaacctctcccacaacaggcctatatcgactttaccaaatccacgaacgtcgtcgaggacgtcaaagccgccaccccggggggactcggcgcccacgccgtctgcctcctcgccgtctcggagaagcccttccagcaagctacggattatgtccgctcgcgtggtactatcgtcgcgatcggtatgcccgcgggcgcgtacctgaaagcacctgtgttcaacaccgtcgtcaagatgatcaccatcaagggcagttacgtggggaaccggcaggatggtgtcgaggcaattgacttcttcgccagggggctcatcaatgcgccgttcaaaaaagcgccgttgaaggaccttccgcgtatatttgagctgatgggttag

SEQ ID NO: 14894 - DNA, 711 bp, A.fumigatus
cttgcgacaccaaccagcatgacaatcccagacaagcaatgggcccaggtggttttagagaagggcagcccaccggtctacaaggagatacccgtgcccaaacccggtcctgatgacattcttgtcaaactccgttactcgggtgtatgccacacagatctgcatgccatgaagggcgactggcccctcgcgctaaaattgcctcttgtcggaggccatgagggtgtcggggtggttgtggccaaaggcgagctggtgactggcttcgagattggcgatcacgcaggtatcaagtggttgaacgggtcctgcatggaatgtgaattctgtaagcagtctgaagagcctctttgtccccgcgcaaccatgtccggatacacggtcgacggcacattccagcaatactgcgtcgccaaagccactcatgcctccaaaatccccaacggcgtcccccttgatgcggcagctccaatcctctgtgccggcctcacggtctacaagggcctgaaggaatctggcgctcgggccagggcagacagtcgcgatcgtgggcgcaggaggtggtctaggctctctcgcccagcaatacgccaaagcgatgggattgcgagtcgtagcgatcgatggcggcgaagagaagcgagaaatgtgcgagaaactcggagcagaggtaagaggtctgcaattttttttttttctgcacgtacctaa

SEQ ID NO: 14895 - DNA, 207 bp, A.fumigatus
aggaatctggcgctcgggccagggcagacagtcgcgatcgtgggcgcaggaggtggtctaggctctctcgcccagcaatacgccaaagcgatgggattgcgagtcgtagcgatcgatggcggcgaagagaagcgagaaatgtgcgagaaactcggagcagaggtaagaggtctgcaattttttttttttctgcacgtacctaactaa

SEQ ID NO: 14896 - DNA, 183 bp, A.fumigatus
aaagctgacgacatgaactatactgttgtcatcaacagtgcgctttggggtggtgcgctgttgtattatctgctgtatgcgcgcaagttctacaagggtccgcagacgactgttggacagccgtcgtctactctttcggagacgaatctggagaagttggatggggagaagggcgtcaattga

SEQ ID NO: 14897 - DNA, 666 bp, A.fumigatus
gacggggctgtgtggtatcctggggtttctgtctcttgcagttatagcagctgtgatggataccaacctggagaaagtgttgggaactgcttttggtcaaccgatggcgcaggtaagcttgttgtgctgtcaggcacacccgaagttcgagctgatgatcgtcagatctactacgacgcactcggcaaacccggtgcactgggcttcatggccgtcgtcgccgtcgtccagttcttcatgggcctgagtctcgtcctcgcagcctcccgacagagctgggccttctcccgcgacggcgccctccccttctcctccttcttccggcacgtcagcaaacgcatccgctaccagcccgtccgcatgatctggggtgtcgtcacagccgccgtcatcatcggtctactctgcctcatcaacagcgccgcctcgaacgctctgttctctctcgccgtcgcggggaacgatctagcctggctgacccccatttttgcgcggctcgtctggggcggcgagcgcttccacccgggagaattttacacgggccagctgagcaagcctatcgccgtcacggccatcgtctatctcttctttgcgatcgtcttgtgcatgtttcccaccctgggacctggtccaactcgtaagtttttcatttcttcaggtagataa

SEQ ID NO: 14898 - DNA, 1179 bp, A.fumigatus
ttatctcgtttctttgctccttatctacgactttcaggattcagtatggcagatgaagatctcaagctctccttacctactcccacatctccgccgagtctgagctcctccgtccatttctacccattcgcaacgtcaccggacatcatccgctccaatgaaaaggacattttcataacttccagtctggtcaaccaggcacaagcgattatccgttctctccgtggcgcacgctttgctcatatccactccgacgccatcaaacacctaaccgagattctatacttctcactcacgacgttaattggcaatcggactctgggagaggagtattgcgacctcgtgcaactggaagatgatacacttcagctccccgccattcatagaagagcaggttatatcctgagtagcatcttagtaccgtgggcgctccagcggattctccctgggtttcgccagcgactacgcgcaaaattggagcgtagcatctcccggcaagaattgaaagcgcagcagaaagcagaagaattaagatttaccaagaaaaatgcttcgaagaagccgtctttcttcaccgcacttcgactccagaagtacattctcgagcatctcgactcaatcacctcgctttcacctatttacgccctaagtatagcaaccttttattttactggctcctattaccatttatcgaaacgcttctggggactgcgctacgtgttcacgaagaaactcgaggaaaatgaacagagagtagggtatgaggttttgggggttttgcttgtccttcagatcgcggtacaaggcatcctgcatattcgaaaactcggtcttagtatgcaacaagggggggaaggtattgagactgaaatggctggttccaagatgcaagatgactccttgatccgctccattcagaacccttacaaccttccgcttcttcctgcttctgcagctcgatatgatctttcagaagattcgaatgtcattccgtggattccttccgggcaacagagcaagtgcacgctttgtctggaattgtacaaagatcccagtgtcacaacatgtggacatgtcttctgttggacgtgtattcgcgattgggtacgcgagaagcctgagtgtccactctgccgacaagaggtaataccatctaaggtcctgcctttgagggggtga

SEQ ID NO: 14899 - DNA, 195 bp, A.fumigatus
cttcaggtatattaccagcagataagagtgcagcatgatatcccccacacgcctgtgtggaacgtgcttctcaaaaagcctcgggacaccagacgccaaatttcaaagatgcatatccagatgctgggctgcatctccggatttcaaaacaagcacttggctcttaagcctaaaaacgcacctccgccttcctag

SEQ ID NO: 14900 - DNA, 1260 bp, A.fumigatus
gagtgcagcatgatatcccccacacgcctgtgtggaacgtgcttctcaaaaagcctcgggacaccagacgccaaatttcaaagatgcatatccagatgctgggctgcatctccggatttcaaaacaagcacttggctcttaagcctaaaaacgcacctccgccttcctagtatctgtctcaacttggcccagcagtcacggcaaatgcgcccagcccccacttcgaggactgctgtcaagaagtacaatggattgcagaatgacttgaagtcctcgcattggttgaccgggctttggcatggaaagcaaagctacatgcgagaacatgcattttcgacgctctccagggaaactgtgggaggcgatcaaagattttcctccacacggcctgacgagtctggcccgggaaggctaagaatgaacttctgcaccacacacccaaaacgctcgtttagaaagaccctgatagcgcaatcaatagctagtccttctaaccgcaaaggtagttctggtcacaccagtcaatgccagtcgtacagcaatgcagatgtatcacggagcatcgggtctggggatgaaacacggaccgagacagcagtatgcgagaagcgtctggttgcgcaacagtctcttgctttaaccattactcctggccccaagttttggagccacaggctgcgcaaggccccgagtgggagagacatcatcgtgcactattgcaagtcccttagaaagaccgaggaagtagcgaaatacttcttgaatgatcatgtaataggctttgacatggaatggaaaccgcagtcaagcagatctgccagcattcagaacaacgtctcattgatacagattgcaaatgcggagcgcattgccctcttccaaattgcgctgttcaaacccgcgagaagacccgaagactttatttctccttctctacgaaaaatccttgaatcatcagaaattacgaaggctggagtagcgattaaggcggattgtacgcgactaaagaactttctcggtatcaatgttcgtgggattttcgaactcagtcacctgtacaagttggtcaagtactgccagtcagatccagcgctcatcaacagaagatctgtcaatctaagcgagcaggtcgaagagcacttcggtctacctctagcaaaggatgatgatgtccggtgcggcgattggaccacggcattgaactaccgtcaagttcagtgtgagtttaccctgaaccccattttgtttcgagtgtattaa

SEQ ID NO: 14901 - DNA, 282 bp, A.fumigatus
aagatcatatcgagctgcagaagcaggaagaagcggaaggttgtaagggttctgaatggagcggatcaaggagtcatcttgcatcttggaaccagccatttcagtctcaataccttcccccccttgttgcatactaagaccgagttttcgaatatgcaggatgccttgtaccgcgatctgaaggacaagcaaaacccccaaaacctcataccctactctctgttcattttcctcgagtttcttcgtgaacacgtagcgcagtccccagaagcgtttcgataa

SEQ ID NO: 14902 - DNA, 291 bp, A.fumigatus
agacaggggtcggagtatgttaaggagagggtgagggtgcgggtgctggcggagtcgttgagtgtgggtgggcggcaggaggcgagcattgcgaagaacccggatcggcacttgaaggatgtgcttgatgcggctggggcggagtttgcggatgagagggaggaggtggaggctttgacgtatgtttatgtggctggacaggaccgattggaggatgcggagtgggatttcgaggcctttaagagggataagatggcctggtgggttgatgcagatgagagcgagtggtga

SEQ ID NO: 14903 - DNA, 1824 bp, A.fumigatus
  unsure (1786): Identity of nucleotide sequences at the above locations are unknown.
ctctcagaaagaatgttgctaacctggcgtcgcagcgatgatgaagaggaaaacccgccccaacagcaatgcgaaaagatttcccgaaagtggcagaggtctgttgaacactattcgcttcaatcattgctttgcaggattaatggatttaataggccacttgtatacccgcgtttcggcaagaagaaggctgaagttgacggtcaagatcttgaacgactgcgagataacgaattcttgaacgacaacctgatcggcttctacatacgctttttggaggatcatctggaacgaaataataaggaagtctcacaaagagtctacttcttcaattcatacttttttgcaacacttacgaacttgcctagaggtaagcaaggcatcaattaccaaggcgttcaaaaatggacgaggaatgtcgacatattcagttacgattatatcgtggttcctatcaatgaagccgcgcattggtatgttgcgattatatgcaatctaccgaaacttccgggcattatgaaggaagaagaggtgattgatcaacatgcggaagaagacgcggagccttcagcgctaccaaagcgtgacgatgcggagaatccaaacacaccgcagaccgtcgggatcatgtcttccgacagcggagaagccgaaactggcgctcgctctgcaccaaatccggaaaaggaggaattggcaagggagtcgttggctgccatgagcttgttggatcgaaaggagatgaaagagaggggggagctcgaagtacctccttctgacgaagagtggccagaaaaagaggagaaccccgtatcctcccccgcaaagctctcgagtcctccaagagatacggagccctccaagcaggtcaattctcaagatgcccgccaatcgtcggcctcaggaagtcaaaagtcacggaagccaaagaaaaaacgacagggtccaagatatgaagtatggcagccaacggtcatcacgtttgactcactagacctgtcacgctctcccaccatcagcgtcctgcgcaactatctccgtgaagaggctcaatctaaacgtggggtcgagattgacacaaccctgatcaagggcatgaaagctcaagaaattccattgcagcccaactactcggattgtggcctctatctgctcgcatatgtggagaaattcgtacaggatccggacacatttgtaacgaaattgctccgaagagatatgagggtggaggacgattggcctcttctaaggtcagggcttcttcgttctcgattgcggaagtttcttgacgaattgtatgatgaacaagaacaactgagtcgcgagaaggcggctgaaagggctaccatggtggaccgacagccaatatcttatctccttggacttggaggaaagactgatcttgcagctgagaatatggaggatgcatcagcaacgcgatctgagaagttgccaagcagaaatccgcccctcgaggtgtctggtttagagcttgctcagaaggcaaaactaggtgagtcgcggtccgtgactaggagctcgtccagagatggtacgccagatagtacggcgcaagcgaaaatgtcaacgcctcaaacgttggcagcaagtgcatcagggagcactactcgcaaggaggttgtcgaggtcccccgacagtcaagaacaagtgcaattggagaatgtcacatcgcattgtctccttcacgtcggagactctcaaggcaggcaagcgcgatttccggctcagggttcaaaccctgtcgaagaagacacagagcgaacncagatacctcatcaatcagcgaatggcagcattgttga

SEQ ID NO: 14904 - DNA, 285 bp, A.fumigatus
gaatcccgtgattacttgcaacgttctggcaatgactcattcaatgcgcaggatcaatgctatgataaccttcgcatctcgaaaaatgcttgggataccaaccttgtcaaggtccgcccccgccggcatcccgattacctccccggccctgaagacagtctaacccccaagataggtcaaccctcgctacctctccgtgaattgggaagccggtggtggtggtgcatttgctgtcatgcctgttgtgttcacctcggagtagcgggccgggcttatgcacccacc

SEQ ID NO: 14905 - DNA, 813 bp, A.fumigatus
cccgatcggcctcaactgcttcacggactaccagaacgaatttctcctccactgttggacccggatcacggcctccttcgcatgcgccacgaccgcacacatcgcttgctggtacccgaaaaccgaacggtcactccatcactcggcccgcgacgtcattggatacccatgaagaagaggatttcgctgcaagcattttgggaaagagaaagggtaggcggcagtccctattttccctgtttgatatttattcccaccctgcatctattacaccgcatagtaaggacaggaagttgtcgtgcgattggtctgactcgcaacggaagctccttggtattcaagaggcccctttgcgaattggtcaactcgaggcatcaccatgtcctgctttggatgagtcggcaaaggatcccgtttcccaagacatgctggacccaaaacccgtgcacctcgcgcaggatggacccattaaacctcctccctcaaagatccccgtatcttctccccgtgagacacgcattcgagatgcctgcatctaccccaaaaccttctcccaggaaaaagaaaccacctatcgtaccatttctgcacagagattcttcgatcaagacgtttaactattctacaggcgccgaatgggatcatgctacgcgtgaaaagacaatggaggagtttttcaatgcctttgtctcacgagtcagccaagccggacaagagagcttcggtctgaaagagaccgttgagttgtacaaaagcagaggtgagtacgggtacccactcgatctgcaagtgtgctcacagttgttacagtga

SEQ ID NO: 14906 - DNA, 1482 bp, A.fumigatus
aggacgctaaaaagggaccatgagattgccatggacgatgtagaacgtcagcaacgcgccgaaattgagacggtcagacaagagagcaggcagcagctgcaggcactagacaaccagcaccaagacgaactccgcgaactgagacgccatttcgagcagcagataaacgacgaaaaagccctccgattccaagagatcaaccagatcacctcgcagactgcgctcgacacgcaacgttcgctcctcgagttagagcgcaaggatagggaaattgccaagctccagcaaaatctacaggctgtccgagaagatctggagcgtgaacgcaaggcaaatcacgacttgcgacagaaccttgacacggcaagctgcaacagtgttacactcgagtcctcagttcgcgcattgaaggcaagaatagaattcctggaatcgggacgggaagagcagtctcaggcctttgagcgtctcaaccagcagatgaatgatgccctggctgaaactgaggcgacaagggagaagctgaggaaagaggaaactttgagaaggaagctgcacaatcaggtgcaggagctcaagggcaacattcgcgtgttttgtcgagtgcgcccgtccttagagtccgaagttgcggaaaccgctcaaatcgagtacccggaccagtcagacgaatgcaaggagatttgtcttctgggtccagaagaaagaagcgctctcggcaccgttacccggaagaacaacagtttcacctttgaccgcgttttcggaccttcgacacagaatgcggaggtgttcgaggaaatcagccaactcgtacagagcgccctcgatgggtacaatgtctgcatcttctgctatggccagacaggcagtggcaagacatataccatgtcttcccttgatggcatgatcccccgagcagtacatcagatctaccagaccgctcagagcctggaagagaagggctggaggtacactatggaaggcaacttcgtggaggtgtacaacgaaaacttgaacgaccttctgggcaaggcggaagagctggacaagaagaaacacgagatccgccacgacatgcagagatgtaagacgacgatcaccgacatcaccactgtgcggctggagtcgcccgagatggtcgaatctatgttaaaacgagctgcggccaatcggtcagtggcggctaccaaggccaacgaaagatcttctcggtcacactcggtcttcattctcaagctcctcggtgaaaaccacattaccggcgaacgcagcgagggaaccctaaacttagtggatctggccggcagtgaacggctcagtcacagccaggcaactggggagagactgaaggagacacagaacatcaatcgcagtctcagctgcctcggagatgtcattgcagctctcggacaaggaaaggaaggtggacacattccctaccgcaatagcaaggtttgtttcttgtcgcctcttgtcaat

SEQ ID NO: 14907 - DNA, 792 bp, A.fumigatus
catttgacagagcgacctcacattcttacggtaacagacaccacccgcgccagaagcgctacacaggcccccgagcccagccgatctgggacaggaagccttcctccgtcacgtccaggaacaagtatgggacgagttcatactagaactaattcccatgcgtcatcaactctgacccgatcggcctcaactgcttcacggactaccagaacgaatttctcctccactgttggacccggatcacggcctccttcgcatgcgccacgaccgcacacatcgcttgctggtacccgaaaaccgaacggtcactccatcactcggcccgcgacgtcattggatacccatgaagaagaggatttcgctgcaagcattttgggaaagagaaagggtaggcggcagtccctattttccctgtttgatatttattcccaccctgcatctattacaccgcatagtaaggacaggaagttgtcgtgcgattggtctgactcgcaacggaagctccttggtattcaagaggcccctttgcgaattggtcaactcgaggcatcaccatgtcctgctttggatgagtcggcaaaggatcccgtttcccaagacatgctggacccaaaacccgtgcacctcgcgcaggatggacccattaaacctcctccctcaaagatccccgtatcttctccccgtgagacacgcattcgagatgcctgcatctaccccaaaaccttctcccaggaaaaagaaaccacctatcgtaccatttctgcacagagattcttcgatcaagacgtttaa

SEQ ID NO: 14908 - DNA, 330 bp, A.fumigatus
ctcgggctgaatccaacagcggacccttcaaagtttgcctgctttccgatggctgattcggagttgtggtgtagacaagccagcgccacttgtgcaagaacctcatcctcaatcgggtccttcacgaacaactcatcacggtgcttttcaatgtatcccgtctccacctcgcccttgatgaaatctgggcttctgcaaacggctttgatgaactcgatgttggtgatagggcctgcgacctcatattcttccaaggcagctgctagtttgcggattgcctcttcccgggtggcaccgcgaacgattagttttgcgatcattgggtcgtag

SEQ ID NO: 14909 - DNA, 216 bp, A.fumigatus
  unsure (212): Identity of nucleotide sequences at the above locations are unknown.
ttaaacttacaggatgatttagctgaagccgctacgcacgacgcgttgtactttgatgatccctccctcgatgtcgaggacctttatagtgattgggacgaattgtcagatgattattatgatgacgatccaaccgttgaaaagaggcgacgcatgatcgagataacgagtcttcaccacggggatggaagtatccacggggttctatgggntcga

SEQ ID NO: 14910 - DNA, 270 bp, A.fumigatus
ccggattataggcgggtaggtcgcacggcttctcaacacggcatcaaagtgacaacgctgtacacggatcccgacagatatgctcagcatgcgttgagctcaccgtttgcgtttaatctcggctcggtttctgcatatctcgatggtgaccgtatcatcgagattgctaagagagaaggctgccaagcgatacatcctggttacggttttgtaagtgtctgcccacgtatgaacgatcgccgtacacttatcatcgttatttatagttga

SEQ ID NO: 14911 - DNA, 1737 bp, A.fumigatus
ccttcgctaatacctgaaagccagtcaaagaagatcatgacagctgcaggggtcccgtgcgttcctggctatcacggctcaaatcaagacgtgaacttcctcgaagccgaagctgataagattaagtaccccgtgcttattaaagcggtcaaaggaggcggcgggaaagggatgcgtatcgccaggtctaaagctgaattccaggctcaattgcaatctgcgaaatcagaagccatgaactcgttcggagatgaccacgtcttggtcgagaagtacattactacaccacgtcacatcgaagttcaaatctttgccgataagtacggaaattgtgtcgctttgggcgagagagattgcagcatacaaagacggcatcagaagattcttgaggagtctccagcaccccatctaccagacgctaccagaaaagatatctgggccaaggcgagagctgccgcgctggccgtaggctacgagggcgccggtaccgtcgagtttattttcgacaatgacaccggcgaattcttcttcatggagatgaacactcgactgcaagttgagcatcccgtgacagagatggtcaccggccaggacctcgttcactggcagatcaaggtcgcggagggagcccctctgccgttgactcaggaccaagttgaagctgaaatggctcaccgcggacatgccatcgaggctagaatatatgcagaaaatccggaccaaggttttatccctgactctggccgcctgctgcacgtccgcactcctccgacgtcagaagacgtaagaatagatgcaggtttcgtcgcaggagatgatgtctcagctcactacgacccaatgatcgcaaaactaatcgttcgcggtgccacccgggaagaggcaatccgcaaactagcagctgccttggaagaatatgaggtcgcaggccctatcaccaacatcgagttcatcaaagccgtttgcagaagcccagatttcatcaagggcgaggtggagacgggatacattgaaaagcaccgtgatgagttgttcgtgaaggacccgattgaggatgaggttcttgcacaagtggcgctggcttgtctacaccacaactccgaatcagccatcggaaagcaggcaaactttgaagggtccgctgttggattcagcccgagctatcaagtacgagagatgacattggcagaaatgactccggcccggaaagacggcacaaaattcaatgttcgtgtcaagcagactggcaacaacgtgtttgatatcgaggttggcagtcgtattttcgagcaagtgacgagccacagtgatcccgcatccagagtcgtcacatccttctttccccacactcgacttgacacgactgtgatacaagacggggattccgtcgtcgcgttccagcgaggtaatcaataccgcctaacgatcccccgggccaaatggatggaaaaagcattgggcatgaaggatgtcaccaacagtgtcttggccccaatgccctgcaaggtgctgcgcgtggaggtcaaggcaggcgatgtggtggagaaagaccaaccattggttgtaattgagagtatgaagatggaaacagtaattcgcagccctcagaagggaaccatctccaaagtggtacatcaaaaaggggtaggtcatgcgacacttcttttttttctttccttgtgtttttgtttttacccccaccccggcattgttcccgtttattggtcggtcacttga

SEQ ID NO: 14912 - DNA, 252 bp, A.fumigatus
accccctcaccaggaaacatctactccaccgcaaaccccacctcagcaaaggatctcatcaccccgacaatcaaacaagataccttcacaaccggtcgcggcggctcaggaaacatggtccagtatgatcccgagcgtccagagatcgcacgcgagctgcaggacgtaaaatcgccgccgcagcgggtggaggaagccccgcaccatacgggacggggtagggtatgcctattcttatcttccccgcgttga

SEQ ID NO: 14913 - DNA, 1131 bp, A.fumigatus
tcgcccttccagcccgaatccatcgttgaagaccggcatagctccaaggtcaatttgagcatcaataagctgcttgaggtggaagagcacatatggtctccgatgtatggactcaaaggcaatattgatgctacagtccaagttgcatgcaatgatggggagggcaacagaaatcttgttgtccctctggagctcaagacaggcaacagagacacaaatcaggcacacagggctcagactgcgctttataccttgttgctttctgatcgctacggtaagctttccagccgcaattactctccggactttgtctcactgattctacgttttcaagacgtcgacgtaaccttcgggctactttattatcttgaaatatcgaagatatttcgcatccgtggtgtcagacatgagctcttgcaaatgatccaggaacgtaaccggctggcgggttttgtccgtgaaagactccaacttccaccgatggtgaagaagccaggcatgtgcaacaggtgttactcaaagacgccttgcttgatctatcataagcttgcggacgacggagatggcgaaactagcggacttggcgatgaattcgtcaaggctatggactatttgacgccccaacatcgagacttttttaagaaatgggacgatctgctgacgaaggaggaacagagcatgatgcgattcaagcgagaactctggactttgttgagtagtgagcgagaggctctcgggcgttgcttcgggaatgtcgtgattcaaccagggtccgcatacgaggacaaagagagcacaaagattaatcgcttcagatacacctttgtcaagaaacatcctttgccttccttctctttcactgaatcgcaactgaccgtgggagagccgattgttgtatccgatgagaaaggtcactttgcgctcgccaacggatacgttgtgcaggtcagcccaaagcacataatagtcgcagtcgatcggagattgcacaatacaagaacaaagacaaagggatttgatgcgagcaaaaaccaatcattccgaggcatcgcggaacttctgggagatgggcccttaccttcaagctacttctcacgagccggaggaggagattctttatcgactggataa

SEQ ID NO: 14914 - DNA, 630 bp, A.fumigatus
ttcgatccctgtagcggtcccttccagccccgcggtgaaacgttggttcaggatgagagaactaaaaacaaaaaggcagtaatcttgcgagaatcttggtttgacagcccatgcagtaagggcgcatatattcacctgaccggcgatttcgatgcagcagggcagtgcattgtcgatgatgcccataatatgattatacttcacccagatcacctaatatctgcgaccgttgttgcagactcgatcagttgccaacgaagagcagttcttcaggaccgtatcaagaattcgagcgacattagcaagcctcaagtgttcggaaatatctttcatgagttctttcaggaagctatgaaagtcaacaaatgggacctgaagtctttgagggctttagtggaggctattcttgtcagacacgttgaagacttatacttgatccagatgaccgttccggaagccgtcgagtacatgatgagcagagtcccagctctgaaaggctgggcagaggtcttccttcggcccactccgagtgtaagtgcatcctgcaggagttgcgacgctttggtaattaatcgcccttccagcccgaatccatcgttgaagaccggcatagctccaaggtcaatttga

SEQ ID NO: 14915 - DNA, 1899 bp, A.fumigatus
tcgcagtcgatcggagattgcacaatacaagaacaaagacaaagggatttgatgcgagcaaaaaccaatcattccgaggcatcgcggaacttctgggagatgggcccttaccttcaagctacttctcacgagccggaggaggagattctttatcgactggataaggacgaattcagcaacggcatggcgatcgttcgaaacaatctcatttgcatgatggaaaaggacctatttcaagcgaatcgactcagaaaactcattgttgagggagaaacacccattttcaagccgtcaccatcagcttttccattgtctgactccgccaaagcaagcctaaatgtcgatcagaaaagagccatagaaaaagtcatgagtgcgcgagattatgcgctagttcttggtatgcccggcacaggaaagacaacaaccattgcccatatcattcgagcattggtggcgcaaggaaagagtgttctcttgacgtcgtacacgcacaccgcagtcgataatatcctactaaagatccgagatgacaatttccgcattctgcggataggagctactgcaaaggtgcatactgaagtacagcagtttgtcgatcttgcggcagtccctaagtccaccgtcgaagagctgaaagcatcctatgaagagtcacaagtagtcgcgacgacttgtcttggggtcaaccacaatatcttcaatagacgcgtattcgactattgcattgttgacgaggcctcgcaaatcactcttccagtatgcttagggccgatccgaatggcgcgcacattcattcttgttggggaccattaccaactgccacctttggtgcaaaacaagcaagctcaagagggaggactcgatgtcagtctgttcaagctcctttccgatgcacatcctgagtcggtggtcaatcttgaacaccaatatcggatgtgtgaggatattatggtcctttccaacaatcttatctactcgggacgtctgaaatgtggaactcctgcggttgcatcgcgctccttggatctgcccaacattggcggtctcaagctgcaccatatcaaccaactaccgcagtcatcaaatcaacggcaattctgtttgggcacgaaccaaggccgctgctggctacgggacgtgcttgatccgtctgcaaagaaccgttttatcaacacagacacgcttgggatcccagcccgagatgtggcaaacggcactatgattgtaaatccaactgagtcttctatttgcgcacagctcgtggagtcattggtttcgtgcggcataccagcacgtaacattggtgttatcactttctaccgcagccagctctccctgttgaagcagaatcttcgtcgatacctaccacagcttgaaatgcatacagcagacaaatttcaaggccgagataaggaagtcgtgttactaagctgtgttcggagcaacgtcgacaataacgttggcgatcttctccgagattggagacggatcaacgtcgcctttacgcgtgcgcggactaagttgctcgttattggaagcaagagtactctgcgggacggtaatgacctgcttcgcaaatacataagcatggtggaagaacgaagatgggtatatgatttgcccaaatgtgctttggaaagccacatcttcaactgcgacgtgagctttcctccatcactcgatgcagacaagtcaccatccaagggaagcagaagtctcccaaagacttctccttcgccgaaagcacctcgtaatcccctcagcccaatagagggccaaccatcgcgtcgaggtctcaagaaacccgctaagacaggagccaaacttctaagcgggagtaatgtcattggaaatagacctgtgttacaggacgtggtaaatgaactcattggttaa

SEQ ID NO: 14916 - DNA, 213 bp, A.fumigatus
gtgatctgggtgaagtataatcatattatgggcatcatcgacaatgcactgccctgctgcatcgaaatcgccggtcaggtgaatatatgcgcccttactgcatgggctgtcaaaccaagattctcgcaagattactgcctttttgtttttagttctctcatcctgaaccaacgtttcaccgcggggctggaagggaccgctacagggatcgaa

SEQ ID NO: 14917 - DNA, 252 bp, A.fumigatus
acattggtatgtgaaacttgtgcctccaacccgtcccgtctcaacgccgtcctaatgacgccccgcgccacaggcaagtacggagcccaggtcaacggcgccctcacggctgcccaccagcccaccgacgacgcccacatccgtgaatccctcttccactgcaatggtggcgccgacggcgatatctccttcatcaagtactgcggtggtggctgcaagaatggcggcaatgaccgcagcgactactgctag

SEQ ID NO: 14918 - DNA, 879 bp, A.fumigatus
  unsure (819): Identity of nucleotide sequences at the above locations are unknown.
gtccaacttggacgcacccgcggggcagagatgattcatgagagcctagcgctttgcggtcttcccatttccgttctagtggttcactgcttacccctcgtcgcatttcaacgtcaccagactagtttactctccctatgcatcgtctacaaaatggcatacaacctgtcagatattttgaagagtgcgtcggtagacttggctccgtacgaggatctctacaagtatttccacgcccatcctgaactctcgctgcaagaagaagctacctctcaaacggtcgcagcccatttatcccagttcaacgcgtatgagatccacaccaacatcggcggctatgggctcgcatgcgtcctcaggaatggcgatggcaagaacgtcctcctgcgagcggacatggacgcactccccgtcaaggaacttaccggactgccgtacgcgagcacagtcaggatgcgcgacgccgaaggggtcgaaaaaacagtgatgcacgcctgcggacatgacatgcacatgacatgcctgctcgcggcagcggaaactcttgcgaacatgcagcatgcatggagcggaacgctgatcgtgctgttccagcccaaccaggaacccggcggtggcgcccaaggcgatggtggaacgatggcctctaactccaataatccccgtgccgggattatgtctttggccagcacgtcatgcgcatgcgggccgaaagcgttggctgccgcccgggaaccatcatggctgctgctgatagtctcaagtcaccgtctatgggcgcggtggccatggatccctgccgcatcagaccgtcgatcntgcgcttctcgctgcgcacattgttgtcagactgcaggggattgtgagccgagagattga

SEQ ID NO: 14919 - DNA, 660 bp, A.fumigatus
  unsure (62): Identity of nucleotide sequences at the above locations are unknown.
tctcaagtcaccgtctatgggcgcggtggccatggatccctgccgcatcagaccgtcgatcntgcgcttctcgctgcgcacattgttgtcagactgcaggggattgtgagccgagagattgaccccagcgacttcgccgtcgtgactgttggaagtctgcaagcggggcagaccgagaatatcattgcggaccgggcggaggttgggcttgatttccggaccgtcaagctggagactcggcagaagatcctctctgctgtccagcgcattgtcgaggccgagtgcatggccagtggctcgccgaaaccgccggtgtttactcccacgcgccggtttccgccaacggtcaacgacgaacaggtggcgtctcagttggcggcgtcgtttgcacagcattttgaggattttgacggggatacaccgaggaccaatgtcagcgaagacttttctacgctgggtacttgcagaggtattccgtgctgcttttgggtccttgggggtatcgatgcagaactctgggaccaggcagtgagagaagacagtcacacagatgagatccctggcaaccactcggcgctttttgcgccagttatacagccaacgatgagagctggagtggatgctctctgccttgcagctttgacgtttctgaggaaatag

SEQ ID NO: 14920 - DNA, 552 bp, A.fumigatus
  unsure (150): Identity of nucleotide sequences at the above locations are unknown.
atcaagattcggtctctgtctatcgtcgtgggtttgatgcttgtgttccgcaatcagacatcctacaatagattctgggacggccgcaacggcatgaacacaattgtcacctgtgtgcgcaatctggtccgtacgattatcacaaacagntacagtgagcgcggccctcccaccgccgctgaacagcaggacgtcgagcggacgatcagtgtgatcatggcaattccctatgctgtcaagaaccaccttcgggatgaatggggcgcggcatgggctctagggagtgatgtcaatgagaacggcaccgcggtgtatgacgcagattacgcgagtctccttcccgtgggtctggaaggtcatgagcatgacggcctgggtctacctttccagttgaccttctttgtggatgggtttatcaaacggggcgtggaacgggggtggttcaatgctcccggagcaagtcagatgcaggcccagctgaacacattgacagatgcgtatgggaggatggaaaccatcaaattgactcctatacctgtcgctcatttgtga

SEQ ID NO: 14921 - DNA, 330 bp, A.fumigatus
atgacaggcatctattgcacaaatgacagcacgcaccaggtgatgattcaaacgagggctacgctggtccgagccgcggactacaagaggtacgaagagaaagccgggaggagcttcaatcgggccatgatttgtgttcaatcgtttggagcgcatcaactgtcgatggttcagcaaagcatcgtcgtgatgatcaagaaatcctacctccaaagcatgaagttgtataaccccgtcaacataattgaagttcttggcgataacgacgtcgacgactttcatgtccccgaatacattacggaaaccaggagacctcgtacaatctcttga

SEQ ID NO: 14922 - DNA, 1803 bp, A.fumigatus
  unsure (59),(240): Identity of nucleotide sequences at the above locations are unknown.
caagtggcaacgtcagcatgcgaatatttaggcctgaataaccagattcatccttccanaagacctcttaaactcccaagattaccatttccaaaaacaatggcaacgaacgaccagcccgttgtcatagtaggcgccggcctagcaggtctggtggccgcctacgagctctccaaccgcaacatccggtccatcatcgtcgaccaggaaagcgaagccaacctaggcggacaagcattntggtccctcggaggaatcttctgcgtaaactcaagtaaccagcgccgactgggcatccgcgacagtcgagagctagccatggaagattggttcagcagcgcggcatttgaccgcgaaacggaccattggccgaggaaatgggcagaagcgtttgttaacttcgcgacagatcatatggagtcgtaccttggtgcattgggcgtgcggtttgtcagtgtgggctgggctgaacgcgggagtgggcaggctggcggccatggcaactctgttccgcgattccatctcacatggggaacagggccggcgatcgtcgaggcgttcgctggtccggtgaaagaggcggcgaagaaagggctggttgagtttcgattccggcatcaggttgatgaaattatcgttgatggtgagacaggtgctgcggtgggtgttcgtgggcaggtactggagccaacagacgtggagcgaggtgttgcttcttcgcggaagagcgttgggtactttgagcttcgaggcgctgcggtacttgtcgcctcaggtggtattggcgggaacctggatctggtgaagaaatactggccggtggatcggctgggtcctaaggtgccgcagtcgttcgtgctgggggttcctgcgcatgttgatggccgcatgattgatatctccaggaaagccggtgccagcgtggtcaacagcgaccggatgtggcattacactgagggattgaccaactggaacccgatctggccaaagcatgggattcgagtcattcctggaccatcctctctctggctcgatgctacgggaaagcggctgcctccgtttttgtatcccggctgcgatacacttgctactctacggcatatatgctcgactggttatgactacacctggtttgtcttgaacaaaagcatcatcgcccgtgaattcgccctctctgggtcagaacagaacccggacatcaccggcaaaagtatcctccttctactccagcggatattcggctccaatggcacgggccctgtacaggtcttcatgaaaaatggagaagatttcatcgtggagacgtccctgaatgatctacttaagagaatggataacctcgggcaaaaacatggaggtccaccactagacgtgaaccaagttaaaagggaaatcgagctccgtgacgcacaggtagacaacagctacacaaaagacgcgcaattgatgctaatccagaatgcacgcgacttctggcctgataaattcagcagagttgtcaaacctcacaagctcctggaccaaagctacggcccgctgattgccgtcagaatgaacctcctcaccagaaagaccctcggtggactagagacagacctgagcgcaaatgttctccgtcaggacgggagtcacttcacgaatctgtatgccgctggtgaagttgcaggttttggaggcggcggtgtgcatggatacaattcccttgaaggcacattcctggggggctgcattttctcaggacgaactgcaggcattgccatggccgacaaactggcgaaggcccctgcgacacagtcctcgtaa

SEQ ID NO: 14923 - DNA, 207 bp, A.fumigatus
tttgtattaaagttgctggatcaaatacaacagctaagcgcctccgtctcggtgggcgcagacattacacggtatcagcaagatattgttgtattcttgcgactaagccgcgctgttgctgggggcatcacagcacggtcaaacatgcagtttacgaaactctcaaagtacgtccagctaattagactccctaaagaatgcgcctaa

SEQ ID NO: 14924 - DNA, 1008 bp, A.fumigatus
ggtatggaaactgttttgttgaaggctatgcagcgtgcgaaatactatgtggccagcactgtacaggatgagcagcgccatcactacaccctcaacctacccgtctacactcatttcaccaacccatcccgtcgctatgcggatattatcgttcatcgtcagctggaggccgtcttgtcgaatggtgcaatcgacttctcagatgacgtggagtctctgagcaagacggcggatctgtgcaatactaagaaggattcggcgcacaatgcgcaggagcagagcgttcatatccaggcttgccgtagtatggacaagaagagacaagagatcggtggcgacttgatcagtgagggaatcgtactttgtgtctatgagtcggccttcgatgtcctcattcccgagtttggtttcgagaagcgtgtccactgtgaccaactacctctgaagaaggccgagtaccgcaaggagacccgtgttctggagctctattgggagaagggtgttccatcttccgcgtacattccagaggacgaaaggcctagacctgccaattctcgcgctgctcaagctgcggccgcggctcgcgaagcagaagcggcaagagagcgtgcgcgcgaacgtgatgaagcgatccgcaagcagactgagactgggaccatgtctgcggatgatgtcgatgctctcttcgacgatgacgacgatatctccgaggtcaccgagatggctgcaggtgtctctttgaactcgtctgctgaccgcacaactcagagcatgccaccttcaccgactcgtaatggccatcttcagcagactcctcaccgtacccgatccgatcccaagatgccaagcgtcaacaatgacgtgccggaagccaagttgaccaacaaggagaagtacctcaaactgttcaagcttcgcgaggaggacggagagtacattcaggatgtgaccgagatgacccgggttcccatcattctcaagactgacttgaccaagagccctccgtaa

SEQ ID NO: 14925 - DNA, 1422 bp, A.fumigatus
gggctacgcggatctccggcccgtggtgaggatctggacgccgacatcttcatctgtggaagcaaagaccggaaccgtgccctcgaaggtgattttgttgccgttgaactcctggacgtggacgaggtgtggtctcagaagaaagaaaaggaagagaaaaagaaacgcaaagatatcacagatgctcgctccggcagcaccgcaggaacggataaattatcgaggtcggactccgctgccaatggcgatcgacaggaaattggacccgatggcagcatccggcgtcgtggaagtctgcgccaacgaccgacacagaagaagaatgacgacgttgaagtcgagggccagagcctccttctcgtcgaggaagatgagatcagtgacgaacagaagcctctttacgcgggtcatatcgttgctgtcattgagcgtattgccggccaaatgttctcgggaactttggggctccttcggcctagcagccaggctacaaaggagaagcaggaagccgaacggcaggccagagagggcggtagcgcccgtcagcagcatgatcgtcaacaggaaaagccgaagatcgtgtggttcaagcctactgacaagcgtgtccctctcatcgctatccctactgagcaggcacctcgcgatttcgtggagaaacatcaggaatatgccaaccgtatctttgtcgcttgcattaagagatggccaatcacatcccttcatccctttggtactctcgtggaacagctcggtgaaatgggcgatttgaaggtagaaacagatgctcttctccgggacaacaacttcggtgccgacgagttctcagatgccgtgctcaagagtatcggctgggaggactggtccgtttccagcgaaggcgatgcgcttctggagtcccgccgggatttccgttcggaaaccaccttcaccatcgatccaagcggagctatagagctggataatgcctatcacatcaagcctctggccgatggcaaggtcgagattggtatccacgtttctgatatcgcccactttgtgaaggcgaactcgctggttgaccgcgaagcaaagaagcgaggcacagcggtctacctcatggaccgactggtcaatatgctccctcggcgagtgtctacggagctctgctctctccttccagaacaggatcgccttacggtcagcgttgtattcactgctaatccagaaaccggcgctgtcgacgacgatgtttggatcggcaagagtattatcaaaagtgcaggcagattgagttatgatgaggtgaactctgtgatcaagggagagaccaatgtatccgttgccggaatctccgccaacatcattcagaccctcaatgtcggtaacccgttatcccaatttcctcttccaggactgagcactaatttacttgggttatag

SEQ ID NO: 14926 - DNA, 438 bp, A.fumigatus
actatcacacggaaatttcgcgaagctaggtttggcaaccgtgtctcgaaccccccacctctgcgccttttatatcagctggatgatgagaatgtgcctgtagaaaggaacatcttcgattctactgattcacgtgaactggtggaggaattgagacacaaggcaaacttcttcgttgcccgcaaattggtttccgccatgcctgacaaggccttccttcgccgtcaaccatcgcctaactcccgccgccttcattccttcattgatcggatgaatcgcctcggctacgactttgacccttcgagcagtggaactctgcagagcagcctttgcaaagtacaggatgatgacctgcggaaggttcgtgttttactaaggacattacttcattccactgacatactgaccgggattagggtatggaaactgttttgttga

SEQ ID NO: 14927 - DNA, 399 bp, A.fumigatus
  unsure (9): Identity of nucleotide sequences at the above locations are unknown.
ccgcctcangaaaagaacgtcgccgccaaccaccccacgcaccgcggttcctccccacagccgccaccacaacgaaaatctcccaagctctccctcctcgacaagggcatcaacacctcagcccgcatccgcgacgacgtgatcatcatcttcgaagacgcctcggatccttccgacctgcagtccaacgacagcaaggagaatcatgctgcgctccatgcgtccaaagggatgggcccgtccgcgcggaagagtccgcactaccccacatcgcttctcgccccttccacggcggttacttgtccgtcgggctcgaagtccagagcggtgtctggttcgcggaaggcctcgtcctcaagcatgaaggcaaagcctcggattgggatacgcagattatag

SEQ ID NO: 14928 - DNA, 441 bp, A.fumigatus
atcagcgaatggaactacatcagattcgtttctctaatatcccgttcttcacaccgagcatcttctcttcccgacccccgccctcccccaaaacctcctccgaacccgcatcaaccccctccaccgtgcccctgctgttgtaaatctcatccgccagcacagcccgctcaatcaagctctcgcgcgccgggaaccaaaccgacagacccacatacacgatactcgtcgccacgaaccctaacagccacccaaactggtacggatggatcccgaccccaacatcaatgctactgttcacagacgcgatcaaacccggtagattcggcgcaacgccaaccaggaacgcgacgaaggcgcgccagttcgtcccccacgaggaataccgatacgtcgggtttgacggctgatacagcgccagggtatcgtacttccgccgcttga

SEQ ID NO: 14929 - DNA, 213 bp, A.fumigatus
gatgaacagtttataccgttgacgacactagtatcaggtcaatggctggccattattgtttcctcttttcgtatgcccggtagcgctcagcaattcgatcctttcaaccctgagccattctttggtgagttagcctggcacgaggtactcgagttaaatgatccccttattaccttttttgaaactctcttcgaaggcctaatcctcttctaa

SEQ ID NO: 14930 - DNA, 885 bp, A.fumigatus
ccgacaaagtccgacttctctcgatactcccgcgtcagccctaaatggcagctcctctacatccccatgctccccatcgtcttcaccttcatcaccttcatcggcatcgccgcctcatccgccggccagtcgcgctacggcggcgagatcccctgggacccgatcgtgctgatcagtcattggaccagccgcgcctgccgcttcttcgccgccttctccttcgccctcgcctccctaggcgtcaacatctccgccaactccatctccgccgccaacgacctgaccgcgctcgcaccgcaatacatcaacctgcgccgcgggcagatcatctgcgcaatcctgtcgtggtgtctcgtcccctggaagatcctcgcgtccgcgggaagcttcctgaacttcatgtccgcgtacgctatcttcctcggccccgtcggcgcaatcatgctctgggacttttggcttgtcaagcggcggaagtacgataccctggcgctgtatcagccgtcaaacccgacgtatcggtattcctcgtgggggacgaactggcgcgccttcgtcgcgttcctggttggcgttgcgccgaatctaccgggtttgatcgcgtctgtgaacagtagcattgatgttggggtcgggatccatccgtaccagtttgggtggctgttagggttcgtggcgacgagtatcgtgtatgtgggtctgtcggtttggttcccggcgcgcgagagcttgattgagcgggctgtgctggcggatgagatttacaacagcaggggcacggtggagggggttgatgcgggttcggaggaggttttgggggagggcgggggtcgggaagagaagatgctcggtgtgaagaacgggatattagagaaacgaatctga

SEQ ID NO: 14931 - DNA, 1230 bp, A.fumigatus
ggctacagaggtagacatgaatgctatctaggccttgtcgtgtacccgaggctgaggtggagcctaacggcctcaggcctcaggactagcctagctccatcagataagattagatggctggttggctgtcgctccttcttcccctcacacgcctcccacgttgggtcatctgcacaaaatcgtatgttactgacaccaccagggctattaaaagggcggtttcttcccttccaaggttgctttcatccacatctctacatctccgcatctcctcagtctgactactttcatagcatctcgccaaccagccagtccgctcgggttgtttctctcgaaaacatgggtcgtgccacccttttctccgcacttgcttttcttgccggtcatgtcctgcaagcgaccgctattccatcggctttcccgcaagacaatgccgtcaaccaggtgcttctgagcgattcatatcaagaccagtctgtttcgtcaatatccgcagaagacgacgcccaaaacagtgatgtcatccatatcggcgaaagcgagacaatgcgagcaccatcttggttcacctcaacacttatggctcgtcgtctcctagccctgtcaacaactggcaccgtctcgaccatctttcctgacccgctccccggcaattcccacgcgcccccctctgtggccggcctcccaattagcctcccagagtacatcgccgattgcgacgaatacctccccgcagacgtcagcaacggtggcaacggcgacccgaccttcctcgccctccacatctcaacaacctttcgcaacaccgccgccggctcaaacgtcagcctcgccatcgactggtgggatcacttgaaccagaccgagcccgtcgcgccggggtttcctccgagcgaagcaggtctcccgcgcgtcacgctgattgggtacgtggagccgtttgatacgcctctgcacagggatatagaggccgcgctggaggagtgttatctgagcgtgcatccggatgcgagtgcctggttgccgggaaagcctggggcgccgcactcgagctactgggcgaagatggtagtggagcaagtctattggatcggcggatttgggggcttgcagcagattgggtggatgaatgtcactgagtggaaggggatccggcgtgtgcgtagtttgcctggtgtcggtgatgggaggggatgggaagatgtgagacttcctggggagaaggagtaa

SEQ ID NO: 14932 - DNA, 978 bp, A.fumigatus
tttatctttgctccacatggtctcttcttgagattccttgttcttacagtaatactccatcgccctacgatgatattctcacgaccccgtctgcgcatcacccagcccaagtcggctttcgcagagggaaatgcccgctggaccaacctcgatctcgatcccgtccctcatcaccgtcgaaaatggggtccattgagttttgtcggtgagatatcaccgatccaatttctgggccttgcattgctgactccgaccatagcgtactggatctccgacgccttcaacgccgcaacatggcagttcgctagtagcatcattgcggtcgggctgagctggcgcgagtccctcgccatcgtggccatctcattctttatcatttccttcgtcattgccgccaatggtgccgtgggggccatctaccacatcccgtttcccgtcatcgcccgcgcgagctggggcttctggggctcctacgtcgccatcatttctcgggtgatcctggcggttttctggtttgccatacagaatgtcaacgggggaaatgccgtccggtgcatgatcggcgccatctggccgagtttcctgacgttgaagaatgacatccccgaggcccagggcatcacgactgccgggatggtgggatacctaatcttctttcttgtgcagttcccgttcctgtgtattcatccaaacaaagtgcggtggttgtttgtcgccaaatccatcatcgtgcccattgcgtggctggcgattctcgtctgggcgttcgtggccgagggcggcggagcgatctttgaccagaaacccacggtttccgggtccaagtatagctggctgttcctggcgaatatgacgtccgtactggggaactatgccacgctcagcgtgaaccaggtatgtgatgcatttctcagaggtaacaccaatatgctgaccgacaaagtccgacttctctcgatactcccgcgtcagccctaa

SEQ ID NO: 14933 - DNA, 318 bp, A.fumigatus
gttgattttgtggtccacccgtctactgagttggttaagcacttccagggtacttttcactgtttcggtgcaaaaccgaaggtgaccatcaaagacatgggcgagtgtcgttttgtttctttccacatcatctccttccttggattcggcgagcatggaatcagactggagaatgctttggaatcgacgcacattttttggaatctccatgatctttgctctaatgttgacgctgtcatgggaaatatcgtctttgatatccaaaacgactggcaagcgagcgataccgattcaattcaagacctctatctcgcttga

SEQ ID NO: 14934 - DNA, 549 bp, A.fumigatus
  unsure (8): Identity of nucleotide sequences at the above locations are unknown.
aaaaaaantacctcgaagtttacatatacgacaagtgggagagtagccaacaattgccccacttccggagtgggtgaagttttcgtgccaactgaagcgaacatgttcgagggcaagacaacggcccccaactacttgaccgaaccagaactcatcgggctcatggacgcgaacggaatagggacggacgctaccatggccgaacacattgccaaaatcaaggaacgcgagtatgtcgccgttcattcgcgaggaagtggtcgcaacgctgtgaaggaattcatcccaactcgcctaggtattgccttggtggaaggctatgacaacgtggtcgccaatctaccggataaaccatctctcagcaaaccatttctacgtaaagagatggagctccgtatgcgtgagatctgcgcaggctccaaatcgcgccaggaggttgttcaggagagcttggatatgtaccgcgaggtcttcattcatacccagagacgtatcgatatgctgaaggctgcctgtcgaaaatacctgattgagcaggccaccgtgtga

SEQ ID NO: 14935 - DNA, 201 bp, A.fumigatus
tcgatgcctcaacacgaaagacctcacattcgcaactacgtgaaccgatatgacttgtcccaaacaaccaaaactgaatctcagacggcagaaactaacaaaacaactcacatgagcatcaaccttaggattctccaaacagacaaaagacaagtaatccagctggcacaaagagcgacaaatcttctgcagaaacattag

SEQ ID NO: 14936 - DNA, 2709 bp, A.fumigatus
atcggtatcgctcgcttgccagtcgttttggatatcaaagacgatatttcccatgacagcgtcaacattagagcaaagatcatggagattccaaaaaatgtgcgtcgattccaaagcattctccagtctgattccatgctcgccgaatccaaggaaggagatgatgtggaaagaaacaaaacgacactcgcccatgtctttgatggtcaccttcggttttgcaccgaaacagtgaaaagtaccctggaagtgcttaaccaactcagtagacgggtggaccacaaaatcaacctacaagaacaaccggtagacagctacggccacagtcaaggagatcagaagcttatagatccaactaatgagtttagtctgtatcagcaagagcttctcaccaaggacaccctggaggtgacaacatcagccatggaaaagcgcattctcggaacagtggacgatcatactccagcccttgacgaggaagcgaagaagcggattggtattgagtctgcacttgcaaatatctcagcccttcacgaggaaacaaagaggcggattgataatatagagtccgaacttgcaaaggttcaacaatccctgtctgttggtgtcgttgatcaggaacagctgaacgagactgtcggtggtctcaaagcagacatggggaatctccgaacgtcattgcaatcactttctcgcgaaggtagtgactcgcaagttggtgtcgataccatcgttcacgagcaactgcaaagccttgagaatcgtgtgcggtccctcgagcgtgcggcttcagtgactccactcgacaagaagcagattgaacaagaacttgacgaactcgaccaagccgtaattaatatgaagaattcgcatgcggaaatccagtcgaagctcgactcaaccgtcaccgaaacacaagtgaaagaagccctgaaacaaatagccgcgcacctcgagcaagaaactggaggaatgaaaagccaactccgcgggctcgtggaagctttggacgaagtcaagcacgctgcgattcagtcgaagaacaatgaccctgaacttgccaaacaattggaagatattgaaagggcgatcgatgattcagcaaggaaggtacaatgcttcaaaaaagatcttgacacacatgctgtggaacacaaaagtctgcgcgaggccgttaaccgtgccttagagtggaataaggagcttgaggacggaattaagcagaagatcagcagagtaacagagactatcttggaaacgaatgcccggatgcatatatcaaccgaaaccagggataagctcgaagaatacaagtggcatcaaaggaacatgaacatgagtatttggggacacctacataaatgcatgaacgctcttggcatcagattcgacttgagcgccgctaatctagtgactgtacacgataagaaccaggatcctgtcgaaaagcctgagtcgaatgatgagcatcttgctgcagagcatggcgcacacaagaccgaaactgacgtggccgataaatggccttcacaggacgaagctcaagccgcaggatttggggttcaatcactaaagaagacagcccaacatacaaaggatgaagccaaaagcccaaagggcgaggctcaaataaaagaacaaatacagacatccgacgatcaacactgtgcgagtgcccagtctgagccgatcaatcctaggacttcaaatccagcttcccaagcaattagtggtccaaagcaatcacccgtagcaggccggagtgatgaagctgtaaagcacgacaaagcggatacagcacaatcgcgcgcagaacataatcaagaggatgagaagggccacgaatctgcttcatatgaaacacacaaagaggctatagcgcaaccgaaggcatcagtaggaacccagtctcttcaggtaccaggttctgtgaagggcaggtcatctgagaagcacgccccagagcccctccgtctgaagatcgagacacatacctccgcgaggcacgagaaggaccaggcttcggctcagttgccttcgaagcccagcattgaatctacctctgctaaactgagcaagagtaggtgggctctctcaactccgacccagcctcagtccaaaacacctactcatggcgagactgaagagggccagttgatcacgccaactctaaccgagccgccttcgaagccaatcactgagtctatctcctccggaatgagcaacagtaagtgggctccctcaactacgactcaagcgcaaccggagacattagaaagaacccaatcgcttcagacatcggggtctgcggagggcaaatcatctaagaagcacaccccaagaacacccggtttgaagcaggaggcatctgccttctccgcaaagcgagagaagagcaaaggagctgatacggcttcagctcagtcgccttcaaagtcaagcactgagtctgcctctgccgaaatgagcaagagcaggtgggcctcaaccccgacccagactcagtccaaaacacctactcatggagggactaaaggggatcagccggctagttcagcttcaaccccagaagttccgtcaaagccacccgcttctggtgaactgagcaaaagcaggtgggcggatgactctccagacgcgaagaggtcaaagggtgtttccttgccctccgaaaagtacccgaaaggagaccttggtgaaaccttttga

SEQ ID NO: 14937 - DNA, 294 bp, A.fumigatus
gattacaggggtttgatggcccgggacaagaatggcctccagatgcatccccaacaaatctccaagatgcaatcaattacaaattacaagccatataccagacggctaggcatggatagttgtattgaacatggcgaatcgtctctcccagccaaagcaggtctcatcactacagccagtgccgtcgtcgatcttaccatctggggacttcccatgaccacacctgactccgtattctttgatgcagcaagtaaacggtcgggacgaaagtggacccagagcatgaggatatga

SEQ ID NO: 14938 - DNA, 831 bp, A.fumigatus
agtggctggccagaaattttcaggcgcaatctaaacaactgccattgtcatcagatcttgctcggttgttcacatgatgatacgtatgctcggtttctcagagaaacaatggtggactacaagtacataggaagggtgactctcatcgagggcgttccgttacggggagacatgaaggcaatgaagccttcctacagagtcgcaaaatttactcacatattccgagagacgaacattgtatcggcgtcggcttcccaggaaaccaatgcccgttcgtcccttacaccatcgccagttcagcatgcaacctcactctcgaaaacgtccgcaaataccacgatgacaagtaacagtcctgcattgtccacctcttcaaggaaaatgccaaaatccgaggaatttcaaccggttgttcgctccattcgctctaaggcatcgagctcttcgcctcccaagatcgtggaacggaacaagtatggtcagcgtgtcgaccgctttgatatcaagacaatctcaaaggatgatttggcccgtatgaagaagctgaagctttgcaactatttctacctaaagggcgaatgtcccatcgaggattgccgtcatgatcactcacgcaaattaaccaaaagcgagtaccataccctgatgatcgttgcacgcatgacgccttgtcgctacaaattcgagtgcgatgatcctgactgtatgtacggtcatcgttgccctcatagcgagcccggcaaaagggagtgtgtctggggctcgacttgccgattcgatgccgccgcccatggagtagatacgataattgtcaaggtcacgaaaatatga

SEQ ID NO: 14939 - DNA, 285 bp, A.fumigatus
aaacaggcaaacaaggtgggaaaattgcagttaaccaagctttcaattccatgcagggattatattcaaattcatttccccaacattgcctcaccaaagttcgtgacaatgatctatatgaatgtgaagggactggccgacctctgcattcaaggtggaatcaaaatggagctctcggtactcgaggcgtttgtgcgaggcttcaatggcaacggtttgctttctgatatcatcgatgttggcactggcaaaaataaagcgagcgataagattgaaggtacgtga

SEQ ID NO: 14940 - DNA, 1131 bp, A.fumigatus
actctacgttctgtgaaatccgtagtctctgcacccaagtcaaattccaatcaaaagttttccctcatcaaagatgttgaagaaagaacctttgtggatctcaccggcgaagtagtcaagatttttaccaacgatagcgagaaggtcgccctctatctgactgactacaccgcgaacgaagggcttcacaactacaccattgacgccaacaatgctcgtgaaggggatcagtttgcttacctatcacaccccaagagacaatggcaaggccctgctggtcgcatgactctccagataactctctgggaaccacatgcttcctttgcccgagaacatctcaaggagggcagcttcgttcgattgagaaatgtccatatcaaacgaagtcgcatagaagggtctccattggaaggggctatgcactgcgatcgccagaatcccgatgaaatgaacatccgtttgatcgacgctaagaacgatgaccgcggccgagagttgctgcgtcgcagaaagaagtattgggaaagcaaccctcgaaagcgtaaagctgaagagttggaggagacaacttcccatcgcagcaagtcacagaaaagccaaaacaagataccgacagcgaaaaaggaagaaggtcagacctcgctctcgttgcccagaaaacacgaagtcaataagactagtaagctcatcctcgtccagaccacaagaaccaaacctaatcaatgtccggaaacagttcaggcatcaaatccatctatcaaatgcacgagtcttgcggacatcttagacggcgagtttcacgaaaatatctcgcctaatcagattgaatatcggattccttttcaaaatgtttgttaccgagccactgtacgcgtggttgactttttccctccaaaactggaagatttcgccgttccagaagagtcagatcataagccgcgtcttgacgccgaggtggatgaaatacacaacttccatcgtgcggatcgttccattagatggcaatggcggttctgccttctggttgaaaatgtaccgcctcatccacatgggaagtccagccagcgaatgaagctatttgtttctggagctgatgctgagtatctgctcaagcttgacgccgccaagtaa

SEQ ID NO: 14941 - DNA, 1455 bp, A.fumigatus
ggggaaattggttttgcaggaccggcttcgcgtcgtactgagaagtcggcgaccggtagcaagaggtcgccttcgaatgcctcagtcaaccctctccaactcgcgtcgaccattctcaaatcgtgccccatgtatgacacgatcgcgatcttgatctttctgctccaacttccccccatggttctcactctggttcagtttttgttcgcctctttgacctttttgccccctagcggtgcgtcggccggttccttgacatccaatttcgacatctttcaaggccccgccggaactccttctctcggtacaatgattgcgatggatggattctgtctactcatttggggcttgttcatgtggacctgggcgcagaatttcgcgctggacttggctcacgttcaagttgccatcaccctaggtggaggaggatttggaaaaaacgggggggtgaacaccctctgtgttggtatagttttgataatgcaccttgtacggagcaagggtatacaggattttgtcataggtcatcttctttcctcgaacatcatcagccccgatatgttgtcgcaatattcgcatcttttgcctaccgagtttcgacgtactgaaccacagacgtcgccaagctggcttcggagtctactcgcagttcatatactggctcaagccggcaccgccatggcgagacggtcaatggcgaagaacagaacgcctaatcctcctcgtacaggcaagcgcatcgacacggaagcgtccgccggctcgcagacacaaatcgattctgccttcgagtcaggggccagtgtttcgtcatatatcggtgctgatgggcaaattgtcacttcggcagcgcacaaggatggtagggatcgattactctcggcgaagaaacgcaggagacaggcaaatcaggtgcggagtcgtcaaccattttgggcggctctggcaagcacaaagataaccgtcatgagagagtatgaacactctagggctttgtcgaagacggctcgcagtcttcccatgaccgaggatgatctccaaggactctccctggacgatggactcgtatggattacggaaatcgatagttcaacgataaaattcgcggctggtgatttttcttcggcggatgattcgagcggttcgggagcctgcgaagctggatgtctggggagcgaggatatggagccgttctatgtgtgcgtgaatggagctctatgggccaccgctacaatatgcaaagtgcacgatgcaccgaaaggatcaagtatggtacattggcgaggagagatttctggtctggcccccaattgtgcttacacttgctcgtttgtgcggagcgataccgatgaagagatatgtgtcattagtgtcaaaactcctgcgaacaatgatgcagaacaaggtaagaacgatgtcttgtggatctttcacgcattggaaaaatcttattaa

SEQ ID NO: 14942 - DNA, 1326 bp, A.fumigatus
ctccctcaagcagcagtctcttcggtatccaccccaccgcacccgtcgtatcgtccttcatccccaacgaccacgctgaagaactctattgtcaacgccgaagccaaattaaatgagaagcggtctcggctcagaaaggccaagaacgatcacaagcttatcatttccaaaatcaggaaggagcttgacaattacaaccatcgtctacatagcggaacagatgaaaacaggcagaaacagcgctcgctgcaactagaaaggaacattcggcaaacggaagaggccactgccttgcttgaggatcagcttgacaacttggagaatgtccccgaggaagaacttcgaaagtggtcagaccagaaagccaaatacgaacatgagctgggtctgcttaattcggcaaaggaggaactggcctctgctcggtccgctattgcccgtgaagtctcgtccttggaaactgagttgagctccgcgattcagaggcgggagcgtctccaaagccgccgtactaggatcaacgaacaatatgagaggattgtctctgccaatgcgcaagggctcaatgagcgcgaacgtcgcgcagcagaacagtttgcccgagagcaggaccaagcaaaactcgaagcgactttcaacgaacagtttgccactattggccagtctgtgcaagagtaccagttacgcgcgcaacaaatctggcaacaatgtgacgcaatcgagcaagccatccagcagcaacaccagcagatgctcttggatcctggtccgttgacccccgagggtaatttgcccgggacgaatccgttctccgagtctgccttgccactgggcgcattgacgtcgactgctccgagcagcagatcactgctagggctcagcttcccgcctttgaagtccagtccccttcagaccgcgtcctctccggttggtgcgtcatcttctcaccccacgagcccagtgcagcagccatcgtatcttaacttcccgacttccccccttgtcaatgcaagctctcaccttgattcggattttgtgtatcgtcatcgatctttctcgaaccggtctgctcgaagcagcctctatggctccgacttcatggactcgagtcgtcgtcagccattccagctcgacttgtctgagctgcttgctgacaagagaagcccgggatccgatagcaataccgctctgaattcgggcttgagacctgtttccagcccttgccaacgggcgggtagccgtggaagcggtagtggaagcaatggaagtggtggaagtggtagcggaagcggcagtcctagttctgtgtacggtaaaaccaactag

SEQ ID NO: 14943 - DNA, 225 bp, A.fumigatus
actccgaagccagcttggcgacgtctgtggttcagtacgtcgaaactcggtaggcaaaagatgcgaatattgcgacaacatatcggggctgatgatgttcgaggaaagaagatgacctatgacaaaatcctgtatacccttgctccgtacaaggtgcattatcaaaactataccaacacagagggtgttcacccccccgttttttccaaatcctcctccacctag

SEQ ID NO: 14944 - DNA, 273 bp, A.fumigatus
tacgagattatgaactcgcccgaccgtgcctgccaccttgccaagcaggctttcgacgatgccattgccgagctagactctctttccgaggagagctaccgtgatagcaccctgatcatgcagctgttgcgtgataacctcactctgtggacctcttctgacggcaacgaggccgagggtgccgctgctaaggaggacaagaccgaggaggaacccacccccgctgctgaagagaagcctgaggaggccaagcctgctcctaccgagtcttaa

SEQ ID NO: 14945 - DNA, 723 bp, A.fumigatus
ccctctgtgatttcaaaggtccttgactcgtgggacgccgccgaagactcagaagtagagcgggaaaaggccgcaaaggctgcagcggcggcagccaaggccgaagccgaggcggccgcgaagaagaagagcaaggcacagcggatagaggagcgcaagcaggagcgaaagaaactggccgaggcgaacgagagcgacgaggacagcgaagaggacgaggcggcgaggcgggcccgtctgcgccgcacggagaaggagggtgacctcaagcacgcgcaggacctgttcgaggacatcgacctgaaccgtaaccgtggcacccccaaggcgattgtcatcagcgactcggccgatcccacgcaggccgtcgacctctccgccatgccactgttcaagcctacaaccaaggaccagttcacccggctgaccagcacgctgatccccctgctgacggcgcactcgaagaaacctcactatgccctgtgggcgcaggagttcaccaagcagcttgtcaaggagcttaacagcggtgatgtcaagaagattgccagtgccctcaccactatcagcaacgagaagatgagagaggagcgtgccgccgacaaaggcaacaagaagaccaaggctgccaagaccaaggtttctctcgttgctagcagagacaacaagattgatgccacaccttatgatgatgatggactggacgatgacgacttcatgtga

SEQ ID NO: 14946 - DNA, 1191 bp, A.fumigatus
cccccctctccccagcggcgcatctactttggtccagagactcctaccctagcgcctttaacaacgcagggaaatcttcccttccggagactgtgtatagattatggctgccaattcacgtattccgaaatggccatgggcatgtctttgattcaaggtcaaaaatcagaatgggcgctgatgaaagcgcatgagtccgaagcgcttccgcccacaatttcatcgacagccgacgttgtgcagggttatgacaactccaaggatttcaaattcggtgctcaaattgcaggcaacaagccttggcacgcgatcaaagctacggagttgttgagtcgtctgactcctaacctgcgtgttattgacttgaactgtggttgccctatcgaccaagtttttcgcgaaggagcgggttccgcccttcttgatcatccctcgaaactggagaagatgctccgtggtatgaatgccgtctcggagatgatcccaatcacagtcaaaattcgcacaggaacaagagacaactctccaaatgccacaaaacttatcgaacgtttggttctcggaggtcatgaatctggcatcttgaatatcggccctcctggcgtcgcagccgttacccttcatggacgtagcagacagcagcgatatacgaaaatggcggattggagctacatcgccgaatgcgccgcgcttatcaaacgactgaacgagaagaaagatgatgtcacggatactgttcgagaaccagatgaacgtatgctgccaaacggcggcaaggtctttttcctcggaaatggagattgttattcccattatgactacgacgaccatatcaacaatgccggtgtggatgccgtaatggtcggtcgaggagcaatcatcaagccctgggtcttcgaggaaatccaggcaggtcagtacctcgataagtcagctaccgaaagattggccatgatcgagaaatacgccaagtacggtctagatacctggggctcggatgagcatggcgttggcacgacgagacgtttcatgctggaatggctcagcttcacatatcgctatgtaccgatcggactgctcgagtatctgccccctcacattcaagacaggccccctgcttggaggggcagaaatgaattggaaaccctcctgggcagtcccaattacaaagactggatcaagatcacgtaa

SEQ ID NO: 14947 - DNA, 447 bp, A.fumigatus
tcattgtcccccgcttttgatattgtgactgttctgaccgtatgcgcaaatgcgtttgctattagtagagcggccgctcttggcacagatcgcatggaagtccaggctcgcaagttctactctcaacgaaacatgtacctttgcggcttcactctcttcctgtctctcatcctcaaccgtacctataccatgatccttgaggtccttcgccttgaggaccgcgtcaagcaccttgagggcgacaaaaaggcgggcggcaaggactctgcccgcctcgctcaggctggtgatatcggagagattgcacgccttaggaaggagattgaggccaaagaccttgacattgagaccctgaagaagcagtgtgagggacttacccgcgaataccacagcttgggcgacagggtcactggtaccaccaacgacggctccaagaaggacctgtga

SEQ ID NO: 14948 - DNA, 660 bp, A.fumigatus
gccaattctcaaatattactctacctctcctctctattcttccatatatatcctcggatcaaatacctcataatgcgctcaaccaggatgctatcgtccagcctccgtgccttcaactgcgcgcttccgcggacaatgctctcacaacccaaatcgcgacatttctctcagcttctcatacactctcttcaaccttcaccagccccatccttgaggctcctccggactgggctcccccaactcgccgtccgaaacaactccagctcatcatcatcctcgtccccaaacctcaccgatcaaatcccagacgccgctcaggacgcagccaacgaagaacagaacaggttacgccgcgagcaagaacccgcatatcagattacattcacctgcaaaccatgtggtcatcgatcttcacaccgtatgtctaagcatggctatcaccgcgggacggtcctcatccgctgcccttcttgtctcaaccgccacgttatcgccgatcatctcaatatcttcatggatgagaagagtaccctcgaggatatcctacagcgggaggggaaacgattgactcgtggttatgttgacggagacatggagttctgggaggatgggacggtaaagaagcgcgaggaagcgggtgagggctcggaggcgaagtaa

SEQ ID NO: 14949 - DNA, 1716 bp, A.fumigatus
catcatcttaccatacaggatcgaatcatcatggcagattttcgaaagccttcaatatatgttgcctccatggccttattccgcgaccaagtcctgcggtctcccattcaatccgacaaggaaaccacaattgccgatgtgcttgagaccactgtgctgttcatgatccaattggaacgatcgggtcacgtcattgaccgtcccctcatccggcattgtatctacatgctagagggcctctatgaaactatcacggaggaggagtcatcaaaactctatctaaccatgtttgaacccgctttcctcgaaacaagcaaggctttctatcgagctgaagggcaacgtctgttggaaatggccgatgcagcttccttttgtcggatcgccttgagccggattgctgaagagaaagaacgatgtcattataccctctcgccccttactgagccaaaaattaagaacgtcctggatcaagagctaattgccaggaacatcgaagaggtcatcaaccttgaaggcacgggtgtcaagaatctgcttgacaacgatcgggtggatattttgcgagacatttatgaacttagcgcacgagttgacaacaaaaagacacctctcaccacggcagtccagaaacggatcagtcaaatgggtcgagaaatcaatgcctcgtccatagcatatgagaagtcgtcaatatctgctggttcgaaagcaacggaaaagagttccagtggcgagaagaagtccgcagaaaaggaaaagcctgtgaaccagcaaacagtagctgctattaagtgggttgatgatatcctagctctcaaggggaaattcgacagtatctgggagaaggccttcttgtcagaccagggcatgcaaagtgcaatcactactagcttttcggacttcatcaactcaaatgcacgcagttctgagttcctttctctcttcttcgacgagaatttgaaaaaaggcatcaaaggcaagacagaaagtgaggtggactcccttcttgacaacggcatcactctgctgcggtacatcaaggataaggacttattcgaaacttattacaagaaacatctttctcgacgactcctcatgaagcggtccgccagcatggatgctgaacggcagatgatctcgaagatgaagatggaggttggaaaccagttcacacaacgcttagaggccatgttcaaggacatgaccatctcagaagatttatctgccagctacaaagagcatatacggaagtcaggggacccggaccagaaacgggttgacttggaaatcaacgtcctcaccagcaccatgtggccgatggagataatgtcgaaccccaaagatggagaagtccagctcccatgtatccttccaaaagaggttgagagcgttaaacagagctttgaacaattctacctcaacaaacacaacggcaggaagctatcatggcaaccgagcatgggaaccgctgacattcgggcgacgtttaaacgatcgagtggaaaggtccaacggcatgaacttcatgtatccacctaccccaatgatcataccctcccttttccaacgacttttcctacagggcgagttcattcacgtttcgaaggagattcagggaccggacgcccttttccgcaacacgaacctaattccaaacttgcaatcactggttggcggaaccaaaaacccgggtttttgaaaagagccccttga

SEQ ID NO: 14950 - DNA, 603 bp, A.fumigatus
gacgaacatccagctaattctagaaagggtctgagcgcggcgaagactgacgattttgacacaatttggggggtgctgtcatcttctttgaatgagatacacacaaagaatgcctccgctctttccttcgaagagctgtaccggaacgcctacagaatcgtcttgatgacccgcggtgatgacctctacgaacgagtaaagaagctggaggaagaatggctgggaagcgaggtaaagaaaacagtgactgcagcaatttcgccgacattactactcgcgcaggagcctgcagatatgcaagaccaagccagcgagcgaagggaagcaggagagaagttcttgactgtgctcaagggtgcatgggaggaccatcaactatgcatgggaatgattacagacgttctcatgtacatggtttgtccatcgcttctctgtgttcgctggatcaggtacctaacatcatcttaccatacaggatcgaatcatcatggcagattttcgaaagccttcaatatatgttgcctccatggccttattccgcgaccaagtcctgcggtctcccattcaatccgacaaggaaaccacaattgccgatgtgcttga

SEQ ID NO: 14951 - DNA, 1374 bp, A.fumigatus
cctcgtacaggagcttctccagccacttcaaaactcaaggtcgctcttattgagacacaggatctaagcaaggcccgctcgtggaagctcgaaccgcaccagttctccaaccgagtcagcagtttgacaccgtcatctgtgtcgttcctccagagaatcggtgcgtgggatcatgtcgatgcgagtcgtgctcaggtgtaccaggagatgcaggtttgggacggagagacaggatcgcgcatatcattcgactggtccatggaaacatctcccttcgaggatctccccactgtagcgacgatgacggagaatgcgaatcttgtccgtggcctgctatcacgtatcgaggtatcaggtgaagagaatctttccatcttctcaaatacaacggtttcgtcgatagagaatggcattgattactcgagtgggccggatctgtcggcttggccggttctgtcactctctccttctggccccgcgggacaatcccaggcaccttcgcgcattgctgccaggctcttggtcggtgccgacggtatcaacagtcccgttcgtcgctgggcgggcatcacgacggatggctgggactacgataggcatggtgtagtagccaccctatctctgtcggaacccgtttcgcctgcatttcccaccggcaccagaactgcctaccagcgtttcctgccatccttaggcggtcctgttgctctgcttcctcttcccaacaacaccgcaactctagtctggtccaccactgtcgaaaatgcagcctacctgaagtctctgtcgccgagagccttcatcgccatggtgaacgctgcgttccgtctttccatggccgatctcaagtatatgataaacatggaacgcccagcaaacccgatcgccgatgctgagaatccccacgaagacgaacttacatggcgcctgcaacatacccctcagccatcccacatccctcctatggtcaacggagttcaagaaggcagcgtggcctccttcccgctacgctttcgccacgcatcgagctacatttcgccccgagtagctctggtcggtgacgcggcccacgtcatccacccactggccgggcaaggtctcaacctcggtctcggggacgtggcttccctctccaagacgatcgagtacgccgtcaaccacgggatggatgtcggtgatatcctgactctggagcggtatgccgcagagcgatacgccacaaacgccaagatcggcgctgcctgcgatgtcctgcacaagctgtataatgtgcccggacaggggccggttacttgggctcggagctttggtctcgatgtcattgaccgcttaccgtttgtcaagagtttcttaatgaaaaatgcgcagggctga

SEQ ID NO: 14952 - DNA, 321 bp, A.fumigatus
gctgaattctcctacaagatcaagcccaaactcccccaacaattcaaggcagccgaacaaggaggcgtccccttcgccgtcatcctcggcgaggacgaactcgccgctggccaggttcgtattaaggaattgggactcgaggaaggccatccggagaaggaaggtgtgctggtcgacctggctgccctcaccgacgaggtcaaagccagactggccaagaaacagagccagacgtcagcgaaggcagatatttccggcgtaacgcaacagcttgaagccatcaaggttgaagctcccaagaccgaggatgcgggggtttaa

SEQ ID NO: 14953 - DNA, 735 bp, A.fumigatus
aaacccctttccaagaaaaaaagggttttgccccccccccctttaaaaatttggggggggaaaaaaaagggggggggggaaaacccccggggaaaaaaagggttttttacccctttttttgttaaaacccttggggcgaacgcgtcggccaaggctggtctggaggagatgggattgctcatggactaccttgaagccttcggatgtctcgacaaaatttcctttgacatgtctctggcgcgaggactggactactacacaggtgtcatctacgaggttgttacggaaggttctgcgcctgccatctcgtcctccgcccccgaagcacagaagctccagaagtccggaaagaaggacaagtccaagagcggaaacctcgacgatgaggacagatcaaacgaccctacactaggtgttggcagtgttgccgcgggtggccgctacgacaacctcgtaggcatgttcttgcccaaggctcagattccttgtgttgcgtgtctcattcggagtcgcccgtatcttctccatcaccaaggccagactcgaacgggaaaagagcacccaggcactgcgcagcagcgaagtcgatgtctttgtcatggcctttggtggaaagggcttcaccggtatgctcaaggagcgtatggatgtatgccagagactctggaacgctggaatcaaggtaagcctctttcgcgattgtctctacacagtataagcagagagtccagctga

SEQ ID NO: 14954 - DNA, 1257 bp, A.fumigatus
gggggaggggtcaagggaaaagggggaaaaccaagttcaggtgaaaaatcggccagggaagccataaaatcccttcaagaccatgggatccctatcccctggaagaggagacgcttccgaaggtatggacggtcggttcaagggaccgcgcaaaggaacatttcaaggtcaataggaaagcccagcctgtggcaggcaaggacgtacttcgtcggcaacttggtgtacgcggtggcatactggtgggggcggaagcagatcattgcaggcaactacacgcaaacccagttcctgatggtcgtcttctccctgctggtcagtgcactcctgtggagtcaaatgttcgctcttgcaccggagctctccagcgcccgcgccgcaatggcccggatcctaagtctcatcgaaatcggctcggacaagatgcaaggacacgtgcgcagccctcccacaaatgattcgaacgaccccgaggcaacagccgagccaaagcccatagcctccaaccacgaagcctcaagcgtgcagctccgcgatgtccatttcgcataccccgcccgaccagacatcaaagtcctcaacggcctgagcatcgacatccggccaggccagttctgcgcgctagtgggacccagcggcgcaggtaaatcgaccatcatctccctcgtagaacggctctacacccccgagtccggtgctatccttgtcgacggcgtagacatcaccaaacaccgtgacgtctccttccgagacaccatggcgctagttccccaggagagcgtgctcttcgagggcagcatcgcgttcaacgtcggtcttggggcgcgaccagatcacgaagcaacgatggacgagatcgttgaggcgtgcaagctcgcgaatatccacgatgtgattgagtccctgccggacgggtaccagacgctctgtgggccgaacgggagtcagttctccgggggtcagaagcagcggctgtcgattgccagggcgctggttcggaaaccgaagctattgatcctcgatgagtcgacgagtgcgttggatgcggagtcggagaagctgttgcaggatgggttggagagggccgcgaaggggatcacggtcatagccattgcacaccggttgcataccattcgtaaggcggatgtgattttcttgatcgaggggggaaagtgtgtggatcgggggacgcatgaggagttgctgcagaggtcggagagttatagggccaatgttatgcatcagactgtggcgtag

SEQ ID NO: 14955 - DNA, 3378 bp, A.fumigatus
acgatggcgcttctccttgcagccccgctggtgaagacgaatctcggagagagtctggcccgttacgccatcgtcgaagactcagccgacggcaagcgatacatggtttggactattcaccatgtgttgtacgatgggtggtcagagccgattatcctcaagcaagtcagcgacgccctgcaagggcagccagtcgaggtaaaggcgcagatgcgagactttgtcagattcgtgcgagactcggatgacgctgcagtgcaggaattctggcggcgcgagctgaaaggtgccgtcgggccccaattcccacgtctaccctcaagagacttcatgcctaccccggacgccctagtcgagcgtcaagtctctcttgatactagctccggatcaccgtttaccatggcgacattgattcgcggcgcctgggcgctcgtcgcgtcccaatatactggaagcgacgatatcgtgttcggcgagaccctcacaggtcgcgacatcccactacctggagtcgaaagcattgttggaccattaattgcgacggtccccatccgcgtgcgcattctccggggaagtactgtggagtcctacctccaagccgtgcagcagagtgttttggcccgtaccccgtaccagcatttgggtatgcagaacatccgcaaggttagccaagatgcgcaacacgcgtgcgagaccggtacgggtctggtcattcagcctgaaccagagtatgtcggcagcgaactgggcgttgagagaggggacgtggttcttgaagcgctgcatttcaacccgtatccgctgatgctggcttgcgggattcgcaagggtggtttccgggtttgtgcaagctttgacagcagcttgattgagaccaggcagatggaacgaatgcttgcccagcttgagaccgcgtgctggcagttgagtcaaggtctttcccggaaggtcgatgagatctcgtgtctccccgaagccgagttgaaccagatctggcagtggaatcggagtccacctttgtctctggacgaaacaaccagtcggttgcgtgcgaatgcaagcacaaagcctggttcaagctatcctcccgcggttgttccttgggtttgtagtccacgaaactcatctctcctctcgccaatcggctgtgttggcgagctctggcttgaaggggcccttctttcgggcgacacagttgattcacctgcctggcttgtggctggaagctctacctgtgctggccgaactggcaaagtgcaagcaaccggcgacatggttcagttgcgagaagacggcagtttagtgtttgttggtcggaaggagaatgttgttcctgttcaagggcatgcagtggacatcacggagattgaaaggcacctcgcagaacatctgccgccaacaatccgtgccgctgctactgtagtgcggtcttcatccgaccaggagctggttatgttcattgagcaaccggctgcggaggaagcctgtattgagctcctatcggagaagcgcgaaatagtgtgcgacgcgccagacaaagccttccagaccacaatttgtgcgacaatcccgggcagtcttgctgcagtgttgaagaagttggacaaatacatgcgagactcgcttccgtcatatatggctccgtccgcttacatcgtggtagagaaactgcctaatacgatggacgatatcgaccacaatttgctcaatcagatcgcctctcaggtcactccacaaattctcaacgagcttcgcgatgggttgagcaacgcttggaccaaggctacggctccaaaccatctatcagcttcagaaagcattctgcggtctgcatgggccaaagtgcttcgtgtcgatccggagcagatcgacgtggacgacaatttcttccggcgcggtggtgattccgtacttgcaatgaagcttgtgtcgagtctccgagcgcaaggctacagtttgtccgtggctgatatcttccggcacatgcgtctcagcgacgctgccagagtgatgaaggtggatgaacgctcaacagagaagatcaactcatatcagccgttttcgatgctccgtctcccagacgttcagcagttccttgccaacattgtccgaccacagctaggggaccaacactggcccattcgagacgtgttgccggtgaccgactcccaggatatggatatccgtgcaaccattcagccgccgaggacgtcaatccagtatacaatgctgtactttgacaacagcgttgacagagagcggcttttccgttcgtgcagcgacctggttaagacgcacgagattctccgtaccgtcttcatatcacacgaatccagcttcttgcaggttgtcttgaatgagttggaaattcctgtccgcgcacacaagactgacaagcagctcgatcaatacgtcgccagcctcttcagggaggacattgaatccaacttccagttaggatgtccattcctccgacttttctacgtcgagggaaacaacggcgaatcctgcctcgtcatcggcttatcccacgcccaatacgatggcgtctccctgcccagactcctccaagacctcgacgccctatacaccggcacccagctcgccaccttctccccattctccttgtacatggcccagaccagtgaagaggcaattcaaaacaaggcagcggcctactggcgcaacctcctctccagctcctcactctcgaccctcgacggaccctcctctgatcccaccgacaaagcaatcttccacactcgcccggtcaacatccatcccctcaaggagatcaccaccgcaaacctcctcacagcagcctgggcgatggtcctcgctcgccgtctccaaaccccagacgtcaccttcggcagcgtcacctccggccgcaccctcgacattcccaacgccgaaaacttcatgggcccctgctaccagctcacccccgtccgggtccccttccatcccgactggaccgcaagcgacctgctgaacttcgtccagacacagtctgccgagtctgcggcgcatgacttcctcggttttgagaagatcgctaagctcgcggggtgggcctcagaaaggcaaggctttgattcgatcgtgcatcatcaggactgggaggatttcgatatgatgccgtttggcggagggtcttgtcgggtggacattgcgaatccgcatggggatgcggcgtatccggtcaaggctgtttcgtttgtgaaggagggagagatacatgttggtgtggtcggtagtgagagagatgtgatgtttgtagacgaggttctcggggaattggctgctgcggttgtggagttggctggtcagagtacagaggtgttgctggatagcaagttgtttagtggacagtga

SEQ ID NO: 14956 - DNA, 537 bp, A.fumigatus
gatgtccattcctccgacttttctacgtcgagggaaacaacggcgaatcctgcctcgtcatcggcttatcccacgcccaatacgatggcgtctccctgcccagactcctccaagacctcgacgccctatacaccggcacccagctcgccaccttctccccattctccttgtacatggcccagaccagtgaagaggcaattcaaaacaaggcagcggcctactggcgcaacctcctctccagctcctcactctcgaccctcgacggaccctcctctgatcccaccgacaaagcaatcttccacactcgcccggtcaacatccatcccctcaaggagatcaccaccgcaaacctcctcacagcagcctgggcgatggtcctcgctcgccgtctccaaaccccagacgtcaccttcggcagcgtcacctccggccgcaccctcgacattcccaacgccgaaaacttcatgggcccctgctaccagctcacccccgtccgggtccccttccatcccgactggaccgcaagcgacctgctga

SEQ ID NO: 14957 - DNA, 1194 bp, A.fumigatus
ggatgcactgcctgtactctatacgcaaatgaccacggcccgagatcattgcgtcgatttcttcccgctgcgcgtcatcggcaacttcgtctggcatggactcgggtcatccaagccttccccattctacggacggtgttcccccgattccggggccgctttatccagcttgttgtccgggatatcggagactcaaacttttaccgaatcgtcgaagctccatccggccagacggccgaggagtgggcaagggccctctgtacggaggcaatccaattccgatgcccagtcgaccggcctgtagcccagctgacgctcatccaggcagccggctcgagtgcactcgtcctgcggctctgtcacgcccagtatgacggctcctgtctggaacatctcgtccgaagtctgatgatggcttaccatggccggcctcttgtggtcgaatcggacttccaagcgtacacccgcacatgcctccggcttcgcatcccggaggtgctcgacttctggcgccgtatcctggccggttcatcaccgacgcagctcgcgtcgtcaatgacaggcgatcgcgaggcggcgcggaagatcaatcggtcgttcttccggcgcgaggtcaacagcctggccgcaccggcggggttcactcttgcgaccgtcgtcaaggcggcctggtcatgggtgctgaggaacgaaacccgatccgaggacgtcgtattcggccagctcgtaagctgccgtggcagtgtgcctcttccccatgccgacaccatcatcggcccatgcatgaacatcatccccgtccgggtgggacgcgacttactcggcgccgtgcaagcccagcatgcgcaaaccatggagttcgacatgatcgggatggacgagatcgtcagacattgtacctcgtggccggcggggaccgagccggactcgatcataatccatgagaacttccatgtggactgggaggttcacgacggaggggtgaccattcagaagatcgccgcggtgttcaaccagcagccatcgtcattgacctttctgataacgattccgacagaaacaggcttgatcgcagtcctcatggcccccgcaaacatgagcagcacgcatgcagaccgcgttcttgatctgttttgcaacacattaacccgccttgcttggtcgccagctgctgtattacggcgatccgagtga

SEQ ID NO: 14958 - DNA, 1059 bp, A.fumigatus
  unsure (1017): Identity of nucleotide sequences at the above locations are unknown.
ttctggcgttttcagttgagggattccacggcattgaacccggaaaaggttcgggggaatcctcttgtggaaattccaaattggaccacggtggccatattagcggaattcagggccggcggggcattcgtgctccttgatcccacccagccagcggcatacctgtcggccatctgcaccatgacgaggaccgcgctcctgctatgctcctctcacaatcagcgtctcgcggcagagctgaggcagacgaccattcaagtgccccgggatccgtaccacggagccatgcccaccagcgactttcggcgacagtcgtcccctgcagtccagccccatcacaccctgtacgcatgcttcacctctgggtcgacggggcggccgaaagggttcatcatcgaccatgtggcattcaacagcggtctgcagacgtacgctcacgcaaccggcttgggatgcgattcccgggtcttccagtttgcgtcgtatagctttgcacccagtatcacggatcaactcgcctcactcattgtgggggcttcgatatgcgtgccggccgaggaagagctgcaaaacgatgttgaaggttccatttcccagctgcaggcgacctggctaaagttgaccccctccgtggcccggaccttggatcccggacgactcccttgcgtcaaaaccctaattctagtgggcgaggaggctcaagtctccgacgtcgccgcatggcaagatcatggaatcacggtcctgggactgtacggccagtcggagaatgccaagggcacgatggtctcgcgcaagagtagtgaagatgcagaccccggcaatatcggctctccattctgcgccgtggggtgggttgtcgaccccgatgactatcaccgcctcatgcccatcggcgcgacgggggagctcctcctagaaagcccatgtctttgccgcggatatattgacaacgaggacgagacgaagctagccttcgtgtcgaagccatcctggctcacccaggttcgggggcanggcaccgcacaaccccttttgcgcacgggagacatcgtctga

SEQ ID NO: 14959 - DNA, 1104 bp, A.fumigatus
tacaattgcgtcgacggcacgttctgcctcgttggccgcaagggaaaccgggtcaaacttcgaggccagcgcctggagctcgctcaggtggaacatcatcttcgctcctgtttgtcgagcacacaccccgttctggctgatgtcgtacagccagcgaacgagaacggccgggacccgatgctggtcgcattcgttccgtgggcggacagccagtcggccgcggatgcgacggacggcttctttgcgccacccacgaaggattttcagacccaagcccgtgcggtccttgggaggttgcggcatcttctgccctcgttcatggtccccagcacccttttggccgtgcgtaccataccacggacgggcacgggaaagattcaccggcgacgcctgcgggaggcggcatcgatgctttcccggaagcagctgatggcgtacatctcgccgttcatcccataccgggcgccagagacagagctggagaggaagctgcagcgggcctgtggccggttgttgaatatcgaagccgaccagatcagcatgcaggacaacttcttcgatcttggcggtaactcgctcacagcacggcagcttgtggcggtagcgcgcgcagaaggcctacaggtcagtgttgcgcagatattccaacagcccaccctggctggactcgcacaaaccgacaggcacccagtccgacgcgctgaagttcctcgcagcagccatgacccagacccgttcggccgggttcgggacgatgttcgtcgggaaggtctgccacatatcgcgcgtggcaacattgaggatgcactgcctgtactctatacgcaaatgaccacggcccgagatcattgcgtcgatttcttcccgctgcgcgtcatcggcaacttcgtctggcatggactcgggtcatccaagccttccccattctacggacggtgttcccccgattccggggccgctttatccagcttgttgtccgggatatcggagactcaaacttttaccgaatcgtcgaagctccatccggccagacggccgaggagtgggcaagggccctctgtacggaggcaatccaattccgatgcccagtcgaccggcctgtag

SEQ ID NO: 14960 - DNA, 300 bp, A.fumigatus
agactgattgtcctgattgccgaatatggcagcgacactgcggttgcttctggtgcggttctccgggctctcaatcaagaactagggccgattaggatcatccagtcgagctacggttacctgcgcaccgagccctgggatcctgagcttatcaaggctcataactcaagcaaaccgaagcaggttgatccgaacaatggagacttatacgtgaagaataccatctgttgggtcttgaagaaggtatggcgacggagaccccggccaaaactagtgtatatcgtttgttggctgacataa

SEQ ID NO: 14961 - DNA, 513 bp, A.fumigatus
attcacgccggtcagggcgatgaagttcctccatttgctgaatacaggtttcgaactttgttcacattcccagcaaacactaagcagaggtttaaatgcaaccaacatctgtatgtgtcagatatgactttcttgcgtaccgagggccacatccggccagtcaagccggataatgagctcggtcgacgccattaccgtgttgaatatgaccttgtcatgattgtcgacggttacaatatacgatatgaggcgcgctgggataatggccaaggagaacaagtccacgcagagaagcaaatcaatattgccgcagcgtttgccagtctcgagcctgagtgggagtcggacgaggacggagaggagtatctgactgacttatgcatacagtctggacagagaagcaaatcaattgccattgtagattgttcaatacctactgcgatatgcttactgaatggcaccatgcaggttgcggatgtttgctctatcccaccagccacccattgtctttga

SEQ ID NO: 14962 - DNA, 2256 bp, A.fumigatus
tcgtcgcgtccgttgcgcatacctctaggctatgtctatcttaaccgatcctttgcaatcactctcaccgaaaatgccgtttttgagcccgtatgtacgagtcaaccaaccgataccagacaaccatctcccctccttgacacccgcgatcccttctactcttccgtcacaccgcagttatacgctatcggctgcgcaaccgtcgtgagttatctcctcgttataatactgctcattacaccgcgaacgttttatgttggtggccccggtggtggcgccaattttctggggcgtcatggcatgatcagcggatcctacagcggcaattcgtcggtggtcggcgttggtggaaggccgtggctacagaaagtagctgcgattttggtggcggtatcgttgactatcgcgtccgcggactcattccgggtcgctgagcgacagtataactacggttattccgatgccgaagcgctcaccgaggaggtcatcgatggcacggagatccgcgtggtcagagttatatcaagcacctttctatggctggcgcaggtgcagacgctgatacggttatttccgcgacataaggagaagatcatgatcaaatgggccggatttgcgttgattgtcctggacacgatatttagcattctggataagtttcttgtcaagaccaatacgacgcggccccgactctacgacgatgcgattcccgcgctcagctatttgtttgagctcgcgctcaaccttctatacgccgcctgggtaatcttctattcactatccaaacaccgatatgccttcttccaccccaagatgaggaatatctgtttggtcgcacttttatccttgtgtgctgttctcatacctgtcattttcttcgttctggatatcgccaaagaagagattgccggttggggtacctacatacgatgggttgggtcagcagctgcgagtgttgtggtttgggagtgggtggaacgaatagaagccttggaacgggacgaaaggaaagatggcattctcggtagggagttattcgacggagacgaaatgctagaagtcacaccatcagaagaggttgactggcctcgccagacttatggtggaggcgaccgggacgggggaagcggtacgtcctcgggatggggaggtgttatggggttggcaaatcgacctctgcgcacgagggtcggtctaccccgtggcaaccgcaagccggacaaacaacgcaaaacagttagttccgatgtgcgacgtcatggagctggccgcccgacaccacccccggcggcgactactccagttagtcgggcggataccacaagtgcagccagcaccgtgtataatgtccattaccacccggtgtctagcccaacgcctccagtcgtaatgcctcatatggaggaggaagatgaatatgagacaggtcagctgaaggaaatgaccatgagaaccgaggatggaggaggtgacgtcggtcagccgcgtctttcagcgcaacagacccgcgaagagtcacctcagatcgtcaatatggacggccgttggcgaacgctcctcaatcccttcaggaagagacgtgcttctttgcccagggaagtcgcctcagcgcaggcagacgaggatccttcgactgcgcaggaagatttgtatggtgacgaaggtgacaggccgcgtgcggcatgcagcaaacagggatatttgttcccattcaacttcaggatcaggcccggctctgacaaacgcgacgcagatgcttcccttccagtgaccgtcattcctgcccgacgccggggccaaaatacatggtctccgcaatggctaaacgatgcaaacatactggaaccgacgcccaatcgtgtcgttcgttcgaaccgctccaatttacctgtgagggtgattcagccgcagactcggactgccgctccgtggagcatacccgagggggacacgatcctcggcaatggcaactatgagctgcgctacgatccggaaacagcggcgcttatcgtgcctgatggtcatcaggcacagcaacggactgctgcatcgagcacggcgcacaatggagacggtcagcccgttgatgaggcaaccgctggacctgcgggacatgacgctcctgatatgctacgcgagagtcaaatcagcgctccacctgagcagcctccatcatcgacaccgtcacggcaggatgggcaacggtctccgactcatccgagtctcgggggtgatcccagtcgagacgacacatga

SEQ ID NO: 14963 - DNA, 1392 bp, A.fumigatus
ctcgatctgcttcataagctcgacaataccggcgacgttgcccgtctgtgccgaacatgccgagtcctcaattacatggccctcccgcagctctacaaacacatcaccttgacctcctacgacaaaatccgataccgtggggatgagccggagggaataggcagcgccagccccttttcgatgggcctcaacgctattattacgagaccctacgcttcactggtgcggtcgctgacgctgcggggagactggcgggagaatgagttggaggaacacgctcgggtcggccgggtgccggactcatcgatgatgctgaacatcgcagtgcgggcggccgtggatcggatgactgagctggagagtttcagctgggagctgagcacgaagatgctcgagacggtgtacctggggctggcgcaacggccgaagctcacctcgctcagtatacgatttccctcgagtcggcatccgcggccgacgatcgtcatcccgccgatgcctcatctgcgctcgttgaaaatcacgcatatcgacccgctgtgctatcccgatgatatctcgacgttgttgtggaagtgtaagaaactgcgggagctcaagatgcattggtccccgcggatgcgcatcgagcaggagcccagcgttatgctgcatgattacttccgcaaatgcattgctgcgaggcagccgttgaaggttaagaagctggcgcttcagaatctatacgcccgtcacagcgaggagttcaaggttgctctggacccgagtgcgctggaagatatgacttttctcagcgagtgcggatcggagagcgccaagtcgttgaatacgttttttgatagcagctggccgaaagggcctcccggtcaggtgaatttcaagtcgttgaggcaagattccacctcgaggagacatgctgagtttctatcttatttcactggcctggaaaggttgtatttcgtcaacgcttcgcgagattcatctgatgatgtcaactcgccgcgacgattgctcccgtcttcagcactcacaccgccctccttggatcataccgccaatagttcaactctgagcgcctccaccgaggaaactcctgccgcttcgccggggtcgaataccggcgtgcaggctagtattcgcgatatttacctgaatagcatcattatgaaccactgcgcaaccctacgccatcttctgctcccctctcgctggccgctctcagcgtccaccatagcccgtcttgttcatgccagtccgcaactggagcagctggctctggccacagatctttccagtatggataccctgggacttgtactcccgtttcttcgcaacctagtcgctgttcgtttgctggttccaactgggccaggatcatcttcggcagtcttc

SEQ ID NO: 14964 - DNA, 1536 bp, A.fumigatus
cttgagcttagggtcctttcgggacagtcatggaaatgtgtcaatcagattcgggctcacgaggcacaggtcactgatgtggcccttcacgtggtctctgactcctgtctcattgccagttctggtcgagatcgcatggttcagcttttccgtagcactgacgaaagcctggagcttgtgcagacaatggatgatcacgtcgggtcagtgaatcagctactcttcattaataacggcgagaagcttctctcgtgctcctcagatcgcaccgtgttcatacgagaacgcatgactcgagaaaccagtggagaaacagctattgcgtatctggcctccagggctgtcacgcttaaggcatctccggtttccatgactctatctacagaagacccaaatattctcatcatatccactgttgatcgttgtatacaacagtatgatctcgattcggggaagcagactcgctctttccgaaccaccgattcggattcaagcgacacagtggtcatgactgccctgagcatggcttcccacattccagggaaatgtcccacgttgcttatgggagtcgcaagcacagacaaatcaattcgcgtgtacgatatggaacgcgaagcacttcttactgccgagttcgggcatgccgagggcgtgagcgatgtatgcttgctgaccagagattctgactgcagtgggaaacctcctagtcggactctggttagcgctggtatggacggcgtcgtcatgatatgggatttagtggtgcaagcacagcaatctccggattatacccaaaccaacctatcagaagaggaagtcgatagtgtgtcgaaaaaatcgacggtctccaagcctctgcgcaagatcctatccaaacacgagcttgctggattccagcggcaagacaacatcacaggaactccaactcctgtgcgggactcctctcagtcactagctcgcaaaatttccaaaatctctctcacaccctcttccttaaagaacgaaaaatcagctccggctactcctcctttctcaaggtctgaccgtcgctcacccccttcgcactcccgcctgcagaagttgcgcaagtctccatccccaagcagaagatccacacctggtaaaaagctcggcaacacaaacaatcattctcgtcgcatatcactagacttccgctcccgcggcagaaacgtgtccaagagcgaatctggaagtttaaatatatctacggagcaggtttgccgcacattgaaggcttaccggaaaaaattaaatacctccacagagtatctccactcccagaaggaactgcagcgcgaactggacctaacacttcgagtcctcgcagctcgacctaatggttgtggaaatgctgaaaccgagacagacagcagcggaaaggaaaatgatggaaatcaaaatgccttgcaaagtccacatcggatgcactcggctccaagtttgcgccaaaagggcacatataaccgctcgcgaattctatgttctaatgataatggtgaaaattcgagcgaatag

SEQ ID NO: 14965 - DNA, 2028 bp, A.fumigatus
actcttcctccatggtgctcagctttgtctgacctctattatcgcgacagcaatactcctaagatggctcctcctggatatcgattgagagcgttatcactttccccagtcttctccatcctcatccttccctttctactcttcttcctcagcttcccagctcctacctccgctgctggatcggcagttcttggtgtcgacgtaggtaccgagtatatcaaggccgcgcttgtcaaacccggcattccgctggagattgttctcaccaaagactcgaaacgaaaggagtcggcagccgttgcgttcaaacctacaagagaaagcaatgctccattccctgagagattctacggcggcgatgcgctggccctggcggcccgttatcccgacgatgtttacgcaaacctgaaggccttgcttggagttcaattccagaatggagacaatgagatggtaaagacctatcataaccgatatcctgccttgaggttagaagctgcccctggtgaccgggacacggttggactgcgcagcaacaggctgggcgaggctgaaagaaaagatgcgttccttgttgaggagctcttagccatgcagctgaagcagatcaagggcaatgccgacagtctggccggaaaaggatccgacgttagggatgtgatcattacatatccctcgttctacaccgctgaagaaaagagaagcttagagttggcagcggaattggcaggtttgaaagttgaagctctcatcagtgataaccttgctgttggcttgaactacgccaccagccgtactttccccagcgtctccgagggccagaaacccgagtatcatattatctatgacatgggagccggatccaccacggcaagtgtcatacgcttccaaagtcgtgcagtgaaggatgttgggaaattcaacaagactgtacaagaagttcaggtgttgggaaccggctgggacaggacacttggaggagattctctgaacgatctgatagtgcacgacatggtcgcaaatctagccgaggataagaaattgaaaggccgcgcaactcccgctgaaatccaggcgcatggtaaaaccatggcaaggctttggaaggacgccgagaaggttcgccaagttttgagcgctaacaccgagacgggcgccagttttgaaagtctttatgaggaagatttgaatttcaaatatcgtatcactagatccaaattcgaggagcttgctgcggatcacatcgctcgtatcggaggacctattgagcgatctctggccgcggctgggctacagctcagtgacatcgactctataattctccacggtggcgctatccgcacaccatttgtacagaaggagctcgaacgcatcactggatcttctgaaaagatcagaacaagcgtgaacgctgatgaggcagcggtatttggtgctgcattcaagggcgctgctctgagccccagtttccgcgtcaaagatattagagccagcgatgtctcgagttacgctgttctgctcaagtgggcctcggagaccaaggaaagacagcagaagctctttactcctacttcccaagttggtcccgagaaacaggttacaatgaagaatctggatgattttgagtttagtttctatcaacaaattcccaccgtcgatgaggtcgtcgagttgccggttgtccgtgtgcagactcaaaatctaactgcttctgtctcccagctgaaagagaagttcggttgcttgccagccaatatcactacgaagttttccatgcgtctcagtcccgttgacggacttcctgaagttacgggtggatccgttagctgtgaattcgaggtcaagaaggggggcgtcgtcgaagatgtgaagggtttcttcgggcttgggtccaagaaggatgaacagacacccctaggtgaagatagagagcccacagagtcgattacgctggaagcggaagaaccccaagtctcgacaacatcctctgctgctgaagcttccacaacgtccaccaaggagaccaag

SEQ ID NO: 14966 - DNA, 561 bp, A.fumigatus
gatcatttctttccgctccactgtttattcagagacctccacagatatggctcacattggattttcttttattttttcttttgtttcagggacggaaaagaagtcatacagcgacaaacgccaatcatcccgagcgagtatcaaaaatacttggagcaagggcttcccgcgccggctctctcctccgataccgtgcgctactggtcggactataaccgattgttctatcatccgcgttcaatagtgcagctcaacgattacgagttgaattcaaagattatgcctttcgaagactggagtgtcggggatgatttgtttggagaactggacaaagagcatgacctattcgaccgagacttgagaccttttgcggaagaatgcgatcaattgcgagccctccaattattcacaagctccgatgacgcttggggcggatttgcggcaaaatatgtggataggctgagagatgaatttggtaaaaaagccgtttgggtatgggcgatcgaaggtggaaagaaggttcaaaaagtgagcctcttccctcccagatgtcataactga

SEQ ID NO: 14967 - DNA, 468 bp, A.fumigatus
ttggccattccatgtatgtttccattttctagggctaacagaaaggccggaccgtacttaacccttcctgcaaacaggggagcaaaaactgcaatgacagttgctttgcaatcgtcagatctagtttcggctctcatacctgtcgacaatgctcctgtcaatgctccgttgaagagtgacttcggaaagtatgtgcgaggcatgcaagaggtcgaggcgcaaggagtcaccaagcagtcggatgccgacaagatccttaaagaatatgaggaggtaagtttctccctcttgtgctcagactgggtcttgggtcaaagcagtaaaagcaggaaaactcacaccaattgcacagtccctccccatccgtcaatttctcttgaccaacatagttcgcgcggaagatggtcagaagatgaaattccgtatccctttatcggtgctgggaccggctattcctgctatggctga

SEQ ID NO: 14968 - DNA, 402 bp, A.fumigatus
  unsure (369): Identity of nucleotide sequences at the above locations are unknown.
gtttctccctcttgtgctcagactgggtcttgggtcaaagcagtaaaagcaggaaaactcacaccaattgcacagtccctccccatccgtcaatttctcttgaccaacatagttcgcgcggaagatggtcagaagatgaaattccgtatccctttatcggtgctgggaccggctattcctgctatggctgacttccccttcctcgaaccgggctccgtcacttatgatgggccgacgctcttcgtcagaggcacgaagagcaagtatgtcagcgatgacacggttcctgtgatcaagaagttattccccaatgctgagatagcggatgttgaggcaggtcattggctgatctcgcagcaccccgagctnttcaccacggggacggaaggaccgcgcatgcgt

SEQ ID NO: 14969 - DNA, 255 bp, A.fumigatus
ctggctgacctcccagagttcttgcacgtgacctcaaacggcaggtcttcactctggtcagtctctcagtgcatcttaagtgtggacgacgaaatcgctcatggacttcaggatttgcggaatcatggccactctttccatcaccacgaacataactattccgtcatggccaaagacgtggagaaattcatccatcagcacgatctggccaagtgtgtcctgattggccattccatgtatgtttccattttctag

SEQ ID NO: 14970 - DNA, 1353 bp, A.fumigatus
  unsure (1),(2),(8),(10),(11): Identity of nucleotide sequences at the above locations are unknown.
nncgggcngnntttggttgaacctcgaacccccgtcgatccttccagccccgtggtgaagaccattatcggttacaatggtacagctcaatcaggttatcgaatcgcgaatgagcctatgactgatgctctttataatacagaatcagaagtgcatccagacatttcgtccaatcctagaatatccataatcgctcttccgccgcacccgagcttcctgcaaacaagtaataagctcctcttcctgctatttggtccgctgaaagtagccttccagattgtatgtctctggtgggctctagcttatcgcacagagcctgcgcaatggctgcttgttcaggtaagaaccttgcccgcccagattgactcgcaggtatcatttcttcctgctaaatttggtccaatgcagaacccgccttcaatacctacgttggctatcgcatccacggcatcattcctccggcacagcaagttaataatcgactggcataactttgggtacaccattttggcgcttaaactcggggatcgacacccacttgtgcgattttccaaatggtatgagaagagcttctgtagatacgccacggcgcacttctgtgttaccgaagccatggcttcagttttgaagaatcatttttgcctcacagcccccatactgcccttgcatgaccggccagcgagtcattttcagcccatcttcgatcaaagcgagcggaagagtttccttgagtctttgccagaaacaacttcggtgaaggatctgctccgggctggttcccttcgtataatagtcagttcgacgtcctggacagctgacgaagacttctcgttactcattgacgcactctgccggtactcgaacctggcaagcaccagcaagccttggctacccgctattctggccatcattactgggaaaggacctcagaaggaaatgtacctgaagcaaatttcaaagcttcaagaagcgggcaagctcagcaaggtcacaattcgcaccacatggttaaccacagatgactatgcgcgccttttggcttctgcttccctgggaatcagcttacataccagtagcagtggtgtcgatcttcccatgaaagttgttgacatgttcggggctggattaccggtgcttggctgggatcgttttcaagcctggcctgagctagtcactgaaggtgtcaacggtatgggttttggaagttctggtgagctcctcgaccaccttgttgacctgtttgagaacccaagtaagctggagaagatccgtgctggtgctcgcaaagagagtaatcgtcgctggaatgacgaatgggatcccatagctggaagactattaggcctcacataa

SEQ ID NO: 14971 - DNA, 300 bp, A.fumigatus
ctttatagtcatcaactaacggtcgacatttatatcaagttatcgtacctctctactaccgcatactctcattattcacctgctaagactactaagatagccgacctccacccattgactcttcccctctggttctggtgtgaaatcttgttcctgatcatcttatttgcttcccgttcctgttttaagtatctcccctgttcttaccgtactccaatacctaccttcatattccatttatcgttcatgatcatactccgtacattagctacctatctcctccagtattgtgcacgctag

SEQ ID NO: 14972 - DNA, 213 bp, A.fumigatus
cactcagctaacttggttcatctgcgcttctctcctagtgagaacgacgtcgaggtcgtcgatgtgaggacttttcactcctttaataatttccctgacactctttttttttgcttttctacgcttgccgtggatctgaacctattccaattcatccgctcctccccgtcatggccgacagcttggggaagaaagagcgcagaaaaagcctga

SEQ ID NO: 14973 - DNA, 828 bp, A.fumigatus
cagcagcataggaaggacgcgatcatccaatcattcaacctgaatctcagagattttaggccgacgtaccgggagagcgtggacttcatatcaatcgctgtgccggaagtgggctccaacaccaatgcattgggattcatacggtacgaaaagaaatctgggcgcgtcatcctcgtgaacgcctgcgctcagcttcggaccgatgcgctacagctagggcacacctcgaaaaagggccaactccagtttgcaggatgccacggagagggactcaaacttgccgccatggtgatgtgccgagaaggctatagcgtcagcatcgaaactggcaattcttattggagctttgcttacggagggccttcaaaatctcggttttgttgcaatataggtccgcttagtgtggctacacccgacggtaaactcaatcccgctcaggacatggcttgctttacgtaccgtacttggagagatgtgtgcgtggaggtcggaccggacagtgaagggacgggagggggtgtatcccttgagaagttcaagcaatggctgacagtatccctcgatatccgtggctactcctaccctgaatctatcatcgaaactgaccaaggtgacttgattattgacccgaggtttcgcggtaaaacctttctgaaaggtcttctacttccagcttctgttttagaggcacggccattcgagcttagttacaacttcgtccagggcggagtcaaccgtgacaggcagcgattaattagtcggtacgaacaagcagatctggtgcgacgaatctgggaatctgctatccgcgaaaacgaagggctttga

SEQ ID NO: 14974 - DNA, 240 bp, A.fumigatus
ccactgcggcccatgattggtaaaccgcggaacatgtcaatgagtcatccgctattattaacttacatcgttgctgttacagtgtatgtcacatggggcagcgccactataatggacctaaagacaatatatttcggtcgtctggtctcgtaccagcccgtcgaagtgggtttggatcttatacaccatatatgctctgacttcgccaaaccgtcagcttttagccagtgtacttgctga

SEQ ID NO: 14975 - DNA, 399 bp, A.fumigatus
cagagctggtgttttgggatgcagggtagcagcacgttccgttatcaattgaattgtggtctcgatctcctctcggccagtcaggaaaaccaaaatatcaccgtccccttcttgcaagtgtatgtcaaatacagttttgacggctcgttccacataatcttctgctgggttttcgaggtacagaatgtcgacaggatacattcgtccctcaagactaataattcttccgatgcttcctcccagttcgccggcttctccgtcgccttggaattgttccccggcgaagaatttcagaaagtcttcagcctgcagagtcgcactactgaccacaattcggaggtcggggcgtctcttcatgatttttttaagtattccaagaagaatatcggtactcagtga

SEQ ID NO: 14976 - DNA, 213 bp, A.fumigatus
agcaagcttaggcgatgtcttgcaattggtagtagtgcagcaggcttgtataatgctggaatgaaggtggaagagatttccaattctgaagccattgttaatgctggtctatcaaccactttcagttatgtaaattcaaaaaccactcgtaagtcatacgcctctcggtttataaaggaaacgcaatcgaggcatattggacgggtgatatag

SEQ ID NO: 14977 - DNA, 492 bp, A.fumigatus
tcttctgctgggttttcgaggtacagaatgtcgacaggatacattcgtccctcaagactaataattcttccgatgcttcctcccagttcgccggcttctccgtcgccttggaattgttccccggcgaagaatttcagaaagtcttcagcctgcagagtcgcactactgaccacaattcggaggtcggggcgtctcttcatgatttttttaagtattccaagaagaatatcggtactcagtgatcgctcatgtgcctcatcgaccatgattatcgaatatcgagaaagaagaggatctacgaggacctctctgagcaacattccatcagtcaggaacttaattcttgtcgaagcagatgtcacgtcttcaaaacgaatcgaatatcccacttcttcgcctaatttgcagcgcatctcctcggccactcgagctgcgacagtagtggcagccacccgtcgcggctgttaccagcttagcaattacacatactga

SEQ ID NO: 14978 - DNA, 1698 bp, A.fumigatus
cagccgcgacgggtggctgccactactgtcgcagctcgagtggccgaggagatgcgctgcaaattaggcgaagaagtgggatattcgattcgttttgaagacgtgacatctgcttcgacaagaattaagttcctgactgatggaatgttgctcagagaggtcctcgtagatcctcttctttctcgatattcgataatcatggtcgatgaggcacatgagcgatcactgagtaccgatattcttcttggaatacttaaaaaaatcatgaagagacgccccgacctccgaattgtggtcagtagtgcgactctgcaggctgaagactttctgaaattcttcgccggggaacaattccaaggcgacggagaagccggcgaactgggaggaagcatcggaagaattattagtcttgagggacgaatgtatcctgtcgacattctgtacctcgaaaacccagcagaagattatgtggaacgagccgtcaaaactgtatttgacatacacttgcaagaaggggacggtgatattttggttttcctgactggccgagaggagatcgagaccacaattcaattgataacggaacgtgctgctaccctgcatcccaaaacaccagctctgctaccgcttcctctttattctggcctaacaacagatcagcaaatgtacgtcttcgagccagcccctgaaaacacacgcaaggtcatcgtgtcgaccaacatcgcagaagcttcagtcactatcaacggtatagtatatgtcgtcgactgcggatttgccaagctcagagcgtataatccaagcacaggcatagagacattgacagctgtcccgatatcaaaagctgccgctgttcagcgagcaggtcgcgctggtagaacgaagccaggcaagtgcttccgtttgtatactcagcaggcctatgaaaaattaccagacgctacagtacctgaaatccaacgctcgaacctggcccctgtgatcatgcagctcaaggctctgggtattgacaacatagtacgattcgatttcttgacagctccgcctgcggacttggtgatacgtgccttcgagcttctatactcgcttggagcagtcgatgactatgcgaaacttaccaatccattgggggtgcgaatggccgaactcgccttagatcccatgttggcaaaggtccttctcagcgcgcgatccttcaactgcttgagtgagatcctttccattgctgcgatgatcagtctccaaggttctatatgggtgcagcacgaaggcgataagaagtcggtggagagcagccgcagaaagtttgccgttgaagaaggagatcatttgacctacctcaatgtgtaccaggcctttgttacgaaaggaaagaaagatcccaaatggtgtcgggataatcttctaaactatcggtcgatgcaacgagctgttagcataagaactcaattaaaacgctaccttgagcgctttgggtatcaagtggatgagacactctctggtcgccacggaacggctgatctagccagaccggccgagcaaattcaaagatgcttgacaactggctacttcgcacatgctgcaaaaatgcagccagatgggactttcaagacagtcagcggagggcttactcttcacgcgcatccaacttccttgatgtttgtacgtgctcgccactgtcagtgtctgccaccatag

SEQ ID NO: 14979 - DNA, 312 bp, A.fumigatus
ctgaaagtggttgatagaccagcattaacaatggcttcagaattggaaatctcttccaccttcattccagcattatacaagcctgctgcactactaccaattgcaagacatcgcctaagcttgctttatcttgtcgaaacataccctgtcacgattgtcgttggacaaactggtagcggaaaaacaacgcagctgccacagtatctggatcaagcgggatggtgtgcagatggaaaggccatagctgtcactcaggtattgttctatcccctccatcatgacccacagcacgtcagtatgtgtaattgctaa

SEQ ID NO: 14980 - DNA, 201 bp, A.fumigatus
cacaaaatgtcaggacatcaccaccacagccatgaccacagcggacattgccatggagaagatggacatgatcattcgaacgatatcacccctgctattcagtcccttctttactcacagattgccttcgatgatattaccacattgaacggtatgcctacggtagccttttatatggtcgttcgcgaacatggttgttga

SEQ ID NO: 14981 - DNA, 1014 bp, A.fumigatus
gccacccgttgtatcgtctcgacccttctaaccgtgatagtcggccaacatggcggtggataccatcaatcggacattcacgactcggccatgatcattgcctactacaaattctgctacatcgccaccgtcctgtactgtcccatggcgctcttcgtcaaaatcgccctcctctccatcatcatccgcattttcgccccgtaccgacgaaagatcatcttcatctacgtcctccttggctgcctgtgcatctactacattatcgccgagatcgtcaagatccgcatgtgcgatcccattccgtcctactgggagggcacacccggacggcgctgtctcgaccagagcgccgctctgctcgccgattcggtcatcagcgtcgtcagcgacttgatcatcctcctccttccgctgcccttgacatggtcgctgcagatgtcgcgcaacaagaaactccgcgtgatagggattctgtcggcgggtggcctggccacggcgtttagtatctaccggttgattctcgtggtgcgcgacggtaacacaacggacatgaccatcttcttcatctgcatcattatgtctgggtatgccgcccttgtccgtgtttctgttttagtgatcggctctgactgtggcagaaacgccgaaggaggcgtcggcctcatctgcgcctgtctaccgagcgtcaacctcctcatcaatcgagcacgcaagaccggctacagctctaaccgatacgccgagcaggagtcgtccgtgcaactgggtcctgtgagatcggcagccaagaagcggctctccagggggctttcgaagtccgacacctacgtggatccgaccgagtttggcaacgaccagagccatttgatctcgcacgcgggtgccgtcgacggcgagtcgcgcgatgcagcgcttgggatccacaagacggtcgatgtgtcgcagactgttgaggtattggatgggaatcgccgtcatagcgggagtgacagtagccatccgtctcgctattga

SEQ ID NO: 14982 - DNA, 960 bp, A.fumigatus
catcttcctcactcaaatgtgccacttgtgttctggccaaagaacatgtcgatggcggaagtggctggagcggaaaaggtacgaggccgcactcgcaagaacggcgcatactcacacggacaggctcaactccaacctcccttttcgcggtctctgcatgattcccgaaagcaagagactggaggaaacggtcctcgaccgaaagatggcagcgtcactgaaaccaccgaccgcagtccagatgtgctgctgacgctgccaaccatctcgcgcacagcaaaccaccacgtctatctcgtgcaggacgacatccagagcttcctccacaccgatctggacctttcacgagtcaacatcatccacaatctgctttggatggccggccgaccgatgaacgcgcggcccctcctgcgccagaaaatgatgggcttcgagatcatcccgaccgagcgtgcagacctgcacctgctgaaattctccaccaagctgctcgtcaagccgctgcccgagtacgtcctcgactacgacttctggacccgccatctctgctcctcgcagacgctgcatggatccgcaacggggctcctcctctcgtacctgtggctgatctgcaccccgctggacctgcagctcgctcatgaccaccgcctcatcccccacgatgtcacctggccctggtggaaggccttcgtcaccgagttctacgcgcgcgtcgacgtcaacgccctcgacaccgtcaacaagcgctaccagttcggcgagctgcggctcggccgcatcaacaccatctaccgcgtgcggttcttcctgtcgcatttcatccgcggctatctgtacgggtacaaccggtacgtggtgttctacgagcgcaactttgcctggatgttgatgatttttgccgttttcttcgctggtgttgtccgcgatgcaggtggcggcggatgtgccgcggttgaatga

SEQ ID NO: 14983 - DNA, 324 bp, A.fumigatus
ctcactgcgagacaggtcaacacggcgatgcagcagcagtggaaagacgcgtaccccgggttgctcggcaagctgctcacgacggcgatgctggctgtgggccgcaacgtcgagcagggctcgttcagtgccttgtatgcggcgacgagtcccgagattgaagagaaggggtggaatgggtactactttagcgatgtggcacagccggggaaggagtcggcgcaggcgtcggatccgatgctgggggctgcgctgtgggatttgagtcatcggctgctgaaggagaaggttggggaggatggcctggtggattggaatgcttga

SEQ ID NO: 14984 - DNA, 714 bp, A.fumigatus
tatatgttgtgccaaatgctgacggcaaaacagctcatactctccgcgggcatcaatgtcaaccagtacggcgagactgccgacgggctggaccgacacttcgaggtaaatttcctcggccaattctacgtcgtcaaccagctttggcctctgctgcgcaaaacggccaagatgccggggacgccgccgccgcgggttgtcttcgagtcgtccgagcagcaccgcaatgcgcccaaggtggtgcattttgggtcggtggacgagatcaacaaccccgagattgggacgacggaggtctacggccggacgaagctggcgattatcctcggagtcaggtatgggctgttggagagggtgatcaagccgaataaggataatatctatgtgctttcggtgcatcctggcgcggtgcgttcctttccttctagactatctgtctggtctaatagctcactgcgagacaggtcaacacggcgatgcagcagcagtggaaagacgcgtaccccgggttgctcggcaagctgctcacgacggcgatgctggctgtgggccgcaacgtcgagcagggctcgttcagtgccttgtatgcggcgacgagtcccgagattgaagagaaggggtggaatgggtactactttagcgatgtggcacagccggggaaggagtcggcgcaggcgtcggatccgatgctgggggctgcgctgtgggatttga

SEQ ID NO: 14985 - DNA, 249 bp, A.fumigatus
gaggtgaagatggcattgtcctcgcccttggcgacaccgtcggttcgcttccactgcccgatgcaggggccacaggcattggccaggacggtgccgccagcctcggagaaggaggccagggtctggtcacggtccagagtggcccgaatctgctcactgccaggagtgatgaagaagtccgccttgggtttcagaccagccgctgatgcctgcttgaccaggtcctcggcgcgagtcatgtcctcataa

SEQ ID NO: 14986 - DNA, 186 bp, A.fumigatus
  unsure (105): Identity of nucleotide sequences at the above locations are unknown.
attggaagctgtcggaatgaggggtgtttctatgatggcatcatcctttccctgttgggactaggccaaaatcacgggaaaaggctggaactaaacccgatcggngcagccctaagcgagggcttttgcaccaaacacacaacttccgctctgggaacaagtgccagcccgaccatctccatcgac

SEQ ID NO: 14987 - DNA, 543 bp, A.fumigatus
agggcagctggcagatatccatgcgcagcgtgtaaggatttaagcacgcagaaagtcgtgatgaggcttgttactaatcgtaggcagacattactgtacctcattcggaggagctacgcctatatctacgcacttctgatctcttcggaacccgtatctgaggccttgctgccagtctacaatcaattgcagaccttgcgacgatgtctcctggaagtcaaagagtctggaggtgtgtcgaattctcgcgaattgtacccatacagtatgaaggtgagtaacctccagcttccttgcaaggcacagaagttgacatcgtacagctcaactccattgacaacatgcgagttgacggcaaattttacatgggaaacgacattcctgaaggacagggcagcgttaatgcgctgctggctgaatgctatgatattgtatgggagctgcgcgcggctgtacctgacgactgagagagaaaaagcgcttaattctctgctggtgatattcctgtatcttgtccccttcttttttgtatcaacggcttga

SEQ ID NO: 14988 - DNA, 993 bp, A.fumigatus
gtaccacggacccggtgtcgagacgctcagctgcactggtatggccacctgttgcaacatgggtgcggaggtcgaacccaccacctcggtcttccccttctcccccagtatgggttccttacctgcaggcgacgcaccgtggccatgtggcccaggcgggcggccgagatcgccgcatctggccctaagaaccttttgcgggccgacgatggagcagagtacgaccagctcatcacaattgacttgtcaacgctggaacctcacgtcaacgggcccttcactccggatctgtcggtgcgtctatctgactttgccaacaccgtccgcgagaacaagtggcccgagactctgggttctggattgatcggtagttgcaccaacagttcttatgaggacatgactcgcgccgaggacctggtcaagcaggcatcagcggctggtctgaaacccaaggcggacttcttcatcactcctggcagtgagcagattcgggccactctggaccgtgaccagaccctggcctccttctccgaggctggcggcaccgtcctggccaatgcctgtggcccctgcatcgggcagtggaagcgaaccgacggtgtcgccaagggcgaggacaatgccatcttcacctcctacaaccgtaacttccccggacgcaatgatggcaaccgacgcaccatgaacttcctggcgtcgccagagattgtgaccgcccttgcctactcgggcagcaccactttcaaccccatgaccgacactctgaagaccccgagcggtgaagagttcaagttccgccctccccagggctctgatcttcctagtgctgggttcgccgacggcaaccctgccctccagcccagcgctggtgtgcctgacgcctccgtcgaggtcattgtttcccccacctcggagcgtctcgctttgctggagcctttcgctcccttccctgagggcgagctgtccggcttgaaggtcctgtacaaggtctag

SEQ ID NO: 14989 - DNA, 318 bp, A.fumigatus
cttggtgcatatttttctaggatccctaccactaaacgaccttcttatatcggctcgacatttccatcttattttctctctgctattggcattatggactcccccgccgcccccgtccctttcgacccgcaggagcaaccgatcctggagcgtcttctccggaccagagatgcactcctgctgctgaaacaagacaagtcgtcctatatcaaatctcgcgatgtgctgccgctatacgaagaagtgatctccgaggtggaaaagctcaatgctgtgcggaaggaacaagaccgccggctgacacacaaccgacgttag

SEQ ID NO: 14990 - DNA, 204 bp, A.fumigatus
ttctctgctggtgatattcctgtatcttgtccccttcttttttgtatcaacggcttgaaatatggtggttctcttttcttcgaggtttgcgatttttctcctgactttagttcaggcgtttgtctgggcgctttttgggatgctatgactccttttaacagaaatgagttgtcgccattgtgcaaacttgatcaaggtagctga

SEQ ID NO: 14991 - DNA, 1143 bp, A.fumigatus
ctggccccgaaatgcctctccccgcaacaattgttcgcacgacgtggcctagccactgaggcgtccgctgcacgcatgccgccttatcctaagatcgtgcggaatctcgagcaggttcggaaagtgctgggatcttcgcgtgcgctcactctggcagagaagatcctctacgcccatttggacaatgcggaggagtccctgttgacgggcactaacaatggaaaagacattcgcggcaaggccaacctgaagttgaagccggaccgagtggcgatgcaggacgcgtcggcccagatggcgctgttgcagttcatgtcctgtggcctgccgtcgactgcggtgcccgccagtatccactgcgaccatatgattgtgggtgagcgtggcgcggacaccgatctgcctgcctctatcgagggtaaccgggaagtgtttgacttccttgagagcgccgccaagcgctacggtattgaattttggccccccggtgcgggtatcatccaccagagtgtgctggagaactacgcggcccctggtctgatgatgctgggcacggacagccacacacctaatgcgggaggtttgggagctatcgctatcggtgtcggtggtgcagatgctgtggatgcattggtggatgctccttgggaattaaaggcgcctcggattcttggtgtgcgactggagggtaggctgagcggctgggcctctcccaaggatatcatattgcatctagctggtaagctcaccgtccgcggtggtaccggctatgtgattgagtaccacggacccggtgtcgagacgctcagctgcactggtatggccacctgttgcaacatgggtgcggaggtcgaacccaccacctcggtcttccccttctcccccagtatgggttccttacctgcaggcgacgcaccgtggccatgtggcccaggcgggcggccgagatcgccgcatctggccctaagaaccttttgcgggccgacgatggagcagagtacgaccagctcatcacaattgacttgtcaacgctggaacctcacgtcaacgggcccttcactccggatctgtcggtgcgtctatctgactttgccaacaccgtccgcgagaacaagtggcccgagactctgggttctggattga

SEQ ID NO: 14992 - DNA, 279 bp, A.fumigatus
caaaatactcttgttacaggcatcgcgtatcagctcgttcccgatgatccactcatcaacacggaacaatgcactcgcgacgttaagctcatggccgaactgggggccaacgccatccgcgtctaccatgtcgatccccatgccaatcacgacggctgcatgaaagttctggcagatgccggcatctacctgttcgttgatctcgacacttttgacacacagatcgagcaggtcagttctcattgcaggatacatattcttccaccagctggtccctga

SEQ ID NO: 14993 - DNA, 1029 bp, A.fumigatus
actgatcctcactggaatgaaacccagtatgaccggttcaagcaggtcttggacgagtttcaaaagtatgagaatacagcgggtgtgttcgttggaaatgaggtcctcaccacaaaggagggctcagccgctgctccctatgtgctggctgcggctcgagatatcaaagcgtaccgcgatgcgcagaactatcgaaacattcctgtgggttactctgcagcggatatcgcggagctgcgtcccatgttgcagaattttctggcctgcgcgaaaaaccctagtgatcgcttagacttcttcgcactaaatgcctacgagtggtgtggagattccgggtatgttcagtctggctatagagagcttcagagaaacgcaagtggctatccgatccccatcttcttctccgagactggctgcaacgctgcacggcctagaacctttgatgaccaagcagccattttcggtgaacatatgtcggatacctggtccggctctatggtctacgagtggatccaggaggtcaacgactacggtttggtcagttatggccctcctgcgccgaatgctcctccaacagacactcttgtttatgatggcttcactcgcaaaggtgttccgactcccgtgtctcctgacttccacaacctcaagacccaatgggctaccctttcacccactggcgtcgccttgtctgactatgttcaatccacctctactattagtcccccggagtgccctgcctacacatctggggcttgggaggtcgatcccagctctccgctgcccactctgggccagacgcagacgaactctggccccacataccaggtcactaatgtaagcggttctggaaatctgccagtcctcagcgccacagctaccaggtcgacatcctcgaccccgacacaagtgctccatagcggtgctgccagtcccctttctcttccacggatcgttggctcgaaatatatcgcgagcgcatccgtgtcggtcgggtttgtgattggtatggttgctgtgtttctatga

SEQ ID NO: 14994 - DNA, 1098 bp, A.fumigatus
  unsure (365): Identity of nucleotide sequences at the above locations are unknown.
gaaaacaacccggttctcgaccatgggtccaaacaagttccgttacccccagggtaccaggcaatcccaagaccaagaaagggttcatgcccatggttatgcggagattcgcggccttgggttttacacgtcccccatctcaaggaatggacgcaggcctccaacttcaaccagtcaggtttgcaaggaacgcaattcgaatgccccaacctcgtcaagttttcagtcgacgactgcgacgactcagaggaccccaccaagtgggtgctcttcatttccgtcaaccctgaagcgccactcgggggctcgggaacctactatgtcgttggaagcttcaatggaacccatttcacttcggaaagccnccgcgagaccctctatgacttcgccaaggacaactacgcctctcagtggtactctggcatccccgaggacgagcccccggtctccatcggctgggccagcaactggaactacacccagcaggtgcccaccggccccctcgaaggctggagaagctccatgtcgctgcccaaagtgcacaccctgaccaaggtcgacggctcctgggtcgtcaccaaagaaccattcgacggattggactccgtccgcgggaagcaactcaagggtaagcgctcacggaacggcgatgtgacctttgacttcaaaaacgtcaaatccaatgctgtcgccttcgacgtcaagatcaacgggatcccctcatctggcgcaacgggccaggtctacttcaacttcacctcgtcgacgtcgggcgagtacgtcgatggcggtctccgattggacaacggcttcttctggatcaaccgtgcgggaacccatctgttcactcaggccaacagcaccggctactggcccgtcttcaacacgaccgtcaagtcctacgaccaccacaagttcaccttctccggtgtcattgatcgctccctgctcgaggtcaccctcgccgagggtgttcaaactggcacaatgagtttctacccaacccatccgctggataccctgaccgtgtccggcagcgatctgagcaagaagacttctttccgtgctaaggcctggggcttggagagcggctggtaa

SEQ ID NO: 14995 - DNA, 234 bp, A.fumigatus
cctgctaatccctgtgactgcagtggtgcacccaaggatgagtccaccattgtctccagaatcgtctcagcagagtactggcagcgacaatgtcacgcgtatttcccagaagtcaacggctatacgttcggtagcgccaatggcaagaccgctgaagacgtgaataagtggaccaagggctgggacttgaccaacacaacacgtctgatctgggcaaatgggttcgttgtatga

SEQ ID NO: 14996 - DNA, 561 bp, A.fumigatus
  unsure (376): Identity of nucleotide sequences at the above locations are unknown.
cccccaagtaagaaaacaacccggttctcgaccatgggtccaaacaagttccgttacccccagggtaccaggcaatcccaagaccaagaaagggttcatgcccatggttatgcggagattcgcggccttgggttttacacgtcccccatctcaaggaatggacgcaggcctccaacttcaaccagtcaggtttgcaaggaacgcaattcgaatgccccaacctcgtcaagttttcagtcgacgactgcgacgactcagaggaccccaccaagtgggtgctcttcatttccgtcaaccctgaagcgccactcgggggctcgggaacctactatgtcgttggaagcttcaatggaacccatttcacttcggaaagccnccgcgagaccctctatgacttcgccaaggacaactacgcctctcagtggtactctggcatccccgaggacgagcccccggtctccatcggctgggccagcaactggaactacacccagcaggtgcccaccggccccctcgaaggctggagaagctccatgtcgctgcccaaagtgcacaccctga

SEQ ID NO: 14997 - DNA, 186 bp, A.fumigatus
ccagtcggactcggacatgcaggtcagtacggtcttagaaaactggagcaaggtctcaacttagatactgtcgagaaatccattccactgtctcagatcctgcaggatgagaagggactcgtcaaggtttacagctatataaatccttctagaacatggctttttactaccttaaatgaaaattga

SEQ ID NO: 14998 - DNA, 222 bp, A.fumigatus
tggcaatatttcgtccccgttgtcgaggggatgcccaagaactgcagcaaggatctcaaccgcgtggtggagtatattgaccacgtctatgagtcgggggatatcgagcgccagcaggaaatcaaagagatgttcgggttgggagctctcaagcattttgacgattttgcagcgtatgttgcgttcgccttctttgaaaggcggatcatgccttggtactaa

SEQ ID NO: 14999 - DNA, 1500 bp, A.fumigatus
cgtcatcggtcgatcagaactctttacaattgtgcttgctacgcagtcaaaccagccgcaatgtctgaatccccgaagtccgagaagtatatgtgcctgactcggttcagcacgccagttcccgaattagatgatcatcgatttcaacttgattccccacctcgaatcgaagctaccgctgatatttctctgagtcggcaaaacactgctcagcatgcctaccatcaagagacgcctcagcgtcccgatttgctctcaattcaagatgcgcttcgggaagcgggatcgctttcccgggattttgagcaagctatactggatgatgatcgatcaggcaaagatatcaatactctcggccgtcgcttctccgttgacccaaacggtaatgtccgccatggtcgtacgtggagccgaacccatcaggaacttgcgaatatgtcacgggaatcatctccctcagcaaggtcatcgtcgcctccaaattcggttgaagccttcgcagacccccgccgccgcgagcgtgcgaatacactggagagccatgcggccccagatctcgaggccattctgcagcgcacagtgtccggtggtactcatccccgccgcccgacctttagtaacgcaagtgctatcagaccgcaaccaggtgatatccagctagaaccaaacgacgagagttgcgtaccgacgtatgagcaacctggcaggatcccggtgatcgactacgaagaattggaggaatttgtggctttgagccggcaaatgaagccctcaacttcccggcgtaagcagagtctaagctctcagagtcgggggcctcgcgttttctatgatctgcgcccagggcttcggaagtctgatgttgaaggcgagaagcgttcttcgagtgctgatcgctcttcttcggacctcatggacgcagatttgaagacagccgataaggtctatgcgaacgtcgtggatgaaaaagacatagtggaaaagcttcagaatgagaacgagccgacccgcttcggctttttctcatccgagtcccagagcactgtgcatgcggcggaaatgggggaccttgtgctccctggtgatactttccgggatctctttcaacttggcccggaaggaagtgtgtggtggttggacgtactcaatccaacagaagaagaagttgctgcactctcgcgggcattttccatccatccactgactacggaagatatcttgactcaagaaacccgtgaaaaggtcgagcttttcaagcaatattactttgtctgcttccggacattctatcagctcgacaagacagacgaacgcttcatggaacccgtcaacttctacatggttgttttccgcgacggggtcctctcattctcattcaccgagaaatcacacgcggcaaatgtcaggaaaaaaatggggaagcttcctgattatgtgtccctcaataatgactggatctgttatgccatgaatgtaagtcacaaaggccttgatttctaa

SEQ ID NO: 15000 - DNA, 606 bp, A.fumigatus
aagagtcacttctccccaggtgggtacatctataattgctgctcagtatcaagagataccagccagtctgttcacttcatccgattattgccctttcaggctcctgactttctttcatgcctttctaatcagaccgttgatctggcaatatttgacgtccctgatactgcgatgtctgtctcctccttcattatcagaacgccctgttcatcggccaatatcggccctgggttcgatgtcatcggcctagcattgtctcttcacctcgaactacatgtcaccattgactcttccaagtcatcgtccgagcatcccttgaattgtgtgattacctatgaagatcagagcaagagtactgagaagattagcctggacccggaggttaacctgatcacccgtgtagctctgtacgtacttagatgccatgaccaaagggcatttcctgttgagacccgagtccatattgtaaatcccattcctctgggtcggggtcttggttcgtccggcacagcggtggttgctggcgtgatgttgggaaatgaagtaggtcgtcttgggttgagcaaggacagactactggattattgcttgatgattggtaggtaa

SEQ ID NO: 15001 - DNA, 435 bp, A.fumigatus
atatggcttgaatttcacatcaaacatatcatgtttggccttcctactgataactatctgtattctttagagaggcacccggataatgtcgctgcctcgctctttggaggctttgtcggtacctatctgaatgagctgaaacctgaggatgtagcccgcaaggagatcccgctcagtgaagttctccctgccccggcaggtggcattgacacaggcaggaggccccccgagcctcctctgggcatcggccattatcgaaagtttcaatgggccaaggaaatcaaggccatcgcaattatccccgactttgtggtgcccactgccaatgcacgaaacgtcctacctaccacgtacacgagagcagacgtcgtaagtcccacacatctcaatcatccgcatcacgaaccgtttgcgatgcgcttctcgctggtctaa

SEQ ID NO: 15002 - DNA, 291 bp, A.fumigatus
  unsure (102),(172),(253): Identity of nucleotide sequences at the above locations are unknown.
gtttttaatctacaacgtgctgcattgcttcccgcaacactgggcaactctccgccagaaccagatatgatttacctggcaatgcaggacaaagtccatcancccataccggaagacacttatcccaggcttgaaagagaatccttcaatccaatgaacccatctacccaanccggggctaatttggggatttgttcaatcccgggccaagaaccaaccatttttggttccaacccaatgaataggttcgaanaaaatccccggaccccctccctgttctccatttgggct

SEQ ID NO: 15003 - DNA, 801 bp, A.fumigatus
cctgcttgggaatgcttacaactcccacatctgatttgtgccattgcctcgttttctgtcgagaatttcgcgtctctgcagccttggattgctctaacacgatgcttgaaaattcagggaaaatcgctagcattgccatacgctcgtgcagtccacgagatggtcccaaccacacccctccgcaatgacctgaacattcgaccccacgagtccattaacgatctccccgtccaccgcctcaccgatccccagatcttctaccccgtctccgagtcccggcaattcacccgtgttgacgccggtcgcgtgttctccgccgctcccgccctgccacacaaagaagccgagcgcgccgtggcccaccccgacgaggctataagcaagatcacgcaggacccagcccgcattgagcgcgtcggtaagggcgacgacgagcagcaggtcctccagcccgcggacgtgcgcatcccgcacccgcacctggtttcccacgagcgccaggtgaagtcgaaccccaacgagttccgcgagaacatgaagctctaccgcgagcggctccagcaggaggaggcgatcgagcaggaacgcaagagactcgccaaggagcgcgccgagcagcggcttgtccgcgtgcagcctgagggctcgcggttcgagttccgcatcaaggatgtcgttgtcagtcgcgagacgacgggcacggatggtcgtggtgcccaggcgcccggtcggagatacggtgtgcctacatacgaccgcaagaagggacagatcaagatccctactcgcgtggaggtctaa

SEQ ID NO: 15004 - DNA, 420 bp, A.fumigatus
agacaattgaaacaacacacgccagggcgaacgaattacattactcgcctcaagggcaatgccggtaatcggccctttcctctgaaccctaatttcgtcagtgagcccatactcagcgaggagctgcgcaatgagatccaccggcgcgttgtggacaaaaagcagagtgtgcgtgcagtcagtgtcgacctcggtgtggatatgcgacgagtagcagccgtggttcgattagtagaattagagaagcgatggaaacaacaggtatgcatgttttcatttctttctgctctgtttcagatctgccggctatttcctgtgttacgatggcattgtacaatgatgagaacaacaaaaatttcgattagtctttatgagcccgagcttaacctgcttgggaatgcttacaactcccacatctga

SEQ ID NO: 15005 - DNA, 750 bp, A.fumigatus
gagaacattggattcaccggaatcaaaatccgcatttgtctggaggaggttcccaccgaccagtttacgcccgagcggatattgagtcccgaggaaccgttaggcgtggtccttgacacttattttcctggtggtcagacggtggacgaagcgttggtcatagatatccctcaacggcggacgccgaagccgtccccccgtcacccggtatattatcaccattcggaaccgggagagcatggcgagtactttccgctcatgcctgcgaatccaaatgccccgaccccccccactcatctgtcggcctcatctacgagtgtgaacgcccaccatacgggcccctcaatctctattctcaccacgggtatggcgcctccgctaccctcaccaggcaatagagcgaaccgacattcccgccggccaccactcactcgacatactactaactcacccacaatgcttggcacagcgccaaatccaaaaggtatgcgcggactctcactgttattcttcgtgccgttaagagcccattccttactgactagatgtagactcgaatatggcctcgtgtcctcagcctcccgtagcagcgccccaggtccctacgccacctggtcctcctcccgagtcgccccagaccaagacgcacacgccgccagcgcgtgttgcctcgccgcgccctcgtcccacgaaaccgaagaaggccggcaacggccaatcgccaaacgctgcctttggtggccttattga

SEQ ID NO: 15006 - DNA, 717 bp, A.fumigatus
ctagatgtagactcgaatatggcctcgtgtcctcagcctcccgtagcagcgccccaggtccctacgccacctggtcctcctcccgagtcgccccagaccaagacgcacacgccgccagcgcgtgttgcctcgccgcgccctcgtcccacgaaaccgaagaaggccggcaacggccaatcgccaaacgctgcctttggtggccttattgaaggcacggtacctcccatcaatgtcctcatcgtcgaagacaatatcatcaaccagaagctcctggaagccttcatgaaacgcctcagcgtccgttggaagtgcgctgcgaacggtgaagaggcggtgaggaaatggcgcgagggtgggtttcacttggtcctgatggacatccaactccccgtcatgaacgggttagatgcgaccaaggagatccggagacttgagcgcctaaacgggatcggtgtcttcaccaagacggcctcgggacgatcgagtgccagttctttgtcgccggaggttaaccaagcatcatcggaggtttcgctgtctgaggaggatactcttcatgacttgtctctgttcaagagtcccgttatcattgtcgctctgaccgccagtagtttgcagagcgatcggcatgaggctctggctgccggctgcaatgactttctgaccaaggtatgtcattccgacgctacatgcatcctggtccgggtggatggctga

SEQ ID NO: 15007 - DNA, 441 bp, A.fumigatus
cctgttggatttccttggttggaacaaaaggtgacagaatggggctgcatgcaagctctgattgacttcgaaggctggcggaaatggcgaggatttgccgacgaaccccagtcatcttctcccaccgatggaggtttcaccagccctctgcaggcgggcgctaatggtgtgtccagtaaaacctcgacctccccgtcatctgcagcagtcaacgcgacggcccgggcgtttgccacaggccctggtgcgggtaaacgcaaatcaaccgttcccgaattgaccaagcccgtggatatccttcctgaggaacctcccggaagtggtagtggtgagggcaacgagactctaaattcaccagccagccctcttacctccgtgcatgtgggtgacccaactgagcctcctggtgacgaggagcagcaagctctggatgctacgtag

SEQ ID NO: 15008 - DNA, 381 bp, A.fumigatus
catcctatggagatgcacacttttctcttttcccccgaaaaagtcttcataaaggcattgggatactcggaggatgctctctcccgcccgatcattggcatcatcaatactttttccgggttcaacccctgccatgcgaatgtaccccagctgatcgaggctgctaagcgcggtatccagctcaatgggggcctggcgatagaatttcatactatcagtatacatgagtcattctatcatccgaccagcatgttcctgcgcaatttgatgagcatggatacggaggaaatgattcgagcccagccgctggatgcgtgtatcatgattggaggtccgtttatacgcttccctattcttgcaaagccagcaccccagacatag

SEQ ID NO: 15009 - DNA, 576 bp, A.fumigatus
  unsure (533),(537),(539): Identity of nucleotide sequences at the above locations are unknown.
tcgtacaggaaggccctcttcgtgcgaaagctgacagcatccagtgagctcacagtcaagatcgtcaacatcgaagacatgacgaaagtcaagtacctccgagagcaagccaaaggcacgaagcacgtttccttcgatccaaacggacgatacatagccgtctcgtgtactgacggtcttctctacatttattcgactttcttggaggagccagaattagtacggaagttggacggcgtcatccgacgacttgaagcggaggacgaggcaacggcaaagatcgcctggcaccctgatggcacagcatttgcagctgccgaagtgaccagagacatcggaatctatactgtatctgaatggaagaaggaaaaggtcttctcgggtggtcacaacggagatattacatcggtcagctggtcaccaaatggggctcttcttgccacagctggtgccgacggcaagattttaatctgggaaaccaaaacgcagcaagtgctgcaccgttacgacttttcctacgttggccgtccctntttncnctcggagcagggcggggccgaaattatgccatgggga

SEQ ID NO: 15010 - DNA, 795 bp, A.fumigatus
  unsure (93),(94),(138),(183): Identity of nucleotide sequences at the above locations are unknown.
tgctgggggtatgctggcgctactgcacactcttcgtccccttctgcacctctcaaccctggacgatctctgggccagactttgggcgagttnntggacgcatctccatttcgcacattcccactttcgcagcaggtnatcagaacactatccaatccactttacctttcatcttctctcgtngtcctcaaagtaaacatcgcaccggacggcgcgatcataaaagcgtccgcctccaaagatcgcaggctccttacccacacaggaccagctgtcgttttcgaaaatccagaagatctggccaaaaggattgatgacccagacctagacgtgactaaagactcggtgcttgtgttgaaggggataggtcctattggcaatcccggcatgccagaagctggtctgattcctataccgcgcaagcttgcttctgcaggcatcaaggatatgctgcgtctctcggacggaaggatgtcaggaacagcgggcggcactattgtcctccatatttcgccagaatcagccttaccagagtcaccattcggggtggtgcagactggcgatatgatcacttgcaatgctgatagcgggaagctcaacctggaaatttccgacgaagaactcaaattccgtgtagagacgaggaagaaagaagcggatgcagccacagcttgcttgcacagagcacggagcagaggctatcgaggcttgtatgaacggtcagtcaatcaggctcaagacggagccgattttgacttcctaacagccgttgggccatcagatatcagtaaatga

SEQ ID NO: 15011 - DNA, 873 bp, A.fumigatus
aggaaggttattcggcccacacaccaggcattcgtctcttgggatgaaggaaatgaccctggtgtcaagtttcgtgatcttgacgatgtatcagagtcgatgaagcaacgcatccggaagttcaaagaactgggactttcgccaaggtccagcgcccctggtcatttgtctcttttttgggccctgaacgccaactcacccaacgttgttttctggaatattcttcgcatctactctgaccctgctcttctggaggaagtacgaaaggagattgctccctttgttaaggtctatagacccagtcgcgaggagactgggctcccattccaggaacccgtcaaggtctcccttgatccggatgagttgtttcgatcttgtccactgctcaaagccagcttctatgagactatgcggttagattcagcaggactttcctttcgtgaagtcacctctgacttgactgtaactgagtctcctgaggatgctgcagctgccagcttggccgaaccacgcacttaccgaattaaaaaaggaggaaacatagtcatggcgcacgggatggtccaaagagaccctcggctcttctctaacccagaacagttcgatccgctccggtttgttgtcacagatccagacacaggcgcacgaaaggcggacatgcacacaatttatccattcggggccggcgtttcgggctgcaagggccgcgctctcgctgaaaggatgaacttactgttcactgctgcaatcatttcaacgtgggatatcgaaccggcaagtggcaaagctttgacagttccaggacataggccttccagtggggcgtatttgcctaaggatgacattagagtacgcttgagaatgcgcgtatag

SEQ ID NO: 15012 - DNA, 297 bp, A.fumigatus
tcatgtctgactgagctaggttgtgacaaaaccgttcccgcacaacttatgggtggtatctcggccaataagccagtcttgccgcttgtaacaggaccgatgatgccgggaagctaccgcgggcagagaataggtgcgtgtactgactgccgcaacaactgggcggctttccgtgcaggagacatagacatagaggagatttcggctatcaatgacgagctggcaccgacggtttgtctctactgctacagcgattcccaattgtcggcaatacatcacgctgactcaggcttctaa

SEQ ID NO: 15013 - DNA, 591 bp, A.fumigatus
  unsure (488),(489),(533),(578): Identity of nucleotide sequences at the above locations are unknown.
atcgggacctgcggtgtgatgggaactgccagtacgatggcttgtgtcaccgctgctctagggctgatgcccctgcgcggtgcttctgcgcccgcagtctcgtctgccagggtcaggatcgcagaagagacaggagccaatgctgtggccgcggcaatagctaagaggagaccgcaagatattctttcgaaagagtcgtttttgaatgctatcacagttcttcaagcgatcgggggatcgacaaatgccgtcgtccatctaatggctattgttaatcggcatcccaagctccagggagctataacattagatacttttgcggagattgggcggagcactcctttgctgattgatttgaagcccaccggtgacaactatatgaatgatttccataatgctgggggtatgctggcgctactgcacactcttcgtccccttctgcacctctcaaccctggacgatctctgggccagactttgggcgagttnntggacgcatctccatttcgcacattcccactttcgcagcaggtnatcagaacactatccaatccactttacctttcatcttctctcgtngtcctcaaagtaa

SEQ ID NO: 15014 - DNA, 207 bp, A.fumigatus
ctgctgatagattatagtctctgctcggggaatgtcctgcctggtcgtcctgcatcgttatcgactgaaaacagcaaaagcaagtataatttacgtatgtatttgctgtccttttctaatttcaattgcagaacaggagtcttccacgtcctcgctcatgaggcgatcaatgatcctgatagcgtcaatatcggcacaactccgtga

SEQ ID NO: 15015 - DNA, 189 bp, A.fumigatus
ggagcctgcgagaatcccaggtcatcaggtgcgcacgatggcatcgactactctgcgtgctgtgacgcatcgcttgacgaccacgcctgtcgatcaattgcctcagatcgcatcattcctagcaacatcattgaccgattgcggggagctcctgtctgcgacacagaatcagaagtcgggcaagtctga

SEQ ID NO: 15016 - DNA, 927 bp, A.fumigatus
  unsure (761),(762),(763),(764),(768),(786),(787),(795),(811),(813),(815),(816),(818),(819),(820),(823),(826),(827),(828),(829),(871),(903),(904),(905): Identity of nucleotide sequences at the above locations are unknown.
gtcggtcgtcgacaggcctggtcaatcgctaatctcttatttgcgcagaaaccggatcctatctccacgaagaaaatgtgtataatcacattgacacggatctttcatcttacctaccaataccccactctcgttcgggaaatcacgacgccgtcactaccaggattcatcacttcgtcgttgaatctcatctccgtcaagccggcttccgagcctattagaaaattaaagcccaacacgccgttcttggagattgtcctgagcgctttcttggagctcatcgcaagacacccaacgatattccgcccgttttctgcgcagattcacagtatcctccaggaaatcattggtgcaaccgctccgacgtttcccggcgcaaccgtggacctagcggagcagttgttcatcgcgctccacaactgtgctccgaagaacacatccgcagaggaatggaagaacgcctgccggttgacaatctcttcagcgcacagggccgcggactatgttttgagaggggtagtagagcagtgggagtctgtcgatgctaccttgagacaaggtgctcagccgcaggattacagccaggtggtggctgatgctgggccagatgcgctaggacttcccggctgggagggcattcatgctggagtggaaagactgacggtactcttacgcttgctagcccgatttctgacagtaccgacggcgtcggcggtgacaattccactgggcttgattttggatctgacatcacgactttnnnngggngggggggggggggggggnngggggggngggggggggggggggngngnngnnnggnggnnnngggggggggggggggggggggggggggggggggggggggggngggggggggggggggggggggggggggggggnnngggggggggggggggggggggg

SEQ ID NO: 15017 - DNA, 384 bp, A.fumigatus
  unsure (24),(25),(26),(58),(100),(101),(102),(103),(106),(109),(110),(111),(113),(114),(116),(118),(134),(142),(143),(161),(165),(166),(167),(168): Identity of nucleotide sequences at the above locations are unknown.
cccccccccccccccccccccccnnncccccccccccccccccccccccccccccccncccccccccccccccccccccccccccccccccccccccccnnnnccnccnnncnncncncccccccccccccccncccccccnncccccccccccccccccncccnnnnaaagtcgtgatgtcagatccaaaatcaagcccagtggaattgtcaccgccgacgccgtcggtactgtcagaaatcgggctagcaagcgtaagagtaccgtcagtctttccactccagcatgaatgccctcccagccgggaagtcctagcgcatctggcccagcatcagccaccacctggctgtaatcctgcggctgagcaccttgtctcaaggtag

SEQ ID NO: 15018 - DNA, 927 bp, A.fumigatus
  unsure (819): Identity of nucleotide sequences at the above locations are unknown.
attctttatcgcgccgctacaaagacctaccactcttacttgattctccgtcgcctattccacgtccattcagctctggcagattttgatctcgctgtcaaagcactcgattcgtacattgagattgtccttggggccaaagcaagggcggagaaagcagcacagtacggcgaactagaaagcgacgagaatttgctccagacgcttgccgaaggagtaactatgcttgtgtgttttggctcagataaggaggctgaaaaagcgaaggacttggttgcgatcttgaaaaagttcgtcgctaagcacgtgcaagagattgaagacgacggggaggaagcaaagctcgtcatccggcaagattcggatgattctcaggtggtgtctcctcgtgtcatcgccactgcttacagagcaatcgggacagggcttgccaactgggcgagttggacgcctagaaatgaagaccgggatgacatccgtgcggaggccatcgagaatctagagagaagcatcgctccagaacttggcgatgagttcaattactcatctttgtatactctcgcccttttgctcgcggaaagccgagacctggatggtgccatcgattatctcaagtcggctctgtcctacacgcaaacacacggcccacagtccgatctttccagagaacgagacctagtgccgctctggcatttactcgcgctcttgctaagtgcaaaacaagactacgatatcgctgagcgctcttgcgaagctgcattcgaacaatttcccagcgccgtcgtatcattggtgaatgggagcagagggtcacaaaanccaaggacagatcccgtatacccccccaagactacggaattaggcccacccttggatcaaccacctgcgtgggccaaaaaagggacccctcctctcaaaaccccctga

SEQ ID NO: 15019 - DNA, 432 bp, A.fumigatus
cctcctacctccccggcttccgcatctcgcaacaagccggcggcaccaacaaggaagacatgttcgtcgaattcaacatcaccgctggcagctggggctgctcgctcttctcccttcttccccgccggcacgccggtcaccacctccggagccgccgcgcccgtcgagattttcgccgtgaacggccccctcagccggtctccgcacggcatcgacgtgtcctgggcgtactgtccggcacccggggcgctggtcgggagtaccgcctttgagtcggatcccaacgaggcgcggacgcggttcgtgaatagtttctcgtgcacggataagatgacgtatcggttgagcattgcctcgtggtacaagcaggcggcgagtgtggagtttgcgcaggggccgggggttggtctgaggatgactcacaactgttaa

SEQ ID NO: 15020 - DNA, 522 bp, A.fumigatus
cggaggattcaaatggaggatttgatctattccatgtctctgtatatagaaacactctcggcaatcaaacacccctcacttcaccatcccaaactctcggcatcgtataacccatcagcctcgcaccggacactaggaacgaatacgagcttagttcgactagccacggactacatatataagcccatcatcccccgcaacacgatcatttctctgggattcctccgtgcccccaagcgaagccgcaaaatgcgcctcttcaacgccacctcccaccaactcaccgacttcgtcgagaccatcccgccctacgccatcctctcccaccgatggcaggacaaggaggtcctcttccaagacatcgtgtcgggcacggcacgcaccaaaaaggggtacgagaaaatcacgcaatgctgcgcacaggccctccgcgacaatctggggtatatctgggtcgatacgtgctgcatcgaccaagaccagcagcgcgaagttctcggaggcgctgaactcgatgtatga

SEQ ID NO: 15021 - DNA, 1599 bp, A.fumigatus
gtggtattcagaacgcgggaggtgtggtacgcttatctgtgcgacgtggatgtggctgatacgtcggacggcgaagtgccgtcggaaggaggaagaagcagtggcggggggttcggaggcagtgtctggttcacgcgcggctggacgctgcaggagctccttgcgccggcgcgggtcgaattcttcaatgcggattggcacccgctcggcgccaaggcggagctgaagagcatcatcgctgggattaccggcatccccgaggcggtgctggacgggacgcgccggccacaagagctgagcgtcgcgcagcggatgtcgtgggcgtcgcagcgggtgacgaccaaagtcgaggatatggcgtatagcctgctcggcctgttcgagatcaacatgccgatgctgtacggggagggcaagcgggcgtttatccggctgcaggaggagattatgaggcagtcggatgaccagacgctgtttgcgtggacgaggtcgtcgggttcgagttcgtcgccggcggatgctgagacgacctaccatgggctgctggcgcagtcgccggcggactttcgagacagcggcgagttcgtgcagtcgcagcaaaggttcaaccggagtccgttctccgtgacgaacatggggatcagtattgagctggctgtggtgcactggacgatggacaggtacctcgcggtgctggactgcgagatgcagagcaagaagagccgggtggggatcttcctcgcgccgctgccggaaaacaaccaatatgcgagggtgatgggcgctggagaccacctgccgacattgccggccgacgtgaagtccgagtatcgcaaggtgtacgtgagacagagaatcgcagggaccccaaggcccccggagcgcatgtacgggttctggctgcggcagtttcccccggtttggaagggccctcactcgcaattcgaggtgacggcgtaccacccctgggacgaaacagagcgcaagctctgcatcccgccggggaaacggggcaccgggggaatcatcagatacttcatgcgccaggacccggtcgtgaacctgcgcgtcggattccacgccctgctgaaccccggggtcccatttggtggcttttttatgcccgacgcttgggttccgagcgcgccgatcccatgcctttcgaagcgcagatggcggccgaatggatggacaaacggggggagtgcgttttcatcggagacaggaaaccacggcctcaacgtgaacgacgggatgatccgcatcctggtcctggacgaggtcgtccagggacagccaatgtgggtggtctacatcgcggagccggaaaacggagcctggcacaaagactgcgtctgcgacggatgccagctgacggtgtttgggacgcgatatcgatgccagtcatgtcctggatttgactactgttccgactgcttcccgaacgcgaagcacacgcaccccggccatgaattcctcgaggacaagcctgtttggcatgctggagtgtactgcgactggtgtgctgaggtgagtatgctgctttccttgtcttctgcgttggctgactccacaggggatatatggcccgcggtataa

SEQ ID NO: 15022 - DNA, 585 bp, A.fumigatus
ccacggactacatatataagcccatcatcccccgcaacacgatcatttctctgggattcctccgtgcccccaagcgaagccgcaaaatgcgcctcttcaacgccacctcccaccaactcaccgacttcgtcgagaccatcccgccctacgccatcctctcccaccgatggcaggacaaggaggtcctcttccaagacatcgtgtcgggcacggcacgcaccaaaaaggggtacgagaaaatcacgcaatgctgcgcacaggccctccgcgacaatctggggtatatctgggtcgatacgtgctgcatcgaccaagaccagcagcgcgaagttctcggaggcgctgaactcgatgtatgagtggtattcagaacgcgggaggtgtggtacgcttatctgtgcgacgtggatgtggctgatacgtcggacggcgaagtgccgtcggaaggaggaagaagcagtggcggggggttcggaggcagtgtctggttcacgcgcggctggacgctgcaggagctccttgcgccggcgcgggtcgaattcttcaatgcggattggcacccgctcggcgccaaggcggagctga

SEQ ID NO: 15023 - DNA, 471 bp, A.fumigatus
cgcatcaacattccgcgcatacataccatcagaacttcaatatcacacattttcaaagcaacaagctacaccatgcgcttcctcacatccatcacccccctcgtctccctcctccctctcatccacgccctccccagccccaccagctgcaccaccgtcaccccggacatcgcccgcgtctctgaagcggacccagtagcctcctacctccccggcttccgcatctcgcaacaagccggcggcaccaacaaggaagacatgttcgtcgaattcaacatcaccgctggcagctggggctgctcgctcttctcccttcttccccgccggcacgccggtcaccacctccggagccgccgcgcccgtcgagattttcgccgtgaacggccccctcagccggtctccgcacggcatcgacgtgtcctgggcgtactgtccggcacccggggcgctggtcgggagtaccgcctttga

SEQ ID NO: 15024 - DNA, 519 bp, A.fumigatus
acagcacctgcagaatgtcaggatcatcatgcgctcattgacactcgcatctcaacaccgctttatctgcatctttttcacctgagatctgtcactttcacccctgacaacttacagcgagacacatcgaagatggggtatgtgaacaaacaccatacacatcatgatgtactgacaagcaacagatacacccactactacaccgtcgacaacacgtccagccgcgaatggcaaaccgcctggccgcagctcgtcgaggacgcgcaaaaaaacatcgacagcgccagtatccctattggcggtcctgacttcgacgccggcccacccatcatcgacgtaaagcagggaatacacctcaacggggtcggagacgacggacacgagcctctctgtttggaccgacacggcaacgccggattttcgttcatcaagacggctcggaagccatatgacgaggtggttgcgtgtatcttgctccgggcggctgtgctggctccgacctgtgtttgcttgaggtga

SEQ ID NO: 15025 - DNA, 1575 bp, A.fumigatus
aaacgcactccccccgtttgtccatccattcggccgccatctgcgcttcgaaaggcatgggatcggcgcgctcggaacccaagcgtcgggcataaaaaagccaccaaatgggaccccggggttcagcagggcgtggaatccgacgcgcaggttcacgaccgggtcctggcgcatgaagtatctgatgattcccccggtgccccgtttccccggcgggatgcagagcttgcgctctgtttcgtcccaggggtggtacgccgtcacctcgaattgcgagtgagggcccttccaaaccgggggaaactgccgcagccagaacccgtacatgcgctccgggggccttggggtccctgcgattctctgtctcacgtacaccttgcgatactcggacttcacgtcggccggcaatgtcggcaggtggtctccagcgcccatcaccctcgcatattggttgttttccggcagcggcgcgaggaagatccccacccggctcttcttgctctgcatctcgcagtccagcaccgcgaggtacctgtccatcgtccagtgcaccacagccagctcaatactgatccccatgttcgtcacggagaacggactccggttgaacctttgctgcgactgcacgaactcgccgctgtctcgaaagtccgccggcgactgcgccagcagcccatggtaggtcgtctcagcatccgccggcgacgaactcgaacccgacgacctcgtccacgcaaacagcgtctggtcatccgactgcctcataatctcctcctgcagccggataaacgcccgcttgccctccccgtacagcatcggcatgttgatctcgaacaggccgagcaggctatacgccatatcctcgactttggtcgtcacccgctgcgacgcccacgacatccgctgcgcgacgctcagctcttgtggccggcgcgtcccgtccagcaccgcctcggggatgccggtaatcccagcgatgatgctcttcagctccgccttggcgccgagcgggtgccaatccgcattgaagaattcgacccgcgccggcgcaaggagctcctgcagcgtccagccgcgcgtgaaccagacactgcctccgaaccccccgccactgcttcttcctccttccgacggcacttcgccgtccgacgtatcagccacatccacgtcgcacagataagcgtaccacacctcccgcgttctgaataccactcatacatcgagttcagcgcctccgagaacttcgcgctgctggtcttggtcgatgcagcacgtatcgacccagatataccccagattgtcgcggagggcctgtgcgcagcattgcgtgattttctcgtacccctttttggtgcgtgccgtgcccgacacgatgtcttggaagaggacctccttgtcctgccatcggtgggagaggatggcgtagggcgggatggtctcgacgaagtcggtgagttggtgggaggtggcgttgaagaggcgcattttgcggcttcgcttgggggcacggaggaatcccagagaaatgatcgtgttgcgggggatgatgggcttatatatgtagtccgtggctag

SEQ ID NO: 15026 - DNA, 207 bp, A.fumigatus
acccactcggatttctcggcctggtctatacgctatacattggccgttgcgtattttacgatcaccctcatcttccattctttccgttacatcaaggtcaaaggttcatcactggcgttttgtctcctttgtattctcggagttctcacggggtcacgccattcgcattactatgttcgatcatccacactgctgcataatgcatag

SEQ ID NO: 15027 - DNA, 642 bp, A.fumigatus
  unsure (404): Identity of nucleotide sequences at the above locations are unknown.
aaaccccccccccccccccaaaaattttttccccccccctttttggggccccccgccgggggggggggaaaaaaaaacctctctcttttccccccaaaaaaacccccttttaaaaaatttttttttttttcccccccccccttttttttttttttggggggttttttttttccccctttttttttgggaaaaaattttaaaaattttccccccccccccccttttgggggggaaaaatttttttccccggggccccaaaaattgggtttttggggccctttccccccccaagggggcccaaaaaaaacccccccccccccccaaagggggccctttttggggttttggggggggggccccccaaatttttttttttttttttttttttccccaaacccaaattnccttaaacccactcggatttctcggcctggtctatacgctatacattggccgttgcgtattttacgatcaccctcatcttccattctttccgttacatcaaggtcaaaggttcatcactggcgttttgtctcctttgtattctcggagttctcacggggtcacgccattcgcattactatgttcgatcatccacactgctgcataatgcataggaggggagccggacaatatatataa

SEQ ID NO: 15028 - DNA, 348 bp, A.fumigatus
accagtaattccaagtcagagcgaaaccaagagcatcgtcaacgaagcgcctgcaccagtcgtcagcgataccctcaccctatccatgaacgaactacttaccctgcgaaagtacagaacgaacccgcaatgggaataaacgccgccatctcccccaggcttaacatcgtgacgaacacaatcccaccacatatggcatacgaaataagcatcgacgcaggcccacctgtcgcgagagctttgcctgttcccaggaagagtcccgtcccaattgtgccgccgatggcgatcatctgcacctggcgggcggagagcttacgagcgagcctgtcggcgttgacatgttga

SEQ ID NO: 15029 - DNA, 270 bp, A.fumigatus
ggtgagggtatcgctgacgactggtgcaggcgcttcgttgacgatgctcttggtttcgctctgacttggaattactggtttaatgacgctgtctcaacggcggcggatgtcattgcactgcaactattgctgcagtattggacggataacttcccaggctgggcgatcagcttaatctttctgatttttgttattttacttaatgtgatgtctgtgagaatctacggagaggtatggtcatggtgcgctttttgcagggaagttaactaa

SEQ ID NO: 15030 - DNA, 504 bp, A.fumigatus
gcaagccctaacagtgaaaccagcatcgtcggcgtctccaaccaaatctcgtgggtctgcatcggcatcgcctccctgcgcttccgcgccgccatccgccggcagaacctcgagcatctcctccccttcaagaactggacgtaccccgtcggccccatcatcgccgtcgggctgaatatcgtcctgatcctcgtgcagggctggtcctgcttcagcccgtccttccaggccgtcgactttgtgtcgttctacatcgagatccctatcatgattgtcatgtttttggcctggaagctggttaagcagacgaggttcgtgcatctggatgagatggacttggttactgatcggtatgatctgaatgcggagcatgctgaaagcgatggcaatgccgatggtgatagcccgtcgcgggtcgggaggattctgcatatcaaacagttgcagagtgaaaagggcgtgctcgggaagctgaagcgagttgggatgtggctgttcctatag

SEQ ID NO: 15031 - DNA, 516 bp, A.fumigatus
  unsure (112): Identity of nucleotide sequences at the above locations are unknown.
acctttgaccttgatgtaacggaaagaatggaagatgagggtgatcgtaaaatacgcaacggccaatgtatagcgtatagaccaggccgagaaatccgagtgggtttaaggnaatttgggtttggggaaaaaaaaaaaaaaaaaaaaaaatttggggggccccccccccaaaaccccaaaaagggccccctttgggggggggggggggttttttttgggcccccttggggggggaaagggccccaaaaacccaatttttggggccccggggaaaaaaatttttcccccccaaaaggggggggggggggaaaatttttaaaattttttcccaaaaaaaaagggggaaaaaaaaaaccccccaaaaaaaaaaaaaagggggggggggaaaaaaaaaaaaattttttaaaagggggtttttttggggggaaaagagagaggtttttttttcccccccccccggcggggggccccaaaaagggggggggaaaaaatttttggggggggggggggggtttt

SEQ ID NO: 15032 - DNA, 198 bp, A.fumigatus
  unsure (28): Identity of nucleotide sequences at the above locations are unknown.
ggattttccgcctccgaggacgaagcantacgtcccagcaagaagcccaaggtcaagttcaccgaggcgaacgacagagaggaagcagagccttggtacaagaagagcaagaagtccagcgaccaagcagcccacactcctcgtcaaattcaaaccctggaggatctggaatcgctcgccactggtttgcttggttag

SEQ ID NO: 15033 - DNA, 438 bp, A.fumigatus
atccccaagcgaggttctggagcttggcagcggtctggtgaggggctgaagcgcttcttagcagagctgtcttctctctgcatgatcgaagcaaagatgacagttcatgatattgaaaaatatccccctcatgctccccaagagcctctgagcggaaaggccgcaggcgctgagccctttgaattcaatcaacatgtcaacgccgacaggctcgctcgtaagctctccgcccgccaggtgcagatgatcgccatcggcggcacaattgggacgggactcttcctgggaacaggcaaagctctcgcgacaggtgggcctgcgtcgatgcttatttcgtatgccatatgtggtgggattgtgttcgtcacgatgttaagcctgggggagatggcggcgtttattcccattgcgggttcgttctgtactttcgcagggtaa

SEQ ID NO: 15034 - DNA, 504 bp, A.fumigatus
cataaggaatgcagaacagagctgacttcatccagtggcggcacggaatccattgccatcacagcgggagaaaccaaagacccagctaaaaacctgccgcgagtcgtccgcaatgtcttctggcgcatcgtcctcttctacatcatctccatcattctcatcggtctcaatgttccctacaactaccccaacctgtcaaagaaaaccaccgccaccagcccgttcaccatcgtcttcatggaagctggcagcgccgtggcaggcagcttcatcaacgccgtgctaatgaccagcgtcatctccgccgccaaccatgccctcttcgcagggtcccggcttctctacacgctcgcggtagacggccacgcccctcatttctttggccacctcaaccgcttccagatcccctgggtcgccgtgttagccacatccctcgtcagcggtctctgcatcggagccagctacatcggagccggccagctctggacctggttgcaaaagtaa

SEQ ID NO: 15035 - DNA, 300 bp, A.fumigatus
tatattttccttcttctgcctttctctctctctctctctttctctctttcggtatctcttatccctacaagtcacatctattttctttgtttccagtttacgttgactgactcgcgcggcatcgaagaaattagtgcgatcctacgaagccgttctcttttcgacgaagaaagcaatacactacctagtatctactccctcaatcaaacaactcacactcgaaaccccaagaatataccatcaatatgcccagacaaccctcattggactcggagcgacctatcattgccaaatctgtaa

SEQ ID NO: 15036 - DNA, 585 bp, A.fumigatus
ctgactcgcgcggcatcgaagaaattagtgcgatcctacgaagccgttctcttttcgacgaagaaagcaatacactacctagtatctactccctcaatcaaacaactcacactcgaaaccccaagaatataccatcaatatgcccagacaaccctcattggactcggagcgacctatcattgccaaatctgtaagttccttttacccttttccacttctgcgtgttgtatcgcctcgccagagtcgtctaacccagcacagaatcgcacgtccaaaagattttcgaccgtaagcggtagcccatcacttgcaccatcagagcagaccatcggaagcctacctagtggtgatcccagactggctgagttcaaccacctgcgcgatggcctcgagcgtctagagaacaaaccccttctgaagcaacgtttcgtccctacaccagagaaaagcgacaacctcagtaagctggcccttggtgcaaaagtggaacgcgcactgggacggcgaatgactagtcaagatgccgtcatgcggaagcccgttctagatgagaaggtcgctacttcggagacctccgcagcttaa

SEQ ID NO: 15037 - DNA, 288 bp, A.fumigatus
agtagattctgcccaatagctttttttagtttttactttcttggggactgccccattaactatactcgcctagaggactactcaccgtcgatttgctgcggaggtcgtctgcctatattgtcctccacttccctgcactcgtcagcaaacaagaccttcgaccacttaattattatgggtgtgctacggcttagagtcgatggtcagacgttcagggaccctgacaaccgtgaaatcactttgagaggcatcaatgtagccggtgaggccaaatatcccaagaaaccc

SEQ ID NO: 15038 - DNA, 468 bp, A.fumigatus
ttcgacttagaagctaatctcaattctgtgactagaaacgtcttccttggcctagcgctggataaattaaacaaaaatgaagaatcggagcgcgcatatcgcgcagcaacccgtgcaaaatccgacgacaagacagcgtggcagggattgatcaatctttacgagaagcagggaggctttaagctagatgcttatcatgaggcagctctgagactcgggcaaatattcgccgaagtgtacgtctcgtgttcgacgctgtataaacgaagaacaggtgctaatctgatcctagcgacgacaagcaccgttgccaggatgtcgtggacaaatatatcaagttcgcaaagaaacagggcactcgatcacaatataagaaggctcttgaactacacctcccaacgagtccgctttatgtctacctcgaaggacggataccacatccttcccatacatacctccgtctcatag

SEQ ID NO: 15039 - DNA, 207 bp, A.fumigatus
gaggcgcccacatccaaagctgccattatggcaggacaacgaagtgagctgtccagcatgtcaacaaaatcggctctgaaggcagcgcgcattgcgctagactccagggatttcgaagatgctgccgaaaaagccaaagtggtggtgaagcaagagcctcaaaactatcatgcgtatgtgaagacgaagcttgctaattcgacttag

SEQ ID NO: 15040 - DNA, 2028 bp, A.fumigatus
tctgatcctagcgacgacaagcaccgttgccaggatgtcgtggacaaatatatcaagttcgcaaagaaacagggcactcgatcacaatataagaaggctcttgaactacacctcccaacgagtccgctttatgtctacctcgaaggacggataccacatccttcccatacatacctccgtctcatagaaatggcagaatccgaagaaaaggagtttattaacagggagattggagagcgaaggacccggctcggtgcgagaatcgatcatgtaacaatggaagtgaaaagagaggctttcaaacgtggggagcttgagcagctataccgtgggatcgtcgattggacccatgatgatcaagttcgacgcacctacgaagaaaggcttctccagcgaacatatgatatactgattgttctcccgccagccgagaaggccgaaaagcgtgctgaggtcttgcaagctgctcgcgacatggtcatcatcaaacaccctttcgagctggcctggaagattgtacttgagtggcaagacattcaaagcttctcagagtgggatctaaatttcttgaaggacttcatcgaatttttcccggaagatggacttacgaagattctgaaaggcttcttagccagtgacctctccccgttttcgaaggagacgaaggagacgaaggaacctacaccaactgaggaagagaccgagaacggaaacggcgataatcacgagctggctgtacaggatcgcttgttaatgatggtggaaggccttgaatcatctcgctcctctatcgttgcaaaccgtatcatgggtgagctttatttgtcgctggaagaatacgacagtgttgtggatgttgcacggaagggtctctcaaatattacagatctcgccaggctgactgggataagcctagttaacactactgactgcctgaaaactttactggcgaattctttgatctactaccagatccctcggcatcaccccgaagctaaagaaatcttcgaagacgttttgcagagaaaaccaacattcacagcctgtctgctgggcattggattgattctcaaggtcgatgaagattatgctgaagctgtcaacttcttggaacgtgctctagagcgggacccgtctaacctcaagatcaggggcgagctttcgtggtgtaaggctctgaatggtgaccttgagactggactgcatggtcttcaggatgtgctcgccgagttacaagacatggagtcgccaaatcgcgaatttaagagtgagatcctttaccgtataggttattgtcaatgggagctcgatccatcgccaaccgcgcgcaaggatcgaagtggtgcttatgccagtttccttggatccattcaatccaacatcaactttgctcctgcatacaccagcttgggtatctactatgcggactataagaaggacaaaacacgagcccgtaggtgcttccacaaggcgttcgaattatccgcgtccgaaatcgaagctgctgaacggctcgcgaggaccttcgcggaccaaaaggaatgggaccttgttgaagccgtggctcagcgcgtcgttgattcgggcaaagcaaagccttcaccaggctcgaagagaaggggctatagctggccatatgccgctttgggtactgttcaaatgaacaagcagcagtatgctcaaagcatcgtctcgtttcaagcagctctgagaatctcaccaggcgactatcactcttgggttggccttggagaaagctaccaccactctgggagatatattgcgtctgcgaaagctttcgatcatgctcagcaattagaatcagctctttcatccgatgaaagagagcatatctggttcgcaagatacatgctcgcgaatgtgaaacgggagctcggtgaatttaaagatgccatctcacgctatgaggatgttttgaagttccgaccgaatgagctcggggtgactatagctttgcttcagacacttatagaagtcttcaccacggggctggaaggagccgcgcca

SEQ ID NO: 15041 - DNA, 348 bp, A.fumigatus
gatatcctggtcgcactgggcattgtcgaactgccggtgcgtctcttcggaatcgaagctgcaggcatcgtcacacgcgtgggcgcagatgtcagccccgacgacctccaggtaggtgatcgggtggtttgcttctgcaggaaagacgccttttccacatatacaaccacgttggctgctgtctgcgtgcggattcccgacagcctcaccttcgatcaagctggaacgatgcttataccgtatttcaccgcgattcactccatggtcaacgttggacgcgtcacaaaaggccaggtaagtggcaagaagacccgatgttattgcataaggtggcagtgcatttactga

SEQ ID NO: 15042 - DNA, 1236 bp, A.fumigatus
  unsure (956): Identity of nucleotide sequences at the above locations are unknown.
tccgtcctcatacacagcgcgtgtgggggagtgggcctggcggcgattcaggttgcccagatgctggaggccgatgtgtatgtcacagttggcagcgaagaaaaggtcaagtacttgatggagaactaccacatcccgcgacacaagatcttccactctcgcgaccggtcgtttgtggatggtgtcatgcgagaaacgaaaggccgtggcatggacttcatcctcaactccctctctggcgagctcttgcacgccacatggagctgcgttgcagagtttggaactttactcgagatcggcaaacgcgacctgattggagacggcaaactcgacatgaggccgttcctggcgaaccggaactattgctgtgtcgacatcgacgggctctggaagagaatccatgtcgctagagctttgatcttctcgatcttggacttctacgacaaaggatacatcaccccgctgccgatgacaatcttccctgccactcaaacccaagatgcattccgattcatggagaagggacagcacatcggccgcgtgggcgtctcgttcaagccagccgacgggggaccccagctgggcttggaaaccaccaagagagccctgacgattgccttcaacgggtccgcctcatacctcatggtcggtggccttggagggatcggtcgtgccgtatccacctggatggtcgatcacggcgcccgcgagctcgtctacctgtcccgcagcgctggccgcacgcccaaagatgacgacttcgtcaccgagctccagagcatgggttgcgctgtcaggcttgtgagcggggataccacgaagctcgcggatgttcagagagccattgccgcggcaacgtatcccctcaaggggattgtacagatgtccatggtggtcgccaacgagaacttcactcgcatgagcttcgccgagtggacggcgtcgactgcacccanagtgcagggaactgggaacctgcacgatgcctctgtggccgcgggtttcaatctggatttcttcgtgatgttcacctcggtatcgggcatcgttggaaaagccgggctaacccactattgccttgggaacctcttcctccgacgcgtttcgcccattccggatacggccgggtttgcccccccccgtgggttgatttggggaacggtcgacgaagttgggatggattccggaacccctgcgcctgattggggatatattccgaaccggtttccaaccttt

SEQ ID NO: 15043 - DNA, 3291 bp, A.fumigatus
  unsure (16): Identity of nucleotide sequences at the above locations are unknown.
gggctgatacttccancgcggctgacgacaagagacggcgaggattaccagtccttgatcaacgaggaagtggtcgggagagaaccatcggcgctcttcttctccagtgtgaccgggcaggtcctcggcccggaccacagtacctggtccaaatattggcaggagaatctggaatcgcctgtccggttccgcgaggctgtcacggccattttgaaacacgacgtgggaaaaaatgctgtgttccttgaggttgggccccacggggctctcgcaggtccgttgagacagatcttcactcaggctacttcgtcagctccctatgtgtcggtcatggcgcgcaaccaggactgcaatgcgtcgttcctcgccgccattggagcacttcactcactcaatgttgatgtcaacctggaggccctctttcccacgggttgctgcctgccggatcttccccggtacccgtggaatcacgaagggagctactggtacgaatctcgtctcagcaaggagtggcgcaaccgcagattcccataccatgatctccttggtgctcgggtggccgagagcagtgacggtgagcctgcctggcgcaacatgttccacgtcaccaacacgccgtggatgcgtgaccacagggttggcgagcacatcgtcttcccgttctgtggctacattgccctggcaggcgaggccatcagacaattgaccaatgtcgaggagggcttcagcgttcgcaacatcattgtcagcacggcgctggtgctcagcgaaggaaagccgacggagatgatggccacgttccggccgcaccgtctgacaaacttcctcaatagcgcatggtgggagttcactgtttcagcctacaacgggcgcaactggacaaagcactgcacaggcgaggtttgcgctcagtcatcggcgccggagcagacccaggatcctgccggcctgccccggacgctcaatgtgagaaaatggtatgagaaaatgggcaaaggtggtctcaatttgggaggatctttccagaccctcgagaccatgacgacctccacgtccgagcagcgggcagtgggcaaagttgtcaatggaaggcagggagatgaagccaactaccacattcaccctaccgtgctcgatgcaaccctgcagattctgggcgctgcagccgtcaagggctacgcacgcaaaaccaagacctggctaccgaccagcatcgacaaattcaccgtccataggtgcgcgtccgatatggtcaccagtgtctccgctcagctgtcgagtaacttttcagttgttggagacggccgttgtacatccggggggaccaccgtcgttgacgctgtagggatccggatgtcacttgcggacggtgccggtgcagcagacatttcggacacacatgccgcatccagatgtgaatggagacccgacattgacttcctcgatgtgcatgagctgttccgctcaccggcgaaccgaacagaccatctgcggctcctggaggagctcggggacatctgcttgctcttgtcccaatggcacttttcagaagccagcaatccaattccaccccatctacagcaatatatggcttgggtcgggtctcaatccggcgcgattgccttcagattgccgtcgacatggacaggtctcgatcacgaggcaatctcggatcgaatcgacagtatattgagtcagctggcagacacaccggcagccccagtcgccaatgccattcatcaagtctgcgtcaacatggaatccctcttgtccggcgaaagcctagacagtatcctccccggagagaccctaacgcacgtccacgagttccttgggcaggtcgaccgaagggaatttattcaattgctgagccactccaagcccaacctccggattctggagattggaactggaaacggcgtgtcgttgcaccgagacattctcgccgaattgacacgacctgatggggagatcctctgcgccaagtacacattgactgcccccggctatgttgtggcgacgacccaagagaagatattcccaaacatgcaattcgccagtttggacatctcccaggatccgtttgaacaaggattcgaggacgtcgggtacgacctcattatagctgtcaacgctcttcgtgagtgcaaaaataccgaggaaagcttggccaacctcaggaaactcctaagttccgatggaaggttgcttctgcaagagctttgcccatcatccagatggatccggtatgtactcggtgtgcttccgacgtggtgggcgggccctgccgatgagcccatcgagacaccctacctgagccaggaagagtggcagacgacgcttgcagctgcaggatttggcgacatcgaggccgtggctctggattcagaagagcctcatcaagttacgaccaccatggtcgtgaggcaggcccgtgaggcgcccatgaagaaggtcacggtgctggtggaggaagaaggacccgctgtcacacacatcgtgagcgagctcgaaaaggagggctacgaggtgaccagatgcagattagaggatgacccaccggcaggccaagatgtcatgtcgctcctggacatcgaacagccctttttccacgggatcgatgaagcacgcttcctgttgttcaagtccttccttctcggtctccaggaccgcaatgccgggatgctctggacaacccatctcatcgacataggatgccgtgatccccgatatgggcaagttctcggcctcgcccgaacgatccgtacggagcagctggcagatttgggcacctgtcagatcgacagttttgacagctcggcgtccattcgcggactccttcgcttgtttgccaagtttcagactcgccaaggtgacgaggaactcaacccggactttgaatgggctattgtcaatggccaagtgcaagtcgcccgcttccaccctttcatcctggccgatgagctcttggtctcggaggactcaaaaaacgagatggccacgctgaatgtccgcacaccgggacgggtcaacagtctacactatgcgcggcatgaacgaaaggacctcgagaaggacgaagtggaggtcgaggtgtactgtgccgggttgaactttcgagtaagccacagctatttaccccgagtaagtgtcatgttactgaccgagccgtctaggatatcctggtcgcactgggcattgtcgaactgccggtgcgtctcttcggaatcgaagctgcaggcatcgtcacacgcgtgggcgcagatgtcagccccgacgacctccaggtag

SEQ ID NO: 15044 - DNA, 615 bp, A.fumigatus
  unsure (520),(521): Identity of nucleotide sequences at the above locations are unknown.
caggacacttacaatgacgttcatgaagcttgcaggcccctggggcttggccgagttgtactggctgatcgcaccgcagatcacgaaccgagagtctttctgggcccgcgccaggcaagcatcgaggatttctcctccgacgttgtcaaaatatacatcgatatactccggcgtcgcctccttcaactgcttcttccagcccttatccttgtagttgatcgccgcatcgaacccaagctccttgaccaggaactcgcacttgtcagcactgcccgcaatgccgacaacccgcttggctcccttgaccttggcgatctgcccggcgaccatgccggtcgcgccggccgcaccagacacaacgacggtgtcgccgggcttcggctgtccgatctcgatcatgccaaagtaggccgtcaaccccgtcatgcccagcaccgacatggcatcggtggggctgcagccgggaaggaacggccacttctggggctccttgggccccagcagacaatattcctgccannccggagtacgcgacgacccagtcgccgaacgtgtattgggattgtaatccgcttcccgacgcgatcacctgtgcgatgctctgggcgcccatga

SEQ ID NO: 15045 - DNA, 852 bp, A.fumigatus
  unsure (113),(272): Identity of nucleotide sequences at the above locations are unknown.
aatccgatttacaacatgagtaccacccatacactttaccagtcctccaccgggggctacaaccaagaccccaattccaccacccatattggaaccaacgtcaacactgcagntagcaccaccgacccgtttactggacatgcgtcccagtcagccggaccgcatacctccaacgtcgccaacactatagatccccgcgtcgatagcgacttgaacaaccgcgcccagtacgcccccggcacggccgcctccggcaatgtccacccacgcgntacacagagctacaacaacccgaacagctccaacgcgggtcctcacagctcctcagtcatgaacaagcttgatccccgtgtcgacagccagaccggtaacacaaccaccaagacgaccaacgagacgggtacaggcgcctcccgcaatcctaccgatacctctggagcaggtgcgggtgtcaggcagggctcctcaaccacctccgtcggaacgcctggagtggaagacaatcgctcacgctatgaccccaatgtatcgaggcacaaccccgcgactgggtccggatacgcgacggcgggcggagtgggccaccagcccgccccgggatccagcagctacgataagcaggactaccgagctgaatatgctcccagcacagaaaacaagcactatactgcggacgcacagggccgatcagcagccaagggcgaggagattggccggggggtgaaatcagccattgctggcatccacgtaagtcgatcggctacgttctttgatccgcggagacgagtactaaccagggctttaacagggtgctggggagtcgttgcggggggcaatgactgcagctgttga

SEQ ID NO: 15046 - DNA, 333 bp, A.fumigatus
acagataaccgaaagcctatatgtgaagcatcgctccatctatcactgcacggtttccattcctgcatcgcatttccatcgatttttttcatatttggccgcagcagatatataaccaaaatgcctatctcaaaccgacagctcatctacgccaacacgccgtccccggccatcgacccctccctgaccaatggaaccttcaagctcaacacgacctccctccccgaccagatccccaatgacaaagtcctcgtgcgcgtgcactacctctcgctcgacccgggccatgcgccagtggctcacagcaaaacggtcgtacattgctacccgtga

SEQ ID NO: 15047 - DNA, 597 bp, A.fumigatus
  unsure (65),(66): Identity of nucleotide sequences at the above locations are unknown.
tcgcgtcgggaagcggattacaatcccaatacacgttcggcgactgggtcgtcgcgtactccggnntggcaggaatattgtctgctggggcccaaggagccccagaagtggccgttccttcccggctgcagccccaccgatgccatgtcggtgctgggcatgacggggttgacggcctactttggcatgatcgagatcggacagccgaagcccggcgacaccgtcgttgtgtctggtgcggccggcgcgaccggcatggtcgccgggcagatcgccaaggtcaagggagccaagcgggttgtcggcattgcgggcagtgctgacaagtgcgagttcctggtcaaggagcttgggttcgatgcggcgatcaactacaaggataagggctggaagaagcagttgaaggaggcgacgccggagtatatcgatgtatattttgacaacgtcggaggagaaatcctcgatgcttgcctggcgcgggcccagaaagactctcggttcgtgatctgcggtgcgatcagccagtacaactcggccaagccccaggggcctgcaagcttcatgaacgtcattgtaagtgtcctgctaggcatgtga

SEQ ID NO: 15048 - DNA, 270 bp, A.fumigatus
tcgatcgctgacagtgtattgcagtcgcaacggatcacaatgaaaggtttcatcgtgttcgactttgcgaaaaagtatgacattgccttgaaggatctctcgacatggttaacccaggggaagatcaagcgcaaggagcatatcatccgagggggactggaggcggcgcctcagggcctagtgagtctttacgaaggtgccaacaccggcaagatgatggttgaggtggcacctgttagcgaggctattggagccaaggccaagctgtaa

SEQ ID NO: 15049 - DNA, 552 bp, A.fumigatus
gcaattgtcatctttgcggcaagcttgaaggggattgttattgtgccagcttaccccgatcgcgcatcaattcatcttcctcgtcctcgccttccaactcctcaccagccatgccttccatctcctcggccgagaattccctctctccctcctccaactccaggtctagacgtcgatggtccatttcatagctctggtctacgtcctcctcttcctcacccacatcttcttcttcttcatcatcttggtcgtcctcatccatcatctgcccccgctggcggccagagactccccgcccgaaaagagaaaacagcgcgccttgcgcagcagcaccagggtgggtgggagcggccgcagacatctcgacaggcccagatgaaggatgcaattgcgggatattcgggatattccgcgacgggggcgtctggaattgtgtttgagcagatccatggcccagtcgcgatctgcttgtttgttgctgtgggggttcgtcggagtttgtttctggaactggcgcggggtgtcttcggaggtgatggcgaggcattgtga

SEQ ID NO: 15050 - DNA, 285 bp, A.fumigatus
gtgttttgtatagctccaagtccaatcggcttgaagtggattccaaaggatctccgtccgtcactctccggtgtcggcgcgcggggtgcatccacccctccatattttgaagggatatttcaacttcactcgtctgcaattgtccttcagtttccccagcttcagttattttcttctgactgtatattcacaatgccgtcatataacattgtcgttttcgctggggaccactgtggtccggaggtaagttcggggtccacagcaggcatatcttgtgtcggatag

SEQ ID NO: 15051 - DNA, 771 bp, A.fumigatus
cgccgcaaagaacgccgatgccgtttttcttggtgccattgggggtccggaaggggaacactctctcatatccacctccggaacccaaaagtaacacaacccatggaattgggaaagtgggccgttcggcccggaaaaggccttcttcgtttggcccaggaggaggggaaaattggatacctccgcccctgcaacttcgccgccccgtcgctggtcgacggctcccctctccgccccgaagtctgccgcggcgtcgacttcaacattatccgcgaactgaccggtggcatctacttcggcgaccgcaaggaggacgacggcagcggcttcgccatggacacggagccgtactcccgcgcggagatcgagcgcatcacccgccttgcggcccacctcgctctgcagcacaacccccctcttcccgtgtggagcttggacaaggccaacgtcctcgcgacgagccggctgtggcggaagaccgtgacggaggtcatggccaaggagttcccccagctcaaggtggagcaccagctcattgactccgcggccatgatcatggtcaaggagcctagaaagcttaacggtattgttgtcactagcaacctgttcggtgacatcatcagtgatgaagccagcgttatccctggttctctgggactcttgcccagcgcaagcttgagcggcattcctgacggaaagaccaaggtcaatggtatctatgagcctattcacggtacgttttctccttgttgtctacagcttgcgatctga

SEQ ID NO: 15052 - DNA, 258 bp, A.fumigatus
gtgtgcgctgacgtaaaaacaggttctgcccctgacattgccggcaagggcatcgttaaccccgtcgccgccattctctctgtcgccatgatgatgcagtactccctgaaccgtatggatgacgccagggccatcgagacggccgtccgcaatgtgatcgaggccggtatccgcactgccgatattggcggcaagtcgacaactagcgaggtcggtgacgctgttgctgccgagctggagaagctgttgaagcaatag

SEQ ID NO: 15053 - DNA, 207 bp, A.fumigatus
caccccctgcagagaggagaagaaatgggtggcttccaattgggtagctccatcgtgcttgtctttgaggctccgatgggaaccaggaaatcattcgatattggttgggaaggagggaaacgtgaaggaggatggaactggaccattgagaaaggtcagcggatcaaaatgggccagaagttaggttacgtggatattcaggaatag

SEQ ID NO: 15054 - DNA, 678 bp, A.fumigatus
catcaacacagagattccatcgttcgccgacgcgataagattaagaagccggaggagattccgcgtagagggaagtgttccgtacaggtcctccaacatgagcatctgagatgcctggataaacgcaaaactcacgcagactatctcgacttcccgcaaagtctcacaatgcctcgccatcacctccgaagacaccccgcgccagttccagaaacaaactccgacgaacccccacagcaacaaacaagcagatcgcgactgggccatggatctgctcaaacacaattccagacgcccccgtcgcggaatatcccgaatatcccgcaattgcatccttcatctgggcctgtcgagatgtctgcggccgctcccacccaccctggtgctgctgcgcaaggcgcgctgttttctcttttcgggcggggagtctctggccgccagcgggggcagatgatggatgaggacgaccaagatgatgaagaagaagaagatgtgggtgaggaagaggaggacgtagaccagagctatgaaatggaccatcgacgtctagacctggagttggaggagggagagagggaattctcggccgaggagatggaaggcatggctggtgaggagttggaaggcgaggacgaggaagatgaattgatgcgcgatcggggtaagctggcacaataa

SEQ ID NO: 15055 - DNA, 894 bp, A.fumigatus
caattgctcatctactccgcagacaggtcgccctcaccgctaccaagcaacctccgtgaaatatcctccttagcctcatggaccgtctcgacacacaaaccaggctgtggtgttgcggccctccgtcacccgtcacccacccagtactggcaatcggatggaccgcaaccggacatgctaaccctgcatttcttcaaacttgtcgcagtggtcaaaatccgtgtctacctcgatttcgaaatggacgaaagctacacccctaccaagatggtcttcctagccggcatgggcggcaatgacctggtggagttcgcaacctgggaaggtgaagggccctgcggctgggtcgatatacctcttgaaggtgtgggaggccgagacggcggctgggtccggaggcgacggcgaaagcgcacgcgggcccgtcctcaggacggtaagggcaagggcaagggaaaaggaaagtccaagggcgtcgcatggccagactatatgttttcagactcggagaacccggtcgagtacgacgaagcggcctatgactacgacgacggcgaaagcaccagcgaggacgacgaagacgacccgtatgcggggaacgtgctgaaagccatggtgatccagatgcgagtgacggagaaccatcagaacgggaaggatacgcatgtgcgcgggttccaggtgtttgcgcgcgacgacgatcggcggcgtatgggcaatgccccctctgcctctgcggatggacggacccgaaggcacagtgctcgacggtcccttcgcgggagtctcaatgatggcggcgctgagggacgtaatcccaatggggatgctgacggggttagggtcggtggcttagaggagccggactggatgggggagcctgtaatacgatag

SEQ ID NO: 15056 - DNA, 537 bp, A.fumigatus
gatacccatttcttacctttcttatattctactatatggagcgagcgcgctgctggggcaaccgggtgctatcgacaatcacgagccaatggcctcaatattctgataattaataaagtatcgagtcatatctactttaaatttgctcaagtcatctcccattggacatcacatgggacggaaattgctcgtgcgacgaggaaacccccccagaaaaacttgcttttacatatccactattgcttcaacagcttctccagctcggcagcaacagcgtcaccgacctcgctagttgtcgacttgccgccaatatcggcagtgcggataccggcctcgatcacattgcggacggccgtctcgatggccctggcgtcatccatacggttcagggagtactgcatcatcatggcgacagagagaatggcggcgacggggttaacgatgcccttgccggcaatgtcaggggcagaacctgtttttacgtcagcgcacactcagatcgcaagctgtagacaacaaggagaaaacgtaccgtga

SEQ ID NO: 15057 - DNA, 426 bp, A.fumigatus
ataccattgaccttggtctttccgtcaggaatgccgctcaagcttgcgctgggcaagagtcccagagaaccagggataacgctggcttcatcactgatgatgtcaccgaacaggttgctagtgacaacaataccgttaagctttctaggctccttgaccatgatcatggccgcggagtcaatgagctggtgctccaccttgagctgggggaactccttggccatgacctccgtcacggtcttccgccacagccggctcgtcgcgaggacgttggccttgtccaagctccacacgggaagaggggggttgtgctgcagagcgaggtgggccgcaaggcgggtgatgcgctcgatctccgcgcgggagtacggctccgtgtccatggcgaagccgctgccgtcgtcctccttgcggtcgccgaagtag

SEQ ID NO: 15058 - DNA, 243 bp, A.fumigatus
cgtatgatttttttccatcattgcagtcgccaatctatcaagaaatatgtactggccaacaacaaaattgctttcgccagtcaggccgcttttgacagccagttcaacaaggctatcaaggccggtgttgagaagggagagttcactcagcccaagggtaagtcactacttccgcgcatgttctttttctgcggaatcatagcactgacgcgtctcaaattccaggtccttccggtcctgtga

SEQ ID NO: 15059 - DNA, 240 bp, A.fumigatus
ctaatatgcttcacacagaaggccactactgccacaaaggctgcggcccccaagaaggccgccgctaagaagacggagaaggccgagaagcctgctgccaaagctaccaccaaaaaggccggcaccaccaccaaaaaagctgctggaagacccaaggccaacaccgccaaacctcgcaaggcctcgactgcggtatgtgaccgttatcgctgttgcttctcgattttcggtggatgctaa

SEQ ID NO: 15060 - DNA, 192 bp, A.fumigatus
ccgttatcgctgttgcttctcgattttcggtggatgctaatacgtaagcaggcccctgctgtggtagaccagcccaaggttctctccacgaccaagtcgggccgagtgaccaagacgacagctaagcccgctgagaaggccgccaagaaaaaggccacaacgaccaagaaggctgagaagagcgaggcgtaa

SEQ ID NO: 15061 - DNA, 978 bp, A.fumigatus
cgttatgcttatagatatcccaaccggccccgtaaccattccccaaccctacctttccacgagcttttccagaccctcttcaaccctctgggcgaaataaaaaagaagccagccggagcggttgcggctcgcaggaaagtcggtccccatgggcagtcagcggccaatctcaatccgctggagagacgacgcgatgtgattgagcgatttatctcgcggtggaggaaagaagtgggtgatgatatttaccccgcctttcgactaattcttccggacaaggatcgggaccgggccatgtacggaatcaaggagaaggctattggcaaaatgcttgtcaagattatgaaaattgacaagaactccgaggatggctttaacctgttgaactggaagctgcctggacaagcagctacctccaggatgacgggcgactttgcggggcgatgtttcgatgtcatctcgaagcgacccatgcggactgatgtgggagacatgttgattgaggaggttaacgagaagctggacaagttatcggcggcttccaaggaggagcagcagctgcccatccttgcggagttttaccgacgcatgaatcccgaggaactcatgtggttgattcgtatcatcctccggcagatgaaggtaggagcgacggagcggaccttctttgacgtctggcatccggacgcggagaatctctacagtatttcgagtagtctccggcgtgtctgctgggagctacacgatccgaatattcggctggatgctgaggacagaggaatcagcctgatgcagtgcttccagccgcagctggctcagttccaaatggattcgttggaccgcatggtcgctcggatgagaccgacggaggaagatcctgtcttctggatagaggagaagctggatggcgagcgcatgcagcttcatatggcatctgacgattcagtatcttcaccacggagtggcgatccccgttaa

SEQ ID NO: 15062 - DNA, 1134 bp, A.fumigatus
ctccttgattgttccctcgcgtactactttgataaccggcctttactgtcgtcggacgacgggcagtgcccattaccgtctcatgaaaatctctggaatgctcaatcggccgaagcctggcgggatgttctcgagagaacttccggtaagtttggaccaggcaagcgaaaattctcaactaaaacatcgatttcaggttcgcgaggtatctccctttataaagcagtgctcacaatctatatcgagaagaaactcgtcccagggatcggagaattcagtcacgtcctcctcattcacgctctctaccatcgaatgtgggaggtcggtgactattttcgccgtcccttatccttctggaatcccaccgcaaagaagcaaacccttgataccgctatcccgtcggggtctgtgtggctaccaggcatcccttcgtactcaaaatggcgcaacagcgcgtgtgattgcctggatattttgcattggacggcgaacagcacgatcgccaaagcagcgggacttgagcatcccaccgtactacacctccatgctgcccgaattgtcctcctcgccccattccgcgaaattcgttctctggcgacgtcgttagcaatgggcaagattcgctggagcgatcatcaacaagccctggagtggcattacatattacgctggatcaaacacgaccagtacaaggctcgtcttgcgattatacatgcaggcacaacattgtggcacgtaaggcggtattcgacgaatgcgttccacgagccggtcgctgtatatctttcaatactcactctatgggcgtatggctcgtgtcatgcccaaatagccgaggaacccagctcaagacatggactacggcatcatccagtccgcgagccaacttttatccacctagaccggccatgtgatgacgagctagtccaactctttgtccgcgagggtcatgctatgcaaggaaacgtcacaggcgtcggggacatatgtgctcctcatggtcctgagcgcattttggaagttggctgcgagacccttgccgggctaacttcatggggaattagcaagagatttattgccatccttacgaagctcgcggagctatcctcgcagccacaggctccgagaaactga

SEQ ID NO: 15063 - DNA, 225 bp, A.fumigatus
cattacatcacctgcgtttactgtccagaagagtggcataattcagataacattgtattcgacagaacctatagccatcaggcactatatacattattgaccccctataaagttatcaccaactcccagtcgtcccccaaatcgaaatacgagtttcgtggtgtatgtcataatatcagtttctcggagcctgtggctgcgaggatagctccgcgagcttcgtaa

SEQ ID NO: 15064 - DNA, 294 bp, A.fumigatus
tttaaatatttagtcatgccttttaggctaactaatgtactagccatcttccaggcttatattaacaagatgatgcagggaattcttgataagttctatgtcacctacctagataatattcttatctacttacagacagaagaggaatataagcagtatattaaggaggttctccagtgtcttaatagcgcaaacctgtatgctaaactattaaaatataagttttataagatagaagttaagtttctcagctttcttataggccaggaaggggtctgggtagatcctatataa

SEQ ID NO: 15065 - DNA, 591 bp, A.fumigatus
cgggtagaagcaaatggcccttccctaccgaacataaaatcgggcggatttcggttgtttatattaaggaaagaggctttaaagatccttggaactcagcctacttacaagtatatgtttgctgtctcggatgccgtgcatgaggctccggtatatgttgccgcacagaacaagctctacttgtcccaattagcacctccagcaggctatctcccgcagcttgttgtcgacttgaaccaagatccgcctacgctatcagaatttctctccgatcctccggtctacgcgcccaatgggggtacattctacaatggcagggtgatctggggagcctctggcggtaaccggtcgatcggtggcactgagcagcggcctggattgagaacgctcgaccctgaaaccaacaaaagcgtcattctgctcaacaactattatggttattacttcaatacggtcgacgatctcgcagtgcacggcaaaacgggcgacatttggttcacagacccgcgtatgtctcctttttgtcttccgatttgcttgctgcgaaatcattggactgatgccttaaccagaatactcatggttcaataa

SEQ ID NO: 15066 - DNA, 192 bp, A.fumigatus
tactggacgcaggatctatggtctccgcctcttatcttaacacttaccgcaacaggacagctcttagggctattatcaaagggctctaacgcgccatgtgattgtggggaattcaaaaccactaagcctgaaatggcaagcaactttcaaagctctacttcatacgtatggaccagaccattcgaggtatag

SEQ ID NO: 15067 - DNA, 246 bp, A.fumigatus
ccagaatactcatggttcaataagctcactgatacaccacctcagcttccatctgctacatacagatacaaccctaaatctggcgccgtttttgtggttgatgacagccttagtcagcccaatggcatcgcattcaatccggattactcgattgtgtacatcagcgacactggcgcagtgagtgggccggtcgatcccaaattcggccacccgggaacaccttttaatgccacaggccccaggtaa

SEQ ID NO: 15068 - DNA, 366 bp, A.fumigatus
gagctcaaagggacaaggaactataggttggactcactaatgaaggtgcaccatgactatagaaccatctatgcctttgacgtgagcaaagacggcaccacagcttctaacaagcgacctgtttatctgtctgctggatatgttccagacggtctcaaggttgctgccaatgggtacattgtgaccggcaatggacggggcgttgacgttctcgatcctcatggccagcttttgttgaccatacaaaccaattataccgtgcagaacttcgcatggactggcccaaaactgaagacactctggttgatggggtctgggggtatttccaaggtcgaatgggatcttgcaggccaggagctaaagtag

SEQ ID NO: 15069 - DNA, 276 bp, A.fumigatus
  unsure (268): Identity of nucleotide sequences at the above locations are unknown.
aaagacatcctgtcccgctttgtcgataagatcaacttatcctacagaactagggccaaagggggagagaggacaggaaagaaaagtttcatctcgaccatctatctatctatccagactttggttccggccaagctcgatgcctgcttgttaaaaggtcagatctcctattactcgccaaattcaaaagtctctgctgttgccgattttcgcgtccgttcgtcctcccacgtcctgtttcaccgggggctgaaagagcgctccattncgaagttc

SEQ ID NO: 15070 - DNA, 1050 bp, A.fumigatus
actgattctccattcagcggtcatttccacgccgacgaggccctggccgtctatcttcttcgccagctcccgacctatgcctcctcacctctgattcgtacgagagatccggctcaactggccacatgccacaccgttgtcgatgttggtggagagtatgacccagctagcaaccgctatgatcatcatcagcgcaccttttcaaccaccttcccaaaccacaacaccaggctttcctccgccggcttagtgtacatgcactttggtcgggcgatcattgcccaacatacttcactcccgctggatcacgaggatgttaccttgctctatgagaagctttacacggatttcattgaagcggttgatgccaacgacaacggtgtctcagtctacgatccagcggctctggcatcggccaacattgagaaacgttttagggacggtggtatcacaatcgcttcggtggtcaacgatatgaacaaccctgaccctacttgcccacctggagagccccaagatgaggatagtctcttcaacagggcaagcacgtttatgggacacgtcttcactcgcaaattgcaccatgcatttacttcatggcttccggctcgggcgaccgttggcgctgcctaccagtcccgtcgcgaagttcatccctctggccgtattatcattcttccacagggcggtgttccttggaaggagcatctctacaatttcgagaaggaagcctcaggcgctggggacatcaatcccgacgagcaggtctactatgtactctaccccgagagcgctactgaaggatccaagtggcgcgtccagtgtgtttcagtaaatgagggtagcttcgagtcccgcaaaccattaccagaaagctggcgtggcgttcgtgatgccgatctggatggctgccttgctgctgaagccgagaagtctggtaagcctaagatcccagagggtgcagtctttgttcatgccagcggcttcattggtggacacaagacaaaggaaggtgcatttgccatggctgttcggtcattggagctataa

SEQ ID NO: 15071 - DNA, 288 bp, A.fumigatus
atagtgacagttcgctttcagcctcttccttcagcacctattctgaagaatcgcgttttcaagatcagtgcgtcccagaaattcgaaactgtcgtcaaattcctcaggaagaagcttgactgcaaagacacagattctgtcttttgctacgtcaacagcgtttttgctccgggcctagacgaaggcgttgggggtttatggagagtgagtattcttgctactggcacttttgcactgaaagtattaattgaagggttttacagtgtttcaagacggatgatcaattga

SEQ ID NO: 15072 - DNA, 540 bp, A.fumigatus
tctttatctttcggagactcgacatacattcattatatcgcagttatgatttcgtcccgaacagccatacagctggcgctacccttacggtcgcttgccagggcggctggggtgcggcctggtctaactcctatcgtccgttttgcccttcgtggtagctacctcccagcccgtcatgttcccccgccatgcacgcctcaggttcgacatagttctcactcgccgctgggggcggcgccggtgaaccctcggaaaaaggtgacgatgcagaccttacggagtctctacaagaagggagaacccatcacaatgctcaccgcgcatgactttcccagcggccatgttgccgacgcagctgggatggagatgatcttggtcggcgacagcctggccatggtcgcccttgggatggaggatacaagcgaggtgttaatggaagagatgttgctgcattgtcggagtgtagcgcgcgcagctaaaagcgctttcacggttcgtaaaccttgtcggcggtgtggtttgtattcgaggcttggctga

SEQ ID NO: 15073 - DNA, 795 bp, A.fumigatus
cgctctgaattcacttccatccccggtgaagacgagattgaaaggcaacgggcacgccaacaagagaaggagaagaaacttgctccgaaagctcctgccgttaaagaagtacctaaatttgacgcaccagatgtaggccccgtgaacttggacaatctggagccgtcgaaagagaccaaacctggcggtaatggtttcgaaccaccgcagcggatgactccagaagacgtgcagatgccattgcagaccaaaccagaatcaccaaggaaaagctccgagagcttcgtgccccctccgctccataggacaggaccattttatgctggtcgtgaacctgccgcgtccggtatgcaaccatcaaatatcacgtctgccatccggtcgcagatggtttcctccaccgccgctgcacctggtgccaaagctgggttgagcaaagaagtccatgaattgaagaggaaggtactcgaaaagagcaacggcggtttgtcaaccggcaccgtactgtcccctcatcctaccacgtcgacctccgcccccctaaagacgtcaaactgccaatcgaacaaactctgccaggcgaacacgcaggagaagctcggacgcgtgcaagacgaggacactactcagtccgaagggaactgtgtggctaagcagcgggctggtcttcggaaagtcccagtctcaaagaaaaaagaacgaaggagagaccctaagcctgggtactgcgagaattgcagagacaagtttgacgactttgaggaagtaagaatcgatcatgtaggaaggaattga

SEQ ID NO: 15074 - DNA, 621 bp, A.fumigatus
gtcgcagacctccccatgggctcgtatgaagtgtcgccggaacaggctgtgcaatcggctattcgcatggtgaaggaaggtcgcgtacaggccgtgaaactggagggaggcgaggagatggcgccgacgattaagcggattgttgaggctggaattcctgtcgtcggacacatcggactcactcctcaacgccagaatgctttgggaggcttcagagtgcagggaaagtcgacagccggtgcgttacggttgctcaaagacgctttggccgtgcaagaggctggcgcattcatgatggtggtcgaagcagtaccggctgagattgctgcgatcattactaagaagctctctgtgcccactattggtatcggcgcaggcaacggctgttccggacaggtcctggtgcaaattgatatgactggcaactatcctcccggtcgtttcctcccaaaatttgtcaagaggtacgccgatgtttggggcgagagcatcaaaggaatcgaacagtacagagaagaagtcaagagtcgcgcgtacccttcacaagaatacacttatccgatagccgaagaggaactcgcggaatttaaaaaggctgctgacgtgattaagcgctcctga

SEQ ID NO: 15075 - DNA, 186 bp, A.fumigatus
ttgccattccagagtcttgcactttgtactgtctgccgcaggaatttcaagaataccgcgatcaagacctgcggtcacgtattctgcaaagaatgcgtggaagaaagactcacttctcggtctcgaaagtgtccaaattgcaatagatcattcggaaataacgaccatatgcatattacgctatga

SEQ ID NO: 15076 - DNA, 645 bp, A.fumigatus
ttggcgcggcccttccagccccgtggtgaagaccagtattccatgctcaataccgagttgacgtcgatgcagaccgcctgcaaaaagtactctttgttggcttcgcaaaaggttgcagattttagcgctttagaagagaaagtcgcccgattgactgctgagaaatcaaaagcggatcagaagtatttcgctgcaatgaaaagcaaggaagcgcgagagttggaggttcgaactttgagaatacagaactcgaagagttccgatattgtctcgcaactaaaggaatcggaggccaccactcgctctctgttggccaatatggagaagcaggctagtgagacgaaggaagcattgaattcaatcatcagcaagcatcatgcagcccaacagcaaatcgcggagaataacattgttattgacggcctcaaagcccaggtcaatgagctcaaggccctctcggtgtcgaaggattcgtcattggcgagtgcttcgagcgcgtgtcgtaaagctgagactgaaattgagagcttgaaagtcacccttgccgataccaagaagagtcttgagaattggaagaacaagagtttgggcaattcgtcatcagagtatgagatgttgagggtaagtctttccgcgtatgcataa

SEQ ID NO: 15077 - DNA, 789 bp, A.fumigatus
agactgacatcgaaaatagacgaaccataccttccaccaaaccatgcactactcctcctgtcagattctgccctcccactgggctcctttgcctactccagcggcctggagtcctacctagcccacagtaaacctttgcctcgctcggtgacaacaatcgcatcgtttcatcacttcctcaagttgtcaattgcgtcaatcgcaagcacctctctcccgtatgtccttgcagcctataggaacccgggagaactagagacactagacaacgatttggacgcgtcgacgccgtgtatagttgctcagagggcaagtgtcgcgcagggaagggctttacttggcgtctgggagcgagcatttcgaagcgcatatgcttcgggaccgcctgctggcgagacggatgctgccaaggcagtgcaaatgattgaaaacttctccgacgctctcaaatcttgggtcggcactgcggatgaattaggaccgaaaggtcatcttgctcctctatggggtgttgtatgccttgctatgggtgtcgatctccggcagacggcgtatgttttcatgctgaatcatgccaaagcagttctcagtgctgcagttcgcgcctctgtgatggggccatatcaggcgcaaagcgtcctagccagcaaggccctgcaagctatgatttcagaacgaatcgaccgagaatggaacaccgcagtagaagatgcgggccaaatcgtccctcctttagacctctgggtagggcggcatgagcttctctatagcagaatattcaattcataa

SEQ ID NO: 15078 - DNA, 621 bp, A.fumigatus
cccccccccatagttcggtccggcaggctcgtggtgaagagatcgtctgtgaagaaatctgaatatgttctgagcactgataatccactagatgctcccgcctctcccaagccccagaatgagggtgagcctgaagatgaagagatgggcggcactgagacagagacgaaaaaggagtcagagggaggcgacggaaccggcgatgcgagtgctcaaccgtctgctgagggtgcctctgaagaacaaacagtgcagggaaagtcaggacttgaagcttcagcacgctcacatctcgtctcccaaacacacgccatcatccttccaagctattcgacatggttcgacatgcatacaattcatccgatagaaaagaaggcgttagcggagttcttcaacggtcgtaaccggagtaagacgccggcggtctacaaagactatcgtgatttcatgatcaacacgtatcgattgaaccctatcgagtatctcacagtcaccgcttgtcgtcgaaatttggcaggagatgtatgcgctatcatgcgagttcattcattcctcgagcaatggggcttgatcaactatcaggtaagtctgcatctattgtctataacttcattcccgtag

SEQ ID NO: 15079 - DNA, 1671 bp, A.fumigatus
tttcatgatcaacacgtatcgattgaaccctatcgagtatctcacagtcaccgcttgtcgtcgaaatttggcaggagatgtatgcgctatcatgcgagttcattcattcctcgagcaatggggcttgatcaactatcaggtaagtctgcatctattgtctataacttcattcccgtagctaacgtggtctcctgtaaggttgaccctcaaacgcggccatcgaacattggtcctcccttcactggacatttccgcgtgatcgccgatacaccccgaggtcttcagcctttccagcctggtcctcagcatgttgtcaaacccggaaagccccaccctgccactgaccgggctgcctccgctactcccgcatccaaagccgatctcaatcttgaaatccgccgcaacatctacgatgataagggcaaggaaataacaccagctgctgaagataaggaaaagcagacgaacggcgaggggtcagccgccaacggtacagctgcggacgcatccaaggctatggaaagcgcagtccgagaacctagaaagaagttccattgcttctcttgtgggatcgactgcactcgactcagattccattacgccaaggcagcgccaacaaccacaaacgcgaatgctccagactccaagtacgatctttgcccgaactgtttcttacaaggcagaatgcctgctagtcataatgcctccgacttcgtcaagcttgaagataacgaatacacaattgcaccggataaggatgctccttggtccgattcggagctgatacttcttctcgaaggcctggaaagttttgacgacaattgggagcagattgcgaatcatgtcggcacaaggaccaaggaagaatgtgtgatgaagttcctgcaacttgaaatcgaagataaatatgtcgaagacatgcccgagatgcgtgcggcgagtgggcgagacccaatcaaccatgtcgagaatccagtcttgtccgtggttgcgttcctggcgcaaatggctgaaccagctgtggccgcagctgcagctgggcgttcagtggaagaaatccgcaaagaactcaggaagcagctggataaggacatgggctccggcaagccgtcggataagggcaaagagaaggagggtgcaagcgtcaagaatgaagattcgatggacgtagatacctttcgtgaagaggcggctgctggtgttgcagactcgggagaaggcgagaagcagcccaaggcgtctcttgcaacggttgcactcggaacctccgcagcacgtgctgcggccctcgcctcgcatgaggagcgagagatgactcgcctcgtctctgctgctgtcaatgtgacgcttcagaaattcgaaattaagcttcaacaattcaatgagatggaagagatcatcgaagctgaacgtcgggagttggaactcgctcgccagcagctcttcctggaccgcatggccttcaagcggagagtaaaggaggttcaagactctctccaagctatcagcctgaagggacccactgaggagacggctaacctcattggagatgctgccacagcaggcataagcacccgctacaacttccaaccagcaggtggcgatgcgagggacggtgtacagcccttgagtgcagagacgggcgccgactacaaaacacttgacctgtga

SEQ ID NO: 15080 - DNA, 462 bp, A.fumigatus
aatttaagccagagccaagattctgagtcggagtatgagacggaattcccgagccggttcagacgaggggaaacccaagagcacatctccgggctcccgtcacaaccccctatcagacttgaacgtcgacggagaggcaccgattcagattcatacctcgattccaatgactctgatagtgacggggacgagtcgacgagtccccagcgaggagtcaagcttgaacccgacatgccagaggcggatttagattcggagtcgggctcgagtttcgatgatgatacgaaagataaagatgagagatataagaacgaaaatgaagacgatgtgtctcccggctcggatgacgatctcccatacgatcgatatcagaagcgagatgattcatactcggcatcggaagatgaggatgagaagagtaatctgcctcttcattctcagcccatgagcccggttgtttga

SEQ ID NO: 15081 - DNA, 228 bp, A.fumigatus
gtagaagagattgcaaaggtccccggcatcgatgtcctgttcgtcggaccctgggatctgggaaacaatatcggccgtcccgtcaagggggcgttccatgaagacctcgaggctgcgattgagcggatccgcaaggctgccgtcgataacggaaagagggccggtatctattgcgtgggtggtgcggctgcaaagaagtatgccgaccggggtttccacatggtatga

SEQ ID NO: 15082 - DNA, 249 bp, A.fumigatus
cggtggacaggggccttggatgcgggcgctcatggaatcgtcgtgcctcttttgtatactgctgatgatgctcggagattggtggaatccgccaagttcccgccagttggccggagaggctttgggagtccctttgccatgggctctattggtggtgtttctggattggagtacctccagggggccaacgatgctctgctcactatcgtgcagattgagactaaggaggcattggagaatgtgagttga

SEQ ID NO: 15083 - DNA, 2334 bp, A.fumigatus
cagatacagtatgcggacgatgccgcgaggcaggcctatcggaggaatgctcctaccgaccggaggacatgcctcctcggaacagctcaacacggtatgtacgccttcgctcaatgcatgtccatgtcccagacacaggacctaacaggcacaaacaggtcgctacttccgcggcaactgaaacggctgaggtccttgccctcttcgtcacattctcccccgttggtggtcatccagtccgctacaccgccccgttcgacgtggaatgggagggagccgtcgccgaggcgcacgctgcagagttcgcgagaggctggttccaggctgcagtataggctcggccttttttcgcatcggcgaacgcagtctggatctgctatgtaccctgcccgaggtaactggcaagcgcgcgggcagattgaggccgacgaaagttccgttggtgagcccgagggaaaggacgatgcgattgaggtttcgtcgagtcattcggaggagtcgtttcatactgctacgcgatcgccgatgccggagttcatttcgacggagagtcgcggcgtgcagggatcgcgctttgcgaggatacgacaggcccaggagagacggacgggaagtgtcaagcgggaagaggaagaggtgactgaggctcgtctgccgatattacgacattcaaatcttgctggtgggacgtttatctctgccgtggatgaagacgaggagatgatggatccttcagtagatttgtccaaaaaagatgcagatcgactggtgaacatctacttgaagctggactatgtgacgctgccgatcttggatatacaggactttcgggcagcgtatgaggcagttagtgttgctggggactctaccacgccgaacgcattttatgccattctgaacacaatctttgcgctcgcctgtctcaatgtagacgacatgcgtgaggaaagggcgagatacttcttcaacgagggtcagaggctggccaacctgtttgatcaatacaagtctattgatcttcttcgattgtacatcctacaggttcaatatctcaacgcgataggtgatctacctacggcttgggctttgatcggatctacgatacgactggcacagtcactgcgtctacccttcgatgcaaagcaacacgggcacagcagaaaagagcgagagacttgccggaggctctggcatggcgcgatgataatggaacagataattgcgctgcggctcggcatcgcgccccaaacacccgatccgctgcgggttcctctgcctacgcacttggatacagactatgttgatgtgttctcgagcgctccgtccagcgcaccgtcgagctcgcaaggtgaacgtgcatcaataatcgagtttttcaccgcctgcgcaagactgtacaggcttgtcgaagacgtaatggcatgggaggaagaggcaaggattcggcctcacggctgtgccatgaagaaactactgtcgctggattttacgcgattcttgaaagcagatagcctcttacatgattggaatcagtcattgccctcgtctttccggagcagtggaggccgtggcacagacgaacactcgatcgtcgtccgacagcggaatatccttcgagctcgatacttgtatcttcggctccggctaaaccgaccactggtaactctggggctagcgctgaccaccgcgtgcaaatgcaagtcggatggccagccgcacattgtggtaagaaggcccgccccagactcacctattgccctgagcctagtccatggggcttctgtcatgtgcgtccgatccgcactcgaactggcagagctcattcgcgcccatgagactggattgcttcgatttgatgcaccatacgacgcaagtcactgtctcagcccaccatactgggagtctgtggactatctctacgtctgtggtacagccttccttgctagcttcaaccacacatgtcctttcttcggtgatatgaccgacgaggaagacgaacagtgtagagtactctggccctgcataatagaccttctcggtcgctaccagggatatcgtcgacgcggccgaacggacaatgtagcccatgcgtgcagccgtacactgagcgagcttgccaaggctgttgaaagcacagattttacgccttgggcggtcgactcggcgatattaggacaagacgcgcgagcaaggttgtctcaacgaactgagatggagtcaccggttcgacacagacgaatatcaggtgcgagtcagacgatcccggatcctcttggggacgttcctgggtttccagagtggatggatagtttaccagttgaccttgtgggatga

SEQ ID NO: 15084 - DNA, 279 bp, A.fumigatus
cgtgtcacgctcttcacccgcgctggctgcgggctctgtgacaccgccaagcacaccgtgacccagctacacaagcggaggccctttgattacgccgaattagacattatggctcccgagaacaagtcctggaaggacgtctacgaatttgacgttccggttctccatgttcaagctgccctcaaggatcagttctctgacccgaagaagcttttccaccgattcacagagcaggaaatcgagaatttggttgaggaggcagaagaaatgaagccatag

SEQ ID NO: 15085 - DNA, 732 bp, A.fumigatus
  unsure (54): Identity of nucleotide sequences at the above locations are unknown.
caacgaggatacacccgagcagcccgcaagagcaggacatcgaaactccctttntgcatgtacggcaagtttgcgcctagtcctggacgcggcgagattcctagattgaaccattattccaacgcgctggcgagacgggtacagaagcgacgtcgacgggacaaggtgcctggtttacaactacgaaagggcgacagtgatgatgacagcgatcgggcgagcagcagtgaagggaaagtggctggcaaggagaactcgaaacaaaaaacgggacaggatggaaagtcgacatcacgattatcatcgttttcggaattttttgccttgcttgaagctcatcccaacgtccccagcattctgtcatggtgggctcagttggtggtgaacttatcgttgttctcgctggcggtttacgtggtgttcgggtttgtgtcggccatccgtgctgaatttgagcaggctgcggaggaagtgtctgatacaatcctggctgagatggctgtttgcgcaaagagctacgtggacaacaagtgcgctggtggagagcgattaccggccttggagacgatatgcgaaaactgggaacgctgcatgaaccgagacccggctaaggttggacgggctaaggtgtctgctcatacgatggctatcattatcaacagctttattgatcccatcagctggaaggcaattgtatgcggtcactcactctgttctattgccgataattag

SEQ ID NO: 15086 - DNA, 405 bp, A.fumigatus
gctcaaccatcggctgaccttgactccagcgccatcaagcgttcgaaccaacacagcctcaaccagctcgcgcgttattccagggtttccctgcatcatgatatccaagagatgctcgacacaggcacctctgattcctctagtggtgaggaagtcgaggagtcagtcgcggtcgaaaaggaccccgaagtcatgatcgttgaccaagacgaaaccgtccatccatatgaggtggcaggtcagacgatcttgtctgacgcagtgaacaaggccgtagagaagtacgagacaaaggagaccgagaagctggtcaaggaatatgagatcgtttcacatgagagtgagatgggaactggctatctggctgacgatgatttcgagctggtagaccatgttcagctgtga

SEQ ID NO: 15087 - DNA, 210 bp, A.fumigatus
tcacgattcttatcatcagacagaatgatttataccccaatagtatcatatgaaactagtttgatcacacagattcatatgcgatggatgcaatatattaagttgtctttaaatgatcagtgtagaccgacgaggatgttgcgaggcaggttgggcaccaatgagtcgcgaccactgagatccttttgttcatctgcggggcttctgtag

SEQ ID NO: 15088 - DNA, 210 bp, A.fumigatus
tcttcagacctgcaacttctcctatatgcagtaacactcaagatggagaaacggtcagctgagagtccgatggactttgagtggcagaccagagcacccggggacgtcacatcacccttctaccagcttagcatgcaacatgacaatcagaaaaagcgtgcgtcctccgccattatcctggcttacagaagctttcagtatctgacctga

SEQ ID NO: 15089 - DNA, 228 bp, A.fumigatus
tctggatatatgaaaaactcaatggatactctgttgactagatcgggacattataccccccaatggatggacggatcggctgcaaatcccatagctagatgcacgcagcaaacaatccttttttttttttttttttccttttaccttatcggacaggaatatggtcaaatcactagcacatatagagtaaaattgcatatatttatattcccagtgatatggagctaa

SEQ ID NO: 15090 - DNA, 183 bp, A.fumigatus
  unsure (41),(70),(78),(80),(108),(112),(115),(116),(117),(118),(119),(120),(121),(126),(127),(128),(129),(130),(131),(133),(134),(135),(136),(156),(167),(170): Identity of nucleotide sequences at the above locations are unknown.
aaattcacttggttggttgtttcctttttttgggtgggtgnttttaaacccccccattccggaaaggggntgtcgaanantccccccttgtttttggttaaaaggggngggnaannnnnnnttatnnnnnntnnnntccctttccctttttttctnttaatttcttntcntaatctaaattaa

SEQ ID NO: 15091 - DNA, 219 bp, A.fumigatus
gacattgaccgggacgggtatatctccaacggcgagctgttcatcgtgcttaagatgatggtgggcaataacctgaaggacgtgcagctgcagcagatcgtggataagacgatcatggaagcggataaggaccgcgacggcaagatcagcttcgaggagttcacggagatggtggagaataccgatgtcagcttgagcatgacactgagtatgttctag

SEQ ID NO: 15092 - DNA, 1188 bp, A.fumigatus
ccgtcatcgttatgttcatgcttctactatcgcattacttttattacctcagaagtgaagctgaggtgcgtcaccaatcataatcaatgggagaagaatgagcaggaggtgaaacgatatcaatttacccttccatcatctgagttagcaactggactcgcttgcagggagctgccattcatcaaagtgtcgctgtacgttttagggcgccgtccgctcttgcggactggcttttgcgaagtagagattcttacacggcgctgctctcgaggaacgccagttagtcgatctttatcgacttggatgcatgaagctgatgaagcatcccgtgggggcgggaagcgcaagctctcgggccgaatacacatcttgggacttgggaatgtagggacatttgttgctcattcgcttgcaagccgaccatctccacctcctattaccctcttgctacatagtagggatctttatggggcttggttagcaaagaaaaagtgcttagcggtcaatacaaacggcctcgacgatatcaagacgggctttgatgtcaacgtattgagtgaccggacttggtattcgctaccgtattggaatcagaatggcgagcccaatacgaatggtgatagcgttacagaagaaaatttggaagccggcgtggaagagtctctttcccagtccgaggaagatgatgaacatatcgaatgtttgattgttgcggtcaaggcacccatgactgccagagccctggaatcagtcagccatcgcttgacccctgactctactgtactccttctgcagaatggcatggggaccatcgaggagatcaacgagaaagttttccctgacccgcttcaacgcccacattacatgtgtggcatcatttcgcatggcttggcgcggaaaagggacgccttccatgttactcatacaggcatcggaactactataatcagtcctgtcgtgccgcgtgatgccttggcatcaaaggatgaaaaggatacggattgggcaccgagcacgaaatacctgacacgcactttgaccctcacgccgccgctcgtggctgtcgccgaaaccccttcatcccttttactatatcagctggaaaaactggcattgaatgctatcataaatcctcttacagccctgatggactgcgagaatggcgagattctctacaactatagcttc

SEQ ID NO: 15093 - DNA, 324 bp, A.fumigatus
ctgatttctctttctagtggtgtcgcagttggttcctctatcggacacgccatcggcagcctgttcagcggtggttcctccagcagtgcccccactgaggcccaacaggctcctcctcccgctcaggctcagcctatggacaatggattgtggcagagcagtgccaccaacagctcttgggagactcctgcttgcgagaccgacgttcgcaacttccgcaagtgcctggatgagaaccagggcaacatgactatttgcggatggtaccttgaccagctggtacgttcaattctcatattgtcccggtatattgaatgctgctaa

SEQ ID NO: 15094 - DNA, 465 bp, A.fumigatus
  unsure (257),(263),(398): Identity of nucleotide sequences at the above locations are unknown.
tctgtttacataagcaaggagtgcatccaatcagcgattgggaaatgtggcagctggatcggagtccgttttcggtcttcggcgacgcatattccaaggtcttcttttccagcgcctccattgacaacatataaaaaccagcaacctatcaacctttctaccggtgaatcgatttttatcaaagtacaccttacctcacttcttttccaacgaaaatacacaaccaaaatgcttcgtcaacgccgtggcgccgcccntgcgcntacccctgcgcgcagcgctcccaccagacctactgtcgctcccgcaagaccggctgctgcccccgctgctcagcaccaccagcctcactcgactgctgctcaccctcctgcgcaggctcagcaagcccctcctcntatggcccctgttcagcagagctctggtcccggactcttcggccagatggcttcgaccgcagcgtaa

SEQ ID NO: 15095 - DNA, 987 bp, A.fumigatus
ttcggaagaactgaagatatatcgacaccgccgtcgcccctgaagcaaatggactattacgctgaaccaataagatccaccacgaaggtctccatcgtgctagagaagcccgatgattggtggacatggaatgcctatataactggcctagcccgaacccgtggagtgctcgatatactccatggagagaggccttaccccgttccgccgattcgaccgatccatccattgactctagccaatcagcaggctagaacgaaccctgcggaatcccagccggactcagagaggccccaaacgaccgaagcaagccaatcagatggatcattaactgctgcagccgccccaaaggccccagcaaagattactgaagccgaattggcactatataccgaagaattgtcgatctataaggaagaaaaggagcaatatcgactggatcgactaggcctagcggctctctggaacaccatggagcaaacggtggccagagagcatctccagcggctaaccagcgaatcagacaacgaggttgagcgatatcaaaagctcaaggccgatatgaagccctcaatcgaaacaagaatgaaccaaatcgaggagaaatatcagaagcttgccgctaagccagccaatcagagcgtatcaagctggctaagtgagtggcagaaggtgctaagcgtgtgtgctgagctgaaaatgacgcaatatactggatatatgggcaccaggagcttcctcacagcgttgaagaagattgaacctcaatatgcaaatattcgattggatcgactgctggaggataacaagctgaatgtctttgacgagatctcccgttatcaaaggcactgggagagtcttagtcaaaaagaacagaagagcatcttcaccacattcaagggacaatcctctaaccaatcgaattctgattcggccaatcagaatcgtggaatcaagcgacttaagcgagacgattgcccctgcgga

SEQ ID NO: 15096 - DNA, 1335 bp, A.fumigatus
ggccggtgccactgcgtatcatcacgtatggagcggagagggagaatgagctccccgaatgactactcgccttccgagttcctcataagtacaggaagaggaagtactgtgaattgcaggaagtgctccatcgcagcaagggggatacgaccgatgagggccgacgaaaatgccgagaggtgcgaggactacttaagggatttgctgatgtggagggaaacgaagacaaggagctacctcctccagattccaacctctggcaacgcgcgaaagaatatcttcagctcccagaagatgtatcggccacacctgttccagtcccagacaactggcagcaatctccctgggagcatatcgaagacaagttgcggcgattactgcacttccgccatccggaaccagggacctcgttttcctacaatcaatggaagacgggccgtcatcatgacaaggccgtggtcgatatggtccgcgagcggaaagattggcatccggtcacggcccccacaagtatcacgcccccccccccacaagtactataccatccagctccaggataagttccgcgagcatggtttacagattattgtgaaaatggagaacatcgaactcaccccagatagtggaagttacaaaggaacggattggcggatggaaggccagctcaatgagcatctcgtcgccgcggctgtgtttgcatacgatgtggcgaatatcaccgagccccggatcgcctttcgtcagaacactaagctagatgaacgcttctaccgatgcagcgatgaccgagagcagatgcggatagtgcacccccgccacgatgtgccagcgcaacaatgtggtaagtatggctcgacagaattcgcagcagttgccgaaattctgggattctcgactgccgacctggatccttgttgttaccacgcagtaaaaacttggcaggataaaggtaacagtcagggtcttacaggggcggttggtacattccccacctttttagagcaccgttacgagccctttgcgctggccgatccgagtcgccctggatgttttcgtttcatcgtgctgtacctggttgatcctcactatcgcgtctgctccactcgcaacgtgccgccacagcaacatcactggtgggcagagtcggtcagtcataatctggccgcggccggattgccgcaagagatcgtcgatgagatcatgcaaggcaccggcagctggcccatggggttgcctgaagcccgacggcaccggcgtgaattcctgaaagagcaccgttggaacaatcttgttcggatctattgcatgcgtcgtccgtcctttgactgttactga

SEQ ID NO: 15097 - DNA, 201 bp, A.fumigatus
catcaacttttcatcagcgccgtctgtcttgaatctgtcctacgctcccaggaaatccgagaactcaaatgtctgcatgtcttccacagggaatgtctggataagtggtatctgcaggaccacttcaactgtccgctctgtcatcgcgcatattatgttcaggagtcgcggcccagccacgactttgtatggatggtatga

SEQ ID NO: 15098 - DNA, 261 bp, A.fumigatus
cgctcggattcatgctctgggtgttggggaattggtcttggagagagcactccctcctatccagcccgtattctcctctgcgcctcagagtctttcccaaccccgcttcgaggccacttcatggaattcgtggcagctgtcggcaaagctggtgctgccattgggacagaggtattcactccaccccagaagtcattggattccattttcacaagtccggttgtgctcgaaggcgtcatatcaaagcaatggttgacatag

SEQ ID NO: 15099 - DNA, 786 bp, A.fumigatus
agattgactggtggtagtgcctcaagtcctggctcaaatcgtgaacatggtcgattccgtacgactgtggagcccgcatcggcccttcctggatatcctggatcgaccagctattcaactgttctggccgagcaccgcagtgatatcccttttgaagtagacaacagctcagcggctgcagtgtccactcgctctattgattcagatcgattgcagatgggctcggatatgctccgattgctgtacgatcttcgggtttgcgatatcatgattcgcaagtaccatgctcggacggtgattaccattgtgccaaagatcgttatttattcgattgttgagtccatccgaaggatatttgacagtttagacgcaaatgacttcgattctcagtttcaagatttggtcaaccagatttttcagaatacttctcgcccgctgaccatccatggttcgatgaccgtggagcagtacttatcttccttcactgggaggaattcccgatgggaagccctggggaacatctttgcgattacaggactagcgctgatgtctacacctgacagcgatcctgatttcactcaggcagcgcctgatagcgaggccaaagatcgactccgcgctcagatcgtcgaggccagtggcatctgcctcggtttctgcgatcaagcatcgtctgtgaacgaactcctaggcttttaccagtacaatgacgttatgttaaggacacagcaatatggtgactctagtatgactatctattcactgcgacagttgatggtttgttga

SEQ ID NO: 15100 - DNA, 366 bp, A.fumigatus
tttcattgccaccagactttcttgatggaagatatcttcaaactgccgaggatggtcgaagttgcaggacaaacccgatcgccggcagtccgtcgcaatggaacgctacagtcctgcgaaccctgtcgcaaagccaaattgcgctgcgatcacgggagaccggtgtgtggccgctgtacggcgaaaaacatcgctagccgatgcttctatcatcctgcgcctatgacaaagcgaacagtcgccagtcgagccagccccattgaagcatcaaggagattgacgagccagccaagttcaaagtcaggactcagacccccttcatgtgaccccggctgggcgatgatgtgcgtttatggtaaagattga

SEQ ID NO: 15101 - DNA, 864 bp, A.fumigatus
ctgcaagtcctgacttgtcgcaggtatctagagctagtccgaaccattatcaagcggtacacgctcgaaccggcagggtctcatggcgtttggggactggacgaccattccttcatcccgtacatcctgggatctgcgcaactggcaccagctatttcagaaacagatccaactcctgaagagggctcgcttccaggtgctccatcgcccaatggcgttaccaaagcacatattgtcgaacgagaaaggttgacgaatatgtatttctccgcgattggcttcatttacgacgtcaagaaagggccattttgggaacacagccctatgctctacgacatttctggcattcaggctggatgggggaaaatcaataaggttagtcttgttgcgcttgccggaaatgaccaattgcttattatccagggtatgatcaaaatgtacaacgcggaagtactgtccaagttccccgtagtgcagcacttcccgtttggctccctcttcagctgggaccgtgatcccaacgccgtcccgccgccgacgtccggtcatatgtctaccacccagtctcagtctaggggcccggcggtcccatctgctggacagacgccgccgtccgggaccagggctccctgggcaactgctactcaggcagccccaccggctggagcagggaccgccgcgccatgggcagcaaagagagacggatgcacgcccggaaaaccacccacttcccttcccgacacgtcacgactgcctcctgggcctatggcccctaccagggctccgtgggcagcatcatcaaccgggcaggcacccggcggtgatcccacccatgtgcccaccaaagctccctgggcgaagtaa

SEQ ID NO: 15102 - DNA, 510 bp, A.fumigatus
  unsure (127),(299): Identity of nucleotide sequences at the above locations are unknown.
tttgcgttgtatcatctcctcggccaaaatccaccatgcccgcccgcaggctatcctcctcggtctcctccaccagctcaatccccaagctcatcttatccctcagcgcctcggccttcgcctcggncccttcgcgcgccttccgctccacccggaacgtcctccgcagccgtctggacctctcatacggatcctcccagtctctattctgtcgcttttgcaaatcctcaatccgcgacctttccgtctccgcccgccgcttatcctccacctttccctccaacttcgcaaacgcatcntccttcgccttccgatcctcccccaccgcgatctcccatatcccgcctgcatccccggtatcccgcttcctcccgccctcaacaacaacatacgccgtattcgccggatccgtccgaatctcaatccatcccccgcacgccccatgcttcatccggaaactatacaccggcgtcgaatagtagttcccgaccttccttttctcggcgttga

SEQ ID NO: 15103 - DNA, 687 bp, A.fumigatus
ttccatagctcaaaaaatctcatggcgaacagcttccccctccgggttctaccaaccatcgacccctctgcggggcataccttcatcactcccagcaagagaatccacgaatctgaagatgtatcagagttcctcatctccaaagcctacgtcgatatcatgaccttcctcctgcagctcaaccgggccatgatccccgtcaaacttgccgacggcactgtacaatcctggccgatcaatacagacgccgtcgagttctctgcgccggtacggcagctccagcagctcctgacaaaactggaggagctgctcgcagaggcgcctcctgataccggtcctcggaggtttgggaatatcagtttccgcaggtggtacgaactcgtggagagccgagcctcggagctactgggcgagtgcttgccgtccgagctgctgcaggctaaatcgtcggatcccaacagtgtgaccgcggaggcggaactcaaagcgtacttcttaggcagctgggggagcccacagaggctggattatgggactggacatgagctgagctttctggcgttcctggctggaatatggaagctgaatgggtttccgaagacaacgccgggagtggaggagagggctatcgtcttgggggtcatacagccgtatgtatggcccgggtgtgataactgcaagtcctga

SEQ ID NO: 15104 - DNA, 249 bp, A.fumigatus
gggcccggcggtcccatctgctggacagacgccgccgtccgggaccagggctccctgggcaactgctactcaggcagccccaccggctggagcagggaccgccgcgccatgggcagcaaagagagacggatgcacgcccggaaaaccacccacttcccttcccgacacgtcacgactgcctcctgggcctatggcccctaccagggctccgtgggcagcatcatcaaccgggcaggcacccggcggtga

SEQ ID NO: 15105 - DNA, 756 bp, A.fumigatus
  unsure (404),(576): Identity of nucleotide sequences at the above locations are unknown.
ttgaccagcgcgggcggtgcaaccggtctgtcaggctcgacagcggctttaatggcgggtggtccatcatcagcggcatccacgcccttggtcgatgccgtctttctcctcttgacctctggccgccatgcactcccatcctggttgagaaatgggtcgaccgcagcccgcgtattccccgtcagctcactgcgaaacagcgccttacgatcagccaacgtgtttgcgacatctcgcttcccattccgcgagtcgaacaacggccggcgacgcgtgatttgcgttgtatcatctcctcggccaaaatccaccatgcccgcccgcaggctatcctcctcggtctcctccaccagctcaatccccaagctcatcttatccctcagcgcctcggccttcgcctcggncccttcgcgcgccttccgctccacccggaacgtcctccgcagccgtctggacctctcatacggatcctcccagtctctattctgtcgcttttgcaaatcctcaatccgcgacctttccgtctccgcccgccgcttatcctccacctttccctccaacttcgcaaacgcatcntccttcgccttccgatcctcccccaccgcgatctcccatatcccgcctgcatccccggtatcccgcttcctcccgccctcaacaacaacatacgccgtattcgccggatccgtccgaatctcaatccatcccccgcacgccccatgcttcatccggaaactatacaccggcgtcgaatag

SEQ ID NO: 15106 - DNA, 1686 bp, A.fumigatus
gctctcgcgctctatcctgaatggctccgtcccggtttcacgtctgaacgacatggtaaaaatctcatatcgtggctgttcttcgcagatgctgatcatgagcaggtcaccagaatcgtggcggcatggtacaagatgggccaggatggagacttcccgctgcccaacttctcgagcaacacacaagatgcgacgggccctttgtacccgggtgctcttttctctccgtctggtgttgtcaaccagtatgtcaacgtgcaggccgatcacaacattactgccagagcaatcgcgagagatgccatcactttgctaaagaatgatgacaatatcctccctttgaagaaagacgacgctctaaaggtttttggaacagacgccgggcctaacccggacggtctcaactcctgcgctgatatgggatgcaacaaaggagtgttgaccatgggctggggcagtggcacgtccaggcttccgtacttggtcacaccgcaggaagccattgccaacatctcgtccaatgctgccttctttattaccgataagtttccctctaacgttgcggtaagctcaggcgatgtcgccgtggtgttcatcagcgccgactctggagagaactatatcaccgtcgaaggcaatccaggggatcggacctcggcagggctaaacgcatggcacaacggcgacaagcttgtcaaagacgcagcggccaagttctccaaagtcgttgtggtcgtccacaccgtgggccctatcctcatggaggaatggatcgacctgccgtcggtaaaagccgtcctagtcgcgcacctccccgggcaggaagccggctggtccctgacggacgttctcttctgcgactacagccccagcggccatctcccatacacgatcccacgcgccgaatcagactatccttctagcgtcggtctcctctcgcagcctattgtccaaatccaagacacctacaccgagggcctgtacatcgactaccgccacttcctcaaagccaacatcaccccacgctatcccttcggccacggactctcctacagcaccttcagcttctcccatcccacgctgtccgtccgcaccgcactctacagcacttacccaccgactcggccccccaaaggcccaacctcaatctaccccaccgccatccccgacccctccgaggtatcctggcccaaaaacttcgaccgcatttggcgctacctctatccatacctcgacgaccccgccagcgttgggaagaactccagcaagacctacccatacccggccgggtacacgaccgtccccaagcttgccccgcgcgccggtggcgcagagggaggcaacccggccctcttcgacgtggccttcgctgtcagcgtcaccgtcacaaacacgggcagccgacccggccgcgccgtcgctcaactttacgtcgaactaccagatagtctgggcgagacgccatctcgccagctgcgacagtttgcgaagacgaagactctagcccccgggactagcgagacgctgaccatggagatcactcgcaaggatatcagtgtttgggatgtggtggtgcaggactggaaggcgcctgttcggggagagggagtgaaaatctggcttggggagagtgtgctggatatgcgggctgtgtgtgaggttggaggtgcttgcagggttatataa

SEQ ID NO: 15107 - DNA, 504 bp, A.fumigatus
tccttccagccccgtggtgaagacctgctcaatgaaatcctgaaggatgagctaggattccaggggttcgtcatgaccgactggcttgggcaatatggcggagtctcctcggccctggctggtctggatatggccatgccaggcgatggtgctatcccgcttttagggactgcttattggggctctgagctctcgcgctctatcctgaatggctccgtcccggtttcacgtctgaacgacatggtaaaaatctcatatcgtggctgttcttcgcagatgctgatcatgagcaggtcaccagaatcgtggcggcatggtacaagatgggccaggatggagacttcccgctgcccaacttctcgagcaacacacaagatgcgacgggccctttgtacccgggtgctcttttctctccgtctggtgttgtcaaccagtatgtcaacgtgcaggccgatcacaacattactgccagagcaatcgcgagagatgccatcactttgctaa

SEQ ID NO: 15108 - DNA, 663 bp, A.fumigatus
cggacgttctcttctgcgactacagccccagcggccatctcccatacacgatcccacgcgccgaatcagactatccttctagcgtcggtctcctctcgcagcctattgtccaaatccaagacacctacaccgagggcctgtacatcgactaccgccacttcctcaaagccaacatcaccccacgctatcccttcggccacggactctcctacagcaccttcagcttctcccatcccacgctgtccgtccgcaccgcactctacagcacttacccaccgactcggccccccaaaggcccaacctcaatctaccccaccgccatccccgacccctccgaggtatcctggcccaaaaacttcgaccgcatttggcgctacctctatccatacctcgacgaccccgccagcgttgggaagaactccagcaagacctacccatacccggccgggtacacgaccgtccccaagcttgccccgcgcgccggtggcgcagagggaggcaacccggccctcttcgacgtggccttcgctgtcagcgtcaccgtcacaaacacgggcagccgacccggccgcgccgtcgctcaactttacgtcgaactaccagatagtctgggcgagacgccatctcgccagctgcgacagtttgcgaagacgaagactctag

SEQ ID NO: 15109 - DNA, 1083 bp, A.fumigatus
  unsure (486),(658): Identity of nucleotide sequences at the above locations are unknown.
ctaacagccacacagatatgggacggtccgttacctccccttagctactcaagttcccaccgaaacccaaaactaacgactgacaacagctatgtccccccggaccaagagggcataacaacaggcaacaaactagccggcaagcacccactaggggcgcgagcgcgccatctccgcacaagcggcgctttgatcgtacgcttcgagatgcccttcgcggtgtggtgcacgacgtgcaagccgcacgagacgctcatcgggcaaggggtgcggttcaacgccgagaaaaggaaggtcgggaactactattcgacgccggtgtatagtttccggatgaagcatggggcgtgcgggggatggattgagattcggacggatccggcgaatacggcgtatgttgttgttgagggcgggaggaagcgggataccggggatgcaggcgggatatgggagatcgcggtgggggaggatcggaaggcgaaggangatgcgtttgcgaagttggagggaaaggtggaggataagcggcgggcggagacggaaaggtcgcggattgaggatttgcaaaagcgacagaatagagactgggaggatccgtatgagaggtccagacggctgcggaggacgttccgggtggagcggaaggcgcgcgaagggnccgaggcgaaggccgaggcgctgagggataagatgagcttggggattgagctggtggaggagaccgaggaggatagcctgcgggcgggcatggtggattttggccgaggagatgatacaacgcaaatcacgcgtcgccggccgttgttcgactcgcggaatgggaagcgagatgtcgcaaacacgttggctgatcgtaaggcgctgtttcgcagtgagctgacggggaatacgcgggctgcggtcgacccatttctcaaccaggatgggagtgcatggcggccagaggtcaagaggagaaagacggcatcgaccaagggcgtggatgccgctgatgatggaccacccgccattaaagccgctgtcgagcctgacagaccggttgcaccgcccgcgctggtcaattatgcttctgacagtgactaa

SEQ ID NO: 15110 - DNA, 690 bp, A.fumigatus
ttgacattctcgaagttacattacttgcaaaaagcccatgaaaaagcttcaatatcctatcggttaaagggcgtcacccgtcatattaatgaaacttgggcgcgcaatggggatgactccgccatgaagaaagcacttcgcaggggaggttacagcacgttaaatgtctactttcagaccaatctacagccgccctccaccacagattttgcaagatggacctctgacggtgacaatcgccacgcatataactcagaccttgccccccctagcgtccttggtttctgcactcttccggatccaagcattaactccagcagccctcgatccagctattccaaagatggctgcaatgtgctggctaagactatgcctggtggtcccatgactcattacaatcgaggtggcactgcaatacacgaaatcggtcactggaatggtctcttacatactttcgaaggggagtcgtgttcggaagacaatgctggtgattacattgcagatacaccgcagcagtcggtgcccactgatgggtgcccttctcagaaggattcatgcccggatagccctggcttggacgacatacataatttcatggactattcatctgatgactgttatgcttcctttacatctaatcagctgaagagaatgcgagacatgtggttctccatgagaaaaggcaaataa

SEQ ID NO: 15111 - DNA, 243 bp, A.fumigatus
tcagacattccagtctccaatagcaacaagatgtaccttataaacccccagcagccttcagagatcgaagccaagatgctctgcgacaagcttcctcaacatgatgttgcctttcaattcctgcgtttatgtcttgcttattataagtctcatgtcgaactgccgagctctatgtcgtgcgacggctttacaaggccgttctctttgtgccactggtggtccagatgcagcattcagggctga

SEQ ID NO: 15112 - DNA, 624 bp, A.fumigatus
tcactcatagaccgccgtcctgtgaagttacctgacgtctaccttcggcctcctttggatgggaagcgcgttccgggtgaggtcgagatacatcaaaacggtcttcgatacatgtctccgttccgaaatgaacacgtcgacgtgctcttcagcaatgtgaaacatttgttcttccaaccgtgtgctcacgagttgattgtcctcattcacgtccatctcaaaacgcctatcatgattgggaagagaaaaacaagagatgtgcaattttatcgggaagccaccgagatgcaattcgacgagactggcaatcgcagacgcaaacatcgctatggagatgaagaggaattcgaagctgaacaagaggaaaggcgacgcagagcagcattggacagagaattcaaggccttcgctgagaagatagctgatgccgggaaagacgagggcgttgatgtcgacataccatttcgagagattggattcactggcgtccccaaccggtccaatgttcttatacaaccgaccactgacgccctcgtgcaattgacggaaccccctttcctagtcatcaccctgaatgagattgaaattgcccatctcgagagagtgcaggtaaggttctactag

SEQ ID NO: 15113 - DNA, 540 bp, A.fumigatus
ggttctactagtgttatgactaatatttattgttatgctgatgacttgcagtttggtctcaaaaactttgacctagtcttcgtattcaaggattttcacagggcccctgttcacataaacacaatcccggtagagtccttggaaggcgtgaaagactggctggattcagtcgatattgctttcactgagggacctctgaacctcaactggacaaccatcatgaagacggttgtgagtgatccttacggtttctttgcggatggaggttggtccttcttagccgcggaatctgattcggaggacggatcggaagaggaggaggagtctgcatttgagctctccgagtcggaattggcggcggcagatgagagttctgaggacgacagcgaatttgacgacgatgctagcgcggaggcaagcgacttcagcgcagaagaagagagtggtgaagattgggatgaactcgaaaggaaagctaagaagaaggatagggaaggcggcttggatgatgaagaacatggcaagaagcgaaaacggtag

SEQ ID NO: 15114 - DNA, 858 bp, A.fumigatus
  unsure (2): Identity of nucleotide sequences at the above locations are unknown.
anattgaaaggacgcaagagctcaacttactctatgatcatcacagacacagttcgtgtgggagaaaatgggccacatgtgttcaccaaggatgcaggtcttgacatggactccgtatcattctacttcggagacgaagaggaaccccaaaaacccatcaaggagaaaaaggaagcgaaaaccagtgctatcgccagcaggaacatcacaagaacgaagctccgagcggaacggccaactcaaataaatgaaggtgctgaggcgcgtcgccgcgagcaccaaaaggagctagccgctaaaaagacaagagagggccttgatcggtttgctggaactactggagacgacaatggagttacgcagaaaaagttcaaacggttcgaatcgtacaagagggataatcaattgccaacaaaggtgagagaactcactatatatgttgaccaaaaagcatctacagtaatagttcccataatgggtcgaccagtcccgttccatatcaacacaatcaagaatgcaagtaaaagcgacgagggcgaatatgcgtacctccgcatcaacttcctttcccccggccagggagttggcaggaaggacgaccagcctttcgaggatctgtcggctcatttcctgcggaacctgactcttcgttctaaggacaacgagagactggctcaggttgcccaggatatcactgaattgaggaaaaatgctttgaggcgggagcaagaaaagaaggagatggaagatgttgtagagcaagacaagctcattgagatcagaagtacatccttgcgccgcacaattctgttaccaatgctaatcactcatagaccgccgtcctgtgaagttacctga

SEQ ID NO: 15115 - DNA, 1248 bp, A.fumigatus
ctatctgtctcttatattcagcaaagtcgttcccggttccaggtcaaggcctcgaaaaccagccagaaattcgatgaggcactggtcgaattgtcggcgattatggctgccacggcaacgatccccaagccgaagaagccgtcgctcaagggccccgagcttgcgacgtttatttcgcaagcgttagaggttcacaattccattctgaactgcgaagcataccctgagagttggttcagtgtgcatgtgtacaatcaccgagctaccgtaaagagcctggaattcctcgctacattactgactagcaagtttttgcccgcgccggatgacgcggaaagctttgatacgaggttgtgggagagcttcttcatgactttgctcaaggttgtgtccagtgatgcactggccttggaaacattccccgagcagaaacgaagggccgtttggaagatcgcaggcgacgtgcgtgagcagggagccgagctgctgcgctccagctgggaggccatcggttgggaaacgacagatgaggaccgggaactgtatgggctgcgcaagctcggcggttaccaggttcaatatgtgcctggcctcgtggcaccgatcatcggactctgcctcagtgtacacgagggattacggcatgtcgcagtggaaatcctacggaccatgattctgagcgaatggggcctgaaccaagagctttccatcgtcgagacggaaatcatatccagcctcgaccatctcttcaaaacaaagaagatgaacgagagcattatccagaagctgttcgtcagcgaactcctcgaatactttgagggctgcacttccttggacgaggacctttccgatgccgtcaaaggtctcatcgcgaccgtcgacgagcttttggatctgtttgttgcatcgcagagcggctcgatggccggaagtatgcatacattgaggttgatggaatatatgaaggatatgggccgggaagacatcttcattcgttatgtgcatgaattagcgaacgtacaagcggcggcgggcaactttaccgaagccggtcttgccctccagttccacgccgatctttacgattgggacccgaagcgagtggttccagaggtccttgaccctcccttccctgagcagacggctttcgagcgcaaggaatcgctgtactttgccatcatccagcatttcgaggacggcacggcctgggcgcatgcgcttgtctgctacaaaggtcttcacccgggg

SEQ ID NO: 15116 - DNA, 1257 bp, A.fumigatus
ccagttccctcccagtggagctctttcggcaagaacgaatcggccaaggatgaagcgattaccgggccgctggccaccctgcgcctggagacgtacctgtgcagcactgaatactcgcaggaccaggtcatcctgagcttgctgcattggaaggaccggccggtagatgagatcttggataccttgaagagggttctgtttgtgcctgagattgagatcgtcaagcagctgagcagtgtgtttgatgcgctatttggaatcctggtggaaaatgccggaaatgaggagtacgaagatctgatattcaacaatcttgtgaccgttcttggcatcgtccatgaccgacggttcaaccttggcccgctggttgaccactatgcggacaaccaattcaatttccccttcgctaccccctgtctgatgcgaagctatctccgcctccttcaggctagtgccgatgtgcaacagtcacggagcctgcgtgccacattcaaggtcggccgacatgtcctcaagttcatcatcaatgccaggcagcagcaaaaggccaaggaggaaggcatcggtatcactcgggggcagtccactttcaaccgggatctgcacaccatcttcaaatctctggaagtcctcatgaggaatccgtcaccggcaatggtgggcagcaagacgcttgtagtgcagcatttccacacgtggctgccggggctatccaaagtcattagcaaagacgagatcatcatgattgcgctcagctttatggactcttgcagcgacgtcaaaggtcttctgatactgtacaagttggtcctgatccagcactacacgcagctggagatattcgaatccggaccagaacgacggactctgatctccagttgcattggctggctggaaccgtactggggagccaccggatccgtcaccgaccaatatcgcgatcaggttcggttgagttgcgcgatcgtcgcccagcttctgaagcagccagatccgttgttgtatggcttcatgcctcagatcgtctcgtcatactattcaatcataccggatggcgtggaggagactagctatctgtctcttatattcagcaaagtcgttcccggttccaggtcaaggcctcgaaaaccagccagaaattcgatgaggcactggtcgaattgtcggcgattatggctgccacggcaacgatccccaagccgaagaagccgtcgctcaagggccccgagcttgcgacgtttatttcgcaagcgttag

SEQ ID NO: 15117 - DNA, 435 bp, A.fumigatus
gcattgatatcgctggtcaatgcatgcgcaatcacgacgaacacttccctgacgacaggtcaaatcagaactggcagcaaacgactcgtaagctgccactgccgggacatcacgatgagctctaaccaagacaccacgcaatcgtcgacaaagaagcgagaatcccgcgcaggaactcgtaaagtgaccactctttccgctgaacagctggcgcgaaagcgtgccaacgatcgagaggcacaaagaaccattcgtcagcggacgaaagaacatatcgagcgactccaaaaccaagtggctgagctccaagccaagaaccagcaatttgacgacgtgatgcgacggaatgctgctctagagcatgagatcaagagcctcaggcagcaactggctatgctcactggcaaccaaagctatagcagtactggtatgtga

SEQ ID NO: 15118 - DNA, 366 bp, A.fumigatus
  unsure (267): Identity of nucleotide sequences at the above locations are unknown.
aactactttttcaggtatgcattgatccccgacataccgttcatcgttatcaattacgtatcggctgaaagaatcatccagtgcggcaagttgcgaaatgcggaacaaatgtttgccagcatcagtgcccaatcaccgcctctgaagtacttcccagcttctcagcgagtcacttatctctactacctcgggcgctatttgttctccaacaaccttttttatccggcgcagatcgcgctgcaagctgcctacgaccagtgtcaccgncaggctgtcagtcagaaacgcatgattctcacgtaccttatcccatgcaacatcatcatgggcccgcttcccttccctgcagctcttgcaaaaagctga

SEQ ID NO: 15119 - DNA, 1506 bp, A.fumigatus
ttggtgtgggtacaagcttggacacggcattattactttacgtcaccacacgctctccccgattcctacaaagcccctggtcctaacaacatggacgatcacaacaaggctgtagcgaccattgcaggccaggtccgaaaatttcacagtcgccgacaaccttttcgcatctatcatggctcgacgaatagtacacggcagtctcaacatcatcacaataacaccgtcaacacagcacatctaaatcatatgatacgcaccgattgcgaagctcaaacagtgctggtcgaacccaatgtcccgatggaccaccttgtccgggccactctggctgctggcctggtccctcttgttgtgatggagtttcctggtatcacggccgggggaggattttccggcacttccggcgaaagcagctcttttcggcacggtttctttgatgccactgtaaattggattgagatagtcctgccaaacggcgaggtacgaattgcgtcgaagagctcggatcccgatctcttctggggcgctgcatcggcattcggcactcttggtgtcgtcacattgctcgaggtacaatgtcagcaggcaaaaccttatgtcgagctgaagtacgagtccgcgtcatgcatgactcatgccatggacatcttccgcgccgcggctgcagatccgcagatcgattacctcgacgggatcgtcttcgccagggatcacatcatcgtctgtacaggacgactaatcgattctctgcctgcaaatgtcagaccccaacgcttcaccggcgctcgggatccatggttttatcttcatgcgcagaaacgtgccaacacatcttcaagaaaaccagactacatccccttgaccgactacctttttcgctatgaccggggcgggttctgggttgcccgatacgcctattcgtatttcctagttccattcaaccgcatcacacgctatattctggattatttcatgcatacacgggtgatgtaccacgctctccacgaaagcggacactcgaagcggtacatcatccaagacgtggcggtaccatatgctgcgacaaccgagttcctcgactggctggaccaaaaacagaactttggcgcctaccctatctggctgtgtcctctgcggcgttcggaggggctgatgtcaagtgctgattcaaaaaatccagtcccgccatctaccgatccagaggatgacgggtatctcatgaactttggtctgtgggctccgtctcccttccacagcaaccctgatcaattcatcgcccagaatcgccgactggaaggcaaggtgcgcgaactcggcggaaagaagtggttgtatgcgcatgcgtactacaccgaagatgaattctggtctttatacgacaagaggaaatacgaccagctgagggagagataccatgcgtcttatctaccggatctgtatcaaaaggttcgtgttagacttgcggcgcccgaagacgttagttatgaccgccgtagaagatag

SEQ ID NO: 15120 - DNA, 354 bp, A.fumigatus
ctaccaactatggcgggccagggcacccctgtactggatcgcttcctagcaggaattgctgatattgtgaaagagcgcgatggagccaggctccaggatttcttgcagatcgagcctcctctccccgacgcgtaccgacagatggtggacgagctgcgacaacaataccccagcggatcgccaaaagaaggaaacttgttacgacgatgcgaagaggttgtgccgcgcaccaaaggagctagctcgtgggcggccttccctacatttatgaagttatatttctgcttccttcgcgatgtcaacgtcgacaacctccttgagacgtataacctacttaagggacttctcaagtaa

SEQ ID NO: 15121 - DNA, 630 bp, A.fumigatus
ctgtatgtcttggtcatgtttatcgctccatcactcggcatcgctgacggtacagatacgctctcgctgctgctgctcgcgtgcatctcgatctcgcgtgacggagaatggtccgcgtccaacggaaccatctatggcgtctatgtcggggtgatcctcgtgcacgccgtgtgcgccgtattcgccgggccgatcatgaacaagatccaaacgttttcgattttcgtcaacgtggcgatgatcatcgcaacggtggtcgcgcttcccgtcggcaaggtcagccgcggccagtcgctgaacccgggctcgtatgtcttcggggacgtggagaacctgacaacgtggccgacgggctgggcttttgtgctggcgttcctggcccccatctggtcgattgggttcttcgactcgtgcgtgcatatgagcgaggaagcgctgcatgcggccaaggcggtgccgctggggatcatctggtcgtcgggttgcgccacggtcctaggatttctggttttgtccgtgattgccgcgacgatggacccggatgttagcaagacgatgggctcgacgtttgggcagccaatggcgcaggtaagccatccatgtcctcgtatggtaactgacggcgactga

SEQ ID NO: 15122 - DNA, 564 bp, A.fumigatus
cgctctcggcaagaagggagctcttggcttcacaggtgtgctgattgtcattcaattcctggtcggactgagtttggtaagctcccagccatcttttcgggggaaaaaaaaatatacagaggtactgatcaacagatcgttgctgcctcccggcaagcatgggcgttctcccgtgacggcgccctccccttctcgggctacttccgccatatcagcaaacgcatccggtaccagcccgtccgcgcaatcgtcgggttcgtcgccgtgtgcatcgttgccggcctgctctgcctgatcaactcgatcgccgccaacgcgctgttctccctgttcgtcgcgagcaactacgtcgcctggggcaccccgattctctgccgcgtggtctggagcaagaagcacttccggccgggcgagttctacacggggaagctgagccggccgattgccatcgtcgcaatcctgtggttgatctttgggctgatgctgtcgatgtttccgagcgggggaccgaatccaactcgtaagtgtcttttttgtctttgcagtctaggaactgatggctga

SEQ ID NO: 15123 - DNA, 183 bp, A.fumigatus
cggggctacgctacagcatcaacgatgaactacaccattgtcatcaacggcttcgtgtgggttgcatgcatgacgtattatttcctctttgcgcggaaatggtacaccggccccaagatgacgatcgattcgtcgtcgtcggaggtggtatccccgccagagaaagatgcagcagccaactga

SEQ ID NO: 15124 - DNA, 600 bp, A.fumigatus
cgaaactatagtcatctccacacctctctctctctctctctctctctctcacacatctcatttactcaataccccctacaagccctacagggcagccataacacccaacacaccagccacacccacaatccccgctccaaggaacggggtagcctgcgcacccgccccctccgacgtggaggtcgacgtgcccgccgcaccggcactagtgctcgtgcgggtcatggtggtggtgaacgacccgcttgtcgaggtcgtggtatccgtcagggtagccgtggtcgaactggtggtctcgctcaccgaccgggtctccgtggcggtcggcgtaccattcgttccggtcagggtggtcaattgctcgttccacgccgacgacgccttgctggccacatcggaagcgcgggactgggcgtccgaggccacggacgacgcccaggactggacgttggaggctgcggcgccggcctcggaggtgagcgaggagacggccgccgcgccgccggtttcaaacgcggaggcgatggaggttgcgtcggcgacgacgttggaggcgatgttttggccgttggagacgatgttgttggctgcggagactag

SEQ ID NO: 15125 - DNA, 237 bp, A.fumigatus
gtcgcagcttttgaacgttggcgtccgacgcgcatcagactgattgcaacagcggaactgggctacaagcaggagctgcgacgacagtattcgacattagaaatctttgcggtcgcgtttagtatcatgggtttggttccgtcgatcgcgtctaccattgcattctcacttccagctggtccagtcgggatggtttgggttcgtttgttttcttgctttctttcccgacgcggctaa

SEQ ID NO: 15126 - DNA, 306 bp, A.fumigatus
ctccaggcggatatggcgtcagcgatgcctacggctggcggtctatactggtggacacattatttcgcgggtgagaagttcaagaacccgctgagcttcttggtcggatacagcaacacccttgggctgattggggggatgtgctcggttgactgtatgtcttggtcatgtttatcgctccatcactcggcatcgctgacggtacagatacgctctcgctgctgctgctcgcgtgcatctcgatctcgcgtgacggagaatggtccgcgtccaacggaaccatctatggcgtctatgtcggggtga

SEQ ID NO: 15127 - DNA, 819 bp, A.fumigatus
cccagggacggtcagtatggagtgcctgagctggctgggatctatttatggtgtgttggcagtgtaacgacatataaaacgatccccagtctccagctcagtctccagtctctaatctccagcctccagcctccagtctccaatctctggctgcttcattgtcatctagaactgataaccctatctcatataaacaaaaccaaacacccgaaaaaagcaaaaatgcaactcgtccacctcacagctctcctcctggcaacagccacctccacctacgcacaggacaacaatgcaattgactccctagtctccgcagccaacaacatcgtctccaacggccaaaacatcgcctccaacgtcgtcgccgacgcaacctccatcgcctccgcgtttgaaaccggcggcgcggcggccgtctcctcgctcacctccgaggccggcgccgcagcctccaacgtccagtcctgggcgtcgtccgtggcctcggacgcccagtcccgcgcttccgatgtggccagcaaggcgtcgtcggcgtggaacgagcaattgaccaccctgaccggaacgaatggtacgccgaccgccacggagacccggtcggtgagcgagaccaccagttcgaccacggctaccctgacggataccacgacctcgacaagcgggtcgttcaccaccaccatgacccgcacgagcactagtgccggtgcggcgggcacgtcgacctccacgtcggagggggcgggtgcgcaggctaccccgttccttggagcggggattgtgggtgtggctggtgtgttgggtgttatggctgccctgtag

SEQ ID NO: 15128 - DNA, 1308 bp, A.fumigatus
taccagttgcattttcacgacataatgtcatcttcgctagcaagagcccggccgtctaggcgctctgctccccgaaggagttacgtgattgaggaaacatccgagtcagaagaccctggcaatgtaacccccactgcatccaaccacagcgacaacgatgacgacgacgaagatgaggaagaagaatatactccggtccctgctaaaagagcgaagagcgtgtcccgacggcgaacgacgaatgaagcgataacacccaccaccgcacgtaaggtacgaaaaacgcgacggtcgacaacagcagagcaaggtgataccttagaaatcaacaataaaaatgacgaaggcgactctgtcgtccccaaggaagaggaacccgaatctcctttacagaatgcggctgcagctctgaaaagaaaaagtatggctcatccccgcaagagtcgggtttcttccacgctccatccggaaaagtcctcattgccaactccagggccctcagtctcgcccgaaccagagccgcgatcgcaaagaggtagcgtgcctccgctagccgatattaccgaatctgtggtcaatcaaacaccagcgaagccgtcagacgatccgaagtcgcagatctccatcatcaatccaaattcgacgatcctagagagaccgatggacattgttatgaagtcacgcaatctggcaccctctgtaccagaagagccatctggacccaagccccggttgattatcacccacctggttctgacaaacttcaagagttacgcagggaaacagattgtaggtcctttccatgcttcattctcctctgttgtcgggcccaatggatctggcaaatcgaatgtcatcgattcgttgctgttcgtattcggatttcgagcaagcaaaatgcgacaaggcaaaatatctgctctgatccacaactccgcgaacttccccaacctaccattctgtgaagtcgaggttcactttcaggaaatccttgatctgccaggtggagaacacgaagtcgtccctgattcccaactgatgatatcccgcaaagcattcaaaaacaataccagcaaatattacatgaatgggaaggagacaaacttcacggcggtaacgactctgcttcgagaacgaagtattgatcttgatcacaagcgattcctcatccttcagggagaagtcgagtccatcgctcaaatgaagcccaaggccgcaaatgaacacgaagacggactgctcgagtatctcgaagatatcatcgggacgtccaaatacaaagctcccattgaaaaaggcagcagctga

SEQ ID NO: 15129 - DNA, 285 bp, A.fumigatus
gataccgttaatctgagctccaatatgacgccttcagccaagtccccgataagagcggaagaccaacagcgagccaacagcgtcactgtaactcatcctggcgcaatcatcatgggtacttgggaggatttcgacagcattttctacttcaataagagttttaactacgatgacaaggtcattgaacagatcctttccaaccgtcgcgcgttaggaaaccaattgtttgccgaccgactcttgggattgctcggtgttcaagctggtaggcaattcgctccataa

SEQ ID NO: 15130 - DNA, 354 bp, A.fumigatus
ggaatgggcttcatacttgccttttttcttcttggggaagacttcgggtcggtgaaatgtattgtcatcggacgtaaatgttgtcttcccctccaacaaaagatcatctccatcgaacagaacttccattttcatctcgagtactcttcttctgtcaaaattcacgatacctatagcatcgaccgtgatgaattcgacagagtgatctgcaggcctgacattcagtatacatccatcaagggcacagttatctactggcttgctcttccacgatcagttggcgcagccgagaaaagaaacatggttgtctgtactttctttcagcaaggcagatgtagatttggaggtatttag

SEQ ID NO: 15131 - DNA, 198 bp, A.fumigatus
tccgcatctgctcgcggcatggtatggccccgaggagagaggactatagctcccttgcttcatgctgtgatgagagagttactcgtttttttttacaagataatgcgatcatccattgtcttctccctcttcgtgtttttctgcccatcactgtctgacttgtatattgagaaccacttccaggctattgcactttga

SEQ ID NO: 15132 - DNA, 444 bp, A.fumigatus
gtttacttccatacctctgaatccctatcggtcttggagctcccccgtctcaatctcccgcaaaaggcttctcctggcaaacttaaagttccacccgatatttgcggcacgagtgtcggattcctagccgctcatgagattgcatgcgcgcagggtaagcaagtcaatgcatcaaccccctgcctcttgagatttgtctgctcgtgctctggagaacatcaaagcttgaggccgagcatatatctcgactccgtgaagctctttttcgagatcatctctgagagacaatacatcagtgtagcaggcgtggtagttgaagcggcctgggcgtgttgtggtaactttaaatatgatctagataaagacaaggctgttagtcgctatgtccacacaaatagaacacaggctgccattcaatcttccgagtgctcatctgtgtgctga

SEQ ID NO: 15133 - DNA, 333 bp, A.fumigatus
atttggcctcaacattctcactaccggagtgtttggaatactttactcttactgccggtccctaaacggacctctggcggaagcgcccaatggaaatactggtacggcactattctttttaccctcttacaaaacccttccgtattcccccaaatcccaattgagtgcggactgggatatggaatcagaacccggggggcttccttgttttccccggaaccgcccctcaattcctcttcctcaaaaaattgtgccattttccccgtgaacccctttttccttcccggaattatcccggtttctgtcggggtgtctaatgggtcaaaacccgga

SEQ ID NO: 15134 - DNA, 369 bp, A.fumigatus
ggctccgtcgctaattcagtgccgcatcctccaacaattgtccacaacctgacttcagcggttgtcttcaaaaaggagcgtgcgtcgatactcataatgttgttaccacgaaagtctagggtcgggtccagtggttattcttactccagttataacaactcgccatggaacgaagatgttacattttcgatgtacagcgtgtatggaggcagatcgaacttcatcacgcagctcgctttcgagttcctcactttgggagttctatttctcttcctttttggctgttttttcatcagacagcctaaggcgctgcccaagtgtctgcctaagaaggctcttgtcttcgggattttgagctatatcctgtga

SEQ ID NO: 15135 - DNA, 309 bp, A.fumigatus
aatcccatctacactatcgacatccaactacccaccacaacctccatggtgctcctcgtcacaaccactcatattatctccgcattcgaggccgttcccccctcttctcgcaaggagctggacctccccgactctctgagtatcggttccccaatttcacatgagcaagtgatccgtctatcacgctattccaacaatggagccaacagcaccagcccccacccaaaaccagacagaagcctcaactcgctcctccgcggcacaagagtctacgtccctcctccgtctaagaaacctgaacctgtatga

SEQ ID NO: 15136 - DNA, 699 bp, A.fumigatus
tatgaccaccagagtcccgagtacctcgctctaaaggcccgcctgctcgctgctgccgaaacagatgcctacaaccgcatgacagcctcaacattcacatcctccgcaccagggcaaagcgggccctcgccgatcttctcctcctccacgccgactctctccgcccttcacgactctaaagcactcgccggcgatacggggacgaaagacccgctcaccccatcactggtactgaacattttcctctcggtgctcatcaccgggttcagcgtgtactgggcgctgacgagcttccgtacgcctgacattttagtgagctctgtatcctctttgtggcggggacagccacccagcaaaccgagtgcgaatagggtgagcgggggcgtgacagagcccgtacgggttctggtctctctgttggccgcgctgatggtgggtgtggcggaggtgttgatctatgcgatctatcttcaaaaggttgaccaggcgcgggcgcgcgagaggcgcatcaaggagaggaaggaggtggtggagactgatgtggtccgggccgggcccggccaggcgggtaaagagggcgtccagagaattgatggagagcaggagacgatatggggaaggggtgcgaatggaggcgtgcggcgaagggtgagggagaaatgggaagagaaggagagtcagtggaaccacgatgggtaa

SEQ ID NO: 15137 - DNA, 201 bp, A.fumigatus
cagacaaactcctcatcaaccctggaaaccagctttgagttaaacgatacgctctatgcgcgcgcgcaaatctccccggccgacacggacgaagtatacctctggctcggggcgaacgttatgctcgcgtaccccatccccgaggccgagaggacgctgtcggagaagtttcttcctcgccacgggcaagagatccgcgtg

SEQ ID NO: 15138 - DNA, 1029 bp, A.fumigatus
  unsure (63): Identity of nucleotide sequences at the above locations are unknown.
caggtggaagagtttcccgctgtctcgtctgaggacatcaagttggctatgaaggagttggcngacgaacccacaaccttcatgttccacgcagagatgttgccccatatcgcggcctctgttggagacgctgtcagtacttttgacccccgtgcggccccagcaggtcccgtggaagcttactccactttcctagcctcccgtccctcagtcttcgagacttgcgccgtgcaggagatcctgtcactcgctcacttggcccccaatctcccactgcatattgtccacttatcagccatggaggtgattcctctcttgcacaaagcccgcaccgatggtgtcaaaatcacagccgaaacgtgtttccactatctgtcactcgccgctgaggagattcgcgatggtgacacccgtcataagtgctgccctcccatccgctccaaactgaaccaggacggcctctgggccgaactcgaacgtcatgccgaggacggagtcatcaagactgtagtgtcggaccactccccctgcacaccggacctgaaactcctgccatcccacattcccggccatcatgccgccaatggcgaggtcgaaaattccggcagctttttctccgcctggggcggaatctcatccgtcggtcttggactccctatcatgtggaccgagctcagccatcgcaagaacctgacttccgctcccgatgacgcaaacaccaagcgtgcacttcaggatattgtgcgatggtgttgtgccaacactgcggcgcaggttggcctgcagaatcaaaagggcgacctcgtgccgggctttgacgccgatatctgtgtctttgacgacaccgcagaatgggtcgttaagcccagcaccatgcttttccgcaacaagtgctccccctaccagggtcgcacccttcgaggcatggtccgcgaaacctgggtgcgaggcgagaaagtcttcagccgagacgatggttttgtcgccaagatcccaaccggtcgcctccttctggagaagcgggtttga

SEQ ID NO: 15139 - DNA, 297 bp, A.fumigatus
caaccactctcctccagcaccgtaacaacacaaacgaacccgcgcggaattcccgccgctcccttcatcgacaatgtcagcgactatgtcgcctcgcgcgcagacgtggaacccacactacagcgtttccaggagatgatctccaaatatcaatttatggagctcaatacccagcgccgagcggcgggcctccgagaaaagattcccgacatcaagaagacattagacgtcgtgcggttcttgaagatgcagaaagaagtaggtcatcgagtccagtcaccggtgattgtatgctga

SEQ ID NO: 15140 - DNA, 1167 bp, A.fumigatus
  unsure (118): Identity of nucleotide sequences at the above locations are unknown.
gccgctaaccccacggagttgccgataggagattcgcctgatttggttttggtccctgccacaccagaggaacggatcaagtccatcaggctcaacagtacagcatggaagggctgtntggatgtcgagacgtacatcgcaagagagaaccatttgtatcagcagcgattggtgaaggatggcttgacctgttggcttctggttgaccgtagggagccggaaggccagcggacgatcttgagttcttgtgagacatacaagaagaaggctttgctggctcaccacggcaaggtggaagatattgctacccatggagtcgggagcgtctattgtcgacctgagcacagaggcaaaggttacgcaaagagaatgatgcaggaattgtgcacgaagctggagacatggcaaatggaaaacgaacccagaagtagatcactcttcagcgtgctgttttcggatatcggaaagaacttttatgcgcaatttgggtggaaaccgtttccttcttcgcacatttctcttccacctatctccagggaagaatatgatctgtcctcacgggcaaatctaccaaaggcgagaaccttggttgccgatgacgttcgcaaatgcatgtgtagcgatcgagtcttacagaaagaacgggaatccctgcgtgctgcttccgagaagaccccgattgcccacgtagcaattcttccggactttgaccatttcgtttggcactgggcgagggaagagttctatgcagagaagcttcatgatgaccaagccccgccgctaatcaagggcgctggtgaggataaggcaaaagtgtactgtgcatggaacagaaattttggcgagacacctcaggacaacactttgttcattttgcgatgggtatatgatgaaccgaccacgccggaagagactgaagcgacagcaaaggcaatggctgctatcctgaggagggctcaactcgaggctcacgaatgggatatggcaaaggttgatgtctggaacccaactccactgttgcagaaggcagttgccatgctagattccccagcagagctggttcaccgagagaaaagcagcattgctagcttgaggtggacgggcgccgcacaaggcttaggcgaagaggttgaatggctctggaacgagaagtatgcctggtgctga

SEQ ID NO: 15141 - DNA, 222 bp, A.fumigatus
tcagccagttgtttttgttttgaagcctatcacagagttactgatttcctacaggagaactcctacgggcatccagaccaaacaacaatctacttcgtcaacaacatcgacagacataaaatcaagaagaatatctcgacagatgccaacaccgccgcggtagccaaaaagtcacgaaattggcatgaactgttcaggaaccaaaaaagacagaagaattga

SEQ ID NO: 15142 - DNA, 1602 bp, A.fumigatus
  unsure (1544): Identity of nucleotide sequences at the above locations are unknown.
ccgatctggtactggtcggcagagatcgatagaggggcaaaatgtatcgtgcagatgaaaggaaaccagaccattctcgtaccaccgccaggtgctgatgagaaatcgcgaaaagctggcgggaagggtgcggtggaggggccaaagaccttcgcctttgacaggtcgtattggtctttcgacaagaatgctcccaattatgcgggtcaagataacctgtttgcggatttgggtgttcctttgctggacaatgcgttccaaggctacaacaactgtatcttcgcatacggtcagacgggttccggaaagtcttactcgatgatgggatatggcaaggaatacggtgtgatcccgagaatctgccaggagatgttccagcgcatagccaagatgcaagaagacaagaacctcaactgtacagtcgaagtgtcctacctcgaaatctacaatgaaagagttcgcgatctgctcaacccttcaaacaagggtaacctcaaggtccgtgagcatccgtcaaccggtccatatgtcgaagacctcgccaaacttgccgtgcgctctttcgaggagattgaccacctgatggacgagggtaacaaggctagaaccgtggccgccacgaacatgaacgagacctccagtcgatcgcacgccgttttcactctgaccttgacgcagaaacgtcacgatgccgagacctcgatggatacagagaaggtttctagaattagtctggttgatcttgccggttcagagagagcaaactctacaggggccactggcgcccgcttgaaagaaggagcggaaatcaacagatcgttatcaactcttggtcgtgtaattgcagctctcgcagacgttgcctctggcaaaaagaagaatgcttcaatggtcccataccgtgattccatcttgacctggttgttgaaggattctctgggaggtaattcaatgacagcaatgattgcggctatatcgccagccgatatcaacttcgatgagacactcagcaccctccgttacgccgactcagcaaaacggatcaagaaccatgctgttgtcaatgaagatccgaatgccagaatgatccgagaactgaaggaggagttggcacagctcagagctaagctgggaggcggctcgactgctggagcagctggaggaatgcctgcggaggagtactatccacccgacacgcctctggagaagcagatggtttcgattcagaaggccgacggtactattaccaaggtcagcaaggcagagatcgtggaacagttgaaccaaagcgaaaagctctacaaggacttgaaccatacctggcgaggagaaattagagaaaaacggagcggatccaccgggaaacgtgatgctgcgcttgaaagaactcggtatcagtatcgaaaaaggcttcgttggcttgagcactccgaagaaaatgcccatttggtcaatttgagtgatgaaccggtacttgctgaatgtctggtcttacatattaagcctggaactacaaccgtcggaaatattgagcaaggaaattntgttggagatcacgttgaatgggctccagatatcttccaaaacaattgcccattttga

SEQ ID NO: 15143 - DNA, 297 bp, A.fumigatus
cggaatttttgtggggccaatggccggttgactatacaaaccgggttttccaacccaactttgttcattcaagttggttcaaaattcggaattgggccgaaccgtattgaggaagtttccagtaaaaatataacgccatcgatggcccgtctttcaggtcttcagagggaggtcctgtctctctatagaaagtgtctgagagaaatcaggaaaaagccttcagtgagtttcctctttagtctacatgatgaacttgtcagtaaagcattcttttggctgattgaatcgatactgtag

SEQ ID NO: 15144 - DNA, 591 bp, A.fumigatus
actacaaacatggcattcccacgcttttcgaccgacctagctcccttgttccagctgttagatgactacgatacccatcgtacctatcgcccaaagaacaaggtcacacctgtccggacattcgcacccaagttcgatgtgtgtgagttcccagatggatatcgtcttgacggagaacttcccggtgtcaaccagagcgacatcgagattgagttcagtgaccctcagactattgtgatcaagggtcacgtagaacgcaactacaacaacaccgctaccgagaccggggacgacagctcatccaccaagtcccgtcaacccacagttgaagacgaaaccgaagagggcaacgcctcgtctgctatcgcatcgccggctaagccagctgagcaaactgttacaaattcaccgacccagacaaactacaagctctgggtctctgagcgctcaattggcgagttccaacgaaccttcgccttcccaaccagagtcgaccaagatgctgtcaaagcaagtctgagaaatggaatcctctcgatatttgttccaaaggaggcggcgcccaagttgaagaaaatccgcgtcgagtaa

SEQ ID NO: 15145 - DNA, 234 bp, A.fumigatus
  unsure (156): Identity of nucleotide sequences at the above locations are unknown.
aatttagtaacactagtcggccatgcagattccaatttttttgttcacaaagttacatacttcaggcaaatagtgcagatttatgcagtcatggccttttttccttcccttctttctttcttttttgttttttttttttttttttctttttttatntgggaaacgccaggaaaaattgccgaaggggttctagaagctatgtacttcatggggatacgcaaccacactcactag

SEQ ID NO: 15146 - DNA, 729 bp, A.fumigatus
aaggcccataatcgcacattcggtcggatattttcggcggtcatacttttttcgaaaaaagggccctcgagtaacgaacctcgcgtaacaccgaacgcatatttgtccaccatgccgccgaagactggacgaggacgtaaagcaattggggctcctcgaacccaacctcgagatgacggaggtgcaggtccatctaacgctgcggctacagcatcaccttctactcggggacagccgcccaaatttcgcgggggaacaaggggggaaaagcgaccagcccacgccccgaggccgtcagacgtccaacgtatgtacataaatgactccttacgcaggcatatcaaaacctatgcaatagcattatcgctaataccgtaccagctggggaccccaacccctcaaggtcgccgacaccggtacaagccgggaaccgtcgcattgaaagagatccgcagataccagcgctcatatgacctccttattcagaagctaccctttgcgcgactcgtacgcgaggtcgcattggaacttcttcccgccgaagtaggcgcggagctacggtggcagtcgcacgctattcaggcgctacaggaggccgccgaagctttcctcgtacaccttttcgaggataccaatctctgtgctttgcatgctaagcgtgtaacgattatgcagaaagatatccagctcgcccgaagaatacgcggtatttggggcggtctgggttga

SEQ ID NO: 15147 - DNA, 567 bp, A.fumigatus
tggcagtactggcgacttctcacaacatttctctacttcggtccattaaatctcgatctactcttccatgtctttttccttcagcggtactcgcgactcctcgaagaatcttccggccgatcccccgctcatttttcatggctattgttctacgcgatgacctctctcctcctcatttcaccgtttctctctcttccattcctcggcaccgccctctcctccagcttggtgtacatttggagccgccgcaacccagacactggactcagtttcctcggcatattagtcttcactgcgccatatcttccctgggtcttgatggccttcagcttggttgtgcacggcattgtacctaaggatgagatttgtggcattgttgtcggccacatctggtacttctttaatgacgtctacccgtcttttcacggcggccatcgccccttggatccgccgcgatggtggaggcgaatctttgatccgagagcagcagctggagaggcacaaagaacagacacggataatgtgaaccgtgattttgccgccgcggccgcccctgaggtccgatga

SEQ ID NO: 15148 - DNA, 510 bp, A.fumigatus
  unsure (32),(33),(34),(42): Identity of nucleotide sequences at the above locations are unknown.
aagggaaccccgggggaactcccccggggaannnagctcggngggaccttttactgtgcaccgccaagccggggccatggtcatagtcactcgacgagcagcattgaggtgccgcctcagacaacaccgtctgacctagacctgctgcacaagtggatgaatgacccgcgcgtgagtgcagcttggggagagggaggtccaaaagaaaaacaagagaaattccttcgcaataatcttaccagccgtcatagctttcccgttattggatgctgggacggcaagccgtttgggtactttgaaatctactgggtcaaggaggatcgcttgggagcgcttatcggaggagcggacaattatgaccgggggattcacttactggtgggagaacaggaataccgtggatctcaccgggttgccatctggctcagtgcattggtccattactgctggcttgccgatccgcggacgcagacagtcatgctggagccacgggtggacaatgagaagtaa

SEQ ID NO: 15149 - DNA, 198 bp, A.fumigatus
ttctatctgtacagctctttttctactacaattcccatatactgctactactactactactactactacatctcgctttctcagctgttcagcgttaactacatctacaagcccctctttcactcaccccaccatgtctcctccagcaattatagctccctccatcctcagcgcggatttcgcagtcctgggcaatga

SEQ ID NO: 15150 - DNA, 486 bp, A.fumigatus
ctagctaggattggcatctttccagaaagctctccctgctgtaattctatctgtacagctctttttctactacaattcccatatactgctactactactactactactactacatctcgctttctcagctgttcagcgttaactacatctacaagcccctctttcactcaccccaccatgtctcctccagcaattatagctccctccatcctcagcgcggatttcgcagtcctgggcaatgagtgctcaacaaagatcgcgcagggggccgattggttgcacgtcgatatcatggacggccactttgtccccaacatgacctttggcgcccctgtggtcaccaagatccggtcccatgtggaccgcccaacccaggcccttgggaagggtacttttgactgccacatgatgataatggaggtgggcgcacatccctcacaaccaatctacaccatccagagcagtctcctgagagaaacacgctaa

SEQ ID NO: 15151 - DNA, 264 bp, A.fumigatus
atggttcttgtcatgacagtacaccccggttttggaggtcagaagttcatggcctccgagcttcccaaggtgaaggctctccgtgagcggtacccggatctaaacatcgaggtcgatggtggcttggggttgggaacaattgaccaggctgcggatgccggtgccaatgttatcgtcgctggttcggcggtgtttggcgctcaggaccccgccgacgtcattgcgaagctgcgcgaagctgttaacaaacgccgccagacataa

SEQ ID NO: 15152 - DNA, 216 bp, A.fumigatus
acatttgttgatgtggttgttgcttgtctcaaccccggttcaggcattccggctggctacccccacggatggatctaccccacgtcccacgtgaaggccacgaccctagcccttatcagtgaccagattgccatcgtcggactgacgtcgaccgccagcgggagcagcggtgatgtcgacgctgcttatgttattttccccttcttgtttagctag

SEQ ID NO: 15153 - DNA, 363 bp, A.fumigatus
gagaaacacgctaacactcctccacagccccataaatgggtcaaggagttcaagtccgccggatgcgatctttactgcttccactacgaggccgccatctcctccgtcgctgcaatgaccccagaagacaaggagaccagccgtttgacaagcccgaaggaactcatccgctatatccacgacgagggcatgcaggcgggcattgccattaagccggatacccccgtcgacgtcctctgggatatcctggaaaacaaagatgagaaggaacggcctgatgtaagtcttcattattcggatacgcataggctactgggtttcatactaacggatcactgttgctgtagatggttcttgtcatga

SEQ ID NO: 15154 - DNA, 450 bp, A.fumigatus
cgaattcttggagaaaaaggaggagcaacaattcgcttcggtatcaccagataccaaatttccaacttctcctttgtatcgtcatcagtttcccctctttttcctacacattgcaacctcagcatgtccgactctactctctatctctacacctccctcactgcggggtcatcccacattgtcaccgccactgcacggttggagacgattctgaaggccaacaaaattccctttcgcgcaattgacgtggctactgatgatgccgctcgtaagctgtggggccgtcgttccaagggtaaaaaattgcctggattggtgaagtttggcactgttgtcggtgtaggtctttctgatgcccccctgatgaaaggaggcacagctatgcgaaggagctacgtgactaatagtttcgcccatgtaggatctagaggacatcgaggagtggaatga

SEQ ID NO: 15155 - DNA, 318 bp, A.fumigatus
tgttacagatgtggattccgacttgagcgacgagtgcacttcattctcaagctcccgaccgacgagcctcacatctcccactacaaggaattcaatgacttcgcctctaaatcggaatcggtaccccagcctcacaataccatcatcgaccgcgtggccctcgctacacaatgtgccaaagagctctccagttcctccaacaccgccgccgaagataccagtctcacctgctgctttgtccatgcttgcgagaacagtaccggctctgaatgcacctccatctttggatggcagtgtaacttcggaccaggtctctaa

SEQ ID NO: 15156 - DNA, 600 bp, A.fumigatus
gatctagaggacatcgaggagtggaatgagtacggtgagctgaggatgcacatcgatagcgtggaagatttcgacagcattcctgccaccagctaccctctgtctacctcccagacgaacactggatctgccacccctgctaccccacagcctccagcacaaagcgcaaccccgaagcaaagcacaattaaaatccagagcccaccggcgaaggagcaaaaggatgattccgtgacgcttgccttgcgacaggcgggcgcggaggctgcggcaaaggccaaaggcaacacgagcgcagatgttaagaaagacaacacctccgcagattctgaacagcagaagggagagccccctagcagtggggagaataaagaaggagaagaaactgtacgtcggcactcggtggttcctgcggaaattgtcgggggatgtggagggcgtccacctttgagagtgcccgagtgcgccgcagaatcgtctgccgatttccgtgctgataatgctgaagctctagggttagttcaacatcaccgcggctctattgtctccgcaacttccccagaggaaatggagaagtggttcaagaatagcgcaagttaa

SEQ ID NO: 15157 - DNA, 1146 bp, A.fumigatus
cggaaccaacaggggataccgcagcacaggatggctgacgcttctcggacttcaatgagatgtccgctttctcggcaggtccgagggacgaaacttaataccataatcgaggaagcaagcgagagtctggactcggacaaagttgagagcaatggtgttgggttacattcaatcacctcaggcccgcagctgaagctcatgaccgccggtctttctagcctttcactctcaaagctgaatcgtcttcgctcgccgttatcagcaggcacgacgtcatcttgctcggacacggaatggcagcgacagatgcagagcttggatgatctgtatgatgttacagatgtggattccgacttgagcgacgagtgcacttcattctcaagctcccgaccgacgagcctcacatctcccactacaaggaattcaatgacttcgcctctaaatcggaatcggtaccccagcctcacaataccatcatcgaccgcgtggccctcgctacacaatgtgccaaagagctctccagttcctccaacaccgccgccgaagataccagtctcacctgctgctttgtccatgcttgcgagaacagtaccggctctgaatgcacctccatctttggatggcagtgtaacttcggaccaggtctctaatagcagcgagccaataactccagacttgcagtcccttccagatgccgactgggacgcggacatgcatgtgcggccggaaatgatgaacagtcgacatgcggacattgacaccgatgggatcgacccccaagttcaaagcattgagatagccattgagaaacccgatgaagattggccactcgttctctgcagctttcccgctattcccaaccaatctaacttggcgtcggaatgtggtattttcctccctgaagatgcccttctcacttggaagcacaccccctggggcggcacacggaaccttggtcataaaaatttgttcaaaagaagaaagtggcgcttcaactacttgttgaacgttcctcccgcaccgataatagaattccgtctctgcgctctccggaatagcttatatggggccatatacctttccccggagggatctttggttcacttgtggccgggcccttcccatgggtcgaatcaaaaaaaatag

SEQ ID NO: 15158 - DNA, 195 bp, A.fumigatus
ttcaacatcaccgcggctctattgtctccgcaacttccccagaggaaatggagaagtggttcaagaatagcgcaagttaatattcgggcgtccaggaggaatattagcggtttggagaacgaacatgcggagcggcaagacaagatgagacaatcgtggaagattcagaacggcgaggagaacaagaatggatga

SEQ ID NO: 15159 - DNA, 573 bp, A.fumigatus
  unsure (530): Identity of nucleotide sequences at the above locations are unknown.
tcgcccacccaaaactcctcattatgtttgaactccagtcaagtccgccaatacctcgacacattcgttcgcaccgcctacgaaagctacgtgctcggtttcccaacctccgaccacctcttaaccctcagcaaagtcaacgtctttcgcgccttcgccagcatcatgtcgctactaggaatgtcacacaccgacgactggatgcacgacgacgctctctcccccttcgtaaccatgggcccaggctacatcgacgagcagaaactcccgcccagtctccgaccaacgcgcctccagaagacaatcccgcatcacccctggctggatttcttccccatcccgaaaatcagagataacctgctcacgacgggggaagacaatttcgacgactgccaactgtgcgttgatatcatggggttctgggactcggggatggacgcctgctgtatgctggtgtggggggaccccacggatccgaaaaactgggaggtcacagagaggtttctgaagaagtggccgtgggtcgttangggggttcttcacgcccagggcgccgaaggaccgcacatgcgc

SEQ ID NO: 15160 - DNA, 285 bp, A.fumigatus
tcgagctgcgggaaaacgtacgccaatttcttcgtgtttggcattttcgagctcctcgacgagggcaaccaaaaaatcttcagctatctcaagacctggaaggagcagtgtatgctggtcgtattgaacttttcagaagagccacagccattccaaaagcccatggagctccagaatcgggatttgaagctgtttgttagcaacattggcaagcctgtaagcggggagtgtgagttgcagccgtatgagggcaggatatttgaagtcaaggctatacctaattga

SEQ ID NO: 15161 - DNA, 228 bp, A.fumigatus
tgttgtctgtgccatgatttgtctatgacaaaggacattgttgaacaactgatgttggatgtatggaccttgcagtaccactattgcgacataagcatactgtggaacagtactgtccctgcctacgtcaactacaacacactaagttttcacctctcgtcacaaacaaattccacatatcaacagggccacttctcactcatcagagagttttgctgctcagagtaa

SEQ ID NO: 15162 - DNA, 1479 bp, A.fumigatus
ggttgcctatttgcgaagatggatgccactcggttgaagaaaccccaggtttcccgagcctgtgacccatgcagacggcggaaagtccgctgcaatggccaacaccggtgtcagcaatgtgagcatctggacttgctctgcacatatagtgacaatcaacgtgcacgatcgcgaaagaatgctctccgtcgaggaactgtgatttctgaatacaaaatccccttcgcgcgggaactcaagagtgaacatatttcgacgtctgtactagtccccccctcgtctctcccagatttgaagtcggtggcgctatcgacgtcgtatttgtatagcctcatcccgaaatacatggcttatgtgtatcctttcaacccgatcatgacggacgaggagatccgcgagtccattggcaagatggcaacagatagagaccatgcggcctttgtctacgcctttactggtgtcacaattgacctgacacagtcgaatgcagcgacgtcccatgtgtcggagcagatcaacgagctcgccggccgagctatccagctccggactccgttgctaccggggttccgaccatctatccttcgggctgtcacaagcgtgtacatccagatgtgctacatgagcttggggcagtatgacctggggttcttctacctgcgagaagccatcagcatggtgcatctcctccggattgaagacaaagccgtcatggccagccttgacctgaccgaacgctcgcggcggcagcgactttattggttatgcttcatccatgaacggttcatgtcaatctttcacttttcgcccgcaactctgtctccatacgcgcagttccccgaagatgatcccagtctcgatcctagtgtctcccatggctgggtccaggtgatcaagacattcctcctgctcgagccgacctttatcagcctctggattggcgatcggagccaggtgacggttgcatgggtcgagcaaaaacatcgggagctcgacgacgagctatgggaattagaggtttcgatgctgtcggatctgcagcaggcggatctggtcgtgacgcgccagtggatgcggaccctcctctggcagatggccatgtcgaactgcctgctgtcatctcatgcttcctgtccatcgctgtcgctcgagatgccgctccgattatccagccaactacgccagttcctcactaagatctcacaaaatacgatccagatccacggctcgtctatcttgagcaagttattggagattatcaacaccattgccgatgtggtactgcatgggccacaggtgacgctcgaggaaacgaccagtcgtattgatgatattttatttctaaaggacgtcatcttctcattcaggaatttgcagcaggtctccaagaagattctgattgagaagttacatctaatcggggagcggtttgcgcatatcgaagtggcgtcgcagctactttgtggccaaggggcataa

SEQ ID NO: 15163 - DNA, 222 bp, A.fumigatus
agaagaacaagcttatcgatgtacggtcgaggcactgagcaaattcgttgccgattgctaccggaagtcgtcttcggaatcattatcatccgtaagatcaagacgatggacaagttcctttgtttctctagcgatttcgaaagcaatgggtggaagcttcttgataacctctctgtgttccgcaatatttaccgcatcctcgccctcagctgttgtttctaa

SEQ ID NO: 15164 - DNA, 1149 bp, A.fumigatus
cacgaagagcagatgactggcgcagcaaagcaagaatgggacaccctcaagatggagctcgaaagtagaatctcccaggcggaagaattgaacacctctcttcagctcgaactcgaaaaggtgcgaactgagcgtgatgccacggagagagatttgagaagtcaactcaacgaggcatcgcagcagagtgccggggacgccgggctacaatctcaattctctgagctgcagatcaagtatcgggacctgcaggcggagttacaccaacagcaacaggtgacagaggaagtcagacgagaagcctccacctttttaatggagatgaaggctctgtcggagcaaactcagtcacgctgggagcacgaagagagattgtcaggcgaggttcaacggctggaagacgaattacagcaatggaagacccggtacgccaaagtcaagactcagctacggcatcttcgagcatcatccggcatttcagagactcgtcccggcctcagcaccgtaattcaagacaacggcttcatgcaggacgatggattggtcaaggatatacatgttaccaagttccaaatttccattgacgagttgcttcgcgtcgcacgatccgatgaataccaactcgtgatgcaccagattaagggtgttattctcgcagtccgtcatgttcttaatgacattgagtcgacgcagaaccctgccgacggattagcagctatgcgtacaaaagctacccggaaagtgtctgcgacagcaaataacatgatcaccgcggccaagaacttcgtccgttcgaatggtctttcacctgtttcgctccttgatgctgcggcatcgcacttgtccactgcagttattgagcttattcgtctcgtgaaaatccgccccactccagaacatgagctcaacgaaaacgaagaagaacgagatcaattctcgcagatgaagtctcccgactattttagcgttgctccgagccaaagcagaatgagtaataacgactcgatctatagtgctatgagcgatccttctaatcgtactccaaatggaacacattctcacttggatgcagggtctcagaatggtgctttgaccggctcacagctgaaatctgaagatcacgagctccaggaattgaaggtgagttga

SEQ ID NO: 15165 - DNA, 183 bp, A.fumigatus
ctgctttgtagcaacggctctcagttcttcatcaccacggctgtgacttcctggctcgatggcaagcacgttgtctttggtgaagttgccgatgagaagtcctacagcgtcgtcaaggagatcgaagctctcggaagcagcagcggttctgtgcgtttcaacactcgccccaagattgtcaag

SEQ ID NO: 15166 - DNA, 579 bp, A.fumigatus
ccccaccttgctcgtccttctcttctcgtcccctcctctcctccgttgtcaattgcaatcagtcatccttcctgtctcttcgcagattccatcaaaccccttccgccatgtctcaggtcttcttcgacgtcgagtacgcccctgtgggcaccgctgaaagtaagttattccgcgccctccctgactttattctacttggtttacggtctggggtacaattgcattacccctccatcccgcttttcagcatcggcgaggaactgtgctcaaagcggcctcgatgcattcggtctccaatccatactttcgattctttttactgacggtatcttgcttcgtgccgtgacagccaaggtcggccgtattgtgtttaacctcttcgataaggatgtccccaagaccgccaagaactttcgtgagctctgcaagagacctgccggtgaaggctacagggagtctactttccaccgcatcatccccaacttcatgatccagggtggtgacttcactcgaggcaatgtgagttttcgtcatccacagcaccgctcttgccggtcccgtttgctttctgggttctga

SEQ ID NO: 15167 - DNA, 1335 bp, A.fumigatus
tctcatcgacaagcttctaaaacgtatgcgcactactccagattctatgctccttggtgtggccattgccagaacctcaaacctgcatacgaaaaggcagccaagaacctggagggactggccaaggtagcggctgtgaactgcgatgacgatgccaacaagcctttgtgtggtcggatgggcgtacagggtttcccaactctgaagatcgtcactccttccaagagacccggcaagccaaaagtggaggattaccagggagcaagaagcgcaaaggcgatcgtcgatgctgttgtggaccgaatcccgaatcatgtgaagagggtcacggacaaggatttggatcagtggctctccgaggaccaggagtctcccaaggctgttctgtttactgagaaaggtactacgagtgccctcctcaaggccgtcgccattgagttcctcggctccatcaaggtcggccagattcgcaacaaggaatccaaggccgtggagaaatttggtgtcaaggaatttcctaccctcgtcctagtccctggcggcgataaggagcccatcatctacgatggcgaactcaagaaacaagccatcgtcgagttcctcagccaagtcgcagctcctaaccccgacccggcccccgcctcaaccgacgccaaatcctccaaggccaccaagtccgctaagtcgcccaaatcctccactatcctcagtgaagaagccgaaaacttgaaacctaccgcatcccccgacccaaaggtcgtccctgatgacgccacagagtcaaagcccgcccaggtcccgatccaggcaccacccatccccgtactccctacggcagaggaactcgaagccgcctgcctaaagcctacatctggtacctgcgttctagcacttctccctgaaccccgcgaaggggatgcagacgtgtccagtcccgcgaaggaggcgctaaccagtctatcggagatcgcgcacaagcacgcccagcgcaagagcaagcttttcccgttctacagtattcccgctatcaacagcggggccaagactctacgggctgggctgggattgtccgaggaccagacctcagtcgagatcattgctctgaatggacgcagaggctggtggaggcgctacgacgcgtcggaggctcaggattatggcgccgtgtctgtggaggcgtggatcgacgccataagactgggtgaggggtcgaagagcaagttgccagatggtgttattgtcgagcagaaggaggagggtgatgtagaggccaaaaaagacgctgataaagagaatcttcaccacgggacggccggaccgcgcttattataccca

SEQ ID NO: 15168 - DNA, 186 bp, A.fumigatus
ttgtccaaacgtggacagcaggcgtatttagagctgtctacttgggtgttgaagcaaggtgtcctgaagctcttggcatgtgacggcggagatcaaaacagctccgccatgatgcaaacaattcatgaacgcatcttcagcttcccccacgctatggcgtattcggctacagctttgtttacttag

SEQ ID NO: 15169 - DNA, 1590 bp, A.fumigatus
ttgctgctagatactctcccatgcaccacagttaaaatgatggcggaggtaaaagtcacgccggagcctccacggggaccagggacagcggactttttgttcatgccgttggaagtcttctggatgatcttgcagtatcttgacgccagggatattgtacgatgtcgtcgggtttcaaaacattggaaagaagcatttaccaacccagagtatcttgttcgcctgttgattcgactgtttcccagcgctccagaggttcgggggctgaaagacaaacagtcattggacgagctactctccgcggttcagagtggtgagcattggcgcgaactgttcgacaaggttgcctcgagatacgatcatctcagccggggcaagccaaggtcggtccaaaagctcaagctttgtgatgactttggagtcacgggagaaagagagtggtttcaggtacagccttgggatagccatgccagtcatcttatgcagcgcgttgattacctctatcccgaaacgttctggacctacgaggatggtctgcttgtgtaccccagcgcagattactcctctttggtcctcatggatgtggagaccggtaaacaggttatggtaccgttcttgattatcggtaaggtgattagaaggattcgcttgcagaaacgagttcttgtagtggaatgggctgagccaaaggcttttcactggctgaatgacagcgacggggtccatcgccattttgcatcttcttttgacgtggcccaagaagccaatggcagctggaacgtctcctttcgcaacgaatggaagatcatgttccttggccatcctctaagtgaaagagatcggttctactcgactcataataagacacattatgtgatctacatatggcagcccaatcgcagcttgtacactgccgatgaggatgccccaatcgagtccctgttcgtctgggacatttcaaagccctgtccctacaggccttctctggatcctacagggcggcaacggaaggaagagcaggatcaagctcccgccattgtctctcgtttcggttttagagagttaggattcttctccgtcagacaacgaggagtaccgggcatccaaggtctagaaataaccgatgatggccaagccatagaaatcattgagaacttgtgcacagggccgcttgaccgactcgtcggaccaacggagtggacgtctcaggtgcagatcacgagcattcctctgattggcgatggaccagtatggaggcgagacgttggctacatcttatcaccttaccgcgggagcaatgggttacagacgaagccccttggtctgctttgcaagcagttctggtacactgtcatttccgaggtctatgacagaaattcgaaggcaggatttgctttgcacctgtctccgctgggctggccttttgattccaggatttatatgagcatacagacaccatactctcggattgtcttgaaacccgacgatgtttttgaactagcgggtaggggaaagatctgcgggaacgagaaattcgtgataggtgaaaatgcaaaccgcgagcttgtcatctggagattcgatcgctag

SEQ ID NO: 15170 - DNA, 669 bp, A.fumigatus
gaagaccaggtcctccccggcctgatcaacgccgtgctcctcaccgtcgtcctctccgccgccaactccaacgtctacagcggcagccgtgtgctcctcggtctcgcgcgcgagggcttcgccccgcaatggttcgccaaagtcacgcagcgcggcgtgccctacatcagcgtggccttcaccgccgcgttcgggctcctcggcttcctcaacctctccgagtccggcggcaaggtcttcaactggctggtcaacatctccggcgtggcggggttcatctgctgggcgtccatcaacgcctgccacattgcgttcatgcgcgtgctggccgcgcgcaatatctcccgcgataccctgccgtacaaggccatctggcagccgtggctcgcctactacgggcttttctttaatatcctgatcatcttcacgcaggggttcacggcgtggatccccacgtttgatgtctcggatttcttcgtcgcgtatgtctgtccgatcctgtttgccgtgctgtatctgggccataagattgtcttccggacgaagtttgtggatcccctcgaggcggatctggattccgcacgcgtcgagacgaagagtacctcgtgggagacgtctgctccgaacaaggggtggtttgagagggtcaagggtcggtttattggctaa

SEQ ID NO: 15171 - DNA, 393 bp, A.fumigatus
tcaacgccgtgctcctcaccgtcgtcctctccgccgccaactccaacgtctacagcggcagccgtgtgctcctcggtctcgcgcgcgagggcttcgccccgcaatggttcgccaaagtcacgcagcgcggcgtgccctacatcagcgtggccttcaccgccgcgttcgggctcctcggcttcctcaacctctccgagtccggcggcaaggtcttcaactggctggtcaacatctccggcgtggcggggttcatctgctgggcgtccatcaacgcctgccacattgcgttcatgcgcgtgctggccgcgcgcaatatctcccgcgataccctgccgtacaaggccatctggcagccgtggctcgcctactacgggcttttctttaatatcctga

SEQ ID NO: 15172 - DNA, 408 bp, A.fumigatus
agaccaggtcctccccggcctgatcaacgccgtgctcctcaccgtcgtcctctccgccgccaactccaacgtctacagcggcagccgtgtgctcctcggtctcgcgcgcgagggcttcgccccgcaatggttcgccaaagtcacgcagcgcggcgtgccctacatcagcgtggccttcaccgccgcgttcgggctcctcggcttcctcaacctctccgagtccggcggcaaggtcttcaactggctggtcaacatctccggcgtggcggggttcatctgctgggcgtccatcaacgcctgccacattgcgttcatgcgcgtgctggccgcgcgcaatatctcccgcgataccctgccgtacaaggccatctggcagccgtggctcgcctactacgggcttttctttaa

SEQ ID NO: 15173 - DNA, 534 bp, A.fumigatus
caccaaatccttcgtactatatgcttctatctatccatccccactaatcgtacaaacgcaggcatcttttggtatagtacaatacatttgtgcgagatttttgcgagatcaaatcaaatccatcgaaacattctcgccatggacgcaaacccccccagaaacgccgtcacccccgtcaacaccaccaacaccccatactcggacccatacgccccaaacgccccggccttccaccctccaaccttcagcagcgcctcgctcagcggcccactgatcacattcccgactccgcgccccgtctccagaaacgcaaacaccatgctcacatgcgccgagcgctcactcttctgcacctcgtgggacagcgccgaccaggaggacgagtaccccccggcaaagaatccatacacaatgcagaaggcatacagcgtcgcgatgtggttcgccaacccccacagcaggaaaacagacgccacggccccggcggacgagagcaagatgcacttcgtgacgtggtgtcggtcagcgaggtag

SEQ ID NO: 15174 - DNA, 309 bp, A.fumigatus
ggcctggcctacctgcccacacccatcgtcatcgccatcatgtttgcattcccccgagcccggcgctggttctcgaccgcgggattcgtcatcatgtgtctggccctgggtctgagttcgttctcgacaagcgtcacccacttgatcatgtcgcagggagtggcatacggcattggaggatgcctagcctacacgccgtccatcctcttcctatccgactggttcgtggagaagaaaggcctcgccttcggcatcgtctgggtatgctcctctccgtccaactccaaccaaccccccaaactaatctag

SEQ ID NO: 15175 - DNA, 765 bp, A.fumigatus
tacgaaggatttggtgtcatttcaatctctatctatcgatctatctatctatgtccatgtctcgtgtctatcttgatatcttgtacagtggcaatgttagccaataaaccgacccttgaccctctcaaaccaccccttgttcggagcagacgtctcccacgaggtactcttcgtctcgacgcgtgcggaatccagatccgcctcgaggggatccacaaacttcgtccggaagacaatcttatggcccagatacagcacggcaaacaggatcggacagacatacgcgacgaagaaatccgagacatcaaacgtggggatccacgccgtgaacccctgcgtgaagatgatcaggatattaaagaaaagcccgtagtaggcgagccacggctgccagatggccttgtacggcagggtatcgcgggagatattgcgcgcggccagcacgcgcatgaacgcaatgtggcaggcgttgatggacgcccagcagatgaaccccgccacgccggagatgttgaccagccagttgaagaccttgccgccggactcggagaggttgaggaagccgaggagcccgaacgcggcggtgaaggccacgctgatgtagggcacgccgcgctgcgtgactttggcgaaccattgcggggcgaagccctcgcgcgcgagaccgaggagcacacggctgccgctgtagacgttggagttggcggcggagaggacgacggtgaggagcacggcgttgatcaggccggggaggacctggtcttc

SEQ ID NO: 15176 - DNA, 1128 bp, A.fumigatus
  unsure (487),(531),(539): Identity of nucleotide sequences at the above locations are unknown.
ggcgagactgacaaggctctcgtagggcctggcctacctgcccacacccatcgtcatcgccatcatgtttgcattcccccgagcccggcgctggttctcgaccgcgggattcgtcatcatgtgtctggccctgggtctgagttcgttctcgacaagcgtcacccacttgatcatgtcgcagggagtggcatacggcattggaggatgcctagcctacacgccgtccatcctcttcctatccgactggttcgtggagaagaaaggcctcgccttcggcatcgtctgggtatgctcctctccgtccaactccaaccaaccccccaaactaatctagcacagagtggctccggcctaacaggcatcctcttcccgctcatcctccaaacgctcctcaaccagtacggctggcaaacgaccctccgcgcctgctccatcgcgctcttcctcctcgccgcccccttcatgaccttccacaagccgcgcgtcnccatccgccactcgcacctccgccagctcagcctcgctttcctntgggacanagtctacctgatctaccagctcggcaacacaatgcaagccatcggcttctggatcccgtccatctttctgacctcgtacgcccgcaccctcggcgcaagcgacttcctcgcctccctcaccgtcaccctcttcaacctcatgaccgtcttcggctgcatcttcaccggctacctcgctgaccgacaccacgtcacgaagtgcatcttgctctcgtccgccggggccgtggcgtctgttttcctgctgtgggggttggcgaaccacatcgcgacgctgtatgccttctgcattgtgtatggattctttgccggggggtactcgtcctcctggtcggcgctgtcccacgaggtgcagaagagtgagcgctcggcgcatgtgagcatggtgtttgcgtttctggagacggggcgcggagtcgggaatgtgatcagtgggccgctgagcgaggcgctgctgaaggttggagggtggaaggccggggcgtttggggcgtatgggtccgagtatggggtgttggtggtgttgacgggggtgacggcgtttctgggggggtttgcgtccatggcgagaatgtttcgatggatttga

SEQ ID NO: 15177 - DNA, 267 bp, A.fumigatus
tgtctcaccatatacgccccgcccaacgtctccgtcacgatcatgatgacaaagaacgggctgatgatcaacgccgtcttccaatacatgatgaaggccacgacgaacgccgcgcagaacgtggcgatggcggtcagcatcaccgccagcttgctcgtgaccgcttcctggactgtccccatatccgacatgatgcggctcgtgatctcgccggggcccaggagatcgaagaacgccatattctggcgcaagatggcggcgagatag

SEQ ID NO: 15178 - DNA, 1461 bp, A.fumigatus
  unsure (1421): Identity of nucleotide sequences at the above locations are unknown.
agagacacaggagtattccgggagtactcagttatcctaagttctccccccacggagtcctcctggcaatcactcgactttctgttctgggaagagccaggctatcacgggcctgacctgctgaatgcgccggacgacattcgcctgatccaactcgcccaggataatgagtccacggagatcacaccagcctctcttggctcgccaaaagcgtttgagttcttgttgcaaatgcttcgtgcgtcggcttcaggagccaagtgcgcagtgaaactgattgtgcccttgcaccgtgggtttatcgttcgctccgacatcattccactgcgacttcgcgactcggaatatgtcgagtcggcagtgtcctttgcggagccgctgcagacttacagtgggaagaaagttgctatttccagtcgcgcggaccttacgacatactttgcggccgccgcagccggtctgattcttcgtcaaggctctacgcatgcttcagatgccggatcgcaagcgctctttcagatggtcgagtccgacctggcaaaccgactctcgtttcgggggatacagccaggaaccccccgacgccggacgcttgcattagtcgacgcaaatagctcgcatccccaagacggactgggcttttaccgtgcggcgagggagcttggaatcaacgtggtcgtgctggagaatgcaggacactggctggaagacccggcccaggcacactggcgcgaggctttcatccccacccgattgacgaacccccccgaggaggatgttggcgaccacatcctggcatctctcagggcctatggcaagccggtggatgggattgtcacctttgccgactcgttctggtactacattgctcgaatcgcccatgagatcggagtagagaccgcgccgccggactcgatgcgtatcgccacgaacaagttcctgacaagcaaatatgtcggtcatgacgcctatctcgcatcgaatgtggacgaggcgctcagaatcgcaaaggaggttgcgctcccatatcctctcatcgtcaagccctgcgatggctggagctcagaaggagtgtcccgcgtcgagtcccctgatgcattccctgccgccatcaagtcgatcgatacgtcgcgccacgggaccgagtttgtgatggagccatactgcgacgggcccgaagtggacgtcaaccttgtcctattggacggcgaagtccttttcgccgagatctgcgacgacctacccaagtccgccgacgtcaatgggctgactgtgggatccctgaccaatttccacgagctctacagcgtgtacccatccgcgctgccgtctaaggagttggaactgctcatccatagctttgtggacactctcctgcgcctggggattcggaatggggtgatgcatctggaggagcgcgntcagaactctcgatggaataccgcgagcagaaccggatga

SEQ ID NO: 15179 - DNA, 978 bp, A.fumigatus
tgttggagactatcgccattcgcagccccatcacgtatactgaactcaagcgagcaggttatctacggtcttctcgtcagcgtttacgatgggttcgctgccggaacggtttccgcgtccgaactgcgctccaaaaccgccacgtttagtctatactatgtctatctcagcatcggcctgtttgccttcacctacgtcgcgacggtggggttctattacaccggcgagcgcatggcccgggccctacggaccacctatctcgccgccatcttgcgccagaatatggcgttcttcgatctcctgggccccggcgagatcacgagccgcatcatgtcggatatggggacagtccaggaagcggtcacgagcaagctggcggtgatgctgaccgccatcgccacgttctgcgcggcgttcgtcgtggccttcatcatgtattggaagacggcgttgatcatcagcccgttctttgtcatcatgatcgtgacggagacgttgggcggggcgtatatggtgagacatcacaagcgggcgatggagctgtatagtcaggctgccgggattgccgaggaagccatcgccgcgatcaagcatgtcaccgcgttcgggatccagaccctcctctcccagcggtatctgtccgtgttggagcaagccggccaaggccgaccgaaaggccgagaacatggtagcgggcatgattgcgtggatgaacgccatgccgaatctgatctacgctcttgcgttctgggccggctcgatctatctgacccgaggccagatgtccgtggcggaagtgagcgcgacgacgttggccgtcacgatcgggtcctttgccattatccgaattgccccttccgcacaggccttgctgtccgggatcgcaatcacgggggaaatcctgaagtcgatcgcgagacgatcgccgcaagatccactggtcaaggaaggcgacgagccttcgaccgtcgtgggtga

SEQ ID NO: 15180 - DNA, 609 bp, A.fumigatus
gacatcacaagcgggcgatggagctgtatagtcaggctgccgggattgccgaggaagccatcgccgcgatcaagcatgtcaccgcgttcgggatccagaccctcctctcccagcggtatctgtccgtgttggagcaagccggccaaggccgaccgaaaggccgagaacatggtagcgggcatgattgcgtggatgaacgccatgccgaatctgatctacgctcttgcgttctgggccggctcgatctatctgacccgaggccagatgtccgtggcggaagtgagcgcgacgacgttggccgtcacgatcgggtcctttgccattatccgaattgccccttccgcacaggccttgctgtccgggatcgcaatcacgggggaaatcctgaagtcgatcgcgagacgatcgccgcaagatccactggtcaaggaaggcgacgagccttcgaccgtcgtgggtgacattgtcttggaccgcgtcggcctcatctatccctcgcgcgatgacgttgatatcctgcaagatgtgtctctgaggtgtgcggccatgaagaagacagccattgtcttcaccacggggctggaaggatcgacagtggtcagttcaaaa

SEQ ID NO: 15181 - DNA, 324 bp, A.fumigatus
accctcctttgcccagtgatgttcagctccatcggcgaaaagactctgtacatcttcgccattagcaacgtcatcacaatccccatggtctgggctctgtacccggaaagtaaccagcggacgctggaggacatggatctgcttttcgcggcggagacgccgtgggtgtgggatgcggagcggacctttgcgcgcctcaaagctgagaaccctgggtatattgagactgccggccggaagaacagtctcctggattctgaggctggtgtcggtaagcccgctgctcaaacaacccagcatgaggaaaatgtgtcgtctgagtag

SEQ ID NO: 15182 - DNA, 297 bp, A.fumigatus
gacaacctcaggatggcccagacacaggaaacagcccgtacgccaggctttagggcgcgaaaggacgcaatcttgtcacggcggtacattgagggtcaaatcgctgatggcaaacatatcatcattttcgatgatcgagtgctcaaggtcgatgcgtggatcaaatttcacccgggaggagacaagtctattaaacacatggttggccgggatgcgacggatgaaatcaatgcgtacggtttccgaggaatccaagacgatagtaacctgcaacgactgacatccgcttttgtatag

SEQ ID NO: 15183 - DNA, 849 bp, A.fumigatus
catccgcttttgtataggctgcattcatcagaggcacgccagcgaatgttgtctttccagatcggtcgcatccagggaccgtggttgaactttctccctcccatccagggcgggaagttccggccatatccaggcgagacatgttcaagcgacgaggacagcacagatcaggatatctcacagcccccttctccagtttttgatgcagcagacgcaggagacaaagcaccaagagtccgccgccgaaggaaatcagcaacaatttcggatacatcagtctcaaccacccccacagaagggttcgagccgaaacccttcttccttgatgcccgaactcaagaagagatcatctttgatgtcgccaagtacccgtccctcgacacggcgaaccaggaagaaatcaagcggaaataccgcgaactgaatgagcggatccgcgcggaaggtctttacaattgcaactatttctcgtactttattgaatgctgtcgctacactcttctcgctaccctgtcatatacctttcttcgcctagggtggtatgggatatcggccttccttctagggtgcttctggcatcagctcgttttcacagcccatgatgctggccatatgggcatcactcactattttcatgtcgactcagtcattggcatcatcattgcggattatttaggcggcctgagcctgggctggtggaaacgaaatcacaatgtccaccatattgtcaccaatgctccagagcatgaccccgacattgagcacatgcctttctttgccatatcacatcgtttcttgacgagtcgtcttcaccacgccccgctggaaggatccgaacttgcgcaactt

SEQ ID NO: 15184 - DNA, 345 bp, A.fumigatus
tttggtcgacagaacccagcccaagacaacggtatgaattgcactccctacatctcggttctgattgctaattgcgtacaggttacaaagtgttcggctcacgcttccttgattcaaatggacgatgctgactggtggactaggtttttcaagaacggcgctcagatcaacacgcccatggatgttgagatagcgcaatccattgacaacaacctagaaccgtggccaaatgcttgggacagcctagaagccacggcgtatctccatgctgaagctcttcagacgattctgcctcggtataccgaggcggtttggaactatgcggtgaggatcttgccaccctga

SEQ ID NO: 15185 - DNA, 294 bp, A.fumigatus
aaatccaccgtccctagctggtcaagcccgcgtccattcatgtatactcctttgcatggggtcggaggtttgatctttcccgagctatgccgctcggttgggataaccgacttcgctgctgtaacagagcaagtggaaccgaaccctgatttcccaacagtcgcattcccaaacccggaggagaatggatccctggacttggccatgcaatcagctgataaagagggcaaaacgctcattattgctaatgaccctgatgcagatcggttcgctgctgccgagaaagttgagtaa

SEQ ID NO: 15186 - DNA, 789 bp, A.fumigatus
agtagcggttcttggttcaccttcacggggaaccaccttggcgttctactggcgtcgcatttgtttgattcgcttgaaggccgacatgacaaatcacgcatagctgtgttgaactccgcggtctccacaggcatgcttgagaagatggcaaggtcaaagggcttccactttgaggaaacattgactggattcaagtggatgggaaacattgcccggagactagaagagtcagggtaccatgtaccttttgctttcgaggaagccctgggatatatgttcccagatgtgtgccacgacaaggacggtgtgactgctgctatggttttcctagcagcggaagctcgatggagatctcagggcctcaccccatattcgaaactacagcagctgttcaaggattttgggtactttgaaacactcaataagtattccgatcaccttagcccggaaatcacaaaaagcctgttcggagccatcaggaacgggccttaccgaacacaaaaatcccttggttcattcaagatcttgagatggagagacatgacagagggctatgattcgggtactgaggatcagaaaccagcattgccaattgataaaagtagtcagatgttgaccatatggctggaccgagatgttcggttcaccatccgtggctctggcacagaaccaaaagtcaagggtaactcccacaacaggaacatgcgcaaagcattgctaattcacttccttagtctacatcgaaagctgcagtgcttctcatgcgcaggctgtggatgctgtctgtga

SEQ ID NO: 15187 - DNA, 594 bp, A.fumigatus
tgcattgagcgattgctgatctcaaaacgcagaatcccgagacgcgggctgaaattgagcagctacagaaggctggagcgactgcagagctcgagctgcgtcttcggcagcgtacgtatattctacaatacgggctcctttgtctcctgcaccagccgcctttctaaccacacaagtgcaggcattcaattcggaacagccggccttcgtggtcggatggcggcagggttctcctgcatgaactccctaaccgtcattcaggcatcgcaagggttggccaaatacattcgagacaaacactccgacattgcgccgaatggtgtggtcattggccatgacgctcggcacaactctgctaaatttgctgctctggcagccaatgcctttattgcgatgggaataccggtctggtattattcaaaacccacgttgacaccatcagtaccatttggtgtgacgcatgtgcgagctgcggctggcgtcatgataactgcaagccatgtatgtctccttacgattcgcgcagtgacaagagcaaagaggtctgacacagatgatttggtcgacagaacccagcccaagacaacggtatga

SEQ ID NO: 15188 - DNA, 453 bp, A.fumigatus
tgcccctaccgtcaatatttactaatatggacactgggttacaggctcaaacatgcccatgctctagtcgagggaatgcaccagcaccactatcatcaacaaaccaccagcacaagccattgcaaccgcaaggctcatttccactcctctgaaggctgtccgcgctatcttacctgccacagtcacacccacgtccagcagcacagacaccatcatcaccatcaccatcagcaattgacgcactctacgcattatgacggagcaagggagacaagtcaatcttgcacttgcagtcattcgtatggaagtgagactcgtgctcacagtggtgggtaccggggttgtcgtggtttgacacaggtgtgtctgtgtcggcggccgtatggcccaccgttgccgggtgggttgatgtgcgtggggaggggaagggtgggatgtgtttgtaggagatag

SEQ ID NO: 15189 - DNA, 351 bp, A.fumigatus
atacaaccacacatcatggcttccccctcttccacccccccgcattcagatgcccatgtcaatggcaacgttcttcccacagcatcagttcccaagctctacggtagcggcgatggcgctcagtctggtgctggcactcccattggctttcaaaggtacccacacaacaagatcctcgacaatgtagccggatcgaatgtacgccatccatctcctcaacctactcatctgggaattcccggtagtcccctacatcgggtcctctctgaggaagatcccggctacattgctgccaagttcgagggcaagcagaagcagatggaacaaggtatgcgttactcgctcgcttaa

SEQ ID NO: 15190 - DNA, 1548 bp, A.fumigatus
  unsure (1364),(1427): Identity of nucleotide sequences at the above locations are unknown.
ggaagatcccggctacattgctgccaagttcgagggcaagcagaagcagatggaacaaggtatgcgttactcgctcgcttaagttcatgcgcaagatctgtgccgctgatacgggttgttttgcctatagtcatggaccaattagaagagaagggcttcttcccaagtgatttcgttgtttccgagaccacctggttctacaacatgcttggaatcgacgacacctacttccagaccgaaacagtcgactctattgtcacccagattctgtctctttatgccgcgaaagtggcagcttatgcgcgggatgacaagaagcttgaaatcagactggacaaggaagcggaagaccatgctgtctacattgataccagcaaacctggcatttcgtccgtcgatgggccccgttacgaacaaagaattgacgccaagtatatcaacaactcgactcccgaaaacagctacagagttgagactttccgttcgccaactcctcttcctggagacagcgagcagcagctccgttgttacttcgtttacaagtgccaattcgcccaccctaatcccagtcctacggagaccgacatcgagatcattggcgagaagagattcttgcagaaggcaaccgccaacaccaaagccatctaccaggagatcatcagcaatgcggtgaaccgggccggccctgtcattgagatgttcgaaattgaaggcagtcgcgagaagagactggttatcgcctatcgccagggctctgctatgggtctgttcagcgcgctctccgacttgtaccactactaccgcttgaccagctctaggaagtaccttgaaaacttctccaacggcattacagtcatctctctctacctgcgcccactgaagaatgcagagatctccgccaagtaccctccaattgaggcagccattcaccagatcatcaaggagacctctcttctttactgcattcctcagaatcgcttccagcaccacttcgccgttggtcgcctgagcttgcaggagactatctacgctcattgcgcgtgggtgttcgtgcagcagttcttgaaccgtctcggctcggaatacacctcattggctgctgtgcttgacgccaacaacagcgtccatcaagagttgctgtcgaagatcaagaagcgactgcgtacggaaaccttcacggccgactacatcttcgaaatcatcaacaagtacccggaactgatccacaagctctacctggattttgccaacacccattacgtgcagactcgcgcctcggaggatgacttcctgccaacgctcagctacctgcgcttgcaggtcgacgaagtcctggacagcactagactgaagcagctcatttncagcaccgttgctaacgagcacgacgaaatggtcatgagcgctttccgggtatttaacaactncattctaaagacccaactttttcacgccgacgaagtggctttcagcttccgactgaattctgaattcctgccccgacatgaatacccacacacgtctgtccggcattgttcctggtattaa

SEQ ID NO: 15191 - DNA, 591 bp, A.fumigatus
gtcctatttgggataccatttctgcgaaacaacccggcgggatatgtttcgcgagcctttgagctgaccagacaattcatgttcaagtggacggtcaattggagatttgttggagaagaactatttctatcccggaagttttccctggccctattggcattgcaccttctgctgctgggtctttttgttgccacagtatggctggagccgtcgggatcaaacctgccaagcttcctgcaacggttaatccaacgacgttaccgcacagcctccctttccaagtctttcgtaatgacggcaatgctgtcctcacttgcgattggtctgctgtgcgcgagatcgctgcattaccaattctttgcttatcttgcttgcgccacacccttccttctttggcaggcgggtttccatccgatcctcgtgtacgtcgtgtgggcggcgcaagagtgggcttggaacgcatatcctagtaccaacgcgagttctctggttgtagtcctctcactcgctgctcaagtattcggtgtgctcggcaactcgttcagtcgcaagcatctggatcagagtagccagaaagaacatatgcgatga

SEQ ID NO: 15192 - DNA, 696 bp, A.fumigatus
agtgtcgggaccattcctagctacctgaagctaacaattgagccttcgaatgcagatactgagatcgattggacgacgtacatgcagcaagtctcactctatatctccggcgagcgcgactacaccctgatcaaagggtctacggggcccttggtttatcccgctgcccacgtgtacatctacaacatcctataccaccttacggatgaaggacgagatatcttcctcggacagattctgttcgccattctatatctcgctacattgaccgtcgcgatgacctgctacagacaagctggagcccctccatatctgctagtaccccttgtgctctctaagcggctccatagcgttttcatgctgcgcctattcaacgacggaattgcggctttcgccatgtgggtttctattttcttgttcatgaacaagaagctagctgctggagtcattgtatggtctacaggcgttgccatcaagatgacgctgctgcttctagctcctgctatcgcaatggtgctagtgcttagcttatcttttggaccaagtatccgattaggattccttgcggtgctcatccaggtaatgcaagtgtcttttgctcgaaagaaagtcgctaacatggcgggtaggtcctatttgggataccatttctgcgaaacaacccggcgggatatgtttcgcgagcctttgagctga

SEQ ID NO: 15193 - DNA, 693 bp, A.fumigatus
tctagacaggtaatcctgaagaactttgcttgccatgaatccccaaggccctcactgacttcggttgctttcatcagggcgatcgcgcagcttcgcgcttgccgtttgatccccgagtccgaagtccgcgaactctgctacaaagctcgagagatcttgatagaagaagggaacgttgtttctgtggatgctcctgtcacaatatgcggagatatacatggccagttccacgatctgatggaactgttccgcgtcggaggcgacgttcctgacaccaactatctcttcatgggtgacttcgttgatcgcgggttctattctctcgagtcatttctccttctcctgtgtctcaaagttcgctatcctgatcgcatcaccttgatccgtggaaaccacgagtctcgccagatcacaaccgtctacggcttctacgacgaatgcattcgcaagtatggcagcgccaatgtgtggcggtattgttgcgaggtgtttgattacctggcgctgggcgcacttgtgcttggggccagctcggaattgggaccgaccggctcaacttttagcgacaccacccagtccacgatgccgattgatggcccggaactgggaaacgaagtacttaactcccgaggggatgtccccctgagcccttacagactggggggacgatcttcttcggaaggcgtcgactga

SEQ ID NO: 15194 - DNA, 390 bp, A.fumigatus
ttcattcacgatcccttgatcaactggcgtctgaacattcgcgagtcaccagaacggccgccgttcagcactgagcgccgacagtccattacgtccgttatgaatcttgaacatggcgttcagcccagcaatttctcccgtcaccgtcgcccatctatcctcgacggtggtatcctcgatgtccaggagggcattccgcccgaagcccgtgaggcacagaatgcacgagcggtgcaggtgcttgctcgggtcaaggagaagctcacaggtagagacttcaagcccactgaagagctcaatgtgagcgatcaagtggacaaacttctcgcgcaggcaacgagtgtggagaacatatgtcagcattggattggatggtgtagtttctggtga

SEQ ID NO: 15195 - DNA, 252 bp, A.fumigatus
atggcctccaatagacatcattacagttttgaatcattaaagctatgtgaattaattgttctcctgcggttcatttctactgattgttctatgagtggcacttgcatgagcatccactcacaagccgaggtcgccagcggtcagcttcatctaagaagcggagcgattctgggcaattcatttcgtttcgttctgcatccttacatctcctccgtctcgtccctctgttcgcgattctattccaagcggtga

SEQ ID NO: 15196 - DNA, 1035 bp, A.fumigatus
ctgtatcgtgagacggaagaaatcggcgatctcaaccaagcttgggatctctactatactgtattccgcaagatcagccggcagctcccacagttatcgactcttgacctcaaatatgtctctcccaggctcaaggactgtcatgaccttgctcttgctgttcccggaacctaccaaagtggcagaccaatcatccggatcatcagctttgatcctatattgcacgtgcttcaaactaagaagcgacctcgacgcatgactctgaagggaagcaatggaagctcttacatgtatgcccttaagggacatgaggacattcggcaagatgagcgagtcatgcagttgttcggactcgtgaacactttgcttgataacgatggcgaaaccttcaagcgacatctttccgttcagcgtttccctgccatccccttgtctcagaactctggtctgataggatgggtctgcaacagcgatacattacatgcgctgatcaaggagtaccgtgaaagtcgccgcatcctactcaatatcgaacatcgtattatgctgcagatggcgccagattatgacaatctcactctgatgcaaaaggttgaggtcttcggatacgccatggacaacactactggaaaggatctgtatcgtgttctgtggctcaaaagtaagagttccgaggcctggcttgagcgtaagacgaattatacaagatctttgggagtcatgtcgatggtgggctatattctgggcctgggtgaccgtcatccgtccaaccttctgctggagcgcgccacaggaagagtcgttcatatcgatttcggtgactgcttcgaggtggcgatgcaccgtgagaaatatccagagagggtgcccttccggttaactcgcatgttgaccttcgccatggaagtcagcaatattgagggaagctaccgtatcacttgcgaggctgttatgcgcgtgatcagagacaacaaggattcccttatggccgttctggaagcagtacgttttgtccatttttcactcagtatctag

SEQ ID NO: 15197 - DNA, 291 bp, A.fumigatus
accatgacgcccgccgacgcagacgcccatcctctcgttcgcaacgctctccgcatcaccctgagcgccaaggagtacaagctcctccacgaatacatcatccagcgcacacctccttccatcaaagacaaggccccctcgccatctcgatatgaggccatcgtccgatcaaagaacaagcacaatgaagccgcgctgcgggcatccctgcgagtaatcctcgtctctggcggactgctaaagctcgtggaagccatcgtccgtcgcatccaaggtgatatgtccaagtaa

SEQ ID NO: 15198 - DNA, 1908 bp, A.fumigatus
ttgaatcccggtcgaacggtcttgctaataactcggcatggaatagctgattacgatccgatcgaccacctgaatgcgattttctcccacccctccaccctctcctccgtgtccgaggtgtcccaagccctccgtgaatatgaagacgagctcgaccatgacattgccacgctggtggaggagcaggttacctccaatgccgagagtgtggagcgcattcaggcagccaaggccgatttaacggaactgttcaagaagatcgacgaagtgcgcgaccgcgcatccaagacggaacaagcgattacggagatgacggcggacatcaagcagctggacaatgcgaaaaagaatctgacgcagtccatgaccgcactcaagaggctgcagatgctgacgacggcgtatgatcagctccgtgccctgagcaagacgaggcagtaccgcgactgcgcgcagctgctgcaggcggtgattcagctgatggcgcacttcaagtcataccgatcgattgatcaaattgcgctcctgagtaggaacgtggcggatattcagcgggaattgctggaacaggtctgtgaggactttgagttggcctttgctaagggggaagttgctcagaatcggatcacgctgtcggagggctgtcaggtcatagatgcgctgggcgagagtgcgaggtccaggctggtgacctggtattgcaattttcagttgcgggagtatcggcaggttttccggaacaacgaagaggcaggctcgttggacaatatttcccgcaggtattcgtggttccgacgcattctgaagatctacgatgaggagtatgcggcgattttcccagcgtcttggagggttaatgagatcctcgcgaatgtcttctgtgagggaacccgcgacgatttcaaggggatattgtctcggtctgttcggaacggtcagacgatcgatgttaatttgctactttcttgtcttcaggagactctggactttgagcattcccttgagcgccggtttgccagcccggcccggccgtctactgacaccttcgcctcaaccgagacacccgtctttggtcaggctatttcggaggcattcgaaccatacctgagcgtatgggttgaagctcaagacaagcagctggctgcgcttatacctaagtaccggcaacaacccattcgaccaccggacgaggaattcgattgccacatagtaatatcctcatctacagaactctttactttctatcgacactcccggcagcagtgtgccaaactctccactggcggaagcttggctgacttggccaaggtctttgccaagtatctggatcagtatgcgcagcaagtttttttgaattatattagtgaacgacgtacaggccatacaccgtcaaatgtgccatcgttggaagacctcatcttggtcctcaatacagccgattactgctacaccacttgcaaccagttggaggagaagatcaaaggcaggctcgacaagaacctcaagcaaagtgtggacctgcaaagtcaagcagactcgttcatgggcattgcatctgccgcaattagaggtctggtacggaaagtcgaaatcaacctagaaccctcttggcgcgaaatgcgcaacacgccctggagtcgtctcgacgccgttagtgaccacagcccttatgttggggagcttctgtccaagacccaggccacgttctcagaaattttgcagttcttgcataagcagcagtatgctagagccttcgccgaccatgtcgtagagctcttgtcgacccagttcatctcgaatatatcccaatgcaaacctattacggagactggcgcggagcaggtatgttctgtgtttttacctcgccaaatatcgttgtatagtcttcacgcccggggctggaagtaa

SEQ ID NO: 15199 - DNA, 240 bp, A.fumigatus
tctctggttgtctcacttgggccaattgacagatggtcacttgtcgcaactgcagcatgtgccctgcgtttaccacccctgagagctaatggaatgtccgtctcgactcccacctcctctaccggccatgtgccacccaacggcgcggcggacctcgatccactggatgcaggtgagcacaccaacctgattgaatcccggtcgaacggtcttgctaataactcggcatggaatagctga

SEQ ID NO: 15200 - DNA, 432 bp, A.fumigatus
actaactggatagcaattgtgctctgttgccccgacactagagattacctgatcaactacgcgcgaagcctgatctacaccaccgccatgggattccccttccttgcgtccatacgcgctgcgtatgagctcctggtagagggacagacggagccgcatcagaccaaactgcagcagctggtggcgtacttccgagaccggctcgcggaattggacgccggggactccgccgcattccaggtggatcacttcccgacttcgcccatcttctccgtgcgtagccgcttcccgcgccagttggccgcggcgtgccagcaaaaaggctatgtggtccgcgccatcatgggcgctacttgtccttgcggtaaagaagcgggtgagggtttgccctcatgcttggaacacgaatggaggaaaatgatgggtgggtga

SEQ ID NO: 15201 - DNA, 828 bp, A.fumigatus
tctgttcgaatggatagttccccgcccaagtccctccgggagtcactacgtcaagcgcttcttcgccgagaagccaagtcctctcgtcgacgcttgacggtgctacctcaatcctcagtagatttctcctcgaatgattttctgtcgctgtcgacatctccagcctttcgaggacgctttttagacctcctccaccgagctcccccactgtacccattcgccagcggagggtcgcgtctattggacggcaactcaacctacgcagaggagctcgaaaagttcatcgcagagttccatagcgctcccagcggacttttattcaactccggcttcgacgccaacgttggtgtcttctcctgcattccccagcctggggatttgattgtgtacgatgaactcatccatgcaagcgcgcgcgagggcatgcggttatcgagagccggcaagcgggtgccgttctcacacagctcccccgacagcctggatgaagttctccagtcacatattgccgccgaccctctgatccagaggggctcgcgcagcgtcttcatcgccatcgagtccatctacagcatggacggcgacattgcgccgatccaggactttctccgggtggttgatcggcttctcccccaaggcaatggctactttattgtcgacgaggcgcacgccaccggtgtgtttggcccccgcggtgcgggcgttgtccagagcctcggcgtcgagaagcgcatgttcatccgggtgcacacgttcggcaaagcgctggcgagtcacggtggtaagcccgagtcaattccgatctatatgtttgaactaactggatag

SEQ ID NO: 15202 - DNA, 390 bp, A.fumigatus
atccctcgggacgatgatatcctcggttccgtgcacaagacactctccgaatgggctcgcactggagtcactttcgctctcgtcgagacggccggtggagtccattcgcctgggccgaacggtagctcgcaggcagatctttatcggccccttcgtttgccagtggttcttgtcgcagattcgcgacttgggggcatctcatcttccatctcggcctacgaatccctactgcttcgcggctacgatgtcaattcggtgctcctgttccgcgacgattactacaagaaccatgaatatttgggcaactacttccgcaacaagagtattccccttgtaccattgccacagcctcccaaacgcccgccgtcgcaggatgcagcgtctctggcg

SEQ ID NO: 15203 - DNA, 852 bp, A.fumigatus
acaatgccgctacgcatctcgcgcacttgcctggcgcaagcagccattaattcccctgttccattcctctaccagacccggacactcgctgcgccgctgagctatgcaaaatggagtgcccgagacggcagatcatttcagtcaacatcgacaaccttcacgacacccgaatcaagcctacatagaggcgaagagtctgcgcatgatggggagagctctgaaaatgcgacacctcccttggaatctgattctccctcaccggccccgagcaacgatggccgtcgatcccggaggagttacctgaagaagcgcggcgccgcggtttcacaatcacgaacaccaccatcctcacaaccaccacgaaggccactcacgatgacagaaagcgagaagagggcgttcggtggtctgttggaacaaatgggtgtgaaggagaaggaagacctggaggcggctacagaagcaacagacaagccggcactgagcaaagacgagatgcacaagatctccaatatcttcaactctgtgctggaggaccttcggaagaaaaaggagggttctgaagtttcgacggagggtgccggaaaacgcaagtcccggaggcaggtggatgagcccgcttcgacttcgaaaccggggcctcaggagcaagcggttgactccaatcccccagaatcgcgcagtgatgttcctcgctctgccgagctggctattcagttcaccgtgcaaagggagtcggcgaagatcgagcgcgctctccgtgcagcgattgacgagggcaaaggggatacagggatctgggaagtgtgcaagttttcacaacagcctggaaggaccccgattgcgttagct

SEQ ID NO: 15204 - DNA, 1032 bp, A.fumigatus
aaggtaagatgccttgtctctctctcttgtttcttttacttttgttcttccccactaatcctagcagatcaccctcgccctcgtgctcaacgaacgttgacattgatcgccaaagccttacaaggccttgcgaacatgacgacgtttggtaataaagagccgtggatggaaccaatgaacaagttcttgcttggcaaccgagtcgaattcaagcagttcgttgactctatctgcgcgattcctgctgaccgtcctacccctattgtcacgccatcttatgcgacgccgattcaaattcttaaccggctgccccctacctctcgcgagggcttccctagtctcccgttcttaatcgaccacgcaaggagcttcgcaaacttgataaggatctggcttgaagcagctccgggaaagctcgctgaactagaagacatcgatccggccgttaagaagtttcacgagatggcgctccgtctccaccaacgtaccaaagagtgccttagtaaagcagaacaggcagaacgcccgaatggtactctcgaagtcaaatgggaggaactggtggattccatggaacgatcagcgactttctttgaagacagctccaagccgacgacaccggcgacagaaacagtgattgcaacgccagcatctgttccaggcagtcacaggaattcaattggctacttcgcttcacggccttcgctgcctcgccggtcgacagattatggaccagacgctgaggaggagactcctcccagctcttcttcagcaacctgggaccagagtcgtgtgcccttttcaatgccccgctggtcggacactcgagacagcaccggtagctcaaagaactcttccacttactctcttgaatattctgagccttccaaggcgcgcagatctagcatgacgaaagagacgtcaagcaagtatcggttttttgactttgtaccggcctcgtcaagacgcaaggccaaagaccgtgaaagtactcaacaacactcgcgcgaagaactacggaacgagttttga

SEQ ID NO: 15205 - DNA, 702 bp, A.fumigatus
cgcgacatttcaggacgcgtttcctcagtcagaagcgcgggttcagcctgtgacactgacctgagccccctacactactccttcaattgtcaaggcgcccgcaagacagtcactattatgggcgccgataatgagctctccgaattcgaaaagcagcgtctcgcgaacatcgccgagcgtgatgcgctcctcaagaagctgagcctggacgcccagtcatccgggctcttcccgccaaaatcagcgagaagctcaccagggggtcaaacaaagccaaagaagaagcctccgccgaagaaggtcaagaaggaagatgagcacccagttccgcggcgtatgtcctcgcggttgagagggctcgcggcggatagcgaggttgcgaaacgcaaggcggatgagcagtacgaggctgcgcagcaggcggagcgggcgaagagggttcgcaagtcggatgcgttctctttcagtgagatgcttgtgtccgggcagaagctcagcggtgatagtctaatcggggtggatgtggtgacgaagggagttgcgatgccgtatcagcggacttttggtgatgaggatattaagaagaccaccgataaggagctgaaggcgctgagggaggaaatgagcggattgcgtctgtgggaggcatgggaacctaatcgtgcgttggccttccgtatgaactgcgacagcggtgactag

SEQ ID NO: 15206 - DNA, 843 bp, A.fumigatus
catgatcgtatcacaggcatcaagctcacccccgaacgaatttacacgatgacattccacccatcagaggctaagcctttgatcttcgccggtgacaagatgggcaacctcggtgttctggacgcctcgcaagagaagccaacctcagccgtcaagcaggaagatgacgaagaagacgcagaggacgatgacccagacccagtcctgaccactctcaaaccacacacacgaacaatcagctccttgcacatccacccctcaaagccaacccacctctacagcgctagctatgatagctccatccgcgagctggacctggaaaagacaacctctgtcgaaaaatacgccccagagtcaacctccgacgacatccccatatctggcattgacatggcacccgacgatcccaacaccctctactggacaactctagacggcgccttcgggcgctacgacactcgcgcctcgcgcagaagcgccgtagccacctggcagctctccgagaagaaaatcggcggcttctcactcttcccaacccacccgcacttcttcgcaaccgcctctctcgatcgtacgatgcgcctctgggatatacgcaagctctcccacgatgaccccgtcccggtaggcgagcacgtcagccggctctctgtgtcccacgccgcattcaacagcgccggccagatagcgacatcctcctacgatgacacgctcaaaatctacgactttgggtctaagggtatcgccgcctgggaaccagggtacactctctcagacgccgaaatgaaacccgacactatcgtccgccacaattgccagacaggacgatgggtgaccatgtaa

SEQ ID NO: 15207 - DNA, 2226 bp, A.fumigatus
ctgaagattggcgctggcatcgacagcttttttgagtacgctttcaaatcgtacgtcctgctctcgtcgggacaacacccctcgcatgatccccggagtccctggcaggtcctcgatggtcacttcccgccattgagtgaatatgaacactcagcggaagcgttcctgcgcgtgtgggaagagtcccatgcagctatcaaacggcatctatatcgaggggagggttatcaacatccgcatgtgatccaaggcgatatatttaccggcgcaacacgggcattctggatcgatagcctgagtgctttctatccaggccttctttcgatagcaggggagctggacgaggccatagctatacaccttttgacgacagcagtctggacccgattttctggccttcctgagagatggaatgttgccaccgggaacattgagggtgagcttgcttggtacggtggccgtccagagttcattgagtcgacatactacatatatcgggccaccaaggatccgtggtatctccatgttggcgaaatggtcctccgggatctcaaacgccggtgttggacgaagtgcgggtgggccggtcttcaggacgtccgcaacggagagttgaacgatcgaatggagagcttcttcttgggagagactgccaaatatctgtttctcctatatcatcccgaccatcctctgaatgatatggatcagccctttgtcttctcaaccgagggtcacccgctgattataccaacaagtaccatttccagcactcatcagcataggaagcaggtgcagcatggagaactggtcaatctaccggtttgccagttggcacctgagccaccgacattcggtccatcctcaacggctgcgcgtcctgacgttttccatgctgccacgttggctcgtttgcacctaatgccaagccgaggcccgacagaagggcctatttttgagtatgcgcatgaccatcctagtgtgacagtgtccgatctatcgtcgccgaccaattacacgtattatccgtggactcttccacctgaattggtaccattcaatgcaacaagctcaccgatgacctcgcgaccgacacttgacatctctttcccagccattccgggtatggtcattggccccgggtcaattgagcgggttcgggatggcattttcatcaagaacatcggaggccttcgattgagcatggttcaagatgtgccgtcggtcgacgcgacagggaaggcgagccaggatgatttccgtgtgcaggtgataaacaatgtgcctttgggcaaagatgagaaggtatacctctcacgagaaatcacatttgatatcctcgatcccactgatcctaatttcacccgaatgagcgactctgccatgattgacatcgtcattgacgtaacgccagagcttctccgtcgaggaaatgattcgattgctagtcgcgaacgaggtgctgcggccgcggagcatagtgaaaaccatgtcatccaagagaacgcatccgtggacgacaagatcggaagtgtcgacccttcaacctccggaatgaagaacgtgttctcatctctaatggacacggtgtctgcactcctgcgggacgaggatccggggttgacgacccaatcaccctcgagaaaatcgtctattcttcggctgagtctgccagctgccgtatctagcggtgcaggctcggctcccctcccagaggtggaggatgcctctattgtttccatctcggggcagccgttaagaagtcgcctgtcatggtccacaatttactttgctgatgaaatctgtgaccatcggatcttacgggagattgctcaaagtcatcaagtcctagtcatcaaacgaggcgggtgcagtttctctcaaaaactgcgcaacattgccgcttacccaccttcccgacacgccctcaaacttgtcattgtggttgattacgatgagaagacgttcgcggaggcctcaacgtccactcctccccattctgcaggtctggccgccattcgtgctgaaccgtttcttatccggccgttattagacgagccgcaaatgaccgcaggagggcttccgcgtcgccatcctattagcatggtgatggttggcggcggtgaggagacgtatgggttgctgcgacgagcgacaggtgttggcataaagcgacgctattcgatccgctctcagggcataccgatcaataatctgtacatagtctga

SEQ ID NO: 15208 - DNA, 1248 bp, A.fumigatus
  unsure (35): Identity of nucleotide sequences at the above locations are unknown.
ttggtagccctggtttgcgcgattgccgtcctttntgagccctatccagggacagtaatgagatcgggggcgcagtcaacgccttcactgcaccaggacgatgagagcggcgccgacgacaagttgtcactgcagttttggaacattgctctgaaacgtctcggctacgcaatgcgtgagaacagtgttgaggctgtccaaagcctggtgctagcaggaaattggtatatgcatcgaatggaacccctggaagcctggaaacacttcaacctcgctggcgcagcttggaacaccctgaggttaactcgatttccactctgggatctcaaacacaatagagattcgacatccaacgagctcactatactgcaagcgctctacttcacgatctggaagtcggaatgcaaattgcgactggaattgccggtaccaggtccctctctcaccaacactacggatttcccgctggcgtttccccagccgcccaggcttggttcggaaccgtcgacgcccgatgcatcagagagcgagagaagttggtattattacctcacagagattgcggcgcgacatctgctcaaccgtttggtgcaaatgaactcggagtgtgccgacacgcttacggagaggcaggtgtcccttctgatcggccatgctgagatattgcaggctcaaatattcgactggtatacttcgttgccatccatgttccattttaccatcccagacgggtacgatgccgatttccaatcggatcccatgatatttgtgcttcagcatcggtattttaccctccgtgagctcgtcgcaagaccttttgtacggcttgtggttgatgggctccttgacggaatggatcctttgcttcgtgcccgagctcggtcattcgcgtcagagagcatacaattctgtatgctcaaactgtcccaaaccgtcgcataccgtcatcaaggaaactggtatatgctgcgatccataacgactgcgtctttgattctggcctcggtttatctggctcaatgccggctacgggagcgcgaagctgccggagccacaccaacatcagagagcctgatgccgccagaagcttggatctcgcgagtcaaggatgctgtggagttagcccagccctttttcgacgaaccgagcggtggcgcttcgaatatgaaacagataatcttggccgcactggaagctgcccagcaacgttcggcgtggtgcggttggaggaactatggaaaagagtaa

SEQ ID NO: 15209 - DNA, 2157 bp, A.fumigatus
gtcttaaccaagatgaacagttcgtgcgcagacatcctgctctttgcaacaaacaagtggaacgtgactagaccatccattttgttcgacacgaaagacgtttacgagccgaccactacgaacaagttctggcttgatgtgcaattaagatacggcgattacgattctcatgatatcgagagatatgtccgcgccaagtacctcgactacactactgatagcatgagtatctatccttccgccactggccttatgattggtattgatcttgcatacaacctctattcggcgtacggacagtactttccaggcttgaagactctcatccagcaggccatggccaagatcatgaaggcaaaccctgccttgtatgtactaagagagcgtattcgaaagggtctgcagttgtatgcttctgaaagcaaccaggagttcctcaactctcagaattactctgagttgttcagcccgcagattcaattgttcattgacgataccaatgtttaccgtgtcaccattcataagaccttcgaaggcaacttgaccacaaaacccatcaacggtgccatcttcattttcaaccctcggactggtcaactgttcctcaagattattcatacaagtgtttgggctggccagaagcgtcttggccaattggcgaagtggaagacagccgaagaagttgcagcactcattcggtctctgcctgtggaagaacagcctaagcagctcattgtcactcggaaaggtcttctggatccccttgaagtccatctcctcgacttccccaacatctccatccgtgcctctgagctccagttgccgttccaggctgccatgaaggtcgagaagctggcagatatgattctgcgggccaccgaacctcagatggtactcttcaacctctacgatgaatggctcaagtccatctctccgtataccgccttctcccgtctaattcttattctgcgagccctgcacgtcaatattgacaaagccaagatcatcttgaggcctgacaagacggtaattacacaagagcatcatatctggcctacgctctcggacgaggactggatcaaggttgaagtccagcttcgtgacctgattctgaacgattatggaaagaagaacaacgtgaacgtgcaaagtttaacgagcagcgaagtccgagacataattcttggcatggagatcagcgcgccttcccttcagcggcagcaggccgcagaaattgagaagcagcaggaggaggccaagcagcttacagctgtcacgacgaagacgcagaatgttcgcggtgaagaaatcatcgtcacgaccacgtctcagtacgaacagcagtcgtttgcttcgaagaccgaatggcgtacacgggcaattgcgacatcaaatcttcgcacgagagccaacaatatttacatttcgtcagacgatgtttcagaggaaggatacacttatatcatgccaaagaacattcttcgtcgcttcatcactatcgcggaccttcgagtgcaggttgctgggtatctctacggtagctccccacctgataacgaccaagtgaaggagattcggaccattgtcatgattccgcaagtcggaaatactcgagatgttcagttgccccaacagttgccacagcatgagtatctgaacggacttgagcctctcggtatcatccacacgatctctggcaatgaaccacattacatgactgctatggatgtgactcagcatgcacgggtgatgaatgctcacccctcgtgggacaagaagaccgtcacgatgacagtgtcatttacccctggatctgtttcccttgcagcatggggcttgacgccccaaggttacaagtggggagctgagaacaaagacaccacatctgaccaaccacaagggttctcgaccagcatgggtcagaaatgccaactgctgctcagcgacaagattcgtggatacttcctggtccctgaagataacgtgtggaactatagcttcatgggaagctctttcagcagcgtcgaaaagcgacctgtttatgtcaagattgatacgccgttgagattctatgacgaccaacatcgtcctttgcacttccagaactttgctgaactcgaggacatttgggttgatcgttccgataatttcgcttaa

SEQ ID NO: 15210 - DNA, 213 bp, A.fumigatus
gcggcccgggaatggttgcctctgcagagtacggctatcaatttgtcgggcaacccacgttacgcgtcaaaacatacccgcggtctccaaagaacgtctgggtcgactctgattgactccacatggggcattacgaatttttggttcaacatcaaatctcaccctctaggacttggatggcctagtcaatgtgaagatttgtcctttaaataa

SEQ ID NO: 15211 - DNA, 207 bp, A.fumigatus
ctgactcatacgcacaatagcgagtctcatgagaagtattcacctgcatacagcggtttaaagatagcgaaaagtcctccaactggtggtgatactctttttatctctacatatggactttattatcgccattccgaaccattccagaagtttgccgagcctttgacaggtgagtattccgcttttgacctaaaacacggagcctga

SEQ ID NO: 15212 - DNA, 357 bp, A.fumigatus
taccgaggctgttcaggcgaattcaggccggcaatcgactttgccgtctcaagtgttggaaactactcctatcctactcagcttgtccctcagccgttcatatccccgatctccatgcgcgattccatgaacgattgtaacgccctctgcaggtatcgtggcaatcaccggagaggctcccgcccggagatctgtcgctgccactgtacttgcaacgagtctctcagcgccataatttacggcattctgtcccacaagctgtatctttacccctggttaaaacgtcgctcaacgaccgtttcgtgtgttcggctgacccctcaagacagaagcagtagcgtcatgagctgcggttga

SEQ ID NO: 15213 - DNA, 483 bp, A.fumigatus
acacgacagacggctccattcgaagcattctggaaaattgggaagtgcaagtccccacaatcctgtcggttgcagacgatgtgtgtctactacacaggagcaagttgcctggtccagggttttctcggaaatgcggaccgtttcttcaagaacgcagttatgaaccagcttgcgtacgacgttctgcaggctgttcacccagaggtctctgtatttttgagagcagacggctcccaagtgatcccaacagcttggctgatcgagagatgcggctggaagggcaggagaattggccgcgtgggagtgtatgaccagcatgctctcgtcatagtgtactacggcagcgtgaatggctttgatgtcctggagtttgccagtcgaatacgggagggtgtgatgggccgattcggcatatggcttgagtttgaagtaaggatcgtcacagaagttccggtgatcaagaaatccgtaagctcagactga

SEQ ID NO: 15214 - DNA, 228 bp, A.fumigatus
ccaggggtaaagatacagcttgtgggacagaatgccgtaaattatggcgctgagagactcgttgcaagtacagtggcagcgacagatctccgggcgggagcctctccggtgattgccacgatacctgcagagggcgttacaatcgttcatggaatcgcgcatggagatcggggatatgaacggctgagggacaagctgagtaggataggagtagtttccaacacttga

SEQ ID NO: 15215 - DNA, 549 bp, A.fumigatus
gcttacggatttcttgatcaccggaacttctgtgacgatccttacttcaaactcaagccatatgccgaatcggcccatcacaccctcccgtattcgactggcaaactccaggacatcaaagccattcacgctgccgtagtacactatgacgagagcatgctggtcatacactcccacgcggccaattctcctgcccttccagccgcatctctcgatcagccaagctgttgggatcacttgggagccgtctgctctcaaaaatacagagacctctgggtgaacagcctgcagaacgtcgtacgcaagctggttcataactgcgttcttgaagaaacggtccgcatttccgagaaaaccctggaccaggcaacttgctcctgtgtagtagacacacatcgtctgcaaccgacaggattgtggggacttgcacttcccaattttccagaatgcttcgaatggagccgtctgtcgtgttcaagtcgatggttgccaggactggtgagttccaatgtaacactagcgatgaatacatctgtggagttcgcttga

SEQ ID NO: 15216 - DNA, 495 bp, A.fumigatus
cgatgcacttgctgcatagatggcgaaaatcccatgcttgatgccatccaagcgctccagaacgagggtacccgtggtgaagtcgcccagagctaccgcgagcaaggcaacgaggcagcgagagaaaagagatggatcgatgcgaaggagttctataccaaagctcttgccgttgtgacaacgaaaatcgataagtgggacaaaccagagaatccagaggaggacgagaagctcctgcggcaggtcgaggaggcttcatacatcaaccgcgctctctgcaatctggaattgagtatgccactgtgttatggccacacctggcacaaattgctaattaggttcagaaaattaccgttctaccaccctcgactgtgcctctgtcctcaagctcaatccaaacaatatcaaagcttattaccgttccgctatggcgctttattccctcgacaagcttccggaggccgaggatgccgcctcgcggggtctcgcccttga

SEQ ID NO: 15217 - DNA, 726 bp, A.fumigatus
ttaggttcagaaaattaccgttctaccaccctcgactgtgcctctgtcctcaagctcaatccaaacaatatcaaagcttattaccgttccgctatggcgctttattccctcgacaagcttccggaggccgaggatgccgcctcgcggggtctcgcccttgaccctaaaaacaaatcgctacaacaggttgccgccaaaattgccgatcgcaaagccactctggaacgtattgcggcgcgaaagaaggcggaggaggaaaggatacagaaggaaaagcagcttctcagtactgcactacgtgccagacaaatcaggacccgcaagacaacccaaccgccggaaatggaggatgcgcatatccggctgactcctgatcctttgtctcccgaaagtaccctcgagttcccggccgtgctgctgtaccacatggacgcccaatcagacttcattaaaacgttctctgaggcgacatctattcaagatcacctggagtacatcttcccattgccatgggacaccaagcaagagtatacaatcaacagtgttgattgcttcatggaaaccgtgacaggggggctgatcaaggccggcaagaaactaccacttctgcagatccttagtgggggcaaggttgaagtagtcgacgagcttgtcaggatctacgtaataccgacctccaagagcgcgaaatttattgccgagatgaaggccagaaaagagggctga

SEQ ID NO: 15218 - DNA, 297 bp, A.fumigatus
atgtccatcgccttgcggagctgcagcaggcctccctccggcccgtcaagaccacgacggatatggtcccatttgggacctccgactgctgcgaagagcacggcgtcggattccagagcggcctttttcacttcttctgtgacggattttccgtgcgcatcgatgctgcaaccgccgatgagctcttgccggaggttgaactttcggtgctcgttctcaaagacctttagcaccttgaccgcttcggtcatgacctcgggaccgatcccatcgcccgggaggacgaggatgttgtaa

SEQ ID NO: 15219 - DNA, 378 bp, A.fumigatus
gactttttttttgggacaggacatcaaacatttgtttatactacagatagcacgatgggccaaatagaggagctgccagacgactttgacgagcgcctcagtcttaacgaacagcctccggctactgaggtgcctcccgccaaaatctacaatgacggcccttctcccgccgtggaagaaactccctttccgatcaacgaagagagactgaaggagcttgaaaatgaccctaatgcacccaagctgccgccgaccatggcgtcggtcaagtcgcatacctcggaggagcttttgagcatgatgaataagaccccactgttcatgacggatatcaatcaggcgggggacgaaagtgagcctattttccccagcctgtag

SEQ ID NO: 15220 - DNA, 615 bp, A.fumigatus
cccattccgccaggaagtgatcgagggcgtagatttcgtcgtggtgagggagaactgcgggggagcgtatttcgggaagaagatcgaagaagaagattatggtacgtcgtttttaacaagcagtatgctttcgagactgactgtgttatttcagcgatggacgaatggggctatagcgagcgcgagatccagcgcatcacccgcctctcggcggaaattgccctccgtcacaaccccccctggcccgtcatctccctggacaaagccaatgtgctcgcctcgtcgcggctctggcggcgcgtcgttgaaaagaccatgaccactgagtatccccaggtgaagctcgtgcaccagctggcagactcagcatcgctgattctagcgaccaacccgcgggcattgaacggtgtcatcttggctgacaacacattcggcgacatgatttctgaccaggccggttccatcgtcgggacattgggcgtgcttcccagtgccagtctcgatggactacccagtgaaacaagaaagcggacaaatggtctgtacgagccgacccatggatctgcaccgacgtacgtttcttcctttgttacccgaattatcatgtttcactga

SEQ ID NO: 15221 - DNA, 240 bp, A.fumigatus
agcaagctgacaatcatctgcagaattgcgggccagaacatcgccaaccccgttgccatgatcctctgtgtggctctcatgttccgctattcgctagacatggagaccgaggcgcaacggatcgaaaaagcagtgcagggtgttcttgatgccgggatccgcacccctgatctgggtgggaaatcggggacgaatgaagttggggatgcaattgttgctgcgttgcagggtagttcataa

SEQ ID NO: 15222 - DNA, 939 bp, A.fumigatus
aacaatgttgtgcagctcagccgtatctactcgaatgaattgcatcggacgaaccccgcggtctcgtcaaccccgcagcatcggttggagaccgatcgccgatacaggagctacgactatgcttatatagttctttgtcaacaggatatagtctttccatggtcacatcaggctttgaatcaagtctgtggtattgcgttggatactgatcaccttctccacttgtctcacatcattcaatcaaagagaatggtaactacttacaacatcctcgtcctcccgggcgatgggatcggtcccgaggtcatgaccgaagcggtcaaggtgctaaaggtctttgagaacgagcaccgaaagttcaacctccggcaagagctcatcggcggttgcagcatcgatgcgcacggaaaatccgtcacagaagaagtgaaaaaggccgctctggaatccgacgccgtgctcttcgcagcagtcggaggtcccaaatgggaccatatccgtcgtggtcttgacgggccggagggaggcctgctgcagctccgcaaggcgatggacatctacgcgaatctcaggccgtgctcggccagttcgccgagtgcgtcgatcgcgaaggagtttagcccattccgccaggaagtgatcgagggcgtagatttcgtcgtggtgagggagaactgcgggggagcgtatttcgggaagaagatcgaagaagaagattatggtacgtcgtttttaacaagcagtatgctttcgagactgactgtgttatttcagcgatggacgaatggggctatagcgagcgcgagatccagcgcatcacccgcctctcggcggaaattgccctccgtcacaaccccccctggcccgtcatctccctggacaaagccaatgtgctcgcctcgtcgcggctctggcggcgcgtcgttgaaaagaccatga

SEQ ID NO: 15223 - DNA, 843 bp, A.fumigatus
aagtacctgtcgcttgtaatttgttacacttcgttgttctcagtagctgtcaatctcgtcgctctcggctacctatatcctcgcgatattgctagaagcacgccgtctgatttcaccatccatctccagggttcttgcttgtccttcctgtcgcgtgacagcggcgatccctcccatgcgacccaagtaacggaggagcgccgcgctggtacctcctcaaatgctctccgctcgaccacgaatgcgatcatctccagctgtcgctcaacttccctgaccagagcgacatcccgcgcaagtcggcatgccgaccgtcgcaccccagcgacgacaaccactcagttggctctgagcgagcatttcaacgccccaatccgcccccatgtctggtacagtaagcggcgcacctggtctcgcgcgcagctagatcaggagcgcaaggagttctttgagacccgcgtcactggtcggccagaggtttgggcagctttagccgcggcgatctcgttcatgcatgtgaacgacctggccacggcgcagagtatcatcgatgcggcgggtgtcactgtgcccacgggagacctttgccagggctgctacgatgagcagggggcactttaccgtctgcctcggtgtatcgtgagcgacccagaaaatatggtgcaggaggactccgccagtcgctgtgatgatgggtacgacgactttgacacagatgattccaagctgtcgttggacgaggcatcgggtgacgagctgattgccggtgactctggagaccgcagggatgagaagggcaagataagcgagcctgagtcttcaccatgggtggagatacgcgtc

SEQ ID NO: 15224 - DNA, 1044 bp, A.fumigatus
  unsure (1019),(1025),(1026): Identity of nucleotide sequences at the above locations are unknown.
atatggccggacttctccagatacttcaacaccgttggttccaaggaggggtggacccctgcagcgtttgtgtcctcgcgccagaatagggcgaaggattctcagcagaaattccagcaacgaccggaggacttcatggacgaggaagacattcgagaagctgaagaggcgaaaaaactgcagaccagtgacgactttgctgggtttggatttgcggcgaccggcgcgacccgccgtggagggctgatggaccttctcatggccggcggtgaaaccatgggtgtcaagctactgaagaagatgggttggcgagagggtcaagggattggccccaaagtacggcgaaaagccaatcttggcgacggcccaggcccaggcgaaaacgaagccgataagacctacctcttcgcaccggaggattcgcccatgattgcaattgtccataaggcagatcacaagggccttgggtttgagggtgaaagtcggttggattctcacaaaccgggtgctgacgagtctgatgaagacgatttctttgggcgacggttgacgtccgggagccgacgaaaaccatcgaagacaaaagagcaacctaggcgtggtgcatttggagtcggggtgttgaacgatacagggtcagatgacgacgatccgtattctattggcccacaaatttcgtacaaccgggtcatcggcggtgacaagaaaaagaagaagaaaaagcccaccgatgagtctaagccagcacttgttgcagctaatcctctagtgaacaccaagcccgtattcatatcaaagaagaccctcactgcaaaatcgtcgacgggattcagaaaatgtcatgacggccggctcccgttggacggctttctcctagctgatggtatttccagcctctcaatatctacacaagagaagagatacgcgcccccagaagtcccaaaggactggatatcgagcaaaatacccttaagcttgcaagagatgtcttcgaactatgtttttacggccagaggcgnccaagnntttttcttttcgacctaa

SEQ ID NO: 15225 - DNA, 195 bp, A.fumigatus
tatcggacaagcgtttcgggatatactaatagccgctctcagctccgagtaactgctgcacgacctggaactgtcaactttgagcttgatatccagaaagagcacacggtaagcctccggcctgtgactgactctttgtcccattttaacaatattatcagaatagactcagcatccttcatggagggacaatag

SEQ ID NO: 15226 - DNA, 318 bp, A.fumigatus
tgtcaagctgttgggttcaatgaaatcctgcacggctattcacgtctgctcatgcaatgggtcatcctcgggctcatcgcccgctccaagcataacttcgtcctcgtccaacagctcgttttccccgtcaggcaatgcatcgtctactatgaggtcctgatcacccatggccctaaccttggcctgagtcatttcaaacacatattgcccgagatgttcgactccctccataggtgtaccctgaacctcgtcgtccagcgatcttgtggttgggaacatttcgcccgtggtcaacatgagtttgtcagggcgctgtag

SEQ ID NO: 15227 - DNA, 1623 bp, A.fumigatus
agactaattgaatacgttgaaaatacttccaaagcgccttcagaaacatcgttgaagaagcgacggagagatccggttgagaaggaaggaacaagtgcacgagtgatccgcgtgtcgacatacaaacagccaaatccaggtccctatcctgtcgatgctcccaaactcaacaccattcgtttcaccccagctcaggttgaagctatcgcatccggcacgcagcccggattgactgtgatcgttggccctcctggaactggtaaaacggatgttgcaactcaaatcatcaataatatttaccatgacttcccgaaggagcgtacccttctgatcgcgcacagtaaccaggctcttaatcagttgttccaaaagatcgttgccctagacatcgatgaacgtcatcttcttcgactcggccatggtgaagaggaactcgaaaccgaaaccagttacagcaaatatggccgcgtggagtcgtttcttgaaaaccgcaattacttcctcgctgaagtgacacgcttagcggcgtcgatcggtgcagaaggcgcacacggcaattcgtgtgagacggctgggtatttcaatacagtctacatccagccagcctgggcaaaattcttcgaccatgctcgtgctgaaagtacaaccaccgaggatatcattgcgtcttttccattccatgcctatttctcaactgcccctcagcctgtgtttgatccagcccgtttcgaacgagacattgctggcatgtggcggcaaggttgtcaacggcatatcgacaagatcttctctgagctggaggatattcgcccatttgagattctgaggcaatcccgtgacaaagcaaactatctccttgtgaaagaagcgagaatcattgctatgacatctacacatgcggcaatgcgtcgacaggaaatcgccgaccttggcttccattatgacaacgtcgtgatggaagaggcggcgcagattactgagatcgaaagttttattccgtccgccctacagcacatgaagaatggcgagctccctctgaaacgcgtggttctttgcggcgatcaccttcagaactctccgattattcagaaccttgctttccgccagtacgcccatttcgagcagagtcttttcctacgcttggtaagactaggcgtccctgtgatcaaccttgatcagcagggccgagcaagacctagcttggcagaacttttccggtggcgttatcatcagcttggagatttgcccattgttcacacggctcaagaatacaagcacgcgaatgctggcttccagtacgactatcagttcatcaacgtcccagattatcaggggagcggagaaagggagccgacccctcacttcatccagaacctgggagaagccgagtacgctgtcgccatttatcagtacatgcgtctcctagggtacccggcatcaaagatatccattcttgctacctacgcaggccaaacggcgctgattaaagacgttcttgcccatcgatgtgctaaaaacgcactgtttggcatgcctaagatcgtaacaactgtggataagtatcagggtgaacagaacgactgtaagttgaactgtcttgagctacggattatgctgacctag

SEQ ID NO: 15228 - DNA, 456 bp, A.fumigatus
cctaggttatgcgcagacgttatcctttccctcacgcgaactcgcacagtgggctatctccgagacgttcgccgccttacggtagctctttcccgttcacgcctaggtctctatatcctcggtcgtcgcgaggtgtttgagtcatgctatgaactcaagccggcctttgaccttctcctacagcgccctgacaaactcatgttgaccacgggcgaaatgttcccaaccacaagatcgctggacgacgaggttcagggtacacctatggagggagtcgaacatctcgggcaatatgtgtttgaaatgactcaggccaaggttagggccatgggtgatcaggacctcatagtagacgatgcattgcctgacggggaaaacgagctgttggacgaggacgaagttatgcttggagcgggcgatgagcccgaggatgacccattgcatgagcagacgtga

SEQ ID NO: 15229 - DNA, 837 bp, A.fumigatus
aagatccttacggaggcgaaggtgttcttgagcggaaatggaagaaacagcctgaacaacaagaggaagaaccgtctcgcgggtccactgaagctctggaaacccagagtgaggatgtcatatttaatacctacgagcctgcaacaacatgggagagtcttcctcgcgttggtcacctggggaagtggtcggaccttccccctacggaagctgatgtgtttaacccgtaagtttgcgactatgttcctctacaggcagttacgcattcttttcgcggctgcggcagtttctctgaatgacaacgagctctttactgactgggaattcagtttcatgctcaaggagaaactgaccaaggagggccaccttcatttggctgctcaccaagccgcagtcgaaatctgcctgatgcatgccctgaagaagccactcactaagatatgtgacgtcgtggaacatgaaaagcccgttttcaaattgatctggaagtgcaagattgtcccgaatgcagagagccaatggggccaatctttggtctatccggacgacgaatcgaaggatgttctcgttcacatcttcgagcagattggtgggggagccgatacgactgccacaccagccgaggaagaagtgcaagaggacgttgagacagaggagcaaggagccgttgaagattcgatatcgcaggcccccacccctccattcttcggttaccgtagtgtgcgggataagggattcctctccctttcattgaatgatccagagactaaatttgctgtaagttgtcttgcatctttgattgatatcctatgggaaatactgctaatgttatcgtag

SEQ ID NO: 15230 - DNA, 276 bp, A.fumigatus
ttcctaaagagactgtcccaactgagcggtcactatttcccggatcctgtcatgcattcgatctccacggtcaagcaggccgtagaatatctcgagggagtcgtcaatccgaaacctaccaaattggccgatcaactagtcaacaaccccgagcttcagcacttgcctaacgtcaagctctttaccaagcgccagacagcgttgcacaaggatgaggaattgggtcggaagaagatcattgaatctgaacttcgcgcaagaggcctcattgaataa

SEQ ID NO: 15231 - DNA, 750 bp, A.fumigatus
ttccttcctagcggggtgcttggccctcgtggtgaagaccggtacggtatctcgagggcggaccaggatgcgttcgcagccgagtcacacaagaaggcttcagctgcccaaaatgctggcctgtttgatactgaaatagtaccagtcaagaccctttcttttgacccggagaatcctgatgcggcacccaaggagattactgtgacaaaagacgacggtattcgtcataacatatctgttgagaagatggcaacactgaagcctgccttcaaggcagatggcactagcactgctggaaacagctcgcaggtcagcgatggtgccgctgctgctttgttgatgcgccgttctaccgccacggagcttggcttgactgcttcaatccaggctcgctgggttgccaccgctgttgctggatgtgctcccgatgagatgggtgtgggacctgcagttgccatacctaagcttcttgaacttgtcggcatggatgtttccgacgtcggtatctgggagatcaacgaggcttttgcttctcaggctctttactctgtgcgcaagcttggaattgacgagaccaaggttaaccccaagggtggtgccattgcgattggtcaccccttgggtgctaccggtgccaggcagctcgccactttgctacctgagctcaaacgcactggacaggatgttggtgtagtcagtatgtgcatcggaactggcatgggtatggccggtatgtttgttagggagtaa

SEQ ID NO: 15232 - DNA, 801 bp, A.fumigatus
tggcgcaattcgcccgcaccagttgccaagttctacaaagacacaacgacattcagctgtatatcgaaccccgccatacagatccccttctctgccgtaaacgatgactactgtgactgtccggatggcagcgatgagcctggaacatcagcatgttcttatttatcccgtaattacccactaacgtccgccgatcgtccggggaacagcgacctcgaacttacacttgccctcccggggttctattgcaagaataaaggccataaaccgtcatttgtttctttccagcgggtgaatgacggtatctgcgactacgaattctgctgtgatggaagtgacgagtgggcgcacgtcgggggcaccaagtgcgaagataagtgcaaagagattggcaaacaatggcgcaagcaagaagagaagagagcgaagtctatgacggctgccctcaagaagaagaaggaattgcttgtggattcgggcagacagcaaaaggaagtcgaggaccacatcaggagattcgaagttgaaatccaggcactagagatgaaggtgaaggacatggaggctgactatgaggaggtgaagaagcgagaagagagcaagatggtaaggggcaagaaggcaggcaaggttaacatccttgcttccttggctaaaggacgggtcgaggagctgcggaatgcactggtagaggttcgcaaggaaaaggatgaagctcgatcgccgcttaataaatctcgaagacatcttgtccaagttcaaaatccaatacaaccccaatttcaacgacgaaggtgttaa

SEQ ID NO: 15233 - DNA, 504 bp, A.fumigatus
ttagtccgcgacacgcagtgcaacgagccctatgccgaggataacgtcatcccaatccttccgccgaaggaatcagaaaaacaacgactgatggcgagggcgcaaaagctagccgagcaagggctcactcattctctcaaaaaagcgcctggctctaaaaagcgcaagaagcatgctaatggagattcggctgagattgaaaccactgccgaagcagagtccaagtcagccttggcttcttactcacagaaggaacggcctgcagcctcgagtcgaagcaatacctcgactccaacacccagtgcatcaaatggtatcaagaacgcctctactgcgctgctaaccgctcgagttctggaagaggagaatgagaagaaacggcgtcggaaaatgatgggtgcgaacgagaatatcagtagtctttttactaaaagctccggagacgccaagtccaccaacagtgactttatgacgagaggctacacaatgccctctaagaaataa

SEQ ID NO: 15234 - DNA, 516 bp, A.fumigatus
gactgtccaactaaggttttgcacagtatcccaacccgccgcgagctcgtcagagaagccgcaaaagctcccagcacagcgcaagtgaaagaggcccaacgtgaaatgcaagagcacttttggaccacctgtcccttatcgcataaacctttagctcgacctattgtctccgactgcgtcggtaatctatacaataaggatgcaatattggaattcctgcttcccggcgacgacgcccagggaatcagctctaaagcagactgcgaagagatcttatgcgggcgagttaagggacttcgcgatgtcgttgagctgaagttcgaagtcgatacggagcgcggcgaacatgcatccaacaagcataataaacgtgaagcatggatctgtcccgtcactgctaagccgctcggcccgagtgtgaagtcggtctaccttgtcccatgcggccatgttttctctgaagaagctattcgtcaacttagggacgataagtgcctacaggtatgtttgttgtga

SEQ ID NO: 15235 - DNA, 2343 bp, A.fumigatus
  unsure (1654): Identity of nucleotide sequences at the above locations are unknown.
aataacctgggccctagccggcttttcatcagtgccggcggcgcggataacgtcactatcagcggccccccgtccaagctccgccaagtgttcagagtctcggaaaagctccgctctgcacgctatgcgcagttgcccgtctatggggggctctgtcatgctccccatctctacaactgccatcattggacctggattatggagccaatcaacggcgcagcgttcaaccagaatatggtagataccgcacctctcttttcggcaggtgacgacgtgccgttcgaagcgtctacgcctcgccagttgttcgagtctgtcgtctgcgaccttctcatgggcatgatccgttggaaccgagcagtagatggggttgtggaattactgggacagacattgccaagtgaatgccacgtttatgcgtttcgtccatgtgctgtggttacgggcatggtagcatcggggcaggtcaaattaccccattgccagtttcaaacgcatgatctgctcggctggacttgtcacgacgacactgacaacgggccgacatgtagagaggattccagcatcgcaatcgtgggaatggcctgccgattccctggcggcgcaaacgatctgaaccagttctgggatctattggaacaaggggcagatgtgcatcggagagtaccggcggaccgatatgatgtagagagtcataccgacacgagtgggaagtcgcggaataccagtctcactccctttggctgcttcatcgaccagccgggactgtttgacgctggattctttgacatgtcccccagggaagcaatgcagacagatcccatgcaccgcctggcgctgatgaccgcgtacgaggccctggagcaggctggctttgtcccaaaccgcacggaatcgacgcacctgaaacgtatcgggaccttctatggccaatcgtgcgatgactaccgggaggccaatgcgggccaggaggtcgacacctactatattcctggtggctgccgtgccttcgctcctggccggatcaactacttcttcaaattcagcgggcccagcttcgactgtgataccgcctgctcttccagtttagccactatccagatggcatgtacgtccttgcagcatggagataccaatatggccgtggcgggaggtctgaacatcctgaccaacagcgacggctttgcaggtctcagccgcggccattttctgtccaaaactggtggctgcaagacatttgactgcaacgccgatggatactgccgtgcagacggaataggctccatagtcttgaaacgattggatgatgcccagcgggataacgatcatatcttcgggataatcctcgcagcggcaacgaatcattccgcgcgggccatttcgataacccatccgcatgcgccgtcccaggccgagctctaccgcgatatcctgacccgggctggcgtgagccccttggatgttgactttatcgagatgcatggcactggcacgcaggcgggcgattcaacggagatggagtcgatcacctccgtctttagtcctggggtccccaaacgcagccggccattgtacattggatctgtcaaggccaatgtaggccacggggaggcggcagccggggtcatgtctttgatcaaggttctcttggttntacagagacaggccatccccaaacatgtgggcatcaagacagccctgaatccccgattccccaaccttgatcggctcaatgtccgaattccccacgaccaggtgccatggccgcggagtcccactcggaaacggtatgcactcgtcaataacttcagtgctgccggtggcaatacttcccttctaattgaggagcctcccgtaagacctgaacccaaagcagatcctcgagcagcatttaccgtcgcggtatcagcaaaaagcaaggcatccttgaagaataatctgcggagcttcctggcctatcttgagtcccagccgtctataagcctcgcccatctctcgtacactacaacggcccgacgcatgcaccataatcaccgtatcgccgtccatggctccaccctgtccagtattatgcaagagttggaaccatacctccctgctgtggacacgcatcgaccagtccctaacacgccgccttccattgcgttcgtgttctcaggccagggcaacttctacacaggtattgcccgccagctgtatgagcatcatccgggcttccgactccaaatcactcgccttcacaatatctgtctgagccatggtttcccttcattccgacgggccattaccggagatcttagcaacgatggatccgaagccgagcctataatcactcatctgaca

SEQ ID NO: 15236 - DNA, 900 bp, A.fumigatus
acttctataggacaacaaggctctaacaacgcaaatccaggcagtgctaccaacgccgctggttctgcaagcgctgttaacgctgcaatcgccgcaatcacatctaatccttccagcaatactacagccacgagcagctcgagtaacaatcggtggacatccaatgtccaagaaattcttagcatgaatctcgaactgtggcgaaatagccttccagacgtcatgaaatggaaagacactgaccctccctcaaacgacataaacgttgctcgcatgcgggctaaatattacggtgcacgatacatcatccatcgtcctcttctatatcatgctctgcattttgctgggctccctaatcccaatccaactgctgcatcggttgagtcacccgctgggtccattctctctggctcgaaatcccagcaggtttcgccctcaatgtcacacagtcaacgggcttcaaacatggcgcgtctgtcgagcgatatgggcatggcagcccatagcgctcccccatcctttcaaggaggctccatgggcaccattgcataccgagatctaccgcctaagctacgacgagcctgcaaagtatgcattgactctgcaatcttgagtacagaggcttttgatggaattgaaggtcgtccgattgtgacaaatatctttggaactgctcatgcccaatttggtaatatgctcgtgctgtctgcaacctacatgtctagtctgtcagagctggtggaccggaatgtgctcgagaaacttctcaagcgaacaatcaagttcctgttgcagagccgatatatctcccccagtcttcgagccgacgcacggattctcaccgagatctacgagaagatattcggagagcccgccacgagtttctcatcctacgtctag

SEQ ID NO: 15237 - DNA, 246 bp, A.fumigatus
gatgacttcagactagagctatactctatcttatattttatggcttctctctattcactgtatatagatgtacctattgatactatatactataacactaatttatatataaaggtctctgcgcatgctttacactatattagccttttaggagacttaaatcctaccttgactcaaaaaaagtcaccagtaataatagagatgtatgaccaggcagatcaagaatccttgctttactctgactga

SEQ ID NO: 15238 - DNA, 219 bp, A.fumigatus
ttcctacaacacgattggctctgcgcattcatctttgagagtaacagaaagtccaacttgaattcctctggacttctagtatacctctctaactcggtcttacttgctcttattcgttgctctttttcgtccacagacttggagacaataatgccgagcaaaaccatcattgtcaccggcgcctcaagaggtacttccatctatcaagcatccccttaa

SEQ ID NO: 15239 - DNA, 405 bp, A.fumigatus
atacaccttgctaactcgcattccacaactctctcaggcatcggactggccattgcaaagtaccttcttacagcacctcaatcgcacaatgtcgtcgtgattgctcgcagcgtcgaacctctccagaaactcaaggaacagtacaacaagcaggtcgaggtgctcaacggcgacctggcagatttctctctcggccagaaggcagtcgacctggctataaagtcctttggccgtcttgatggattggtactcaaccatggaatcctcggacaagtcggcaaaatcgacaaggcagaccccgaacagtggaagctcggatttgacgtaaattttatcagcttcgtcgcgtttgtaagacatgaccgttactggatgctggttctcgagtgcaaaggaactaattga

SEQ ID NO: 15240 - DNA, 375 bp, A.fumigatus
atcaaagctggtctaccggcgcttcgcgaggccaagggaaagattattttcacctcctctggagctgcggtgtccgcctatcgaggctgggctctttatggcgcaaccaaagctgccatgaatcatctcgctctttctttgggcgaagaagaacccgacgttaccaccatctcgatccggcctggaatggttgacactgagatgcagcgcgagttgagagaagaccatgctgcgaatcttgagccacaaatgcattccaaatttacaactgcccacaaggatggaaagctactcaagcccgagcaacccggccatgtgatggctaagctggtccttgacgctccagcttcacttagcggaaaattcctctcgtaa

SEQ ID NO: 15241 - DNA, 330 bp, A.fumigatus
cttacattgttccccacagcgactgtccaaaaaatcattacagagatcctgccaccgtcctccggtcaaacattctccaaggatgcgcgagatttgctcatggaatgctgcgtcgaattcattactttgatttcctcggaggccaacgatattagcgagaaggaagcaaagaaaacaatcgcttgtgagcatgtggagcgggctctacgtgatcttggattcggtgactatattcctgaagtccttgccgtcgcagaggaacataaggagcaactgaaggtttgtatcctgcaatatctctcgaaaaaggcgacttttgctaaggaataa

SEQ ID NO: 15242 - DNA, 213 bp, A.fumigatus
gtatggtgcacttcttctctctgttttctcttcaatttatatgatgagtaccctacattccatgctaagtatgaaggtgctctgcatctaatgcttctaaaatgtattgcttttcatctttcgactgattatgattacaaactcctgccgtttatttctatctgctcgttggttcagacatgtactgacggtcatatgtataggcctcgatag

SEQ ID NO: 15243 - DNA, 585 bp, A.fumigatus
agaaaatcatgttacaccgatatagctcaaacggaaaacaccaacgaccataatcttacagacgaagctcgttccaaagcacctagcgggcccgttatgggaccgttgcacgatgaagcgccctcttccaacaaacttcctaccgaattgcaattgtcccctgcctcagcagcacgcacattagttcacgatctaactctacctcctgtggccaatctggacattcccccgtctcctcctggctcacccgagcctatggctaatgcgaagtttacccattttctgtcattgaaaaagcaaggtacacattttaatgagaagttagcaaattcgtcgtcactcagaaatcccagtctcctaccaaaattgatggatcatgcagggatcgacgaacgagcgcaatacaatacttctctgccttctgaattatggaacccctctggtttaccgagctggggttacaaggaggaactgttgaagtcacagaaagaaagtaacaacaagtttgaagaaagagtgcgtacgggacagagggaaagcattgatttcgtgccttccgttaccatggactccaacactacgtga

SEQ ID NO: 15244 - DNA, 678 bp, A.fumigatus
gagcgagacgatgagattttgatagatgctcaagcatccggccagggagaagcaccatctccgattcccacggaatccgcccagcacagcgacatgcgcattgatgaagagagccggccagtgtttacaccaatagcggatgccgggaccgtactgcgagttgaaacgcgaaaggtgccagttcctcctcaccgtatgacacccttaaaggcaaattggcctaagatctacccgcccctggttgagcatctcaaactacaagtgcgaatgaacatcaagaaccgagcggtcgaactgcgtacctctaaattcaccaccgacacaggagcgttacagaaaggcgaagattttgtaaaggcattcacacttggattcgatgtcgacgatgccattgccttattgaggcttgatgacctgtatattcgctcatttgagatccgtgatgtcaaggcttcgttgaacggagaacatcttagtcgcgctattgggcgaattgcgggcaaggatggaaagaccaagtttgccatcgaaaacgcaagccgaacacgggtcgtgcttcagggcacaaaggttaccattttgggcagattcagagatttgggaatcgcccaagaagccattgtttctctgatcttgggcagtcctccggtaagttgttgcgtcgcattgcccgtctga

SEQ ID NO: 15245 - DNA, 807 bp, A.fumigatus
ggctatcggatattcctttgctcagcaaagcagcgccgcagtcagagaacactcattctacccgtatgtaacaggtcactcatacataataaagaaccgtcactgacttctggtctaagttataccgacaatggcggctctaccctaggaatcacaggatccgattttgcgattctagcgggtgatacccgttctgttgccggttacaacattaattctcgctacgttcccaaggttttcaagattggaggtgatgccgagacaggggagggtgcccacattctgctctcggtcgtgggtttcgctgcagatggtcaagcactcaaggagcggctagatgcggtggtaaggatgtacaagtaccagcatggaaagcccatgtctgtacgagcttgtgctcaacgcctatcgactattctataccagaagcgcttcttcccttactacgtccatgcaatccttgcgggcttggatgaagaaggcaaaggggcgttgtacagctacgatccagtcggctcgtacgaaagggagcaatgccgagcagcagggtcggcagcgagcttgattatgccttttttggacaatcaagttaatttcaagaatcagtacatcccaggcagcggggaaggacatgcccttgaacccaagaaggcagagccattaccaagggcgacagtcgaacaactagttcgggacgcattcactagtgctgttgagagacatatcgaagtcggagatggtttacagatgatggtgatcacccagagagggatagaggagatttatacacctttgaagaaagactag

SEQ ID NO: 15246 - DNA, 870 bp, A.fumigatus
ggaaaatgttcagaatgtgacggcatcatgtccttcaacttcggacgcaggctgtacaccagtatctgggatacagcacatcctctgcttgtgcgtgagctccggaacagccgcatgacctttttctttgaatcaccgagcacaggaaattggttccggagatttctgttcaatactcatgcacggaagatatcatcattgccgccacggacgagacatattaccaagcgctttgcatctggtagcttctttatgctcgggatttccccaagtccgtgtgcagtagaggctgggacgtcttgcgcaatcagtccagagaaattcgtctcgcaaagtcacttactggataggaagtttgtttgcgcgtcactttacacgtggaaacggggtttgcacacaacgaaggatgatgatgggttaaagtcagaacaatcgaatgagcttctcaccaatgatagcaatacctctccctctccgtctcgggaaactgcggatagcgatactcggtctgggaccatgaagtcacaagaagagcatattgagggattcacaagccggcacatcatgaaccgtctaccccacatgtcacatctgcatcgacctacgaaagaagaattgctagctgcagccaatggcttttggtctcgcttgaaagtgcgattcaagtggttctctatccgtagcgtccgtcccttcaattttgatgagattactgcacttttttcatgggtgctgctgggtcatgtcgtatggatcgtcctaggaactaccacgttcttctcgctgttgataatcgcaataaatacggtgctggctcaaggtatgtttcgagtcattgaccgacggtcttactcgaactatatgtactaa

SEQ ID NO: 15247 - DNA, 405 bp, A.fumigatus
gaaacgttggcaggatgggtgggcaattatctcaccaaatcatcaggtgtgaaggttgtctttgagtccgctattgtacctaaatggaaggacggcgttataaccttcaaaaacgtgttcgtctcaagacgcccgggacagggaacaggacacgtcagtaagggttcgtcgaagacggcagctgccgtggctgccgctgccgccttaagcgggagttctagccctgagccattttcggatcagcaatcgatacccgatgaggaggacacgaattacactcagtttgacctgtccattgagacagttaacgttacattgtctttcacaaaatggatcaatgggaaagggcttctgcgcgatgtcgacgtttttcaacacgccgctagaaggctcattgctcgccca

SEQ ID NO: 15248 - DNA, 354 bp, A.fumigatus
gtgacgcgcttggcgagaggatatgtcgtcaccaacaggaggctgggaataccataccagagacactgggagggaaattgtagcaggacagctaatccggctagaagttgggaacaggtaaaaaccaatgccttcttaggggatagggcacctcgcgcaatcggccggaattttgtgcgttcgacatacggatccagattcctgtcccataaatcattgatcgcacaaccggcgcctctcatgattaatgcacccgtgaaaaaaagaccagtagtgccaagaatctgcatgggtgtggcagatgccatgggtgccgcgatgagtgtcgagaaaacacatgggaagaagaggtag

SEQ ID NO: 15249 - DNA, 285 bp, A.fumigatus
gcataccttccacttcggcgtttcaagacctgtaatcttgggaagcccattttgcatattgagcttcgaaaatgggcccatgtcctgcttgtcgcccctttatcggcgaacacgctggcgaagatgacaatggggattgcagataatctgcttctctccgtcatcagagcatgggataccactgggaaggtagactcgggtctcaaggacagaaagcctgtagtgttcgttgctccaggtgagatgcgccaatatattacttgttcactgtcaaatctgttctaa

SEQ ID NO: 15250 - DNA, 258 bp, A.fumigatus
ctatcaatagctatgaacaccgcgatgtggaatcacccagccactaaaaggcaactcaaaatattaacagacgagtggggggtgagtcggacaaatgaagaaggttgggtcactgtacttcacccaatcgaaaaatcacttgcttgtggtgatactggtaacggtgccatgatggattggaaagatatagttaacgtagtagagcatcatcttggaatcagtagtgttaagataaaagatattcgctgcggaacttga

SEQ ID NO: 15251 - DNA, 1305 bp, A.fumigatus
ggaagaaatctgtggaagctttctccgatcacagcttattataaaatgagattgcagttctcttacttgcctcctgtccgtcttgatcagctttccagacgttatggatcagggagtagtctcttgaacgacaagcgccaccgcttactttgcaatcgcaattccttgactacctcgtcgagggtcaattcaacaggacgccaatcagcgtatactgcaaaacccaggtcagcgatcacgaagaggacgtctctcatgagatgtcagccacattcttcccagtccccatcctctacagatcgcccagcagccataacggacaataaccccgcaacacactatatacctccccagaaaggcttcattgcttctcttcccggatcatggatcccgtatgctgagttgatacgcctcgataaacctactggcacatactacctcttcttcccatgtgttttctcgacactcatcgcggcacccatggcatctgccacacccatgcagattcttggcactactggtctttttttcacgggtgcattaatcatgagaggcgccggttgtgcgatcaatgatttatgggacaggaatctggatccgtatgtcgaacgcacaaaattccggccgattgcgcgaggtgccctatcccctaagaaggcattggtttttacctgttcccaacttctagccggattagctgtcctgctacaatttccctcccagtgtctctggtatggtattcccagcctcctgttggtgacgacatatcctctcgccaagcgcgtcacttactaccctcaggctgttcttggtctcacattttcgtggggtgctatcatgggatttccagcgctgggcgtcgatctttttagcaaccatgctgctttggaagctgcggcagccttgtattctagctgtgttgcttggacagtgctgtacgatatgatctacgcacatatggacatcaaagacgatgtcgcggcggggatcaagtcaattgcccttcggcatgagcataacactaagacagttctttctggcctggcagcagttcaagtagcgctgctcgctactgcaggagtagcagcaggtgctggacccctcttttacgtcggcacctgcggcagcgcagccgtttccctcggtatcatgatatggaaggtccaattgaagaatgtgaagaactgctggtggtggttcaagaacggatgtttgctgactgggggcggcatcactttggggatgttctttgagtatatagctcaaaccactggcctgtataaaagcgataataacttacattaa

SEQ ID NO: 15252 - DNA, 210 bp, A.fumigatus
ctcaaaccactggcctgtataaaagcgataataacttacattaagaggatagcactcacgaacataggacaggattcaaggtttctttcaagttccgcagcgaatatcttttatcttaacactactgattccaagatgatgctctactacgttaactatatctttccaatccatcatggcaccgttaccagtatcaccacaagcaagtga

SEQ ID NO: 15253 - DNA, 207 bp, A.fumigatus
tctcttgaacgacaagcgccaccgcttactttgcaatcgcaattccttgactacctcgtcgagggtcaattcaacaggacgccaatcagcgtatactgcaaaacccaggtcagcgatcacgaagaggacgtctctcatgagatgtcagccacattcttcccagtccccatcctctacagatcgcccagcagccataacggacaataa

SEQ ID NO: 15254 - DNA, 606 bp, A.fumigatus
ctaatactagtcttaggtatcattcctcgcgcggcccagctcctctttgagaaactcgacggcccggctaaacacaatcgcaacagctcgaccggccttcgtacaccggctcgatactcgatcagctcgacttcgagctttgggcgggcgactgccgaaaaaaactggcagttgaaagccagctatgtggaagtacgacaccttaggaccgactccgaagcttgcagtcgaaactgtttgctaacttgcttgcagatctacaacgaacaattgcgagatcttctcctccctgaatcaacccctatgagtgatcgcggctcggtagcgatccgcgaggatgccaaaggtcgcatcattctgacgggcctgcaccaagtcaacatcaattcattcgaggatttgatgaacgccctgagcttcggctcctcgattcgtcagactgattccaccgcgatcaacgcaaagtcctcccgatcccacgcagtcttcagtctcaatcttgtgcaacggaaatcctcaagctcaattacattcgccaaaagagaaacggatgtccatgccggtcgaggggccttccggctccgatgcgtccgtcacggtcgatag

SEQ ID NO: 15255 - DNA, 492 bp, A.fumigatus
agttggcggaggaagtcgggcctccgacgaggatggcaaaacagcggtcaaagtcggtatgtgtcccgggcaatttggctccgaacgtgcgagggacaagggagagtcatgcgtctgaaccagcaagctgatgtgattacagcggttcgtgtacggcccccgctaaaacccaccgatcccggttacgagttgattccgcaacgtttccagcggtcgatggttcatgtcacgtcgccgaccagtcttgcggtcgatgtcccacaaggccggaagttgttcgtgtttgatcgcgtgtttcccgaaactacggatcagaatggcatctgggaatatctgagcgacagcgtgagctcattcctccaaggctacaatgtttccatcctggcctacggtcagtcgggggccggcaaatcgtacaccatgggaacgtctggccccagcgagcaacacgatacacaatcaatgggttcgtcgggatcgcggcatatttag

SEQ ID NO: 15256 - DNA, 2772 bp, A.fumigatus
  unsure (734): Identity of nucleotide sequences at the above locations are unknown.
gcttcggctcctcgattcgtcagactgattccaccgcgatcaacgcaaagtcctcccgatcccacgcagtcttcagtctcaatcttgtgcaacggaaatcctcaagctcaattacattcgccaaaagagaaacggatgtccatgccggtcgaggggccttccggctccgatgcgtccgtcacggtcgatagcaaattgcactttgtcgatctggcaggaagcgagcggctgaagaacactggtgcttccggcgaacgcgcacgagagggtatctccatcaatgctggtctagctgccctgggcaaggtcatctctcagctttcttctcgtcaatcaggcgcccacgtctcctaccgcgattcgaagctcacccggctcctccaagattctctcggcggcaatgcttacacatatatggttgcttgtgttacacctgcggaattccacctcagcgaaactctgaataccgtgcaatacgcacagagggcgagggccatccagagcaagccgcaaatccagcatattgccgacgaaagtgacaagcatgcagtgatcgagaggctcaaggccgaggttgcctttctgagacagcagatccgtatcgccgaggacaatgaccgacgggctgctggaccgcaagagagggctgagcgtcaaaatgaaagggagaaggagcttcaaaatcaactccttgacgtgcaagaaagttataacgcgctgagccaacgacatgntaagctgatttctgaactcgctcgcgattcggagcactccaccaatggagaagcagacgatgttgcctcggccgttggcaagagctcggtggagcgactgaagcggtctcattcttttgcccaatccgtcgaacaggttgttctcgagtatgagaaaacaatccagagccttgaatcctccttatccaatacgcgatcctccttggcggtgacggagagcactctcttggaacgcgagaccaaatgcgcctatgtcgagactgtcaacgcccaactgcaagcgcgcatccagaaacttctcgaccgtgaggccagcaccgagtcctatatgcacgagttggagtctcgacttgatgaccagtcttcgggcgaggagaaatacacggcgatcattgcggagctgcgcaaagaactcagccgtgcgcgcgaaagcgaagcggggtgcgaagagtacatttccacactggaagagcgtctcgcagaagccgaccaagacatggagctcatgcagcgagaggttgaacgcttggaacatgtgattgagcgtcagcggagtctcggcaaactcgatagtcttctctatgagctggatcatgtccaccagaacggcgccagtcacgatgaccttcaggaagaaatggattctcctgctgctgcgaggagcacccgcaattcccgtcagagagccaccaccctcgaagttttgaccgaagccgccgaaacggcgattcctgaatcagacgaggatctcgcggagaccgtcccagacattgaagaggaatcaattgtcgaagcggtgacgactgctcacgttgacggctctgatttggaggttttggaaatggtaacgagtcgcttggaaaccgatcccaatgcggagcctcgagcccagtctcctagtcttactgagtcgaagatcgttgctgataagcttgagaccgtctcccaagagctcttggacctgcgcctgcagcacgagaccacggtaaaccaatacgaactgttggaggccaaatatgaagaggcgctcagggcgttagccaaactgcaacaggacgctgcggatgaagtgcgccatccggcctctgctgtccagggactcatttccccagtcactgcttctcgaccagtgtcttttttagaggatgcgaaggcccccgactcgaagagtggaaaacaacactcgttctcgcaatcactctcctcggagttatccttggtcggggagcctgctgcttcgcaagaaccctctactaacgggcatcatgagcccgccgcagaaattcccgtggactcgcaggcgtcccacaatgagaagaactcgctcgaaatagagcggatgcgtcagctactttccgagcaccaggaaggcgttcaacttatgacccaaaagtatgccgagctgcaggccgagcatgaaggtgcccttgctctggtggagacgctcaaatccgagcttcagaaatccaagtctgcctctccgccaactaccccgggcttcaagacgaatgtcatccgaaggaagagcagccagagcctcatgtcgacggtggatcgtgcgcatcgctcgcttgctgccctgaagaacatcgcgatcgaaaaattcgaaggccagcccgacacaatgcagaactttgaggttcatcttgacgcggcgatgcatgagctgcactcgcgtatggaacgcatccagtcgttggaggcggaaaatcagagcgtaaagaaagaaatggagatgaaggcgacgatcatctctggcctcacccgtgagcggtccagcttgcaaggaggtacaccttctgtggatatgggcctagtatcccagttgcgggatcaggtagtccagcaggagaacctgattaacgagctcagagaggcgcacgagtcgcgcgaaaagaagctgctcgccgagatcgctgaattgaagggtctcctgaagactcaggaggcagctgccaaggctcaggatgcgcacgcggaggagcaagacaagcagagtcttcaccacggaggtgccggaccgcgctacgttaggccg

SEQ ID NO: 15257 - DNA, 3246 bp, A.fumigatus
tcccaccccatcacaatgagctccacaaatctccgtctactacagctgaacatcatgaaatctagggcaggaatggaggcccttattaacgatcaccaaactcagaaccttgatgtcctcctaatccaagagccacccgtcactgcgtaccgcacccacgtgaaccacagcgcgtggcgactctatcggccgacatatgccgatgaatcagcaagattccgcagccttctctacataaacaggaggatctcaacctcgtcacatcgtcagattctctgtaatcatcccgatgttaccgcggtcaagatatggactcccgaagtgcaatacctcctcttctcaatttacatccaaccggtggcaatataccaaccagcagaggtaaccaccgccgaactgatactggaagagatccagtccagcatccgacaacactccacaggcacggacaaggtgacaaagctcattatctctggggacttcaaccgccaccacccagcatggagccatcgaccggtccaccacaccttcgcggaacacgcagaagagctgatcaacttcttccaaatacacgagctccaatggtgcctaccccaaggcacgccaaccttctggtcactcagcaatccaggaaaagcgtcaaccttagaccttacattgactaacgacccgacgaagctcatcaaatgccacctctaccacgaccactatggatcagaccaccgcggaacgttctctgaatggaacctacagccagagcgtaatatagactcaaaaccaaagagagcatatgataaggccaactgggcgaggatcggccaaaagattctggaagtgatgggaccactacccgggatccactcaaactcagacctcgacacagcaaccgagaaactcgttcagtctaccgctgcagtcattaaccaagaagtcccaacgcaaaagccgtcaccctactcaaagcgatggttcaccccagagcttaaaacccaacagattgaggtaaaccgagcgcgcagacgatggcaggacagctgcgcaaccctgggcattgcccacctaacaactgcggctctcttccaggacatgcgacagaaacgccgggaatggaccaggaccgtggaaaaggccaaggccacacattggaaacaattcctagacgaggctaaggaaggacagctgtggaaggcggcgacgtacatgcgaccgagggagtcctatgcaagcatcccatctctgaaagtaggtgcgggggaaatctctgacaataaagacaaagccaaggcgttctgtgaagccttttttcctaagaaggcagaaccagaagaagaagacatagcgcctgccccagtggaaataccatgggaaccgatcactaaagaggagatccatcgatccctcaaggctgctaaaggaactaccgctccaggggaggatgagatacccaccctagtttggaaacacctttggaaatacctccagtcagcgatcacccacatcttccgcaaatccgtggaactagggtactatcccaaacggtggaagcaggcgcggatagtggtgctgcggaagccaggtaaaccggactacacagtacccggagcctatagacccatctcactactaaacaccctgggcaaaatactggaggctgtcatggcccgaaggctgtcgttttgggcggagacctataaactgctcccagaaacacaatttggaggcagaccaggacggaatacggaacaagcacttctggtactcgcaaatgcagtcgaccgagcatggtcacgatcaaaggtggtcacgcttgttgcgtttgacctcaagggggctttcaacggagtcaacaaaacaagtcttgacacccgtctgcaggctaaatgtatcccaacgacagccagggtgtggatccgcagctttatggaggagcggcacgccagcatcaacttcgatgactaccagacagacattaccctgctagagaatgcaggtctcgcacaaggatcaccgctgtccccgattttgttcggattcttcaactctgatctggtggatcaaccagtggacaacagtggcggagcgtcggcgttcattgatgactatttccggtggcgagtaggcgcctctgcggaggagaatctcaagacgatccaggaagaggacatcccccggatcgaggcatgggctcggcgaactggctcctcttttgcagcggagaagactgaattgatccacctgacaagatctaaaaaagaacaggtgacaggacaaatcatcatgaacgggaaggtcattaaaccaagcgcctcagcaaagctactgggcgtcatctttgacaaggagttgcgatggaaagaacatgtacaacaagcaattaaacgagccaccaaagtcaacattgcactcggtgggctacgacatctccgcccagaacagatgagacagctttatcaaacatgcgtgacaccagtggtggactacgcgtccacggtttggcataacccgcttagggataaaacccacctaaggctgcttggaacggtccaacggaccgcgttgctccgtgtcctctcagcatttagaacggtctcaaccctagcactcgaagtggaatccaacatgctgccaacccgccttcgtcttaaacagcgaggccagattgtggctgccagtctcagcacactgccagaaagccacccagtacatggcgtaataaaacgagcgagaacacgcagcactcatatagggacaggctctcggttccctctagcagaaaccatgcggacaatggaccttgcccggctacaggccctggaaaagatcgaccccacgcccctggcaccgtggcggaccccagcctttaccgaaatcgacatcgaaccggacagagagaaggcaaaagaaaatgcctccgccaggcagaaggcagccggtgtcacagtgttctctgacgcatcaggccaacagaaccaactgggggccgcagcagtggcccttgaccaagatggaaacattacccattcccggcagatcagcgtgggttcgatggaatattggtcagtgtacgctgcagagctcatggcaatatactacgctattagtttggtctatcatatctcacagaagacacaagaggccctgggcaccggccgagagccagcaactatcctgacggacagtatgtccgtcaggatcgttggtcttcaccatcgggaactagacggatccgcgcctagagtctacacc

SEQ ID NO: 15258 - DNA, 405 bp, A.fumigatus
aaggtcatagaagaaaacgacctaggcagcaaaggattccaaattgaagacatcgcgtggctgaaaaagaaggatcaccccttaaggacatcggcgtcgcttggtatatggctaaacacgccggaagcagcagaatacttcattgccaatggactactggtcggccagaggtacattgggagcgtggaaccataccggattgactggaaacgatgccaccgctgtcaacaattcggccatctagcctgggcctgcaaagaacaggcaagatgcggatactgcgctgaccaacatgaataccgtaactgcccacgtgaaatgagaccaaggtgcctggactgtgatggagaacatcccaccggagaccggaggtgccaatcgcttaatcccaccccatcacaatga

SEQ ID NO: 15259 - DNA, 450 bp, A.fumigatus
gtttcaggcaacacctttactccagtaccatataagtgtatcgttgaagtgcggtctggctttctctctactttgactctcaacgaaccccatccaagcaacatgcaaccagttaagcattcagtcatggacgtgcctctggaaggagaatatgtttcctttgaacactcccttatggctctaccaactgagctgcatttacaaatctcctcctatctttcttatcccgacgctctggcactcaagcacacctgtcgtcatttctactatcttgtctataccggcgttcatctcaaagtagactggctcgtcgagcgttttgagcgcaagctcgagtgtcctatggagaaatgctcctttcggacagacgagtcgttttgcaattcaagaatcaggggaatcatggaacgccgacgacgacatttggagtgtcctcgaagaagaggatga

SEQ ID NO: 15260 - DNA, 2205 bp, A.fumigatus
ccagttgtgcttactgtaaactgtctctcgacggatgggaacccaaagatgaccctttgtcagtgcctcatcgctccttcccacttgatattcactgacttgcctagtgaggagcactaccgacggtcatcggattgttcgttctttgtctttgcccagcctcctgggaagaagtcaaaatcttctcgatcaaaaaagtctcgagtttcaaaagcgtcgtctcgtctctcgacccagtctacagtatcggaagcgcccatgaccgcgcttgacaaccaaatggatgaggatgatattcctcagccaccagcaaaaacgaaagcctcaaagaaggcatcaaaatccaaatcgaagaccttgaaatctaagaaggatgatactctggagcctgataaccagatggaggtagacaccatggaatatgtccaacccgaacctgccaaacccaagcggaccagaggcaagaaaaggtctagcgaggaaatggatccagaagagtctaacatagctattgctgaaaacattcaccaatccgaacctccgaccaagaagagagcgacgaagtcgcgcagcagcgctattcagcgagaagaaagcactcgcggtgacgttgctattgcagaagtgcatgaagaggacgaagaggccttgctcgaagctgaagctaagaaagggcgcgcgaccaccaagaagacatcatccaaaagtcggaaggtttcagagggttcattggcagaaaaggcggctctggaagctcggttaccgcgagattccgagctggatgcagcaattgtagccgaactcgaagccgaggagcccatggccgaagagtctccggcagagacacacaagtcttcgaagaaatcgaagtccaaaaagaaaacaaagaaggccgcagaagagccacccaaggtgcagcacgatactgtcgagcgaaacgaagagcaggagttgcgtcgagttgacgacgatgaatttatctataggcggacaagtgacattcagttgccggccgagcagccgaaaccagctaaatccgctaccaagcaaaaaacctcaaaagaggaaaggctttcagaaaagaagacacccgagtcacctaggagtcgcccagcaactatggttgactcgccagaagttgaagctgaagctgatcgcaggcaccaaagatctctcgtgtcggtggaggtaacagcgagggatccagagcaagacttcgaacccgaaaggagagatagtggttctcaaatgaagaaagcgaccaagaagtcctcgaccagcaaagcgaagaaaactagtcacacaagggccacatctccagagtctggaaatcctgcatccgaaaggcctgatacaaggcatagtttgaagcaggaggcacctttgcaacccgaacaaaaaacaattcctcgtcacattcaagatcaagtacaagagcaagagctagagccagaatcggaaccagagctagagcaggacccccaagacgacatagagcaagacagggaggtagacccggagccggagccggagccggagccgcacctgggagtcgacgaaacgcctgtccgtcgtcggtcatccaaagtcccgccgaagacggctgagagattcagcgacatcccccaagagaagcaatttgccaagtcaattgcggaaactcgaacgccgaactcccataaagtgccacaagctagtataaactctagccgacaggaaagcgatgcggtgtcgcctcttccttccacttcgaagagttcgccatcttcatcgccccagtcttccgatgctgagaaccaacctccaaccatacaactgtcggctccaaggacgcaactagcatcaccgtccaaggagaaagcggttcgcattcccttggctaccagtacgccctcaccgtccaagcgaaatgcgaactctggcgcactcaggagtttacacccttggacgcccattgacatagacgaaattctctacgcctcaatgagcgataaggagaatgtggatgtaggggctgctctggagagtatcaaaggagatcttacaagtcccgagaagaaaatgactgtagaagagtgggtttactggcatgctcggaacggagaagaaaagctcaagcgcgaatgtgagagattagtcagtcagttcgagaaggaaggggccagagccatgcgcgcactggaagggatcgagtgcattgattga

SEQ ID NO: 15261 - DNA, 228 bp, A.fumigatus
  unsure (123): Identity of nucleotide sequences at the above locations are unknown.
cgccttgtactatgcgataatgccgagtcgaccttcccaggaatcttcctcctgcttgatcccgttttctccattcttccgacgcttttcgttcctcttccttctcttttcctctctctcttnggcctcttgttcctccctctccttcaatctttggccaagatccaactgccaggcacgccgttcttcttcctccctgactcgcttctgatgagccagaaatcgtaa

SEQ ID NO: 15262 - DNA, 549 bp, A.fumigatus
agaatttcgtctatgtcaatgggcgtccaagggtgtaaactcctgagtgcgccagagttcgcatttcgcttggacggtgagggcgtactggtagccaagggaatgcgaaccgctttctccttggacggtgatgctagttgcgtccttggagccgacagttgtatggttggaggttggttctcagcatcggaagactggggcgatgaagatggcgaactcttcgaagtggaaggaagaggcgacaccgcatcgctttcctgtcggctagagtttatactagcttgtggcactttatgggagttcggcgttcgagtttccgcaattgacttggcaaattgcttctcttgggggatgtcgctgaatctctcagccgtcttcggcgggactttggatgaccgacgacggacaggcgtttcgtcgactcccaggtgcggctccggctccggctccggctccgggtctacctccctgtcttgctctatgtcgtcttgggggtcctgctctagctctggttccgattctggctctagctcttgctcttgtacttga

SEQ ID NO: 15263 - DNA, 225 bp, A.fumigatus
aagtacccttcatgcgttacttccagccatctgcacgacctcctcgtacctcctctacaatctctctccaactctccatttatcatctcctctgtctctccggagctccacttcatgcgtgactctcccccctgctccagacctcgctactataatactcatcctcataacctaatcccccccttactcttccgtccctacgaatacctgtactacttcctcccc

SEQ ID NO: 15264 - DNA, 855 bp, A.fumigatus
  unsure (742): Identity of nucleotide sequences at the above locations are unknown.
tatgctccccatcagccactgcctcaccgcccgccacttccgcacctctattgccatcatcactacagaaggcttcatctcccatcttcacagcaatctcctactttgagaaatctcacctccatctccgtaccgaggacgtacagaataccgcctgagcaaacccgccaaaagtcttcccatcaaaccctccttacaatgtccgacaaaggaaacaccgcatacggacccccctcatcagataccgccttccgcaaaacatgggaccgagaagaatacgccaaaaaggccgcagatgaagaggcgaagcgcaaggaagagggcaaggcgcgctatgaggcaaagctcctaggcaaaaaatggcacgcgccggtggactatagctcgctcgaggcgacaacctcgcgcaaacagcgcctcgatgtcgcctcgatggtgggcaagacgacgattgttccagcgggatcggcagtgggtaaaaggggtcgcggtgccggtttctactgctccgactgtgatcttaccttcaaggataatctgcagctggtggagcatttgaacagcaagcaacacttgattgcgacgggtcagagtggcgaggtggttcgtgctagtttggaagacgtgcggcagcggttacgatttctggctcatcagaagcgagtcagggaggaagaagaacggcgtgcctggcagttggatcttggccaaagattgaaggagagggaggaacaagaggccnaagagagagaggaaaagagaaggaagaggaacgaaaagcgtcggaagaatggagaaaacgggatcaagcaggaggaagattcctgggaaggtcgactcggcattatcgcatag

SEQ ID NO: 15265 - DNA, 183 bp, A.fumigatus
cgtcaaccaagcagctctccatcagtaccacatgtatatatctatgacaagactggtcaattcaacaattgctctcactatcagcaattaaaacaaaatctagccaaaatggtaaaggataaatccaccgtcatcgagtacgtccgcctccctcccctttaccagattgccaatcccatataa

SEQ ID NO: 15266 - DNA, 564 bp, A.fumigatus
tataccatgggcaaatctagacctcacaagaagaaggcttcgaagtcgcgtgaaaagtccgttctccgagccggtggttcagtgtccaaacagaaaatggccgatcctgcgatactccttgagcaagcggtcgtcttacttcaaacagggcaagcagatgcagcgcttgcagcagctcagcaggctttcaactctgcgcccaccaattcccccgctcaactatctgccctgaacactatcggcgagatctacgtcgaactgggggatatcaatgctgcgagagaatgctttttacgtgcggtggagctcgacccgaatggcacaataccagagtccgaagggggtggtgcggagaagtttttatggctggctcaattgagcgaagtgggagggaaggatagtgtccagtggtttgagaaaggtgtctcagctttaaggacaatcatccagcagttggaggaaaagcaggaccctcaaaccgctgctgagttggcggaaaagaagaagaagatggcgaatgcactttgcggagtagcggaaatctacatgacagatctctcgtga

SEQ ID NO: 15267 - DNA, 696 bp, A.fumigatus
catttcaccgaaacatattcatggtggagtaatctgacagtctccagttgggaggaagatgccgaaaaccagtgcgaatctctcataacggaagctctcttggtcgatcctcaagcgcccgaagtcctccagacactagcatccatcaggatatcccaattacgacaagatgatgcgcgagccgcactctcccgaagtcttgagctatggaaagacttgcctcctgaagatccaaaggttccggagtttgcaactcgagtcagtcttgcgcgtctactcatggaggttgcaatggaattggaagccctcgaagtcttggaacgtttgattctcgaagatgaccagagcgtagaagcatggtacctcggcggttggtgtctttatcttctcgcggagaaacgacaggcccccaaggacgcagaagcagacgcatcgcccgagtcacaacgacaagcttcccttgttgccagtcgcgaatggttgaaacaaagtttgaccctctacgacctggtccagtatgaagatgaaagactcaaggagcatgctcttgagctggttgatgaaatgaacaaagaactaggcgaggatatggaggatgacagcaacgccgaagatgccgaaggggaggaaggggaaggggattgggaagatgagattgaggacgagtcagatgaagaccatgagatggcggattga

SEQ ID NO: 15268 - DNA, 651 bp, A.fumigatus
cgctcagatatatccgacaccgcataccggatatcgattaatttagagacgcccgaaaatgacgcccgaggtgaagaagaaaccgaacagccagccctgattcttcaggtatcatacccaccagaatatcccgacgttgccccggaccttgagatctcgtcccctccaaatgcgcccaagcaccctctgctagacattcaggaagatcgtgaacggctccttgaagctttacagccgaccatagaagaaaacctaggaatggctatggtcttcaccctggtcagcactttgaaagaaagtgccgaactactcatggctgaacgggcgaacgctgtccaggccgcgaaagagatggaagccgcgaaggcggaagaggaggagaatcggaaattccagggcacagcggtgactcctgaaacatttttagagtggagagagaggtttagaaaagaaatggaggaaaaggagcagagggagcgcgaggagaaagaggcggacgaaaagagggcaaaaaaggcaccggtcaaagaagaaaagaagcttactggcaagcaattatgggagagaggtttggcagggaaagcagactatgatgaggatgatgaggatgctattccggccgctgttgagaagatcaaaattactgcataa

SEQ ID NO: 15269 - DNA, 288 bp, A.fumigatus
caagcgctggcaggctttctcatgctcatgccgcgctgcctctactctcttatcagcttcacccaggtgcttactgctcatctcgattctgagttgggcgtcttccttttgctgcttctgttgctgcgtggattgctccaggatttgaaggacttctttcacgtgtttattgacccgagcgtcaatatcgtcttcttcctttcggtcaccattccagagataagcgaggcagttctttattccaggccatcctgcatcgatggttatttaggccatgacataggctag

SEQ ID NO: 15270 - DNA, 213 bp, A.fumigatus
gaagcaggttcgattccaactggaagatttggagtattccctctctgggtagacaggttggcaaacagcctatatgtcgaaccacatcacgttgcaatctgcagccagcagcccaagggatcgttctctattggacatgataaaatcgtcgtgcagatgggactagtcactgcatattccattggactacgccccactcagaccggcaaatag

SEQ ID NO: 15271 - DNA, 1281 bp, A.fumigatus
cgaccaacttcccctacagatgacaagacagacgtaccgtgttgcacatcatttgtcccagatactccgacgtgcttgggaagtgctgctgcccctccatttaatgaagggcacgacctgcaacctgatacgtgcactggagcagcgtcaccggctagggtcggctcgactcatcttttgcattctcttcatgacctagccgaagagcaccttgacaatccacgtcatccagacgttcattacccggagacaccggactgcgtcggtgctcttggaccggatacagtgcccatggattgcgtcatcaacctcgacgagctcgagtcttgtccacccgtatcttcaccgccggagtttaacatggacgtacaagatcccctgcagcaccccggcgtggagccgaaagatcttgaagtgctgttagctgctgtgccttcagatgggcttggtcctgatgttcaattccaaactaggcaagagctcggggtaaatcgtgacggcaacagtgttgttcccgtacatgccacaggagtacggtcaaaggatccccatgtcgcaccgaattctcccaattccctcggctttcggccttgccctgaaggctaccttgagttctctcatgttgagattcgaaaccatcgtcccttggagaacaccacatcttctattgaaaccttggaaaacgtcaccagtccgagttccagttgttgtcattccaaggaaaccagtagaacgtggtgcttggatgggtcaattctttccattgacatccagaatgcagactttcctatcggccttggaaagtcctccttccacgtgttcgaaaaccaagttattcagatacttacggtcgttcatggaccagtggaagcttttctctctcagaagacagctccaagcaccaaggtcaacaagaaaaagcggaaatttagccgtcctgcagctgcagcagctgcagcagctcctctgtcctctgaacaaaagcagtacctgctggagctaagggatcaaggtcatacatggaatgacatcgttgctaaatttcccggaagaaagataggaacgctgcaggccatttattatgcaaaggtgaagaacctccgcaatcctacttcacgagaccagcgctataccgggcggccaaaatcagccgctcgaagctcccaaggcctctctcgcacacgcgggaacactattggtactggtgtcagtacagtgtgtcaaacagagaatgaagtaggatattcgcgatacagtctgcgcccaaggggagtgcgatag

SEQ ID NO: 15272 - DNA, 234 bp, A.fumigatus
gatctaccatgttacagttcagctaattccctattgtacgtgtccgtccagtccatcgtcattaagggaactcgctcagcagacaatggcttatcaaatccggcgaactatcatcacatccgcattactcacatcgaatcactcttgcggttggctgtgatgacttcgccaaagcagtggggttgcaatcaactgctcaaatggacccttccatggggcaatggcaatgagtga

SEQ ID NO: 15273 - DNA, 315 bp, A.fumigatus
actccatttttgctcttcaaagcttgttgcgccctgtccagtctttcttgcctcccttgcgagtggtcgaatcgagacaccatggaggccatcaacgcgaaccctcccccatacaggactgaaaaagtcgaagagaccaagtacacatcggactatgaggaggagggtcaactcaagactggtcaggttgcagatgcctttggaaacgaggagtctgcagagatcaagtacaagacgttgaagtggtggtatgtgttggaaattctcatcagtgggctcggatctttgctgaccattgcatttttgttactctag

SEQ ID NO: 15274 - DNA, 294 bp, A.fumigatus
catgctcgcagagctgtcattttgattgtcggtctcggtttgctcgcaacctacactggatacaacattgggttatttagagaaagatatcctagaattcagaaccttggggatgccggagagatcctgatgggccctattggccgggaaatctttggtctgggtcaattcttattttttatcttcgtcatgggaagccatatcctgacctttcgggtcatgatgaacactgtcactgagcatggcacctgctcaatcgtcttcagtgtcgttggcatgctcatctgtatgtaa

SEQ ID NO: 15275 - DNA, 198 bp, A.fumigatus
gctattcccaagctcctatatcctctcctttctgccgatcttcatttcgtctactggtctgggcagctgttcatggctaccaggcactcctctttccttactgcccgtcgtcttgctgcagtaattctctctgttaagttgccattttcacaaggaagaactgtagaaatgccaagcgttggattggtcaactcctaa

SEQ ID NO: 15276 - DNA, 420 bp, A.fumigatus
ccaactctagctttcctgagtattttctctgcggtgatgatcaccatgattggcgtcgccgtccagttcaaaggaggatctaacatcagtgttaccgccgagaccaacctttatcacgccttcactggtgtgaccaacattgtctttgcgtactgtgcccacgttgcgttctttggtctcattgcggaaatggaggaccccaaggagttccccaaggccctgtgcatgctgcagttctttgagattgcgctctatgtgacagccgccattgtcatctattaccacgttggaaacgatgttgtgtcacccgcactgggctcagccggtccgctgctgaagaaggttgcctacggtattgccattcctacggtatgtacaaatctcacctcatcgtctgctgtgcaaacgctcaccgtgtga

SEQ ID NO: 15277 - DNA, 225 bp, A.fumigatus
attgtcggagccggtgtagtcaacggccacgttggattgaaatacatctacgtccgcatcttccgcaagactaatcgcatgcacaagcgcgatcttgtttctgttggctcatggattgccattgggttgagttgctggatcatcgcctggatcatcgctgagggattcccttcggtcaactattatggcaagctgaagtggtatggcattaaactcggcgtgtag

SEQ ID NO: 15278 - DNA, 582 bp, A.fumigatus
tctacaagaacggccagccatactacttccgggagaagtccaagctcttcgactgggtcgaggatggcctgcgggtcaagttcgagcccctgtacccctgcggcctcatcatccggcccagcgacattgacgactcgcgaccccctccatccatcagccacctgccaatgcacaaagtccgccagctctctacgggactctccccggtcgttctgcgcggcttccgcgaaaccctcaaagaagagctatacgtccagaaagcatccgagctcggcaccatcctcccctggagcttcggcatcatccaaaaggtgcgcgacgccggccgcaccgacaagctcggcaacaacgtcacctccaacgaggcaatgccaatgcactacgacggcatgttcaagttcgaagaggagacagactccgtcacaggggaggttaagcgcgtccaaaagcccccgggataccagttcttcacctgcccggccaccgcgcccaagggcagcgggtacaccctcttcgccagctcccggctcttcttccgctacctgcctctgccgtggaccaccgagcggctgcagaaggtga

SEQ ID NO: 15279 - DNA, 1179 bp, A.fumigatus
caaagcagctatattccgcccaaatggttggagcaatatcgtcccggaaaaaatgttgctgccgccatcaaggccaaccgtgccgattatgtccgtctgtccatccacgagtcaaacggggcaaggaaactgtccatctcgctcgtcccacaggtccgaggcgtcctcgggtacacaccatggcattcgtcgattgcagtcgacgctgacggcacactccgcgcagttcacgccgaggatgtgcgtgagacgcacgagctagtctacaagaacggccagccatactacttccgggagaagtccaagctcttcgactgggtcgaggatggcctgcgggtcaagttcgagcccctgtacccctgcggcctcatcatccggcccagcgacattgacgactcgcgaccccctccatccatcagccacctgccaatgcacaaagtccgccagctctctacgggactctccccggtcgttctgcgcggcttccgcgaaaccctcaaagaagagctatacgtccagaaagcatccgagctcggcaccatcctcccctggagcttcggcatcatccaaaaggtgcgcgacgccggccgcaccgacaagctcggcaacaacgtcacctccaacgaggcaatgccaatgcactacgacggcatgttcaagttcgaagaggagacagactccgtcacaggggaggttaagcgcgtccaaaagcccccgggataccagttcttcacctgcccggccaccgcgcccaagggcagcgggtacaccctcttcgccagctcccggctcttcttccgctacctgcctctgccgtggaccaccgagcggctgcagaaggtgacctggggcatggacaacgacggcttctgggacgccaagctgaagaatctgcccctggtggtgccgcacccggtcaccgggctgccgtgcatgcgctggcaccagccgtgggattccaccaagaccaagttctcgacctgtgcggtcacgatcgagaacgacgagcaggagctggcctcggtggtggatgacctgacgtatgactaccgcgtctgtctgcgcttctcttgggagcagggtgatctgctcgtcagtgataatacagccatgctgcatacccggacggggtacaagacgaattgtgagcgggagctgtggagaatccactttgactaa

SEQ ID NO: 15280 - DNA, 186 bp, A.fumigatus
ggcaaaggacgtcatgtcagagcgaggtgtcgcgcccatagggcccaaggggtcaccgtatcccaagctgttctcaatatctcccgtcacgattacagtcctggccctacatatgttgcagtctactatggagacaacgctaagacctatgtcttctgcccagagaactcgtcaacgtcggcatag

SEQ ID NO: 15281 - DNA, 186 bp, A.fumigatus
tcgacacaactttgggtctggattgtcgggtctaagggcgccaattgggatgctcgggatagtggtaatagctctctgagtcaacctatggaatgtgatgagaagatcgaagtcattgcagagacaaacggaagatatatagtggttatatctgagttgatgagtatattgagcgccagaatttag

SEQ ID NO: 15282 - DNA, 1242 bp, A.fumigatus
agacatttcaagaacttgaaaaggagacgaagaagcttcatgatgagtccaggaagtattttgaagctattaatggtactgatcagctcggggtcgatcctgttgagtaaggtctgggtagcaagatggactaataatcatacaggcatgttgagtcaccagattgaattctccaaagctatgacagagttatataaacccatctccggtcgcgcttcggaccccagcacatacaccattgagggtaacccggaaggaattcgagcctgcgaggaatacgaagccatcgtccgcgacctacaggagtcacttgcgcccgagctagagttgatcgagactcgcattgtgagtccagcaaatcaattgctggaggtcatcaaggttattcggaaggtagcggtgaagcgagatcacaagaagctggattacgatcgacaccgcaacactctgaagaaactccaagagaagaaggacaaatcgctgaaggatgagaaggctctctacaaagcggagaatgacgtagagcaagccacgcaggaatacaactactacaacgacctactgaaagatgagctaccgaaactgtttgccctcgaagctgagtttatccgcccgctgtttcagtcgttctactacatgcagctgaatgtcttctacacgctgcatgagaaaatgcagggcatgaatatctcctatttcgatttaactctggatgtcgaggaggcattcgagaagaagcgaggtgacgtcaaagaacgggcagaagcacttaccatcgtccatttcaagacgaagggcctgggccgacaaccctccaagttcacacctcccggtaaggacaagatggcgtacgagagcaagagcacgttcgcccgaacgaatcgcgccgatgagactgataaccctcctccaccctattcggcctctgcaagtactgttgcggccgccaaggctaagccagctcctccaccacccaggcccaagcccgcgcgattgggtgcggcagtcgagacggttacagctttgtatgactacgaagcacaggcgcatggtgatcttagcttctcagcgggtgacgtgattgagattatccagcggacggacaaccagaacgagtggtggactggtagagttgatggacgagagggccagttcccaggtcagttttattcacgtgttcttctttctatcttgaagactaatcttcttttcactgcagcaaattatgtccagttgcattag

SEQ ID NO: 15283 - DNA, 357 bp, A.fumigatus
caggccgccagacaatccctaaacttcaatttcactctgcccaccaaaaccgccaacctcgacaacatctccccaccccctcgctccctcatcccagaagttatcaccgcacttcccccctcggtactaatggaactcatcatcccgtcccagcgcagcgccctcgccagccagttcaaggccggaagcacacccgcctggtacgccagtctccccagcgatgtccagagttacctgtccgtggtgaagagccagatctccgagggcgcgttgacggctaccacgggcctggcgtatcagactgcggctactgcatcggggccttcaccacgcggatggaaggaaccgaacttgcga

SEQ ID NO: 15284 - DNA, 381 bp, A.fumigatus
  unsure (44): Identity of nucleotide sequences at the above locations are unknown.
caccattctctcgagggcattcaagatacgttcatggatttcgncggcgattcagaatttggctttgggtctatggatgagttcatcaaccctgaaatgttcgccaatgcgcagtctgaggatactcccgactctgtcgaaaccggcgttgcgacgcagacgccaaaggatagcgaggtcccaaagatccaagatgctagcggcaagtttgatgtctctgatgatagctggatcccgatggactggatcaacgttccttcacgttttgaagacgcgctcgtggttaatgactcttgggagaatttcgactggggtacagttgagctgaacaacggggccatgactgttgacgacaacggcattgccatctatgccatgtaa

SEQ ID NO: 15285 - DNA, 1104 bp, A.fumigatus
  unsure (1076): Identity of nucleotide sequences at the above locations are unknown.
aaggatatgcaatgtgtacggaactgcgactctccagaccctaaatatcggcaaacattcgagcagccggtcgtccagacgtgggtttccccccctgtatccactatgttacacaatcaaatgctaatgcaatgccgtaccgatgatagtgttcagatgttcgtcggagaaatgggctgttggctcgtgatatgggcctctcatatttaccaatcgttcatatatccgcgtctgtcgcccaattcttcgcctctccttgcaggcgggtataaccccgtccaccccgatgacataggcgatgaggaggaccatacgattgacggtcctgatgcatctaaccatactctcaagcgtaccgatgctgagggtcggccgtacctcagtggacgtcggatcctccttctcgctgcgccggcatgctgcgatatcgcggggacgactctgatgaacgtcggtctgctcttcgtcgcggctagcatctaccaaatgactcgtggagcattggttctttttgtcggtttgttcagcgtcctgtttcttcgtcggaagctgttcctataccagtggattgcactgttcgtggtggttcttggtgtcgccttggtaggacttgccggtgcactcttcggccagggccatggccatgacatgtcacgggacgatactcttgcaattgccactcgggctgtgatggaagctcgggagatagcgaagactcctgaagcgctcaaggctgtcattggtgtgctcttgattgcagcggcacaggtcttcacggcctctcagttcgtgctggaagagtggattctcgagaactacgcgatggatcctcttcaggtcgttggttgggaaggcatcttcggcttctccatcactgtcattgcttccatcattctgtaccttactgtaggacggacggaagccggtcgctacggctattttgatgccaaagaagcctgccgacaattttcttctaacaagtacattgccatggccagcattcttattatgattagcattgggttcgtgattccgcacagcatctctctccccttctctctttctctctctgcgtngtgcaaatttccgagtacaagaggctaa

SEQ ID NO: 15286 - DNA, 366 bp, A.fumigatus
  unsure (46): Identity of nucleotide sequences at the above locations are unknown.
ttccgcacagcatctctctccccttctctctttctctctctgcgtngtgcaaatttccgagtacaagaggctaatctgttgctctctcacagaggcttcaacttctttggcctttcagtcacccgaactgtatctgccacctcccgtagcacaatcgacacctgccggacactcttcatctggcttgtttcgctcgccctcggctgggaaacattcaagtggctgcaagtcctgggctttgcgcttctcgtctacgggaccttcttgttcaacgacatcatccgtccccctctcaaagcatgtcttccccgtgacaggcaggagaggcagattctgctgcctgaggagcccattgagcacatatag

SEQ ID NO: 15287 - DNA, 357 bp, A.fumigatus
aatagacaatggaccgaattggccgccaaagctctggcggtcttcggctgcatcttcctcctaacgctgacgagcgaggagttcattgtgcctgtcctcagcgaggctagtgcccaactacccctggtccacggcgccccagacaaggcactgattctggctgagaccatcagcatgctcctgttcccatttatgataacattcctactagtcttcctggttatcttcgagtacgtgctcggcgcgtttgcagagatcacccgcttcgccgaccgccagttctactcggactggtggaactcctccgactggtacgtgttcattcattttttccgggccagcagtaacgcaatctaa

SEQ ID NO: 15288 - DNA, 324 bp, A.fumigatus
cgcaatctaaccggcacattgtacaggctcgaattctcccgcgaatggaacatccccgtgcaccacttcctccgccggcacgtctactttccttcgctctcatacttctcccagcccgtagccatgttcatcacgttcctcgtgagctccgtcttccacgagctcgtcatgagctgcatcaccaagaagctgcgcgggtacggcttcctagccatgatgctccagatgcccatcgtcgccgtccaacggtcgcgattcctccgcggcaagaggaccctcaatgtgcgtctcctctccttcttgatcatgggatcagctcactaa

SEQ ID NO: 15289 - DNA, 1266 bp, A.fumigatus
cgggatagaaatggtgtgcctcatgtggtactgcctgcgtggcaagactgttacgagaatgcagctcgagcagaatggctcggaattggtgtctatggcaacaagagccgcgcgcctaacatcgacgccaaagagctgagcaaggcgttgctcaaggtcatgggtcacaggtcgtacaaaaccaaggcaatcgagctggccaagctctgccgcaagaaggaaggccgtgtagcggcggctgagaagattgtcgagctggcgctcaacccagacagaatggccatgcacatgccagaggtgaagctcgaagacaccaagcgccccctctacaagatcagaaatcgtgctgggatggtcctcgaaaccgcgcaaccttctgaaacaacgagcaaatctgcccgtgtgccaattcttcgagacatcaaagaaaccctcgtcgtgactacactatgcaatgcctggtttctcttcccactactcggatactcccttctactcgtcccccgactgcgtctctctgtcctcctctacatcctctacgtcaaatatctcgccaaagcacacaaaaccggcactttagctctccgcaacgaccgcctccgcacgtcctggatctggaaagcctacgcctcctacttccccctccgcctctaccgctcggtgcccctctccccccgcaaaaagtacatcttcggctaccatccccacggcatcgccctccgaggagcactcgggaccctagccgccgacgctgccgcattctccgatctcttccccggcgttacgaacacgctcctgatgaaagacgaggcgttctaccagcctatatatagggagtaccttctctctacgggggtgagcggcgtgtcccactcgtcgtgtatccgacacctgacccgcgcaggacatgatgggcagggtatgggccgggcgattaccatcaccgttggcggaagtcgcgagtataacattgcgcggccggggacgatgtgtgtggtcgtccgcatccgcaagggctttgtgcgggtggcggttgagacgggggcggatctcgttcctgtcattgccttcggggagaatgagctctttgattgtgtgaatgtgtcctcgtcgactgtgctgggggttgtggccagggtatgggagtgggctgttggccacaaggtggcgttttcgactggtcggttcaacatcttctgtccgtatcggcggccggtgaatgttgttgttggggcgccgactcctgtgtgttttatgagccgccgc

SEQ ID NO: 15290 - DNA, 612 bp, A.fumigatus
aaacctgtcccactacgtaccaccttgtctccatcccaacatcttgcctcaagcacttcaatggctactccgacccgggtattattcctcgctaatagcgagcacggccagacgaatatcatcctggccatcacccatgagctgcttgtccgaggagacgtcgacgtacatattgcctcgttccctgcattggaaagacgggtgaacaaactcttgaatgacaatgccccttcctacgatgactcgtttcgatcccgcatccatttccaccccattcgcggaccctccaatacagacgtgttcattcgcacgggcaagcgaggagcgttccatcctcctggctacagcggcgccgtgctcggcttccagtcactctgcgaagacatctggggctggaccgaagacgaatacgttgatatctatcagtgctgtatggaaatcatcaagtcggtgcagccttcggtgattgcagccgactttttcttcctgcagggccgcgatgccgctttcaacgctggctacacggccatcttgatcaataccacatcgctcactcatatcgtgctgggcctgcagccacattccgctgctctatggaagtatccattgtaa

SEQ ID NO: 15291 - DNA, 249 bp, A.fumigatus
atgacaatgccccttcctacgatgactcgtttcgatcccgcatccatttccaccccattcgcggaccctccaatacagacgtgttcattcgcacgggcaagcgaggagcgttccatcctcctggctacagcggcgccgtgctcggcttccagtcactctgcgaagacatctggggctggaccgaagacgaatacgttgatatctatcagtgctgtatggaaatcatcaagtcggtgcagccttcggtga

SEQ ID NO: 15292 - DNA, 417 bp, A.fumigatus
  unsure (54),(55): Identity of nucleotide sequences at the above locations are unknown.
cgtgtggctaagttgcctccttcgatagtgtctacctgtctcgcatttccagcnntcggcagcagactggactcataccttattgctctcgaagcatgtgacgaactcgaactggttattcgacccgattttgccttggaggcttttacgaaggattcggacaatactgaggagcatcgaggtcaacaaatccatttccagcgaggtatgggcaagaactacgaacgtttagagttcctgggcgattgtttcctaaaaatggcaacgtcgattgcgctattttctcagaacccaaatgatgacgaatttgattaccatgtgaaccggatgtgcctcatttgcaacaagaatctcttcaatacggctattaagaagcagatataccgatacatccgcagccggggattttcaaggtag

SEQ ID NO: 15293 - DNA, 300 bp, A.fumigatus
actttcctccacaacaagctgacgaacgagtacggctgtacaaactactgcttgaaagcaggagaattgcctaccattgacggggcgccagctaccgtccttgctgctgtcattgtgcacggtaacgtgatttctgaggcaaggtcgtcttccagtcgctatgcaaaaatcaaggcaagtgagaaggctttggcagtgcttgatggtcttctgccctctgaattctgtcagaagtaccgttgtgattgtaaagaaacaaagaactcttcttctgtaatggagattgggactgcgatttga

SEQ ID NO: 15294 - DNA, 201 bp, A.fumigatus
  unsure (194): Identity of nucleotide sequences at the above locations are unknown.
aaagttgaagatatgtccctaccgatcaagcgagctcttgcccttgttgaagctatctcaggtgatctcgacacgccaattcatagtctgcttcaccgcaaaaccattctgcacctggaactatcgcgaaattcggttcttctgatgaagaactggtggtgcgaactgggcaaactggggacaaaaaatctgangggagtt

SEQ ID NO: 15295 - DNA, 615 bp, A.fumigatus
cctcgagacagagacttgaatttatatgatgctgacagcttgaatggcagacacatatggtatcctgatgggttgacgttgttgcatgggaaggaccacagcacaaagctcctctccgaaggaaagcatgcccttggagaaaagacgattgctgacgtttgtgaggctctgatcggagcatcgttgctgtcaggcggccccgaacataggtttgacatggctacgaaagcagtgagtgctctggttgacagccccagccaccgcgtctcctgttggaaggaatatatcactctctacactctgccgaaataccagaccgagaaacaccgagggtctgaggatgatctagctcgtcacgttgaggaggagctgggttaccacttcacttatcccagactcctcgcatctgccatcacccatccttctctcccttcgacgtggggctaccgtgtgccctgctaccagcgacttgaattccttggcgattcgctgctagatatggtctgtgtggaggacctatttcggaggtttcctgatcgagatcctcaatggctttcagagcataaggtaagctcaaagctgcgcttttccttgtcgccttatcttttgtcctga

SEQ ID NO: 15296 - DNA, 1389 bp, A.fumigatus
agaatcaccaacatggaggtcgcctccgcggggatgtcgaacggcgtcccagcaccagctcaggcgtcgttcgtagattctgcggctttgattcagtacttggttgatgtcctacaagcaaccctaggagctctgaaaaccgagctcgagagcacaggcagcttgttatcggaggccaaatacagcgagacggtgcagagatgcacacgctttgcttcagagtcgcaggtagctctttacgtgcagaaagatcttgtcgcttcagagggaacgaatgctgcggaggacggtgaaggtatgtgtattccaagcggtcagctctacgacagaatgataaccttgtcttgttcttctgcagcgtcttctgttcagtatgcctacaacctctccgctgaaatttcctcctcctctactacggtcgcctctgtcgcatttatcaaacgtcctgctcccattgaccctacgcttcccatatcgtcgcaggttcaggttatcaatcttcccggcccggcatctctcaacaacgctcaggcacaacaaggtgcctctttgtctccgtatgaggtcctgcatctgctcgtgcaccacgcgctgagcccctacttcgaggccaatacccgcaatcaggatgcagcgactggcttgaaacccaggacggatacagaggtgaagactggagtgcctgggaccaagaagaaatttgcagagctggaactgggcttgcttcacctgcaacagaatgttgagatccccgcgttaaacctgccgctccatgaggtagtccaagccgccctggtggaagcggagacccgagggatcaagccttctgtggagctgattccctcaaacgttttggagagcagtgcttttatcaacagcatccaaaataacgtcaatgcttggatcaggtctattcagacgatcacgaaaatgtctcgcgatgctgatagcgggtccgcagctcaagaaatcaacttttggctgtcgatggagaccgctctcgagggtatcgaaaaccagctgcgcagcgatggtgttcaattgaccatggatattctccgccacgccaaacgttaccaggcaacgctcagcttcgttgctgacaccggtttgcgagaagcgacggacatggtgcagaagtacaatcagcttatgcgcgatttccccctggatgaactactctccgccaccacgttacaaaaagttcaggaatcgcttggtctaatctttggccatcttaataaaaagttgaagatatgtccctaccgatcaagcgagctcttgcccttgttgaagctatctcaggtgatctcgacacgccaattcatagtctgcttcaccgcaaaaccattctgcacctggaactatcgcgaaattcggttcttctga

SEQ ID NO: 15297 - DNA, 330 bp, A.fumigatus
aggaagcttgcagcttctcagcaaaccttgaacctggtcgaggatcagtttgaaaccaattacttcggtcctctgaacatcatcgaagcaacgctgcctcacatgaggaagcagaaatccggtcatatcatgattctttctagcattagtatgataagccttggcccctactactccaatgcgactctaacctggagtagctgcccacatcggtacaccgggccttgggatgtactccgccgctggttgggccctggagggattttgcgatgtaagttgttgacagaattcacgttcctaatatttcagctaagaagtcacattatttag

SEQ ID NO: 15298 - DNA, 441 bp, A.fumigatus
tccggcctgaagggtgctcttcagggtctcgccgttttcatgttgacgcagtttctgatctctcaatttttcggaaataaatcacaaaatgctggatctggagtgaagcctggcgaattgacctccttccaagctcgtccgcctcgcagcgaaatcgtcgactacagtcctatccccgacaccgttgctccaatctggccccctaacagcgccgttgatatcagcatctatgtctcaccttccattgtcctcccttctctcagctcactgccatctgattctcttgtattgagtgaaaagaacttcacgatcgggaattacagtgacaccaggggaaatcgcgactaccatcgagattcccaaggaagtccagcaaaatggaacgctttgggcgcatttctatgttgcgctgaccggacaccaactcgacccaacggctaa

SEQ ID NO: 15299 - DNA, 741 bp, A.fumigatus
attctgaaaattaacggaaagcgaatgacttttgcgataccttcaggccaacgtgtcttcctgcctgccgttcaagctccagttcagcagcgttctacggcaagttctcaggacaaggacgacgggttttccaaaaccgtgatccccacgaacggagctgcaaagaagaacgaagaagcacagggcgacaccgataacacaagaaagtccagatcctccagaaagcggaaatctgaagtcgagctcgctagtcgcaaaaaacgtcaacaggaacctatatcttctgaggaggattcgcaggaccgtgagccagatgacgacgttgtccttgtagccaattccagaagcgtggcggtggaggtcaccagtcctcgagcagaggcagattcattaattcctacaaggatactcgacactatctcgacaactaataacaaagaaggagaaagcgttgccgcagcagcaactgaggtccttcaagataatgtcacttctggtgtagccatggacgaggggtcatcctcaaccaatttggccagtgattcctatcagacctcggaaatcattctagagaatattgggggtccaactgccctcgctctgaaaatcttggaagtcgatgggcgtattaaggacgttcccaacgggaatgcttggaaggaatttcgatcttaccgaaacaaccaggacatgggaagtttatgggaagtcagacaggcttggtaccttagagggaagtaa

SEQ ID NO: 15300 - DNA, 834 bp, A.fumigatus
  unsure (569): Identity of nucleotide sequences at the above locations are unknown.
gtgaaaagaacttcacgatcgggaattacagtgacaccaggggaaatcgcgactaccatcgagattcccaaggaagtccagcaaaatggaacgctttgggcgcatttctatgttgcgctgaccggacaccaactcgacccaacggctaaggattatagcacagatagtgctgtgcacttcttccgcccactcaaccattatcttcccaagaaaaaggtcaagaagctcaagaacttacttgccagctcggacgataccgaagaggaggaagaagacaacagtattccggatgtctctattgcttcatactaccaccccaacttcacggtatcgctgattcctgattctggagttcagaaataccgccaagtacaccctgctattcggcatcacatgcaactcgaggccacgggcgcaagagatgcctctggtcagaatgggtggtactaccctattgtgttcttgaatacattttggcaactccgaagccatatgaccgagctcaattccacagtgaagacgatgcctttgcggatcactctgaacaatctgtccaactggaaattcancatgatggcaagtgtggacgagaatgcaaaggctaacccccggcagggcgcctttgggaagttccgttcctggaaggccgggatggctctgaatttgagatggtcaaggaaaatcctctttgaacccaaaatttggttggcttggtacaacgggggttatttacaaatcctgcacataaatcttgaaaacttggggcttttaagaaacaaaaattgttggggttgcccctttccccttgaaaccccgttttgccttccaatctaa

SEQ ID NO: 15301 - DNA, 228 bp, A.fumigatus
tccggaaatactcttcagcgcggaaacaatggcctgcctcaggcgtgctccggcgacccggaccctcccatgtccatgcaaagtaacattgctagttcgtacattgctcgttgcggtccacccaagcagctttccaagtgcaggccggaatatcgtcctctcgacggtggccgagccaagtcttggggtgcaaatgacctgacgatgctctatctgcgacaacagtga

SEQ ID NO: 15302 - DNA, 267 bp, A.fumigatus
agaccctttgtcagatgtttcgccagcctgttttacacgtacaagaagttccttcaaccggccacgggcgacaagaaaaaggcgggtctgacgtacagctttaatatggaagcctttttgaaaagcctgcctagcgagcatgcggagtacattgcggtcctgcagcacacacaaggtaagcgcggggaaaacgtaaaccacatgcatggtctgtattgctcacctcgtcaggttttaacgagttcattggggaaagagaaagggtga

SEQ ID NO: 15303 - DNA, 189 bp, A.fumigatus
cccatacatctgaggacgggtggattccccaggagcaccagggccagtcagatgggggcggtagtgctccgtaacggcatgagcattcttttccctcgtatcatcggagattttaaccctactccctacggtagatcgtctattacggaatactcccatcgagtatacctggtctttagggtaacataa

SEQ ID NO: 15304 - DNA, 339 bp, A.fumigatus
gcgcggggaaaacgtaaaccacatgcatggtctgtattgctcacctcgtcaggttttaacgagttcattggggaaagagaaagggtgaatcccaagtcaaaggacccccgactggccttgttcgatgagattgtcctgtcgaaacggaaccggggccgctcttcgctgttttctagccgtaccacgacggatttcctatccgatacctcgaaccatctctggcgaacagccagtgccacttcgtttccaccgagcagcaggggtcagcagactctttcaggggattacactcgcattgtcactagaggtgcgtcgacgatcgacaaacttattagttag

SEQ ID NO: 15305 - DNA, 666 bp, A.fumigatus
  unsure (571),(572): Identity of nucleotide sequences at the above locations are unknown.
actgagcagtctatctgcccatgcaatgagatgatgcagacagccattcatcagcccatggcgatgaccattcttgctgataccgctccttctgtgaccaacaacagcgccagcgctccgtcgccagcgaatggtgctcatcccccactggcgacggctgtctcggccaattcagccgttgccgccgctcccccgtcggtccccgcggatcctccgaggacggtggtggtagtttacaggtccggccaggactccattgtgcacttggtcgccgaggttctgggcaaaccatggaccacggaaacgtcgctgtccaccctggtgacgggcagtaatgccgtggtggtggggattctggccgccgagctggcgcgcagtctcgacgagtgcgacccgtcgactttgatcgtgatcaacacgcactgtgtggacgacggctcgtcgccggacgaagcgctcaccgatcgctgcgactacgagtttctgtactcgcacagcccgtttctgcggcgcgatctgacgcgcttcctgtcgttgatcctgggccagacgcggccgcacgaggatctcnngaccaagacccgccccaactttctctcgaacaactgggacccccaacgccgagcttcaaaaatccgggcaaactcttttaaccccctttggtaa

SEQ ID NO: 15306 - DNA, 327 bp, A.fumigatus
gccttgcgacgatttccatgcgctgcatcaatgcttacatgctatctaggctcctatgatgccgtcatgcttggcaggtacaccgacctggtcaagatttacggtgaacatacgcgcttatgcttgaactctctttcgcttaacctcctgaccgctaatgctactgcgaactcggagaaccatataacgatctcctgtttggaaaaggcttgtgatgccgctgtagcccttgtgcagtactacgtcaagtcttccgattcggagccaatcgttcgatatggtgcagatgtgagttgctgctacctgctgttggtgtgtcatcgctaa

SEQ ID NO: 15307 - DNA, 276 bp, A.fumigatus
gcgacccgttctttaccgctgttacatttccttaacaaggagctaaactgtactgctaaggtcgcagcggatctggtttccggtctgcgcacagcccgcttacccccaacaccacgccaaaatatccgccagcccgctgccacagcatggtctaaaatctcatctcttctatctgacctaaacccgcggttggacgcatggcaacgtcaatggacctgggccggtgagccttgcgacgatttccatgcgctgcatcaatgcttacatgctatctag

SEQ ID NO: 15308 - DNA, 204 bp, A.fumigatus
ctttctggcagttcctttctgatgcggcatatgaacagcttgaccggactagaccctagcctgccggaaatccaatgggactttgatatctgcgccttactgggccaggacatcccggccggagagacaggtctcgacctcggccattacttcgatttcgcccaatctttcttccctccacccactgatccgggaactctatga

SEQ ID NO: 15309 - DNA, 1293 bp, A.fumigatus
cacctaagaaaacaagggggattcaccggtgatggatttctaaaacatacgactcctgcttacaatattgacgaccacaccaagcagaaggcaagagataacctcgctggtttcgaggcaacatcgttggtcggcatcctctcctctgtcacgatatcttcctttagccagaatatcatgcaagcgctgcgcattctcagtatggtcgtttcgaagttgctggtcttcgcccacatttttacagtagtcgtcgcccattcttgggttgaacagctcatggtcatcgcgccgaatggaacgtttgttggctctccaggatatcctcgaggaaatgttcttcgcaccgatccctccttcaacgacaaggccatgaccaatctgataccgcctgatggccgggctaatctgagtcagatccttccaagtgatcgtttgtgtaaggatacacaacagaaacaatttcagacagatggtagcccaagacttcaggcaaatcctggagctgctatcgcccttcgcttccaggaaaatggccatgtgaccctaccccagaaccaggctgggaaacccaggaatcgtgggacagtatatgtatatgggacgacggagccaaaggacgatgaacggcttcttgacatacacaatgtctggaacaaggaaggcacaggaggtgacgggcgcggcgtcctcttgtcgacccagaattttgacgatggccgttgctaccagataaacagtggtcagatctccaagcatcgccaggccatgtacccgcatgaggcaaaccaactcatgggagccgatctctggtgccaacaagacattgcgctcccatctgaagcgccaaccggcaagccctacacgctgtactgggtttgggactggcctacagctccgggagtggacccatccttgccgaatggaaagcaagagatatatactacctgcatcgatgtggatgtgattgatagccctcctactcatgagcgtgtaccggcgaactatgtcgaggatcagtcactaaacaatgcggccatcccatctcagttcgcagagatttttggaatgaaacttccgtccttctctgcgcctgtctcttcgacatcacggctgattccgacaccgactgccgttcccaagcaacccacaccagccaccgtgacctctttcatcacactgaccaagaccgtacagccggatgcctggcagaccagtctaggctcatcaatacctagctactccacgcccagcttctcttctccagcttggaactggtttcgaaggcctatctaa

SEQ ID NO: 15310 - DNA, 189 bp, A.fumigatus
tttgcgatcctcttcatagcgaaatctcgcacgattgccgttcgcctgatctccatggctatgaccggatactatcgcacgatggtccgtcctcgtacgcaccgccctctgagtatgctcaaatacgaccccgtggtgaagaagaaggtcttatttctggaagcgacaaagggtggaagggcgaaatga

SEQ ID NO: 15311 - DNA, 1566 bp, A.fumigatus
attctggaaagagaacagcaattacgagaattagaggcctcccgtacccagatagcaactcggatgagtgaacaggaagcggaactcgagctactgcgagaggcaaaggttgctgctctggctcaacagaagaaaatatcccaccagctcgacgcagtccaaggaacaatcgtcgaactcagtgataggctgtcctcgaaagacgtcgaattcaaatatgtgcagaagaagttagacacatgccaaagtaatctactgaagagagaagaagaactcacacaggtcaagaaaaagctttgcaatgccgaatcggccaggtcaaagatggaaacaggtaaaaggaaggcgaaatccgaaatacacgctcttctcaaaaggcttcaggactcagagcgctggaaaagaaatatcaaagcggcgatcactcgaccaggtgatccaccgtttgatggaccagtcgcaggcacttgggacaaactgaaggattatctaaactcggcagataacgacaccccggttcccgattcacagaaaactactgtccctacaggtcttaatgtcgtgagcgtgagtagaagtccttctgtggccttgacaccgaacaggatctgcgagagtcctattcagggctttgttcagacgacggaggtgatatatcggccacagagcttccaaggcggcgagctgtcatccccagttctaactaatgcgagagctggaaacaccgactcccttaatcactgtgaaaggccggaattattgactgaaattgtaccattctcgagtattcgacagcagctatcagccgcatcttgctcgtctctgagtcctgaacctagcgatcttgcagagatgctagacctcaccccaaacaacaagccacattcagttcacggtgatacggttgtggaattgccgacacaaacgaacgagaagggtaccgtagctacatcggacaaagccgacggttttgaactcggaacgatagatgaacagtcgcggagctcacagcatcagctggtgaagctgaactgcttggcgacggaaacggctggtggtcataagaatgcaagggaggatcaggacaagcagaaaacagtcactttcagggcagaaaaagagggaaacaggattgagaagcggaagttctcagcgaccgtggacagcactgccgaagagagcgcctccgaggatcgtcttatcaagaaaccaggacgcaccatgaaacgcacttacagtaaaattcagcgttctccttcgtcgaatggggtccccaaatttccaaacgagtccaatgcttctccggctagcgaacggtcgaatcgtgatacgcatacggagaatcaatacacgagcaatgataagagagcacgagtgtctgtggcgccgtcgaattccaagcctagagggcaagggcaaggggctggaaactacttggaacgcagaacaagccctgctagcttagcgtccggaaacagtaggcaatcatcagcgatcgaaaataatccgaaaaacaacaggtggacggcacgaggtgctacgcggaggtcgcagattacgcagtaa

SEQ ID NO: 15312 - DNA, 1110 bp, A.fumigatus
gtcccctccaacgtttccccagatttacggacaggctctaaggttgaacatcatggtaatcgtttgctaaagcagtacattgaaaagcaggaatgggctgctgctatacagaaaaacacaaaccgccaggatgaggttatgagcgtagagaggacgcctaatacgcactctttgagacccacgactgatcagttcacgatcttgaaacgacgtcccacaaacgggaaaaaggtgcccagcgcgttacgaaatatgacactggcgtcaaacaacggaagctcgcaattgtcagaggaagatctgttccagcttctaatcaattggatgagagttcgagaagaaaatgaaatctctgcttcgaatttacaggagcgcatggaagcagacatgtttgcactgacagaggaaaacaagagtctgaagaatcacctcgagacccttgacaatcaattacagcgtagcaggtgtcaatcaaagatatacggagcccaaatagagaattggaaaacaaagctagcgaagttcaagggtattctcaacgagcttggggctgagtatcgaaaccttcgcaatgagaacctccgactcaaagactcaaaggcaactctagagaatgaaagaaacgaaatcgagtctggaattaaagatgctaagcgccagatttctcaggccgcggttctcgtcaaggaaaaaagaactcagctcgcagagtcggaaagaaaagtcgaatcgatgacgctggccttgaaaaacgaggaagagaagacagcatttgttcaaacccagttggtggaagaaaggagaagatcatcaattcttgagtcgtacatccacaataattcgagggttcaaactaagcagcttgcgataatccggacagaacagcaggagatgctgaacaagctcaactctgcgtttgacagactggatcagagtgtgaatgcttcccaagcagcaaatcaaaccacattggaattgacactcgagaagacttttccactgctcaaagaattgagcgagcagcttttgagttgcagagcggatatccagcaatacaaggacactgtccacaagatcttttcaaggtgtgatcagagtcaaaggtactga

SEQ ID NO: 15313 - DNA, 759 bp, A.fumigatus
cttgttgcggtcagtgcgaatatgttcgatttcaagctaaatgagggactcgagcgaaatttcgcgctcaacgagaatgtggcacataaagttttggagcaactgaagctcttcgaaaatactaacggctgtcatatggcacttctcaagcagctcgggatcaacgaagaacagtacaataccgtgcgggaaatgttggaagctctgaagccaagcatgcagaccatcagctcctctctcacgacgctcaatgagaaggggattgatcttacccagcatattacgcatctagaaaagtgtatctttgaggcgcagaacccagctccaacaatagacgtttgcgctctgttcacggagaatgccgcactcaaagatcaaaaggagcagctttcaatcagagtgagatctgctgaagagaatgctaaggcgaaggagctcgagactgaaaaagcaaattgtgcccttctggacgttacaacaaagatgcaggaagagatgaaacgagcacaggatttcgaggctgaagtcgtcaatcagcgacagacgatcatatctatcgaggcgaaaattcgggaggaattgaacagagcgagcgtcattgccagagatcaggccaaggcaaggtttgagcaacaaatccataaaatgctgcgagagaaagcagaagcggaaaaggatatggccgcgatcagggagtcgctggctgaggttcaagcgtcaatggtagtcaacatagactcttacaagggaaggtcctaa

SEQ ID NO: 15314 - DNA, 492 bp, A.fumigatus
gcgtttccctggaccattcttcgcagagcggggtcgcgctgggaccacatgatgcggcagggcttggcgcttgatcagggtgtagttcagatcctcgagggcgcgctcgccatcggcagtgttgttgtagttaacgtaggcatatccgagagagcgtctggtaacggcgtcacggcagacacggatggaggcaacctggccaatggaggagaagagctcgtagagcatagcctcggtgacggaggggtcgagttcaccgacatagagggaagcagagtggggctggctggcgctgggagtagtggagggagaggcgctctcaacggcggtcacctcaggagcgctggtggcagcggcgttggtggcctcgggggtgccgttgacagtgttgtcagcggcgggggtggtagagacttcggcagacattttggttttctttttctagagcagataaagagtatactgttagcgagcagtaacactgggatgtga

SEQ ID NO: 15315 - DNA, 192 bp, A.fumigatus
gagaggaggggagaaaagagggaaaaagggaaagagcgaaagacacagggcaaaaaaaagtggattattgacgaacctctcttctttttttttttttttttttcccttttctctctgccttttttttctttgaattttgtcgttgaattttttttttccttctggaaaattcaaggtgttacgtcacgctag

SEQ ID NO: 15316 - DNA, 2352 bp, A.fumigatus
agagcgttgtcccaacgatgtcatgtatctcaggagaaccttgctcagagcgtcctcgctttgttgcgacccatcacgtctgagactctcactgcttatgagtggttcgctaggagttacctcactatcccagacttgtcagcgtatcttggaacgctcgatcaattagcaggtaacataaattacaaattgttgctttctgccttggggcctttgcagtcccgatttcgagaacgtcctcaaagtgtcacggatctggatgcacgcctctggctccttgcatacatcatctactttcaccaatatgcaaatgggacccaggctggacagcaagcagtggaaccggacttcgtgaagatcgtatctgaactcttaaattccacggccgtgcatctctcacggcgactcgaggcagatgacatgatcgacgatgatgtcacggaggagacaccgttgcacccctttgtcaaggaacaaatttctagccttgtcaatcaaagtaagattacaggacttctgtcgcaactccagtcaacacatctctcccaaagtgacctggccaactccgagtcggatgcgtccaaagaggcaaagattctggcaacctatgccctcacgctcctgagagtgtttccccgccggggagacgacattcgtatgtggctatacttagggtcggctacatccggggatcaaaaggcaggtcatccaggttctcggattccagcaatcaaatacttttggcatgcgtctcgatctagcaggatctttgacaagatcagccaagactccaccaaagtgcttcccttattgaaaccggccgatgagtttagggaatccgggctgtcaatgacccaagccgagagagacgaggaatggacgattatcctgctcttcttggagctctatacctttgttctaaaagtgatggacgacgaagaatttttctccagccaatcctccttcacggcttcatcaaactcgagagtttcgtggaccaaggagagcgcactgcctttgaaggacatcaaagacatgactgtatttctcaagaacctcgcattcacactctactggaattcggcggacctaaatgaacgcgaggcgcctcagacggccggaggaattcaaagctacttcactggtgctgtctcgtcgtctgatgccatcaccagtgtcaaggaccttgagatgcgcaacaaagagaagggcctcccaggtgttactggaattccgcttgactacttcaagggactcgtaacaggacttctgagaatgattcatgagcgcgattcgcgacgcaagttccttcctgatggacattggttgatgaccaaccgcttcgacatggaaggcttcataccggccgttgtagcggaagaggagaatcggcaccaactccaagatgaggacgaggaggagagtcaggatgattggatgagagatgacgaatacgagcctctgaatcttatcgggaccggtcgtgcacagcagactcgccgtatcgaggcactcaggcggcgccagcaacaggctgctcgcaggaagcagcttgaagctgtcgctcctaggctggagatcctaaggaacatgcctttctttattcccttcgccacccgagtacaaatttttcgagaattcatctaccgggatcagatgcgccgaagacagggatatatagacccggatgcatggcggatgtctgtggctcaggcgtccatgggtcgcatgatcgatggccggcccgcagcgcaggatatcttgagtcgtcatcatgcaaatatccggcgggagagcgtatttgaagacgcattcgaccaattctacgagctgggcgaaggtttgaaggagccgattcagatcagcttcatcgacaagttcaacaccgtggaggccggaatcgacggcgggggtgttaccaaagaattccttaccagtgttaccaatgaggctttcaagtccggaagcgagccaaagctattcgaggaaaacgatcaacacttgctctaccctaaccctgccgctgttgagcaaagacgagaagttctgcggcaactcgggtttgttgagaacagccctgaatggaatgagcaagttcgggatctacttagacggtatgagtttctaggtcgcattatcggaaagtgcttgtacgagggaatactggtcgatgtgaactttgcgcccttcttcctcctgaaatgggccttgaccggtggcgcaggatcagcacagagggaaacagcctatcgcgcaaatctcaacgacctgaaggatcttgaccaggggttgtaccaaggattggtcagtggattgatcccctttttttttaatgaggtggcaatgtgctaa

SEQ ID NO: 15317 - DNA, 690 bp, A.fumigatus
atctctgcttctctacagctgcaactcaaaaattacaccggggacgtggaagattttgcgttgaactttacggtcacagacaccataccacttccaaacggaggcactcgcaccgtcacccaagatctgaaaagcaacggatctgacattccagtgaccaatcagaatcgcctcgtttatatctcttacattgctcggtatcgtctgcaggtacaaccggcattgcagacaaatgcattcctgcaaggcctggggcacatcattcagccgtcttggctatcgatgttcaatcaatccgagttgcaaaccttggtcagtggggagtctggagatatagacgttgcggatttgagacgcaacacgctctacggaggggtgtataccattggcgatgacaaggaagagcatccaaccgtcaagctgttctggcaggtcatggaggagatgtccaacgaggagcggcagaaagtgctgcgattcgtgacgtcgacccctcgagcaccattgctagggtttagccatctcaacccgcgattcagcatccgcgactccagtgaagaccaggatcgattgcccagcactagtacctgcgtgaacctgctcaagctgccacggtatacaaatgctaaggttctgcgggaaaagctgctttatgctatcaattcgggggctggctttgacctaagctga

SEQ ID NO: 15318 - DNA, 441 bp, A.fumigatus
aaaaagaaaaccaaaatgtctgccgaagtctctaccacccccgccgctgacaacactgtcaacggcacccccgaggccaccaacgccgctgccaccagcgctcctgaggtgaccgccgttgagagcgcctctccctccactactcccagcgccagccagccccactctgcttccctctatgtcggtgaactcgacccctccgtcaccgaggctatgctctacgagctcttctcctccattggccaggttgcctccatccgtgtctgccgtgacgccgttaccagacgctctctcggatatgcctacgttaactacaacaacactgccgatggcgagcgcgccctcgaggatctgaactacaccctgatcaagcgccaagccctgccgcatcatgtggtcccagcgcgaccccgctctgcgaagaatggtccagggaaacgc

SEQ ID NO: 15319 - DNA, 534 bp, A.fumigatus
tcagcccctggtctctgcagcttcgggttcccaatggcgtgtctggaccgtcaacaattactccaagttctgtatcagctgtttcccaaaaaacccgacatctacgtgggcaaaagtgtcgtaggggttgacgaacaggatagccgtgtgctggtgtacactgccgatggaagcacctacgagggtgacctggtcgtgggtgccgacggagtccacagccgtgttcgaactcagatgtggcgcgcagcaaaaatgcgacggcctggtctgatcagtgaaagcgagatgaaaggtacggattcttatccggatcagatcggcgactcagacgggctgattgtgatcatggctgatagggatgagtatcgagtatgcctgcattttcggtgcctctcctacggttccaggattggacgagcgacacctgcattccagagtagacaacggaacagcattcatcctcgtccccggagtcaatggacgattgtcctggttcatcattgtccgattggacaaaaaatatcaatacggtag

SEQ ID NO: 15320 - DNA, 516 bp, A.fumigatus
atgacaccgaatctcggacaaggggccaactgtgctattgaagacgctgctgccctgaccaacaaactacacgatgctctgaaggttaaaaatccaggacgcaagctatctgacgacgagatcgagcaagccttgtccgaattcagcaacatccaagtcaaacgcatatccaagatctacaacgtgtcgtggaccaccgcgcgcttgcagactcgagcaaatctggtgtataggctactcttgcggtatttcattccatacgcgggagacaaacccgcgaagagagtactgaggattttcgagggagctacagcgctggacttcatcccattacccacccgctcaggtcccggctggacaccgcaaaaaagggaagaaacgttctttccaagatggactattgcgcttgcatttttggtactgatatcagtggtgtcaatcaacctgaagcctgttggatattacagttactggctgtcgctccttggcggcttccttatggacagaatccgatga

SEQ ID NO: 15321 - DNA, 195 bp, A.fumigatus
cagcgcgagcacaggtcggctccatggtcaagttacccgaggacgaagacacaccggagaaaccgagtgagaaagatcttccgtatgatggacaaggatgagaatggcagcctggatatggaggaatttaaggagggtagcaaacgcgacgagaccattgtcagcgccttgtccctctatgatggattggtataa

SEQ ID NO: 15322 - DNA, 1461 bp, A.fumigatus
  unsure (167),(554): Identity of nucleotide sequences at the above locations are unknown.
agtcacttgcttgaatttgtcctaatcctgatccagtgcgccggtcaagcaccgtgctcgcgctgcagagacctcaatctactctgtaccggtcatgcgacgaccctggggtccaacgaactgccagccttgcagagacgccaccagttggcatcctcgtcttcgtnccccttgacacaccaccctcgcaacaaactcaaagccctcaccaaggaccgtctcccgcatctccaatgcctcgcaaacggcctcttgtccgatcgacgagatcgtatcaccctcattgaccgccgtggccgggtcttcccagcagacggaagtcttcgcaaactacgtgctcgctgccttcccctgctatttcatgtgcaccgtgaatcgtgtcccgataaactgggttgcctatgtccacagccggcgcggatcactgaacaccccctttggaatggggtctccgcgcctccaccaccgcatacaccggcgctttgcacaacgacccgcgggtacacggatgccgcaagggtgatgtacacatggtctttgcgcggcctagcagntatgctatcggacacctcaagagccacctccgacgaggcgctagccaccgcaattagcttggcctgcttcgaggtgcaaaactgcacaaaccccgactcgtggctgcgtcatgctgcggggatcaagacgatgatgcgactgcgtggtccgcaggcgcacctccacggattcgggagggccatgtatattgtctaccggaacctgatggtgacagctgctctgctgtccggcgaggaatgtcttctccaggaaccggaatggcaggacctgaacaggcagattgccgctgacaatgcgcgacggcccgactcatccgcttacaccgacgtcgcggagcgcggcttcaacgagatctccaaggtacctgggtacgtgaaacgggtccgggagctgctcgccctgccatccaaaaagagagcctcgctgcaaccagctctgctgcgggatgttctggccgcgcgcgccgcactgcgcggcatccacaccgagttcggcgtcgccgtttcgatggttcgagccgggcagaatgagcagcagggattcatcggcccgcttcccttcgtttttttcgatggcttctcctgcctctatgtccggggcatccgctccgcgctcgtcatcctcaacaatctaattctcgctatggatgagaaacagcgcacgactatcgaggcggaaaaccgtaccctgtctgatggaattcctgatgttgtctctgaaccgaaaagggaagaatacgaatcgccgctaagaccgcccaaatcgccgggccggtcgcgcaagccggctctggccatacggtctttgatctccccccaaacccgtgagccgccaacatcgaacatgatggaccggcttgtgacgaccatgggcatggacggcgtgagggtaaccttattggaatag

SEQ ID NO: 15323 - DNA, 273 bp, A.fumigatus
actgggaatctgcaagggactgccgcagcttggtcagctcctcgtccttgcgtgcaatctcgctacggagttccgccgctgcctgcatctcggtctccttccgggtcacataaaccttttccagccgctcgcggatctcttcgacatcaccttcgcccaggttgcgctccagcaggctctcatagtcccgctcgaggtcggccagcttctgctccaactctagtctgcggctgtcctgcagctcgctcaattcaccccgatcattcatggtaa

SEQ ID NO: 15324 - DNA, 354 bp, A.fumigatus
aggtctcttgcaagagagccaagaaaaacttactcaggcaaatcatcggtaagtcctcccccattgaattgctcggcggaaggaaagatacggttggctaatatcatgtcccctacctgcaggtttgaggctcaactcactgctgttaaagagagactggaggctgcgaagcagggttcgactaggggtcttccgtctatggatggcagcggcggtttcagttttgtcggctcgagaatcgcgaagccgctccggggtggtggtggtggagggccagagagcagtgctccggtcgccggagttcagtcgcaggagagcggaaagcgcacgagctggtttttcgatcgacgatga

SEQ ID NO: 15325 - DNA, 1608 bp, A.fumigatus
ttgtcctccttggttagacggctcgtaccagcctgcggtgaagacaaggcgaaggtcaatgctgagttgagtccagctgaactgaagcaactacttcgcaaagcgcagacccaggtcatcaactttgaaaactacatgtcagccttggagagtgaagttcaggtgtggagaagcggcgaaacagttcccaaggaccgttggacaccagccaggggctcagaagccgtcagcgcggctaaggctgaagctcgtgcaagtgttacgcgccctggcactccttcccgacttcaagacaccccccgatcagagacaccacggcccgattcgagatttggcgacagatctagcacccccagccttgtgctcgagaaagatgagcgggaggaattcctacggcgggagaatgaactccaggatcaaatcgccgagagggaatcccacatcgcgaatgtggagaggagcttgcgcgaagcgcgagaggaactcaagaacctcaaggagaactcagcacgctctggcaaggacaatgagaaactcagtgcggaggtcaacgagcttcggatgcagctggagaaggtttcctacgagggcaaggaagcctcgatcactatggacagtctccgggaagctaatgctgagctgaccgcggagctggacgatgtcaagcagcaactccttgacgtacgaatgaaggccaaggagaccagcgcggcactcgatgagaaggagaagaagaaggcggagaagatggcgaagatgatggctggtttcgaccttggaggcgacgttttctctgacaacgagcggaaacttcaggaccttatacagcgggtggatgcattgcacaaggtcagcgaggctggcgagccagttgcccctgatgacctcctagagttacggaccagcctggtggagactcagggattcattcgacaggctgagcttaccatgaatgatcggggtgaattgagcgagctgcaggacagccgcagactagagttggagcagaagctggccgacctcgagcgggactatgagagcctgctggagcgcaacctgggcgaaggtgatgtcgaagagatccgcgagcggctggaaaaggtttatgtgacccggaaggagaccgagatgcaggcagcggcggaactccgtagcgagattgcacgcaaggacgaggagctgaccaagctgcggcagtcccttgcagattcccagtctaaggcgtcgactaacggcgcctccggcaagaacctgcaacagcagatcgccgaattcgatgcaatgaagaagtccctgatgcgcgacctgcagaaccgttgcgagcgggtggtggagcttgagatctcgctggacgacgctcgagaacaatataacaacgtgctgcgctcatctaacaaccgtgcgcagcagaagaagatggcattcttggaacgcaacctagagcaactgactcatgtacagcggcagctggtggaacagaacagcagcctgaagaaggaggtcgccattgcggagaggaagttgattgccagaaacgaacggattgcgagtcttgaaggtctcttgcaagagagccaagaaaaacttactcaggcaaatcatcggtaa

SEQ ID NO: 15326 - DNA, 447 bp, A.fumigatus
cgagcaaagtcaacctcgacgtcgacaacccctcccgaacgacacctcccgtccgttacacctctccccccggttcattttcaatcgccatcaacatacaaaatggctgacgctccccgtggacgtggaggatttggctcgcgcggtgaccgtggtggtgaccgtggccgtggccgtggccgtcgtggtcgtcgcggcggcggaaaggagcaggagaaggaatggcagcccgtcaccaagctcggccgtctcgtcaaggccggcaagatcaccagcatggagcagatctacctgcactctctgcccgtcaaggagtaccagattgtcgacttcttcctgcctaagctcaaggatgaggtcatgaaggtacgaaacgaacaatttcatctgcgaatatcctctagggagcaattgttcacgataaactcgtggactatgggaaaatga

SEQ ID NO: 15327 - DNA, 258 bp, A.fumigatus
cttatccccgccccccgtggtaccggtctcgttgcctcccccgctgtcaagcgtctcctccagcttgccggtgtccaagacgcctacacctcgtcctccggttccaccaagaccctcgagaacaccctcaaggctaccttccttgccgtcgttaacacctacggcttcctcactcccaacctgtggaaggagactaagctcatccggagccctctggaggagttcagtgatgttctgcgccagggcaagaagtactaa

SEQ ID NO: 15328 - DNA, 282 bp, A.fumigatus
atcaagcccgtccagaagcagacccgtgctggtcagcgtacccgtttcaaggccgttgttgtcatcggtgactccgagggtcacattggtctcggtatcaagacctccaaggaagtcgctaccgccatccgtgctgctatcatcattgccaagctcagcgttctgcccgtccggagaggttactggggtaccaacctcggtgagcctcactctctgcccgtcaagcagagcgccaagtgtggttccgtttccgtcagagtacgttatgatcgaacgcgatag

SEQ ID NO: 15329 - DNA, 390 bp, A.fumigatus
gaatatctagcgatctttggaccggccgcgaccacatggttcgccttccttcaacgaaacgtcgttctgaagagtcataaagccacgataattgcacgcgttgtcgcagaccaaggcctctttacccctactcacctgacctgtttcctgacatcaatggcaatcatggaaggcacggaccccatcgagaaatggcgtaccagctttcttcccagttacaaggcgaacctcactatctggcctctagttcagggcgtcaacttctcaattgtgcctctagagtatcgggtcttggtagtcaacgtggtcagcttaggtgaattgtgtccagctcatcgtctcgctttcactccgctaacacgtctggatcaggctggaactgcatattga

SEQ ID NO: 15330 - DNA, 879 bp, A.fumigatus
cttctgcctgtggaggaacatcgcactaatgtcggctcgtgtatagatctgaaacccgagaacctcctgtatctcactcgcgaccccaagtcccccctggtgttggctgattttggtatcgcgaaaatgctggaaaaccctaccgaagtcctcacaaccatggcaggctcattcggttatgcggcgcccgaggtcatgctcaagcaaggccacggcaaggccgtcgacttgtggtccctcggtgttattacctacaccctgttgtgcggatactcgcccttccgatcggaaagcctgtccgatctgatcgaagaatgccgcgctgcccggatcgtcttccacgagcgctactggcgcgatgtctccaaggatgccaaggacttcattctcagcctgctccagcccgaccccgccaagcggcccacatcgcaggatgcattgaaacacccgtggctgactggtgagtctgccagcgaccgcgacttgctgcctgagatccgtgcctacatcgcccgctcccgcctccggagaggaatcgagatcatcaagctggcgaaccgcatcgaagcgctcaagatgcaagaagacgaagagggcgatatccccagtcctgccgagatggcggcagctgcggacgaacccagcaaatccagtgacactacagcgtttcctcctctcgaggggtcggaggcgaatgggagctcatcccctgcgcctgttgatggcacaaccggtgggaccaagaagcggagtctgagcaaggtcgcacgcggcgcgatcttccgcgaagtcgttctggccaaggttcgcgagatgaaggagaacgaagagcgtgaaagaatcgaacgggaggctcgagagcgaactgcccatgcttga

SEQ ID NO: 15331 - DNA, 342 bp, A.fumigatus
gtcgactcttttgccgcagagcctcgcggttgcatcgacgtcgctaatgattccacagaaccaccagaagtccaatttatcgaactccccagtacatccgataccccacggcccatccccatgcacccccacatctatagcaacggcatcatctgcctcgacctcctcggctctgccggctggtcgcctgtgcaaacggttgaaagcgtctgcatgagtatccaaagcatgctgacagcaaataaccgcaacgaacggcctcccggtgatgctgaatttgtctcatataacaagcgccgcccgcgtgatatcgctttcatgtacgatgatgataatgtgtag

SEQ ID NO: 15332 - DNA, 492 bp, A.fumigatus
gtttctcattgtgtttgtttttgtcttctgtccttcgccttttgttctatggagctactgtccctttggcagaaagatgctaatcatggtatggttgtcttagtctcttctatgttcaacaagctgtccgggcagcccgagagttacgaaaaaaagtacgtgttccaagccctgagcctccttgtctatcatctcaggcccactgaagacattatgcttacctcttctagagcgctgtatagatttggaaggacgctaggtgcaggcacttatggtatcgtccgtgaagcagagagcagcgggggaaaggtcgcaatcaaaatcatcctgaagaaaaatgtccgcggcaatgagcgcatggtctacgacgagctggagatgttgcaggccctcgatcaccccaacattgttcactttgtagattggttcgaatccaaggtgggtgcaggagcttctttgctgaccgtccgccgatcgcaatctgactggtga

SEQ ID NO: 15333 - DNA, 480 bp, A.fumigatus
ctacccatactccttccgatctggctgttaagaagatcccaacccaatgatcctgtcccatcttgtgcagcccaaatacagactaacactactacaatagctgaggtcctcggccgtgtctacggcgtcattacccgccgccgcggccgcatcatctccgaaacaatgaaagaaggaacccccttcttcaccatcctggctctcctccccgtcgctgaatcattcggcttcgctgaggaaatccgcaaacggacgtcgggtgctgcacagccccaactcatcttcgcgggcttcgaggccctaaacgaagatccgttttgggtccctgctacggaggaggaactggaggatttgggagagttggctgaccgtgagaatgtggcgaaacggtatatggacgccgtacggaggagaaaggggttggttgttcaaggtaggaagttgattgatgcggagaagcagaagacgttgaagaagtag

SEQ ID NO: 15334 - DNA, 591 bp, A.fumigatus
aatgctttcctggcggtcggcgataagacaactcggttccgacgaaaaatacagctggagattgttcgtgcgaagggccttccgccgctcctgcgcctgttgcagtcctcataccttcccctcattctctctgctgttgcatgcatccgcaatatctccattcatcctctcaacgagtcgcctatcatcgacgcaggcttccttaagccgttagtggaccttctgggctcgacagacaacgaagagatacaatgccacgctatctctacacttcgcaaccttgccgcaagctctgatcgcaacaaagagcttgttctgcaggccggtgccgtacagaaatgcaaagatctggtccttcgggttcctctgagcgtgcaatctgaaatgaccgctgcaatcgctgtgctggctctcagcgatgaattgaaacctcatctgctcaacctcggtgtcttcgatgtgctgatcccccttacgaactccgaaagtattgaggtccagggcaacagtgctgctgccttgggcaacctctcctcaaaaggtacgtcaccagctatcgctctactactctcacaattgcgcaagtactaa

SEQ ID NO: 15335 - DNA, 339 bp, A.fumigatus
gcaccagttggcgattactcgatcttcgttcgtgactgggctgaccccaacggcggcattcacggttatctcaaaaggttccttgcaagcggtgaccctaccttccaacacattgccatctggactcttcttcaattgctggaatcggaggacaagcggctcatcggctacatatccaaatctgatgatattgtacagatggtcaaaacgatctctgacaagaacatcgaatcagacgaagaggatggggaggatggtgaggccgaggtcattgcgctggcacggcgatgtctcggtttactcggaaacggtccaaaacagactcttgtcgaaggctaa

SEQ ID NO: 15336 - DNA, 756 bp, A.fumigatus
gttgagatggcaagcagtctaccctctttggctattccaggtcagcgcctggggccagtgtcgtcttattctgcaggaccaggtacccacgtgcagaatgccaacatttatgcatccattgctggaccagtggttctccaacaagctcaacccagctccaaattaaaatctatcctcagcgtctcgcggaacctgccgaggaaaacggacccttctacctcgaccacacctgtgaaagccaccaccactacgaaaccgaaattgaggtacaacactctccccgctgtcgactccattgtattagcacgcgtcacccgtgtccagaaacgccaggctacggtctccatcctcgttgtgctcgatgagtcggctggttcccaagaccctgatccgtcgaagacggcttcagacaacgacaatattgtctccatccttgcttcggcggccaatcctgagaatcacagtaactccgacgagcttcgctttcaggcgcttatccggaaggaagatgtgcgtgctgttgagaaggaccgcgttgtgatggatgagatgttccgtgttggagatattgtgcgtggttccgtcatttccctgggtgatcagagcttctattatcttaccactgcgcgcaatgaccttggcgtcgtcatggcacgtagcgaggctggcaatatgatgtttccggttagctggaaagagatgagagaccccgtcaccggtgctgcagaattgcgaaaggttgctcggccgttttga

SEQ ID NO: 15337 - DNA, 486 bp, A.fumigatus
cctttcatcatggccggcccccaacggcctgcctccggcctacccaccaggaggacgggaacacgacaagcagtacggcgcccgaactcgtcagcgactgagagaaggacatcattggcgataccggcaaaagcttctgtccctaacgcgtctcgtctgaagtcacccagcgacacgcccagcatctctgcgataaggaatcagagagattatgagcgcgaaattaacgaagacacgagtattcacgtggttgtacgctgccgtgggcgtaatgatcgcgagattaaggaaaacagcggcgtggtagtatcaaccgagggagcaaagggaaagactgtggagctgtcaatgggtccaaatgcagtttcgaataaagcttacactttcgacaaagtcttttcagctgcggctgatcaagtcactgtatacgaggacgttgttcttccaattgtgaacgaggtcagctatttactgcaaaccttgtga

SEQ ID NO: 15338 - DNA, 645 bp, A.fumigatus
cacgtcttcagggcctcttcggggaaggggaagctaactgcaagcagagaatcaaaactcacacggttgttgcaagattctctcggcgggcgaacaaaaacatgcataattgccacaatctcaccctctcgtagcaatctcgaagagaccatatccacgctggactacgcattcagggcgaagaacatccgcaataaacctcagatcaattatatggcgaaaaagactcttcttcgagagttcacactagaaattgagaagttgaaaggggaacttatcgccacaagacataggaacggtgtttacatgacacccgatgcctacgagcagatgacgatggagagcgaatcccgaagaattgtcaacgaggaacaaagagccaagatcgagtccatggagtcaagcctacggaacaaggttcaagagctattcacgttgaccagcaactttaacaacctcaagaaggatcatgaggatacacgtgctgcgttgaacgagaccaacgagttccttgagaaaacggagattgttttgaaggatacaagagccactctcgaagaggaagaaatgttacgcaaagcccatcaggatacggaagcccaactacgcgatattgggtccgatttggtattgacgctggaatag

SEQ ID NO: 15339 - DNA, 495 bp, A.fumigatus
acagttggtgatgtggaagggttgcacgcgaaattagaacggaaagcaggcctcgaggcaacaaatcgagagaaatgggagacttctgttgacgaagttactgatgtgacaagcatggtcgacagtagggtcgggtcattcttagaccgacactcgaagctcgctgaaaacttcatcacgaagatcaacacttttgtcgagggtgaactgatccaattccagtcaactgaagaagcacttcgcaattacaatctctctttcgaaaaagcgctacgtgaggctcaggctcagacttacaattctcatgatcagatgaacaacgtcctcgaagagattaaggttctgcgcgaggaagtcaaaggcagggtcggagagggtttaaatggtctgtcagcagcggcagcccgtatctcgaaagaggtcatcggcgagttttcagagtttcacgcccaggtgagctggattcccgtgttacggccatgtaccaagtgctaa

SEQ ID NO: 15340 - DNA, 1476 bp, A.fumigatus
  unsure (1040): Identity of nucleotide sequences at the above locations are unknown.
ctccacgcatcgtacagcgctcttgggaaagatttgaaatccatgtttgaggacatggtagcccatgtcaatagccaaaaagccgagatccatcaacttcgcctacaacttcaggaggctaatcagcagtctgttgaggcgaatcgcaaggcctcagcacatctagcccaagtcatggaggaggaacatgcgcacgctgaagcggaacgggatcacctcatgtcacagatcaggtcattgattgaagaatctcgccagagacaattcggccgtttgaagggcagagttgagtgtgtgcggaccgacatcatgtcttcgggtgactccttggaacaagcgacaacgcactatgatcggcaggttgatgaatgggtattcaagtcggaacagtttgccaaagatgtcattgcatctcgagatgaactcaaaaccaagatgcagcatgattgggaggtaagaaaccatctctcaattagtgatgtgtcaatactgatttcgcagacatttgatcaacgcaacgcatctattcagaaagtcaccgagtcagtgcacgaagagaccgtccggattgtggatgcccagatgaaagatatgagtagacagatgggcgcattggatgactttgtcgccaaggcacgagcacagaacggccagtactgcgacgcccacatgactagcctacagaccatggcgtccaatacccaacaatcctacgcagcatatgaagaacacctatccagttctcgtgaccgaatcacctgtttgcaggaggacgcaaatcaacaaatggagagccttcaggaattgacgctacctctgtccgacgaggttcagaaacccttgtcggagcttcgcactaacattcgggaacgccctcttcaagagtatattccaaccggcatcactcctcaaaagaggcattatgagtatccaacgaccctgcctcgaaccgagtcgcatgatgccttggtcaaaaggatgaggatctccaaggaacttgaggccctgccatttagcaacggtgagccaagcgcttctgntacttctcaagacagttctacccgcggcactccatcaaaaggcttcgtctaccacgatgttgaggacgaggtaggagcccagcaacctccgtccactgccgcgactccttccaacactggtcttagggaagtcgacgcaaacatcgtcgcaaaacaactagcatgtgacactgatgatgatccaaccgccactcaatccaagtcttccattgcagcaaacggccgggtatctctgtcgaccgacaaaccaacagagattgaggaacctgacgccccgcccgccaaaagacactgctccagctctggtgtaactgataacaagcttccccagaagatgctgacgaagaaaatggccggcatgatggaaggcagagaaaatgttcctctgcccggatcgcgtggacgaaggctcagaagccaacatgcctccgattaa

SEQ ID NO: 15341 - DNA, 210 bp, A.fumigatus
gtgatgaccacatcggatcatgtgagaggggcggatgaccccctggagcacgggccatataacgccgtgtgcgcaacatgcgggtttgtttacattttcctttttcagtctccgtcgagccacaacaaacgttggcctaattactttgatatctacggagagggacaacttaccgacattcagcgaccaaccgaacaattttcttgctag

SEQ ID NO: 15342 - DNA, 657 bp, A.fumigatus
cggaaacagatgctcgcgggctacaactgtactatcttcgcgtacgggcagacaggaacgggcaaaacgtacaccatgtcaggtgatatgacagacactcttgggatactttctgacaatgctggtatcataccacgtgttttgtactcgttgttccacaagctcgaggatacggaaagcacggtaaaatgctctttcattgagctttacaacgaagagctgcgcgatttgctttcagccgaggaaaacccaaagttgaagatattcgagaacgagaaaaagggcaccagtggcagcacacttgtacaagggatggaagaaacgtggattgactcggcttctgctggtattaagctacttcagcttggcagccacaagcgccaagtcgctgcgaccaaatgcaacgaccttagctctcgaagccacacgatcttcacgattacggtctataccaagcggaccactgagaacggtgacgactacatcagttctggaaagctcaacctggttgacctggctggtagtgagaatatccagcgcagcggtgctgagaataagcgagctacagaggctggtttgatcaataaatctctgctcactcttggccgtgtgatcaatgctctcgtggataaaagtccgcacatcccatataggtaa

SEQ ID NO: 15343 - DNA, 597 bp, A.fumigatus
cctttaatagcgcttggtgcttccctccacaatgttttaactcgtgtaaaatcacatccacacctctaccccgcagtcgatcttgcctactcctcatccgatcccgtgcagaagccagtcattctgcagctaccttcaaatggccttcgcttgcgatttgatgggcccgatcaaaggctacggctcattgaggtgctagacttctcgaaaatcactctggtttacaaaaatcaagaagtaatgaaggccgtaaaaccacaagaacaagccgtttcgcaacaaggtcctagttttcgtcatatctacaatcgcctcttcgggccctcctacccgggagaatatactcctccaggtgacggtcaatcaccgtatgggacatatgtgctctcgtatccagggattgcgttctcgttccctctacagaactcagcatggtcggagcaatgtgactttgtagccctgctttcttcatcggcagctttaccagcaacatccatggctatatttcagggtgcctcgtggccggaggctagggataaattattctcgcagcagccgcaatatcctcgctttccagcactgagcgctagatattgt

SEQ ID NO: 15344 - DNA, 885 bp, A.fumigatus
cttgacatggcttctgtcggcaacactgcctttccacaatcgaagcgggatatctcgactgacccagtctctcgggaggggaatgcgatcagtgataccatcgactcaaacaccgctgaccatgaactactggccgaccaagcgccccaagacgatgcgccggataccagccttttcgaggagagtgaggtgccaacatcgacgaattcgccggcgagcacaccccgtgtattgagcaaaagacggaaaagaatcgtcggcggcaaacccaagcgcgtccggacgggctgcctcacatgtcgcgagcgccatctgaaatgcgacgagacttcccaccggtgccagaactgtcgcaaatctgggagaatatgcagacgtggcgttcggttgaatttcattgatacacagactgtggcacctccacactgtattcctcgtcctcctggagcatccgtcagttttcgggatgagtccagagttatcgcctcggagtatgtgggcggagccgagagatatccccctccgggaatggagcctcctttggaattggccttgccgtcagagtatccttctcagacaagccccccgatacctctttcttcgatggacagcatgtcttccctttttggaatcactcaagattcgctgcctggccaaagcggtaacttcaccggcaatgcgctctcagcggattattccgtcttgcccgatcagagtgcttcatacgcccctttcaagtcagcaaaagttggagtaaaggactcaagtgaccgtgtatatctcaacgaccccgacgacatcttgctgttgcgggtcttcgtcgaggaggtgggtctatggatggattctatggctgcagtcaagcatgtaaggcccatgttataa

SEQ ID NO: 15345 - DNA, 1878 bp, A.fumigatus
actcggcggtcggcttataacagaggcagaaaaactttgatctactctacccgttttgcctccgaactcactactcttgacatttatttctctatacagaccctcctagagatgaccgtcgctcaaggcccaggcggaacatcaccgcctccacagcgagagcgccctgacattgatgaagacactcctctgctcaagacaaaatcttcacacctacgtttgtactcagatgccgggagttattcagcgttagacgaaagcgccgatgcgggctcgacatcgactgctttcccagcagaggatgaggaagctcttctcaacctcgccagagtcagttcgttacctcaaggtcctgatatcgaaccgagcctcgagcatattcctcctgcccctatcgcggataaaggggcttccgcagacccagaacactgctcagcgcgtcgaaaagatgattatgcctcccgatttattggcgtgtcgcccatgcgcttctggctcattttctctgggattctattgggttatgtgatcggattctttgactcgaccttaatggcctttagccaccccgtcatcacgtcgcactttcacgcctcgaactctgcatcttggctctcgactgcttttcttttgacttcgactgccttccttccgctttttgggcgcatctcggatacgttcggccgaaaaccagtctatctctttgccattgctgttttcttcgtgaccacagcatggtgtgcggccgcgcaaagtatcggaagtttcatcgctgctcgtgctgtctgtgggctcggagctggtggtgttttctcgatggggatgatcttatctagtgaccttgtacgtatcgagtaccgagggttgtatcagtcctatatcaatctcgtcctcggagttgggggctgccttgggcttgcttttggcggcttcctgtgtgatcatgttgggtggagaggtgcgttcctcgtgcagctgccgttcatcttcgtttacttcatcgtcgcagcttggacaacgccagcagacctagggctgaagagagccaaagcggatcagatgagcgtgcctcaattgatcaagagcatcgacttgacagggtcctttatccttgtggttacggtgacggctttgatcttgggtctcaacctaggtggtaatgtgttcgcatggactcaccccttcattatatcgtcgctagccttatcaattgttctagccatggtctttgtgcgatatgaacggaacgttgaacgggctgtgatgccaatctcacttctgtcaaagcaacctcgtgcaagcatcattttcggaaatttctttgggtcaatctcgatcaacaccatgatcttcaatgctccgctgtatttccaggcggtcaaattggcaagtcctaccgattctggtctcagattggtcgctgctactctcgctgtcacagtttctagcgtgtcgaccggcttcttgatcacttggaccaagcgtctcaagcccacaatgctcgttggcggcctcttcctcttgatcggaggctgtgctgcggctttgattggtaaagacactcctgacttgatcgcgatgatttgtgtctccctgtctagtctcggccagggtttctcctttcccactctcatggtatccgtactggctacaagcgcacaggaagagcaggctgtagctacgacaactctgggcctctttagaaacctggggtcagtcatgggtgtggcgacgagcagctggatattccagaatacacttgtgtatcagctcgacgaactggtgacctctcccgataaagaaagcgtcattcttctcgctcgcaaatcggttcaagctattgctaacctggatccaatgcatcagcagcaaggttag

SEQ ID NO: 15346 - DNA, 201 bp, A.fumigatus
gtctgctggcgttgtccaagctgcgacgatgaagtaaacgaagatgaacggcagctgcacgaggaacgcacctctccacccaacatgatcacacaggaagccgccaaaagcaagcccaaggcagcccccaactccgaggacgagattgatataggactgatacaaccctcggtactcgatacgtacaaggtcactagataa

SEQ ID NO: 15347 - DNA, 855 bp, A.fumigatus
agcacatatatggcgactcatagctctttttttggtatgttcctgtcatcattgccctttatttttgggaatattgctaacttcttcaaagccatggtctctgttgccgagcagtttggcaatctgcgtaatacgcttgggtccgctttggggattttcacaataatcagatggtttcgaactttgattgcgaagatcacggggcgtcctccgccggctgatgctgcctctcttaccccgtctgcctttgcggcctttatgcatgggcgttcggcgcctgctacgctcccagacggctctcctgctcctccgaagccttcgaagaagccatttttcatgttccttatcgccgtcttcggtctcccctacttgatgggcaagctcattaaagccctcgcgcgctcacaggaggaacaacggaagcagatgatgctaggaccaaacggggaacccatgcaagcgccattggatccatcgaagcttgatttctgccgagtcttgtatgattacactcccgagtctcaggaaagtgctggcatcgatctggccgttaagaagggtgacattgtcgctgttctcagcaagacggaccccatgggcaacgcatctgagtggtggcgctgccgcgctcgggacggccgtgttggctacctcccaggaccttacctcgaaaccatccaacgaagacctgcgcagcaggctatcacctccggcagcgaagcgggcagccgcaccaatactatgacatcggtcattgaaaagggccaggtcggcgatgagaagaagccagtcctgaaggggaaaatgggtgacatctcgccggagagctttcagaagagtgcattctactcataa

SEQ ID NO: 15348 - DNA, 1107 bp, A.fumigatus
gtggctgagcgctcgggtcttcgtcgactgtgtttgacatccacggcagcttcttcttttgacgaacgctcgcttcgtttatggcgctctcgctctgaggaatgcctgttcctctctgccttctctggggtccggaatttgtccttactccgtaactcctcctgcctaagcttttcttcatgctgtcgcttggcttcctcaagggctttgttccaccgatcaaggagactaccacttcgctcaggtttcttgcgtggcaatgatcttcgtacttcctcagaggaactcttcgaatgtcgtctctgtccctcatccggggatcgcctctttctcctgcgtgcatgttcggctgctatggcgactggaacaacagctggcaaggctgcttccaatggctccaaggcatcaatatctcttgagatttcctcaacaggtgttgggtctggagtctcttcggagaattccgcgcccacaggagcagcttctttgactgggacagactcttcaacaggagcgccttcctcgacaacggcaggttcctcggcaggtatctcctcggcggcagcagcaggctcttcaacggggccaggttcaacgggagcaggttcaacggaagcaggttcaacggaagcagattcctcagtaggagcctcttccatgggagcaggttcctcacgagccgactctgtaggaggggcttcctcagcagcaggctcttcaacgggagcaggttcaacaggagcagatatctcagcaggaacctcttccacgggagcaggttcagcgggagtagattcctcagcaggagcctcttccacgggaatacgttcctccgctggagcagactcttcagggacggacttttcaactggcgtgggttcctctgcaggttcctgcaaaggtgctggttcctcagcaggaacctcctcagcgggggcaggttcctcagtaggaatctcctcggcagcagcggcagggtcttcagccggagccggttcttcaacgggggcaggatcttcaactgatggagattcctcagcagcaggctcttcaacgggagcaggttcctcagcaggagcatcttccacaggagcaggttcctcatga

SEQ ID NO: 15349 - DNA, 216 bp, A.fumigatus
gaatctcctcggcagcagcggcagggtcttcagccggagccggttcttcaacgggggcaggatcttcaactgatggagattcctcagcagcaggctcttcaacgggagcaggttcctcagcaggagcatcttccacaggagcaggttcctcatgagccgactcttcacgaaggccctcctcggcatcagcagcagcaggctctcccactgaaatag

SEQ ID NO: 15350 - DNA, 2226 bp, A.fumigatus
  unsure (7),(34),(35): Identity of nucleotide sequences at the above locations are unknown.
cagtggnggcgtatctggcggctcggccgtgtannaaagaagaccgaggaggctcctcaagaaccaccggagcaacctctgactgaagaagtcgtcgaagaatctgcttcccccgagtctgtggccgaagagccagcatctgccgagcagccccctcctgcagatgagcctgcgcctgaagaacctcctgctgctgaggagtcggcccctgctgtgcctgaagtggaggagcctgcgccgcaggacgagacccctgttcaaaaagctcctgctgcagaacagtctactgctgaggatgtgacccctgaggaacctgcccccgttgaagaggcatcggcaaaagaacccgttgctgaagaacctactccaggtgataaatcctctccagttgaagaggctgctgtcgaggaagcgcctccagccgaggaatctgctgcgtctgaagaatccactcctgttgaggaggctgccccaacagaagaatccgcggctgaggagtcagctccagccgaggaggctaccgagtctatttcagtgggagagcctgctgctgctgatgccgaggagggccttcgtgaagagtcggctcatgaggaacctgctcctgtggaagatgctcctgctgaggaacctgctcccgttgaagagcctgctgctgaggaatctccatcagttgaagatcctgcccccgttgaagaaccggctccggctgaagaccctgccgctgctgccgaggagattcctactgaggaacctgcccccgctgaggaggttcctgctgaggaaccagcacctttgcaggaacctgcagaggaacccacgccagttgaaaagtccgtccctgaagagtctgctccagcggaggaacgtattcccgtggaagaggctcctgctgaggaatctactcccgctgaacctgctcccgtggaagaggttcctgctgagatatctgctcctgttgaacctgctcccgttgaagagcctgctgctgaggaagcccctcctacagagtcggctcgtgaggaacctgctcccatggaagaggctcctactgaggaatctgcttccgttgaacctgcttccgttgaacctgctcccgttgaacctggccccgttgaagagcctgctgctgccgccgaggagatacctgccgaggaacctgccgttgtcgaggaaggcgctcctgttgaagagtctgtcccagtcaaagaagctgctcctgtgggcgcggaattctccgaagagactccagacccaacacctgttgaggaaatctcaagagatattgatgccttggagccattggaagcagccttgccagctgttgttccagtcgccatagcagccgaacatgcacgcaggagaaagaggcgatccccggatgagggacagagacgacattcgaagagttcctctgaggaagtacgaagatcattgccacgcaagaaacctgagcgaagtggtagtctccttgatcggtggaacaaagcccttgaggaagccaagcgacagcatgaagaaaagcttaggcaggaggagttacggagtaaggacaaattccggaccccagagaaggcagagaggaacaggcattcctcagagcgagagcgccataaacgaagcgagcgttcgtcaaaagaagaagctgccgtggatgtcaaacacagtcgacgaagacccgagcgctcagccacctatgaagttgagcgttcttcgggggaaaaggctgccgtgcctatcgaacccagccgacggaccagagagcattcgagtagtcagggaggagaacgtagaagtacctcctcaagggatggccattcatcaggctcgaagccgcgagccttcctgaaatacatgacagccgaatcagaaacgaatggtccccttcttaagatcaatggggacaaagctgctgcaaatgtgcttgggcgtcggtcttccccaagccattcccatagccaccgtcactcgcacgaaggaagagggtccgaccgttccacgagctcccatcatgcggcggaggaggagcaggctcgacgcgagagacgggcgcggcgaagggctgcagaagaagtggagcaggcaaaggaaagagaagcgaccgaccatcatcgccaccgtcatagcggagaaacccgccatcaccatcaccgacgccggagagatgagcctccaaaggaagagtcgaagctcaaaaatatcctcaaagcagttgttgctcattaa

SEQ ID NO: 15351 - DNA, 303 bp, A.fumigatus
aagaccactatatcatgcctgaggcgactgctcacaatatgttgcaggtggtctgtggctctagctgagacgttcaaggagcaaggcctgcaaaatgtggttcgggaggaattctccaccgacacctacctgctacttctggaccagacgaattacctcggtctattcggagagctgatcagcaagttggatggggatcttaaggaggagctcacccagctgcatgccaacacagttgctgaggccagaaagggtctttcttggaaggtgcgccgctttgctttcttgggacagaagccttga

SEQ ID NO: 15352 - DNA, 891 bp, A.fumigatus
  unsure (8): Identity of nucleotide sequences at the above locations are unknown.
gggggttntttgggattgagcgccttgaggagcgcagtttccacccctggtgaagactccttcacatttttgacgaccaattccaggccctccaccagaaccagcccatccagcaaccgacaccgttcaaagactttatcactcacttcctggcgcacccccaagcagccccagctcgactactggacccgcctccttcaaaaccactccttcgacttcccatccgccgtcatcgaaccaaagctatccagcaccgaggttgccaaaattgatgcgtccctgggcatcaatggcctggccagttccaccggagtcacggccccgatcgtgttccagacggcctactctctcctcctggcccaccttagtggcgcacgggacgtgatctacgacaatctggtgacggggcgaaacgtcgccctcgacaacccgcagctcatcaatgggaactgcgcaaacttcttaccgtaccattcgtatgtggcagatgatatgccaattgagaccctgctccggtccacacaggcagacttctggacgtcgacggagaacggcctagtgtcgctcggtgagatatatgaggctctgggtcgcgatcggtccactgccgccgccaaatgtctcttctgcttccagccattcgagccggtcaccgctcagcaggatccaatgcgctgggtggtcatgaagatgagcaagaaccggatgactttcaactatgccatccagatggaggttgtcaaggcggcggccaagggcgagtatcttgtgcgattcggctatgatgagagagcgttctccgctgaggaggctcgggcggcgttggcatggtatactcggtgtttagatggcatggtgaaaagcaaggtggttggggagctgggggtctag

SEQ ID NO: 15353 - DNA, 1152 bp, A.fumigatus
  unsure (31): Identity of nucleotide sequences at the above locations are unknown.
ttgttacgcatagcgcggctccttcgagccncctgtggtgaagacgctcccgcacctttcggtacactcaagactgctgcattgtctgaacagcggaatccgttctccacgacaggcgctcggccgctgctacgtgtctttgacatactgtatcttaatgggcgagacttaactggctacacacttcgtgatcgtcgcaaagctttgcagaaggctgtccgccctgtccatcgcagatttgaaatacatccctacgaagaagctacaactaaagatcaggtcgaagctgcgcttagaaaggtggtagctgaagcttccgagggtttggtgctcaagaaccctcggtcaccttaccgcctgaacgagagacacgatgactggatgaaggtgaagcctgagtacatgaccgagttcggagagtctttagatctcatcgtcatcggtgggtactatggctccggtcgtcgaggcggcaacctttcaagttttctctgcgggctaagagttgacgatggccatgcctctcagggtgcgagcgcgtcaaagtgctactccttctgcaaagttggaggtggctttaatgccgctgattatgcaaatatccgtcatcacaccgatggtaaatggatggagtggaacccaaagaaacctccaacggcgtatatcgaattggcaggtcgagatgctcaatatgagcgaccggacatgtggatcaagccggaagactcagtcgtcatctgtgtcaaagcagcctctgtatcagctagtgaccagtttcggcttgggctgactttgcggtttccacgtttcaaaaggctgcgcatggacaaagattggaaaagtgctctgtctgtgcaggaattcctagatctcaagtcgaacgttgagcaggagcaccgggaaaaggaactgaacgtggacaattcccgtaggaaacgcgtcaagaggacagcgaagaagcctctcacggttgctggatacgacatggacgaagatgtcaagtatgctggtccatctgggcatatatttgacggattgaacttttgtgagctttacaccgggcagctgggcctgttcattgatggtgtactaattatgcgaggcagatattctgacagattcgagtgcgcccatcaagaaaacaaagcctga

SEQ ID NO: 15354 - DNA, 192 bp, A.fumigatus
ccgccacagcgccaaagccgcatctcgtacggatggacactccacgatggtcccaccacctacagttcgggcgtgttacaggctgttccttttcattttgctaccagcagcttacaccccaccattcctattctcgccaaatgttggccggatgaggaggctgtgcgatcacaggtcggacactgcacttga

SEQ ID NO: 15355 - DNA, 825 bp, A.fumigatus
  unsure (21): Identity of nucleotide sequences at the above locations are unknown.
catatccggttacggcctacnttaaacccggcgaagattcgtcacaagagcttcaaggtcgagtgctcctttgcacaggtctcagtggacatgttcctgttctcttcccaataccaggatgtggcatctcttagcaacctgccgagatatactggtgggcaaacatacttctatccgggatggaatgcagcccggggagaggacgcgattaaattcgctagggaattctctgagtacttgtcttcggagattggacttgaagccgtccttcgtgtccgtgctacaactgggttacgcatgaatactttttacggtaacttcttcaaccgcagctccgacctatgcgcctttcccgcattccctcgcgaccaagcgtacgttgttgaggttgctattgatgagaccgtcaccaagcctattgtttgcttgcagactgctgtcctccacactacatgcaatggcgagagaagaatccgggtgttaaccctcgctcttcccacaacgcagaaccttgccgatgtatacgcatcggcagaccaacaagcaattgcgacttacttcagtcacaaggctgtcgagcgggttctttcaagtggactggaacctgcccgtgaggccctacaagccaaggctgtggaactcctgtcgacatatcggaaggagcttgctggtggaaacgtgagcggaggcgggctgcaattccctgccaacttgagaagtcttcctgttcttttcttggggatgatcaaaaacgtgagttttccttgctctaccttttattccctggaccaatctgtcacgtccccgggtgaaactgtcggctaa

SEQ ID NO: 15356 - DNA, 510 bp, A.fumigatus
aggctccttttccttttcttcattcaatacatttacccgaagatgtattcactccacgacatgcctgacattgcaggattgccagatgagcagactggcgagatcgttctccctcctccagtcaatctgtcttctgaacgcatcgtgccgtacggtctttacctgattgacgacggacagacccagttcctttgggtcgggcgtgatgcagtgccccagctcctccttgatgtcttcggtctacctgaccgatcccaactccgcgtgggcaagcagaacctcccggagcttgacaatgacttcaatcaacgagtgcgggcggtcattgagaagagccgggaccaccggtcaaagggtgttggcagcatcgtggtgcctcacctgtatgtggtcaaggaagatggagagccaggtcttcggctgtgggcccagacgatgctcgtggaagatagggccgatcagagcgtcagcctggtgcagtggatgggttctctgcgagaaaaggtttga

SEQ ID NO: 15357 - DNA, 204 bp, A.fumigatus
gttcaccatcctgtcccgtattacctgtcagtattttctgctgcaaggctctctccagatatcaagttacaaatttgcgcctcgtacacgatcgacgaagcagaacattctcatggggaaactgaaagtttctataattctgcctttagtatatacatccacagcggcccctctctgagtgatccaaggttcagtcccggctaa

SEQ ID NO: 15358 - DNA, 816 bp, A.fumigatus
  unsure (783): Identity of nucleotide sequences at the above locations are unknown.
tttggcgaccccgaggagtcagcctctgatcttgacgatgatacctccgacctgccattccctgagcctctcactcgagcatcatttctcgcccccgactttaaccccgcagactacctctcgtccttggccaatcggcaccagagcctcgaagacctccgacaagaactgcggaatctggaccaagcgctcagtcgggagttgctagatctagtcaatgaaaattatggtgatttcttatctcttggcagcgcattgcaggggggcgaagagaaggtcgagcaggttcgggttgggcttttgtcatttcagagggaggttcaagctatacgggataaggtggaagcgaggcaaagcgacatggaaaaactcctgaatgaaaagaggcgactgacagggcatgcgaacattgctcgggccctattagacttcgcagagcgtgttgaggacctggagaaacgattaatgattggtgatgcaccgacccagcaccaacgcgaatcggccgagggactcgacacggactcggacctgctggacagcgagagtgaggaaagtgatgaagaggacctgcccactggctcgtctgcagctccgctagtgtctctgcggagactggaaaatcacatacagaaatacgtctacctcacccgactggcttcacggattggtgatgaccatccattcttacttaaccaacgaccccggttagcgaaaatcagggccacggtgctcgtggacctgaaaacagcacttgagcaaggcagtcatgctggggcgaancgggatacgaaaacgatggccgtattgcgactc

SEQ ID NO: 15359 - DNA, 543 bp, A.fumigatus
  unsure (96),(126): Identity of nucleotide sequences at the above locations are unknown.
tacccgccccgcacgagcgatgagcatatagcgttggcggagcagctgttgacgctggcttcgacggacccggctgtggcatcatctatgggtcgnccgcgtttggcgggtgcagtcctcgtgacnacgccccaggctgttgcgacgtccgatgtgcgcaaggaggccattttctgcgtgaagacgcagatcccggcgctgggtgtgattgagaacatgtccggttatacatgcccttgttgtggggaagtgagcaatttattttctagtggcggaggtaaggtcatggcggaggaattggggatcagatttttaggtactgtgcctgtggatgtcaaattcggcgaactggttgaagggaagatggttgtggatagtgactcggatgaagaggatgggcctactcaagctcaacagccagaggaacctgtcgacaacaggccacttgttgagcggtataaggactgctggtcatactctcgatttgaggagtttgcaaagacattaatatctcagattgagagcggaagtgccgcgagttga

SEQ ID NO: 15360 - DNA, 1323 bp, A.fumigatus
tgggatgattttgacaacaaaccagaaatcgagactttcttcatattttatgtggaccctggtttgttgataatggattataggtcggacaggctgtcatcccaccacggagtccaactatcgccctcactttctggccagaaatggtcacagctcacaccgtctcactcccgtccggtagtcgagactgttggtccatctcatcaagcaagctccggccgttatagagttgctctagatacctctgcacggacataccgcaccactgccttacgtcaaatcaatgggaatcacagacctccgtcctgggtcaatcgccaggccaatcgttctggcaatcggtcctcgacgttagcgtctcagccagtactggttcgggcgtattctggaagtacagatgacactggagaaatatccaatatgccttcacggctgtcatttccattctcagttcggtctggaacgccaaagcgtggcccaagccttccctcagaagatgactttagtattgatggcattctgcgagccatcgagcctgaaattcgaaatactttggacgcgattggcgaaatatgcggccgaagcaaactcagtttggccaacgagtatgggagtcatatcgcacccttgggagagattcgggctccccctggcggtctcttgactgtcgaggaagccagttcggaccatgagagacaacctgatgatgctatgataatttttgacgatgacagtaacagtgtcatgggtgtgcgagattacaccactctgcctcaatatcgttacttagaacagaccagaccatctacaatccccccttctacgatggggtatcactcattcgtgccgttctctgtcgcagagggcttgtctgtcctcgcgcagtctgccaatctcgatgaaaacacctcggaccccgttgcagattcattgcctgcgactagggaattcatgtcgaagccgaactcaagcggtcgaacattgctcggaaagcagagcgagtgcattacagaggaccatcttaagagtattttgacacctgcgctggtagcagagatccgcctcgaggcacaagccaacggccattcattacacgcattaccttctgactctcgccgaggccagctgtccgcagcagagaatggtgataccgcgacaagggatggtggacagacagataaactgtctgtactgacagacgtgcaagcgctgttcaactggcttaggaacgcttctcaggacggtcaacctcggtccgctgaaaagctgctgcgtgccatgctcgagaaacaaaatgaacatccgccaaggaacacatgctag

SEQ ID NO: 15361 - DNA, 285 bp, A.fumigatus
  unsure (221): Identity of nucleotide sequences at the above locations are unknown.
agatctcacgaatctttcccatttgaacgagcctgctggtgccgctctttcgtctgtatcataatcaactctgtcgctgattgctccgaagttctgcaggctataaaactccgttacgcgcagaaagagatatatacatacagcggcatagttcttattgcaacaaaccccttcgctcgggttgactcgctttatgtaccacaaatggtacaggtgtacgntggaaagcaccgtgcctcgcaagcaccccatttgttcgccatcgcggaggaggcgtttgcgtaa

SEQ ID NO: 15362 - DNA, 183 bp, A.fumigatus
acaattctctttcgtgagagaagccgaaaaacgttcgagactacacaagccgacttgcaaatggacaatcaccccaaattgccgcctttaatgaatcctgcaatgctggaagcgagtgaagatctcacgaatctttcccatttgaacgagcctgctggtgccgctctttcgtctgtatcataa

SEQ ID NO: 15363 - DNA, 3240 bp, A.fumigatus
  unsure (70),(3229): Identity of nucleotide sequences at the above locations are unknown.
ttcttattgcaacaaaccccttcgctcgggttgactcgctttatgtaccacaaatggtacaggtgtacgntggaaagcaccgtgcctcgcaagcaccccatttgttcgccatcgcggaggaggcgtttgcgtaagccaccactgcggccattactcaacttctacttacgtgccttacttagtgacatgctacgagatggaaaaaaccaaacgattgtggtatctggcgaatccggtgccggaaagactgtgagcgccaaatatatcatgcggtattttgcgactcgtgagtcgtcagaccaacccggaaaatatacaacaagtcgggcggatgcgatcagtgaaaccgaagagcagatcttggctacaaatccggtcatggaagctttcggtaatgctaaaaccacaaggaatgacaattcatcacggttcgggaaatatatcgagatcatgtttgacgacaggaacaacatcattggggctaagattaggacatatctgttagagcgttctcggctagtgttccagcctctcaaggaacgcaactatcacgtcttctatcaacttgtggctggagcaaccgaccaggagaaagaagatctcgggctcacatcggttgaagatttcgagtatctcaatcagggtgggactcctacaatagaaggtgttgacgatcagtcagaattcaacgcgacgaggaagtcccttaccacgattggggtgccggagaggacgcaagcagagatattccgcattctggctgctctattacatcttggtaatgtcaagatcactgcaacgcggactgattctactttatccccatcggagccttctcttgttcgggcatgcgacatgcttggtatcgatgtaaatgagtttgccaagtggatagtgaagaagcaactaatcaccaggggcgagaagatcacctccaacctcacacagcaacaagcaactgtcgtgaaagattcagtcgcgaaattcatctattccagtttgttcgattggctggttgacaagataaatcgccgcttggctagtgacgaggtcctaaacagctaccgatcattcatcggcgtcttggatatctacggttttgaacacttcgcaaagaactcatttgaacaattttgcatcaattacgcaaatgagaaattgcagcaggaattcaaccagcacgttttcaagctcgagcaagaggaatatgtgcgcgaaaagattgattggacattcattgaattctccgacaatcagccgtgcattgatcttattgaggccaagcttggcatattatctcttttggacgaagaatcgcggttgccgatggggtctgatgagcaatttgtgaccaagctgcatcacaacttcgcggccgataagcagaagttttacaaaaagccccgattcggcaaatcagcgttcaccatttgtcactatgcggtggacgtgacctatgagtctgatggcttcatagaaaagaacagggatactgtgccagacgagcatatggacgtccttcgcaattcttcgaatgaatttgtgaaagaaatattggacactgctgctgctgttcgggagaaagattcagcatcgatttcatccaaaccagttgcagctccaggacgcagaatcggagttgctgtcaacagaaaaccgacgcttggcggaattttcaagtcatcgcttattgagctcatgaacaccatcaattctactgatgtgcactacatacggtgcatcaagcctaatgaggccaaagagccctggaaattcgaggggccaatggtcttaagtcaactcagagcctgtggtgtgcttgagaccgtccgcatcagtactgctgggtatcctactcgttggacgtacgaggaatttgccatccgttattatatgctttgtcactcttctcaatggacctcagaaatcaaggaaatgtgccatgcaattctacagaaagcgcttggggacgcgagccatcagaaacaagataaatatcaactgggtttgaccaagatatttttccgagcaggtatgcttgcgttcctggagaatcttcgtacatccagattgaacgaatgcgcaatcatgatacaaaaaaatttgcggtgcaaatattataggcgtcgatacctcgaagcgcgctcctctatccttaccacacaagctctgatcagaggcttcctggcaagacagcgcgcggcagaagtgcgtcaagtcaaagctgccaccactatccagagaatttggcgtggtcaaaaagaaagaaagttctacaatgaaattcgcggcaatttcattctgttccagtcagtggctaagggcttcctctgccgacgcaatatcatggacaccatacatggcaacgcggcaaagatcatacagcgcgcatttcgatcctggcgacaaatacgggcatggcggcagtatcgtcgtaaggtaatcattgtccaaaacttgtggagaggaaagcaggccaggaggcaatataagaagcttcgagaggaagcgagagacctgaagcaaatctcctacaagctcgaaaataaggtggttgagcttactcagtatctcgagtcactgaaacgcgaaaacaaatcgttaaactcgcaattggagaattatgagacacagttgaaatcatggagaactcgtcacaatgctttagaaaatcgtaccagggagcttcaggccgaggctaaccaagctgggattactgctgcccgattggccgccatggaggatgaaatgagcaaattgcagcagaattacgctgaggcacaaacgatcgtcaagcgcctgcaagaagaggagaaagtctcgcgggagtcaattcggtctgccaatctggagttggatcagctgagacaactgaacattgaagctgaaaatgaccgggcttctcttcgccaacaagttgcggagcttgaagagcagctagagttagctaaacgaagtatttctttgaatggtcttaacggagatgcgcagaacagcggtcctatccagccacctgccggtggcttgataaacttggtttcctcaaagaagtcgaagcctaagcgacggagtgctggggctgaaaaaattgacactgatcgcttcagcggcgcgtacaatcctcggcctgtatctatggcaatcccgagttcgactttcggtcgccagaactttccggggcataccttttcaccaggactggacactgttgaggtggagctcgagaatntactgtcctga

SEQ ID NO: 15364 - DNA, 891 bp, A.fumigatus
cccatcgggtattcaaacgtcgcacggacaatgcaggaattcttatcattaacttcacgagacgccattcaagccttgttccagagctatacgctagaccccttgcaattctatatccttggagggaacgtggcgtacagcctgtcacctgccatgcacaatgctgcttttcggcactgcggcatgaggcacacgtatagcattccagaatctccttctcttgcggcgcttgatcggctgggccgtgatccgcattttgggggggcgagtattgtgcagccgtggagggtacaggtctttcagaaactcgcatctaaaagcagacatgctgaagctattggggccgtcaataccatcatgcccctgcgtgcacgcgctgatgggacgatgtttcctttacaagagcaagcaagccgccgtaaccaggcagggcctgttctgggatggtacggagaaaacacagactgggtgagtattatgacttgtatcagtcgtcacctgtctccccgtaatacgatcagccccttgaaatcagcaggcctggttattggagccggtggcatggctcgagctgcgatttatgctatgcttcggctaggttgccgaaatattttcatatacaaccgaaccttatcacgtgcggagggtgtcgcactccatttcaattcctgggctgcatcgcaggtgggctcaacccaagtagtacgggtgttgaagtcccttgaagatgaatggccattggatacctgcccgccatgcttaattgcctcatgcgtgccagcagatcctgacagagatgaacctccagccaacttcgaaatgccgacacagtggctcggaagtccaaccggcggcgtgattttggaggtgagcaacgtttgtcgcgtttga

SEQ ID NO: 15365 - DNA, 282 bp, A.fumigatus
agagacttagctgatcgattttcattgacgcagttcgcctacaagcccttggatacgcccctgctacggcaaatgcgccggttccgacgtgaaactggaaggccgtggatactggtcggaggattggagttagtctcggaacaagcagtcgcacaattcgagctcttaacaggacggaaggcacctcgccgattgatgacccttgaggctcttcagaactatgttggggaggacggtcctctcgatgagaaagagatccaagcaagactaggctatacttaa

SEQ ID NO: 15366 - DNA, 375 bp, A.fumigatus
tatggagttattgaacaatcgttatgcagattcggccttggtcttccgcatcggcagtacggcctagttaccggcgagttccggaaaaaagatcaccgcagtttctttggaaatgactatgagacttgggatcctgacaaggtcctggcagaagccaaacttgtgcacttctctgactggcctttaccaaaaccctgggtgctttcaaaccagaagctgcttgctgaaattctacctaagtgtgactttaaacccggcacgatgcaggagaggggttgtcgtgatcgggaggtatggaagtctctctacgaagacttccgtcgaagacgaaaggtttgcccaaagattcgcacgatacatacggaatatggctaa

SEQ ID NO: 15367 - DNA, 492 bp, A.fumigatus
cagggacagccagttgctagtgctcgccaaggagaagtacaaggcgttgctagtacctatcagtgcggaaatgatcaaggctggaggaggtacgcgagtccgggttcagaggcacaattcgccttctcgtcaaaagcagagctggcgctaactttgataactatcgacacaggctctggtgaatcttgggataagagtattgcgaaattgctcgcattcggcgagacagaatacgatcgcgttatacacatcgattccgacgtgaccgttctccagagtatggatgagctcttcttcctcccaccagccaaagtcgctatgcctcgggcttactgggcgctgccggatacaaagacactatcgtccctgctgatcttgattgaaccctctatcgcgaattcaaagccttcatggagagtgctcagcctgctctccacggtcaagtggaagttgattcgaatgagacacagaggtatgatatggagttattga

SEQ ID NO: 15368 - DNA, 432 bp, A.fumigatus
acaatgattcaaccatgggactatgcttccatcgaagccgccgagtctctcctccaacagccatcctttgaacccttccacctgcaaaacctcatcgatggcgcccaaacaccctccaccagcaacgaatggctcgactccttcaaccccaagaccgggcagatatttgctcggattccaaacagctcggcccaggacgtcgaagacgcagtgcaagccgccgagtcggccttcgcatcatggtcgcagacccccccgtcaacacgcgccgcgcacctgaatcgcatcgcggccctcatcgaagaacgccgcgaactcttcgccgtatgggagagcatcgaccaggggaagactcttgcacggtcacgggtggagattgatcgcgccatctctaacttcaggtacgtctttcgcgaatacaccggagattaa

SEQ ID NO: 15369 - DNA, 579 bp, A.fumigatus
atctgcctgtgtggttcgaggatctacgtccaaaactctatctacgacgcctttctctcccgcttcgtcgcctatgtcaaggagcactacgtgctcggccagaccgtcggcgccgtcgtctccctcgcccattaccgcaagatccgctcgtatctctccctagccacccaatacgctgatagcttcaagctcggctcggtgcctccggagaccccggacggaggctactggatcgaaccaaccattctcacggttccggacgacagcccgatcatgaaggacgagatcttcggccccgtggtgacagtcagctccttcgagagcgaggacgaggcgatcgcgcgggccaacgacagccagtacggactagcgagcattcttctgacgcgcgacggagctcgcatgcgacgggtgggcgagcggctggacgccggactggtctgggtgaattgctggctagtacgcgaactggggacaccgttcggaggcatgaaagcgtcgggaacgggccgcgagggaggcgattacagccgggatgtattcactaatgtgcggacggtgcatattccttccgtctaa

SEQ ID NO: 15370 - DNA, 471 bp, A.fumigatus
ctgacagctctagtgaatgaaaccgaagtacgtttgcagtggcatcagccgagcgagactaatgagcaggaatggttgtaccaagtccaaggcgacatgcttctccgagttatcgagaacgacacattccgcgacattcctatcaaagagggcgagatgttccttcttccaggtacgtattccgaattccagtcgatcaagctaacacttgtaggaaacaccccccacaacccagtccgatacaaggataccatcggtctagtcatggaacgacagcggccagcagaatctcgcgatcgcctgcgatggtactgtaccaagggaaatcattgttcgccgacgatcatccgcgaggaggtctttcactgcgcagaccttggctcacaactgaagccaatcattgagcggtggcagcaggatgaggagagccgaagatgcggggaatgtggttgtattgcagatcccaagtga

SEQ ID NO: 15371 - DNA, 216 bp, A.fumigatus
ataccaggcaggtgtcatcgggcatgcatgaccatcagcatccagatcaacatggccaccctcaatcccttgtcctgggtcacctggctggccgagaatgaagacaaattacgacccccggtcaacaactactgtctgtatcaggggaacgactttatcctgatggcagtgggagggccgaacgagcgcaatgagtatcatggtgcgatcttctag

SEQ ID NO: 15372 - DNA, 561 bp, A.fumigatus
gttctctgccgggaggttaggctcatggctaattggacagtacttggaaaggtaatccaagatgcgggacttcctcctggtgtcctgaacctcgtttatggggcgggctatcccaccggatcgcctttggtcaggcatccccgtgtcaggggtgtttcgttcaccggtggtacagcgactggtgtccagatccggagggataccgtcgaggatatagggaagcatatctcgcttgagctaggcgggaagaatccgacgctggtcttagaggacgctgatcttactgccgctgttgcgacggccgcaagagctgcattcgagaaccaaggagaggtacgagtcccccctttaccaacaaactcagacggaactgacaaattagatctgcctgtgtggttcgaggatctacgtccaaaactctatctacgacgcctttctctcccgcttcgtcgcctatgtcaaggagcactacgtgctcggccagaccgtcggcgccgtcgtctccctcgcccattaccgcaagatccgctcgtatctctccctagccacccaatacgctga

SEQ ID NO: 15373 - DNA, 762 bp, A.fumigatus
gcattgcaataccttccaggcccgggcgtgtcacatcaggcactaagccaggcacgtagttatatctcagagccgctgcccataaatacatcgtggtggtgtgcaaagtcaatatatataggacatccaccgaacaatatagttgtctcgagtttgttaaaccatgtctcaatgccgcacatcatccccgctgtatccggacaacatccggggcggatccggttccgagtctacataaaaagcagccgtaacctcggtctccccacgtcaagatcgtgtcaccaaccatcgcatctcaggatcctcaaaatgtccaacggaactccctactttctacccgccgaaaaggcccaaggcctagcaaactacccgcacgcccgcttcgcccccacaactgcgcaccgcaccctctacgtctccggcacctcttcccgccgcggcgacggcacctgggacggtgtgaccgaacacgcagacggcacctggactctcgatattcgcgcccagacagctgcagtcctgcgcaacattgagggcatcatccacggcgcgacacacggccgcggcgggctgcaaaacatcgtcgacgcgacggttttcctgatcgacctgccgcagaactacgcggggatgaacgaggagtggaataaggtctggccggatcgggcgaatgcacccgctcggacgacgattggggttaaggagctgccgaatccgaggttactggtggagattacatgtacagctgttgttgcgctatag

SEQ ID NO: 15374 - DNA, 1242 bp, A.fumigatus
atatccatcagaatcataatcttggctgccagaatcaacatggggagctgctgtacaaaccaccgcctcttccgcatcgacatgcacacccatattatgcccccttcgctccccgacctctcttcatatcattccaacactcctcctcctcctcctccctcgtcctcctcctccgattcctccaccgcatccgccgcagaatcaccatggctcaccctccatccaaaccccaccaaccccgaagaagtagacatgtacgtaggcgaccgcttcttccgcactgtcgcgaaaaactgctacgacacggcaacacgactcgccgagatggacgcggcagggaccgacgtgcaagtccttagcacgatccccatcctcttcttctacgaccagccctccgcccccgcgaccctcctcgcgagacacctcaacgaccacatcgcctccgtctgccgccaacacccgacccgattcctcggcctcgcaaccgtgcctttacaagacgtccccgccgccgtcgcagagctgcaccgcgccaagcaggaactaggtctccacggcgtcgaaatcggaaccaccatcgacgggatgacactcgacgatccaaccctgcatccgttctgggccgcatgcgaggagctgaacatgcccgtcttcgtgcatccgctcggctacacctggccgaaggagaacccgcgccgctgggcaaagtactggagtagttggctcatcgggatgccgtgcgagacggcgctagcgttacatctgctgatctgctccgggacgctgctgaagttcccgaggctgaagctgtgttttgcgcatgcggggggttcgttccctgcgttactgggacggatccagcatgggtatgactgccggccggatctggtggcgggggatgcgggaggggtcacgccgactgagcatgcgacggtgcgcgagaatatctggattgatagtctgacgcatgatgtggagctgctggagtatctggtcaagaaggttggggcgcataagatgatcatggggagtgactatccatttccgcttggggaggtgccggaagccgggaggatgatcgccaaggatggccggttggagggcttcttgtcttggaggcagcgggctgagattctcgcggggaatgccttgaggtttttgaatctggataaggatgagaagtggcgggggctgatggaggagagatggaggatgtttgagaaggtatatatcaacgtcttc

SEQ ID NO: 15375 - DNA, 471 bp, A.fumigatus
  unsure (268): Identity of nucleotide sequences at the above locations are unknown.
ctcaagcgagatatgcttccctatatcctcgacggtatccctccggatctggacaccagtcgctgtaccaccggtgaacgaaacacccctgacacggggatgcctgaccaaaggcgatccggtgggatagcccgccccataaacgaggttcaggacaccaggaggaagtcccgcatcttggattacctttccaagtactgtccaattagccatgagcctaacctcccggcagagaactcacaatatgcagaaacgctagtgatctcgntaggtttcgcaacagccgtacacccaaacgccagacacggcgcgatcttccaggtttacaggtacagcggcatgttccacggcgcgatcagcgcaaacactccaatcggggagcggtgctcgaacgtcagcacattattgtctgtccagcgcgcagcggtcctttgttgctggatgtacgtcgcaaaatacgtgagtcattag

SEQ ID NO: 15376 - DNA, 285 bp, A.fumigatus
gcgaccgcttcttccgcactgtcgcgaaaaactgctacgacacggcaacacgactcgccgagatggacgcggcagggaccgacgtgcaagtccttagcacgatccccatcctcttcttctacgaccagccctccgcccccgcgaccctcctcgcgagacacctcaacgaccacatcgcctccgtctgccgccaacacccgacccgattcctcggcctcgcaaccgtgcctttacaagacgtccccgccgccgtcgcagagctgcaccgcgccaagcaggaactag

SEQ ID NO: 15377 - DNA, 312 bp, A.fumigatus
agttttggacgtagatcctcgaaccacacaggcagatctaatttgtcagttccgtctgagtttgttggtaaaggggggactcgtacctctccttggttctcgaatgcagctcttgcggccgtcgcaacagcggcagtaagatcagcgtcctctaagaccagcgtcggattcttcccgcctagctcaagcgagatatgcttccctatatcctcgacggtatccctccggatctggacaccagtcgctgtaccaccggtgaacgaaacacccctgacacggggatgcctgaccaaaggcgatccggtgggatag

SEQ ID NO: 15378 - DNA, 876 bp, A.fumigatus
cctgtcttaagagtagacaatatggttcactccaatccctcctacgatttacccgcaaattactctgactatcaagcctatcatcattattcttcgcagctgtcactatcatcatccccctcttctgatggctcctcagcagagaatcctgataattccactccctgctcgatagtgtgggtcaataccctggagacagcattcacttttcttgacccatgggcgctcagtacgactcaggtttatcccctcggtgcttctacttcgctgctggaagctccaaaagatggaaaacttgatctattttcatactgcgatgaagggacgtctcatacgacagcgcccaacaccagaccggaccatgtggaaatttcgttggaataccctcgtgcgactgaaagttcgtcgggctggattcatggagtagagggctacggtcgcaatggccctgattttcagatttaccttacgccttccccagccgctgaacactttccacaaccctctgaggcgatgcataacacgccctctcctgcaacaacatcaactacgtcttccgattcttcacagcatgtcaattgggggagaacagaagttgagcgagaaattgagcgcaatgacgcagaaaagaattcaattccagatgacagtggccccacagaccttccctattctcatttgattgcggaagctctcaaggccgctcctgataggaagcgtacacttcaggagatctacagctggttcgagcagaatacaagcaaagggagagatcagcgctcaaaaggatggcagaacagtatccggcacaatctttcaatgaatgcggtatgtaatcccacagatctccatagtttcaccttttctttgttttga

SEQ ID NO: 15379 - DNA, 810 bp, A.fumigatus
tcactcttcatgaaggggggaggcttcgccctgtccccgcatttccagcaggttttcacttcgcacttccagaacaacaactattcgagttcagtccgtcccagctcctcttcctcccactctacccatggacagacggcttcgttcgcgcaaagcggccggccgcagtccaccagcggtggcatcaatgctgctccaaccatccacggtcgctactcgaccaagtacctcccctacgctcttctggattttgaaaagaaccaggtttttgtcgacgctgtttcgggtacacctgaaaatcctctctgggctggcgataacaccgctttcaagttcgatgtgtctcgcaagaccgaactgaacgtccagctgtatcttcgcaatccgtcggctcgacctggcgccggtcggagcgaggatatcttcctcggtgcggtcagagttctccctcgatttgaagaagctcaaccatatgtggacgatccgaagctcagcaagaaggataatcagaaggcagccgcggctcatgcaaataacgaacgtcacttgggtcagttaggcgcagagtggctcgaccttcaattcggtacgggatcaatcaagattggagtctcctttgtcgagaacaagcagcgcagtttgaagctggaagactttgacctgctgaaggttgtgggtaagggtagttttgggaaggtgatgcaagtcatgtcagtattcagctctaccatgccttctttaatgatcatactaatcttttcacaggaaaaaagacactggtcgaatctacgctctcaagaccattcgtaa

SEQ ID NO: 15380 - DNA, 669 bp, A.fumigatus
gtcgcctattatgaaggtcatccgtctcattcatggctgatcaatcgtatagctttttgtggaactccggaatatcttgcgcctgagctcttgcttggcaacggttacacgaagactgtcgactggtggactctgggtgtccttctctacgagatgctaactggtcttccaccgttttatgacgagaacacgaacgacatgtatcggaagattttacaagagcccctgactttccccagcagcgacattgttcctccggccgctcgtgaccttttgacgaggctgctcgatcgtgatcctcagcgtcgccttggcgcaaatggcgccgcagagatcaagtctcaccatttcttcgccaatattgattggagaaagcttcttcagaggaaatatgagccaagtttccggccgaatgtggtatgtatcaatctcccattttaccaagccctgccactaaccataccattgcagatgggcgcatctgataccactaacttcgacacggaattcacttcagaggcaccccaggactcgtatgtcgatgggcccgttctgtcgcagacaatgcaacagcagtttgcgggttggtcttacaacaggcctgtcgctggtcttggagatgctggcggcagtgtcaaggatccatccttcggcagcattcctgagtga

SEQ ID NO: 15381 - DNA, 471 bp, A.fumigatus
tcttttcacaggaaaaaagacactggtcgaatctacgctctcaagaccattcgtaaggcccatatcatctcgcgatcggaagtcacacacaccctggcggagcggtccgtgcttgcccaaatcaacaatcctttcatcgttcctctgaagttctcgttccagtctcccgagaagctttacttggttctcgccttcgtcaatggcggagagttgttccaccacctccagcgggagcagcggttcgatatcaaccgagctcgtttctacacggctgagttactctgtgcgctggaatgcctgcatggcttcaaggtcatctaccgtgatttgaagcccgaaaacatcctgcttgattacaccggccacattgcactttgtgactttggtctgtgcaagttggacatgaaggacgaagatcggaccaacagtaagtcgcctattatgaaggtcatccgtctcattcatggctga

SEQ ID NO: 15382 - DNA, 678 bp, A.fumigatus
cttttcacccacaagtggcctcctcgccaaacaagagagtcgcattcgtcactggttatgccagctatatcatcgaaagcgtggtttccgtcctcggaaaggccagtccggccgacaagagcaccaaggctctgtggttggccacgatgcgtttgctccgcaatgcctttgagcacgatcaagacggtaatgcctgtcctccccatcgatctatgcgtcaagctaaccttcgcagaattctggcaatccccatcacacctgaaccaaatctccaccccactcatcaaccaactcgcacacgccacgaattcctccacagcagccaccgtaatcgccgaggccgtgccagcgatcaccgagctggccgtggctgccgactcaacagacaaccacaaggaacttaacacggcactgatgaagttcctccgtccatctgccggcccgaacggcaaacccgccgggggcgagaacccgcacacgcgcctcgcagccctcaaggccgagcaatcgctcaccgagcagctgggcgaggagtggcttgcccttctgcctgagatgctgccgtatatcagcgagctgatggaggatgaggacgagaacgtcgagcgcgaagtccgcaaatgggtgaagcagattgaaaacgttctgggtgagaagttggatgatatgttgacgtag

SEQ ID NO: 15383 - DNA, 306 bp, A.fumigatus
tggcaccgctacatggagccgtcgactctgtcagcggaagagttcttcaagcggtggaggcagattggcggtcccccactcgaggcgcagcacacgttcggcgtcactgccaaggcgaagaatgtcagtgagacctttacacgccgccttgtggaagggttccactggaggatcctggagaacgtggatccaaatcccaataatatcgtcggatgtgctgtgtaccagtcccatggcggaaagacaggatgccttctccgactagagcccaactatgaacgcaaggtaagcattctctcagcatga

SEQ ID NO: 15384 - DNA, 192 bp, A.fumigatus
tggaaaggtccgcggttcgatcccgcgtgggtgcattacaatgctttactttttgtgctccttttgggcctcatgttcacatttatcctggatactatcactctagagtacagagtacacaaaatgtcttttttctttctggagcttgaagacacctgtttgttcatgctcattactggtcgctcgacgtaa

SEQ ID NO: 15385 - DNA, 471 bp, A.fumigatus
tccaccccatccaccatgtcgtccatgcggggtctcgtgcagttcattgccgatctgcgtaatgctcgagcgcgcgagcttgaggagaagcgcgtgaacaaggagctggccaatatccggcagaagttcaaggccggcaacttaaacggctaccagaagaagaaatatgtctgcaaactgctatatgtctatattcaggggtatgatgttgatttcggtcatttggaggctgtcaacttgatctcctccaataagtattcggagaagcagattgggtatctggctgtgaccctgttcttgcatgagcagcacgagctgctacatctggtcgtcaacagtatccggaaagatctacttgataataatgagttattcaactgtttggcgctgcatgccgttgccaatgttggtggacgggagatgggggaggcgttgagtacggacgtccatcggctgctaatttccccgtga

SEQ ID NO: 15386 - DNA, 792 bp, A.fumigatus
  unsure (742): Identity of nucleotide sequences at the above locations are unknown.
gttttccatctttattacacagactttcctttctcaagctcaccctttgttatagaggacagccacgtccgcgaaatcattagagcatcgctgcaacagatcatgactaccgctatggacacaccaaagaatgtccagcaaaacaatgctcaaaatgccattctcttcgaggctatcaatcttcttattcatctagataccgagcataacctcatgatgcagatatcctcccgtttgggtaaatacattcagtctcgagagacaaatgtccgctacctcggtttggaggccatgacacacttcgccgccagggccgaaactcttgaccccatcaagaagcatcagaacataatcttaggttcacttcgagatcgagatatcagcgtgcggcgcaaaggtctggacctgatctatagcatgtgcgacaccacaaatgcggcccccatcgtgaacgaacttctacggtacctgcagaccgcggactatgccattcgagaagagatggtcctcaaggttgcgattctcacagaaaagtacgccactgatgctcaatggtacatcgacattacattgaaactgctgtcgttggcaggcgaccatgtcaacgacgaagtatggcagcgagtcatccaaattgtgacgaacaacgaggaattacaagcctatgccgcacatacacttttagggtacctgaagactgattgccacgagagcttggtcaagatcggctgttatgttctangagaatttggtcatttgatcgccgacaatgaaaggctcgagcccgattga

SEQ ID NO: 15387 - DNA, 402 bp, A.fumigatus
ataactgattcaaaagattcatcctccacagctccttcacctgtcttactttgtccgttggcattgcaattgttggattttcctcgagcttcctcatcacttcggttacgtcatacatcatcctacgactctcacaagcacttgaagcaacaccgttctcttcttagagaatctttgacttgcagcacaatctactcaaaaccacctagccaaccgaaagacgcaatggtccacccgtcttccacctgctgcaaaacctccggtgacggaagctgcgtctgcgcagcccaggccaagtgctcctgcggcaaagagaacgccctccactgcacctgcagcagatccgccattgaaaacaccatctccgggcccagatgctcatgccgtaagtctgcccgctag

SEQ ID NO: 15388 - DNA, 405 bp, A.fumigatus
tcaggctgtaggacatctaaagcttttgtcaagaagaaggccgccttgactctgcttcgattgtaccgaaaataccctggcatcgtgcaaaacgaatgggctgagcgaatgatttctttgatggacgacccggacatgggtgtcactttgtctgtcacatctctcatcatggcattggcgcaagataggccggaagaatacaaggggagctatattaaagcggcgcagcgtctcaagaggatcgtggtcgataatgagatcgcgcctgattatctctactaccgtgtgccctgtccttggatccaggtcaaactgctgcgcttacttcagtactatccaccctctcgtaagttttccatctttattacacagactttcctttctcaagctcaccctttgttatag

SEQ ID NO: 15389 - DNA, 1062 bp, A.fumigatus
tcgccgacaatgaaaggctcgagcccgattgagcagttcttggctttgcaggggaagatgatcaccagtaacgacaacactcgtgccatgatcttatcctccttcatcaaagttgtaaatctcttccccgaaatcaagccacaactcttgcacattttccgtctctacagccattcccccgacaccgagttacagcagcgcgcttttgaatacttgacactggcaacgcttcccacagatgacctcctccggaccgtgtgtgacgagatgcctccattttcggagcgaacctctattcttctgtctcgcctgcatcagaagacggccggcacgaccgagaagaagacttgggtcgtgggtggcaaggatgctaacgcggacaagaaagaagttcttctagcacagaacactggactcaagcgtacatttaccactattgtcaatggtaccaaaaccggggccaacgggtcggcagcgacgtcaaacgcctctggcgacctggccggcctcgatctcagtgctccacctgcacccccgccgaatatggccagtgcagctcatcttacgcctgactgggaaccaggatacaatagattgtactttgcggatgaaggcgtgctcttcgaggatgcgcaaatccaggttggcttgcggtccgagtatcgtggccacatgggcgtcgtgaagatctacatctcgaacaaatcttcattcgcgatcggatctctgacgactacgctggacaaccctgcggcaccaaacctgaagattgatagcaagagtctcccggagccttctgttccagccgcaggccaaactcaacaaactctattggttgaggctccccggccgtttagtgatgcgcccaccatccgaatctcgtaccttgctggagcgcttcaggcttacaccctacaactccccgtgctgatggcaccgctacatggagccgtcgactctgtcagcggaagagttcttcaagcggtggaggcagattggcggtcccccactcgaggcgcagcacacgttcggcgtcactgccaaggcgaagaatgtcagtga

SEQ ID NO: 15390 - DNA, 1056 bp, A.fumigatus
  unsure (14): Identity of nucleotide sequences at the above locations are unknown.
aggcgcgcctgcgngagaaaatccaagggagaaccggaacctcaggttgacctgggcggacctcgcaagctaaatttcgagcagatttattcgttcttcaaggacatcacatccggcctccgtcatttgcatgtgaatggttatattcaccgggatcttaaacctaataactgcttgcttcatgaaacgagcgatggtctacgggtgttggtcagtgacttcggcgaggtccaggctcaggataccacccgattgtcaactggggcaaccggaaccgtttcatattgtgcaccggaagtcctacgacgagagtaccctggaggaccatttggcaatttcacgttcaagtcagatatcttctccttggggatgatactccatttcctatgttttgcggaacttccttaccgcaatgctgacctgattcacgaggagaaagaggatcttgatcaacttcgtgctgagattagccagtggacagggtttgatgacgaacgtagactgcgaccggacttgcctgagaagctctatacttttctcaaacgtctcttatctgtggaccccgaccgacggccaactgcggatgaagtcttgagtggcattcaggccggtgtcaacggcaatgagcatttccggttcaggagatctagctccacgagtcccgaccctcgtaccaactcaaggattcatccagtcgatagccctgacgtctcgtcggtgggccgatctctctctccaaggaatacactcgctggaagcccagtggctctacggtgcagccctaactatgaacccaacagcgccgtccttgaggcagcgtctgttgccaatagcaatgtgacagaggaaagagactctctcaactccgagcgagagctgatgatccgacccaggttttctgctacccctccgcctatgcaggatcatatcgaccgtgataaacagacaaatgagaatcgagatactcgtcccctacagcatttgctacctcctccgccaactcgtcatttcctggcaagggttcttcggagtagtctcgtctcatcgattgcttga

SEQ ID NO: 15391 - DNA, 1071 bp, A.fumigatus
tacgtaagcgcggatccggccagccccggggtgaagactctcgcagaactacgccgcgagatgctacgatacagcttggatgaagtcggagctgtcgttgccgagcttgagctagacgaagatgcggacgaagtctctgttgacgatgaatatgattatgattatgatgacgatgaggaagaggaagaggacgaatttggaaggacgcgtcctgtcctagatgaagactatcatcggcagatgcgggagctagagaagaagttgaacgccaagggcttgtggaacgtgggcaaagataccacttcccttccagaggatattcagaaggagcttgaacgacctgctgttgttcgcatcgagaaatccgacaattctgttgatacggtgatgaaggagagcaagccgaagaaaaaggttgcttttgccgaagagctggatattgctcctgcccctaaacctgctgttcccgagaagaagactcttccacccaagcagcctgaagtgcccgcaatggcggactcaattgttgaacgcatccagcagaacggaaagacaccagcggcaagtagcggtccaaagaaggcctcgcgcttcaagagtgccaggaaagcaaccacggaagagatacctagcgttgttcctccgattaacagcatccgagcctcagatctccgctcatcccatcgcaagcccatggtcccaacaccagattccattcccctcttccccgccaaaccaaggcaacccaaaccattctcacagccgatttcggacatcattgaaaagccaaacccgccccctcaacccgaaggtacgaaggggaaggtcctcgcagacactcttgtcgagcgaaccgtctcagaaggagccgcggtcgctcccgagccagacgagctcgacgagcagctgcacaggaaagaaatcgcgacggagttctacaggatgcgaaaccggaagatccagcagaacggcgggttcctggacgatgagcctgagatggttcccatagacaccgatgaagcccccaagcgcgtgagcaagttcaaagccgcgcggatgaggcaatcatag

SEQ ID NO: 15392 - DNA, 339 bp, A.fumigatus
acgctgggcccgcacattcgtgacacctgtatggactacctcaaccaagtaaccgccctcaccgagaaagtcctacaagccatcggcgtgtccctgggctacgacgagtcctacttcgacgagatctgcacggaaaccatggccttctaccagttgcttcattaccctccccagcctgccgacgccgacccgctgcagcgcggtatcggcgcccaccgcgactttggcgtcatcacgctgctgctacaggggatgtccccgggctggaggtgtgggacgaggagtcgcagtcatattaccctgtgtcaccaatcgagggggcatatgtggtgcacctag

SEQ ID NO: 15393 - DNA, 582 bp, A.fumigatus
cacctgtatggactacctcaaccaagtaaccgccctcaccgagaaagtcctacaagccatcggcgtgtccctgggctacgacgagtcctacttcgacgagatctgcacggaaaccatggccttctaccagttgcttcattaccctccccagcctgccgacgccgacccgctgcagcgcggtatcggcgcccaccgcgactttggcgtcatcacgctgctgctacaggggatgtccccgggctggaggtgtgggacgaggagtcgcagtcatattaccctgtgtcaccaatcgagggggcatatgtggtgcacctagggaatcttttccagcagtggccgaatgataaatacatgtccaacgtgcaccgggtgatcaaccggtcggatgtagaccggtactgcatcccgttcaactacaatgggaatctagactttgtgatccggtgcattgactcgtgtcgcgcgaagccggaggacgaaaagtatgcgcccatctcggtggatgactacatccggcagaagtataaggatgtgtatgggcgtgtgggtatctattcggttgctgagcgggtcaaggaatag

SEQ ID NO: 15394 - DNA, 207 bp, A.fumigatus
ttctatttgtgcctgtcgaaggacatacgcaagcggcatccagggggcttttttcaacgttcgatagaacaaggtcatgagaagcatcgaggcaaagtcgcttactttacggagcgtcccgatatacgcctggcaaccactactaaggatgacgtgggagaatcccagtacctcgctgccggtggtcgctcgacccagaccgcttag

SEQ ID NO: 15395 - DNA, 852 bp, A.fumigatus
  unsure (58): Identity of nucleotide sequences at the above locations are unknown.
aagggtcagcccctgatgacacgcttcgcggtgtcacaaatccctagtctcgcagtcntgcatcatgtttctcgacgccagtctcgattggttgctccaaccgtgtcggttttcgcccggtctccctccgcgttcagtactacgagtgacaaccaagagcccaacctgcccttggcgggaattgaagcagtgcacattgcgaaaaccttctcaacatggcctgttgatgcgacgaatgtgacgcgacgcgaattccgcaagtatgtcgagggcagctcctccatccttcacattggcactcatggcgacgttgactaccggaaccctcttctctcttctatctcgatgggagaagacttccgcgtcctcgatatgtccacaataaaaaccaacgccaatcttctcgtatttgccgcgtgcctaagcggtctgggtcgagcgaccaccggcagcgaggtactgggattctcccacgtcatccttagtagtggttgccaggcgtatatcgggacgctccgtaaagtaagcgactttgcctcgatgcttctcatgaccttgttctatcgaacgttgaaaaaagccccctggatgccgcttgcgtatgtccttcgacaggcacaaatagaactatctcagtttgacagagagcacgcagcccgttacctcgatcagttgatccagacctcgccctcaagcgatggggactctcacggcctaatggactttgtcccagatacggactttatgatctcgatgcaaaagatgatcttggcacagctggattggtctagtccattcttttgggccccctttgtgcttatgggatatggcagcttgcgatttgcgacgtga

SEQ ID NO: 15396 - DNA, 2172 bp, A.fumigatus
cttctagggcccatcttcacaagtcccgtggcattgaacttggtccttgttgacgccagctcggccatcggagaaaataatctatgggatcctgttgaacttgagctgaaggatcggtactcccctgaagtgaaggaatgctatgaggccgccttggagctgtttgggagagctaactgtaggagaggtcaagcagcggttttgcttcggcaagcgtgttgccttcatatcgaggcgcggcgacttcaaccgactgatacgtgtcgaactgccctcatgcaagatgcctgtgccaagtttacgcagtcaaaacagctcttcgggaaagacgaagtcaattgccagattgtaactacccaccagatcctcctcgatatcaccagcggagataaccgcagtgtcaaagcgaccgcaagaggcatcggaatatgggcagctcaagcagagaaccagtccgtgggccactgtcttggtcttctcatattccgcttcgcccgccaggaatggtgcacgttcgcccgaatggacaatgctctcgtggcatgggaatgtgcctatgaaatatctgagagtattgatgatgtcgtactcatgtttcagtcggtcgtctctcgcgcctgggtacaaggcgaaatgttcaacttggccgcgctcaaaatcctggtggaccaagccgtaggaatgtttgacagagttcgccaatattacgacaccgtggccaaaagtatcccggacaccgaggcggaagatgcagatagactcatcgttcagaccagtaaatttgataccctttcaagctttgagtcaaaggcaagcacgatgtattttcgtctggaagatccgaagctagcgcaagagtggcaagcgaagtttgcagatataatggagaacgatgaaagctttctgacaatgagagagcgaatggaaaaaacactggattttcagggcctctcccctgcgttatcttgctctaattcgaggatcaaaggtctgtggcaaatgaaggtcataggagatgctatggctgccaagtatcgcgacgccaagttcatattccaagaatggctcgacagaggtgacatcgaacgcgccgaagcagtttaccgtcgctttatggatgagaccaaaatcatggaatcatcttatgctcgggatgcctatcggctcctattctgcagtagcgttggggatgagacatcggcaaagacgatccttgccagcatggacgataattccctctttgaaggtgacctgaatgattatcagcagggcattggagtcaaatctacctttgccggagtggcagacaacgcccttatgttctgtctgctgtcccgggacgcggcgagggctcatcgcgttgttcaaatcgtccagaaaatcgcaccaaccttttatgacaccatggatgataatgtcattgaccgttcttttcgtctgagctactatggcgcgaccatgctgtataatggccacttgcaggtggctctccgtcgattgctggatgcccgccaattgattgaacttcggcgtcaacagactacggatgtcgacgctcgagttgggacattcagctcaggatggatcgtggaggaatatctcaatcttgttcgagcatgcttcaagtgccccgatgcaagggttccatcaaatatgcttcaagagcttgatcacagccatcgtgatgacctgtcgtgggaggaacatgccctgctgtttctagaagaaagcagagcccgttccgttcttgaagcgctgaacacgcaggttgcctgtgaccgagatgagcataatgcgtcggctccgctgttagagttgatgcacaaacgcaggctgctcagaacgctactcgctttgaggcaccgaacacctgagcaagaacaggagatcggcgagcttcgcctccagatcaaccacatggaagctagtgaagtttgtgcagcggccagctctttcattgatatggcgatttcgattgtggcaccgaaattgctgtacaaaagtatcaaccaagacgcagtggtgatagaagcaacgttcggttatcaaggcatgattgcttttgctgtgaccagtgatggacttcagaacatatacgaagatcgcagtagcagcgtcgacatccggaagcctgttatgcagatgatgaaggtcttaacggaaaatgcctga

SEQ ID NO: 15397 - DNA, 1038 bp, A.fumigatus
tatgatcaagaaaaaaccagccatgtctattcccgtctttccgcgcccaacccgacccgtttcgaagtcattttatcgtcactcctcaacggcgaagcaatcagctattcctcggggctatccgccctgaacgccgcgcttgttctgctgaatcctcggcgaattgccatcggtaatggctaccatgggtgtcacggtgtaatcgaaatgttcggccgcctgactggactccagaaactcgatctcgactgccctgctgagcagttggaggccggagacgttattctcttggagacgcccgtaaacccgcaaggaactgctttcaacatcgcagcatacgcggacaaggctcattctagaggcgcgtatctgattgtcgacagcacattcgcaccgccaggcctacaagaccccttcatctggggtgccgatcttatcatgcattccgggtccaaatactttggcgggcacagcgatgttctctgtggtgtccttgcaacacagcgcaaggattgggcgaagaaactcttccaggatcgattgtacttgggcagcgtgatgggtaacatggagagttggcttggtgtgcgcagtctgcgcaccctcgatattcgcgtccagcgccagagctcgaacgcggcgaacttggtctcgtggttggacaaggcattgcgcgcgcagaatcccgcagcgggtagcgatgaagccgccacgcaggctgccctcgagcaagtctttcacgcgagtctccagaaggaggacgaggagtggctactaaaacagatgcctaatggcttcgggcctgttttctccatcaccatgaaggaggaggattatgcgcggaagctgcccagcaagctttcgttcttccatcacgctaccagtcttggtggggtggagactttgatcgagtggcggacaatgaccgatgccacggtagatcgtcggttgcttcggatcagtgtaggcttggagaactgggaggatctcaagagcgatcttgttaatgctttccgcgcgctcattgggaccaagtaa

SEQ ID NO: 15398 - DNA, 225 bp, A.fumigatus
gtcgacgtaccagttgctattatcgcaatataccccctttttccattaattattggccgggtcccctcgttctcctatctggcgatcactcaatatactggtccacaacacgcctgcttcgacgtcacgtgtgtcttgctgtggggttcgccgacaatcggccatctgaacccccccgctactcgacaggacgttcctttctctgttattcacaatattctgtaa

SEQ ID NO: 15399 - DNA, 381 bp, A.fumigatus
ctaagaaacataacaatggctcatctcaatcaagcaattggcgcttctacgcgctctttgcacgcagatgatgaactcaatgtagttaccgacgttgctccaccattgcatgtctctacgaccttccgatactcggacaatccggatgaactggtaccgctcacggatctcagcggcgtatgtcacagcagtttgatcaatcctttttgtgcttattggccttactctgacattgtcaatttgtactgtagtatgatcaagaaaaaaccagccatgtctattcccgtctttccgcgcccaacccgacccgtttcgaagtcattttatcgtcactcctcaacggcgaagcaatcagctattcctcggggctatccgccctga

SEQ ID NO: 15400 - DNA, 474 bp, A.fumigatus
ccctaccaagccaacttcatccgccaagatggtctcaaaaaaccgcacccccgccgagcgtcttcttcgggcccaatacccgtgttaggtagtcgctcattcccacatccctcattcacagagttacaaaagcctcgccagacctgcatagcagttatctattgcgtcatctccttcatcctcttcctgaataacatcctgcccttcctcgcgagcgccataatgaacgcactggtgcttgtggccgtcatcgtcgtggccgtcatcatcgggaaaccactctcatacctcaagtgcgatgtgatcggagatctgacgggtgatggatcgtctgcatatgccttcgccacgagcctggataactatctggaccatctgggcggaaaagtcgattacaagaactggatagcggcgtctagaggtgtgtgtctggaggcaaagtcaatctgggggctgagtattgcattgtggtga

SEQ ID NO: 15401 - DNA, 228 bp, A.fumigatus
atctggaaagtcagagatacatcgatatcaatacacgggttcctcacagaccacaattatcaatgtctcaggaacaattactccattcattcaattgccgcggcgtacgccgtcggtctgttccctcacggctgttactatgtcaagatgatggctaatgccaaggatcacgctacaaacattgagtatgctcaagcatctcttacatacacactagacagcttatag

SEQ ID NO: 15402 - DNA, 258 bp, A.fumigatus
ggcgcgtatctgtcaagaaatagtatcaagctaatgcataccacacagcttgctggaaacctggccaaacttcccacgagcgacttgaatacactttcattggagtatatcggcgctcggctcttgtatacagctctgtatatgggagctaaatctgaggctatcagctatttgcgtacgggtgtgtgggcatggagcatatcaatcccgatctggggattgattcaggctggacgggctctgaacagggcagagtaa

SEQ ID NO: 15403 - DNA, 1029 bp, A.fumigatus
gtacgatgcgtcccaaacacgcaacttcagcttctcaacaccaggtctgtaaacatgtctctcatcaagaccttctccgtccgcctccaatccaatgaatggagccaaggagaccagtcgagtgacagtttgccccaaagcccattgttcgctttttctgcaccagagtctgatgaaggtaccacttcttacaattcaggcaatcctgatggagacgtctttaccgcagcaagagaatctcgcatcagctctcaggatgcaactgtgtcttcttcccttgaagctgttgcaggctgcggcaacgacggggaacttgagccttcgtcgcacctcttctcctccacaccccatctctcttctggactgagcttgaatgttgcagattgtgccgactgcatcaagatgcagaacccaggccggaagaggagtgcatctgacgcatcccttaccgattctggatctgattcagaacgaaccaagactaccggcatgaaaccgtccgcaaaatgcatcatcagcgacgttggcggtgtcaaatcagctccggagcttgataagcggacttacaatgcaaacgagggaaagaaaggaacgctccagccttcaatccagtcttcagagcagaactctcgcaggagacattccagaacacttagcatgatccccaagcccgtaactcggctggacaaggacacagtctttattccagcgccaaatgggtcgcaagatacatcaatcgctgcatgtagtgacaagcctactgaagaggaaaatgctcccactccaactaagacaactatgactgagacattccacagaaagtggggagactctgactccttcgtcacgtcaactcctgtgacgtctccaggctctcttgaagcgaatgaatctgtagccacagaatatactaacggcccaagacacacatctgacacggactcccctgaggcgacccttggcaagcacaatgtcctaagtgtcttcgtattcaaaccaaatctcgagggtgttgacaccactggttaa

SEQ ID NO: 15404 - DNA, 1929 bp, A.fumigatus
agaccgctcaactggaatgtcatctacaattttatcctactgtttgccatgtgtttcgtctccgcagttgtcaacggcgttgcatggggctctgatgacaggtctctcaactactttgattttggctcctacggaagcactccggtagtcactgccatcatcacattctgggtggctttgatcctgtttcagaacttggtacccatctcgctctacatctccctcgagatagtccgcacgtgtcaggctattttcattcacagcgatgtcttcatgtattacgagaaactgggaatctcctgcgtgcctaaatcctggaacatctcggatgatgttggacagatcgaatacatcttctccgacaagactggcactttaacgcagaatgtgatggacttcaagaagtgcactatcaatggagtttcctatggcgaggcctttacagaagcccaggtaggtatgatcagacgtgaaggaggcgatgccgacactgtggccgcggaagcacgagaaaaaatcgctgccgatactaccaagatgcttcaaatgctccgccgaatacacgacaacccatatctgcgtgacgagaatttgacgttcatcgcgccagattacgtcgcagacttggaagggcaatctggtgaagctcagaagcaagcaacggaacatttcatgcttgctcttgctttatgccatacagtaatcacagagcagacgcctggtgatcccccccaaatcgagttcaaagcgcagtccccggatgaggcggctctagtgagcactgctcgtgattgcggcttcactctcctcggaagatcaggtgacgaccttattttgaatgtcatgggcgaggagcgaacctatactgtactcaatacactcgagttcaattccacgaggaaacgaatgagtgcaatcatccgtatgccggatggcaccattcgtcttttctgtaagggcgcggatagcatcatatactcgcgactggctcgtggcaagcaacaagagcttcgaaagaagacagctgagcatctagaggaatttgcgcgtgaaggattgcgaaccttgtgcgtggcagagcgagtcctcagcgaggaggagtatcggacatggagcaaagaacacgacattgctgcagctgcacttacagatcgtgaacaaaagctggagcaagtttcaagtgagattgagcaggagctcatgcttatcggtggaacagccatcgaggataagcttcaggatggggttcccgataccatttctttgttagccgatgctgggatcaagctgtgggttctgactggtgataaagttgaaactgccatcaatatcggtttctcgtgtaaccttctgaccaacgatatggaacttcttgttttcaacatccccgaggatcaaccgcagcgagcctctcaagagcttgatgagcagttgcagaaatttggattaaccggttctgacgaggaactcattgctgctcgagaggatcacaggccaccgcctgcaacgcacgcggtagttatcgatggcaatacactcaagctcatgctctctgatgagctgaagcaaagattccttctgctctgcaaacagtgcaagtctgtgctatgctgtcgagtcagtcccgcccagaaagcggcggttgtccgcttagtcaagaatggcctgaatatcatggctctctcgattggagatggggccaacgatgtcgccatgattcaagaagccgacgtcggggttggtatcgttggtgaagaaggtagacaggcggctatgtcctccgactatgctataggccagttcaggttcctccaacgcctgatccttgtgcatggtcggtggtcctaccgccgcatgggtgagactatagcaaactttttctacaaggtaagtgaggtatcgattgacgcgtgccacacattatgctga

SEQ ID NO: 15405 - DNA, 282 bp, A.fumigatus
acaatcacacagaatatggtctggactattgctctcttctggtactcgctctacaatgatttcgacggctcgtacctcttcgactatacatatattgtattggtcaacgttgctttcacatctttacctgtcattttgatgggaattttcgatcaggacgttgacgacaaggtgtcacttgccgtccctcagctgtatatgaggggcatcgagcgaaaagaatggtcgcagaccaaattctggtatttatctctcaattcctggtgttccagctccttctga

SEQ ID NO: 15406 - DNA, 543 bp, A.fumigatus
tatgccttcttcctcgctttaccgtcaaagccgtgcaaaaggttttctttccctcgggatgtggacatcattcgtgagcaggtcacgcaaggtaaattcaagtatttggaccaatacgaggcatttgttcccccgaaggccgctgcaacttctggtggcctgagcaatggatcagccgcgtcgtcagatttgggtaaaccaatccagtccagtatgaaacaggatcccttctcagacgatcagcagatctacccgccgtcggtcgctcccacaattcacacccacaatccgcggagccagaacggtagcaatgggaccaattacagctttgacactacacaacatcctcgccctcagtcagtgcagtgtgcgcaacgcacccgtcattcatttgatagagctcggccgagttacgatgtcaattccgacttcaattcgggcgcgatgctgagccgtgtcgattctgcgacgggcataccggtgccgcagagtccccatagcccgctcaaaagtcctcatgacccaccatcatatcaggtataa

SEQ ID NO: 15407 - DNA, 555 bp, A.fumigatus
cgacaaggtgtcacttgccgtccctcagctgtatatgaggggcatcgagcgaaaagaatggtcgcagaccaaattctggtatttatctctcaattcctggtgttccagctccttctgacatcactcaggctgtatatgctcgatggcttttaccagtcgatcatatgtttctatatgccatacctcctctttagccccgcgactttcgtccattcaaacgggttgaatatcaacgaccgaacccgaatgggtgtccttgtggcttcgtgtgccgtcattgctagcaacacctacatcctcatgaatacctaccgttgggactggctgacggttttgatcaatgtcatcagctctctcttaatattcttttggaccgggatctactcttcgacaaccgcgtcggctcaattctacaaagctgctgcagaggtttatggagctttgtcattctgggttgttctccttatgacggtgataatatgccttcttcctcgctttaccgtcaaagccgtgcaaaaggttttctttccctcgggatgtggacatcattcgtga

SEQ ID NO: 15408 - DNA, 195 bp, A.fumigatus
atgacagtcgaggcagaaccctccgcctgctcaaataactcgcaaacaaggacattcacttgcgcctcttcgcaaatcgaacaacaaacgaagtgccaaatgaggttgtttgaaaggtgcaaacgaagtctaacagtgcttaatctcaaggcaagtgcctctttacaacaaaaagtgagcctgggtctcctctga

SEQ ID NO: 15409 - DNA, 1050 bp, A.fumigatus
aagagaaggttagtttcattgttttaccggaaggcagcttcatgtttgcttacaatcaaccagggtgatcgcactactccttttatcatgcctcctcgcggcaagaagcactacaccgagatttgggccgaagaggatggactgatgaacgtggatcaagccaacggcgatcgcgaacgtcttcctctgaaccagggacgcggcagcatcgatcaggtcactgacgagactgtggaaaccgacaaggtctcggtcggacccttggtcagccgtctctattcccttcttcgctatgaacaccgtgcagatcccgacgagaactccacgaccggcgctgccaatggagagccttccaccagtaacttcttcaacggagattccatggatatcgatcagccagctggtgaatcagacaccaagccacttccgtccgcgacttctttccccgatgcttctcctagcggcttcaaggtccccgcagccaagctcgaccatgctcagcttgacgagcgtctcaaagcagagctccgccacattggcttccttggcgaggatgacaacccggattacgatgcccattacgacgatgatattgcacaacgtttgcgtctgctccagagcgaactcaaaaagcaaatggttaccaacaatgcccgcaaggcgcggctcctagaaatcgctcgtgaacgcatggcctaccaggaatacaccaccattcacgacgaccttgactcccaggttcagcaagcttatctcaagcgcactcgcactctgggtaagagcaagaaaggctcccaggccaagcaccggcctggtggcgccggcggtggcagccacgtcgccagcggtgcaggtgtgagtaggcctgccattggcgacgtggctcggaccctcatggaccggcgcaagcgctgggaggagtgcatcgggcccatcttcaaggactcgaagacttcggtccccggcaagggcgagactattttcgacccggccgtcatggctgaatatgagaaggccgagctcgaaggctgggacgaggagcaggagtag

SEQ ID NO: 15410 - DNA, 402 bp, A.fumigatus
aagaccatcgtcgaccgtatgagcggggttggccctatcccggattctaagtctctcgagtcgttgatggaacacctcaagactctcagtcagctagcagaggctcgtgttgatgcctgcgatgctggtattagagagctctcgcagaaacgcaaagaggttgttgaagaccaggaaacatacgaccgcgagactgcatccaaggtgaagcgcgatatcgacgatgacgaagaggaacctatcagagcctccaagggaggaaaactgaagaagcgtagggagcgtggaggaagcacaaaggaggaccgtccgttggcacatggtgctcatgacatcgcccgtcaggatggcgctgagacaaaggtcgaaggaggtacgttttattatgccttatttttgtga

SEQ ID NO: 15411 - DNA, 570 bp, A.fumigatus
agttcagctccaaacatggatccagctaacgagccaaacctagccgcttccccagcctccaagaagtcgaagaatatggcgtctgaagtcacctcccctacctgtccctcgtctatgacatctcccaaatacactgctactgctggtgaagcttccgttactgccgagtctccttccgaggatgacagtgatgagcaccagcctgaacccgctccggccattcctcaaattcaagtgtttggtccgaacccgctcaaattcgatgatcctaccatctatcacattcgtgaagtcactcctgatatgacagatgaggagaagaaggagatctattgcgtcaaccgtttcccaaagagtgatctaagccacatgatggctggcgttcctccagacaaagatttcagcaacgccaaacctactaatcaagtcagcgccaacacttttctctcttacatcgaaccttacgtgcgtcccctgaccgaggaggacattgcgttcttgaaagagaaggttagtttcattgttttaccggaaggcagcttcatgtttgcttacaatcaaccagggtga

SEQ ID NO: 15412 - DNA, 183 bp, A.fumigatus
tcgctgacgatccatgcagatgaattgaacacgctgaatatcaagctgttccccgtataccctgctccccctcaggtgcgagcctggcaggttcctctcttcacagtccggtaccaggcgtttatggatgagaattgggatctgaccatgcaacgggtacgccttaaaagatgcgacctgtag

SEQ ID NO: 15413 - DNA, 1161 bp, A.fumigatus
atcgtgcctcatatcaatggcgtcaacagcatccgcatcatctccatcctcgcagacaccgacttctccctcacctgccgcgcgatccgccatctcctctactacggctgcctattcctgctagacatcttctccttctcagcaatatacgcgcccaccgcccaattcagctctaccatcgcctgtgacgaaggaatgcagcgcgaatgcgcccgctacgtcaatacgctcttcgctccgtccctcatccacggaagcgccagtgccgccactgcaccgtccgcctcgacttctgcactgtcacccgccgcccacggcctgacaaacgcccacgtttccggcatcccaggcaacctcgtcggcctctccaagcacgacccagactctgtgtggcccccggtaggcgactaccgcgaccgccgaagcacaagccgaacacctagtccaagctcgagctaccgctccagtaccacaacaccctccaactcgaccatcctcccagacgatcacgaccccacgcagcccccacctcccccggaagtggtcgatggcgtgggcatcgtcgagctctacgcaagcctcaagcagggacagagcgtgcggcaatggtacgcgcagaacagccgcaagctcgcctacatcgacatccggcgctttatcacgttcggcatcatcaaaggtttcctataccgggtccacaagtacgcctacgcgacgggccagcccgcaccgcagctgaagtcctcccatcattaccataactcgcaatcgcagccgccatcgggaccctcgtccagaggaccgggcacagggacgaacagtccctatgcgtcgagtgtgggcgatgacgcggctccgattgcccagcagcagcagcagcagcagcagcagcagcagcaacagcatcattatcgccagcaccctggacagcgtggggatgacgcgagggagcatgcaacgtctgtacatagcgggagccgctccgcggtcgtctttgatgacgaggacgaagaggagatcgtagataacaagacgctgtctaaatacctggacggcatgcattgttttgatcagatttgtactgagctggagatcagtgagaaggacctaacagcggcgctgaagaaatacccaggggaggtcttgattatacaccgatga

SEQ ID NO: 15414 - DNA, 282 bp, A.fumigatus
ccgatcggcctgaaatcgccccggtatgaccgcaatgagttcatcttcaacttctgcctggttctggccgaggaggaggacttcagctcgtacaagagtgtggtgcagaagcttgccgatctgatgcatgggctggaagaacagaatggattcttgtctagggatcattcgaaaagtggagaggggaaggtatacagtttgtgcgagacattgatggaggatttgaacaactactgcgagtgcatgattccgataggtacattgccttcttcgcgaggctga

SEQ ID NO: 15415 - DNA, 402 bp, A.fumigatus
gtcttctacaaggtcgggttcggtgggctttcatacacctggaatgtcctggcagccgatgtgacgaatctacgaaaccgagggctggcgtttgctttcacctcgtcccctgctttgatctccgcgttcgccggttccaaggcggcgtcggatctcctggcccactcgacctggcgatggggctttggcatgtgggccattatcttgccggttgttgcgctgccaatttatggccttttggcgtaccacctacgccaagccgagaaaaagggggttctcgtcaaggagacgagagattggagtatcaccccgaagacagtttggtgggccattatggaatttgatcgtaagtatcaaccaagggcggttgtcgcctcaaaagggttccttaccgaaggctaa

SEQ ID NO: 15416 - DNA, 804 bp, A.fumigatus
aagcactctagaggagaaaccaaagaaaacgaactagcctcatcaactctcttttactccgttgactcttcccgccccaactaccctcttgacaacatgacaatcaaggctcagcccactctgcacactgcccgcctggagctggtccccctgggccatgagcatcgcgagttcaccatgaagttggacatggaccccgaggtcatgaagatggtcgccttcggccggccatttaccgaagacgaagcaatccaggtccatacctggctgatgaactgcgcaacgtcggtgcctggcttcggaacctgggtcggctttgccgaaggcgagttcgtgggttggtgggtattggctcccgtccccacgacggagaaccccaagagcttcaggaccgatcgaacggagtatggcttccgagtctcgccgaagttctggggccaagggtacgcgaaggagggggctcgggagatggttcgctatgccttcgaggaactgggtctggccgatgtgattggcgagacgatgactatcaacatggcttcgcgggcggtgatggccgggtgcgggttgacgcacgttgagaccttcttcaacaagtacgatactccaccgccaggcattgaggagggagaggtacggtattcgatcactagggaggaatggttgcggatgcaaaagcccagcatgactcgaagtcgctggtttccggctttcgccagctggctgccccgattgctcctgtccaggctctggtcctatattttccaagggcgtaggctcgcagctggggcggccagcccctga

SEQ ID NO: 15417 - DNA, 402 bp, A.fumigatus
ataacctgtgccggaagccggtatttaacattcatgcttcacgtcttatcagtcggtccgtcccatgcagcgtttactgtcgaagcagcaatggcaaccatgaagaaattccactcgattgtcggtgaaaagcctgcccaggatgctgaggccccctcagtcgatgacccaaatgttgggcagatcagagccgacgacaaggaggctgctcatgcgcccgccaatgcggaaaccaataatgaggaggccaacccgagcgacggagctcaggctggtgtcaagaagatagaggctgtgaccctgagttggaccaggggcacagcgtacgcaattctagtgctgtatgtttcgctcccattgattgctgcatgtgccagccatcccaaaagatcaaactgctaa

SEQ ID NO: 15418 - DNA, 312 bp, A.fumigatus
cctggttttcattctgatagcatttggttcctaacgctggtcaacgatttccgactgtccatgtatacaagcttgaacgcttatgccacaagttctttcctcggccactcgctgttgaccgtcatcaacattgtgtcctacgttatgggcggttccgtgtacataccgatggccaaggcgctggatctttggggccgtgcagagggtttccttctgatgactttcttctgtattctgggtttgattcttctggcttcatcccagaatctccccacctattgcgccggacaggtaagacatgaccaccgctga

SEQ ID NO: 15419 - DNA, 1008 bp, A.fumigatus
gtatcaaccaagggcggttgtcgcctcaaaagggttccttaccgaaggctaatcaatgatcttaccactcacctagtgcccggagttcttctcttcgctggcgggttcgtcatattccttctcccctttactctggcggcgacggcgccccatgggtatcagaccgactatatcattgcgatgatcactctcggcctggccctaatcatcgcttttggcttttacgaaatgctcgtggcgcccgtgccgttcttgaactataaattcctcattgaccggaccgtgctgggtgcatgtctgctggatatgacatatcaggtttcctactactgctatgccagctatcttccgtcgttcttgcaggtcgtgtacgagctggacgtcgccacggcgggatatgtcaccaacacgttcagtgtggtctcctttgtcttcctgttcttcgccggttggctcatccgctggaccggtcgtttcaagtggatcctttgggtgtgcgttccgctctacatcttcggcctgggtctgatgattcacttccgtcaaccgggcggatacatcgggtacatcgttatgtgcgagattttcttctccgtcgctggaagcgtcttcattctctgcgtgcaactggcggtgcttgcgtccgttgatcaccaacacgttgccgccgtgctcgcgttgctgttcgtcatgggcagcattggcggctctatcggcagcgcaatctgtggagcaatctggaccagcacttttctgtcgagactggagaggaacttgcccgcgtctgccatgcctgacttgagcttgatctattcgtccctccccacccagctcagctaccccgtcggaagtgctacccggaccgccatcgtggaggcatacgggtatgcccaagcaaggatgctcattgccggtactgcattcatggttctgggcttcatctgggttggcatgatgaggaacctgaacgtgaaaaacatgactcagaccaagggtaatgttgtgtag

SEQ ID NO: 15420 - DNA, 1158 bp, A.fumigatus
ttgattgtccttgatagtcaaggtgacctggttgttgctcctagccctagagtcgagcagactgaggccgccatagccaaaactctgataacaaagcgacagaaaaatgtcagccaggctcgttacccagagcgtccaggttatggaactcagggctctccggtgacgctctacgccaattacttcgagttgaagtctgtgggaaaggaattgttccgctacaatgtcgatatcgtcgccgactcagctagagccaagcctactggaaggaaagcccgacaaatcatccggctcttactggacgagcatctcttgcaataccagaacagtattgccacggactacaaatccacccttgcctctagggttgagcttcccagtcaagggcagtacgacgtccgttaccgtgacgagcacgaagatgactaccccgagcagcctaaggtttaccgtgtcaactgccagttcaccggtagactgaaccccggcgatctccttgactatttgacctcggcaaatgcctccgccatgttcgagtccaaggcagaggtcatgcatgcgatgaacatcgtcattggccatcatccgaaggcggacaggtccgttgtatccgttggtgcaaataagcactttgcaatccatccaaatgcagcagagagatacgatctcggtgcaggccttgaggtcttacggggcttttttgtgagcgttcgggctgcaacggctcgtatcttgatcaatgtccagattaaatacgccgcctgttaccaggaaggcccgttggcaaatgtgatcaacgagtaccaacgtagtaacagtcgcgatatttacaaactggaggctttcctaaagaagctgcgcattcaggcaacccatatcgtcaggaaaaataaaaagggacaagtagtaccaagaatcaagaccattgccgggctcgcaactcgggctgatggtgcgtcgcttcctcatccccccaaagtcgcaagacatggggctggcccaaatgacgttcagttcttcctcgatgcgcctgggcagaagagcgagcctggaaactccaagggcaagaaaggcaagaagcctgcgaaagctggcccagcgccagccggccggtacatcaccgtctcggattttttcttgcaaggtaagttcccctag

SEQ ID NO: 15421 - DNA, 501 bp, A.fumigatus
agtgtagtcaagtggggggagctggagatagctcgaaaatccccccagcgcttaacccaatcttccttagaccattctttctcatactttcattctcttacatactctgtgaacctggtgaacttcctcattagactcaattctaccatgtcatcaagaggtgctggggattcccaacctcgacgcggtagaggaggcgaccgtggatgggcacgcggtggagaccgcggcgctagtggacgtggaggcggccgaggaggcactatggagcttccattccgtccaagcgagccaagaggcgggtcttatagaggagactcaagaggtcgtggagggggcgaattcagaggcagcggcagaggggactccggaggtagagggggtagaggcgggggcttcagaggtggccgcggcgaccaagggcccaggatattctcgtatgtggctatcaatcctttctttgtgtttttaacggcgtattggttgattgattgtccttga

SEQ ID NO: 15422 - DNA, 1590 bp, A.fumigatus
atgcctactatcgtagagatcgagcttgcaagtgagagacagtctcgagaagcgctgctcccagcagaggagtcacatctcgggtacccagatctgccgtggccggtgcgtgttctaagacttatcgagcccactcttcctcaaagcgtgagtggatctgtcagagatgctgcttcacctgtgggtaatcctcgggatttgcctcctcatgaagaagaggaagatgtgaagccggctgctcgacaaacgaccggctcccgtgtctcttggggagagcataaaacgcatgagtacgaagttccttccacgtcctccgaacttgaatcagtggaccatgaaaccactagagagcgagagcaacctcattcgccggtgctccaacaacggtatgtatctcccaaaaacgccgcggatgatgtgggtgcggacattgaatttgcggctgccttggctgctgccactgcagcagcaggctttaatcctgccctcgtgacggaggatccaacatatcatacctggtcttcgcctcctggctctcatggcagggttgagtacagggacccatgggttgagaccgagtcaaagtctcgcattcctcatggttttgtcgaaggcgaggttgagactcccgaggaggaaaaagccccatccagtagagtcatcgaggagcagccactgtactctgaacccgagcctgtttcacgggaacctgagagtcaagaatcgtctgagcctcaaactcgaacttcgatcgctcaggaggtaatcgaccggctcagtgaaaagcaagatgagcgagacggctcacgtaaagctctatacggtacagaaaagagttcaaactctggcaaggaacgcgacgaatctgagcttcgcgctcaagattcgttttcaatgcccggtggatttgaaacggaagaattacgctcagatccaaagcgtgatgtggactcgcgtgacgacggtgatgtagaccgccgctccgttgcttctgcacctgtatctggcgaatacgatttctcaacaagaccaagaaaatccacacaagacagcgaatactttgacaatggtgaagatgccggatcagcgtcaattgaacaagatggcagcgaggggaagaaaaagcgacggaaaaggcgctctaagcgtgacagtgacacctttactgactccgcctctgtagagtcatcacccgccagaattgggcagtccagcgagaagctcaagagcatggatgacaaggataaagagaaaaaagcgggaggtttcttcagcagtatctttggttcgagagtttcagagccggtagacagcaagagatcgtcctctacagataggccgtcgcgtgacgttcactccgagatcgggcgtcgagagtatgaggagtctcgccgccagagaaaggaggaaaagtcctcccggcgagatgaggagagcggttccgataaggagaacagtaaggttagagataaggatgatgttgacattgagaactacaagtctagcaggcaacggagggaagagagacggcgacgaagatacgaggatattgtggattcgggaaaatctggggagtatgagaaggtatag

SEQ ID NO: 15423 - DNA, 1674 bp, A.fumigatus
  unsure (1656): Identity of nucleotide sequences at the above locations are unknown.
gaccgcaaattatcggaagacaacgacgagaatcaatcttttttagcagaaggccccgaaatgccagcccagataggcgacggcgatagagggagtggtgcttcggggcatgttcgtttggcagagggggccatcacagggttgggtataggcgtactaggacagcggccaagagggcgctcaacacctcctgaagcttctgagagaatcatggacccagcccctaggtcccggagtaggcctgcctcgcccgaaccggatcggcaagagggagacaatcagagccagtcgtcacgacgatcatccatattgcggtcgaaggactctcctaccgcagtgccgttgcacttccgtcgccctccagcctctcccgggacaaaccgttcggtttccgtcggcacccctactgcaccgtccccagggtctccaacaacccctaaacgccgaccaaattctacagagtttaagaattcccgcgagatgcggcccttgtggctagtagagcgtcatggtcctggacacggggagcatgagcttgaggagccgttaccatcactgccatcaagcaagacttcgtccgcgaatacctcggtcgaagacctcacagcccttcaggacgagagaagctgggaagcggttgacctgagccatcatgtccatggcatgcggcgactaagcggcatcgacgtgtctcagagcagagggttcgagcatgatgcctttggttctcagcatgtaacacctacggcaacaacttttgagcagatacacccacattcacggaaagagaagttaaagtacgagtttcattctccctcagaacttcttcaggatccaagcccgtatggagacgtacagccctctaacatgggagatctcccttccgcggagggctctgccgtgggcgtcaaggatgcaagttctgagaatgaagacagtgcagaactcgcagctgaggccttgccccctcggccgtctactccgcaaaacaatgtcaccgcggcctctgaagacacggagaccacccccactcaaaccaggaccgtgaatgctttcgaaggtccaggattcgctggggtggtggatgctgctgttgcagcagccgtgagtaatcgtctcagcacgcggccggatgttgcaattcccgacaaaagtagtccagaggatcttccttacgatgcggacagaactcataagccaattgccgaccaggaactcgcagcaacctcccctcccgcccccggcgtacctctgggctttgctgccgttgtcgatgctgcggtcgctgcagccaccatctctattggtgggcagcctgaggctgctaaagaacttgagcagtcgcctgagatatcggagcccataccccaaaccccacacccaaacgagcaagagacatcacatccgaccgggaacgacagtgtcccgcgagacgacaagagaagggattcggttgatacagtggttccccaagcggaagaagcatcggatgaaaaggagaagctggacaccagtgcggtcatgccagacctgaccggggaaaacaaggagcttccgtccgaagcgaaaaatgagaacgcgaacgacaatagtcaggctcaaacagagcagccgccggtcgatactgacgagccgtcttcgtcttctgccaagaanaagaagaagaagaattag

SEQ ID NO: 15424 - DNA, 201 bp, A.fumigatus
acaaggattccagatcaacaggcccatggaatcgagtctttgtctcccgtaacggtgacctatggatatctccataaaggtactgaagtgttttctttctatcataattcgcatgacgatgggttttttgaggatgagagacgtattggaaagaatatctttgtttactatgagattcttgaggctttagaagaaatttaa

SEQ ID NO: 15425 - DNA, 642 bp, A.fumigatus
tcaactgtacgcaaacccctgaacgggctaaccattcttcaagacgttgagtattatccaaaccaattttacaaatctaacagcatgggtattccacagtggtccgagcaggacgagtgtcaggcgcgcatgcaagatgccggtctctacatcgactggccaaacccctacaacctcgaaccgggcctctatattatcgtccacacggactatgccacccggcccggcgacattatggatgttattgacgacgcatatagtgccgtcacaacgcgactcaaatcgcaaaagttcagcaatccgaggcagccacttccagggcgcaagagacttttcatccattatgagctgatcaaccaggatgatgggaccaccaactccttcccgacagaggtagacctctttgaggatgttcagagacacctcatgcacatgtttgatcagctggagttcgggataaagtttgatttcccgtataaacttggtccagtgcatgtgttttggtgtgatatggtcgagtgggagcatgaccttcccactgtcactgttgaagtgtttgaggagacggagtctgattcgcaggacgctgtctcccccacaatcacagttgaaatgtatgaggaggtagactctgactcgtaa

SEQ ID NO: 15426 - DNA, 219 bp, A.fumigatus
aagctgattgtgttctcagtaggttcgtccaggcagttaccacgctttttctttgtcgcgcaggtctctaagtcttatgatgtctcgaacttgggtcaaattgtggaagcgcgatcctacaaaaaggcgtttaagtctcaaaaaccctttgttgttgcctgtagcaaattggtctttgtccattgtgattttttgacatggccggaatacctgagatga

SEQ ID NO: 15427 - DNA, 255 bp, A.fumigatus
atcagtatcgtcgtgcaaaatactcatatctcaacaatggagagcgcagatgttgtcgagtcaccgcgcaagcgactgaagaccgaggatacccccgtctcgggcgatgctgtgctgcatccttccaccgtgccgggtctggagttctccgacggggatgctcaaacattgaaagaagctgaggtcggaatcaccgaatttgtcagtgcagacaacctgggcttttccggaattctgaagaagaggtacaactga

SEQ ID NO: 15428 - DNA, 240 bp, A.fumigatus
gtgatttcgagtcagaataccgcacccaaatcaaatttaaacataagactaatgagctggctggagaagacctgtcctcaacctaggcaccacgcctacaagacggatcggcgtccggaagcccgacaagagaccttcgatcgtctatccgatattgcagtttctagactggcccaagctgctattatgtataatcgtacgatgattgacgatttcaggaggccagtggttcttccttga

SEQ ID NO: 15429 - DNA, 873 bp, A.fumigatus
aaagatgcatgcgaacagcgcagcacgcaactccaaaattgcaagactaaacaaaaagacatacctttccacaacgataattccaaaccatctggaccccaaacagtatgtgccaagtgtcggtttttgtatcgctctgatggctatttttttcagttagcccagtgcaccaatcgaaaattcagttacaaacgcaaagccaaagagggatcattgctctgcagtttcaggaagctcatcgtcatcttgcgcctccccttacgagtcagagtctacctcctcatacatttcaactgtgattgtgggggagacagcgtcctgcgaatcagactccgtctcctcaaacacttcaacagtgacagtgggaaggtcatgctcccactcgaccatatcacaccaaaacacatgcactggaccaagtttatacgggaaatcaaactttatcccgaactccagctgatcaaacatgtgcatgaggtgtctctgaacatcctcaaagaggtctacctctgtcgggaaggagttggtggtcccatcatcctggttgatcagctcataatggatgaaaagtctcttgcgccctggaagtggctgcctcggattgctgaacttttgcgatttgagtcgcgttgtgacggcactatatgcgtcgtcaataacatccataatgtcgccgggccgggtggcatagtccgtgtggacgataatatagaggcccggttcgaggttgtaggggtttggccagtcgatgtagagaccggcatcttgcatgcgcgcctgacactcgtcctgctcggaccactgtggaatacccatgctgttagatttgtaaaattggtttggataatactcaacgtcttgaagaatggttag

SEQ ID NO: 15430 - DNA, 339 bp, A.fumigatus
ggtcggaatcaccgaatttgtcagtgcagacaacctgggcttttccggaattctgaagaagaggtacaactgagacctgagatactgcaaatcaagttaaccctcttttgtctcagatacaccgatttcctcgtcaatgagattcttccgtccggtgaagttttgcatcttcgaaatttgaatccccccacttcgcctacagatggaaccaagaccaacgatgctgaatccaagtcggaatctcctatagcggataatactgtagagccagcagcctcgggagagaaagatgcgccagccgctaaacaggtgaccgctgccgagttccagctctcagag

SEQ ID NO: 15431 - DNA, 1437 bp, A.fumigatus
acacgattctgtggatcatacaagctcgagcttggcagatatccacgccttgcagtaatgggtcaatcgcattccaagggcaattctggccctggcgactcactgcagtcctatccatccttctctcgctccgatactaaggagtctcttcgctctcttcgcggctccatccggtccaagattcggagtagcgacagtcctagaggatcgactgcaggattgtcggacgataaatccgacgccgcatcagtcaagtcgacaaccagtagacgcagttccaccaaccaaagcgtcctgtctcccgatgataccccttctcaacccgatgctcccgagcctcctccatctccttccctgtcgagtagcttgaaacgaggtcataaagatgtcaatgcaatgcagcagagtggtgaggtcgaccatgtatccgatgtaccccccaccggcgctgcacccacaggcccgtcgacacaaaaagtcggcgaatcgatcctcatcaaaagagaaaaccaactgaatcctattctggacttcatcatgaatgctccattagagacgtctggatctccgggtatgggaatgggtgccctgaagtctattgaccttgatgacatgatctcacgactgctcgacgccggctactccaccaaagtcacaaagaccgtttgtcttaagaatgcggagatcatggccatttgttcggcggcacgggagctcttcctctcccagcctgcattgctagagctgtcggctcctgtgaagattgtgggcgatgtccatggccaatatacagacctaattcgactttttgagatgtgtggatttcctcccgcttccaattacctcttcctaggcgactatgtggaccgtggcaaacaaagcttggagacaatcctgctcctcttgtgttacaagctcaagtatcccgagaactttttccttctccgcggtaatcatgaatgtgccaatgtcactcgtgtttatggattctatgatgagtgtaagcggcgctgcaacatcaagatttggaagactttcatcgatacattcaactgccttcctatcgctgctaccgtcgctggcaagatcttttgtgttcatggcggactgtctcctagtctctcacacatggatgatattcggggaattgcaaggcccactgacgtacctgactatggcctgctcaatgatctcctatggagcgacccggcagacatggaagaagactgggagcccaatgagcgcggtgtcagttactgcttcggtaaaaaggtgatcatgaactttttgcagcgtcatgacttcgacttggtctgccgcgcacatatggtggtcgaggacgggtacgagttttaccaggaccgtattttagtcactgttttctcggctcctaacgtgagtaccgaacattccttttgcatgatttttttcttgtga

SEQ ID NO: 15432 - DNA, 276 bp, A.fumigatus
  unsure (253): Identity of nucleotide sequences at the above locations are unknown.
tactgtggcgagttcgataattggggtgccattatgtcagtgtcaggggagctgctatgtagctttgagctactcaaaccgctggattccactgctctgaagaaccatatcaagaagggcaggaaagagcgtaatagcatgttaagcaagtctgtgaggtcccccttacttcgcttcgttggcgccaaggagatcacaactttttgtgcaaaatcgccgagacgcttgtgggctaattcttgcctatccggcntttggcacatcagggggcataaa

SEQ ID NO: 15433 - DNA, 996 bp, A.fumigatus
  unsure (828): Identity of nucleotide sequences at the above locations are unknown.
atctattccgcagatgccaacttgattgtctccctccttgatatccacgtcacccccccagcagaaggatctcaggaacagccgccattggaaatcctcgagtccggcacgggtcatggctccctaactctgcacctcgcgcgcgcgatccaagcagccaactcagttccacctcctctcccaccgaagtctcagatccaatacctgcagggacgaccgatccgccccggaaccgacgcggaaaaggcagaccccaaatcaaccagcaacaccatccaagaatcaccagacggattcgtcgagcagcaaactgagcaacaacaacagcagcaacagcagcaatgggacgcctggcgcgcccaccgacgagccatcatccacaccgtagacgtgtcccccaaattctccgcccacgccgaaaagatcgtccgcgggttccgccgcggaatctacgccggtaatgtcgacttctacgtcggccacgtggagaactggatcgcagagcagaagaaagtccgcgcgtcgagatcccttctctcgagcagccccacagtcgagccgttcctctcctacgctatcctcgacatgccctccgcgcacctgcgcatcccccacgtcgcccccatcctgaaacgagacggcatcctagtcgtgttcatgccaagcgtgacccaggtcggtgactgcgtggacctcatccggcgggaaaagctccccttcatccttgagaaggttgtggagctcggctccggcattagcagcggtcgggtctgggatgtgccgtttgccgtgaagaagtcgcgtgctgacccgtcttcgtggactgangccgcggacttcgcagagacccgaggaagactttctgacgctggcataaaaaagtacctgccgctcctgaaggagctgcaaggcaagatgatagcgtgctggtctgccggcctaaagtcgggacccggatcgtgggcggaggtttcgtcggcgtgtggagaaggatag

SEQ ID NO: 15434 - DNA, 183 bp, A.fumigatus
  unsure (8): Identity of nucleotide sequences at the above locations are unknown.
gtcggtantcagggcctgcattgcgacggggaatcagttttatattccttgtggtcaagaatagaaggatctacccttgtgcgcctttacaagatctcgcactcgctgaccaatgatgctatcgtgttccagaactcctcgtcgcacatcggtcttctgccctcttcgaaggggcttcgttaa

SEQ ID NO: 15435 - DNA, 378 bp, A.fumigatus
cttccggtatgtgcagttgcaaggcattgttcccagcgaaggcgtcccctgacttcttcaattgtttacagtgatgccttccgcgatatgttggacagcgtcaagacgcctttcgacaagtgcatcgagatcctccaggagaacatgaaacttgacccccactttatcgagttctactactgggccgaggaaaacaacgtcccaattgtggttttgtcatcggggatgaagcccatcattagtgccttgttcgagtcattgctgggacacaagcctcgaagccatctgcacattgtttccaacgacgtggagagccgcgacggcaaggacatcaacactgtaggcggttggaaaatcaagtaccacgatgacaggtaa

SEQ ID NO: 15436 - DNA, 1212 bp, A.fumigatus
acggtggggccgtttccccttcccaccccccggcaccgggattgggttgttcttggagcggaaccccccagttccttggaccattgtaatgaacaaagtcagttccctttcaaacaaaaacaatgggtgattcttcggcattccagtcacatgacggttacgttccagctcggtaattttctggggagtttaggaagggagctcatctggaacgagctcaggtttcacgattcggatatcattgttcttcaggaaatcgaccaaggaagctataatgagtatttccgggaacaactggcttacaatgattacaagggtgtttactggccacggggaagggctatgggcatgcaggaggaggacgccaaatgcgtggatggatgtgccaccttcttcaagggcagcaagttcatccttctcgacaaacagctgatcaattttggccagacagccgtgcggcgcccagatgcaaaaggtcaagacgacatctataaccgactctggcagaaggatcatattgcggttgtcgtgttccttgaaaacaggcagaccggtgcgcggttcattgtcgtgaatgctcatctctactgggacccagcattcaaggatgtgaaactgattcagacggctattctgatggaagaactcaccaaattatcggagacatatgccaaatggccgccgtgcaccgacaaggcggctttccgattctccaaagaggagggccaatcagaaacaccacctctggaggaaccggcgccatccatgcagtatgctagtggcgatcagatccctctcctgatgtgtggagatttgaactcgtctccgggatccgcagcatacaatctgattgcgcacggccggctcgacgaggagcacccagatttggagaagcgtctttacggcaatctcagcaaagtcggtatgacgcaccccttcaaactaaagtccgcatatggagctattggcgaacttcccttcacgaactacacgccagactttaaagatatccttgattatatctggtattcttcaaactcacttcatgtttcggcgttactcggagaggtggacaaagactatctacagagggtgcccggattccccaattatcattttccaagtgatcatatcgcattgctggcggagtttacagttaaagggaaaaagggtaaggttgtggaggcggactttgggccgcaacggaattga

SEQ ID NO: 15437 - DNA, 900 bp, A.fumigatus
tcgccgacaggagagcaagtaggacaacgacgacagccaccagcttccccgcaattcgggcatgcatcttcgacttggacggggcttctcatcaactccgaagacaaaatcactcagtctacgaaccgacttcttgaaaagtatggaagacctgttttcactccatcaattcgggcctcgcttatgggcgtccccgactcaacaaacagcgacctgttccacaactgggccaagttgcccatctcccgcgagcaattcgcccgtgaattgagggaagaagtgcaccgacagttccagacttgtaccccgctgcctggcgcggagaagctcttgtcaaacctgaacagtgcacgtagtacttgttctggtgagcggatcgagctggcattggcatctagcaccaagacccataccttcgacctgaaaatgtccagaccggaaaccaaaaagctgcttaacattatcccatccgagaggcgggtcctgggtgatgacccgcgagtggggcaggggcgagggaagccagcgccggatatatacctggtcctgtggcaagcattgaactctacggcagactctgggaaacccatcttgcccagcgaatgtttggtctttgaagatagcgtggccggggtcgaggccgggagaacggcggggatgagggttatttgggtaccgcatccggatctggcggtcgaatatgaaaagagacagagggaggtgcttgctgggaggacaggcatgattgaaatcggggacgagtggcagataggagagattgatgatggctgggatgaaagcataccgagtatggattttttcgatgatgagaaatatggcattggttgcaccatcgtagttgagctattgtctgagatctggtcccgcgcaaaagagtag

SEQ ID NO: 15438 - DNA, 291 bp, A.fumigatus
gttcatagaaccttctcccgtattgccctctacccattgcttatttcaatcaactcatcgcagccctgtagcaagtatgcccagttcatggggaaccccggagtatcctcccagctctctttcacatacagctcccccaatacaatcaatcctctggtgtcccgcagtaaccatgtcgtcgtagtcgtcttgtccttgaaggagcattacgacctctgggtgacatacgcgcaatcgaaaaccgccaatatctacatgcccaatgagttcactcattggtttgaatggtag

SEQ ID NO: 15439 - DNA, 2127 bp, A.fumigatus
  unsure (809): Identity of nucleotide sequences at the above locations are unknown.
atcatcctccgagcgcgccagcagcatctcttcaacgaattcgtttctgcccaccctacaatcaccgccgaagtcctagacattgcgcgaaacgcatataccgcctatttgaagaagaaccttccgttactgaaccccgaactgcccccggcgcagtatcaagaggaggtggagaaggtctacgcgactgtgttgaatggtggacccttacccggtaatgagaaggcgggcgatgacgaggcaaaggttaagatgcacatcaagacggtggcatcagctgcgaaggtaatcgcgcatgcggaaagcctcgaccaggccgctacccccaaggggttcgccgagtccttctactcaaatgctcaggaccttctcctcccgtatctggattcgctcaaggcgtcctcgatcaacgcggacgatcattctatcttcacgaagttgacgatgaagtacgaggaaaggtttatgaaggacatgcgcgacctcttcgtccttgaccccgacgagttgactagggtcaccgagtatggcgctgagattgcggactttgtggagaagattgtagagaacaagtttggctacgttacggacgacggctcagtatacttcgatatcactgctttcgagaatgccggacacccttatgcccggcttgagccctggagccgatccgataacaagctggtcgcggagggagaaggcgcattgaccaagaagacgacggagaagcgttccgcttccgactttgctctctggaaggcgtcgaagccgggtgagcccagttggacgagctcctggggtcggggcangccgggttggcacattgaatgctctgcgatggcttcggccaagcttggcaagcagatggatatccactcggggggtgttgatctagcgttcccccaccatgacaacgagctggcgcagagtgaggcttattggtcccatggccacccccacactgatcagtgggtgaactatttcttgcatatgggtcatctatcgattcaagggtcaaagatgtcgaagtcgcttaagaacttcacaacaatccgagaggcactggagaggaaagagtggacaccgcgcagtctcagaatcgtcttcttgctcggcgggtggagggacggcgtcgaaatcacggaggaactcgtcagtgctggaaattcttgggaggacaaagtcaacaatttcttcatcaagatgaaggatcctgcaacgttatcaggccagacctcgggctccgacaccactctccctgctgctctggaggccgcgaagaaagctactttcgatcatctctgcgactctttcaatacgcagggagcgatgtcggcgatttcagagctgatctcaaaatacaacagcgccgacaaatctacactcaatcccagggacgtcgaggctgtcgcccggtgggtgacctcgatggtcaatatcttcgggttgaatggcagcgcaaccgccgacagcacggaaattggctggtcgggtatcgatgtgcctgaagaagccaagcctttcctgtatccgctctccagcatgcgtgactcgctccgccaggctgcgcgggctaaggagggagtcaccccggagactgtcgcggagattgtgagcaagggagatgtgccagagctggacctgactgaatccgcaaaaccttatgctgaacttctttcgaacttccgcacgaaggtgtcttctatccagccatctgagtcgctgggcaaggagattctggccctctgcgatcgcgttcgcgacatcgacctgttcgatctcggcatctacctggaagaccgggagaaccttcctgccttggtccgtcctgttacccgagagctgatccaggctcgggaggaaaaggccgcgcgggcgcgccagaagcagattgaaaaagaaaacaaggagaaggaagccctcaagaaactggagaagggcaaactaagccacctggagatgttccggaccaacgagtacagcgcctgggatgaagatggtatccctactcgcgatgctgccggggaggagattacgaagagtcgtgcgaagaaacttcgaaaggactgggagagacagaagaagctacatgagacttggctggccagtcaaatgggcgccaaatag

SEQ ID NO: 15440 - DNA, 756 bp, A.fumigatus
caacgcaggtggtctgggaattgtatgtctaggacgcacttgagacaaccgagtctgaaagaaaagaccatcgctaatacacccaagctcactgcactcacgcaacccacccccgaagaccttcgcaaggagattcgccgatgccgaaccatgaccaagaagccattcggcgtgaatctgacgctcctcccggccctcgtgcccccagactacgctgcctacgcacaagtaatcatcgacgagggcgtcaagatcgtcgagacagcgggcaataaccccggccccgtgatcacgcagctgaagaaggccaacacgatcatcctgcacaagtgcacgaccatccgccacgccaagtccgccgtgaagctaggcgtagacttcctctccatcgacggtttcgagtgcgccggtcacgttggcgagcatgacatcacaaacttcattttcctcagccgggcgcgccaggaactcaacgtgccgttcatcgcctcgggcggcttcgcggacggacagggtcttgcagcagcgctggcgctcggtgcggaaggtatcaacatgggtacgcggttcatgtgcactgttgaggcgcccatccatcagaaggtcaaggaggccattgtggcgtcggacgagaacaacaccaacctggttatgagacggtggaagaacacctcccgtctgttcaagaacaaggtgtcggaggaggcgccgaagattgttcttctaccacaggcgtcgaaggactcgcgcataggt

SEQ ID NO: 15441 - DNA, 183 bp, A.fumigatus
cgaggaaactgggcattgccggtgagttgcatggacttggagttggtggaagggactccggttgctgacggatctacagtccctgtggtacagggaggtatgcagtgggttggatacgcagagctcgctgcggcggttagcaacgcaggtggtctgggaattgtatgtctaggacgcacttga

SEQ ID NO: 15442 - DNA, 567 bp, A.fumigatus
tacggagtaacttgtcaaacattaggtaggtattgctcaacccttccccttcgttttaggtggtcgtaccaaatccccgtctccctcttctttcctctgttcttgatgcccatatccttctctcgtacctcactcttggtctcctcttttgcgaatccctcgaaggcccggttgtcgttcttttctcctctgttgattttttctagatcaatggccaccgcgcgccagcagccgccatggcggcaaccgacagagtatcccgaggccaaagctcgcttaccacctctgaagatttggaattcgttgacgcgatctaagaatccattcatccctattgaccctgaaggcaagaaggtgacctggtatgcttgtgggccgactgtttatgatgatgcacatttgggccatgcccggaactatgtcagcaccgacatcattcggcgtatcatgcgcgactactttcatttcgatgtgaagttcatcatgaatattacagatgtcgatgacaaggtatgcaaggctctacatgtgccattggtctccttagcaactgtgctgatgcagtga

SEQ ID NO: 15443 - DNA, 510 bp, A.fumigatus
cttcacggcggacttggcgtggcggatggtcgtgcacttgtgcaggatgatcgtgttggccttcttcagctgcgtgatcacggggccggggttattgcccgctgtctcgacgatcttgacgccctcgtcgatgattacttgtgcgtaggcagcgtagtctgggggcacgagggccgggaggagcgtcagattcacgccgaatggcttcttggtcatggttcggcatcggcgaatctccttgcgaaggtcttcgggggtgggttgcgtgagtgcagtgagcttgggtgtattagcgatggtcttttctttcagactcggttgtctcaagtgcgtcctagacatacaattcccagaccacctgcgttgctaaccgccgcagcgagctctgcgtatccaacccactgcatacctccctgtaccacagggactgtagatccgtcagcaaccggagtcccttccaccaactccaagtccatgcaactcaccggcaatgcccagtttcctcgttaa

SEQ ID NO: 15444 - DNA, 294 bp, A.fumigatus
  unsure (127): Identity of nucleotide sequences at the above locations are unknown.
gcctcactctgcgccagctcgttgtcatggtgggggaacgctagatcaacaccccccgagtggatatccatctgcttgccaagcttggccgaagccatcgcagagcattcaatgtgccaacccggcntgccccgaccccaggagctcgtccaactgggctcacccggcttcgacgccttccagagagcaaagtcggaagcggaacgcttctccgtcgtcttcttggtcaatgcgccttctccctccgcgaccagcttgttatcggatcggctccagggctcaagccgggcataa

SEQ ID NO: 15445 - DNA, 849 bp, A.fumigatus
aacaattcaccttaccagcgtccacaggttatagcgtccttttctcgccccgtgccctccaatccgccggtcgtttgcgcctctcaaacgccctacctgatcgacgttgagggaaatgagtcgactgcatcatttccagcgatgcgcaaccagattcgggaaattatcacttcctccacagtatccctcgcgacagctctctttcttgcctctgatggcgatcgctacatcaatgtctttgacgttgagggccgcaagcttgtgttgaacctcgttgcagatacagaagtatcgtccttggccttgacttcgggtacaggacaaaaaacagatgacgctctggcaattgagaagcagatcctcgcagctgtgaccgaagatggcactattgaacttttcacgagaccattcgtgccgccaaaggatcagaactccaagaccagtctcaaggcgaggggaaggcagctcacgagacgggcggagtcatcaattaaaatcactcagtctgagacttcggatgcctctgtacctgtcgtcgcagcaactttccaagggacagatattctagttgtgtgggccgaaggaggcattattccggtctttgagcgcatcaactgcattgatatagatactgaggagctagctttcactgggttgaagaagattgtcaagaccaggtctagctcggttcttgcctcggttacaacgaatggagttcgagctgctgatgaaacccaagtcgatgaatctcgagcagtggtcgaacaaggggacctattggaggatgatgtcgagatgcaagacacgagggcagacatcttcaccacggggctggaaggacacgcactg

SEQ ID NO: 15446 - DNA, 507 bp, A.fumigatus
gggagggaagatgtatataagaccagagggcgctgttgcgaactatctgtatgcagaatatccatcaagcatcaaataaacattcgtctcaatcaatttgtgatcctctcagttgcctaccacgagatctggaagagatcctacaattaccatataacactttctatccatacattgggcggccactacaaagcaatccctccgctgagcactaccaaacaaaacaaatccaatacacgaaacaccaagtcctccaaagaccataaccgtgtcaacatgtcgtccaagtccttcaagtccaccaccaccctcgacaacgcctcaacccgcacaacgtcctcaacagcctcgactcttaagggcatgttcaccaagtcatggaagctgaaggctcccgagaaggcgccttcatctccgaagccttcaagcaagaaggccccagccaaggactataccggtgaggctgtgcaccacgaggctgttgctcagtatctggcccttcggtga

SEQ ID NO: 15447 - DNA, 2124 bp, A.fumigatus
gctgatatcggcagcttacaggacgagctagcattactcattagtccgttatatgcaccatatccctccaaggactccgactctgtctgttcctcacatgtcccctccccctcattccctgccagcacgggctccgagaacagaatgcggccctcttttgtcctccgtgcctctctgatgggcctcgcctcggccgtcacagagagctacaatggccagtatgtggacgactgtccccgtctgtgtgctgacgccggtcccagcccggccaactggactcacctccaccatctccgcaacctcgagcgctgtgatcaaacggtcctctttggtatgaacgtccatagctctgtcgccgatccaaacaccatcctcaccatccgcgcctgcgtggccagccagggccagacgtacgagcctgccgcgccccccgatgtgcctcagcagcaacgcccacgcaacctcgctgtcgctgaaaactgcggcgccaaggcaatccagacagctttcactccccatgttggcccttcgacgcttctcaaagcgtctggcgcggctccgcagtcggctgatgtggccgaggctgctcgccaacttgccttgttcgtgggccagagcgccgagtgcggcgccaccatcttgttcgccaagcacaagtcggccgtcgtgggcttgtattctggtgcccaaatcaccaaacatgccgcgcaaggcgttctcgattcatatgcgggaaagcagacttcggtcctgcagatctgccatcctgcaagtgcagccctgactgtcggagtggtttcaacagggtttgttgatctggccgcggctcaagatggcgtcaaaagctggagcaatggcctctgccttgacaggaccacgcccgcgaccgccgtcagcatggacgtgctcgtgcccaccatggatactgggttcaatgcgactcgcgccggccacggcaacctcactgccagctcccgcgcaggcaccatgctagacgtgcgccctcagccccagcccgacggcacctgtaacacatataccgtcaaggatgacgatgggtgttgggccctggcccaggcgtaccacctgcaagagaaagacattgaagacttcaacaaaaacacctggggctgggccggctgtgggaacttgcagagtggccaactcatctgcctcagcaagggaaacccccctatgccggcgccgatccccgacgccatctgcggcccacaggtgccggggacccagaggccttccaacggcaccgcattggcggatctgaatccctgtcccctgaacgcatgctgcgatgtctggggcttttgcggcacgacggccgacttctgcaccgagacgcccgcggacactggcgcccccgggaccgcaaagccagacaccaacggctgcatctccaactgcgggatggagattgtcaacaacggcaatgcccccgcccaggtcaagaccatcggctacttcgaggcgttcgaccagctgagggcgtgtctgcgcatgagcgtcgatgagatcccggcccagaagtactcgcacgtccactttgcctttgccacggtcacacccggtttcgacgtggacacctccagcgtcgaggacgagttcagacgattcgtgaagaggaccggcttcaagaagatcctctcctttggcggctgggcgttttccaccgacccgagcaccttccagcgcttcagagatgccaccaagccggagcaccgcgacacctttgtcacgaacctggtgagcttcatgagccgccacaacctggatggcttcgactttgactgggagtacccgggtgcaccggacattccggacatcacgcccggaagcccggacgaaggccagaattacctggctttcctgcagcggctccgacgcaagctgccgagcgggaaatccctatccattgcgctgccggcttcttactggtacctgaagcagtatcctgtcaagcagatggccaaatatgtggattactttatctacatgacgtatgacttgcacggccaatggggtaaggaaacgcatagccctgtctacctgtctacctgtctacctgtctacctgtctacctgtctgaacctgcataacgacttgtgctaa

SEQ ID NO: 15448 - DNA, 477 bp, A.fumigatus
tcatgtttcgtgaccctgaatgcagatgtcgacaaccaatgggccattcccggctgcccagccggcaactgtcttcgatcccacgtcaacaagaccgagacgcacgatgccttggtcatgatcaccaaagccggcgtggaagcccggcagttagtcgttggcgtcaccagttacggccgaagtttccgcatgaacgatgcgtcctgctccggccccttttgcacctatgccggagatcggactcactccatggcctctgccgccccgtgtacggccacggggggctacattgccaacgccgagatccacgacatcctccagaaccacggcaactactccatcgtcaaggcgtacgtcgacaaggagtcggactcgaatattctctggaccgaaatccccgaacggtggattgggtggcctaaatggacgggggccgtcaaggcccgcccatttgattggatcaagaacctctacttt

SEQ ID NO: 15449 - DNA, 447 bp, A.fumigatus
acgtccatagctctgtcgccgatccaaacaccatcctcaccatccgcgcctgcgtggccagccagggccagacgtacgagcctgccgcgccccccgatgtgcctcagcagcaacgcccacgcaacctcgctgtcgctgaaaactgcggcgccaaggcaatccagacagctttcactccccatgttggcccttcgacgcttctcaaagcgtctggcgcggctccgcagtcggctgatgtggccgaggctgctcgccaacttgccttgttcgtgggccagagcgccgagtgcggcgccaccatcttgttcgccaagcacaagtcggccgtcgtgggcttgtattctggtgcccaaatcaccaaacatgccgcgcaaggcgttctcgattcatatgcgggaaagcagacttcggtcctgcagatctgccatcctgcaagtgcagccctga

SEQ ID NO: 15450 - DNA, 612 bp, A.fumigatus
atcgagaacgccttgcgcggcatgtttggtgatttgggcaccagaatacaagcccacgacggccgacttgtgcttggcgaacaagatggtggcgccgcactcggcgctctggcccacgaacaaggcaagttggcgagcagcctcggccacatcagccgactgcggagccgcgccagacgctttgagaagcgtcgaagggccaacatggggagtgaaagctgtctggattgccttggcgccgcagttttcagcgacagcgaggttgcgtgggcgttgctgctgaggcacatcggggggcgcggcaggctcgtacgtctggccctggctggccacgcaggcgcggatggtgaggatggtgtttggatcggcgacagagctatggacgttcataccaaagaggaccgtttgatcacagcgctcgaggttgcggagatggtggaggtgagtccagttggccgggctgggaccggcgtcagcacacagacggggacagtcgtccacatactggccattgtagctctctgtgacggccgaggcgaggcccatcagagaggcacggaggacaaaagagggccgcattctgttctcggagcccgtgctggcagggaatga

SEQ ID NO: 15451 - DNA, 702 bp, A.fumigatus
  unsure (286),(385): Identity of nucleotide sequences at the above locations are unknown.
cgtttggcattccagacagcatgcgatcgggcggccagcccctggccatggacccctcgtggtacatctgccgccacgtcttcatctccaccaagcccgaagcgaaggcggccgtcgacgggggccgcaggtgcgatttcctctcccaggcatgccgggccgacctcaagacccagcttgacccaggattgggggaacagccgccgaccgcaccatgtgctcggcgctggggttttgaccccatcccacccaatttgtcaggacgcgtttggttcgccccgccaangaacgtcatggcgttcgacgcggctttcttcgccgacgatgccctggcgccggtgcagacgagccaagagcagcagccgtatagctggcgcatcggcantggataccacgacccgggcgatgctcgcgcctacgccgcggccgccaaccggacgtacctcgtcgcaaccgtctggggcttcagcccgagtgcaaagtccaccccggtccccgaggtgtcgtttgggtgcctctcgtccggctccagctacgtgccgccgccgccgtcacccccatcgtccatccccagcgacgccgcgtttggcgatgacttttccagcgggtccgcggcccagtggacgacttacggcgggtcgtttgacgcatcctcgggggccttcgtcggacgcaaatccctcgggggccttgcgctggtga

SEQ ID NO: 15452 - DNA, 393 bp, A.fumigatus
ctctctgtgacggccgaggcgaggcccatcagagaggcacggaggacaaaagagggccgcattctgttctcggagcccgtgctggcagggaatgagggggaggggacatgtgaggaacagacagagtcggagtccttggagggatatggtgcatataacggactaatgagtaatgctagctcgtcctgtaagctgccgatatcagctcaggccatttcctgtcgggctatcgagattcgaggaaagctgacaaccctcgtcggagttgcccgcttccccctcatgatgcatgaggctccagccccccttgagaaacagggaaagcttctgaagtctggtttgtccgcagagtgcaaattggcactaaagtgtccatctgcaactcaaccttag

SEQ ID NO: 15453 - DNA, 1296 bp, A.fumigatus
  unsure (626),(725): Identity of nucleotide sequences at the above locations are unknown.
tcttggtgtattcagttgctcactctgctccctctcttgaagtaccccatctggctagctacaaggacaatgggctccgcgctcaactcccccgtctacatcgactatggggaattcttcatgaatagcagcaacgtcctcgctgtcccctatcagaatgtcaccgccgccttcacgacgcctgtcgccgtcaattcgaccgccatagatggcttcgactggacgcagccgtacccgggctcccgccgcgacggccacacggtgtacctggagatcgcccaggaaatgcccctgtcggcgtctatcgtggagaattccaccaccgtcctgtcgtccttgacgtttggcattccagacagcatgcgatcgggcggccagcccctggccatggacccctcgtggtacatctgccgccacgtcttcatctccaccaagcccgaagcgaaggcggccgtcgacgggggccgcaggtgcgatttcctctcccaggcatgccgggccgacctcaagacccagcttgacccaggattgggggaacagccgccgaccgcaccatgtgctcggcgctggggttttgaccccatcccacccaatttgtcaggacgcgtttggttcgccccgccaangaacgtcatggcgttcgacgcggctttcttcgccgacgatgccctggcgccggtgcagacgagccaagagcagcagccgtatagctggcgcatcggcantggataccacgacccgggcgatgctcgcgcctacgccgcggccgccaaccggacgtacctcgtcgcaaccgtctggggcttcagcccgagtgcaaagtccaccccggtccccgaggtgtcgtttgggtgcctctcgtccggctccagctacgtgccgccgccgccgtcacccccatcgtccatccccagcgacgccgcgtttggcgatgacttttccagcgggtccgcggcccagtggacgacttacggcgggtcgtttgacgcatcctcgggggccttcgtcggacgcaaatccctcgggggccttgcgctggtgaacagcaacttcagcaacttcctcttcgaggccgacgtcacgctgccctcgacctcgggcaacgcggggcttgtcttccgcgcatccaatccgagcgtgggcgccgacgcctacaatggctactacgccgggatttcggcctcgggggtggtcctcggccgggcgagcaacaactggacgcagctggggagcggggcggccgagctcgccgcgttttcaatgcgcagcagcagatcaggctatagttccccaggg

SEQ ID NO: 15454 - DNA, 564 bp, A.fumigatus
aagtatagacaagtcacggtaacgcagctcacaatgaagcccgctcatctctccaactctctcgtcttcctcattctccctgccctgggctacgcggctccagcttccgccaccacccagcaccaggcccgagacgtgaagatcacagcaacgcagatcgagaccatcgcgcccaagtcgaagtcgtgcgcggacgcacccgccccgggcgaatgcgccacatccgagcaggccgcggccaacatcgcaaagtcgtttgagacgtacaaggtgacctcggctgcagagcaggcggccgtgatagggttgatggcctttgagagtttggacttcgagtacaataggaaccatttccctggtgttgcggggcaggggagtatgtttgcccttgttttttcttttttctttttttacgattcgtatttctgcaagaggaaggttgaccctgatgtgaatagcccggaatatgcaatcgcctgcattcaatgccaagtatgcggcttctctgccagctcttgcagacaagttgaaggacgtgtctggcgatccggcgggtgtccttga

SEQ ID NO: 15455 - DNA, 651 bp, A.fumigatus
ctggaattgattcagggttgcaaccggcgattagatcccctcctctcctaccctgcttgggtgcgccgtaccgttccaacgggtatctcgaacgatgccatgggatccgttccccaacacccgtttttccttcgagtcattgaattgctgaaatcttacgaccgcagctggctgcttccttatattaccgtcatgtactcgactggtcctctcttcctgtcagtgatttggaaggaatacatgcaagataaaccgagtgaggctgcacgagttcggattctcatgcaggatgaatacaacaagtattcgtggagcttcttcactcaccacgtcggtaacagctggcacggtaaggacgccaggttgattttctggatgggtcaacattggatgttcctgactgttctgggtttcatcctggcctctgtcgtggggttctgcctctggtgggtctatgggcgcatgattctcctgagctcgaaataccgctaccgatactcgaaactaccgggcctgggtcgcttatcctcccctacacgtcgatctcgaggcgtgatgcctacgctacttcgccgtgttagctttaaggaagacgaagaatctgcccatgttacggagacctcgttcgaactttatagccgtcgcgattaa

SEQ ID NO: 15456 - DNA, 312 bp, A.fumigatus
atagcccggaatatgcaatcgcctgcattcaatgccaagtatgcggcttctctgccagctcttgcagacaagttgaaggacgtgtctggcgatccggcgggtgtccttgacttgttgctgtcgaatgaggaatatgatttcggttccggggcttggttcctcaccacgcagtgctcgcaggacgtgcgctcggagctccagtctggttcccagggtgggtgggagaagtacatcaccagttgtgtggggacggatgcaaatgaggaacgcaaagcgtactggatgcgggccgtgcaggcgctgggtgcttag

SEQ ID NO: 15457 - DNA, 564 bp, A.fumigatus
aacgcgggacatgttccgctaaaaagaagtgacactgaacgagaccctgattactgctcagtccttggagtcgagatattgctgagacaagctgattcacgattcaattgcacgggaactttttggtcaccggctcctagaaacacaacccttcaattactgaacttgccgccctacatctacacaatgcctctccccgcacgaacagcgaccgtctcgcgggtgaccaacgagaccaagatccaggtgtctctctctctcgacggcggcgtcctccctccatatgagccgtcagatcatttccctgctcctgaagacctgaaggaggcagaggccgccaatcatggcatcgtcccccccaaaaatgccgcccatgcgacccagttcacaccgacccagcagatcaccgtaagcacggggatcggatttctggatcacatgctgcatgctctcgccaaacactctgggtggagtttagccatcagagccaagggagatctgtacagtatgtgcttcagtctcgtccactcgcactatatcgtggctaatgtgttgtacagttga

SEQ ID NO: 15458 - DNA, 498 bp, A.fumigatus
ccatcagagccaagggagatctgtacagtatgtgcttcagtctcgtccactcgcactatatcgtggctaatgtgttgtacagttgacgaccaccacaccaccgaagataccttccttgcgctcggtaccgcctttaccaaagctctaggcgcccggcaatctcttgcacgatttggacgcggcgacgctccactcgacgaggctctctcctgggctgtgatcgacctctccagccgtccctgggccgtgatcaacctgggcttcaagcgggagaagatcggagacctgagcaccgagatgatcactcatggactgcacagcttcgcgcaggctgccgatgtaacgctgcatgttggctgcacatacggagataacgaccaccaccgtgcagagagtgcgttcaaggcgctggccgtagctatccgcactgcctgtaccagaagggtggctggcgaagttggagcgggagatgtggttagtacaaagggagtgctgtaa

SEQ ID NO: 15459 - DNA, 426 bp, A.fumigatus
gttcacatagtaatacaaaggctggtcattgattctgactcgactacagctggcattcctaatgtctactactttggccaggaagggttgcacaacatcttggtcattgatcttcttggtcctagtcttgaagacctcttcgatcattgcaatcgtcggttcactgttaaaaccgtagtgatggtcgccaagcagatggtgcgtgttgtgtttactcctccggcgtgcccgatactaacaccattaccagctttcgcgcgtccaaacaatccacgaaaagaatctgatctatcgcgatatcaaaccggacaatttcctcatcggacggccgggcaccaaggctgcaaatgtgattcatgtcgtcgactttggtatggccaagcaatacagagatcccaagaccaagcagcacatcccctatcgtga

SEQ ID NO: 15460 - DNA, 594 bp, A.fumigatus
cttaatcatgcagaggaattcaacaagtacctcacctacgtccgcaaccttggtttcgaagacacccccgattatgactacctgagggacttgcttacccaagctctaaagaacgctggcgaagtagaggatggagagtatgactggatgaaactgaacggcggcaggggctgggaatacaaggcgtattcgtcccagcagcacctgcagcacaatcttcccaattcgtctgcccgcgagctccatgcacagcagctccgcggcagccagaggcctggcgttactgcagaccgtttaaacgccgcgcagcccccgcccccatctccagcgaaacctggagctgggaaaacgcgcgaccggccaagcgcctccggcggaatgccaccgaaacgtcagagcgggggtttggaagcgacaacaccaacggcatcgacccaggcgcagttccagaactcgaacgcgaacttgtcgggtcacatgggaagtccggcgaatcccacgaagaacagccaacaaggccagggcacccagggcaatgacccgcagcctactttcgtccaaaaattgatgaaagcgctgtgctgcggtaggtga

SEQ ID NO: 15461 - DNA, 441 bp, A.fumigatus
caccattaccagctttcgcgcgtccaaacaatccacgaaaagaatctgatctatcgcgatatcaaaccggacaatttcctcatcggacggccgggcaccaaggctgcaaatgtgattcatgtcgtcgactttggtatggccaagcaatacagagatcccaagaccaagcagcacatcccctatcgtgaacggaaatcgctgtccggtacagcacgttacatgagtatcaacactcatctgggacgggaacaatcacgacgggatgatttggaagctttgggccacgtcttcctttacttcttacgaggtggccttccctggcaggggttgaaggcagctaccaacaagcaaaagtacgagaagatcggagaaaagaagcaaaccactgccatcaaggatctctgcgaaggatatccaggtatgttgttcaccaagttgtag

SEQ ID NO: 15462 - DNA, 585 bp, A.fumigatus
gctaattcatattttccaggctatcttttcttcctctctacgggcattttctttggtttcaagaagccattaatcttcttcgcctttgagaacattgagtcggtctcatacacttcagtcctccagcgcaccttcaacctcaacatcgcggtgcggcctcacaatggtgatgaaaacgcgacgcaggaagtcgagctgtccatgattgatcaggctgactatgccggtattgatgcatatatcaagaaaaacggtctacaagacgcgagtctcgcagaagcgcgacgtgctaagcgctacaatatcaacggagccaaggcagaggaaaatgctgctggcaccgcgaacgacaatgctgtggaggagagcgaattacaaaaggctcagcgcgagcttgaagatcaggaggatgaggaagaagaagactacaatcctgggagcgatggcgagagcgatggtagtggctcgagcagcgaagagggggacgatggcaatgaagaaggcgacgaagatgatgaagggcaagaccttgttgcggccgagcttgggagcgaagcagaagacgtagctgaggacgaactgtga

SEQ ID NO: 15463 - DNA, 270 bp, A.fumigatus
caggatcttgtttacgtcgagtgcacgaaagttagtgtcacagatccgagacacaaatcacagttcgtcctcagctacgtcttctgcttcgctcccaagctcggccgcaacaaggtcttgcccttcatcatcttcgtcgccttcttcattgccatcgtccccctcttcgctgctcgagccactaccatcgctctcgccatcgctcccaggattgtagtcttcttcttcctcatcctcctgatcttcaagctcgcgctgagccttttgtaa

SEQ ID NO: 15464 - DNA, 1329 bp, A.fumigatus
  unsure (23): Identity of nucleotide sequences at the above locations are unknown.
ggccggttgatgagcgcggccanagaaggtcacgggtggagcaagctatgggactctgtggacatgcgcgcgattgagagagatattacagaatcacgtctacatcttcaccggacctttctcaaagctacggaaaatctggtcaagcggccacgacgaccactacacaaaccagaagagatacggtttcttctgatactcctcgttaatccattgatatacccctcaagcccttcctcgccacatgtcaatctcacccaatcccaaggtggcaggcggccatcccatccaaaggagagtcgtgagaggataccgctccgtgatgctagaccttcccccaaagaacaattgggaccttctgcgccttgcagtggacctccaggccatcattttggcatcgtcaagcgcatactgggcttaatggcacacttgcccaacgattgccatcactatctcgtctcctggttttcacgccttcctactggacagtttgaaagattagtggacctggtgggcagcttcgtgacttaccgtcttagccggcagcaaggacggaaacgcagcgaggccatcgaaaatgataacagtctagtacccagcttcagtagtgcagctgggaatactcctgcggaactgcacgctgcaattaatggtagaggccccagcaagccagcgaaagacaagcggattaagcccgtggtgtacggagatgattggcagatccgggcggcagcaagagtgatgtctctgctattcacagcaaacaatacgagtgctgctcggaagccagatgcagcatttggccaggaagcaggctccttggcaaatagagctgcggcaaatcgccgaggacataaggtcccgatcagtgccttctacaatacactgctggattattctgatcttgtggcggatttcgaagcctgggagtcaaaaatggccaagttctcgttttgtcaatatccttacttcctcagtatctgggcgaaaatacatataatggagcatgacgctcgtcgccagatggaagtcaaagctcgggaggcattcttcaatagtatactgagtcgaaaggcgataagtcagtatctcgtattgaaggtccggcgagattgtctggttgacgacagtcttcgaagtgtcagcgaagtggtgggttctaaccaagaagagataaaaaagggcctccgcattgagtttgttggcgaagagggtgttgatgcgggaggacttcgcaaagagtggtttcttctgcttgttcgggaaatttttgaccctcatcacggtatgtcgacggcgttgcacgccaaaacagagagctcgagctga

SEQ ID NO: 15465 - DNA, 984 bp, A.fumigatus
ccctcatcacggtatgtcgacggcgttgcacgccaaaacagagagctcgagctgattgatacaggactctttctgtatgacgaggattcccgattctgctatttcaatccctactgcttcgaatcatctgagcaatttttcttggttggtgtgcttcttggactggctatctataattcaacgatcctagacattgctcttccgccgtttgccttcaaaaagctgttggcagctgctccgcagaccagcgggccgcaaccttcaagtgcccggtcgaactacaggtgtactttggatgacctggcagagtaccggcctgcacttgccaaaggactccgggctcttttggagtttgatggagatgttgccgatacattctgttatgactttgtggcccacgtcgatcgttatggtgaggctgttgcggtgcctctctgccctggaggcgaaacgagaccggtcaccaatgcgaatcgacgggaattcgtggatttgtatgttcactacatgctagacacagcagtcactcgacaatttgagcctttcaaaagagggttctttactgtgtgtggcggcaacgcgctctcgctgttccgacccgaggaaatcgagttgcttgttcgcggctcggacgaagcgctggacgtcgcgtcgcttcgagcggttgcgacatacgacaattggtctcatccccggccggagaacattccagttgttcggtggttctgggaattcttcgagaataccgatccccaggcgcagaggaagattctttcgttcattacaggcagtgaccggataccggccatgggggcgacaagtcttacgatccggctggcgtgcctcggagacgatgcgtcgcggtatccgatcgcacgaacgtgtttcaacacgctaggcctgtatcgatatcccacgcgggaaaaattggagcggatgctctgggaagcggtggggaacagcgaagggtttggactgaagtga

SEQ ID NO: 15466 - DNA, 636 bp, A.fumigatus
  unsure (266),(380): Identity of nucleotide sequences at the above locations are unknown.
cccagcgtgtattcactgctttttgataactgtattgccactcgcctctcttctgttcgccatctcagtgttctctcctctccactctcctctctacaactctctctgtttgagatcacccacatttacgaatctcgatcacctcacgagagacacaaactaaagatcatggctactcacgttgtcactaccaccaccactatttctcctctgtctgccaaccagatctctgtttacggccatccgtcgcctgtcaactcggtttntgccacgcctgccaacaattctcccattactccccgcctacagcatcttccattgcagtgtcgtcagctgcggcttcttaagggtcccttgtatgtccccgctgccctgcgtcntaccgaacgccctcagaagtcgtctccccccacccatccgcgcagtgcgcacggttctttggacagtttgaacaacgaagaacctagtacgctcgtcagccgtcgttcgaccatggagagcaacttcaacaacactatcagcaagctcgctgagaatgagtggatgaagatggagcaacttggtcaagttactggtcttcccaccagagaacactggaaggttagtatcttctttttccttttctcttcctcttga

SEQ ID NO: 15467 - DNA, 504 bp, A.fumigatus
tcatttaccctaccgggactctctactgcgttaggcaatgagcagaagattaacaatgctccctcacaggcggacgctgcttctcccaactgcgactcacccacctgccgctcatcttttggcctcttcctgcgtcgtcaccattgccgccactgtggacatgtgttctgctcctctcacactccccatatagtgcctctcgatcaagatgctcgcttccaccctgaaggagttccttctcgcgcctgcgatctctgctggagcgcttaccaacgctgggaagaggctcgcactgagcgtttaaacaaaatccagtctctcttggctcagcaggagacgactggcaataacaaccaagacaccgagtctgccacaaacgctacagcgagctcagacactctgcagcaggacgatccttcgaaccaagccaccaatgcttcccagggccaggctactgatattgctgccagcgttccccgcggatggaactggagcaccttctaa

SEQ ID NO: 15468 - DNA, 750 bp, A.fumigatus
atcggatcactgatctacgctctacgactgtcctacattttctgcatatgcataccgtcttcagattcattctctgaatctgtccttatgattcttctgcgaggtctttctgaccatcattccggtccatttcggtcatctgtgcggagtactggttttcattctgggttcttgtctttcgccccctttcgttctctccgcatgggttttcatgcggctgatcgaaagggttcttgtcgttgttgttcagactcaggataccccgtcatgcttctttctgagcggcgatgtgttatttcaattctcatggtttacggcgcttacgaaggaatggcgtggttattacatttacttaattcttatcagggtaccatagatggttgtctaatacattacaatgattctctatctagatatcttcgctcggatcctttctcccactgtaaatctatgcatgaggctctaggtcaatcctcttccacatccctacatgctcaatgccctcctcatcccacctccccatcttctcatccgtcacaaacccaaaccgctcatacatcttctccccctgcacctgtgcgtgaaccagcaccaaccccttccacctcaactccctccccgccacccgccgacacgcctcctggatctccttcacatgacccctcgcccaccccaatgcctcctcaaccagtctccgcccgagtccaagacctcggtactccctcaaaaccgccactctcgtcaacttga

SEQ ID NO: 15469 - DNA, 231 bp, A.fumigatus
atgtctctttactacgacgcggtctcggttttgaccgctccatcatcaacggggggttccttcaaatcccgcatctacagctcgcggaacctcaaatcctccccggcgcaaatctacgctctggtcatcgaggcctcaaaatgggatatccttctcaaggaggtcattgaggccgcagggatcctcaagcacgagcccaaggtagctacgatcatgttctatctaccataa

SEQ ID NO: 15470 - DNA, 996 bp, A.fumigatus
ccgagacctgtggttgaacagctcactcccttacttgccctactgcttgtgcacgaccacctcctcgccaagaatggcatcgcagccaacgcaaaccatccgctgcgccaggcgatcgagagacacaagactaggctaaatggagaattcgtcaaggcgcgcgtgcgccgcggatgtgcttcgatacccgatctgaaggctgccgtgctacgcgagaaacaggccgcgcagggtgcggtcgggacttcttcgacggcggtgtatccgcgctgggtgcggatcaacaatcttcgcacgacgatggaggagcagctccagtctacattcaagtcgtataccagagtcaattcgctcgcggagctaggggagaaagacgaggcgaagctgtacgttgacccgcacgttccggatcttgtggccgtcgcgccgggcgtggacttcacctcgtcccctgcctacaagaacgggcagatcatcttgcaggataaggcgtcgtgtttcccggcatatctgttacttggggatagcgaggactggtccggcgatctgctggatggatgcgcggcacctggaaacaagacgacacacatggcttcgttgcttgcgaagcatgccgccggtagggacgttacccgccacatcgtttccatggatgcgtccaaggtgcgctccaagacattgcagaaaatggtcagcgccgcgggcgcagacaatatagtcaccgtcctccagggccaggatttcctggcgctcgatccaaccgaggaacgcttcgcaaacgtcaccggcctcctcctcgaccctaattgctccggcagccggatcgtccgtcgcgacgacgtccccaaactcccactgccggccgctgcatccccgccgaccaatttaatcacagggaaaagaagcgcaaacccccgccccgacgacgaaggaggagactctgccccgggcaacgccggcggttgcgaactcaacttcagcgttcgcgaccgatga

SEQ ID NO: 15471 - DNA, 195 bp, A.fumigatus
tggatatccactaactgtcccagctcctactccccctccttcacctcaaacgcacaacacatcaaaatgaccgtcgaccccaacccaaaatcatttaccgggggcctccaaacaccggccgaaacaggacttaaccttcccatttcctcgaaccatttcccaccaacaaccccccgactttcaacgacgcgatga

SEQ ID NO: 15472 - DNA, 381 bp, A.fumigatus
ctattacagctttatgcaggcctccttagtcaagaacttaaggttttcctttttttttcggatgcccctgaatcagctcaaaccatcataccttcttttcgagcctcaattgatcaagtctgtctttaccacatcgacataatggtcgcatatcagcttctcctcagcctggccaccgctggcatggtctcagcccagaacaccgtcacctccatgctgatctacggcgcagacccacagcctcttgtcgcttccgtcgtcggtagtgtaagttctcacgagtcatgtcaattcctgaccctcggaagacaatctgacctggcctctttaggacgccaccgcaacaacctacagcatcaattgtcccccaggcacagatag

SEQ ID NO: 15473 - DNA, 189 bp, A.fumigatus
agatacctgaatttcttctcgactttggccttttccgccaccctgatggcttcatgggagacagtgggaggaagtatagcggccggattgcttaatggcgggccatcagcaattgtttatggaatggtgtttagcacaattggcagtgtagcagttgcagcatcactggccgagcttgcctctgtgtaa

SEQ ID NO: 15474 - DNA, 531 bp, A.fumigatus
acagtttgctacaaacggaaactacagagcaaatacaccgaaagccactgcagcagccccgaaaagcccagcagcaccaccagtcacccgcggcatccccccggtactcacagccgacgaggtcttgctcgaagcagtcgcagcggtcgtagcggtagcactggcagtcgccggcgtcgcactcgcactagcaccagcactagcaccagccgtaatagtcaccgccatcagaggcagatcattggaaaacgtcgaggaactaacaccagggaaattcgccgccgtgccgctggccgtctcgatacacacgcctgtggtcgttccgccaacagagcagctgaccgtccaatgactactgcacatcaatcatctgttcacagatcaggccaaagctgtgagtttgtgacttacaagtcttcctgcggctcatccatcttcagcacggtggtcgtgggaccggcgacaagcgtcaggccggggcccatgccgcagtcggtgctatctgtgcctgggggacaattgatgctgtag

SEQ ID NO: 15475 - DNA, 864 bp, A.fumigatus
ctcctttgggtggtgagtagcgccgagataatgttcaagaagcataaatcgctaacaatcttaggggtggatggtgtcatccacatggccgaagaggtaaagatggcccccaggaccgtaccaagatccatgatctggggaactattaccaacggcatcatggcgtttggatacgccatcgccgtcctctactgcatgggagattacatggaggccctgacctccccgacaggatacccaatcatcacgatcgtctaccaggccaccaggtccaagaccgccgtcaacatcctcatggccatgggtcttctccccggctggattgcgctgttcaacggcctggcatccgtcacccgcctgacatgggctttcgcccgtgacaatggtcttccgttctccgattttttcgtgcacatcgaccggaagcacaagattcccatccgtgctttgttcctcgtcgccacccttgtcgtcctcctgtcgttcatccagatcggatccaccgctgcgttcaatgcaatcctctccatcagcactctcgggcttgtacttctcgtacatcatccccctgatcctattggtgatcaagcgcttccgcgagccccaggacatcccccgtggtgtcttccacatgggccgctggggtctccccgtcaacctcttcgcgattgcattcgcaatctacgtctccattttcctacccttcccagctcaggtgcccgttaccggcgagaatatgaactatgcggggcccgtcctgggggcggtcatgatcttcgcctgcgtggactgggtagtgcgcggacggaggaagtgggtgggtccgacgattgtcactcaagaggaccgacgttagttctatga

SEQ ID NO: 15476 - DNA, 495 bp, A.fumigatus
catgggctttcgcccgtgacaatggtcttccgttctccgattttttcgtgcacatcgaccggaagcacaagattcccatccgtgctttgttcctcgtcgccacccttgtcgtcctcctgtcgttcatccagatcggatccaccgctgcgttcaatgcaatcctctccatcagcactctcgggcttgtacttctcgtacatcatccccctgatcctattggtgatcaagcgcttccgcgagccccaggacatcccccgtggtgtcttccacatgggccgctggggtctccccgtcaacctcttcgcgattgcattcgcaatctacgtctccattttcctacccttcccagctcaggtgcccgttaccggcgagaatatgaactatgcggggcccgtcctgggggcggtcatgatcttcgcctgcgtggactgggtagtgcgcggacggaggaagtgggtgggtccgacgattgtcactcaagaggaccgacgttag

SEQ ID NO: 15477 - DNA, 309 bp, A.fumigatus
atgattttatcctgcagcgctttcctgaaacactctctaccgtcattcgccaaagccaaccctcagatcgaaatccgagtatcaccacggccgcacaaacatccagtgatcaaaggtcactatatcaacggacgagagaaagctatatgcgttcgaaatatggaacctgaacaaatcttgaagaaggcgaatctgctcaaggaagccagcggagagaagctcaagcgcaccaagaaacccgtcaccagtctcaacgagagtgtaagaggcatctggtccccataccacggagatctcaagatggtatga

SEQ ID NO: 15478 - DNA, 192 bp, A.fumigatus
actgatggccaagagggttaccctgtctgcaaagagggagaagttctggactcgcggcagacaacgttgctgaagatgttcggtgtcgctactgccgaattcaaagtcgatctaaaggcgcaatggactcggagtaccggtgaagttaagatccttgagaaggatgagggcatggacgttgatggacagtaa

SEQ ID NO: 15479 - DNA, 474 bp, A.fumigatus
gtagccctctctaggtctgataggctcgcggttgctaccagttacgccaggggcccgggcatctctctcatactttccaccaccagcatagccgcctccaaagccaccattccggccaccaccgggaccagagggagcgtttggtggagcctgtccaccgaagccattgcgtccgccttgatagccaatcccgccacgagggccaaaacgatcgccaccgcgatatcctcctcgaaagcctctacctccgtatccgccccggaatccgccaccaaatcctccagggccagaaggcgcaccgaaagatccaggtccggtgggacgcgagggcaaagccttagtatagccacgtcctcccaagcctccaccgaagcggcgaggcttccagcctttgactgtgcggccacgttccacatctaccaaaacacgtcgatccttgattcggattccatctgtctctttgtaggcagctga

SEQ ID NO: 15480 - DNA, 186 bp, A.fumigatus
gaaggtggcacgaacatgtccacaaggtttcgctacccatatctgttgctttgtctcgtcccctattccgagttcctcatcacaatttgggcacacgaccagatcgtcttccccagcgcttctcgtgaatccttcggagggaggacttggcgctttgtacgagctctggcgggagcctctacctga

SEQ ID NO: 15481 - DNA, 186 bp, A.fumigatus
atcccagagattcgcccctatgaagccccgatttctaggtggaggtgctggcactggttctggctggcgcactgtggctctgacaaactgaacttccggactacttggtgtatctatccgaattatatcttctggttcttcaagatcgacaacttcggccattatgtttcttccaaatcgtggtag

SEQ ID NO: 15482 - DNA, 279 bp, A.fumigatus
cagacaaacttccccctcccctcctggcgctcttccagcctcgttccaccattacgttacgttcctcccgttgatcgcgcacccgacgatatcaagaagagtagcattggcggcgttgcagatttccttggagaacttaagaaatatggagaagaagttccttacaatgccacagagagctggctgcaacgcaagtggcgtcagaagctcgagaaaaaggagaggctgaataagcagttgactgaaggccttcaatcttgtaagggcctcgaccattga

SEQ ID NO: 15483 - DNA, 252 bp, A.fumigatus
ctggtagcaaccgcgagcctatcagacctagagagggctactcagagcgagaccgacgtgatcatgatcgtgatcgggaaagtgaccgccacagagaccgtgatcgggatcgctaccgtgaccgtgatcgcgaccgcgaacgtgagagatatggtggccgagaggactatggccgcaagcgatatcacgaagacgattcatatgaggatcctcgcgctaaaaggaggtactaaacctcccttactggattaa

SEQ ID NO: 15484 - DNA, 1077 bp, A.fumigatus
cgtcctcatcatcagatgtctgatccgtcgcgaagccagcatcagtctcgctggcgctcagaccctgaaccatcctcgtcccaaggcctcaattctccgcatagccgcccaacattgccaccgatgagatatcctggagatggatatgatttccgtcgacctataatgtctgatcctcctcaaagagaggatgtaatagatttgacgaacgagccagatttcctggaagagcagagaagaccgcaaaatagcgattcgcgaacaacaccacgactaccacgatttggaagaaacataatggccgaagttgtcgatcttgaagaaccagaagatataattcggatagatacaccaagtagtccggaagttcagtttgtcagagccacagtgcgccagccagaaccagtgccagcacctccacctagaaatcggggcttcataggggcgaatctctgggatttaatacgattacaacgtgaaatggcacctcgacatctcatatcaagggaggaaagcttcagacaggaaattgcatggagagcacgagaccttcatcgtcgtccacccgatgaggtggatatgtttttgcttggtgctgcggaggaggctatcgatcttgaagatgccatggatctcgcgatagttggggataggcctttgagagctgagtatcccacttatgggttgacttcaggtagaggctcccgccagagctcgtacaaagcgccaagtcctccctccgaaggattcacgagaagcgctggggaagacgatctggtcgtgtgcccaaattgtgatgaggaactcggaataggggacgagacaaagcaacagatatgggtagcgaaaccttgtggacatgttcgtgccaccttcctacatgatgttggggccttgctaacgttttcaaggtatactgtggcgaatgtgccaggaatcgtgctgtttccaaggccaagaagactccccagagaaccaaaccgttttctaaatgtcaagtcattgattgtggtaaacccgtcagtgcacccagatcaatgttccagatatacctttgatcacctgtattctgcatag

SEQ ID NO: 15485 - DNA, 687 bp, A.fumigatus
cctgatcatccttgtcccgactcagctgcctacaaagagacagatggaatccgaatcaaggatcgacgtgttttggtagatgtggaacgtggccgcacagtcaaaggctggaagcctcgccgcttcggtggaggcttgggaggacgtggctatactaaggctttgccctcgcgtcccaccggacctggatctttcggtgcgccttctggccctggaggatttggtggcggattccggggcggatacggaggtagaggctttcgaggaggatatcgcggtggcgatcgttttggccctcgtggcgggattggctatcaaggcggacgcaatggcttcggtggacaggctccaccaaacgctccctctggtcccggtggtggccggaatggtggctttggaggcggctatgctggtggtggaaagtatgagagagatgcccgggcccctggcgtaactggtagcaaccgcgagcctatcagacctagagagggctactcagagcgagaccgacgtgatcatgatcgtgatcgggaaagtgaccgccacagagaccgtgatcgggatcgctaccgtgaccgtgatcgcgaccgcgaacgtgagagatatggtggccgagaggactatggccgcaagcgatatcacgaagacgattcatatgaggatcctcgcgctaaaaggaggtactaa

SEQ ID NO: 15486 - DNA, 321 bp, A.fumigatus
cattgctatagtgtatatggagctggcctgaacacagcagccaaagccaaaggactaaagtactttggttccgccacggacaatccagagctcacggactctgcgtatgtcgcgcaactgagcaacaccgatgattttggtcaaatcacacccggaaactccatgaaggtttgcttacgtctgcctccctggagcattgcctcaaaagctaattggttgttttgtttggatagtgggatgccaccgagccttctcagaattctttttcgttcgcaaatggagacgccgtggtcaatctggcgaacaagaatggccagctga

SEQ ID NO: 15487 - DNA, 804 bp, A.fumigatus
aggtttgttgctccatctatcctcaatagttcttttgaaactgacaagcctgtcaatctagccctgaacgaggacggtactttccgtaactctgtcttctaccagatcatcggcccagcatacattcctattgcgttcgccacggctgctgccgcagatcccgacgtgaaactctactacaacgactacaacattgaatactcaggcgccaaagcgactgctgcgcagaatatcgtcaagatgatcaaggcctacggcgcgaagatcgacggcgtcggcctccaggcacactttatcgtcggcagcactccgagtcaatcggatctgacgaccgtcttgaagggctacactgctctcggcgttgaggtcgcctataccgaacttgacatccgcatgcagctgcctttgaccgccgcaaagctggcccagcagtccactgacttccaaggcgtggccgcagcatgcgttagcaccactggctgcgtgggtgtcactatctgggactggaccgacaagtactcctgggtccccagcgtgttccaaggctacggcgccccattgccttgggatgagaattatgtgaagaagccagtgtacgatggcctgatggcgggtcttggagcaagcggctccggcaccacaacgaccactactactacttctagtacgacaggaggtacggaccctactggagtcgctcagaaatggggacagtgtggcggtattggctggaccgggccaacaacttgtgtcagtggtaccacttgccaaaagctgaatgactggtactcacagtgcctgtaa

SEQ ID NO: 15488 - DNA, 183 bp, A.fumigatus
cagttgacagtctctagcgggtcatggaccaatgcgacccttttggcggccatgaagaatcatatcaccaatgtggttactcactacaaggggaagtgctacgcctgggatgttgtcaatgaaggtttgttgctccatctatcctcaatagttcttttgaaactgacaagcctgtcaatctag

SEQ ID NO: 15489 - DNA, 504 bp, A.fumigatus
cgaccgagggtagactccacctacgcattatctttgactagaggaagaagcccgctgtcgccacagtcgcttgggacaggagaggtcaacgactcgacagaccaggacgatgtaaaggcattagagcaaaaaggcacagctgaacaggtggctactgataatggctctcaggcgaaaaggaggaaagtgtctcatgaatgcgtagtgccactgaacattacttgccatctgaaagccacgttgccgctccgagacagacggcttctgcgaagatattatcaaaaagcgttcgaaagcctgcagcaaatcaactgtcggatcatcgccaaagcatatgtcaaacttgtcgagccccgaaagcaagtcaattatccttataacgggcgaaaggttatcgctggtatctctcgacagctcgacccagagatgacaaagccagcctggtggccacatggtgtcacacatagagagccggaccatctccccaaagtgggtaagatataa

SEQ ID NO: 15490 - DNA, 2601 bp, A.fumigatus
ttcttccgggagctttgcaaaggatatatccttctttgcaaggtctcgtggaggttcatcgcacagcatctttctctccgcgcccttcaagtcttgtctcgaatcatttcgcggacgaaaggctaccgctgccatctgacaaccctgcttgggctcgctctaccaggcatcgatgccaacgacttggagaagactcttcatgctctgtctttcattcaatcagcgtgctacaacatccccttatttgacttaacaaagggcagagaagacattaattgtgacatgcttgctatgcagtggattaatggcgaaatggggcgaatggaggcagaaggagcagaggtccagctgaactacgacactgacctgagcgatgagaacgaagaaatgatcttgcgctcatcgacatgcggctttggggatttcatcgtttcgttcttggggcgtgtcttcactctccttgagaaccttccggacgcgagtagagtgcggaatggatcgccagaggaaaacattgtgaacacccttcctgcaacgttcatgcctcttctctcgtccctttcgccagagtacttcgataccgctttgtccaaggttgtcgactttgtgtcgaatcatgtcattcaccaggcgcgagatgcgatggcctttatttgcaattccatttgcaaagtgaatcccgacaaggcgctgaagcgtttcattccggtcttgacgcaagccatccggactgagatcgacgataatggcgcaggctcaactcggacgacgggaactgatgttctcccgcgggatcgtgctctggtctggaacatcagcatgctgagcatgtgcgttgtccacgtcggagatgctgtcctggctcataggaaggagctctttgatatcgcggtctatatgcagcaaaaatgcaggggcataccgaccgttcacatatcgaattttattcaccaccttcttctcaaccttacaggaacgtatacaatcgactactcgctgtacgaacctgaggtcctcgccgagggaataacccctaagctctggagttatcaaccagatccagataatctgacagtgaaatggcatgttccgaaacgtgaggagcttgaatttgctgttgaactcttccaagaccaagcagaaactgctctgagatcgttgactgcgctcaccaatggaacagcaagtgtgaaaagggatggtagcgggaaagattggtcagatgaagtttccaggaatcttgtcttgctacgccttattctctcaggaatctctgttctcttcgacagcaaagcagcgtcgaaaacgaaagatgaaggagtagacgggatagcgaatgatgtcgagatgtccgatgcaaaagacttcccagtcgccaatggtgttggagacgaggaccctgatgcatcactcgacacgtctgacgaggcaactgtcaggccaagcttccactaccctaccggctatcctctggaggagaatgacccgctctaccgttgcattcacgatcttcgagagagagctggctgggtcctacacgatgtccacagatttttatcggataagcaagaggatgatgtaccttgcttcgcagctctatactcggcatttcggtcttggttcattgacgttggcatggaacggtctgcgcatgttctcgacagagtcacgcgccttcttgcggctgatattcatccttacaagatgagcggtatccggaaagactacccgcgtcccctactggtacggagagccaatgtataccacttgcagcgcctgaggcacaatgccgccccaagaccacggtctcgcctcgacgaaattctgctcctggatctcgctgagtcgtgcgtttcgctctacacggagactcggcgcaacgctcagagcgctggcgaatctgctctcaaggctatctgggggtcacgacttcttgtcattcctcctctgctcacagcccttcagaaaggtatcaaggagaatgatcatgcgcgaatcaaaggtgcattgttctctctgctgctgagtagcgtcgcgaaaactgtgggacgccactggaaatatgcccccactctgatcaggactttcattgacgcaagcgcggttgataaaccatctgtgcagaagatctgttctagtgcagtattccagatcatggactacggccgtgcaatggaaagaatggctgtgcttgacagagatattgtggaagcaatcgctccgaaagaggatgtccaagaccaaattacccaaaaacggaagagtatcaacaacaagcgtgctatcattgagaaaaagaaggctgatatggctgaggaactagtcaacctggcaagagtctcccactggaaggtcgctagccgggcagccaccattgtaatcacaatgggtctgagatttgactacatcgcaagcagcaacctcatagagcttgtcactctagggtccgtcgatgaccatccggggctgcgtggcatgtactctcaagctctcattgcattgtttactatgatagacgtccgagcaatctgcggccacgactacaagaattatgtcttcaccacggggctggaaggatcagcggctggtgctaatagcaat

SEQ ID NO: 15491 - DNA, 471 bp, A.fumigatus
cccctacgccgcagtaactgccgcactccctacgcaacaatggacaccgcaggacccaaggcgattttgacccagaatgtctatcccccgcatgagatctcccgagccacttctcctggtggtgagcccgcgggggtgaacggggagggtgagcccaaggcccgtgtccgtcctcgcacctacccttacttcaaatacctcccatatccgatagaagatgaggctgagagagagcgaaatctccgagagatattgaatcagctctacatcgccgttgaagctggggatttcagtcccggcgcggtccactggactcgagagcttaggggttggctgtcactcaagttcgaccccactcgtacagagcggatcaacctggtcaagctatactatgagctctcactggcccctgggattgatccaaatgttgcggaacgcttcgctagcatgttcatgctacttacaaagtga

SEQ ID NO: 15492 - DNA, 1518 bp, A.fumigatus
atcagctctacatcgccgttgaagctggggatttcagtcccggcgcggtccactggactcgagagcttaggggttggctgtcactcaagttcgaccccactcgtacagagcggatcaacctggtcaagctatactatgagctctcactggcccctgggattgatccaaatgttgcggaacgcttcgctagcatgttcatgctacttacaaagtgagcaagcagattctcttctcatgttgcttagctgggttcggcgcgctgacacaatctgcaggcggaagcattatctacgaccagtgaaagatctcatcttagattggaggcccctatataaagaattgaaagcgtttgttttgccgacagagtcgggtctagtgcattcgaccaacctgaagcgtaacgtcaagacgctgacgaagctttgtgcgttcgttcagctctacattgacccatgtgagttgccggctatgctggatgaattcctccctcacttttcaacgtctttctcagaaggtgcctttgttgttgttggtttaatcaatctacttctcccaacctccccgcctccccaatctagagaagatcttctaccgcagcattacctgccgacatatttccacctatggtcgctcgtcaatcgttccaagacctttgatatgacatttctggattatctttcccggttagcacgagattcgttgcctgcagagcatataccattttccgaatatggtctcttcaccaaggagcagtcggcactcatcttcactgccatcctgagactgctcgaaattcctgtggggcaatcgacttctccctacagtgctctcgtagatatctcgtcgggattgggcatcatgctggatcgagatgcccgaaaatatcccgtcgcacatcatattgctcgatgggtcgtgatgtcactcgcgccggaatgcgccgacgcagaggactcaattttgacccagcttgaaggccttattcaggctgtggaaacatttttccatccttccaattcaggtggttggaccaagacattgtctcagcttgtctactatctctctgacttcttcctgatgcggtggaaccgagagcagagtggtgagatggaagtaccgattggtcgcaggttgactgagccactgaaacgccgttttgtgctctgcttgcgcgatgtagtcttcatgggcatttacgccaagagcggcaccgccatcagcttctcattgtctacgttgcagaaccttgcgtttttagaaccgcacctgattcttccgggagctttgcaaaggatatatccttctttgcaaggtctcgtggaggttcatcgcacagcatctttctctccgcgcccttcaagtcttgtctcgaatcatttcgcggacgaaaggctaccgctgccatctgacaaccctgcttgggctcgctctaccaggcatcgatgccaacgacttggagaagactcttcatgctctgtctttcattcaatcagcgtgctacaacatccccttatttga

SEQ ID NO: 15493 - DNA, 1857 bp, A.fumigatus
  unsure (45): Identity of nucleotide sequences at the above locations are unknown.
aggtgcttctcatgttccaaaaagaagccatccccccgcatgtcngcatcaagaatagcatcaacccggggttcccgaaagacctgggatcagcgaaatttgcgtattccctatgaaaagaagccctggccccgacgccccggcaggaagcgcatcgcgatggtcaacaacttcagtgccgccgggggcaattcgaccttggctatagaagaagggccgcttcgaccaaagccggctggcgcgatcgacccccgttcttctcacctggtcaccgtctcggcaaagagcaagatctccctcaaagagaacctcgaacggctgctgggcttcctggacgcccatccggacgtcgccttgtctgacctggcatacacgaccacggcacggcgtcatcaccataatcatcgagtcgccgtggccacttcggatattgcggatctcaaggctcagctgtgcaaaaccctcgaatccgacgcggtcaatacccttcaaccgatttctgccacgggcccgccccccattgcctttgcctttaccggtcagggatcctcatataaatcatgggacctccagctcttccagcactcgccgtactttcgctcgcagatcctgcatttagacaccctggcgcaggggcaagggttcccttcctttgtccctgccattgacggctcctatccccgggaccatgcccattgtcccgtcatcacacagctagcactggtctgcaccgagatagctcttgcaaagtactgggtctcgctaggcgtgacgccggatgtggtggtgggccatagtctgggtgagtatgcggccctgcacatcgctggcgttctgtctgctagcgatgccatctttcttgtcggacagcgtgcgtgcctgcttcaagagcggtgccagcccagtagccatcagatgatggcggtccgggcgtctctcgagcaaattgagcagttcgcagggagcctgccctatgaaattgcttgtgtcaatggacccagggaaatggtcctcagcggcacccgcgaggagatggcggcggtggccaggctcctggaagccgagggattcaagtgtattgtgttagaggtagcctttgcctttcactcggcgcagatggatcccatcctggacgagtttgaggcgctggcggcatcgggcgtcgtcttccaggcgccgaacttgccggtgatctcaccattactgagtaaagtggtcttcgatgagcatacgatagattcggtatacatgcggcgggcgacgcgcgagaccgtccacttcctctctgcgatgaagatggcgcacaagatttccaccattgacgatgccaccgtgtgggttgatatcggcccacaccctgtctgtgtcaacttcgtccgatcctccctcccctcgaccagcgtgaccgtgccgtcgttccgccgcggggaggataactgggtaacgctcacgagcagtttaggggtcctccactgcgccggggtgcctgtggactggaatgagttccatcagccgttcgaacgggccctccggctattggatctgccgacatacagctggaatgaaaagacatactggatccagtaccagggaaattgggccctcaccaagggaaacacgttctacgatgacgaggccccgcaaaccaaggcccttgcggggctggcatcggagctgaggacgtccaccgtccagcagatcatccacgagcagtacgacggtgcagctgggtcggtcgtcatgcagtcggatctcatgcagccggatttcctagcggcagcgtatggccacaagatgaatggacggggagttgtcacctcggtaagcgccctctccctttgtatcccgcatgactaa

SEQ ID NO: 15494 - DNA, 525 bp, A.fumigatus
tcgatccatgccgatattgcgttcacgctgggtgaatatctctataagaagctcaatcccaatcaggaaccacacatgaatatcgccaacctggaagtcgtcaaggctctggtggcgcaggagaacaccaagtcaccacagctcatccaagtgtctgcgagcactgacaatatccgatccagacaggcacatctgaaatggcacaacgtgatcagcggatctattgaggaaccttttgccagtgcgactgtctactacgaggaagcgagcgactggctggcgtcctggcgtcctgcgacccatctcgtgcagggccggatccatgcgctcgagcagctcgcagaagacggcgtggccaaccgcttcacccggcgcatggcctacggactgtttgccagcagcctggtcgactatgctgataagtaccgcggcatgcagtcagtggtgctgcacgagctcgaggcatttgcagatgtcgtcctcaccaccgagaaaggcggcacctggaccgttcccccgtacttc

SEQ ID NO: 15495 - DNA, 1077 bp, A.fumigatus
ccatccggtggcccaccggttagaatacgggccctattccggaagtttgatatctttcggggccggcactttggttgcgcttcccgggttaggggggctgtttcatgcaaaaacattaacaattcgcggcatgcccggtcagtggttccaggcccgtcaatagcggcgttggatacgcgctttatcgcccgatacccgatcctctcgactggcagcggcgagcccttcccgacagccacgacggcgacggagctgttcgaacatgtcatgactgaaatcctcacccaagccattgagtgggaaaatgtcatccagggagtagtagaacgggccaagctgctctccgtgtccgaggtccaggtccaggtcttccgcaactcacatccggttcacgacctcctgtccgccttggaaacctccctaagggaaggagtcgaggtggctatcaaggacctcggcccatggatcacaaggacgcgagacgaggagcggcctccaccgcgcggtacggctcaatctaaaatcgccatcgtcggcatgtcctgtcgcatgcccagtggagcgaccgatacggagaaattctgggacattctggaacaggggctggatgtccatcgcaagatccctccggaccgattcgacgtggacagtcactatgatcccgcggggaaacgggtcaacgcgagccacacaccgtatggttgcttcattgacgaaccaggcctgttcgatgcccccttcttcaacatgtccccccgggaagctcaacagaccgatccaatgcagcgtctcgccattgtgacggcctacgaagccctggagcgggcaggatacgtggcgaaccgcacccgatcgtccaacaaacaccgcatgggcacgttctacggccaagccagtgacgattaccgcgaggtcaactcggcacaggagattagcacctacttcatccccggcggctgtcgtgcattcgggccgggacggatcaactactttttcaaactctgggggccgagcttcagtatcgatacagcctgctcctccagtctggccaccatccaggtatgtcggacgtcttga

SEQ ID NO: 15496 - DNA, 663 bp, A.fumigatus
  unsure (592): Identity of nucleotide sequences at the above locations are unknown.
gcagcctgtacggctctctggaacggcgacacggacacggtggtggccggaggaatgaatgttctgacaaactcggatgccttcgccggcctcagccacgggcatttcctgaccaagactcccaatgcgtgcaaaacctgggactgtgaggcagatggctattgccgtgcggacggagtggcctccattgtaatgaagcgtctggaagacgcggaagcagacaatgacaacatcttgggagtgattcttggggccgcgacaaaccactctgcggaggccatctccatcactcatccacatgccggcgcccagtcctgtctcagccgacaggtcctccgcagcgccggcatcgatccaatggacgtcagttacgtcgagatgcatggaactgggacccaggccggggacgcggaagaaatcaagtcagtcagtgatgtctttgcccctgctgttaagcggcgcagttcccagcagcccgtgttcattggtgcggtcaaggcaaacgtcggccacggggaagctgtcgcgggtgtcactgcgctggtgaaggtgcttctcatgttccaaaaagaagccatccccccgcatgtcngcatcaagaatagcatcaacccggggttcccgaaagacctgggatcagcgaaatttgcgtattccctatga

SEQ ID NO: 15497 - DNA, 2631 bp, A.fumigatus
tgcgtgaagaccggagaagtcgcagatcaggatcagtcttcccatatggagaacggcgagtctgctaaccacataccagaagaagacgtcgatatagcaaacaccactgaaagtgcagcacctaagacactcagaaaggatcaggatgccagctcaattctagaacacgtcgatgatcaatcatcaatagaccagcgagctgaaaagcagcttatggaatctcttgagaatcaatcggcgcggcaaaatgatgctaccactgtgcaggacgtcccaaacgttgatgaagtcgaacctaacccatcaagtgctggtcggaagaggtcgtctgcgtccgctgcgaatgaggattatcaggccgaacctgttaggacgaagagcagaagaacccgtctacgagactcaattgcagaaacttcgctccaatctgatgaggtttctttcgatcagaataaatattacgaggatcgcttgcaaacttacgttgaagccgatgagtggatgtttgacacagtcgggcccctactgtcaaagcttggagttgacaagctggagagtcttgatgaacttcggagacaatctgcagccaactgttcgaaatcctccgtagagagatcaagcaatcagcccacgtcagcggtacatgtgctgtatcgggatctagacagtatcgtcaaaacttgggacgaagcaaaatctcaagcaatgctgcaagatgatacttcattgaccttccaggacatgaaagccatggacaactctggcttgaccatcttcctggagcattcaaggaaatctgctcgcaaaaccggactcaagcccagcttcacggacgacaaagttctgagcaaattcctgaagggtgttaatgaggaatggctccaccttcatgaagtaggctttgcctggctcaaactccttctaatgccggtgtatgggaagtcgcctgtgcggaagaactcgcgctccaaaaaatggccagttatggagtcagcatacgtagcctttcagtggccagacgtgctcaaagaaaaggtggtccagttattggtacgagacgacgagtacatcttcaaaaaaatgcgtgaacaggccgagcaaactgaacttcaaatactcaaccatacgccccaaacgccattcaagtatactcgcgatcatctcgcttacttggaaatgacccagacagtgttcgagattcaccttgacgtttatgcctccattaacaatccccacagtgaggtcgaccaggatacaaggcttgtgcagcgggatcgtctgatgagatggagcatgcttgcaagaacagctttgagtcactatctggatcatggcccatcaagaaaggatagccaaaacagcattattcttcgccatatatgggcgtcgacttttcattccaatatggagccagacgttcatcgggagcacatactgctatgcctccaagacttgaaagaaatgttacatcgcctgagtattccagagatccatcttatgaacaatgcgatgatgcctgagttgtcagcggatgcgatcgaccaggagatctcaaaactaaactccatggactttttcatgaagattttcacccctggttcggaggatcctgtcgagctgatcgaaacgattgagccgattgtagagccctcatcagttgaaattcccgaggagagcgaatcaaatgaccagtcgctttcacagtccatggtacagcttaaggagatgcgctcattcttggaccgaggagatgctatgctaaaactgttcttgtggcaaaggcttcgggatgcctatcaggcgatcgattatccgcctaaagtagtctcatgctaccttcggagtgttgagacgataattcaagaacttcttggcgcttcttatcttgaagaaagtaacgagcaccgagaaatagcgctgattcgatggctcaaatctcttgaccgcattctaatgaagttggtgacactggtccttcagcaatctgacaaggcgtacgagtgtcttgatatggaacatctgagatcttctatgtcagccctgaccaccttgacaaatcttctacacagctttgctctttacgaagactccgtccgtgtcgggcaaacaccgtcgtcctctgtgcgcggttcgttgtctaaatctttgggaaatttcacggagaagttaagggagatggaggtccgctgttggattttacaatacacgcttcttaaagaagcaattacccagaacggggatcttttcgagtctcctctcgaggaccggattctcttcctacgctctgtgcacaatgcacttggcatccgtaagatgtgcaaacggtccaacaagcagttcctcaaattgatgaaggctgaattcttcagcttggagtcgaaggaagcctacgagtctgagatctgccagattctttgggatctttatggcatcaatttgtctcctcctgggatgttcttgtttgagcatgagtgtccgccggaaaagctggatcgttcaacggctatcaagctggttgattttgtcttgaaattagcgaaacgcatgaatatcaaagacttgtccaaatccgaactgaaatccacaattgagtcttcaccacggaggctggacggatccgcccttaggtaa

SEQ ID NO: 15498 - DNA, 1863 bp, A.fumigatus
cgaccatatcagtgcagacgtatcaaccttccttgtgaaggatatgctcagaggattactttcaaggaccagacgaagctcgtcgttgcaagggtgacaggcaaacctgcagggaagaaagggcagtcatccacccctaaggatgaggaagatgacgaggcaaacagcacattgcccagttccattggccggaaaccgatcagcccaagaggaccaccttctcccccatcgtcggagtatacagaatcatgttctcccatggaactgaagcaggaaaatacaaaaacaaattttcgacgaggtccggacactccgaccaatcctgatcttgaaacatattctgagataaaaccagaccaacggcattcagtgcctgcatggcccgatgtccttgatacagtctcggattcattcaaagtaatgcacaacggctacttgacgccacactcgccaatgtccgcaagaaccgggctctcaccccgccgtattctgttcaattcttctctctcccttcttggagctttcgaattcccagaggattacatgtattatgagtactctgccaacggtcatctattgggtcttttaaaagtcttgcccctgccagagattctcaaatcacaacccatgtcccaccacgtctataacgccgctatggccctagcagccctcacaatgtcgagtttcgagccatattcaagaggctcgatcaagctacgccgtcatgccttccatcatagtctgaaggccattcagggcttgaatgccgagttatcctcgagcagcgcggcgaaaactgcggttcaatcgtggaactatgatagaattctctcgctgttgcccacacccaggtcgcttgcaaattttgagcttcagcgaggcgccttgcttgcatggcgctcacacatgcagggtgctgcattatgccttaataccggatacaaacagcttaagcagactctggcaggaatgctgttgatcaggtcttttgcgagaatggcacttttgctgcgcttatataacaaagactactcagttacctcgccggaaactatgcccacgagattgtcacaatggctagatctgcttttgaagcaatcgtcgcaactacaggacaggatgttgctgttggtagaagaggtaacagcattggagatccagaaacgtcaggagcccgagctcgacactttctggtctagcaaaagttccgagctcctttgcaagctggatgaatggcggacagacgtaccgatcgacgaagtgcccgtggatgatgacattagcggagcttatctgactatatcttcttctgatcatgcatctttgatccgtgtatctgcgctcgtttttcccaatactagagacccttgcacttcagccgtcaattacgtggcgtatctctgcacgtgcatgcgggcgcgtacgcgataccttccagattcaggacggatagttcctcctgatgcggagcggaccgcactcaccatatgtcggattgcagcagggataccgcctacgcggttcggtgaatccttcacacacagctacggcatgcttccctcggttgtcggagcctaccggtggtcgacgaacccgggactacgcaactggatcaaacattggttggcaggttaccgcgggccgcgggagggaatatggaacgttcaacaaacgcttaagcttctcgcgacgatggacagcctaccgaagccaggttggcacttcattgctttaaaggtcattgacgagccgcaagaaccatcgccagacctcgacgaagctcaaagcaatgagccgttcaaggtagtgttgcaggccacggtccagaatgcaacttccacaaatgtctttgttgtcaagtag

SEQ ID NO: 15499 - DNA, 1359 bp, A.fumigatus
attcctattagcttagaatccgcatctaccgactcgataactaacagaaacattaagtgtgatgggttacggccagaatgctctcaatgccgtaaatacggtgttcagtgtcctggctatgcaaaagtccgcaaatttatggacgaagggcccgtgattaagaagagatatgggcaggctgcagatctagtcaacgagcacgagatcgaggagataagaagacaagggagtctcgcacgtccacctgattcaattgacgagcggattttcccgtctttagtcgcgaagtccatgactcggcaacaacctgcagtattccgtgacttcgtcctcacagcatttccccgctttttcggtctgaacaaatatcgcgtccatgttccgtgggcagtgtatgtatcggacgttctggggactactccggccctggatgcagctattttctgcatcacttccgttttcatgggacgctcgaatcacgacgtcgccctgcaaaattctagccgagagatgtactcaaaggctctagtatccttaggaggcatgatcaagcatgacaagatcatgcgctcaagggaaagcgttagcacatccattctactcagcctgttcgaagcatactctcagacaagagaggactcctgggctcagcatgccgctggagctgccctgctgatgtccatgcgcggggcaaaatcccatctcactgggttcgatcgctgcctgtatctttcctttcgcagctttctcactgccgctgcgttcatcgagggcaaaccgtgcttcttcgagaagccggagtggcaatccctgatcgacgagatacgaaaacaagacatggccgatccgcgtgcgaacgcaactatctcggcaatcattgacgtaacggaccgattatttatagaagttgtcaagattcccggcatgatgtaccgggtcaaccggcacctcaatgcgtcaccgccagcatcgccctcggacacagagcagctgatttcgaggttataccagtgtaaagagaaaatacatggtttggcatctgagctacgtcttgttgcctctgtgcagggtcatagaaacacccgcggtaaattatccctcataggaccgattccttctacactgccacaaagtttctcaagcggtgtgctgcgcggcaccaaaaattgcttcaaaatcctagaccttctgttacacaatcttactgtttctcagcacaacaagtactactcgccgtgcgccgtccctggcactcccgctgggtacggcccatcttcgtcatcttcgtctcgtatatcggctccggagtcaatgccgagtgaatccttcttcgacgaacccaggatcatacctttccac

SEQ ID NO: 15500 - DNA, 207 bp, A.fumigatus
ggcttaattggggaaaggccggaatgtgcatatgaccaccttacctttaccgagctccatcatgacccattgacacttaaacactttcctccagcggaatcctttctaggattcaactccactaactgcgccactacattgctttctcactcctggatttttcttccttcccactctatcgcttccgctgattgcctcctgtattga

SEQ ID NO: 15501 - DNA, 345 bp, A.fumigatus
gcctcaccacgcgcgtgcccaccagtcttgtccccttccttaagatgcaggcatcattgtcacagtggggatgaattctcgccggattttggacttcaaacaatgggacctctgtctcaacctgtcaagctatatgcagtaacgtcgaccaggaccccctacaactacagcgacaatgtcctcgctggtgattctaggttctggtgctcaagaagcaatgtgctgtttgccgaaagcgactttgccagcggaaagacgatctactacttgacaacaaagacatttgtggaagttgcattctggaccgtggcctgcaacactaccttgaacggctcattgctttga

SEQ ID NO: 15502 - DNA, 207 bp, A.fumigatus
tcagagtccaggggcagaggtaatgaaagaatcaagacccgcgttgtcttcgacgatccccactctattgagtatcaattcgactatgctagggtccaatcagtgcatgaacaattgggcgtctcgattggttccaagatagtttatcaatacaggaggcaatcagcggaagcgatagagtgggaaggaagaaaaatccaggagtga

SEQ ID NO: 15503 - DNA, 240 bp, A.fumigatus
ccagctgttcgtttgccatacaatgcatttgcaatgctattggagtttgtccgttcgcaggccgaagtcagctgctttttgcagttcatgcagttcccacaagcgatagggaatgcagctacaacacgatcgccggttttgatactcttgacaccaggtcccacactttcaactataccacagaactcatgtccgagaacatcgcccttttcaagttcgggaatgacgcctatgagatag

SEQ ID NO: 15504 - DNA, 366 bp, A.fumigatus
tgtcatcgtcaaggtgacgggaagcacaatctgtggaagcgatctccatttatatcatggtatgatttgtggtccccgtggccgcaacatactctgggaaagacgcgcgcatcactaaccccctatctcataggcgtcattcccgaacttgaaaagggcgatgttctcggacatgagttctgtggtatagttgaaagtgtgggacctggtgtcaagagtatcaaaaccggcgatcgtgttgtagctgcattccctatcgcttgtgggaactgcatgaactgcaaaaagcagctgacttcggcctgcgaacggacaaactccaatagcattgcaaatgcattgtatggcaaacgaacagctggttag

SEQ ID NO: 15505 - DNA, 288 bp, A.fumigatus
ttatggacaggagacgggtgccaggatcaaggcgacaacctggcaaggaaaaaacagcatccaagttggtgggttctccaggatcgtgcgcatgtatcttacttctctctgacatcgacggtcttaccgacagtcgaaatgcctaaacccagggtgattgacgaagctgatgtcatcgtcaaggtgacgggaagcacaatctgtggaagcgatctccatttatatcatggtatgatttgtggtccccgtggccgcaacatactctgggaaagacgcgcgcatcactaa

SEQ ID NO: 15506 - DNA, 219 bp, A.fumigatus
gaactcgaaatggccgcctctcaagctgcagggctcgtggagaaggttattggacatggagacaatgcagctgtcacgactgatgtgagcaattattccaagaatgattatggacaggagacgggtgccaggatcaaggcgacaacctggcaaggaaaaaacagcatccaagttggtgggttctccaggatcgtgcgcatgtatcttacttctctctga

SEQ ID NO: 15507 - DNA, 414 bp, A.fumigatus
cattgcaaatgcattgtatggcaaacgaacagctggttagtgaacccctgcggagccgatccggctcccaaaacaaagtacgactcactgattctgcttgttgtaggcatgtttggatacagccatttcaccgctggttttgcgggaggccaagcggagtatgttcgtgtgccagaaagggacgtcaacttgctgcagcttccggatgatgttccgtttgagaagggactttatctatccgatgttttggccacctcgtatcactgcgtcactgatacaagagtggacaaaggtgacgttgttgcgatctggggtgccggccccattggacagatgtgtggcaaattcagtttcgatcaaagtgccagcaaagtgattctcatcgaaggtggaaaagggtgcttgaagaattga

SEQ ID NO: 15508 - DNA, 333 bp, A.fumigatus
gtcacactgtcctccatgatattgggaacgccccagattaacgccgtattgcagaccaatcacttcaacgtgggtgcgatgatgcagacgggtgttcgcttgattggtaacggccaggctcccgtgcaaaagtattggaagcatctgttggagctcatccggaaaggtgaaatcaatccgctggacatggtcacgcaccgcatgcgcctggaggacatggagaaagtctacgcgctatttgacaagcgagaggagggcatgcaaaagatctttgtgcaaaccagattctccgcgcctccagccgcgggatctccgagtctgacagtcttgtaa

SEQ ID NO: 15509 - DNA, 396 bp, A.fumigatus
ggcagaaggctaggatggcttggattttgcattaatgccgcattgacaggtcactctggcgaggttttcaccgtgcgatttgaccccacagcacagcacattgcgtctggctcgatggatcggtctatatgtgagtcgcaactgaagctcagcattctacttagtacgactgacgcttcttctaccaacgacagtactctggaacacatatgggcaatgcgagaattatggcgttctgactggccatcgaggggcgatcctggatttacaatggtcgagagattcacggtcgattttttcggcatcggcggacatgacactagcgagctgggacttggaaactgggcagagaatacgacgccacgttgggcacgaggagataataaattgtcttga

SEQ ID NO: 15510 - DNA, 246 bp, A.fumigatus
aacatcgctgacaaagtgggcttcgatctgcatttgaacctaagagagacgtcagaattccagctgctagaagagctaacattcatgcaaaagcccgcctcctggctgcgtcttaccatttcgagtgcgccccttaaaacaccacacaaaatattggaaaaccacagttcatcttgtgctcttccgtcgtctgggagctccacaaagtccgcaagaggattttcgtcgaaaatgagagaaaattga

SEQ ID NO: 15511 - DNA, 399 bp, A.fumigatus
  unsure (388),(389),(393): Identity of nucleotide sequences at the above locations are unknown.
agctcagcattctacttagtacgactgacgcttcttctaccaacgacagtactctggaacacatatgggcaatgcgagaattatggcgttctgactggccatcgaggggcgatcctggatttacaatggtcgagagattcacggtcgattttttcggcatcggcggacatgacactagcgagctgggacttggaaactgggcagagaatacgacgccacgttgggcacgaggagataataaattgtcttgacatcagcaaacgaggccaggagctcctggttagcgcgagcgacgacggttgcatagggatttgggacccacgacagaagcatgctatcgaatacctcgaaacagagtcttcaccgcggggtgcgagggcagtcagtnncatnccgccg

SEQ ID NO: 15512 - DNA, 186 bp, A.fumigatus
agactctgtttcgaggtattcgatagcatgcttctgtcgtgggtcccaaatccctatgcaaccgtcgtcgctcgcgctaaccaggagctcctggcctcgtttgctgatgtcaagacaatttattatctcctcgtgcccaacgtggcgtcgtattctctgcccagtttccaagtcccagctcgctag

SEQ ID NO: 15513 - DNA, 312 bp, A.fumigatus
gcgcctccatctaccctggaaactcttatttgcaccttgagaaatttgttggagggaagtgcatcagctaatgctgccaatcttaggacgagagttgacaaggttaatgcggagctggttaccttgacgtatggaacaattgttgcgcaattatgccaggattacgacagcaactatcaagaggtcaacaaacagctggacaagatgggctataatattggtatgcgactgattgaagattacctggcgaagtctggtatgggccgatgcgcgaacttccgagagacggcagatatgatctcgaaggtatga

SEQ ID NO: 15514 - DNA, 312 bp, A.fumigatus
gttgggttcaagatcttcctgaatatcacgcctacagtcacgaactggacgagcgataacaatcaattttctctcattttcgacgaaaatcctcttgcggactttgtggagctcccagacgacggaagagcacaagatgaactgtggttttccaatattttgtgtggtgttttaaggggcgcactcgaaatggtaagacgcagccaggaggcgggcttttgcatgaatgttagctcttctagcagctggaattctgacgtctctcttaggttcaaatgcagatcgaagcccactttgtcagcgatgttttaa

SEQ ID NO: 15515 - DNA, 276 bp, A.fumigatus
ccaggaatggaggctccgattaaacccaccgcggcgcaccgtccgcttcctaaaacccagatcaaagacgagttcagtgggaccgaaggagtctacctgctccctcatcaccaggaggagatcaagcgcctgcagcgccaacacttcttcatcaaagccgccaccgaggacaagctaacctctgtcgagcttcctaaaggggccagagtgctcgactcgggctgcgcagacggtgagtggaacccgcaacccctgcctgcatgttgcacaaagtga

SEQ ID NO: 15516 - DNA, 192 bp, A.fumigatus
ctccacttcgccaaccagaagctcaccggccttcggaagctgacgggtggtgtccggtgcctctctcactttcccactaccggattcaagatcaatcggaggcagctcaagcagatgggccatgcggcaggcccggaggtggccaatggcctgtttccttccgcggtcccaaactacgtgcagtcggtttga

SEQ ID NO: 15517 - DNA, 654 bp, A.fumigatus
  unsure (600): Identity of nucleotide sequences at the above locations are unknown.
gtggaacccgcaacccctgcctgcatgttgcacaaagtgaaatcgaccatcattggtgcccgcccgcgaaagagactaaaggtcgcatcggcaggcacatggctagcggatttggcgggcacggacaggcccgacctggatctctacggcgtggacctgggcatggcgctgttccggccggaccctcgactgaaactgcgcgcgcatgatgtgcgccagcccttccccgaatcctggggctggaaggacagtttcgacctggtccaccagcggctgttggtctgggggattcgagaggacgagtggccgcgggtcctcgcgaatctggccaccgtcgtcaaaccgggcggggtcctgcagctagtggaggcagaatgggtcctgagctcgtattcggacgagcaggtgcaccagaaaaagcttgccaaggtgcaggagtggtcgacccgttcgtccgggatggacgtgcacatctggaagaagttccccgatctcctgcttcccctcggctttgtggatatgaaagtggaaacgttcaatctgggctacggggcaacgtcgacgagaccggaggaccgcatctggaccgccgaggctctnccccaattcttccggcatctggctcggaagacccctggtatgtaccacgcctga

SEQ ID NO: 15518 - DNA, 672 bp, A.fumigatus
gcactgaaggtccggctcctctcgctcctcaccctctccgcaacactcaagcccctcacctacaagaccctcatggacgccctctccatctcagctcccgctgagctcgaatcccttgtcacaaaagccatctactcgtccctcatcaccgcccgcctctcccccgcctccaacccccccttcgtaaacgtgacgtccgtcgcgcccctccgcgacatcaaaccccaatccctgccgatgatgatctcactcctgacacagtgggagagccgctgcggcgacgtcatcagcgacatcgaagcagagatcgccaaggtcaagaccaatgccgcgaagcgtagggcgaaagaacaggcgcgggctgctctgcttgaaaaagcgcttgcctccgcggatgggagtgcaaaggacgtgacgggaggcgggtccgggtccaggaggcacggcggatcgcagcggtttggccagggaggtggcaataagcgcgagttcaacgctgatgactacgatgatgaggatgatgggtactgggataatggcaacgatggcggtatcgacttacacgcggctggttcgcgtatggacattgatgagagcacgggatcttctaggttcgggttgggcggggctggcgcgagacatgcgaagcgtatcttgggcaaaaaatcttaa

SEQ ID NO: 15519 - DNA, 297 bp, A.fumigatus
cctcacgccaattctcactcgtttgaatcatctattgggatctgtcttgttggttgtctatcgctctcgctcacaatggcgtcgccgtcacttttggacttggagccgaggaatcggctccccactctgtttgaggtcctcagtcgtcgcactttggctcctgtcgatctattctctttctacatatacatgcgagaccaacagcgctcagtcgattacttggatttctggtatgcgcaagatctctccctgaatagtgcggcgcatgaatcacgggaattttctgacctcaagtga

SEQ ID NO: 15520 - DNA, 663 bp, A.fumigatus
aataggctcgatgtatcacaacatatgtcgctatgtcgccattatgtccgcgaactgcgtcggtctgtcttagttgcgacgcctgatcttgaaaaagcagatagtaaaggctcatccgccgctttggataacttggaacatcttggcgatatcccgcttacagaagctggtccctcgagcttgcgccggggctttcgcgactacgacgacaaggacgccgatcaaaggctgtcggccttccttcgctctgatggccacacatcccagcattcgccgcagagtagcctcgggtcgcagaatgctgctcgccttccttccaatgagcaaccgcctcgtccaagctccggaacacagaacgaatcgaattcccctggccatacagtcacacgacacgatattcgcgcgtctgcagagaagattctctacacatatctactgcctggtgctgaaagagagattgtgcttccggaggaaatggtatcaacgataatcaatttgattgaggatgacgggagagacgatccagaagtgtttgaccctgccaaagactatgttttccaaagcaatggaccgctacgcataccttgggtttttgcagcaaaagccttggggaaaccttgtgccattgaccttcatgatacgcttagctttggctttgattag

SEQ ID NO: 15521 - DNA, 312 bp, A.fumigatus
caagccacggcatattcgttgctgggtaagccctactttgacgatccttgcgcgcttctgctaatgacggaccaggtgattttgccttttattgtggctgcatatttcatcgcttcgtaccagtataagatcgacccggtaatggcgtatctggggtacagcgaatacacgttcatgaactgggctccaatccgcgagccttatgttcgtaagctcctaaataaacgagccactgcaacgttattcatcgctctactggtcgctgccgctctgagcattctgttcattttcgttcccggtactatgctttga

SEQ ID NO: 15522 - DNA, 1467 bp, A.fumigatus
ggacagcttcttgagacggcattggcggacactcaaaagtcgttgaagcgacttttcgatggctcatcgacgatctcaccttcggcaagatgccccgctagcccagcgagtccttctccgcgattgagcgataaacggttccccgactcaattcaatcggccgtattcacgcggccgcttggccgttttcgagtggaccaagaccgggacgagagatgctttggcccgacctccctcgagtcgctaatgctcaacatcaaggatgagctccttcagagtcccgacaccgacaggcacaccgtgaaggaatgcgtgctgcaagcacaacgcaagattgatcatttggttggccagggagaggagattccaatcgggggaaaggcaccgcccacgatgcctccctttgccattctggaggcaatgattgagccatactttacaaccactcatggtcattttcctatctggtccaagaaacggttcactgaaatggcgacagctttgcggcaatccgcgccatccgaacgcgacctggcttcgatcgtctgctgcaacaacctcatcctcatggccatgtccgcggactctccaggatcccaccagcgcgagtcaatgatgtccaagcagacccgcaagacgtcatcgattgactttgacctcattaccggctttttgaccaacgcgaagcgcgctgtcagcaatattgaccaactggtgtcgccgcacctcgtcaatgtgcaggcgctcgtatctctggtagatctccgactgatacccactgtaaccaacggcattggatcactgacgaacaagaagcatatagtagcgcaagtgtacctctccatcggtctatccgagacgctgctagctctagcaatccgatgtgcaaagtccatcggcgtccaccagtggcacgcctttcaaggccgactgagtgacgacgatgtcaacgaaagacaaaacctttcatactgcttatacatgctggataaggccgtttgctggacggctgggtcatcgcccagtataccagtctccgatgtccattttgacccacgcctggtgccgtctgaaaacgggatcccctccagcctcgttgcaaaggccgagatggctaggatagaggagactgtatacctggagatctacgcggtccatgtgcaagcgcgggacgagaatcaagttcgtggattcgcagccgcgattatgtcgaaactgcaagtctgtctcaccgaaacgggagtggacttggaccagatccagacatctttggacggctccgcgtcgaatctgcagttggcaatccgatatctgtctgttcaactgctcctcatctggccccacaaacaccatcccgatcccatgtttcaacaggcccccgaggtcgcgcgaatgtgtttgaagctgctgttacgcctgtggcattccccacccgaccaagggagccaggctgttttctcattgtaa

SEQ ID NO: 15523 - DNA, 333 bp, A.fumigatus
aaccggcactggctcacgggcaatacgggtagtctgcttgtcgacaccccacatgcgctaatgaaggagtgggccaagacgattcccaacgatggcattctccgttactacattgtggggaacatggaaaggctcacggtaaccagtcctgcggtcctccgcgagatcttggtgagcaaggcctacgagttcgcaaagcccttggtgatccagcaaacgttgaggcgcgtgctgggcaatggcatcctgattgccgaaggcgaggagcacaaggtgagaaaggcacagcagtggcctttcatttggcttcaacaggcggaggagatcaacgtc

SEQ ID NO: 15524 - DNA, 621 bp, A.fumigatus
ttccgatatagctttctcgcctcacttccatcactctatctttacgaagtactgatatccatcctctgcggtcgagggaccaatcgggacatcgacatgcttcaagaattcgttgagatgctccagaccatcaccgactgccgcgcggaggcctcatacaatcgacggctataccagctgtcccttatagtcaccgacgtggtaaaggccaggaggacccagcacaaacggccgaagccgacctctgaaggaccgacagatccgtacttgatgtccgagctgctctcgcccgcaaccaccggttacagctacatgaattcagaagtccaagaaacatatgactcgcgcttcgatggtggcgttttccaagatccagacggttcgtttgcgcccatgagttccatcacctcgacaagcggcgagttggcgcgaggctcagatgagtttctgtcgcaattgaggagctacgggaagtcggctcccgggaacgaacacttcgattctctggctatggaagccctgggcgagtctgtcctcttttggaagggcgtcaaccaaggggccagtgcggacagcccgtcggtccggtgcgatctgggggaaagactgaactatatatga

SEQ ID NO: 15525 - DNA, 255 bp, A.fumigatus
aactcctttgttgagcaatgtcactatcaatcgccctcgctgggaaacacccaaggatgtgttagtatctggttctgtctcgacgcaggaagctccttctggctcagcaaccccgtcctcgtgggcttcagaatccctgcctggtcgatctacggtatactcacctccaacaaccacgcgtcagacaatgaatggacttcccgtttttacgtccagctgccctattccttttgcggcagcaagcaccgctcctga

SEQ ID NO: 15526 - DNA, 2370 bp, A.fumigatus
agaccggtgcgcaaggatcttgcgtgggaacagaatcagaaagccgtgtcagcggcctggaatgcagccaatcacaagaaaacgaggattggctacttcagcttgcatgacataaactcttttccttgtgaatatggtgatgttgagaaggtgcggaacgctagtgtgtgtattgataaagcccacggtcagtcgatctggaatgtccacttggagacgtggaagtctgatgcggagttctgggaaatttatgccgccaagtacaccatactgttagagaaagcgcgcgcttttctacgtctgcacaccgaacgccttcttgatagcgcgcccggcgacactccgccaaaagcggcaattttcatatccgcaggattcgacgcgagtgagtgggaaggttctggtatgcagagacaccaagtgaatgtaccgacagagttctatgcgaagttcaccgcggatgttgtgcagatggccgaggaagaagggctaggcgtagatgggcgtgtcatcagtgtcttggaagggggctatagtaatcgagcattgaccagcggcgtcctcagtcatctcgcagcgctgggagacacaacgacattgtcggccatcgtcaaccatgagcagcaggtcggtctggcttccgaaatgtttgaccgcttgcatgtatcggacagcaacgctccagctgaagcactgcgcaccccatctgacattggttatgatagtcagtggtgggcgccaacaagactcgacgagctggaggcgcttgtctatccacctccttccacagcgccaaaatcaaagtctgctcgcacctattttgcgcccacgcaatcttttgcagccaaagtcgttgcagcccctcgggatcgaaagtctactggctcaccggcgggctcagatgttgtacccttgccagaggtaggctgggctacggcggcacacgaactatccaaagtccttattcccagccatcgtcagaccacaagttatcgtccggaagaactaaatgcggaagcttcacgcattcggcgggaacgtcagaccgctgtggctgccgcccaggcctcccagaaggcagcgtcggcagcttcagcggcatcagagggaaatcgaatgcagctacgtacgagaaaggccaaagcttctctgcctagcagtcccaaggcggagactccaaagaaaaatgttacgaagagcactcggaggactactatcgaccctggagacctgccaagttcaactgctgatagctcgcctggcgtcaggacaactcggagaaagagcacaacgccgatcgcttctaagccttcgggtgcagccgagtctggtcggccaaatacgagctcgttagacgttggggcaagcgaaacacccgaacaagcaagcatagctgcaggtagctgtcctccggagtctcctagccgcagcaggtcgagtactccgtcacggtccgctgctcccaaacggtccgagggtcccaaggtgcctcctgtaccgcgcgtgccgtctagttttctctcaaagccagccagtagcgatgatcagaaagtcgtctccgaccaagcacaagcagaaatgacggagaagacggattccagaccggcagatttggacgatttggcagccggcgtgaagaaattgagcatcaaattgaaggtacctacccctgaagaacacgccgctcgcgagaaacagagaaaaacgacaaaagcggcaaaagcgacagagcaacatcaaagacgcgctccaagaccgacaacatccaagacaccaacgtcctccaagaaagcctcaagcgtcaccgcggccgcgaccgcgcatgcttccactgccagaggaacctctcacccttcgccgagtcctagcacctgccagatgccttttggtccgaatatagccatctccaacgggaacatggatcgggtgaagcaagaaagcccggaaaatgcaccagacgatcttgttgtctcttctcctgatccgctggcggaaaatgaaactcctttgttgagcaatgtcactatcaatcgccctcgctgggaaacacccaaggatgtgttagtatctggttctgtctcgacgcaggaagctccttctggctcagcaaccccgtcctcgtgggcttcagaatccctgcctggtcgatctacggtatactcacctccaacaaccacgcgtcagacaatgaatggacttcccgtttttacgtccagctgccctattccttttgcggcagcaagcaccgctcctgaggggaagcaggctttagccatgcagcagccaaaccttttcacccacagtgataatgcagggactggtcatccggatctcatgcataatcaaaactataaacccgaacaaccctga

SEQ ID NO: 15527 - DNA, 954 bp, A.fumigatus
aaggtgattcccaccatggcacccataaccgtctcaaaaggccggacacccagtccgaacgcccaagaatccttcacgcaaatggccgataaggacctagagtccatcggccgacactgtcaattcgaatactgccaccaactcgacttcctccctttccgctgtgaatcctgccgcggaaccttctgcctcgagcaccgcaccgaaaccgcccaccgctgccccaaagccggcgaatgggcccgccgccgcaacggaaaccagaacaccagcaccgcgagccttcccacgcagaaacccacaatctacaactcagaccaatgcgcccatctcgactgcaagacactcatcaacacgctgaaagatcccggcgtgcgctgcccagactgtaatagacagtattgtctacgccaccggctccgggaagagcacgagtgcacgaagatcgcgccgcttggcgctcgggcaggcagccagggcccaagcaatgcggagacgatccgctcgatgttcgcgcgggtgcgcacatggggtaaagacaaaggacaggcgctggcgccgaagcctaaggccaatagcgcagctgcgcgaatttcggagctgaatgcactcaagaaggcagcaaagggtgatgcaggcatccccgctgacaagcggctgtatctgcatgtagttgggacggcagatgcgcaggcacaaaaggcggagccgccttcgggggacttttggttcgattcgaggtggaaggttgggcgggtgctggatgatgcggcgcggaggttgcggatcgagaatgtgaataatcgggccggggaggaggagcggttgcggatcttccatgtggattcgggggagtttttggagttctcggagacgattggggatgggaaggtgaagcagggtcatactattgtcttattgagaggggcgggagttattctggggaagtcgtga

SEQ ID NO: 15528 - DNA, 273 bp, A.fumigatus
ggagaactctcaaaatggatcttcggcgagaaataccatcgcgtcctactcctgggagaagacagctgcggcaagacaaccttcctccgccgcctcacattcggcgaaatcggagagcatgagccgctcccgacgagagactttgacatcgagacgacgaactaccctgccacctacaagtggagtatatgggaatttcggagtatgctacttgcacttttccgtcttccgttttctgttttacattttataccttggtttggtagatgctga

SEQ ID NO: 15529 - DNA, 2178 bp, A.fumigatus
  unsure (1592): Identity of nucleotide sequences at the above locations are unknown.
cttagggagaactctcaaaatggatcttcggcgagaaataccatcgcgtcctactcctgggagaagacagctgcggcaagacaaccttcctccgccgcctcacattcggcgaaatcggagagcatgagccgctcccgacgagagactttgacatcgagacgacgaactaccctgccacctacaagtggagtatatgggaatttcggagtatgctacttgcacttttccgtcttccgttttctgttttacattttataccttggtttggtagatgctgaccgacaagcatcagtccgatgctggcccttgatatggcgggagcttgcgccgcacactttggtcctgtggttgcatgattgctctactgaggacgattggccaccatggaagtttcgtagcttgctagaacaaatggtggagagaggatgtcggtatatctgggttgggttgaataagcaagattctccagacgtctcggaggagtcggttcaggaggcgcgacggaagtatgaggaggagtttgcgaagtataaagatgacctgtcgtggaaagtactgacgcataagctgagtgcgaagactggggtaggggtatctgaggtcctcaaggacatctaccaggccgtgaagagggcgaatctggagcctccaaaggaggacaaacaagataagacggggaccgtcataagcgactcatcagatgaaaaattaactactgaacagctgcaacgccgaattgagaaggaggttactggcgacacgatcgacccggacgcattctggacatccttcctggagggagacctgccggcgtggacccattacacctatctgaaagcgctctatttcgtcatccttgagtcggcgaagaagaaaaccttcacagagatagcaaatgattttaacattcacctcatccgactgagaaacatatccccccagctatttaacgacagcgagacaccgagtgcctacgtccatgcaccattcaacatatgcctggccacattctggactctacaactccaacacggtatccgggaatatcgcatgcacagcatgagctcacatcttccatctcgagaagaattcccccaagtcctccgccgctcgccatcactgatgagcacgtatctctggaaaagctattactccttcaatcccgtctccagaccacgggactattggtcaatcccgaacttacggaaacttccaacacagacagattatctccgcgatccagcgacagtgcctaggaaggacgaggggccagataagctcatacgctacgccttcgctgtaatgcagtatgtgcggaacgcgggggcggcgcgtgggcaagtagttacacaggcgctggtagcactccagcaagctactatgcgtgcaaggacggcagattcgaccgttgagacatactcagagacacaggcatatttctggatccagatagtccatgctgcgttgcggtcgctggatgataagaaaggctcggttgatacttcggagatgtcgttcgaggcattccagcagactttccatctcaaaccgactgactggcaggagtattattcgaagaaattgtggaatantgtcgctgcgcgatcgcagttcgtgatgcctgatctcaagccgctgccgaacgtcattgcatctctccctagcaaagtaattaggaaagcaccagaagggataccaaagctcccatccgcagaagagcttacatttcgggccaggatggcctgtgaggagttgacgccgactctgcaatcttcaggcccgccggttctcagtcacactcaccttctgttctaccttcacaaacgcttcacacaaagtgctgagggagggactcgaaagaagctcgagcgccgggccagagaactatttagcgagatagcaggcccgatagtagctggtgcgacgtatcgaaacttctggatccagcaggttggagtcgcagtgttgaattcggacattggcaagggccgctcaacattcccagaatttattacgagcaacctgcacctggtcttcgaggagctgcatgggatttattacggaccaggagtctggaccagcgccgatgcagcggagaagatcctcggtcccgacagacgaaggatggagacgatcgtcaacatggcggacgtgaacatgtctgcaaacacaaaataa

SEQ ID NO: 15530 - DNA, 606 bp, A.fumigatus
  unsure (20): Identity of nucleotide sequences at the above locations are unknown.
tttcctctcacaatgaacanacgaaaggtcgagctcatgtccgacactgtggactcgcttgagatttctgtgcttcacgagcttcatggggaaggcgaagcagtaggcccagagggccaattccccgagacccaagaagcacgcagaaaaaggaagaagaacaaaaagaagaagagattatctgaagttactcagactggcgagaatgctcaaattagtcttacaccgatcatggacctccaacagccgagccagagccgctctatcaccgacgaggagtttttgccagacatgttccatcgtcttacgaccatcactccactcaatggtcctcatgcaaatcccaaccggcgaatccctcccgctccagtctcattcaagcacaacgactacctgtgcaacctgtcgatatccgaagcagatgtcattgcgatgcaactcttccagggcacgtaccgacttgacatcagggagctcccccaccaagaatgtcggatgaccctcatctgggactacgaccatctgtggggctgcttcgacattggcgtgtggaagggactgatgctcatcgatccggggccgcgggataacaccaaaaccatgtag

SEQ ID NO: 15531 - DNA, 792 bp, A.fumigatus
tccttcgcgtggcgaggtttttgcgagaacgagcccgaggtggcatacgacaacgagggtatcacagtgggagaaatcaccttgggcgggaagggccctgtgtctggctgcttcaagggaatgcccgttgccaatttccctaacgacaagtgcgacttcaaggccgtgcgggaggtcggaccgcccatggtcccgtggccggttgagacattcgtcgcagactggaattatcttcagcatgatagagcgaaggagccggagtcacagcgtctggtgctgcttgcgctttctcctgagccggaatcgcaggtcgtgaatgatgagactatgcagatggacggcgaggaggaccaggaggaggaaggtcagtgccaggacgaggtcaccacggacgtgcacccatcctctcctgcccgtcaaccagcagagacaccacacacttcgccaccaccagacgaacccactcagcagtcccaacgggccccaagcaccattagtcgattccacgcaaccccccttgcgatgcagcgctcctgggcccgccacgaccaggacaagttcctcgatgtcgtctgtggcagctacgagatctccagccccaccatgaaacacaactggtcgcgcaaagccagcaagctgaggatgcgtcttcttgttgatcgaggtgagagctgcgtctggggcatgttcgccatgggcgtctaccgcggaatcatgctgtttcaggaatcacccatccgatttcagaaggatcttcaccacggggccggaaggatccgcgctatgcgtaac

SEQ ID NO: 15532 - DNA, 312 bp, A.fumigatus
ggaaagtgcagtgtgtgcaactatgctatattagaaagaccattacagcaagtcgcttttgatattaactacttatatcaaggtgtgtctatattagggcccttgaagtacatgaaagttgttctcgcaaggtctgagaattcagctgcagtcaaggccgcgagtcactccacctgtcatatcctcttccccgtgtctcataacctgcacgttgcttttttgcttcgtccagcatgccctgtcagggtgaaaaaactgttgagcttttctcctttacccaacatctctaattgcaaggagccctacttgtag

SEQ ID NO: 15533 - DNA, 459 bp, A.fumigatus
  unsure (136): Identity of nucleotide sequences at the above locations are unknown.
catccagaacgacaaggcccagtttttcgtggcgtacacgaccatctgtctcctgctcggcgacaccgtcgaaggctgtttccgccagaccctgtcctgggaccgccgcagccagctcgaaaacgctttttaccgntggatcaaccaggccctcccgtcgctccgcgccgccgcaccgcccgacccgctctcctcgacgcacgagctcgaagtcaaccagctgctcgtcgtctacctcgccattctgatcatcctgcaccgctcgcccacccccaacagcgtcccctcggcggcatcgctcgtcgccgcgtccggcatcgccggtctcttcgagactttccaccagaaggaccaactgcagtatctcggtccgatcttcgccctgtacgggctcagcgcggggctatcgctgctttcggcgtaccgatacgagccgctgaaggaaaccgccgagtatga

SEQ ID NO: 15534 - DNA, 1572 bp, A.fumigatus
ggtatcactaatgacaaacagcatgctaactacagcttgttcgtctttagagaacgatggccggccccctggatcggaggcaattcctggccccagacaatccggcagtcccatctcgcatgctctttctcgtccgcgtctgcctcggccgcgtacggcttcacaatatccctgtgcaccgtgtcgccgacgcctccttcgccggccagaacccaccgacgagccacctcggccgccaccgcatccccatcgcgctcggcatccagcgccagcaaggcccccatcagaatccacgccagggtgaacatgactcgccgaccatccgccagaaccgacgccacctcccgggccgccttgcccttgaacgccgtccaggccatccccagtgcgtgcgccaccctctccccccggatcatgcccaacacccgctccacccacgcagcaaacaccgcgaagttctccctcgccagcagaaaccggaccatctcactcgccagcacattcgtcgtcccctcccagatgctattgaccgcggtatttcgcagcagccgcgagacattgaactcgggctcgtccggctcatccatatacccgacccctcccatcgcctcctggcactcctggatccccacaatcgccatcttgctgatcaccgccttggacacagccgtcaacgcccggaagaccacggtcgcgtcagccccgttgggcacatgcgccggcacggctgctccagggtccccggggttctcaaccacacccatcacggccaccgtgaagaaccccagctgcatcgccgcccgctgccgcacctccacctccgccagcaagcgtagatgcatcggaatcaaccacagcggctcgccgaccgtgctgcgcgcgcgggagaacgcccgggcgatgctcagcgcccggcgccacgcacccagcgagccgatgaaggtgtgcgtgcgggtcacgttcagcagcggcgcgatcgtcgcgacgcccttgtcgcgcggcccgacgaggtgcgcgcgcatatcccgcagctccagctcggcggtggggagatccttggtcccgagcttgttcttgaggcggtggatgcggaccccgttggtgacttcgcggggggcttggttggggccggtgatggtgcgccggaggggcgcgaggaaggtgctgagttttcccgagggggcggtcttggcgaggaggagggtgacgttggcgtcggttgcggaggagaagaatttgaagccgctgatgctgtactcgccttctccgagggtgccgagcgggttgttgttggtgatattgttgttgctggctgtggaggaggccgggacagggtcgtgggtggcccacgtttcggtgttttggacgtcgctgccgccggcgcgttcggtcatccattggcctgaggtccaaaagtcttcgttgcgggaggtgagacggttgaagacgacccggaaaggatggtcttccgggaaggcgtgttgctggagttgctgggagaggatcagtgcggcgccgtcggtcatggcgacggggcaggaggtcagccctgacgaaggcccgtacagataa

SEQ ID NO: 15535 - DNA, 1014 bp, A.fumigatus
  unsure (20),(70),(339): Identity of nucleotide sequences at the above locations are unknown.
ggttgcgccaggagggtttntggtggggcaattggtttgtatggaaacagattcccatccgcccgaaaanggaaaaacccgggcaacggactgaccggcatagttccggcgaaaacatcattttccgggggggaccggccgccccgcggacaatcaacctccgggacagggacgtcttccccgcccgggtgggacgactttgacatccagaacgacaaggcccagtttttcgtggcgtacacgaccatctgtctcctgctcggcgacaccgtcgaaggctgtttccgccagaccctgtcctgggaccgccgcagccagctcgaaaacgctttttaccgntggatcaaccaggccctcccgtcgctccgcgccgccgcaccgcccgacccgctctcctcgacgcacgagctcgaagtcaaccagctgctcgtcgtctacctcgccattctgatcatcctgcaccgctcgcccacccccaacagcgtcccctcggcggcatcgctcgtcgccgcgtccggcatcgccggtctcttcgagactttccaccagaaggaccaactgcagtatctcggtccgatcttcgccctgtacgggctcagcgcggggctatcgctgctttcggcgtaccgatacgagccgctgaaggaaaccgccgagtatgagctgtccacgatcaagctctgtctgcagacgctgtcgaagcgctggcgctcggcggtgggcccgatccgggcgttggaccggctgacggagcaggtgcggcggcagcccttgtttgagggaaatgtgccgagtctgggccctgggttggtggatttcttcaatgggattgaccgacgcctgtgtcggcagtggggggtgatccagggggagaggatggttgctcgtccggtctcgactctggagacggcaaagcacgacgtgatgccgtttgacgggtatatggacatcttggaccagaactgggaggggtctgggtttgactggagcgggtcctggttgttggatatttga

SEQ ID NO: 15536 - DNA, 279 bp, A.fumigatus
gaaatacaaactgctgacgtccaagggtaccttccatcatcgacctatcaatccattcagtccaacctcacgcagctcggcgaggaagccatctcgcctcaaatccgcgaatggagcgccgacgccgagcgccaccagccgtacgtcaagggatataacgtctggggccagcgatacgactatgaccggttggtcacgagcgagggctggaagcagctgagccgatggggagctcgacatgggtactggcgctgtgtcttgtcttacgtgcaggactaa

SEQ ID NO: 15537 - DNA, 897 bp, A.fumigatus
cgaaagcagggtggtggcattaggctacgatccgagctacggcgcctcccgccgtctcgtccaatataccgtcaattatctgtacgggccttcgtcagggctgacctcctgccccgtcgccatgaccgacggcgccgcactgatcctctcccagcaactccagcaacacgccttcccggaagaccatcctttccgggtcgtcttcaaccgtctcacctcccgcaacgaagacttttggacctcaggccaatggatgaccgaacgcgccggcggcagcgacgtccaaaacaccgaaacgtgggccacccacgaccctgtcccggcctcctccacagccagcaacaacaatatcaccaacaacaacccgctcggcaccctcggagaaggcgagtacagcatcagcggcttcaaattcttctcctccgcaaccgacgccaacgtcaccctcctcctcgccaagaccgccccctcgggaaaactcagcaccttcctcgcgcccctccggcgcaccatcaccggccccaaccaagccccccgcgaagtcaccaacggggtccgcatccaccgcctcaagaacaagctcgggaccaaggatctccccaccgccgagctggagctgcgggatatgcgcgcgcacctcgtcgggccgcgcgacaagggcgtcgcgacgatcgcgccgctgctgaacgtgacccgcacgcacaccttcatcggctcgctgggtgcgtggcgccgggcgctgagcatcgcccgggcgttctcccgcgcgcgcagcacggtcggcgagccgctgtggttgattccgatgcatctacgcttgctggcggaggtggaggtgcggcagcgggcggcgatgcagctggggttcttcacggtggccgtgatgggtgtggttga

SEQ ID NO: 15538 - DNA, 1110 bp, A.fumigatus
gatggtccggtttctgctggcgagggagaacttcgcggtgtttgctgcgtgggtggagcgggtgttgggcatgatccggggggagagggtggcgcacgcactggggatggcctggacggcgttcaagggcaaggcggcccgggaggtggcgtcggttctggcggatggtcggcgagtcatgttcaccctggcgtggattctgatgggggccttgctggcgctggatgccgagcgcgatggggatgcggtggcggccgaggtggctcgtcggtgggttctggccggcgaaggaggcgtcggcgacacggtgcacagggatattgtgaagccgtacgcggccgaggcagacgcggacgagaaagagcatgcgagatgggactgccggattgtctggggccaggaattgcctccgatccagggggccggccatcgttctctaaagacgaacaagctgtagttagcatgctgtttgtcattagtgatacctcatggcataatcatcataatcataatcatatatgtacagtccatcaaatatccaacaaccaggacccgctccagtcaaacccagacccctcccagttctggtccaagatgtccatatacccgtcaaacggcatcacgtcgtgctttgccgtctccagagtcgagaccggacgagcaaccatcctctccccctggatcaccccccactgccgacacaggcgtcggtcaatcccattgaagaaatccaccaacccagggcccagactcggcacatttccctcaaacaagggctgccgccgcacctgctccgtcagccggtccaacgcccggatcgggcccaccgccgagcgccagcgcttcgacagcgtctgcagacagagcttgatcgtggacagctcatactcggcggtttccttcagcggctcgtatcggtacgccgaaagcagcgatagccccgcgctgagcccgtacagggcgaagatcggaccgagatactgcagttggtccttctggtggaaagtctcgaagagaccggcgatgccggacgcggcgacgagcgatgccgccgaggggacgctgttgggggtgggcgagcggtgcaggatgatcagaatggcgaggtag

SEQ ID NO: 15539 - DNA, 1677 bp, A.fumigatus
gccgatggggagctcgacatgggtactggcgctgtgtcttgtcttacgtgcaggactaacgaaagcagggtggtggcattaggctacgatccgagctacggcgcctcccgccgtctcgtccaatataccgtcaattatctgtacgggccttcgtcagggctgacctcctgccccgtcgccatgaccgacggcgccgcactgatcctctcccagcaactccagcaacacgccttcccggaagaccatcctttccgggtcgtcttcaaccgtctcacctcccgcaacgaagacttttggacctcaggccaatggatgaccgaacgcgccggcggcagcgacgtccaaaacaccgaaacgtgggccacccacgaccctgtcccggcctcctccacagccagcaacaacaatatcaccaacaacaacccgctcggcaccctcggagaaggcgagtacagcatcagcggcttcaaattcttctcctccgcaaccgacgccaacgtcaccctcctcctcgccaagaccgccccctcgggaaaactcagcaccttcctcgcgcccctccggcgcaccatcaccggccccaaccaagccccccgcgaagtcaccaacggggtccgcatccaccgcctcaagaacaagctcgggaccaaggatctccccaccgccgagctggagctgcgggatatgcgcgcgcacctcgtcgggccgcgcgacaagggcgtcgcgacgatcgcgccgctgctgaacgtgacccgcacgcacaccttcatcggctcgctgggtgcgtggcgccgggcgctgagcatcgcccgggcgttctcccgcgcgcgcagcacggtcggcgagccgctgtggttgattccgatgcatctacgcttgctggcggaggtggaggtgcggcagcgggcggcgatgcagctggggttcttcacggtggccgtgatgggtgtggttgagaaccccggggaccctggagcagccgtgccggcgcatgtgcccaacggggctgacgcgaccgtggtcttccgggcgttgacggctgtgtccaaggcggtgatcagcaagatggcgattgtggggatccaggagtgccaggaggcgatgggaggggtcgggtatatggatgagccggacgagcccgagttcaatgtctcgcggctgctgcgaaataccgcggtcaatagcatctgggaggggacgacgaatgtgctggcgagtgagatggtccggtttctgctggcgagggagaacttcgcggtgtttgctgcgtgggtggagcgggtgttgggcatgatccggggggagagggtggcgcacgcactggggatggcctggacggcgttcaagggcaaggcggcccgggaggtggcgtcggttctggcggatggtcggcgagtcatgttcaccctggcgtggattctgatgggggccttgctggcgctggatgccgagcgcgatggggatgcggtggcggccgaggtggctcgtcggtgggttctggccggcgaaggaggcgtcggcgacacggtgcacagggatattgtgaagccgtacgcggccgaggcagacgcggacgagaaagagcatgcgagatgggactgccggattgtctggggccaggaattgcctccgatccagggggccggccatcgttctctaaagacgaacaagctgtag

SEQ ID NO: 15540 - DNA, 342 bp, A.fumigatus
  unsure (5),(274),(324): Identity of nucleotide sequences at the above locations are unknown.
tccancggtaaaaagcgttttcgagctggctgcggcggtcccaggacagggtctggcggaaacagccttcgacggtgtcgccgagcaggagacagatggtcgtgtacgccacgaaaaactgggccttgtcgttctggatgtcaaagtcgtcccacccgggcggggaagacgtccctgtcccggaggttgattgtccgcggggcggccggtcccccccggaaaatgatgttttcgccggaactatgccggtcagtccgttgcccgggtttttccnttttcgggcggatgggaatctgtttccatacaaaccaattgccccaccanaaaccctcctggcgcaac

SEQ ID NO: 15541 - DNA, 759 bp, A.fumigatus
agaccagtggcttttgatttccgcattcggccgtggagccagagccgcggtatgacgacacaagtcaggccacaaggagaactcagatcatacaacgcaaatttgctgtctaatggctcactgatcaactcttgccttcacagaatcatcccaaccggatacaaaatgtccggtccttcgtcacgagcgacgtctctgttctcctcatacccatccaccccggtccctagtatggtctctcgcgaccccgattccctcgatgcctggattctggggagcgggattgcctcgttaaccgcggccgtacacctcatccgagaagccaaggtgcctccgtcacgaatccacatcctcgaaacactgagcgagccaggcgcgggatcagtgagtaagggcgacgccgagtcgggctaccactttcgcgcggaatgtatgcctcagttctgcggcaatcgaatggaggaattactcgcgctggtgccgtcggagcggcccgggaaaaccgtctgggacgatatccgggagtactttgaagaacatgtgtcgaagaaggcctcgcggacgaggttcctggctcggcagaagaacggtctggagcggatcggacgacggagactccatctgggggtcaaggatcggatggatctgttccggctgtcgtccagggcggaggatgggctgggccggtcccgcattcaagaccatttctccgaggggttcttcaggacggagtactggctggtgccgtcgacgctgtag

SEQ ID NO: 15542 - DNA, 1083 bp, A.fumigatus
ctacgataccacgctaggtttggtttccggccctgtcacagtgccgtcgagttccgccgtctcatccagcatttcccgcatgatatccagacgcatcatcctcaccccctggaccgactccgcttcaacctgcatgagtctgttgtcgccccggtggcgcgcttcctacaggcacagggggtggactttcgcttcaacacgaccacgactgatatcatcgtcgagcccgcacaggagcctactcgcgtgacaaccctgcggaccgtatacaaacgcgagcgcgaggtcaccattgatctgggcccgcaagatatcataattgtttctttgggatctgtcttgtccggtgcttcctacgggtcaaacacaaagccgccctcgctagagatgatggagatcgagaaagacctcgacgacaactggctgctgtggctggagctggcaagcaagcatcccaaattcggcaacgcatacaacttttgtacgcgactgcgggagtcccgggtggcatactttaccgtcaccgccaagaatcccgctgtgttcgagaagatgctcgcgatcatcggcgatgaccctgcaacgggctcgttagtcactctgagagatagcagctggctgatcacgttgaatatgccccggcaaccgctgttcccggatcaaccggacggagtgcgagtcttctggggctatgctcttgagccagagaaccacggggatttcgtcaagaaacagatgctctcctgctcaggcgaggaaatgctgacggaggttctgcatcagctggatctccccgtcgacgaaatcctgcctcagaccatcaccgtgccatgtgtgatgccgcgattgacggccgtcttactcccgaggagtaacggggaccggccgcaggtggtcccccccggaatgtccaacatgggcctcatcgggcagtttgtcgatatccccgacgagatggtcaccatggactatatggtgcgaggagcgcagatggcggtgcaccagctgatggggctggagtgggagatgaagaagtcgaagaagggatctacggtgagtttgctggggtttccgaaggactag

SEQ ID NO: 15543 - DNA, 429 bp, A.fumigatus
ccgaacgcgccggcggcagcgacgtccaaaacaccgaaacgtgggccacccacgaccctgtcccggcctcctccacagccagcaacaacaatatcaccaacaacaacccgctcggcaccctcggagaaggcgagtacagcatcagcggcttcaaattcttctcctccgcaaccgacgccaacgtcaccctcctcctcgccaagaccgccccctcgggaaaactcagcaccttcctcgcgcccctccggcgcaccatcaccggccccaaccaagccccccgcgaagtcaccaacggggtccgcatccaccgcctcaagaacaagctcgggaccaaggatctccccaccgccgagctggagctgcgggatatgcgcgcgcacctcgtcgggccgcgcgacaagggcgtcgcgacgatcgcgccgctgctga

SEQ ID NO: 15544 - DNA, 1722 bp, A.fumigatus
tgtgtttttttttctatcctacagaatcctgactccaaggttgccaacatcctgctggccgtttactacctttatgacagctcgcgacacgcgacgacagatcctgccttcggctcgttgtacaaggtggccatgactcagtacacgcagaaagccttcaaattggacaaggaagaccccatgacatgtgcactctttggcagctacttcctattgagaaaatcctactccaccgttgagacactggcgcggaaagctatcgagcatactgatgtaatggcgattgccagtgacggctggtatctcctgggacgcaaagctcactacgaaggtgaccttgcccgcgctgcggagtactacagccgcgccgatcaagcgcgcggtggcggcgacaaaggatatcttcctgcaaagttcggtacggtgcagatgcaggtgtccaaccaaaactacgacgacgccaaattccggttggaaaagatcattcagcaaaccaagaaccccgaatgtatgattttacttggggctcttcatgccgaggaggtctttgctgcccaggccagcggtagcaaagaggacaagtcggcggaagctaagaaggccatcagcctgctggaatcggtccgtagcctgtggaaggacgaagccaagaaggtctctcctgatgagtcagtcttggtgtacctatctcggctctatgagcaggtcgccccggagaagagcatgcaatgcctgactcagttggaagaaatgcaactggctgaaattgccgaagaagaacatccggagggtattgaggacgaagaagaactcaaagccgtcctccgaacaaaccttcctcctcaacttctcaataatatgggctgctttatgtaccaggctgacaaggtggaacaggcgagaacgttattccaggcagctttgaatgcctgcgttcgatcacaggagaaggaggcgcagcttgacacagatgcccttgtaacgaccattagttacaatctgggtcgtgcatacgaagcctccaacatgcaagacgaggccaagaaagtttacgaaggcctgcttgaacgtcatgccgactacacggaagccaatgcgagactcacgtatattgctcttcggcagagccctacggatgaagggccgaagaagatggccaaactctacgaagcagattcgacgaatctggaggtacgcgctctttttgggtggtacctgagcaagtccaagaagcgggcggcgaacctcgccgaggaccacgagcagcggcattacaaacataccctgcagtactttgacaagcatgaccgctactctttgaccgggatgggcaatgttcacttggcgacagcgcgagatatgcggcgcgataccgaccaggataaggagaaacgccgcaagatgtacgagagggccgtcgaattcttcgacaaagcgttgcaactagatcccaagaatgcctatgcagcgcagggtattgctattgcgctcgtcgacgataggaaagaccacgccgctgccgtgcacatcttctccaaagtgcgagatacactaagggaccccagcgtttacctgaatctgggtcatgtctatgccgaactccgacaatactctcggtcgattgagcactacgaggcagcgctgtcgaaagatcgtgctcgcgatgcgcagattctggcttgcttcggacgagtgtggctgctcaagggcaagcaagaatga

SEQ ID NO: 15545 - DNA, 807 bp, A.fumigatus
  unsure (38): Identity of nucleotide sequences at the above locations are unknown.
aacttgtccgctatgaagacggcactggattatgccanacgggcccacgccgttgcacccacacaggtccatcttgagttcaatgttgccttcgtgcaaaaccagattgcatcgctggcgtacagcttaccagagacgcagaaaacggtgcaggacgttgaggaagccgccgaggggcttcaccaagctatcgagaccttcggacgcattgccaaggtgaagaacccgccgtatcctgccggagcgctggagcagcgcgccaacatgggcaagacgatcatcaaacagttggaacgtgcgctgcaaagccagaaggaatacgaggagaagaacgcggcgaagctgcagcaggcgcgcgaggctcgagaggcggagatccgcaagcgggaggaagaggtgcggaaggcacaggaagccgagcaggaacggaagaagaagcttgcggaggaacgacagcggatgattgaggaagcccagcgactggctgagcaacgggcagaagaggagagggcgcgtgaggaggcggagatgacggtcgattcagcgactggcgacaaagtgaggcggatgaagaagacatccgtcgaagcgcaagaagaagaggcggaagacgatttcattagtgacggggagacatctcgccggacagtcagcggggagcctggcatcgaaggtgaggcggcaccgaagaagcccaaacggctggaacgtcggtccggcggcaaggcgcatagcaagtacaaaagcattgagattgtggaagatcctgacgttggagatgacgtgcactacgctgctgccgggtga

SEQ ID NO: 15546 - DNA, 813 bp, A.fumigatus
  unsure (63),(71),(82),(157),(222): Identity of nucleotide sequences at the above locations are unknown.
cattggtggaaaagcctcaagggttccaagagacccgagcggggcttcaaagcagggaattcnaaagcagntctttcgttcntggttacttgcaacatggttcaattgctgctgtatcattatttttacgacccagttgatcggtctccgctttatntcataaacaaggactattattatagtaacatggctctgacgaaacaatcatttggcttggttatnacagccctgacagaatggggctgtccaacatatgtacgcgtcagtggggacgaaagtgtgcgaggtcagattcacctgtgtaaggatggacgactcaagacccagtttcccgagcgtctagtcttgattgccaaccaccaggtttacaccgactggatctatctttggtggatcgcttacacgaaccaaatgcatggccgcatctttatcattctcaaggaatccctcaagtatattccaatcattgggcagggtatgacattctacggtttcattttcatggctcgtaaatggctgtccgacaaacctcgcctacaacatcgtttggaaaaactcaagacccaaacgtctggttccgaatccgaatccccgcaatatgaccccatgtggctcctgattttcccagaaggcaccaacctgtcgccaaatacgaaacgaaggagcgatgaatacggccggaagcaggggctaccgcctctgaaacatgagcttcttcctcggtcgaccggtctactattctgcctacagcagctgaaaggaactgtcgattgggtatatgactgcagcgttgcgtacgaagggccgccgtga

SEQ ID NO: 15547 - DNA, 417 bp, A.fumigatus
catcttccttttaccaactgtaggaaaggcagttaccccgacaagtactttactctccgatccacatatctacagggaaggcctccgacctcggtcaacatgtactggagacgattcgctatgtccgatattcctttggatgaccaaaaggaattcgatagctggctcagagcgcgctggacggaaaaggacgagctacttgacgaattttttgaaactgggaggttcccaactgccctagctggcagtattgacgctgggaatgtgtccgatgtacagatagaggctgcctctaagggctttgtagaaactcatgtccggctacatcactggacggagcttgggcggattttcatggtactaacaggcatggcggtgctttgcagattgcccaaggtttttgggctatgggactag

SEQ ID NO: 15548 - DNA, 888 bp, A.fumigatus
aaaagcatcatgacgtcgttagaaaacggttacgtcaatggcaattcattcccaagcgccagctctcaggtcaatcttcgcttttctgacataccctctgcgattgatattcccgcgtcgacccttgacagcgaagtcgaagtcagtttggaaggcttaccggacgaccctacagagctgtgtacccttctggagaacgagaaagccgcgaagaatttctgggtgattatcgcgctggcgtatgccaagcagaagcagcttgatcatgcgatcgacatcctcaataaaggcctggcttcggtcggtcacggggccgccaaagagaaactgggtctgttgggctgggtctgttggctgttgatgctgaagagccgacaggcgcctcgagttgcttcggaaggggaactgtatacagaagccaagaccaaagactattacctccagctcgcgacatcgacgctgaatgaggcgtcgcgactgaaccctgctttccctcctttgttcctcgcccgaggcgttctgtgccttttgcgggcatccttgcacccaccaagaccggtccgaccaggatcagttgatacatctgagagagtggagtcgctgcgacaggcgctcaagtgcttcgaagaatcgtcaaaggcgtttggaggtcggaatgtgatggcgatcctgggacgttccagagcgcaatacttgctgggcaggtatgcggaggcgctagaggggtatcagaaggttctgatgaaaatgcctggtctgacagatcctgatcctcgaatcggtatcggatgctgcttatggcaattgggcttcaaggatcaggcaaaggttgcttgggagcgagcgctggcagtggtgagttatgcaaggttattgggggtttcatag

SEQ ID NO: 15549 - DNA, 609 bp, A.fumigatus
tgcacgtcatctccaacgtcaggatcttccacaatctcaatgcttttgtacttgctatgcgccttgccgccggaccgacgttccagccgtttgggcttcttcggtgccgcctcaccttcgatgccaggctccccgctgactgtccggcgagatgtctccccgtcactaatgaaatcgtcttccgcctcttcttcttgcgcttcgacggatgtcttcttcatccgcctcactttgtcgccagtcgctgaatcgaccgtcatctccgcctcctcacgcgccctctcctcttctgcccgttgctcagccagtcgctgggcttcctcaatcatccgctgtcgttcctccgcaagcttcttcttccgttcctgctcggcttcctgtgccttccgcacctcttcctcccgcttgcggatctccgcctctcgagcctcgcgcgcctgctgcagcttcgccgcgttcttctcctcgtattccttctggctttgcagcgcacgttccaactgtttgatgatcgtcttgcccatgttggcgcgctgctccagcgctccggcaggatacggcgggttcttcaccttggcaatgcgtccgaaggtctcgatagcttggtga

SEQ ID NO: 15550 - DNA, 348 bp, A.fumigatus
tcacggaactcttctggaactcacggcggcccttcgtacgcaacgctgcagtcatatacccaatcgacagttcctttcagctgctgtaggcagaatagtagaccggtcgaccgaggaagaagctcatgtttcagaggcggtagcccctgcttccggccgtattcatcgctccttcgtttcgtatttggcgacaggttggtgccttctgggaaaatcaggagccacatggggtcatattgcggggattcggattcggaaccagacgtttgggtcttgagtttttccaaacgatgttgtaggcgaggtttgtcggacagccatttacgagccatgaaaatgaaaccgtag

SEQ ID NO: 15551 - DNA, 354 bp, A.fumigatus
aagatcatcctcgctcatctgctcaggcaaccatttccgtactggactgtccagctcacgccgcttatcggcggtgcaattcttgcgaatctgccccacttgggtcttcctgcagtgagtgcatgggtagagcttctgtacctgagggcctatctgttgtttgccttcgtcgcctacatgcattgggcgttcttggtgatcaatcggattacgactttcctgggtattaactgcctgaccatcaaaaaggatcgctcgatggctagggaacaggcctatcgcaatttcggagagagccttctagaggtccccgatgctacggaccccctcaaaggcgggctcaaacaccattga

SEQ ID NO: 15552 - DNA, 264 bp, A.fumigatus
tcccgctttcgtatcattctctggtcgatgataagcgatcttattagttccatcctatggagcgccaagcaggcactccgcatgattgatcggcttcgaattcaggcccttgcttatgatactaagggcttgtatatgagcgttggatttccattacggtctgttgtaactacactttgtttcgccaactggggatatatcctcagctccatgacgagtgactttacgagtttggttatggcctatgcgacgcccataaactga

SEQ ID NO: 15553 - DNA, 669 bp, A.fumigatus
agacctggcgaagaagatggccggtatcatcggacagactctcgatcgtcttcagcctacctgcaagaggattgccgaggtaagttgacgctccacccgtatgttatccgagataacttgctaactggtctgtcacagctgctcgagaaagccgatcgcacaccacgcgacgaactggacgaagagaagctcgtcaaggaagtccgacccctgatcgaagagggcgggcaggtcctccaggaatgcaacggagccatccgtgctttggatcccgatggctcaattgcttcgactgccaaggctcgcgctgcatcccacgaagcatctcctgaggagtacgctctcgctgagaagatcaaggagctgagtgagctggtgatgaccacgattgagaacggccgcaagaggatcgcagacatgcctcatgccaagaagaaaatcaaccctctgtgggccctgctcagcgatcctctcttccagatcatcgcggctgttggtctgcttcttagcggtgtgttgggccttgtcggtcgtctcctcgacacccttggattgggtcctcttctgaatggtctgctgggtggactcggtctcgataagctccttggtggattgggactgtcgtctctgacggattctttggggataactggaagcaagaaggactaa

SEQ ID NO: 15554 - DNA, 2049 bp, A.fumigatus
gccgacgacgctgtagaacaagccaaggacaaggccgaagagacgacggaacaggcaaagaaaactgtgactgatcttgccgacctcgacggccttcctgtgtctgaaggcggagtcatcaaagacaagtccggccaagtcgtcgcgaagattgccgagggtgatgcggaggacctcgttggctacactctgaacaatgaaggcgaggtcctggatgaggatggcgatcctatcggccgcgcggaaatcgtctcccaacaagccaaggacgccacagatgggttcgacgacaccgagaagttggcccctgaagatcagagcacccaagaggacgtcgcaaagcaagcagttgagagcgtccagcagcaagacgtggatgacacagcagagaaggccgagtccgcagctgacgacaccaaggaagaggccgaggaacagctgccaccactttcctcgcttgaaggcatgaagtgcactaaatcaggcaagatcgtcgatccggacactggcaagcccatcggtgagcttgtcgaaggcgatgcaaagaagatctcccgcatgagtgctcaattggacgacaagggccagttctgggacaaccgtggtaacgttatcggcaaggcaaaatcccttcctgttgaggattacgagggcgagccacccttcgctggcctggaaggcctccacgtcgttgaggacggatgggtagaagacgagaatggcaagcgagtcggcaagatcgttcaaggagacccgaagaagctgcttggacgtgcggtcgacgaagacggcgatatcactgataagaacggcaatgtcatcgcacaggctgaatactacgaatcacccgacgagccagagccggagaagcctgacctttctcagctgaacggcttgaagcctaacaagctgggatttgttattggtccagacggcgtgcccattgcccgcgtggtagaggggaatccaaaagaactggctggcaaagagattgatgatggccagatctgggacggccgcaaacccattggacgtgtggagctcatcccggaagaggagcgcgacaaaaagcccgaaggcgtgtttgccggtcttgacaaccttgtcgtcaataaggaaggcttcgtcgaggatgatgaaggcaatattgtcggcaaagtgaccgagggcgaccccaagaagctccggggccgcgccgtcgatgaagatggagacatcatcgacaagtacggcaacgttaaagggcatgccgagccttacgagccagaagaggaggaggaagagaagccggatctttccgtcttggagggaaagatcgtcaacaaggctggcaacgtcgttgacgcccagggcaacatctacggacgtatcgtttccggagatggtaagcgcctcgctggcagaaaggtggacggccagggtcaaatctggggtgacaatggaaatgtcattggcagagcagagatcgtcccgggtgcagagcaggagaagcccgaaggacagttctacggattcgacaatgtggaagttggcaaagatggctttgtcatggccggcggccgtatcatcggccgtgtcatcgaaggcgatgccaaacgactccttggtcgtaaggtcgacgaagacggagacattctcgacaagaatggcaacatcatcggcaaggctgaacgctgggagccagaggagaagaagcgtgatgtcaaccccatgtctggccgaaaggtcaacaaagagggcgagatccgtgatgctgacggtaatctcattggcaaattgacaacgggcaatctgccaacgcttgtcggcaagtcaatcgatgacaacggttatgttgtcgacaacgacggaaacaagctgggcgagtgtactctgctcgagaacctgccagaggaagaggaactggaaccaggtctcacccaagaggagtcggaggcccagaagaaggccgagcaagatagagacctggcgaagaagatggccggtatcatcggacagactctcgatcgtcttcagcctacctgcaagaggattgccgaggtaagttga

SEQ ID NO: 15555 - DNA, 618 bp, A.fumigatus
ccgagggcgaccccaagaagctccggggccgcgccgtcgatgaagatggagacatcatcgacaagtacggcaacgttaaagggcatgccgagccttacgagccagaagaggaggaggaagagaagccggatctttccgtcttggagggaaagatcgtcaacaaggctggcaacgtcgttgacgcccagggcaacatctacggacgtatcgtttccggagatggtaagcgcctcgctggcagaaaggtggacggccagggtcaaatctggggtgacaatggaaatgtcattggcagagcagagatcgtcccgggtgcagagcaggagaagcccgaaggacagttctacggattcgacaatgtggaagttggcaaagatggctttgtcatggccggcggccgtatcatcggccgtgtcatcgaaggcgatgccaaacgactccttggtcgtaaggtcgacgaagacggagacattctcgacaagaatggcaacatcatcggcaaggctgaacgctgggagccagaggagaagaagcgtgatgtcaaccccatgtctggccgaaaggtcaacaaagagggcgagatccgtgatgctgacggtaatctcattggcaaattga

SEQ ID NO: 15556 - DNA, 300 bp, A.fumigatus
gccttggttatcggatgctgcaatataggtggaacacgtccagtgagggaccgagtaccggagtatttccaattctctctccattttcgagaccatatggaaatctaccaagatgctatgatccaacttcgcgagtgcagcatcttacgggtgaatcccaacaacagcagtgctatctactggactaactacgacggccaaaagtctggcagccacatgtttgaagttttgataggttttacctgtcctaatccccttgcacactttcattacgacgtgaagaacattggcatgaagtaa

SEQ ID NO: 15557 - DNA, 426 bp, A.fumigatus
acgtgggggtggatgatggagacaatgattactgacagcgagagtgggatggcaatcttacatcgatactccgtacatcaaagaatggagaatgatgcctcgtttgacctgattgatatggcgaagaaatacggagtgctatatctcggtacggcgtggggagatttcgaccaagcgctgtctccgctgcgttattatcccacgtgtactccgtatgtctcgagcttgggaccaagttgtcatttcgccgctgataagactaccaccaagttttccaagttttttgctgctctagagtgcgatgtgttcgatggttctccgttcacttacgaaggagttcactccaagagaccaagctgtgtgtcggttaattccaacagcagtgatgatgacggaaacaagtatttcgtaaccttatcctattag

SEQ ID NO: 15558 - DNA, 207 bp, A.fumigatus
aagacttggctcagctcgccaatctccggcccgaagcggtacgactgggtcctcgaaggagaccaaatgcatgagaagcaggatacacgtcccttcgggaatggacaatggatctacctccgcgatggatccaacttaacggatctgttgaatgcggagctttcgttgaacattgcaaaggatgtctacagtgaatttgagaaataa

SEQ ID NO: 15559 - DNA, 1512 bp, A.fumigatus
aacttggaccttccacccgtggtgaagactcctaaacgcaccaagctggaagatgaaggctcagctgaggtcaagcttcctgatctgccaacacctgtgaccgaaacacctgcccgcaccactgtgaatggagaggcgaccatgactaaagttcaacataaattcgtactcaaaggtattcagagtttgaagcgcatgaatgatgctcgcttctaccgcgaacctgttgacccgatcaagatgaacattccccactatccgcagattatcaagcatcctatggaccttggaacaatcgagcgcaaattgaagaataatgagtacaagactgctcaggccgtcgtggatgatttcaatctgatggtgcaaaatgcagttactttcaatgggccagaccacttggtgtcacaagagggattgaagctcaaaggcacattcgagaagcaaatgatgaacctacccaaggctgatgaggttgaagagaagaagccgaagaaggtttccaccaaaacctcagcggcccatcgggaaccacgcactagcattgggacttctacagctcgcccgaccgccgcttcccctcaagccacaacctttgctcttggaccagaaggcctgcctttgatccgtcgtgattccaccaatactgatggccggcccaagcgctctattcatccacccaagcgggatttgccttattccaccaagccgaagaagaagaagtaccagtgggagctgcgattctgccaggaagtcttggatgagctccacaaacccaagcactataactgggctgctcccttttacttccctgtggatccggttgcactgaacattccgacgtatcacagcattatcaagaagccgatggatctttccactgtccagtccaaactcaagactggccagtacgaaaatgccaaggaatttgaagttgacatgcgtcaaatattcaagaactgcttcaagtttaacatcccaggagatcctacttatatggccggacagagattccaggagatattcgagaacaaatgggctcagaaaacacgttatctagaggctcatgaaccccacccagaacaccagagcgttagctcttcctccgaagaaagcgaagaagaggaagacgagagcgacaccgacaacgagaagttgactatgctgcagaaacaaatcgctgaaatgtcacgtcaagtggaagctatcacacagaagaaaaagaagactccacctggttcgaagaagccgggcaagtccaagtccggaaagaaggattcgaaaaagagcggaaccatccccttgggcaagaaggacaagaaggcttcctccaagtcatccaaaccagaaaagcagcgctacgtgacttatcacgaaaagcagatcatctcgaacggaataagtagtcttccggacaagaagatgcaggaagccctgaagattatccaaagcaatgttccagccctgaaagtgagttttgacctccgcttgatctcaaaatgtaggtgctaa

SEQ ID NO: 15560 - DNA, 366 bp, A.fumigatus
tctcaaaatgtaggtgctaatgtttcctttcagggtacacaagagacggagattgaacttgacatcgatgagctccctaatgaggttctattgatgttactgaagttcgtcaagaagaacgccccgcatgtcatagaagaggaggatatgaccgcttctactgcagcaaatatggctgctccaaagccaaagaagaataagcctatgagcaagtatgagcaggaggctcagatcaacatgctcgagagcaacctctctcgtttccagggcggtggcggccgttcccccgatcctcttccgtctgtggaggctaatgaaagtagcgatgattcagaagatgattctgaagaaagcgaagaagagtag

SEQ ID NO: 15561 - DNA, 255 bp, A.fumigatus
tcagatctatcgatacatactaattttgggaccactatcccatggtcgttgccgcatttgcgccccaaagttcgtatgactagatacgggggtatggggaggacgcgcccgaaaaagctcacctcgaaggcctcaatccccattgtccgggaacatgagatcgatatcatcgatgatgaggtccagaatgccctacaacaggtggaaactggtgtcgagaaggctgaggagtcggtcagtgtttcccccaactaa

SEQ ID NO: 15562 - DNA, 1689 bp, A.fumigatus
gagttccatcttcaagctgctatcagcgcgactgcccaaggaaaagtaaatgaagctcacattcccacaccagaaaccgtcctcagtaatcttcgatatgacgagctctatccccccatcttctcacagccggcgacatacatccgcttctcgtcgactgtcgaggactgttgcggatgcccgtataacatgaccgaagaggatgatgtcttcttcaagatcatgaacgagaagcgggagccgtcgaacaggataacagaggatcagttcgaggaggtgatgtacttcttcgaggagacggcacagacaaagcaaccctttgcagctgtagatagccctcctgtcctgagcttcgcagaaatgcaagactcgatggatgcaactgtagaggagagcgtcaagtgttttgcaaaggacatatatgagcactggaagttgcgaaggattgctactgggaaccgcccactcctaccgagtctcaaggtgagcagacctcatcgcatgactccatatttcccacgactgaccatgagcagtttgaaactggtcaagataccgatgatacagacccgtatgtctgctttcgtaggcgtgaagtccgtcagattcggaagacccgcggcagagatgcccaaagtgccgacaaactgcgcagactcagaaaggagctggaagatgctcgacagctggtttgcactggtgcgccagcgggagttggcaagaaaagagatgctctcgatggagcggcagatattcctgcaacgttccgaggtgaaggagatgaagaggaaactcaacatcaaagacgatgacgaggatctcatcaaccagaaggtaacgtcaataccagcacgacttcctcatgcgtttgctaacctgccggagcagccaaagaagaagcctgcggaggcgccagctgcacaacgaccgaccgctcctcagatccggatgccacagaagcccggtactcaggctgcggacgacatgcaattgctggaagacgtccaggcggagaaagaaaacgagattctgcgagatatcaagcagaacatcgcgaagcatatcaagtggaacgagggctatgtggattacacaagagcgcctctctcgccacctccagagaagaccttccaggccgctttccgcccagcaatcaccacccagttgccaactcctccttcttcagattcgtctgacaatatgatgttggagtctgccttagatacagccaattccctctccttccgagataagctagtccctcgtacatgggagatgaacgaggacacctgcagaataccgtcgttcagaaggcgcattggacgtggtggtcggttgatgattgatcgtcgaaacatggcgtcgcggtgtagaatcgagatggatccgctgaaggctgatcgattcaagtatgatcgggaggattcagacgatgagtcagaattcgaatgcgatccgtacgatgttcagatcatgcaacatcgtgccataatggccgccaaagcacgagatcaagctgctgctgccgcccaagcacatgcgcaggctcaagctgctcaagcgcaagcacaggctcaagcgcagaaacggttgcaggccgaacaaaccacaaccaataacgggcccccgaacatggggcacacaatgggatcgaaccccgggcctggtgccgtcgcctccacttcgtga

SEQ ID NO: 15563 - DNA, 501 bp, A.fumigatus
ctcgccttcttggaagatttggaactcctcgatgacggatatgtcattcccaggccctcgcccgaagactcgcttacagacttccttccagatgagcttctagtgttggtcaagacgctcacactctcctcagagcaattagagcatcaaaaatcgaagagcaaagccccaaaaccgtcgtttggccacgccgaagctgccattctgctcaaggccgtccagctcgtgggcagccaataccccacaactgttgcccaggatgaggagattctttcggggctcgtccagtctgaagcatctcaacccctgaaccaaaccgaccgacgacagaagatggctattcaggttcgcctgggtgagaaatatatcttgcaaactctggccaacatgctcgagaagttcatcacgaactccgctcagtctaacggagggtccggtctcaaacgaggcgccaacggcgacagtggcgattctaggagaacgaaagctcccaagaactga

SEQ ID NO: 15564 - DNA, 192 bp, A.fumigatus
gacggcagtcggaacacacgaggtcggggattgccctcctgtggcaggggggtcgtaccgccaacttcaacaatcgcggggccgatagcgaataacgggtcggggatctcagcatgcttatcaagcccgcccgagatgccaatggggttgttgagcgtatacccgaagacctgcataagcaaattcagctaa

SEQ ID NO: 15565 - DNA, 792 bp, A.fumigatus
aaatgcgaagcccagcgcaacaaaatcgtcctcccccaaaaccgctccaggctcctcctagccctcattcccgattttctaacgatctacccctgcgcccaaatcatcaaagactgggccgccggcttccaactgccctccgacgtcgaccctgaacagccgccgttcctcctcggcgcccaggactgcttctgggaagccgcaggcgcctacacaggcgaggtctcccccgcctcgctgcgttcgctgggggtccgtctagtcgagttgggccacgcggagcgccgcgctctctttggcgagacggacgaccaagtagcccgcaaggcggctgctgctgtcgaccagggcctgatccccctggtctgcatcggcgaggttactgcgccgggggcgatcgcgtcagaagcggtggggctggcggtgcgtgagtgtgcgggccagatgcgcgcggtgctggatgcgatcccctccgctgcgccggtgatctttgcatatgagcctgtttgggcgattgggaaagcgaagcctgcgggggtggaccatgttgcggctgtggtggaagggattcgggcggtgattgggaagcgagaaggggaagtgagggttttgtaccggggaaccgcggggccggggctgtggggggctggaaggctgggcaaggccgttgatgggatgtttctgggggagtttgcgcatgaaattgaaggtgtccaaaaagtggtccaaggaagtggaagaaaacttgtcagagcaatagcagactcactagccaggagtttttttagatga

SEQ ID NO: 15566 - DNA, 1263 bp, A.fumigatus
ttcgatgcagctattatggcgcccgaaactccccaaccgattgatcccgcggaccttccactgctcatgactttagaccagctcaagaaccccgcccccaagaacgcgaacgtcagtttccttcgtcggacgcaatatatctctgctggtctccgcgcaccggatggccccaaggtcgcacctatcagagcaaaggcccgttccgccgacaaaacgaaatcacaggatgatccgatgtacatcaagaaatacattcaaaaaggcttcgatattgcctatccggatagcagacatgttggggaggatacaccgaacagaatcaaaggccacactcctaccaaaatcgaggtcgacgcttgggctaacccggttcatcctgacaatccgaagctcaagccggtcggattctaccctctgctccccgatctacagggattcccggaccctggaggattcgttcagttcaagttcgataaagcgcctgttcagggtgtttcagggaaacgagacgagcgcatggatgtggccattcttcttccttccgccccagaagagcgggtctgtcaggagcatgcgaccaaagccgctttacacaagtcgaatcccgaattgtaccctgatccaggtccgataccgtgggattacgatctcttcttgcctgagaagaaggatgcagtcaaggaggtcattgcgagcttacggctttcgaaccccgatcgcgacagtgaagtcctgtacactcacgaaggaacggatggcattaggtttcaccgttacgaacgcatgcgcacgtacgccactagtgctcagaccctgggcaatgaatcaaagcagcgcgatgttgctctgacgcttttcgacccagcggaggcgaaggaaggacagcagacaaaacagagaggtgcatactactatcctattctcggaaagacccgtctaaagcccgagcgggcccgtactattgcgcaggcgggtcttgctcccacgcggcccaagacaaaggaggaccaggtagatcaaatccaggttgttgtccgcgatccagacgaggcagaggtatacaaacgctctctacatagagcggccattgatccgaaatttgcaaaaactctccctccgcctcctgaaccggaatctgctcctgagcaggaacatcctgagactcacgactctgaccgaggagaagaggtgaccgaagatcgcaatcaccagccaaccgctgcagaagtgagcgacgacgaagacaagatgagtgacgaatag

SEQ ID NO: 15567 - DNA, 585 bp, A.fumigatus
  unsure (140): Identity of nucleotide sequences at the above locations are unknown.
ggggtcgaccgcaagaccaagccgtatgtgatggtcaaggtcagcctcgacgatgactcggatgagcaggtctcctgcatctgcgacgccgtatggcaattcggcgtggaccgggcgtatcgtggcaacacgaccaaccngcggcctgccccgctgccgcatggcttcactcttccgccaaaggagcagtctaccctgaaggagacgggaggctactcggggccccagctgttcgaccgcacagctgccctggtggcccgctaccgggcgctgctggatgcaccgcccactccggcgtccgatgcgaatgaaaccgaccaagccaaggagctggcagcggctgtgactcgagccgagcctgacgtggagaatgtgcccgcagttgagccgcctactccggctaatcggccggcgcgcaaggtgatatttgcctctggaggtatcaccaacggcaagcaggcgcaggcggtgctggatgcgggagcctcggtcgcgatgatgtacacggccgtgacgtatggtggaatcggcacagtcactcgagtgaagcaggaattgcgagaggaaaagaaaaaccgtcaatag

SEQ ID NO: 15568 - DNA, 627 bp, A.fumigatus
atagtcagcattgtccacgatcacaatgatcatccgtcaattcttcatctaaaaaaactcctggctagtgagtctgctattgctctgacaagttttcttccacttccttggaccactttttggacaccttcaatttcatgcgcaaactcccccagaaacatcccatcaacggccttgcccagccttccagccccccacagccccggccccgcggttccccggtacaaaaccctcacttccccttctcgcttcccaatcaccgcccgaatcccttccaccacagccgcaacatggtccacccccgcaggcttcgctttcccaatcgcccaaacaggctcatatgcaaagatcaccggcgcagcggaggggatcgcatccagcaccgcgcgcatctggcccgcacactcacgcaccgccagccccaccgcttctgacgcgatcgcccccggcgcagtaacctcgccgatgcagaccagggggatcaggccctggtcgacagcagcagccgccttgcgggctacttggtcgtccgtctcgccaaagagagcgcggcgctccgcgtggcccaactcgactagacggacccccagcgaacgcagcgaggcgggggagacctcgcctgtgtag

SEQ ID NO: 15569 - DNA, 474 bp, A.fumigatus
caaggcagactcgtcatggttgccaattccaccagtcttgcctggaaatcggctggtttgagggcccgcgccgtgccgtcattgcgatgctcccaccggtcttcagtccttcatagacaggccgctttccagcaacacggtgccgtgcgacatgcctcaagcacgaccagcgaggcagctgaggcagtaaaggaggcacccaagaaagctggccgcggcctcaagagaacggtgtacggaacatcgttggtactcgctgcattggtgggttatgtatatgcgacggataccagggcaagcatccaccgctatgctgtggttcctcttgtccggacgctttatcccgacgcggaagaggcgcatcatattggtgtggaagctctgaagacgctctacaagtatggacttcatccgcgggaacgcggcaaccaggacggtgacggcgtgttggctactgaggtaatacagccctga

SEQ ID NO: 15570 - DNA, 615 bp, A.fumigatus
ctgaatttgcttatgcaggtcttcgggtatacgctcaacaaccccattggcatctcgggcgggcttgataagcatgctgagatccccgacccgttattcgctatcggccccgcgattgttgaagttggcggtacgacccccctgccacaggagggcaatccccgacctcgtgtgttccgactgccgtctcagaaagccatgatcaaccgatacggcctgaattccctgggcgccgaccacatggcggccatcctggagagacgcgtgcgggatttcgcctatgccaatggcttcggcctgcacgacgaagcggagcagcgggttcttgacggcgaggccggcgtgccccccggcagtcttcagcccggacggctgctggccgtgcagattgcgaagaacaaggcgacaccagactcggacatcgaggctatcaagcgcgactacgtctactgcgttgaccgactggccaagtacgccgatatcctggttgtgaatgtctccagccccaacacgccctgcctgcgcgacttgcaagcgaccgcgccgctgaccgccatcctcaaggccgtagtgagcgccgctagggggtcgaccgcaagaccaagccgtatgtga

SEQ ID NO: 15571 - DNA, 369 bp, A.fumigatus
caagttttcttccacttccttggaccactttttggacaccttcaatttcatgcgcaaactcccccagaaacatcccatcaacggccttgcccagccttccagccccccacagccccggccccgcggttccccggtacaaaaccctcacttccccttctcgcttcccaatcaccgcccgaatcccttccaccacagccgcaacatggtccacccccgcaggcttcgctttcccaatcgcccaaacaggctcatatgcaaagatcaccggcgcagcggaggggatcgcatccagcaccgcgcgcatctggcccgcacactcacgcaccgccagccccaccgcttctgacgcgatcgcccccggcgcagtaa

SEQ ID NO: 15572 - DNA, 951 bp, A.fumigatus
tgtagttgggaggtttatgacaatgcccccgacctatcctcgcctccaacagcaggcgtgcagaacgggacccttatggatgacggtgaccatgggaaagccgtcaagatatgctacctgactgagcagacatcgcatcatccaccagtgtctgccttctttatagattgcccggaaagaggggtctccgcccgtggattcgaccagctcagtgccaaatttacgggcacgagcatccgcgtcgctcctggtcaacacaacctgggaatctttgtcaatattgagaagagagataatgaggaataccagttgacccatccaagtgctcatcttggtgggctattacgaggtgcgctggccgtttcagtctcagatacgtgttttatcacctgctccaaaacacgcatcaaggtcattctacagtatctggaggaaggctggattggtcgagcccagaacaaggtggaaggcttgattttccggtatgacccgaaccaagataccattactagaattaaagacgtgcccgacggcgatgttcttgccaggatcagcgggtcatggcatggagagatctattacacagtggctggaacagctgagccgcgtcttttaattgatgtaacgcctctcttcccagtgccaaagacattacctcccgaagaggatcaattgtcaaacgagtctctcaaattctgggcgggggtcaccaaagccatcaaggaaaaaagatatagcgaggcaacaagactcaagcaagaaatcgaagagcgacagcgggagaaggcagcagagcggcaacagaagaacgaatcgtggcagccgcggtttttcaccggaagtgttacaccgatgggaagaccagagttgaccgaagagggatatacagccctgcagggtcttcgtaacggcgactataaactggcggaaagtgaaattaaaggtgcctga

SEQ ID NO: 15573 - DNA, 876 bp, A.fumigatus
ggttgttcaaggccccggcccaaagacttatttgcccgcactttctcagtgctttttattgtcggccatatcgctattaagcagattttccaccttgagccgtgtgaactggacttcagggttcgcaaggcaggacaggagagccataaggttgccataacagccgctcacaaggacaatcagacgggcgaggatgatgaattggacctgattggtgggacgaccgaagatgacttcacggaggctatgtctcacattcgagaacgggagttgctctacggagagaattctctcctgtcgaacttcgggcctctggttgcggagatttgctctaatagtaacgcctatcccgatcgcaaccttcaggcggcagccactctgtgtatggccaaactgatgtgcgtgtcagccgagtattgcgaaaagaatctccccctcttgatcaccatcatggagcgctcagaggacccgaccgtccgcagtaacgcggtcattgctcttggagatatggctgtttgcttcaatcatctcatcgacgagaacacagatttcctatatcgtcgactcaatgatgatgatgtatccgtcaagcgcacttgtctgatgacactcacattccttattttagctggacaggtcaaagtcaaaggacaattgggcgagatggccaaatgcttggaggatgatgacaaacgcatcgctgatttggctcgcatgtttttcacggaattggcgactaaggacaacgcagtgtacaatcactttgtcgacatgttcagtctgttgagtgctgagcggaatcttgaagagactgctctgagacgtatcgttaaattcctgatcggctttgttgagaaggtgagttacaaaacctga

SEQ ID NO: 15574 - DNA, 450 bp, A.fumigatus
aacttacctacatacacaatggaaaatgttcaaccgctgtggaatgccgaccctatgattcgccatctcctcgccgccttccgggatacattctccaaccgcggcagtatccatcatcttcatcgtcatcatccagtcatcaatctgcacgttcctttccctcaagcactttctggcaacttacaccatgcgcctctttcacagattactaatggccacgccgtcaacaatgggctccaagtccagcctcagcgaagccctcgccctcctccccccactccagctctaccgccgcatcctccgcgtccaccgccgcaagctcgatcccgagatgcgcatcctgggcgactcatacgtgaaaagcgagttccgcgcacacagaaacgtagagaatcctctgcatattgtacgcttccccgtttttcctcaggtcaaattgagcagtgctaa

SEQ ID NO: 15575 - DNA, 609 bp, A.fumigatus
tgcctacatatcaagcgttgtgtatatcaatgtttaactgcaactctcacgccctaccatctacaagtaatgactaatcattttgaccaagaaaaatatacttcggctggaccgataaaccgaacctatatatatatacaacgaaaccattcccctgcaacagaagcactatattccctaccctcccaaacaaacaaaatgccacccaagacaagcataatggagaacccctcctccaaaatcccccctccggcatcagccctccaaaaagccccaaccctgaaaccccgccgtggggtcctgagagacggcacgcctgtcacaatgtaccccattgctcacggggcctcgagcatcccgtcgggtctggtggcgacgctcgctgatgaattccgcgcggagattgaggcaggctgcacgtatccgatggaggagccgatgggcgaggccaagttcgccgagtactggtttgggacgtttgcagttgtagccctgacgggggacgaggaggagattagggaagggagggattggaagaaggagtgtttgggaacgttctatattaagccgaattatcctggtaatttattctgcatacagtttgtttga

SEQ ID NO: 15576 - DNA, 414 bp, A.fumigatus
ttcgccatctcctcgccgccttccgggatacattctccaaccgcggcagtatccatcatcttcatcgtcatcatccagtcatcaatctgcacgttcctttccctcaagcactttctggcaacttacaccatgcgcctctttcacagattactaatggccacgccgtcaacaatgggctccaagtccagcctcagcgaagccctcgccctcctccccccactccagctctaccgccgcatcctccgcgtccaccgccgcaagctcgatcccgagatgcgcatcctgggcgactcatacgtgaaaagcgagttccgcgcacacagaaacgtagagaatcctctgcatattgtacgcttccccgtttttcctcaggtcaaattgagcagtgctaaagcgtgcagatcggcttcttga

SEQ ID NO: 15577 - DNA, 189 bp, A.fumigatus
caacctacggagtatgaggatctggatatcctctttgtatattattatgcatcggcacaaaagctcgctacaggtggatgcatttctctcattttgacggcgttcatgtctatatttagctttgcactagttcagcggtataagattccatgcatgcagctggctctgggattagaagcacgagcatga

SEQ ID NO: 15578 - DNA, 255 bp, A.fumigatus
gaaatatccctccatatcctcacaatcaccaacttctcccaccccgcctgcgtcccgctattcccaaccgactcggccttccacccccctccccaccctcgtatcctctccttgacctcctccggccgattctgtgcacagagcagcacatacgccaccccacgctcaggatgcaacacgcccggaagcgcctcaagcaaccgattcgtcgtctccatcccatccaatcctcccgcgtacgttaacgacaggtaa

SEQ ID NO: 15579 - DNA, 825 bp, A.fumigatus
  unsure (425),(468),(504): Identity of nucleotide sequences at the above locations are unknown.
aacttgcaaggctgcaagctgcacaacatgctccccaccccctcgacagaccacgtctccttcgacaccatctacgaaccctccgaagactcctacctgttcctcgacacgctctcctccgcctccgaatcacaatggctctccgagcgcttcaatagcaccagcaccaccaccagcaccttcccgctagtcgtcgaagtcggcaccggctccggcgtcgtcctggcctttgtcgccgccaactcccacgaaatctttggccgccgcgacatcctcaccctcggcacagacgtgaaccgcaatgcctgcgttgccacccgcactacggtcaaaacagccatccaagagcgccaagcagccgcagccctgaaatccacacatgtcgcctcggtgctgggagatctttgcagccccttgcgcccggnctccgtcgacgttcttctcttcaacccgccgtatgtgccgacngaggaacttgcgcgtctgccctttgtgacggagcangaggccgatcccgcagcggagccgctgtcaagatcggccaagttcgagcgggactcgtattacctgtcgttaacgtacgcgggaggattggatgggatggagacgacgaatcggttgcttgaggcgcttccgggcgtgttgcatcctgagcgtggggtggcgtatgtgctgctctgtgcacagaatcggccggaggaggtcaaggagaggatacgagggtggggaggggggtggaaggccgagtcggttgggaatagcgggacgcaggcggggtgggagaagttggtgattgtgaggatatggagggatatttctcaatag

SEQ ID NO: 15580 - DNA, 429 bp, A.fumigatus
gggggggggggggcggaatccaagaagagggctttccggggtggggggggggggggggcgggggggggagggggggggggagggggggaaggggggggggggggagggggggggcggcgggggggggggggtgggggggggggggggggggggtgggggcgggggggcagtgagaggggggcgggggaggggggggggggggggggaagggaggggggagaagggggggggcaaaatgaggtccatatagataggaggtggggggggtgcggggggggggggggggggggggcgggggggggagttggggggacgtgcgggtctgctgggggggggcggtggggggtggaggggggggaggggggggggggggggggggagggtggggggtgtggggggggggtggtcgtgggggggggggaggggtag

SEQ ID NO: 15581 - DNA, 1851 bp, A.fumigatus
gagacgcatgactctcttagactgaaaacaatgtcctcagtctttggaagccagcccccacgcttcagtcctcctcagtctgcacaaccgtacagatcgatattcggaggcccaagtagccaggatgtgacagatctggaaccgtacccagagacgcaacagggcggaaatcgccctgatcaacatgattcagacgttgacatggaagatgtcccattgactgaagtcgatcactcagacgatgagacatacgttgaaagtgaggacgacggttctgtgtccgacgatgaggccagcaatgatggtgattcgtacaaattagcgaagaagcaggctgcggtgctgccatcgtctagcaagcaacaccctgatagtccgccgtcatcgccctcatacaggcctaataggttccgtggccctgagtctacgtggagaaagcttacgtttgaagaccggcagaatgcgcaagcactggaggaactcagagccagagaccttgccgctcatctgtacaatgcttttgctttacgggttagggcacgtgagatcgcacggcaagcgttagaaagcgataagcaacttgacgagacggaagcattcgtacccccgaaacgttggacagcgtggcctgtaccggcaacggaggttcctcgtccaggagagcatctacgaagacaaattgatgacgaatggactttgagaatgccgccggatcctcgacccagcgcagagctggaggagtcaatcatagcaatcatgcttaagactgccaaggatcggtttcaggcgagagattggaccactaaaggcgtcggtccaaaccaaaagcagagagcacgatctatgtcccaaacgaacgacgaaactactggcatagagagcgaatgggagtgtgacattgacactactgatgccatggaacttcgtccggtagtccaagccgacgatgacaaatctcgacgacagctacgccctcttacgcgcaacatacttacccgattcgatcagctactgatgggtttgcaccatgctcgaaaaggcggaatgacgggagatgatagctcagcaagtgaatggcagagtgacacggagagtgccgcttcgaacgcatctcattcaaggaaaatgcgcaagggtgagaagggagagaggagtcaatcaagagggcgcaaacgaagtcgcagatcctccgtgcgggctacatccacgacaggccgatcccgcagcgtactcgcgtcgagcgcacgcacaccctctcattcgcgtggaaggtcttttgatcgtgatcgcaggcgatcagccagtcgcattcgccgtggacttcgggactggagtgaagtattaggtgttgcttccatcataggcttaccgcatgctgctgttatgcgcactgctcgcagatgtgccgctcttttcggggaggatatggaattccggaccttcagtgagggtcaactacagcattcgaaggaaggagatgtcaacaagtgggagtatgttgagaacgagaccgatgagtctgaaccagagcagatcgtgccttcccctcctagtcgaactcaatcacgaaaatcgcgctcccgcgcagcgtctacaattggctcgacgtctcgtcccagcagtccaacatcggaggcagctggtagcaaacaacgactcaaaggaaaagggcagcatcgcaagcaagacatagtgtgtcctgtcaagtcatgtccccgacatatcgatggtttcactcggacatggaatctcaacttgcacatgaagcgaatgcatgccggataccggtccaggagcgccagtctcaagtctgcaggtgccaggtcccgcgctccgtcagtgagcggttag

SEQ ID NO: 15582 - DNA, 606 bp, A.fumigatus
aattttagcggaccaggcttggaaacatggcttttcctgcggcaaaatctcgacccctacgacccccgaccgcctgcaccacccccactcccccaaccaccccaccccccccccgacctcccgcgacccgcccacaacaccctctccccccacaccgctccccgcacacccactctctacccctcccccccccccacgaccaccccccccccacaccccccaccctcccccccccccccccccccctcccccccctccaccccccaccgcccccccccagcagacccgcacgtccccccaactcccccccccgccccccccccccccccccccccgcaccccccccacctcctatctatatggacctcattttgcccccccccttctcccccctcccttcccccccccccccccccctcccccgcccccctctcactgcccccccgcccccacccccccccccccccccccccacccccccccccccgccgccccccccctccccccccccccccttccccccctccccccccccctcccccccccgccccccccccccccccaccccggaaagccctcttcttggattccgcccccccccccccc

SEQ ID NO: 15583 - DNA, 621 bp, A.fumigatus
tgcaagttcctcagtagaattttagcggaccaggcttggaaacatggcttttcctgcggcaaaatctcgacccctacgacccccgaccgcctgcaccacccccactcccccaaccaccccaccccccccccgacctcccgcgacccgcccacaacaccctctccccccacaccgctccccgcacacccactctctacccctcccccccccccacgaccaccccccccccacaccccccaccctcccccccccccccccccccctcccccccctccaccccccaccgcccccccccagcagacccgcacgtccccccaactcccccccccgccccccccccccccccccccccgcaccccccccacctcctatctatatggacctcattttgcccccccccttctcccccctcccttcccccccccccccccccctcccccgcccccctctcactgcccccccgcccccacccccccccccccccccccccacccccccccccccgccgccccccccctccccccccccccccttccccccctccccccccccctcccccccccgccccccccccccccccaccccggaaagccctcttcttggattccgcccccccccccc

SEQ ID NO: 15584 - DNA, 597 bp, A.fumigatus
cggaccaggcttggaaacatggcttttcctgcggcaaaatctcgacccctacgacccccgaccgcctgcaccacccccactcccccaaccaccccaccccccccccgacctcccgcgacccgcccacaacaccctctccccccacaccgctccccgcacacccactctctacccctcccccccccccacgaccaccccccccccacaccccccaccctcccccccccccccccccccctcccccccctccaccccccaccgcccccccccagcagacccgcacgtccccccaactcccccccccgccccccccccccccccccccccgcaccccccccacctcctatctatatggacctcattttgcccccccccttctcccccctcccttcccccccccccccccccctcccccgcccccctctcactgcccccccgcccccacccccccccccccccccccccacccccccccccccgccgccccccccctccccccccccccccttccccccctccccccccccctcccccccccgccccccccccccccccaccccggaaagccctcttcttggattccgccccccccccccc

SEQ ID NO: 15585 - DNA, 222 bp, A.fumigatus
tctgctcccataggtgaagacaggaagttcccaaatggaatcgcccatcttgcagacaaagtccataagttgggcctgaaaatcggcatctactccagcgctggaaggtggacttgcgcgcggtatgagggctccctcggttacgaggaaaaggacgctgccctctgggcaagctggggtgtatgttctctttccggttctcctggcgtcctccaaggctga

SEQ ID NO: 15586 - DNA, 741 bp, A.fumigatus
gttccacttccccccagcaaaccccaatgcaacaacattcaaccccgcccgaaggatgggaaattcacgctgacgcggcgcacagaggtcgggaacggtggcctcaccgacgatgaatcaattgctcacatgagcctctgggccgccctcaaatcccccctcctcatgaccaacgtcatgaccaagatcgatccgcccaccctctccatcctccagaaccccgccgtcctcgccgtctcgcaggacccccttgcctccacccccgtccgccagtggcgctacttcgtcgacgacgtcgacgagaacggcaagggcgagatccagatgtactctggcccgctgagcggcggcgaccagctggtactgctgctgaacgcggggtccaaggctcgcgagatgaacgccacgctggtcgatatcttctgggagagcggcgccaagggaacggcgaaacaggtcaagcagcactgggatgtgtatgatctgtgggccaaccggatgagtaatgaggatgcggcggccatcattaacgggacgtttactgggccgtcgccctataacttgactgctatgggtggggcgcatgaggtctattcgcgccctctgccgtcgaattcgaaggtgttgatggggtccaaggttgggtcagtgcagcctagtggcacggttacggcttatgttcggccgcatggtgtcgctatgttgcggttgcgtgcgaccgacaaaaaggatgaattgtaa

SEQ ID NO: 15587 - DNA, 447 bp, A.fumigatus
atcgactacctcaagtacgacaattgctacaacgaaggcgaagaaggtacccccaaactctcctttgaccgctacaacgccatgttcaaggccctcaatgcaactggtcgcccaatgctttattccctgtgtaattggggcgtcgacgggccctggaacttcgccccaaccatcgccaactcctggcgcacgactggcgatctgagcaacgtctgggaccgcgacgacgtcaactgcccctgttccgaactggacggcctggactgcaagacgcccggttacaaatgctccatcatgaatgtcctcaataaggccgtttactatccatccaaggcgattccaggcgcctggaacgacctcgatatgctccgtaagttccacttccccccagcaaaccccaatgcaacaacattcaaccccgcccgaaggatgggaaattcacgctga

SEQ ID NO: 15588 - DNA, 624 bp, A.fumigatus
gctgcacctccgctacttggagttggcgcggtcgactcagtagcagatccgggaacaagggcagcgctccgatctctcttctcagaatctttgactttccgtaatccgccgcctccagaagctcggatagcagccaggaggtcttccctgccacccgttggcttaggcagaggtggagccgcgccactcgcagggggaggtgggggaggtgcaccggcaccaggaggaggcggaggtgggggaggcgcagagccgccaggagccggcggaggcggcgggggtggtggaggccctccgattgacgggggaggaggaggaggcggaggagcgggtggccctgagctcactggaggaggagggggaggtgatggtggaacactcgttgaagggggaggaggcggaggaggcggaggaggcacggcactagtgactggagggggaggagttggccgtgaagcagcaggaactggcggaggcgggggaggtgggacaggattgcgggccggtggaggaggcggaggacctgccgcagaggtcggcacatgtggaactttgggaggaagctgtggtggtgttgcagggcttcgcggaggaggaggtggtggccccggggtgccgagctaa

SEQ ID NO: 15589 - DNA, 261 bp, A.fumigatus
tgccgtgcctcctccgcctcctccgcctcctcccccttcaacgagtgttccaccatcacctccccctcctcctccagtgagctcagggccacccgctcctccgcctcctcctcctcccccgtcaatcggagggcctccaccacccccgccgcctccgccggctcctggcggctctgcgcctcccccacctccgcctcctcctggtgccggtgcacctcccccacctccccctgcgagtggcgcggctccacctctgcctaa

SEQ ID NO: 15590 - DNA, 651 bp, A.fumigatus
attaatgatcgattgaagtatggacttcttcctagagatctccgcaagatcgactcctcgactttgccgcacatccttgtccgaccgagcgcgatcctcatcaacctgctgcatcttcgcgttctaatcaagcatgatcgggtccttgtgtttgatgcgtatggatcgaccgattcttatatgcaatcgttatttgtatatgacttggaagggaagctacagcagaaacagacaggaggattcggcgctctaccatacgaattccgcgccttggaagcggtgctcatcagcgttaccaccggtctggaggaagaattcaatggtgtgagggagccggtcgtgcgtgtgcttcgcgctctggaagaagatatcgaccgggataagttgcggcatctcctgatttactccaagaaactcggtacctttgagcagaaagctcgtttggtgcgagatgccattgacgacctccttgaagcggacgatgacctggctgcaatgtatttgactgagcgtgcgaatggcgttcagcgggaggaagatgatcatcaagaagtggagatgcttttggaatcttatcacaaagtctgcgatgaaattgtccaggccagcggcaacctggtgacaagcattcgcaataccgaggaagtgtag

SEQ ID NO: 15591 - DNA, 615 bp, A.fumigatus
gtctttttatttggccctaactggtctggttacgcagttactgattgtttcagtgtgaaagccatccttgacgcaaaccgtaactctctcatgttactcgacctcaaattcagtattggaacccttggcctcgcgacaggcactctcttctccgctctctacggcatgaacttgaagaacttcatcgaagagtccgatctcggatttggtgctgtctctatgacttgctttatgatcaccgcggtcgtttgtgtgtacggactcgcgaagctacggaagctccagcgtgttcgtatgtggggagaagccggtgtaggcggcgcacccctcacacctctgacgaccagaagtggtatcctgtccggccatcggtccaactggcgtgcggactctattgaaccagtctggggcagtcttcccggcgaagctcggacagagagaatcaaacgtcttcgggagaccgcggctgcagccgctgccaggtctgcaagtgccgacgcaacggcccagagggcatctgctttgcgaagctcggcaaacgcgaatggcggagcaccaaaaggctccgagcattctcccacacgcgagactgaggccagcggcagttctgcctag

SEQ ID NO: 15592 - DNA, 732 bp, A.fumigatus
ctcggcaccccggggccaccacctcctcctccgcgaagccctgcaacaccaccacagcttcctcccaaagttccacatgtgccgacctctgcggcaggtcctccgcctcctccaccggcccgcaatcctgtcccacctcccccgcctccgccagttcctgctgcttcacggccaactcctccccctccagtcactagtgccgtgcctcctccgcctcctccgcctcctcccccttcaacgagtgttccaccatcacctccccctcctcctccagtgagctcagggccacccgctcctccgcctcctcctcctcccccgtcaatcggagggcctccaccacccccgccgcctccgccggctcctggcggctctgcgcctcccccacctccgcctcctcctggtgccggtgcacctcccccacctccccctgcgagtggcgcggctccacctctgcctaagccaacgggtggcagggaagacctcctggctgctatccgagcttctggaggcggcggattacggaaagtcaaagattctgagaagagagatcggagcgctgcccttgttcccggatctgctactgagtcgaccgcgccaactccaagtagcggaggtgcagctcaaggaggtttggccggcgctttgcaagacgcccttgcgaagaggaagcaaaaagtcagcggtagcggtaagtttctcccacatcaattgttcgctagcaaaactagctaa

SEQ ID NO: 15593 - DNA, 921 bp, A.fumigatus
gttcatagagttttttttctcttgtctcctctgattccgttgagagtcgcactgacaaactcagggtcttctcatgttcatagtccacttgccgcattttcattaaccccatccaagacctctgtacgagccgggtctgcggagactcgagagcgacggcgacatgatccgttcctaatggcccagtcccgtcaacggaaggctgccaatctatctcgtcaacaagcccttgctcgagagcgtgaagagtcccttggcgatccggtggaaagcaaacctacccctttcatcgaggagctgaaaggcttgaaggctccgacctcagaagatgcggccctcaaccattttatctcgccggaaggactccaggaggcactggaatactcgaaatccctgacatcaccgctagaaaaccccgaccgggaaacggcagatcctcaacttgaaaaggaggctgctgaaagacatctccaggagcatcgaaacgctcaagaagcgatcagacgtatcatcaatatcaacaacggaaacaccaaagaccgcactcgtctgctcatacagaaatgcattgatacattcggaagacataataccgacaagatcctcccacccaagcccacagctgtcgctcaggattcctccactgtccaccccaagaagacgcccagaataggcccagatactggctctcccgaagtccaggtcgctattctgaccgcaaagatcattaacttgtccagacatctccaatcgaccaacaaagacaagcacaataagcgcaacctgagactactggttcacaagagacagaaactgcttcggtacctgcgcaggaaggaacggggtggaccaaggtggcagcatcttattgaaacactcggcctgtcggacgctgcttggaagggtgagatcagcatgtaa

SEQ ID NO: 15594 - DNA, 807 bp, A.fumigatus
ggcaggagcggccgagctggcggcccagtcaccaccgtcagcctcccagctggtgggggcagcagtggcagcagagaaggcggtgccaggaacaccagcacccggagcctgggtatcccagttctcaccagcgaagccggactcgacagcaccggcgccaatctcctcagcaccggggaccttagcctcatcggcaatctccttgttctcctcggcttcagggtcacggtagaagtagagatcgacaacaacgtcccactcggtctcacgagtggcgagagtaccacggagacggagaacttcacgggcaagcaaccaccagatcagaccaatggcgtgacgacccttgttgttggtggggatggcaacatcaacgaactcggtgggggagtcagtgtcgcagagagcgatgacggggatgttgacgtagctggcctccttgatagcctgagcatcggtgcgagggtcggtgacgatgatgaggcggggctccttgaaagaacgggtgatgtagttggtgaagttaccgggggtgaaacgaccggcaatggcggtggcaccggtgtgagaagcgaacttcaggacagcacgctggccgtagggacgagcggagatgacacagatgtcggcggggttctcaatggcagcgatgatacgagcagccaagaggatcttctccctacaaattcgcgatcccgtattagagccagtcaccaaagtcccgataatcaaaaattcaaggcgacataccaagtcttgccaatgttaatgacattgacaccgtcgggacgagtcttccagaggtaa

SEQ ID NO: 15595 - DNA, 765 bp, A.fumigatus
cattggcaagacttggtatgtcgccttgaatttttgattatcgggactttggtgactggctctaatacgggatcgcgaatttgtagggagaagatcctcttggctgctcgtatcatcgctgccattgagaaccccgccgacatctgtgtcatctccgctcgtccctacggccagcgtgctgtcctgaagttcgcttctcacaccggtgccaccgccattgccggtcgtttcacccccggtaacttcaccaactacatcacccgttctttcaaggagccccgcctcatcatcgtcaccgaccctcgcaccgatgctcaggctatcaaggaggccagctacgtcaacatccccgtcatcgctctctgcgacactgactcccccaccgagttcgttgatgttgccatccccaccaacaacaagggtcgtcacgccattggtctgatctggtggttgcttgcccgtgaagttctccgtctccgtggtactctcgccactcgtgagaccgagtgggacgttgttgtcgatctctacttctaccgtgaccctgaagccgaggagaacaaggagattgccgatgaggctaaggtccccggtgctgaggagattggcgccggtgctgtcgagtccggcttcgctggtgagaactgggatacccaggctccgggtgctggtgttcctggcaccgccttctctgctgccactgctgcccccaccagctgggaggctgacggtggtgactgggccgccagctcggccgctcctgcc

SEQ ID NO: 15596 - DNA, 210 bp, A.fumigatus
caatatcaatcgaccacaatggctccctctcagctcccccccattttcaaccccaccccccaggacattgagatgctcctcgcagctcaatgccacctgggttccaagaaccttcaggttcacatggagccttacctctggaagactcgtcccgacggtgtcaatgtcattaacattggcaagacttggtatgtcgccttgaatttttga

SEQ ID NO: 15597 - DNA, 207 bp, A.fumigatus
gacaccataaggtgggcttctgacatttttgcagtggggaagacgtccctgattaccagatttatgtatgattcgttcgacaacacataccaggcgacgatcggaatcgactttctgtccaaggtagatttcacctcgttcactgacaatttgcgtcggcgttcacgaatacttttgcggttgcccatcaccgaatatgcgggttag

SEQ ID NO: 15598 - DNA, 684 bp, A.fumigatus
acaatgtatctggaggatagaacagtccgactccagctctgggatacggccggtcaagagcgattccgatccctgattccttcctacattcgagactcgagcgtcgcagttgtcgtctatgatatctcaaacgccaagtcgttccaaaatacccgcaagtggatcgatgatgttcgtggtgagcggggcaacgatgtgatcatcgtgctagtaggcaacaagaccgatttgaatgataagcgggaagttaccacagctcaaggcgaggaggaggcaaagaagaatggtctgatgttcattgagaccagcgccaaggtcggccacaatgtgaagcaactcttcaggaggatagcccaggcccttcctggaatggagggtgaagcaaacagagagtcgcaaagtgggtttatttgctgcagccgccggcttgcttcctctgagactgactgctcttcgtacagtgatcgacgtcaatatcaaccccagagagacgacaagcaacgatggatgcgcgtgctaattctgtatcaaccttttgattacctgtttataattgctactcgcccctttgatgatttgatctcaatgacgataattgagattgtccataatgttttaccattcttaatatgtacattgcctgtctccattccatgtttcaggtcgaacagcgttttagattga

SEQ ID NO: 15599 - DNA, 384 bp, A.fumigatus
tcctgtcagttactgacctacgtcatcaggggtatcttcttaacaggctcatccattgtcggcggaggtgtcaaagcacctcggattcggacaaagaatctgatttctatcattttctgtgaagtcgtcgctatctacggagttattatggctatcgtgttttcatcgaaactcaatcttgtcgagggcgacgagatcttttccggcagcaattattacacgggttatgcgctcttctggggaggtatcacagtgggggcatgcaatctgatctgcggtatctctgttggcatcaacggaagcggtgcggctctggccgatgccgctgacccgagcttgttcgttcccgatcccctcgcatatttccttcgcacccatagctaa

SEQ ID NO: 15600 - DNA, 330 bp, A.fumigatus
aaggatcacctgatcgcagcggatctcaagcaaagcgatacctacaagatgactgaatctcgtgtcccatcgtcgcggttaggtcgattgtggcaatacagtgggctggctacctcgatggcttttggagcagtgggtgagggcctgcgaaggatgactgggggcaaagatgactatgctgggtctataatgttcagtcctgggaacatggaacgacttgtggccaaactctcaaaaatgcgaggagccgctctcaaactggggcagatgttgagttttcagggttggtattcgggagttcctccttccttgcgttgtggtggacactaa

SEQ ID NO: 15601 - DNA, 1182 bp, A.fumigatus
gttttcagggttggtattcgggagttcctccttccttgcgttgtggtggacactaattctttttcagataacaaaatgcttccagaggctattcatcaggttttgcagcgcgtgcaagatcgagcagattatatgccagcttctcaacgagacaaagtcttggctgacaaccttggacccaattggcgggaccttttctccacgttcgatgaagttccaatggcagcggcttcgattggacaagtccatggagcggtgctcaagagaactggccagccagttgccgtcaaggtccaatatccgggtgttgctgagtccattgactccgacctgaacaacctttccatccttctgacggcatctcgtcttcttccaagaggtctttacttggacaagacgattgcaaatgcgcggacggaactcgcgtgggaatgcgactacatccgagaagccgagtgcggcaaccgtttcagagagctcgtaaaggacgaccctgtcttcttggttccggagattatcccggaggcttcaggaaagcaagtcctgaccatggaacgtctggaaggcattgcagtcaccaagatccatgacttcacccaggcgcaacgtgattggattgggacgcagattctacgcctatccctccgcgagatcaccgagttccggtttatgcagacagatcccaactggaccaacttcctctacaatgcgaagactaataagctggaactccttgactttggtgcttcgcgcgagtaccctgtcgaattcatctcgaaatataacagaacgcttatcgcggcttcccgcaacgaccgagaacgctgccacagcctctccatcgaactgggctatctgactggtcatgagtccaagaccatggtagacgcccacgtttcttcgattttaacacttgccgaaccgttcatggattcttcaccagacgtctacgatttccggaatcagaccatcacggaccgagttcggcgtttgatccctgtgatgattcgggagcgactctcgcctccgcccgaggaaacctacagcttgcatcgcaagctcagcggagcgttcctgctctgtgcgagattgggaagccaagtacgatgcaaggagctgtttgcagacgcgatccagaaggcggagaagtctgggcttgacgttgggtcgacccgaaaatag

SEQ ID NO: 15602 - DNA, 240 bp, A.fumigatus
gcccggatatccttcttcatgcgcgagtccacaatcttgtatttgcccttcactccgcgtggacgaccggagatacctctgttggctcccctagcaacaaccaacttcacctgctgcttgggtttcttcttgaccgctttgctcatcaacttcgcaatggtctgcgacttgtccctttcgctgagcgcttcgtcatctgccagcaaagcagactttttgcgcagtttctcgagtctctga

SEQ ID NO: 15603 - DNA, 318 bp, A.fumigatus
gctgccttcatctttttacggcccttagcctccatcaccttcttgatgggccgagcattgatggcacgcagcttttccttgattgcggctgcagccgctttcgtgataggccgttggggcttagaatgcttgttttcgtcgtcgaggaaccattcggggagaccgtcaacatcccggaaggtgtaccgattgaagccgtcatcaataatgtcctgggacttcttttcaccggtggccatttgctgggcaagtgccatggcctctgcggtaatgatatcgatatctggggtgaaaaaagatgttagtgactccggctga

SEQ ID NO: 15604 - DNA, 315 bp, A.fumigatus
gaagtgattgatgatctcattgttgagttgaggtgtaaaggcttggttgttgatcagaacaacatctgcgcgtttcagaacatcaatgatgctttgctcttgcagaaagtcgccacggacaaggtttgttttccctggcgcaataccccagagccggcagcgtgctctaaactcggtctgctgaagttctgccaggtcacaagcattggccatcatctcgcagccccaactttcacatccaatttcaagcgcagcttgcaaaacgacattaccaactccagatccaagatcgacaaagacgtgccccgattttag

SEQ ID NO: 15605 - DNA, 519 bp, A.fumigatus
tcgtcctcactgtcactctcaatttccgctagctttccagacgcaatgacatcccttgccccatctctttccactcgcttcaaggagaaagttgcgtcgtcgccaccgggcccaagttgctccatgccaatgtccataggggttgtcatatgcatttgcatgcgtattatttctttgcgcttcttctcattctctttgcgcctttccttcttgcgcttggcgctctctttctcctggagacgttgtagctcttcctggatggccaactcctcatccatgggagctacctctgcgacctcctcaggttcatcggccttggcttgcccttttttgactacaagcccaaacttttcacggacctttaagcgccatcggagtaggctccgaaattcttttttgcctagaatcttcaaatcctcacagcaggttcgaatctcgtccgtggtctcttccagtctgttcaatgtcgccaatgcaagatctccccctggagattgttcgaagctgagcttattataa

SEQ ID NO: 15606 - DNA, 600 bp, A.fumigatus
gttggtacctttcagccggagtcactaacatcttttttcaccccagatatcgatatcattaccgcagaggccatggcacttgcccagcaaatggccaccggtgaaaagaagtcccaggacattattgatgacggcttcaatcggtacaccttccgggatgttgacggtctccccgaatggttcctcgacgacgaaaacaagcattctaagccccaacggcctatcacgaaagcggctgcagccgcaatcaaggaaaagctgcgtgccatcaatgctcggcccatcaagaaggtgatggaggctaagggccgtaaaaagatgaaggcagctcagagactcgagaaactgcgcaaaaagtctgctttgctggcagatgacgaagcgctcagcgaaagggacaagtcgcagaccattgcgaagttgatgagcaaagcggtcaagaagaaacccaagcagcaggtgaagttggttgttgctaggggagccaacagaggtatctccggtcgtccacgcggagtgaagggcaaatacaagattgtggactcgcgcatgaagaaggatatccgggctcaaaagagattggcgaagaagaagaaatag

SEQ ID NO: 15607 - DNA, 228 bp, A.fumigatus
ttcccttcttatgttgggagacttctttgcgctaacatcgaccagcacggtaaaggtcgtttggataagtggtatcgccttgcgaaagaaaagggataccgagcaagagctgcttttaaattgatccagctaaacaagaagtatggtttcttggaaaagagcaaagtccttctggatctttgcgcggctccgggcgtacgtttagtcactccctttttttcccgctga

SEQ ID NO: 15608 - DNA, 1029 bp, A.fumigatus
agaaaggtttgcacttcaggtctagtgatacccgtaacccagtctaactgcttgatatggtgtagattcaacctcgtcgtgccacgcgacaacgatgattttaagcctatcgatgatatcgtccatgttatcgacatcgtttctgagaactatattcctgagagtgaggcggatttcttcaacaatgagtcaacaggtatcaaacggaggttgcgccgagctttggcacattcgtcagagacggaattccgagaagccgtggccagctacaatcgtgagatcgagcgtttaagacgtagtggggccattgctaaacatttggacgcgacacatcggttgaacctgccgcttgtagaaaggatattgacacagatttacgcccgtactgtatcccctcgagttgaatctcttcgccgatacgaaaacggaacggataacgtttacggagagctcctacctcgtttcatcagcacgatcttcaaagaaactcggctaaaatcggggcacgtctttgtcgatcttggatctggagttggtaatgtcgttttgcaagctgcgcttgaaattggatgtgaaagttggggctgcgagatgatggccaatgcttgtgacctggcagaacttcagcagaccgagtttagagcacgctgccggctctggggtattgcgccagggaaaacaaaccttgtccgtggcgactttctgcaagagcaaagcatcattgatgttctgaaacgcgcagatgttgttctgatcaacaaccaagcctttacacctcaactcaacaatgagatcatcaatcacttcttagatatgaaagagggctgccagattgtgtcactcaagtctttcgttcctgccggtcacaagattcagtctcgcaatctgtactccccgatcaaccttttgaaggttaagcagttgaattactggtcaaacagtgtcagctggactgacgttgggggcacatattttattgccaccaaagatagttccaggctcaaggcttttgcggatagcatggaatga

SEQ ID NO: 15609 - DNA, 1479 bp, A.fumigatus
tcgtggtgtcaagtagcggcagagtgtatgcccactcagagcatcattatcggtgtcgatctcgccccaatcaagccaattcctcgagtcattacctttcaaagcgatattacaacagaaaagtgtcgcgcgacgatcagacaacatttgaagcactggaaggcagacactgttcttcacgacggagctccaaatgttggtacagcgtgggttcaggacgctttctcccaggcggagttggtcttgcagtcgatgaagttggccacggagttcctggtagagggtggtacctttgtcaccaaggtcttcagatcgaaggactacaatcctctgctctgggttttcaagcagctcttcacgtctgtggaagcgacaaagcctccttcttcccgaaatgtttccgcagaaatcttcgtcgtctgccgtggattcaaggctccaaaacgcattgaccccaaattcctcgaccccaagcatgtttttgcagaattgacagattctacgccaaataacgaagcgcgtgtattcaatccggagaagaagaagcggaagagagaaggctacgaagagggtgattacacacagttcaaggaaataccggtcacggagttcatcaataccactgatccgatcgcgattctcggtacttataataagctcagcttcgaacaatctccagggggagatcttgcattggcgacattgaacagactggaagagaccacggacgagattcgaacctgctgtgaggatttgaagattctaggcaaaaaagaatttcggagcctactccgatggcgcttaaaggtccgtgaaaagtttgggcttgtagtcaaaaaagggcaagccaaggccgatgaacctgaggaggtcgcagaggtagctcccatggatgaggagttggccatccaggaagagctacaacgtctccaggagaaagagagcgccaagcgcaagaaggaaaggcgcaaagagaatgagaagaagcgcaaagaaataatacgcatgcaaatgcatatgacaacccctatggacattggcatggagcaacttgggcccggtggcgacgacgcaactttctccttgaagcgagtggaaagagatggggcaagggatgtcattgcgtctggaaagctagcggaaattgagagtgacagtgaggacgatcaaacggaatctgattacgacgaaagcgatgacgaaggcgaccgattggagagggaactcgattcattgtacgaacagtaccaggagcgcagagaagatcgggactccaaagtgcgggcaaagaaagcgcgaaaagactacgaggcggaagaatgggacggcttctcagactctgacaaggaagacgatgaggaatcggaggaagacggcgcgtcccaagcggtggtcaagccagcacctcctaattcgggaacactctccagcaaggccgcgatgttcttcgatcaagacattttccacgggtataggtga

SEQ ID NO: 15610 - DNA, 573 bp, A.fumigatus
ctccgctccatgggatttttcgatcacctccagaaaggaggggctttttcgctgcaggctcaaaagccacaaattcgtaaggttgtccagacccggcccccgccgccctcaagatcttcctcgcacacccccgtcagatcatcgtcgcagacctcacccccggggagagttaaaagaccacgagactccactagccggtctgtctcgagagatcccgatcatcgcccatcgaagcgtttaagtaccccgttgcgaaataggaaacggccaactcctgaacaacggttttcgagtgacgatgacgcaagtgacacggatacatcatttgagttgcgcaagcgggcaagaacggaggatagtgcggagcctgacctcgcgaggcgcatacggtctttgaaagcattttcggaggagaatgttaaaccactgccattggtccacgctgcagatattacatccaaacaaaaagccggaaacttcagacgagcgtttggaggggcagaccggccgacggagattcttctgcagtatcccagtgcttcacttaaagaaaggtttgcacttcaggtctag

SEQ ID NO: 15611 - DNA, 474 bp, A.fumigatus
gtcctttccaagtcctcgtttcgatgtatggaattgctaacccctgcttcagaaaaggtgcttggtcagttgaagggggaggaaagagagggtctcatcgaccaaatccgacctttgctcagccagcttaagaaattcagctacggaaagcagatcgttgccatcgaaaagctcattttcgattctacgacgctgggtgctaattctctgcctcccgcttcgtccacgactcctcctcactcccacaaatcctcccctcagccaagcaagcgcctggtcaacgatgtagagaacagccgggctcctgttgtcggcgcggctccgcctacccctcctcccaccgacaaccagggtcatacacatggtcctgctgagtcgaagaatcttgcaaaaagcacggtgacttctttgtcggtatctgaatctgcatctgccgactccaatggctctgtgccagtgtccgcatccacctaa

SEQ ID NO: 15612 - DNA, 1230 bp, A.fumigatus
tctttccgggtcggtctcatcggagtgaagacgaccgactcatatttctccatacctatatcttccggaattggatcgtcctctggaggagggaatcacaaaacttatctgaacgctggagctgacgggatctctccatgtggatatgggctgtcattcggcaattttggtgggctccggagtggcgacggtagacggcatcctaactcctctgcctttggaggaagcccagttggaacgggttttcccatgaagcaagggtttaccactctggacaccactcggcccgatgagataactgggtctctcacaatgtctagtttaccacaggcattgccagacaccatgtcgcacccgttggctcgtaacggttttgcgcatgcgtcccataactcggcatcaatcacatctcagagacccacccacgcctctcacccgtcgtttcattctgaaagccagggattcgagggtcgctttggaggctcctccatggacctgagtgctgaaatcaatacgcttcagctgaatgaaggcggcttttcgggccacccagtaagccgtccgccctacctgtcccactcgtcctatgatgggtcattgcaacgcttcaaatatcagagcgctgccgatgaatccagctatgaagcagtcgggggatacgcgggagacggtttgtccgagttgccattaggacaccacgccggccgatcccgtctcggtgaaggttcactttctcccacagatctagcgcggatggagagcaccttttattctgctcttgaggccggcgcggtccctgggtcacattatcggaatgggtctgccacccgactgagtgaaaaccaggctctagccttggagcggaagttgcgtgctatgcagcatgatcaggatcttgcccacggtgctgcaaattctctgcaacgtattccatataatactcctgcgtacgatctcgcgggatatcaagcggcacggctcaacgctttgtcaggattctatcctgtcgcacagcttggtgggctgggctccgctggtatcatccccaggggccatcgtgatcaagaccctgcccaagtggtacggagcccgctcttggaggagtttcgagcgaatagcaagggaaataaacgctacgaactcaaggtatgtatcttcgtttccctctactattctcgggcgaaaaccatattaataatccttgcaggacatttacaatcacattgttga

SEQ ID NO: 15613 - DNA, 600 bp, A.fumigatus
gcgttggaacatatccttaccgaccagcaggcatccatggtcaaggagcttgagaaccatgtgcttaagtgtgtccgtgaccagaatggtaaccatgtcatccagaaggccattgaaagagttccatctcaatacgtgcaattcatcatcaacgccttcaagggacaagtgagcaggctggccgcgcacccatatggatgccgagtcatccagcgcatgcttgagcattgtgaagaagtagaccgggaatccatcttggctgagcttcatgcttgcactgctcaccttatcccagaccaattcggaaactatgtcattcaacacgtgatcgaaaatggcgaagaaaaggatcgatcccgtatgatcaacgttgtactgtcgcaactgctcatgtattcgaagcacaaatttgcgagcaatgtggtcgaaaagagcatcgaatttggtgaagagtcgcagcgtcagcagatcattagcacattgacatcggcgaacgagagaggcgagagccctctcttgggtttgatgcgtgatcagtacggaaactacgttattcgtgagtcctttccaagtcctcgtttcgatgtatggaattgctaa

SEQ ID NO: 15614 - DNA, 315 bp, A.fumigatus
tccttgcaggacatttacaatcacattgttgagttcagtggcgatcagcatggttcacgattcattcaacagaagctggagacagcgaatagcgacgagaaagagcaagtgttccgcgaaatccagcccaactgcctgcagttgatgacagacgtgtttggcaactacgttgtccaaaagctcttcgagcatggcaaccagtcccagaaaaagattcttgccaatcagatgaagggccatgtgcttgccctgtccacccagatgtatgggtgtcgcgttgtccaaaaggtatggctacttcatgccaaagggtag

SEQ ID NO: 15615 - DNA, 228 bp, A.fumigatus
ttgaatgggtcagagataagaccgggcccgcattggccctcatttccctccctccagcgcgagtataaggtcggtcccttccctcctctgcttcctctttcgctcgatattcgtgaggacacaacaggcctttcaacttcctttctcccacacggctcgggcagtccttgcttggtttctctttgcgaaatgtctaccaaagatcacgaggttgaggctgctcagtaa

SEQ ID NO: 15616 - DNA, 201 bp, A.fumigatus
gcaacaaatgctttgcccctaaattccagagcaagctccctatgtgcatgtcagcctctcaatcatcgtaatgctctaaccaacccaaacactccgcactccgcagagtataccttttaccagatcttctgtatgagctcggcttatttggataccgagggggtcatctacattattgcccaagggcggaggatggggagg

SEQ ID NO: 15617 - DNA, 225 bp, A.fumigatus
  unsure (38),(70): Identity of nucleotide sequences at the above locations are unknown.
tgtctcgaggcgcttacaggggtatgcgcattgggttntaccctgacgaatgcgcaggcttactctccanacgtccctctggcccaaaaagagaagtgcaaccaagttcaattaggtcattgtcagcttcaaatcggtttcgacttcttttccttgatggctcttgagacgatgacgctgaaaaccaagagaccctacctggcgcattgggcacccattatttaa

SEQ ID NO: 15618 - DNA, 720 bp, A.fumigatus
cttgtcgttgtccaaggccagtacgtcaagtctctatcatttccaagtatgccgacttttttgcgtattttcgaacctcgctactgcctcatgatacgaagagtcatggagagtcgagagcgcaagttcggaatggtcatgtacaatcgcctaggacgaccgcaaggacaactaggagcaacccaattcatgcaatatggcgtagttcttagggtcgagcgctttgagccccttcctggcggcagaagcttgatttttgccatgggtgtatcgcgcttcaaagttatcaaatctcacatcgtggatggctaccacgttggccaaatacagcgggttgacgatattcctatcgcagaagaggagaatttggaatcgtgggagacgtcgaccatcccacatcgttcaacagaagcccggccatcccaacagccactggactccatgtcaacgcaagaactgtttcagttgggactggactttgtacgaaagcggcggggcgaaggagccagatggctgcacccccgtgttttgatggcctacggagatattccttcagatccagcgcagttcccctggtggcttgcctgtgttttcccagtatccgaagaggaaaagtacgcgcttctgtcagcaacaagtgtcagggagcggctgaagatcaccgcacagtgggctagaaaggcagaggcccgggagaggtatgttctcaagtgccattag

SEQ ID NO: 15619 - DNA, 186 bp, A.fumigatus
ctagccgtcccacttctcgtcttcggtctcatccccttggctcttggtccaataacatcgtccacgtcagtgcgatctgcaggtgttctcacctctttttctcccctctccttctctgtttctgtgtcatttggttccgccagccctgctacatattatatcaatcaacggtggattgcacggtaa

SEQ ID NO: 15620 - DNA, 216 bp, A.fumigatus
ccgaatctcacagcagctaaatatggtcgtgctaattttccatatccgaacgattcgctctctgaaaagtctgtttatctttatacgtcaactgcggacatttctcaaacctctagatggctcactaccgctttctttcttggatctaggttgcaggaagatcaaatcagctgtcgtgttgatttgtacactgcttgtacagaacactgcaaatga

SEQ ID NO: 15621 - DNA, 585 bp, A.fumigatus
tgtatgattacataccaagtcacacaaccatatgtggttgctgaccactctctccttcagatcttggtttacggagcgaatcttccgtctctgtcccccaaagtctctggggagctctatgagcagcaggattatgatggactcgagatacgccctgtcactcaattcaagagctccaacaatcatggaaatgcctcttgtgaggtcggcgagaactatgaggacgatcctgaagatgatggcatagtttctccaaacagtgacgaaaaggatgattttgacgagtcgagaagcgcggattctgaatcttccccggcaggtcaacgcacagtcttcattcgcggcttaccggaccgggccacacatcaagatgtcgttgatgcagtgagaggcggtgctctgctgcacctttaccttcgggctcgggatcacgccgcttacgtctcgtttgttgaaccagctgccgctgccgaattcctgcagcatgcaaaaactcttggctgtcatatttccgggaagcgtgtaagaaagcctatcgaaaccgttgcacatgtacttgtattgaaccactcctcatcttcatag

SEQ ID NO: 15622 - DNA, 411 bp, A.fumigatus
  unsure (282),(314): Identity of nucleotide sequences at the above locations are unknown.
gtcgaggtctcatggaatgaccggcaattctaccttcccccatacgtcggatcgaagatcaggaacggcgcaactcgaaatctagtgatccacaatgtgaattcaaatatcactgaatcaattatccggagggaccttgaccatatccacaacctgattgttatcactgtgaaattcaagcaaggcaatgcatacatctccaccaactccgttcacaatgcactatttgctcggtcgtgcatgatgtctcgaggcgcttacaggggtatgcgcattgggttntaccctgacgaatgcgcaggcttactctccanacgtccctctggcccaaaaagagaagtgcaaccaagttcaattaggtcattgtcagcttcaaatcggtttcgacttcttttccttgatggctcttga

SEQ ID NO: 15623 - DNA, 228 bp, A.fumigatus
ggagtggttcaatacaagtacatgtgcaacggtttcgataggctttcttacacgcttcccggaaatatgacagccaagagtttttgcatgctgcaggaattcggcagcggcagctggttcaacaaacgagacgtaagcggcgtgatcccgagcccgaaggtaaaggtgcagcagagcaccgcctctcactgcatcaacgacatcttgatgtgtggcccggtccggtaa

SEQ ID NO: 15624 - DNA, 186 bp, A.fumigatus
ttcgtcgccctacttagggctaggcttctcagtgtttatccatttctttcagatcaaatctgtttttctgctcgcattgaatgggcggagatactcgttcaggctgctgctcagcgtggcatgcctaggataactcactatatcattatcattgttctgctcttctttgctttcggagaggtgtga

SEQ ID NO: 15625 - DNA, 351 bp, A.fumigatus
tttactcttttcggccacgcgcgttggcttaaccgcgcgaggctattgcgggttatgcccgaaaacagagaaagcaacacagacaatcatgacttatctatcagtggcaccacccccaccaacactgcggtacccatttatctaccacccacgcaactccataactggacggcttcctttctcgccccgctgcctctagctggctactgcatgatcgtcctgctttttcccggccctaacgatgctttcgggaggggcctcccaaactcttttcctaaattcgtcaagggctattggatctgtgagacgtggcccaatcaaaaatcatgtcgttgggtagttcgccagtga

SEQ ID NO: 15626 - DNA, 195 bp, A.fumigatus
tccgatgccatgggcaaaaaaggagcaaagaacaaaaagaagaacaacaacaacaataataagcaacgcctaccggtgaacgataataagttttccctctctgaagacaaccctacagccgagcctggccttgcagtggccgccgaggctggggaccatggccaacctacagtatgcacagcttcccaagtttga

SEQ ID NO: 15627 - DNA, 747 bp, A.fumigatus
atgaaagtcctgcaccggaaagcaaagaaggagacagcaacggtatgctttgggataccgaaatgcataaaaagccagctaacctcattcccagaggatgatttcccagaatgtgacccatccgcggagctcgataaggtcgaggccgaaaaagcggaagcggcacggcaagcggaggaagatgcaaaagcagaagaggaggcagaagcagcagctgcagcagctgctgcagcaggggttcctgatgacgttgatattgacattggaaatgagaactcacctacagatactccagacaacgaggaagctgcccccgcacagggtgacccaccaacgaacgagtcagcagaagaagatgtgacgaagcccgacactgaaaatagtccagccccggacggacccgctgaagagcagagcgactcaccacccgaagcagagcagcccgtcgctgaagtacaagttcctaccgaggagcagcccgctcctaaaaagcccgcacctgaaccttcttctgaggaacctgccgcgccgactgagacggcggagaacaacacttcagaagaagcagtagctcccgaaggcgcaacagccgatatcgctgcagacgaaacgacgaagccagaatccactgacgagaaagccccggaagagcctgctgcagcagaaagcccagtcgaggacaagcaagatgaggcaacaaaagctcttgcagcgtcttcaccacggggctggaaggagccgcgccat

SEQ ID NO: 15628 - DNA, 417 bp, A.fumigatus
acgataataagttttccctctctgaagacaaccctacagccgagcctggccttgcagtggccgccgaggctggggaccatggccaacctacagtatgcacagcttcccaagtttgaatatcagacattcgagcgtcaatatcagaccttcgaccgtcaaactttgcaattttcgttttatcccgtcactgctgctgcttcttcggatggtctgacatcggataaggatcaggataccaccgataacgcgacccattcagaggaaggcccatccctagagagtgctcccgtagaagaatcaggttctcccgttgacgctgcgcctgcacccgaatctgaaggtacgcatgattgtcaatcgccactttctcgctttgatcggggttcaccttcctcacattcatttagagtcacctga

SEQ ID NO: 15629 - DNA, 435 bp, A.fumigatus
aagaatcaggttctcccgttgacgctgcgcctgcacccgaatctgaaggtacgcatgattgtcaatcgccactttctcgctttgatcggggttcaccttcctcacattcatttagagtcacctgaagcggcagctgctccgcctgagcctgacccgtcagatgagccggcacctgaagccaaggaagaagcagaatctgcgccagaggcagacggtaccaagcagaaagccgaagacgccgccaaccccgctgagcccgagacgccagcggctactgaagatgccgcgcaagactcaccgcccgaggacggtgatggtgccgcagcggcggtagatgaaagtcctgcaccggaaagcaaagaaggagacagcaacggtatgctttgggataccgaaatgcataaaaagccagctaacctcattcccagaggatga

SEQ ID NO: 15630 - DNA, 786 bp, A.fumigatus
tggcgcggctccttccagccccgtggtgaagacgctgcaagagcttttgttgcctcatcttgcttgtcctcgactgggctttctgctgcagcaggctcttccggggctttctcgtcagtggattctggcttcgtcgtttcgtctgcagcgatatcggctgttgcgccttcgggagctactgcttcttctgaagtgttgttctccgccgtctcagtcggcgcggcaggttcctcagaagaaggttcaggtgcgggctttttaggagcgggctgctcctcggtaggaacttgtacttcagcgacgggctgctctgcttcgggtggtgagtcgctctgctcttcagcgggtccgtccggggctggactattttcagtgtcgggcttcgtcacatcttcttctgctgactcgttcgttggtgggtcaccctgtgcgggggcagcttcctcgttgtctggagtatctgtaggtgagttctcatttccaatgtcaatatcaacgtcatcaggaacccctgctgcagcagctgctgcagctgctgcttctgcctcctcttctgcttttgcatcttcctccgcttgccgtgccgcttccgctttttcggcctcgaccttatcgagctccgcggatgggtcacattctgggaaatcatcctctgggaatgaggttagctggctttttatgcatttcggtatcccaaagcataccgttgctgtctccttctttgctttccggtgcaggactttcatctaccgccgctgcggcaccatcaccgtcctcgggcggtga

SEQ ID NO: 15631 - DNA, 507 bp, A.fumigatus
gtgagttctcatttccaatgtcaatatcaacgtcatcaggaacccctgctgcagcagctgctgcagctgctgcttctgcctcctcttctgcttttgcatcttcctccgcttgccgtgccgcttccgctttttcggcctcgaccttatcgagctccgcggatgggtcacattctgggaaatcatcctctgggaatgaggttagctggctttttatgcatttcggtatcccaaagcataccgttgctgtctccttctttgctttccggtgcaggactttcatctaccgccgctgcggcaccatcaccgtcctcgggcggtgagtcttgcgcggcatcttcagtagccgctggcgtctcgggctcagcggggttggcggcgtcttcggctttctgcttggtaccgtctgcctctggcgcagattctgcttcttccttggcttcaggtgccggctcatctgacgggtcaggctcaggcggagcagctgccgcttcaggtgactctaaatga

SEQ ID NO: 15632 - DNA, 1359 bp, A.fumigatus
  unsure (1209),(1284): Identity of nucleotide sequences at the above locations are unknown.
ggcgacgtacgcacaaaatccgtctcaccagagggttcacgtgaagcagtagatatgtcaatcaagtctcgcatttcgtatatcctagatgacacattcgaacattctcgttctcccagtttccattcatcgcctgtcacggatgaacgagaggttacggccttgccgttgagtcgaaatcccgatgtcatcagacggcagcccgcgccgcccttcaaggacagacatgtcgaatctactgtcaagattgagtcagaccctttcataacagacagtaaagattgtagcaagcccaacgacgtgttctctatcatagacagcattcggtcatcttcgcctcctgtgcaaactccgagagaactgggatttatgaccccgccgcacgcgcgtcaactaagcaacccagccatgagtacacattctcctcggacgcctacttttccagcagttgcaatcgagaacgaggatggcttcttcggctcttcccctacccctggcaccagaggcagggcacaggtggtcggctcaaccattccctcgacgttaacaactgaggcgatggatccttgtatgaatttcgatcctccctcctctcctccaggtatacggtctctcagtccgaactcacgcaatatagcaacgccttcaaatatccctcagatgccttcagacgcagagaaagagaatatccgtgcagttctgactcaagagaagacgacggtcaatgatgtcacatccgagtatactggtctcggcaaagaggagcactgtgagactggtcaatcggaaaggcctctcaagcgccgtcttcgttcttctatgggcaaacagcagatcacgaatgcgcctgccgttttagaacctgaaacacctgtagcacgtcaggaaacagagtctgtaccggaaccccttaataatgacaagggggggttcttagaaagcgtccatgtcgtcgaatctgcgcccaagatggaccaagagatgatgaaaggcaatgtgaatcaagaggagatgcacacagatccggactgcattgcagactcgttcagtgatgatatggagacccaggtcgcgtctcaactcgaacaagacttggagtctgcaggaaatatgaacgaagagcctaaaagcaaagcaccttcagaacctcccatacaacaaaccacaagaaaaacgatacggggcgttaaggaagctgatgcaggtganacatcttctactcgagagcggcgtcgatcttcgaggctgtcgtcgacgaaaaacccatctgctgttcgaagtacnagaatccatgagcactcgtggctcgagatccatgaccattccttcttcgcagaacatcaagtcttcgcccgctga

SEQ ID NO: 15633 - DNA, 612 bp, A.fumigatus
tccagtataggaggtcatccagcacccgccatcgcggatgaaggtcagtatcggaggcaatcatcacgtactgcgcgctctcggaaacaggctaagaacaaagagcttctttcggaaagcttttcccttaaaaaattagaggccgatgcacctgattctgtgatggaaacacctgcagcagaaattcctaaccagaatctgacttgtattcgggagttgaccctggaaacatatgttcacggtagtaaccttcccaagacgattacacctgacgcatcggtacagccaagcaatagcagctctggtgataccgagatggtcgaagcagagccggcggccgagccagagccgacagacgatcatgctcaagtcaacgcggctcagacagacgctgatggtaacaatcacgctcccgaggacaaaatcatgatttcccattccgcccagactggtaccttggtcggccaagaaggcgtaatatcctctttacgaagggtacttgatgatgtcaaatcaaccaccctgaacttatctgctctgaaagagatcgacgacctcctattcgatatccgggtggaaatgcacgaagcactaagaagacatgcagggtag

SEQ ID NO: 15634 - DNA, 459 bp, A.fumigatus
ttaattcaaattagggccgtgatcaccataagatatcgaagccacagacgggaggcagaaacaaggcgtctctacttcctgggaaggacaatactagctgatgtcgatatcagcagacagttcccccttgccaagctcagtatctggagggcgctgcaccgaggaaagcaagcacttggggcagagagcgacgtcccggatccgatcctgtgctctatttgcatggaacagctcagggatgatgaggacgtccggccgcttccttgcgagcatattttccatccagagtgcgtggatccgtggctgacgagatatcatacctcgtgtcctttgtgcagagtcagcttggtagaagatgacggcaagttggatctagaggatgggaggccacctcggctcttgactctgcctatgcctccccagccggcgttgatcggttttgcagggcgattcgggtaa

SEQ ID NO: 15635 - DNA, 267 bp, A.fumigatus
caagcccaacgacgtgttctctatcatagacagcattcggtcatcttcgcctcctgtgcaaactccgagagaactgggatttatgaccccgccgcacgcgcgtcaactaagcaacccagccatgagtacacattctcctcggacgcctacttttccagcagttgcaatcgagaacgaggatggcttcttcggctcttcccctacccctggcaccagaggcagggcacaggtggtcggctcaaccattccctcgacgttaacaactga

SEQ ID NO: 15636 - DNA, 309 bp, A.fumigatus
agccttgtttgtatttccgatgggccatttgtgaatgggtctctggcattttggcgatgtattgtcgttcaggtatcaaaggtggacgatagcgtgtataatgtcctacttacctcagtcgaggttaacactgatgctagaaaaagatgccgatctcgatttacatcgtccggacctctctacctcttgaaccagcacttccctgaaaagaaatggatgaaattctatttatactatgaactgtccagcccttttgccccgacccctgaagggcaacactcagacagaccaacctgcaaaccagactag

SEQ ID NO: 15637 - DNA, 1215 bp, A.fumigatus
ataagaatccttgaagctgacgcgcatgaaatcctgaacgtcaacgatgaacagctaagtgtggcggaaagaagccgaattcagaaggggaagaggaagagcgcttcccataacaccttgattgaattgtgcagcagcgaggtgtcttacgactcgactctatggtcaaaggtattcccgaacatcattaggatcagcttcgaaacctgcccgtttgctgtgactttgggacgagagatcgtctgtgcgaggctcgtccagatgcataaaactataactgctctcgctgatagtccgcatccacctccatatgcgcccattgaccctgctcaagctcgcgcactgggcagaagcaacatgactgcggaaatccttatagagcaatggaagctctatctagtcatggcttgtactacactcaacagcgtgggtgcgcagtctcaaagtcagctcgcaaatgcccaacatgcgcgcaaatcctctaagggatctcagcagtcgcaagataagatcagctccgccagaagcctctttgcttttgtgataccgttgttgtcggctgagcgatcctctatacgaaatgcaattgtgatggcacttggctctatcaataagaatctttatcgcacttttcttgagtctcttcaatacgccgtaacgacatgcaatgaggaagcgaaaattcgcatcggtgctcaccatcgatccccgagcagccccagacgaaatcggaaaacggatcgcctgaggacagaggtcacgcacgtatacaagttgacttcgcatttccttcgagaacccgaggtgtacaacgacgactggatcgtcaataatctcgtcacttatacaaaggatctgcgcatctttctaagtgacgctgaagtgcagaatgactgggaattccaacgcctacggttccattactgtggcttgatggaagaattattcgagggaattaatcggaccaaagacccgtctcactggatccctttcgagtcacgaaaatcggctttctcgctaatggaagactggtgcgggtactcgcctaatcaagcacagattgctcaaagagaagagaatatgcgaaagttcgccatggcccatcaatctgaatctggggagtttcggaacacagcagctgcaatggagatcgagaagaagaatcttcgcgcagcggctcttagtgcaatggcctcattatgtgtgagtagttga

SEQ ID NO: 15638 - DNA, 2130 bp, A.fumigatus
caggctggaccaatcagtatcactacggaaagtggctcagtgcttcaattcgatgtgggaagaatgctctcttggattgatatcattttcaacaccctcagcgataagtggcacgcaatcggtagacgagcgctcaagaacctgataatccacaacaaagagcattcttatctactggagagagcaatcgagatgtgtcacgtctcggaaaggccgaaggcgctggaaagttactttgaggtggtgactcaagtactgatagaacataccgattatccacttggcttctggagaatcctgggcgctgtactcgtcacgctgggaaatcagaagcgcgagatccgaatgaaatctgccaaacttcttcgcatattagaagaacgtcagcaaaagagttcaagacttcaggacttcgacatcagcatctctgataagaccacagctgtatacaagctcgctcaattcgaaacatcccggcggctagcgaaacagcactctgatttggccttcaccttgttctcagagttctcactacatttccggaatgtgggccctgatagccagcgaaatatggtggccgcaattttaccttgggttcaaaccatggagctgcaaattgatcctaatggtggtccaacagctaagtcctacatgcttctggccaatttgttcgagatcactatccgatgtggcaacatattaccgaacgaggtgcaagcgctctggcaggcactggcaacaggaccccatggtgggaacgtacagctagttctggatttcatcatcagtctctgcttagaacgcaaagagcagaatttcgtcgagtatgccaagcaagtcgtggtcttcttgtcagggacccctgcgggctcgaaagtcattgaattcttcttgatgcaggtcgtacccaagaacatggttcaagagaggaaggatattaccccagctccaccggatgtcaaaagcttaccctatgtggcggacctaggcaccgtgcttcccgtcggcaataaacaagctggcctttcgctaggtcaagtggcacttattttcctcgtagatctaatggttgcgccagtgacccttccattagaagccgttgtcaaactgcttcacgtcgtgctcattctatgggaccactacatgctcactgtacaagagcaagctagagagatgttggtccatcttatccacgagttgattgctgccaagatcgacgatgatgctcctgccgctacacgacagggcatcgaggacttcgttgaatctatacgggagagtgacccgaaggtcgtttgggagtacgaagacaataatgacaaagaggacggcgacgatggcagcagagtacctctctcgatgtccactgttactcgtcaggtcgtcaattttttcagcttcgcatacgagggtgtcagtgatctctgggccaaggaagcactcaactgggctacttcatgccctgtgcgacacctggcatgtcggtcattccaagtattccgctgcatatcaacgtcccttaacccgaggatgcttgcagacatgttggcccggctctcaaataccatcgcggatgaagaggcagattaccaaaccttttccatggaaattctaacaactctgaaaatcatcattagctctcttgcccccgctgacctgctgcgttatccccagttattctggactacttgtgcttgtctcaatactattcacgagacggaattcattgagagtattggaatgctggagaagttcctggactgtgtcgatatgagtgaccccgcagtagtcaccgagctcattcaaggtcagccacccaagtgggaaggcggctttgacgggctccaaaacctggtctacaaaggattgaaatcctcagaatccctcaatcgcaccctggatgtcctgcatcgactaagtggtcttccaaacaacgcgcttattgggaatagcgacagactgctttttacaatcctagcaaatatggctcattttctccaccaattcgacccagacgttgatgatccaaagactcttgcgcgtgctacgttgttggcgcgcgttgctgagggagaaggatgcccccgtctcgcagcgtctcttctcgggctcgccaacggacaatattag

SEQ ID NO: 15639 - DNA, 291 bp, A.fumigatus
  unsure (77): Identity of nucleotide sequences at the above locations are unknown.
ctccaggaaagagacgagactcttcatcttaatcaccgtcaagccaaaatgacaagcaatcagcccccactccgcanacgagggatcgtctcctacggttcctacaagacaggaggatggaagctgaaggacctcactctccgtcctttgaaagaaaaagaactgctaattgagatcgtcgcatcggggatatgccagacagacctgcatttcgcaggcgcagagagcggattcggcgtgcactatccgcggatcatgggccatgaaggtataccataccacctctcctga

SEQ ID NO: 15640 - DNA, 954 bp, A.fumigatus
accacaggcgccggatatgtccgagaagttggctctggggtgcaggtcgcccaaatcggtgacccagtcatcctctccttctccgcgtgcagggcctgcgagtcatgcgagaccggccaccccgcgcattgtgctaatttcaacccgataaacttcgaggtggagcctgataaccttgtcttcagcgaggaggcatccaccgcaacggaaccgagcatctacggacgattcttcggccagtcgagtttcgcgagttactcgattgtccgcgaagactcagtagtcaatgttcgtggggtcgttgacgccaggtccgagctccagttgctgtcacctcttggctgcggaatccagaccgggagcggcgcgattctgaacgcagcaaaggcgacgccgaaggatcgggtggctgtcttggggcttggaggcgtcggattgagtgcggtgatgggtgcgaagatcgctggctgtgcgcagatcatcggtatagagagacatgcttctcgtctggagctggcgaagcaactgggtgccacgcatgtcgtgcaggttgatacgacggcagatccgcagagtgtatcggatgccgttttggcggcgacgaacaacctgggggtgaacatcgtgctggacacgactggtgtgccggcgctgattgcccaaggtgtccgaatggcttcattcaaaggaaaggttctgcaggtcggaacggcgccggagacggggacgttgaccattccgattcatgagttcatggtagcagggaaacagtacatgggtgtggtggagggagacgtaaaccccaaggactatgtacctaagatggtcaaatgggtacgagaaggaagcctgcctctacagaagattgtcaaattctacaaggcggaggactttgagcaggcgatccgtgatatgcagtctggcgagacgatcaagccggtcattgtgtggtag

SEQ ID NO: 15641 - DNA, 489 bp, A.fumigatus
atcggaatggtcaacgtccccgtctccggcgccgttccgacctgcagaacctttcctttgaatgaagccattcggacaccttgggcaatcagcgccggcacaccagtcgtgtccagcacgatgttcacccccaggttgttcgtcgccgccaaaacggcatccgatacactctgcggatctgccgtcgtatcaacctgcacgacatgcgtggcacccagttgcttcgccagctccagacgagaagcatgtctctctataccgatgatctgcgcacagccagcgatcttcgcacccatcaccgcactcaatccgacgcctccaagccccaagacagccacccgatccttcggcgtcgcctttgctgcgttcagaatcgcgccgctcccggtctggattccgcagccaagaggtgacagcaactggagctcggacctggcgtcaacgaccccacgaacattgactactgagtcttcgcggacaatcgagtaa

SEQ ID NO: 15642 - DNA, 921 bp, A.fumigatus
aacggggcaggtcttcaggtccaggggcttcttccaagcggccagcagggccggtcaatcgcgataataattgcaaaaggtccctacaactcccaagacaagcatcctacttctcctctcctgctgcctttacatcaacgcggcagacggaacaacagctacccgcaccaaatccacagactacgcgtctcaacgtccctgcgcgaagcactgcttctattggggcgcctcctcgcagaccggatcggctgcgaagttgatcccatcgggaacgaatgcatctgtcgcttggatcttcagcaaaccgccgactcgttcctccgcagatgcgtgagtgacaactgtggctcacatgccttcgatgtttccagcgccgtcagcatatacgccgagtattgcacgagtaatggttatacgagggcgacgtccaccacgcagacgaccgggacgacttcatcaggtacgccgatcgcctctgcggccgtaacggtgaatgtcatgcacggtgctggcgtctgggggacgacgtctgcggccggcggtccttggactaatgtaaggacgaggttgaccgttgtgtatgctttagtctcgacatctcaggcgactgctgcgacgtccacaagtgagaaggcgtcggattggacgaccgagtctacaaggcagtcagtgccatcggcaaccctatcgacaacgacaacctcaccgaccactgacttggtaactagagaaggagacaagactgttgaaggtgatggaagcaaactaaaagtaggagaaattgtcggtattgtcgttggtattcttggcctcatcgccacggctttggggtcatggtcttcatgcaagactctcaagcaaagaaaacatctggctgcaaatgcacataaagcacccaactatttaaagctttgttcctga

SEQ ID NO: 15643 - DNA, 324 bp, A.fumigatus
atggtaactggtcaaggattaaccaacgacatggtagaacttgcgaaccgccgtgaggcccaaacaggagcagacgaaacaagcatcaatcgtgctcgtgaagttcggcttggctccgcccctggtcagaccaagtgctcgatttgccatagtacttttcgaagacccgagcatctgaagcgacactttcgaagccacactaaggagaaacctttcgaatgtgcgcagtgtggacgtcatttctcaagaacgtatgtcgtcgccttctttttttttttttttatttctatttttatttccctcccccccctttccttgttgtga

SEQ ID NO: 15644 - DNA, 1590 bp, A.fumigatus
ggtgcagtggtggttccccatgccgtacggtgtgagaataggtctctggaatgccagtatccgacggaacgacgctccaaagccaaaacgcggaaggaggtggcccagaacctgtcttctgagagaaacagtacgatttatgggcaggctactcagcgtgaatccccctcttcaccagcaggtgctgatgtcccaggagcggatatcagagagcaaccaagaaatgagcctccgggatttcagattaccgaatttcaactggatcttcccggctcccatcgtgtggatacaccatcaaagcatatgcctgcagagaaaccgcacgggcctcctcgcggaatatcgtcagagcatcagaatggtccaccaggagacgaaacggctgacttgaacgctcgaatgctgctgtcagatgcgggtggttcaacgcacgacgcacgtgtgtcgctgcctgaatatgctagcttgagctcgcagcaattttattcgcagttgccagcaggtggcgctcagaccctttcacaagaatcggcctcgcaacttgaccatcggtccagagatatccagcagccagtagcagccacatccaatctcaatctggaattggagggagttggaggccaacaaatgcagctcgggtttgacccgccatttctagatcaatcgatgctttctaccttgaattggttgcctaacgatatgttccccgacacaacgagcgaccagtcgctctcgaggatgcctccgctctctgaccagctgggtatcctggacgagccggtgagccggacagcatggctacctcctgtcaccgacttgaggcaaatgggtccctctgcgcgggaaaatcactctcacaccccttccgggcacatgtctgtgggcacagatgcggggagtcccgaccgattttctcacagcattggggagggttcattgcattcagagccctcaaacgcaaccaagcggtccggagatttctacgtggacggcgctggagctcgactgccaaagtatagacggaacagaacttcgtggtcaaggttatctgcagaacctattgagctcctggcaccgctgcatcagcatgatacgcgacatcaattctcattcccactgactcaggagatcaggccagacttccttccgggtgaggaagcggcctccaactgtcgcatcgaagctccgacatatgatagaatctaccagtcattccttcagttatgccgcacggacaaccctctctttctcaaattcgagactggtaactttccgagcgccgatgctctttcaagctatgtatacctttacttcgactcatttcagcccgtgtatcccttgttccatccccctacattcaacccaaacaagtgtcattggctcgtgacactggctatatcagcagtcggctgtcgtttctctggtctgacctctctggatgaatgcactacggcgtttgatgaattcctccggcgggctatcaatattgaggtaagaccgttgattttggcttacgggctattcattgctgaccgagtatggcggtccagaaagagaaatgtcgctcagaacgaataccgctgtggctga

SEQ ID NO: 15645 - DNA, 189 bp, A.fumigatus
ttcatggcgatggagcgtgtcacttgcaacagcagtcagttttcaaacaccattgttattcaacctggtgagcactctgatactgagaccgcaactgccacagtgatatcacaacaaggaaaggggggggagggaaataaaaatagaaataaaaaaaaaaaaaaagaaggcgacgacatacgttcttga

SEQ ID NO: 15646 - DNA, 1557 bp, A.fumigatus
tcagattttcagagaatggacgacaaatccaggggaaccaccaatgcaaaacatcttgctaccgatacagatcatccaccagatgacgggtccgcaggactccccgagcctggatccgtcaaaagcaaaactggactgttcaccgcacggagtacgcaaaaggcattggatggggagcgtgatgaatttgcgactttcaggacgcggcctccccagcaggctgctatcgctatgcagaaaccgccggtaccagtgaacaaacctgtaacattgggaagaccgaattcaacgccggaactgaggcaaacggagtctcagggaagcgacgatagagcagagcctggttacccaatgtcgaagcctgttcgcaacatgacggcaggcgccgacacagttgaaaaccttcttcaagacaacagggaactaccggtcagaaacccaccaattccccatcgaaaccccgcaatgcactcagatacttcacccagacccccagatatcgcttcagtgtctggtacaaaaccccggcctactccacctccgcctcggaaaggaggtgcaaaaccagttccgaaaagccctagtcgcaatgagccgaagatccatggagaaaaacagagctacataccgctttcaaattccgacgtggatcttaccggtgctgatgaggccagacctacgctccccccgcggccagacccttcccgtgtgacacacattcctccaagtgatcatcgaattctgctcgaagcgcacgaacatagcaagcgtcatttgactcctagctctccattgttggacaggtcgttacaaaacaacggtagtagccctgacctcattgactactcccctggtctagacgaggaagcaatgtcggatgcgatagttgcatcatcactggcctcaagaaaagcgttctccgcaaaaaaagtccctccaccccctcctccacaacgacaactcaggacccatccgctcctgcgcccaaacacacccagcagcgactctccgcgcagctccagtcccgcaccaagcctgcggcacactctccggccggcaactaaggttggtgaagaagaactcgaccatcacaagcacagaaaacacattatacgcagacacccacacaaacatcacgagggcgatcgaaaacgatggcaaagcgaggtaactgagaaggagaggaagaggtacgagggcgtttgggctgcaaataagggactgctgatacctatcagtaattcgaaggaacgatcttcacttgaggaggtatcctgcgaaggctatcctccaagtgcatctgagatggtcctgaacatagctgttcgcgagatatgggcccgaagccgcttgccgtcaagcattctggagaagatctggaatcttgttgataggcagaaaattggactattgacaagagaagagtttgtcgtcggcatgtggttgatagaccagcagctcaagggccacaagcttccagtggaggtgccgggcagtgtctgggacagcgtgagaggcgtgcccggaatcagaatacccaaggtcccttcccgttaa

SEQ ID NO: 15647 - DNA, 1080 bp, A.fumigatus
gtgtcttgcccggcatctgtccttactggggaaatattgactgacgatgatgttgataaggatgcattcgatgacgcctctgaagtacagactaccagcaaccccagcctcaccgtctcgattcctcagagctcatctacgcgctctctcacagacagtcctccgagcggaacaaatgcaacatctcagttcaccgaagctccgcctctcccatctgttactcagaacgaagataagagggatgaggacactgaagatgccaggtcggaaaggcagtccgggacggatgaaacgcctcgcaggaccagatctccaaaatcgcccttgttgacgacccaccgactatcgacgacttctcttgacgaggtgaatcttgctagtaacaacttagacgaggttaccctgcagaatcatgatttgagccaggagcccatgtccgacgttccccctgtaccttcccgaaattcagcatcctttgctcaaagcatacccctccagggactatctggcaaccttccttccaactcatggggatcacctcccgtgaacaggaccccggcccaagcggtttctgctccagcgccgcccttgacccgaaaactcactggcccatttgcctggctttcccgaagctcaacggcaagtcgcgaagtcaagtcgcctccaccgcaaactagtcggcggaacacggctgcgtccgtctctaccctctcaagcaattccgagttgaccaagcatgatggagaagatttggatggttcagcggccaggagaccaaggcgcagcagcctaaaggaccaattcaagttactaaggatgcgggatgaaggactggtttcggagaacgacggagcaagtgtcgcgtcaggacgggcaagcatcagtcattctgctggaagtcctcccagtatacctgaagaagaagaacatgtctctgctccacctcttgcatcgccacaaactgttccgcctacagccaatcccaatttgccccccgggaacagtctcgggaatatctgcttctgccaccgatgcgtctgcgcctgtcgattgggagctgtggcagaaacttgtaaatga

SEQ ID NO: 15648 - DNA, 1227 bp, A.fumigatus
catggaattccccgctacagctcgttgggagagcgatccgaagaggctctccaacaggaactacgcaaaattcagaactatcaagcgcttgaccggcttgttcgcgacaaggtgggatttgattctcctgctcgtattttccgtctatcttcatccgcacctcatcatagacggcaaaagactgatgaagcttgccagatcgcgggacatgattatacacctgaaactctgcaaaagatctctgaacttctgagcagcaacccagaatactatacagtatggaactaccgacggagggttctgcaacacgagttcaatttggcatcatcaaacgactcagaggaagccgtaacaggtcagatagcagcgctgatcaaaaaggatctgcaatttctgatacctctcctccgaaaatttcccaagtgctactggatatggaattatcgcatgtggcttcttgatgaagccaagcgtcttcttccccgagctgttgctcgcaaattctggcaagaagagcttgcccttgttggtaagatgcttagcctggatagcagaaacttccatggctggggctacagacgatttgtcgtagagtcattggaaaaacttgcaccagaagaccaggaagtgcgaagtatggcacaggatgaatttgagtacgcgaagaaaatgataggcacaaatctgtccaatttctctgcctggcactatcgtacgaagctcatccagcgactgctgagcgagcagtccgccagtgatgaaacacgcaagaagatgctcgacgatggtcagttctcccattgcgctaaaagggtgtctgctgctgggacgatactgacaggcatagcagaactggatctcatccaccgtgctctgtgcgacccttacgatcagtcactgtggttctatcaccagaacctgatgtgtacatttgatccttcactatcagatcagtcgatggcgccaaatctgagtaatgatgaacggttaaaatatttgcgtaaggagatcggtgagattcaagaaatgcttgacggggcagaggattgcaaatacatataccaggcgttgatcgactgtactcttttggcaaggaaagtgaaagggaccatgcccagtaccgaccaggagaacattttaagttggctttctgaactaaagaagttggatccgctacgatgtggacgatggctagattttgagaagtcgctccatgctgatgtatga

SEQ ID NO: 15649 - DNA, 555 bp, A.fumigatus
ggatgcgggatgaaggactggtttcggagaacgacggagcaagtgtcgcgtcaggacgggcaagcatcagtcattctgctggaagtcctcccagtatacctgaagaagaagaacatgtctctgctccacctcttgcatcgccacaaactgttccgcctacagccaatcccaatttgccccccgggaacagtctcgggaatatctgcttctgccaccgatgcgtctgcgcctgtcgattgggagctgtggcagaaacttgtaaatgatggtccgcaggcgctcaaaggaccgaactcagaagagattaatccggccatcaagcgaggaatcccccagaccattcgaggagtcatctggcagattctggctgacagcaggaatccggagctggaagaggtctacaaagatctcgttgcccgcggcacggataaagaaaagcaagtcacaaacggtacaggggaacaggagtccctggattcatctcgcgcatctgtgcgatcggagaactcaaccgcgcactcgaatcatggatcttctcagagcccctcccagtag

SEQ ID NO: 15650 - DNA, 282 bp, A.fumigatus
atcgaccctgagaagctggctaaagagcaggcggctaacgagatagctcgcaaaaaaaaagctaaggaagatgccatggcacttcaaaaactggagaaggctattcgtcgcgaccttggtgcgcgcaccagctattctcggtactttgtgtcacaaggaaatcaagatggtctgttcggtctgtgtaaagcctacgctctctacgatgaggccgtgggatatgcgcaggggatgaattttattgtcatgccactcctattcaacgtaaggactcaaccctaa

SEQ ID NO: 15651 - DNA, 588 bp, A.fumigatus
atggatgaggccgaggcctttacgttactagtgaagctgatgaacaagtatggcctacgggagatgtttatcaatgacatgcctggtctccatcgcaatttgtacgtcttcgaacgtctgctggaagactgggagccagccctgtactgtcaccttcgccggcgaggtgttcatccccaactttatgccactcaatggtttctgacccttttcgcctaccgtttcccgctacaacttgttctccggatctacgatttgatattcgaagaaggtcttgagagcaccattctcaagtttgcaatcgctatcatgcgccgcaatgctgagaccctactgacaatgaaggacatgacaccactgactactttcctgaaagaacgcctgttcgacgtctacattgataagcagccttcaccatcttcaattcttgagtcggggttcttcggcagctctggcgcagcggacaaggaggtctatagggcggatatcatggtgcaggatgcttgtggaatttccctggcccccggaacgattagcacctacactgcggagtgggaagaaaaagtgcggacggagcgagagcgtgaa

SEQ ID NO: 15652 - DNA, 408 bp, A.fumigatus
tgcgtgaggacgactgtcagcgacatgatggttaacttgatacgcaacttggagatcactctccagaacatgaaagatgcatatacctcgcgtgaagaagtgcccttctgggccactaagctgttgacgccagctttcatggctgtcgctattctcaccaccattccacctccgggtcccacacgggttatcgtcgggatgacagccttcacgtctctgtggctctacgtgctcacccactggatggccggtccggcgttctttatggatgcgatctttatgatctccatcacagtacgctggatgctaatgtgcctaaccggagcccccgaaatcgattactaccagaacagcaaaaccgcaacgaagctcgacaccatgcggctcgatacttctgaacaaggttaa

SEQ ID NO: 15653 - DNA, 1131 bp, A.fumigatus
  unsure (1119): Identity of nucleotide sequences at the above locations are unknown.
tccctattaatgataaagacttacagaagacagaatcactcacagggcaccatcaagtgccagttaacgtctcttctatttgacggaagccgccaactggtgcctgacatgcttagtaattgtgtcccatctgctgctccacactcagacaatcatcgcaccatcgataacctcgtaaacaaccacaatcaacaacgctcaatcatgtcttcgactcattcatctccgtctccattgtgtacacaagctggggctactgcaaactgggagcgtctgcgcaagtcgtgtgattcatgtcaggaagccaaggtcaagtgcagtcagcacaagccctcgtgccatcgctgccttcgtcatcgccaaccatgcatctacagcccgcagcgacgcactggacggccacgaaagaggcctacccttgacgggactttacattccgcagtgaatttagggagcgatgaatatagggcaataatcacggaggcgactagctcaaccgtcaacggccaggacctcgtcatggccgatgtccgcggtgatgatacacccttgctggccggtggcattactgcggacaacatcaattccatcagcagcgtttttgaaccatcgttcgaagcgttgttagcaggttcgccactcagcaaggatccgaccaccagagatagccactcagactcctgtcatacgggctatccaactgcctctccgtccgatgcatggggggatttatcccttttcttgcccgattacaatacctccagtctatcacatccggagcatgtagtcgccggcatcgaccagctaccccctctcagtgtggacgcttcgaacacaagcagtgagaatggggattgcggagccaaatgttacacagcgcttcttcaacagctcttgttcttgcgccagtcgcttcctgagagctctcgtccctcaattgacgtaatactggaggtggagagccacgagcgccgtcttctcgatcgagtcctgagctgcgccacgtgtctcagtaatcgttcgtctgttctcctcatgtcggtgattaccgagcgcgtgatccagatgctcgactggatcatggcggagcagactctgttttcacacacgacgagccgnaggagcagggag

SEQ ID NO: 15654 - DNA, 291 bp, A.fumigatus
gtttgcgttcccctttgcattgtgggctgtgcacttacggttctgtctctaggaattgcatgggtactcccgcacgaggctcggtctactatcatcgatgctatctccgggactgggtcgacgtttgtacgagacttggacccgactatcaagagcagcgttctcgccgcgattgtgacggccattgatcggacttatattctatgcattgtggctggtgcagtcaccctgctggcgacgtttggtatgaaatgggagcggttgtttattgctgctacggcggctgcatga

SEQ ID NO: 15655 - DNA, 1656 bp, A.fumigatus
agttcaacattccatgacatttgtcagcgtagtcaacgtcgagacacggtatatatcgtcataatctccagttataaggagactccattctgcaacgagctattccaattagtcgatcaccacgagactagggcatcagcatattctccagattgtactttctcaataatgactgaccttacaaacacggagatgcggccgtcagactcagacatcccaaaagacccagtgaaacaagagagtagctattcggaaagcgatcagagcaaagatactcctcgcagcccacgcaatgtccatggcttcctatgggtgacagtcgttctagccatctatagctcgacattcctcttcgccctcgacaacactatcgtcgccaacatccagcccgccatcatcaaatcgctgaatggagtcgacaagctggcctggtcgggcgtagcattcgtgatggcctccagcgccaccgtcctcacctggctgcagatcttcaaccagttcaatatcaagtggatgtacattttctccattgccgtgttcatggcgggctccgccatctgcggcgcagcgcagtcaatgaacatgctcatcgggggccgtgtggtctgcggcgtgggcggcgtgggtcagtacgtcggcgtcatgaatttcctgcctcgcttgacatcaatgcaagaacgcccgatgtacgtcagtgcaatgggtctgacctggggcgcgggcaccgtgctcggtcccatcatcggcggcgcgttcaccgatagctcggcgggctggaggtggtcattctacatcaacctctgtgtcggcggtctgttcacccctgtgtacatcttcttgctcccttcgctgcatccgcagcccgtgaaaacgtctgttattgagcggctgaggcggatggatcttctgggctcgctcatcctcatgggtgcgtttgcggcgggagtcatcggtgtcaacttcgcgggcgccatgtacccatgggacgcaccaggcatcatcgtcgcccttgttctcggcggcgtgctgtttatcatctttggaatccagcaaaccgtttgcatcttcaccaccgacgaaactcgcctcttccccgtcgaactggtctcgtggcgcaagccgctccttaccctcctcttcatctgcggctgctgcacaggagtctgcgtgaccgtccccacgtacatcatccccctgtacttccagttcaccgcgtcggacgagtcccttcagtcaggtgtccggctactcccgttcgtctgcctcctcgtcttcagttgcgtgggaggcggattcctcacctcccgtctgggatactacatcccgtggtacatcatgggaggggcgttgtgtctgatcgggtccgcgctgatgtacacaatccatcctcacagcagcgcaggaaccatctacggctacagtgcgctgattggtctaggagcggggatgtacctccaaataggccacgccgtggcgcaagccaaagtcaagcctgagaagatcccagccgccgtcgcttttaccaccaccgcgcagctgaatggactgacgtttgcgttggtcatttcacagtgtgtctttgtcaatgaggctgcgaagcgtaagtttgcgttcccctttgcattgtgggctgtgcacttacggttctgtctctag

SEQ ID NO: 15656 - DNA, 1683 bp, A.fumigatus
gaacgcttcttccgggtagaaggcgacatcctgttcatggagttcttgtacccgaaagccgaagatggtgataaaatcatcctgctgctcttggtctcacagaatcaagtgacgcaagctatctgctatgaatggcacgcagacgagacgatacgacaagcgtctccgagaattacaaagaggtttcttcctcctgaagacacgttacccacgatgttgattccgttgaccaagacatcctcctttatgctaatcacaacgacttcaatggctgtctacaagaataggcttgacccacgaagacagcccagtcgatatcctcttcctgtgcctgatcgcgaagctaaaaaagcacccctgtggacacgttgggcaagaccattgcgcaattggtcatataaccaacgacacgacgacatttacctttgccgtgaggacggtagggtgttttatctggggatcggcaacgaaggtgaactggaaaatcaagcacatctgggacaactctgctgcgacgtcgacgctgcatttgatattctcgatattggtcatgaaggtggagatctacttttggccgctgggaccacaggagacggcgggctttttgttcagaaggctcgtgatcaacctcgatgtgtccaaaaattcatcaactggtccccagtgacggattccgttattgtaagctctggccaggattcatcatcctcagacacagctagagaccgattattcgtgtgctccgcgtcctcctatgggcgaggtgcaatattcgaacttcggcatggcttggaggcacagattggcttggttgtctcccttgaagatttgtcaagcacgagggatatttggacaatgtcggatgacataaacggaggtgtttacttattgatctccgatcctgtctcttctattcttctgtatctgtctgcagacttcggggaagagatgtgtgctatagacgaagcagattctgggttagactttagtacccagaccctggcagccgggtgcacaagctccggcgtcctcgtccaaatcactgagaaggcgattcttctcggcacaaccactaagtccactatgagggctcgcttcgagtttggctctgaccaaagtgttgctgttgctgcagtccacagctcggcatcattaattgcgtctgctgtgcgaacacgacacgagatgcacctctctctcaagagtatcaacattggccaagaccagcttcacttatctgagattggtcagcctttacgattaccccatgaacctgtctccattctcattgaggtcttgggcacctttactctcatatttgttggcactggcaatgggaaagttttgatctacagctttgaagactcaaccatgctcctgtctgaagtttccattgacgtggaaaacggggacgacctatcgaaagcaatcgaaagtcttgctgtagtcgccattgacaccgatggaccttcccagaagtacacaatactctgtgggttaagaagcggcatttttgccccctttgaaatgacgttaggccatggtaacacaaaatgtgcaattggtacgttgaacctgacattgaatctcagagcttcactaataggcgtattctccctttgtagaggtcaaaccagcgagcccacgacgaattgggaatacttctgtcaagatacaaagtag

SEQ ID NO: 15657 - DNA, 1446 bp, A.fumigatus
cctgcgtatcatccaggcaacgtccacagtttcgccatggcaaagaccattgatccaaacatcgatggcgaagccgacaccttgttctgcatcgccgacggtcagctcttgatatgcacacttgatcacgcagcgaagacggttcctcgaaggattgatctaccaggaagcgcaagcaagttagcttattctaactatctgagaagcctgattgtcgcgtacactcgggcggaactcgacaccgagtctgatcctatcagaagactgactcggcctttcattgagttcgtggagccggatacgcaacacggggtctccaaggccgttgacgtctctgaagacggttactcggcgtggagacctcacggagcggctggagagaagattagctgtatcctggaatggacacctaagaaaggcgatgaagaataccactttattgtcatcggaacagctagaaaacagcagcaagaacggggacgagtcatttttctccaagcgtcccgcagctcgtccgactcctcgaggattgaatgctccgtgaaatatatccataaatttgagagtcctgtttatgcgattgctccatacggtgatttcacattgatggtctcgacgggtcatgagatcgtaccattggagcccaagctgtcacagacacgtcgtgttcgagcagcgaggtacccaatgctttccccagcgatttccttaagctgccatgaaccttatgtatacatgtcgacatcgagggagtcgctgatggtgctcaaatcctccgaagacaaattgctgctccatgcttacgatcgtcagaagcatgatggactctctcatattcacattggtggtgagtttaatttgacggtcaccactagccgaggcggtcgagtcagcatactttcagagaatggtatcacagacaacgacaagatgatgccggttgctctgtgtgaagcacatcttccctcatctgtgatgaagcttagttcaggatctaaaccatccccattctctcgctcatcccaggtgtactatggcaccgctatgaacgggatagcctaccgctttctaatcctagatgagaaagagtggcgcttactacgtctacttcagaatctctgtattagagatccaatactatgccctttcacgcccaaaaggaaacgaaggcgcaaccctgcgacgaatggcattgcagagccccagccctcacacatgcacatcgatggcgatatactgagtcgcctcgtgatgcgtggtccgaaatatctaacaaaaatgttgacgacccagggctttgaagacgcagcctttccagaaaacggcactgctcaagccactctggagctattcactgagctgtccaacaatctgctgggagaatcccctgaccaagtcgaaaaggtcatgagatggttggagaaggccgttcacgtggagttctga

SEQ ID NO: 15658 - DNA, 531 bp, A.fumigatus
aaaatggcgccaaagaagaagggaaacagaaagcaggatgacgactgggaggccgagctgggagaaagtatcgcccccgtcagtgagcagcctaaggacgcgactcctgcggacgccgctcccgaagaggatgacatgggtggcggtctcctcgctgccctgaggaagaacaagaacaagaaggcaaagaagggcaagccggtcaacgatttcgtcgagggcgaggatgcgacagagcaggcaaatggagatgttgatttctccagcaaacagcctgaggaaggtacagtcgaccaggaggacgttttcgcgggaaagaagaagcagaagcctgcgaaggctacacctccggccccggcttcagttgaaggcgatggcgagatccgcgtgaagactaagaaggagaaggagagggaaaagaaggagagagagaagcagcgtaagagggagcaggtatgtgttgtgtctggtgcactatttgcccctacaaatcgtgtgagtccagttgctgatctagaatatctgttttag

SEQ ID NO: 15659 - DNA, 201 bp, A.fumigatus
gccttaaagaagaaggcgactgctcccgagcccaaggccgagcctgccaaggctgagaagaaagaacaggcagcacccgccgccgctgctgctcccacacctcctgcttgcgctcctgaggcgcctggcaagaaaaagaagctccccgcccatcttgccgctattccgaaggcacctgaagctctcccggacaccacttga

SEQ ID NO: 15660 - DNA, 2247 bp, A.fumigatus
  unsure (2115),(2133): Identity of nucleotide sequences at the above locations are unknown.
tttcgttggctttatgatcagcctggaagcgagcaaggtctctgcaaagtacattttagcaccgcaatcatgtcgacgctatctccccagctggtccgcagcgaatccccgaccgacatggggtttccaaacgcaaacttctcagatccctatctttctgctccgctggaccccgagcaagatgttttcaaatcctcaggtatcagatggaccccagaacctggtcagcacgacctgcgtgaggcctcgacctctccttacaatcacaatgtgaacagcgatactgcccaaggcgctgaaacggctgggtacccgacctcttattctgatttcttgagtcccattgatgacttttcgagtgacctgagtgcccaagcttccccaaacggcgatcaaccgccgggaagcataaatatggaattgcactcatatctcgatgcatggccacatgaagggagttcatccaacatggctgtggctgatgagccacgatccgtggactcagaatcggcagccctctctcagccagccctggtcacctcacagcttctaactccggagcggactaatcatccgagtcctgcgcccgacttgaccaatcgacgaaacaatgaatcccaatcgcattcggagcagatactcactatagtcacggctcccttagacaacaacctcaatgtccatcctccgtcagatgctgccagagcaagaagtccaattgttacggtcgaaagctactcgcgcggagattctccggtcaggaacacgatttctgtccgacggcagccgagccagtctaccacccacctttcgcctggcagagaatcagaggatggggaccacaatacctcatggcagacatctgaacaagcgatcgcacgtgcgcccgatggttcctggcttcccgatggcaccactggccaagccggtgtcgcccctacatcacgtgatgacacgtatatcctcagtcccaatgaagtagagtcacggcgacggcttgaggagaagaacgcggatattcggtcatggtccgccacagtaagcgtcgccggcagtgaagatggagacgacggccttcatacccgcggccgcaaagtgccagcgggcacacgacgcagggcgaggagtgccggggaccctgcgcttcagcaggactacttcaatctgcaatttggagcctacgggccggtcctccctggacccggtgcgttaatacacgagagtagcgacgaggagctcagtgtcaatgactccgaggtcgaagcaagcgatccgggatcgcccgcagtcagcgtcaatgaagcgaggtgggctcgagatggctttgcagattcgcccgtgcaggatcaacccaactccgcggacgaagagccggcaccgcatcaatttctggcaacccacccatggaaggacgcggatcacgactctactcccagatcagttcggatgcagccgtcaaccgccagcgccgctatgatggaataccaacgacgcgctcgagaaattgatgctgtatcccgttatgcaacttggggtacgcgacctatgagtgaaatcgaagtgaatagtattatcggtgcgggaggttcatttgccaatctgtctatcagccaggactcgagcaagaaacacacaaggcggagtagcctgatgaagttcttcccacggaaaccatcgatcagtgttttaaagaggccgctgtcagacctgtccctagttgaaaatcaaactaccaacaatgagatcaaaagtccgccctcgagaaatgacagtttccctcaccggaagctcagccttgcgcgaagcccaaagtctcccagccttagtacaggtggcgcagtcattgcaattgccggccaaatggcagctattggaggtagagactccctgagtaccgtctcaccacactcgacgtctaatccctggaacaagtttgggcggacgcgcagtcggagtgagataccgcggtcctccgcaccgggtctattggacttgatgaccagtcacggaggcccgcccgttcctaccattggccactcacaaacactgacgactgacaatcatggtctccagcaggtggcgtcaagtcggactgttgaaactggagatgatgangaagaagacgatgatacngccgatcaggggcaagtgatggattttccggttcccaaccatctgcctgtggctactacggaaaggttcaaagctcaaattccccagctgaatcctcgtctggaactgcactga

SEQ ID NO: 15661 - DNA, 279 bp, A.fumigatus
ggtctgggggtctggacgcgcttcatccatctcggcgttaaggcctcttacgccattggtgtcgctgagcccctctccatcttcgtcgagacctacggtacttctgagaagtcctcggatgagctcgtcgagatcatccgcaagaacttcgatctccgccccggtgtcattgtcaaggagctcgaccttgccaagcccatctacttccagacggccaagaacggtcacttcaccaaccagagcttcccatgggagaagcccaagactctcaagttctaa

SEQ ID NO: 15662 - DNA, 1386 bp, A.fumigatus
ttttcccagacttctgtggcatatttcgccaaaggacctctggcacgatgccgcgccgccttccaaacatccgggtcgtattctactaatacacctaaacatcttgcagagttctatcgagaggctattctggccgcaaagaagatggatttgaaatatcgtgaaactctgccttcgaccatccgagatgttcttttgagtacgtcagatgatgacgcgcggaagaaacgcaagagcaggaaacgaaagttgggcaagaacgggctctatccagaagaggaggggttcattcgcaagtggtggagagatcgagctctggcggacaatggggttcctgcagagtcgtcgcgcgacgcagagctcaagaagcacatcgcggacttgcgactacgagagacacagttgcaaattctactcattttggagacgttggcccttgagatgaatgggcctggtgagacatcaaagacggacgaatcttccgaacagccgtcggacgataccagaacgaaatcgaagaaaaagccacaggatttggatgtgctgcttgaactgcaccttgaccggttgtgcatttggcacgccgtcagtaccgatgacacagccttggcggagtccgcgaaatcctttgacagtcaaacaggtaagaagatcgagagcgatgccgtccgggacttttgcaccgaggtcattgttccattctacgcttcgcgtctgccggacagatgcaagttaatcacccgcaagctcggtgtctctggcgcgatatcgccgttggccaaacagtccagcggcaccaaaaaggcgtctcgcaccgagcctgggaagcccactgagcggcagtcttctcagagacatccgcgtcgatccttgcagcgggtgctcaccgaccagcaaactgcctctcaagcacgaccccggtctctgggacgctccaacactgtgccgtcgcaagctggggccaagcgcgagtcgatggagccgctgctgccagtgctcagcgtcagcgcgagaggaggcatccagaagccgaaacgggtggagaaccgcgaagtggatttgaacgcggtggctcgtcagcacgaagctaagctaaggaaggtgcaaatgctgatggagcagaagaaggagcttgacgcggcgatcaatgccctccgcaagcccaatcgcgaactggttgcgaaggatatcgtagaggatgcggtcaagcgggcatcgggcggcagctcaagaaaaccaaagaaccccgtccgcaacccgttcggggcaagcgtgcaagtcatggcgacccgaaaggaaaccgcaagaaggacccgtcttgggcttggctcccccattcaaaaatattgtgccgtcctccccaatttagaacggttctccccattt

SEQ ID NO: 15663 - DNA, 630 bp, A.fumigatus
tctgtttttgtagattttcgaggtatttttgggacagcgaatggctatgcattggccttgacagcatcgcatgctattatctggccatattctccctctgcatcagcatcgtcgcccgtggatgtctttacacttacaattcccgaatcttgccgagaatctcatggtgcacccccccttgggactttcctttcgtccgcaaatggcgaaataccaggcttaatggtagtcatgccgtacacaggaagaattatctactgggagaccatatcacatgctggatcccttgggctaccaagacaaaaacaaagtgggcttcaaggtcatgtacctggcttgctcccaagtgaatatgttactgatgtgataaattgcgagccctccggtgtaattgtcacgttttcatcgggaagggtcgctcacattacctttagggattctcaagggaggcccaccgtgatggccaattttcttcggaattcaagcagcagtagtgggctactgaatggcataaaaagcgtcttcagtggtggttgctggaagaaggatgtctctgcagtaaaaggctgcccgttcgcatcaacgagggcagcgggacatcattgttggcacaacgacaggagtgtttga

SEQ ID NO: 15664 - DNA, 183 bp, A.fumigatus
  unsure (7),(12),(38),(120): Identity of nucleotide sequences at the above locations are unknown.
gcaggtnatctnatctctctagctgcagattatttgtntcaaattacaactttctcgaaagaatatggcactgtgactgcctgtggaaagtgtggaattaaggccatcaaagcaccgggntacattttggatggaaattttgcgtgtaaactccggcgacttatcagtaaatttcgtacgtaa

SEQ ID NO: 15665 - DNA, 255 bp, A.fumigatus
gacgtcaatttcagtgttttgcagcgccatcaaaacattctccagctctcggggatcactaagagcccaaacgccacctcctttggtgttgattttgccaacttccttgccgaccagatttctgccgaccttgcctggccctatgccaatccatcttttgactcctcgatcttggtcaagatagcgaatactgtcccaccatttaacggtttcaacacactgtctagacaaaaggtttttcaaatcgtcccttga

SEQ ID NO: 15666 - DNA, 1257 bp, A.fumigatus
tcactaaatcatgttgctattcctcagtctgagatacaccactgccatccgctatgtctgtggtcgctcaatctcaaggctgagcccccatcgccaaagtatctgtccgcactccaccacaacaagattgcacacagctctattctttcccggtttgtcataccgtctactccagagatccgtattcctgatactgatataggtccaggtcatggcgtgcagcgtgtgggaatggctaactcctgggttgacaattttcctggcacggccagaccattcttagatgagatggacgacactttaggattcaacctgtctcgaactatagcaaatggcccaaattgcgagctaaacaagactgagaattcccaacctgctatcatggcgacgtccatattaatccttcgcatattggagaaggaatttggtttcgacacgaaatctcgtgtgaatgtaacacttggacatagcttgggcgagttctctgctctagtcgctggtggctatcttaagttcagagatgcgctaagattggttcgccgtcgggcggagattatggccgaatgcacccgtcaagcctctaaacaatccggagaagactatggcatggtagctctaatctgtgagccggctcatctcgaatctttactttcggccatacatgaattcactggtcatccttccccagacttaaaggacgattcgagtcacggattacccacaatccaacaagttatgattgccaacatcaactccaaaaaccaaatagtattaagtgggagcattcataggatcacgactcttctcatccagcttcgccaatttggtggccacgacccacgtgctgtgaggttgaagagcgaaagcccgttccacaatcccatcatggcgccagctgcagggtacatgagacatgaactagaacacatcgacattgaattcccctcccagctgccgtgtatatcaaacgtctcaggtttaccttttgaatcaagggacgatttgaaaaaccttttgtctagacagtgtgttgaaaccgttaaatggtgggacagtattcgctatcttgaccaagatcgaggagtcaaaagatggattggcatagggccaggcaaggtcggcagaaatctggtcggcaaggaagttggcaaaatcaacaccaaaggaggtggcgtttgggctcttagtgatccccgagagctggagaatgttttgatggcgctgcaaaacactgaaattgacgtcttaacccaatga

SEQ ID NO: 15667 - DNA, 2229 bp, A.fumigatus
gagcttcttcttcttctcgacgacactcttattgccaaaggcatccgtaacttcggtgggaccttccttgtcttccagacgaggaccagatccttgaccttgaacccagttgtggccggaaggagtcatcttgccatccatgacagcccagacttcctcggtcaggttctcggtgaactcacgggagtgggtaatgataacgacaccaccctcgaaagtcttgagagccttggacagggcacccagagagtcacggtcgagatagttggtgggctcgtcgaggacgatgacgtgaggacgctgccacgagcaggcggcgaggacgaccttgacacgctgaccaccggacagaccgcgcatacgagagtgagaaacgagttcggcatcgagaccgaagttggcacagtgggcctcaatctccttgcggaccatgggacggaactgaccgctggcgaaggcttccttctggtcaacctcggctaccatcttggcgtgggactggataatctcgctacgacgaatccaggcgttgtcattgctcatcaaaggggtccacttctcactcttcatgccgacgttctcaccaagagcaaacgagcactcctactcgtagctgttcttgaacttacgacgagcgtggataccgataacacgacgcaaggtgccgtcgatcttgtagatcttgtccatggccttctcatcatcctcggtgacgatcttgttggcgcggtccatggtctcacggtcctcaccggtctggaaacgccactgaatgtactcagagggagtcttgtcgaggtggttatcgatgtgagcgaaagcatgttgcttgatgtaggcgatacggatgttctcgtgctggtagacctcaccgctggtggggatgagctcaccagtcaggacattgacgagagtggatttaccggcaccgttgggaccgatgacagcaatacgagatcccagagaaacttggaaggtgatgtctgtgagctggggcttgggagtgccggggtactggaaggacatgttgctgacacggatgatggccttggccttggtcttgacaccctcaaggaaaccaggctcggggaacttgaactccatgtcggaggcgctgagctcgtagtaggaacgagcactggggaccttcttgacgaactcgctcagattgccgcgataacgcttgagcttaaagcgctcgtagtggacaacgtgctggataacattgtccaagaacttgctgtcgtgggagacgatgatggaggtgcaaggggagttgcaaaggtagttctccaaccaggcaacattcttgacgtccaagtggttggtaggctcatcaaggagcagaatgtcggggttctcgaacacggcacgggccagagccagcttcatcttccaaccaccagacaaagaggtgatggggttttcgaactgctcacgcaagaaaccgaactcctcgagcttcgcctcgacatcggactgagggatgtcgataccgacatcacggagcttcttcatggtccagccaatgacggtctgctcagtgtcggcggcatccaagtcgtgctcaacgtagacagtcttgacctcgtccttcttcgggaaaccttcaagctgctcgttgttgatggcacgcatcagagtagtcttaccggtaccgttaggtccgagaagaccgtaacgctgaccacgcttcaggcggagggaggtctggttcagcaggatcttggcaccatacgcaagagagaaggtgcagttgcagagatcttcaccctcctcctcgtcagaaagaacggcatcctcctcggcagcgccaggagaggcacgcttgcgcagagtctcggcaatggctttggcttcctcctcaccaatgatggcggtgatgtagggaagagcgttctgggtccagctggtgacctcggcgtccttctcgtcaacgagctgaccagcgatggcaccgacatagttgatgatggcctcagacttctcaatctgagctttgtacttgggggagaggatatccttcaggatagcagcaacggtctcaacgtttccgggcagttgatatttcggggatcttggccctccttaacatcccccacaccaaatgagggtgttcaaaggcctgcttgggtcttctccacgggccccctggggtcgggccaaggtcctcttagttccttctcccagaaggggggcatcaccttggggccactaaggggagcgacc

SEQ ID NO: 15668 - DNA, 1485 bp, A.fumigatus
ggagggccaagatccccgaaatatcaactgcccggaaacgttgagaccgttgctgctatcctgaaggatatcctctcccccaagtacaaagctcagattgagaagtctgaggccatcatcaactatgtcggtgccatcgctggtcagctcgttgacgagaaggacgccgaggtcaccagctggacccagaacgctcttccctacatcaccgccatcattggtgaggaggaagccaaagccattgccgagactctgcgcaagcgtgcctctcctggcgctgccgaggaggatgccgttctttctgacgaggaggagggtgaagatctctgcaactgcaccttctctcttgcgtatggtgccaagatcctgctgaaccagacctccctccgcctgaagcgtggtcagcgttacggtcttctcggacctaacggtaccggtaagactactctgatgcgtgccatcaacaacgagcagcttgaaggtttcccgaagaaggacgaggtcaagactgtctacgttgagcacgacttggatgccgccgacactgagcagaccgtcattggctggaccatgaagaagctccgtgatgtcggtatcgacatccctcagtccgatgtcgaggcgaagctcgaggagttcggtttcttgcgtgagcagttcgaaaaccccatcacctctttgtctggtggttggaagatgaagctggctctggcccgtgccgtgttcgagaaccccgacattctgctccttgatgagcctaccaaccacttggacgtcaagaatgttgcctggttggagaactacctttgcaactccccttgcacctccatcatcgtctcccacgacagcaagttcttggacaatgttatccagcacgttgtccactacgagcgctttaagctcaagcgttatcgcggcaatctgagcgagttcgtcaagaaggtccccagtgctcgttcctactacgagctcagcgcctccgacatggagttcaagttccccgagcctggtttccttgagggtgtcaagaccaaggccaaggccatcatccgtgtcagcaacatgtccttccagtaccccggcactcccaagccccagctcacagacatcaccttccaagtttctctgggatctcgtattgctgtcatcggtcccaacggtgccggtaaatccactctcgtcaatgtcctgactggtgagctcatccccaccagcggtgaggtctaccagcacgagaacatccgtatcgcctacatcaagcaacatgctttcgctcacatcgataaccacctcgacaagactccctctgagtacattcagtggcgtttccagaccggtgaggaccgtgagaccatggaccgcgccaacaagatcgtcaccgaggatgatgagaaggccatggacaagatctacaagatcgacggcaccttgcgtcgtgttatcggtatccacgctcgtcgtaagttcaagaacagctacgagtag

SEQ ID NO: 15669 - DNA, 654 bp, A.fumigatus
gagtgctcgtttgctcttggtgagaacgtcggcatgaagagtgagaagtggacccctttgatgagcaatgacaacgcctggattcgtcgtagcgagattatccagtcccacgccaagatggtagccgaggttgaccagaaggaagccttcgccagcggtcagttccgtcccatggtccgcaaggagattgaggcccactgtgccaacttcggtctcgatgccgaactcgtttctcactctcgtatgcgcggtctgtccggtggtcagcgtgtcaaggtcgtcctcgccgcctgctcgtggcagcgtcctcacgtcatcgtcctcgacgagcccaccaactatctcgaccgtgactctctgggtgccctgtccaaggctctcaagactttcgagggtggtgtcgttatcattacccactcccgtgagttcaccgagaacctgaccgaggaagtctgggctgtcatggatggcaagatgactccttccggccacaactgggttcaaggtcaaggatctggtcctcgtctggaagacaaggaaggtcccaccgaagttacggatgcctttggcaataagagtgtcgtcgagaagaagaagaagctctcaagtgctgaaatgagaaagaagcgtaaagaacgtttggccagaaagtaa

SEQ ID NO: 15670 - DNA, 342 bp, A.fumigatus
gagttaactgcatctttagaaacagttgtcctcattcagaatctggagaagacaccaatgaccttcgttccagtcccgccagcggctcacttgtcctatcctccagaggtaggtgagttgaccagtcttgtcatgaacattgtgataccatcaaagccaaagaatcccaaccaaagatatcccgtaatggtctacgtacatggcggctccctgctatacagaggggccaaccttccgattttcgacgctgtgaatctcgtctcccagagcatcaaaatgggaacgccaatcatatgtgtgaacttcaactaccgcgtcggccctcggcggattcctagctag

SEQ ID NO: 15671 - DNA, 819 bp, A.fumigatus
acttcaactaccgcgtcggccctcggcggattcctagctagcaaagaaatacagcgagagctaagagaagacggattccagggctgcggcaatttcggcttcacagaccaacaggttgcattcgaatggtgccagcggtatatcgatgccctaggtggtgatccaaacaacgtcactgcggtcggagagtctgctggtggaatctcaatcagtaaccagcttgctgctgcgagcccgcttcgtttccgacgcgccgcttgtatgtctggcctgtctgtctcgattccacagtggacgatggagcagcatgaggcgttgtttgaggctgtttgtcggtatttccgaattgattctacccggtcggatgtgctggaccatctcggacagatcccgcaacaaatgctggcagatgcaactcccatcatccagggggtgctgtctggaacgggaaatccatgtctggacgggtggttctataagagcgacactgacccgcgtgaaatccagacggcaccatcgtggcttgacgcgctaatgctgggcgatacctaccatgaaggaattatcttccattcgaacattctagaggacactttccagtcgatccgtcagactctcgcagagtacgtgggagcagaagacgaaacagatcaaatactcgcagagtacggcattagcccagacgtcccactcggcctactcatcaagagagtcgaacatatgtgcagagatgcggtattcaaaatccccaactacgccactgctctgggcaactcgcatcttgcggacaagcgcgcattgttttgtgtaccattttga

SEQ ID NO: 15672 - DNA, 906 bp, A.fumigatus
gcccgtattctatatcacttttggggaaacatccgatggcgtgtccaggatccctatttccccaaagggacaccgctagtcactcacagtgggaagccgacgcatccggtattcgtgtcgtacggcatctcatccagagctccaatcctggagacggattacaatcagcacaagtccaacagcacgtacttttctgaccttgacgtggcccgcacggccctggtgacccgtctatacagccctggagcttcgattgtgagcaaggagctcgacgtggagcttctagaagccagtcagcgggacggcacaaagccccccaagcgcaagggtatttatgttgccctgggctcggtctactgcagcttcaagcgcgagatcaagccctttgagttgtacgagatggagaccaaggttatcgcctgggatcagaagtggatgtacgttatgacgttctttttccggcctgcaagccggaaaggcggcgagaagacgctcttcgcgactgctctgagcaagtacgtcgtcaagaagggacggctgaccgtgccgccggagagagtcctgcgggccagtggcttcctgcctccgcggccggagggttctgtcgcacctgaggtgactacctcggctgaggcatcgggcatggggacacctgtcaacggagagggcctcacggctagtgcttcgggggtagacgggtctttagtgcgggaagtgctgaagttgcgggaggaagacatgccggaaccgaaatcgctagaggcggaaaagaggagcaactctgcgtcgtgggattcgaatgagtggacatgggagcggatcgagcaggaacggctacgtgggttgaaagtcatagaaggatattcaacgatggatgctaagctgtacgaagagtggcagcgttag

SEQ ID NO: 15673 - DNA, 708 bp, A.fumigatus
  unsure (126),(182): Identity of nucleotide sequences at the above locations are unknown.
tactgcatcgctgcaccatctcctcctcgaggtcaatgctgtctccggcaactccccaggtcccgtcactctcgcggtgcatctctgctcccaaaccgatggtggcgcccccaaaggccctatcanaagacgtacctgctagatattccggtcccccgagtccttctccagcatggggccanaacaacaaattggaaaactctctttactgatttgtgcgccacggaccttggggatggatcggccaacggcccgaagctataccttgttgttgaggttcgtgtgccggagacgccgaccgtaggcgcccctctccaatccagaccctcagtttctcggggtagttcctcggctgcgaaatcgccaacttccgcgggccatccaggcaagggtagcctcagaactcgccgcagtatgatctggagcaccaagccgcggggccttcagagcgccgagccagcaaaggaaagctccgcagggccgccccaatcttcggagagtgcttccagtactaaagaccgaggtgatacgcaatcttcaaagtcgtctacgacgctgcgcactcttggagtcggtctgctggaagtatcgcagatcctgcggcaagagaaagacgccgagcagattgtcaacatctggtctccctcctcgtggcttgaagagggcgagggccatgtggatgggtttgacgacttggtacgcacgctg

SEQ ID NO: 15674 - DNA, 261 bp, A.fumigatus
agagagagggagatggtaaaagggagaaaggttggtcaagaggcgatcacgatggagagaaagattgaagctacgaaaaagggacccgactgcaccaggtccaggcacccaggcaggaaactggctgatcgttcacactggacgggcctgaacacaaacctactcgatactacaggactgctatctactagtttggaggctggattctggattctggattcttcgagtttgaaggctaatttcattcatcggtattactga

SEQ ID NO: 15675 - DNA, 750 bp, A.fumigatus
tcaggcagagagcgaaaaacttaccatagcgtgaacaccacggcggtggcaagtcttgatgagcagcttcacataggcgtccatgaatggcacagtcatggtgacatcagagcggtcgggaaggacaaagttggggtgcttgcggaacttcttgatgaaggagaagatgtaatcccagcggccgcagttgagaccggagctgtgatcacgcagttcatagataatctgcacatgttagcacatggcaccaaagctagctggagagtatcctggactcacctcatccatctcaaacgcagcagtgatggtctcaatcagaacagtcgcacggatggtcccccggggcatgccgatgtagtcctgagcgaggttgaagacgtcattccagagtctggcctagaggtgggactccatcttggggaggtagaagtaaggaccgtggccgcgagcaacaagctccttggcattgtggaagaagtaaagaccaaagtcgaacaagctgccagagataggctcgccgtccacagtaaagtgcttctggtcaaggtgccagcctcgagcacgagcaatcagggtgggaagggcgcggtctgtacggagcttgtactccttgtttccttgcttgaagtcgatctgacggcgaatagcatcgtacaagttgacttggccgttgatcatgttcgcccaggtaggggcactcgagtctacgcctgtcagtttgtctttttaatgcaattaaatgtcaagtga

SEQ ID NO: 15676 - DNA, 411 bp, A.fumigatus
ctcaccctcgaaatccgccatgtaagtccagacgtccgcattcagagcattgacgaccatcttgcggtccgtgggaccagtgatctccacgcgacggtcaaccagaccgggagcgggaggagcacccttccatgcgtcattttcacgaatgtgtttggtctcggggaggaagtcaggcagatgacccttgtcgatctcggcctggcgatcgatacggcgctgcgtgagggctttccgggtagggttgaacgtgcggtggaggatggcgaggaaagcgcaagcttccttggtgaggatcttgcgatgctcgttgttcacggcgcccaggatggcgacatccttgagctgtacttcgatttggctcatgttgatattgtcttttgcaatgatcaatggctggggatgaggtga

SEQ ID NO: 15677 - DNA, 585 bp, A.fumigatus
agagccgttcttctgcagctccaaccccctaccaccacgccggtaagctcatcccctgtccattgtgccgcctacagactcaacttaccgtcccaggaaatctcgtcaaccatgtccgcgtccacgtcttcctgcaaagtgaccctcgagaacgtcgccgagatcctgaaaaatgacaccaaggtcaagctggcaggtgtcgacgtggacggccagctgcgcggcaagctcatctccaagaagaaattcctctccatcgcggctgacgggttcggattctgctccgtgatttttggctgggacatgcacgaccggacatactttaaagagctggcgatcagtaataaggagaatggataccgggatcttgtcgcagtgcctgatctgagcagctttcgccgaatcccctgggagaacgatgtccctttctttcttgtcagctttttcgatccggagacgaaggcccctgtctgtgcttgtccacgggggctgttgaagacggcgctcagtaaggtggaggcagcgggataccgtgctatggccgggggtaggtcgattgctctacttgatttcccaggaccttga

SEQ ID NO: 15678 - DNA, 780 bp, A.fumigatus
cctttcagatacgtggtcaagtctatcggcgcgaaacatggcatcacgccagcgttcatggccaaaccacgcgaaggcctgcccggcaacagcggacacatgcatatctcgctggttacagaagatggaaagaatgctttcctccgcccgacacctgatccatccccgccctacccagacgtcgcacacctctccgatctaggaagacacttcttggcgggtattctaacgggccttccggatatcatgcctctttttgcaccaacgatcaactcatacaagcggctggtggagaacttctgggccccggtcaccgtatcctggggtctggagcaccgggccgcttccatccggctgatcaccccgcccacagccagcgcgaaagcaactcgattcgaggtgcgcgtgcccggtgcagacgcgaacccacactttgtcctagccgctatcgtcgcgttgggttggcgcggtgtcgagaagaagctggaaatcccggtcccgcctctgtctaaggacgaggacatgggtggtgccagcgatcagggggtccgactggccaaaacattgaaggaggcgacagttgcattcatgcgcaaggaaagcgttgcacgaaaggtatttggcgatcaattcgtagatcactttggggggacgcgagaacatgaggtgcacctgtgggaggaagcggtgactgattggtttgtgttccccgcatgcatgacgacagggatgatgctaacgcaggacagggaggtgcggcgatacatcgaaacggtctaa

SEQ ID NO: 15679 - DNA, 198 bp, A.fumigatus
atccttctatttgtctcttatcgtcagtctgaaacagataccccgtttgctcccgagagtgtatcaaatcggaatggggcccggaagctagagctctattctctagctacaggttatcacatgcagccagtcatcttcacatgccacatgccaaccctcaagatcgcaatgtcgacagtcagtagatggaacatttga

SEQ ID NO: 15680 - DNA, 420 bp, A.fumigatus
tgtcaccatgactgtgccattcatggacgcctatgtgaagctgctcatcaagacttgccaccgccgtggtgttcacgctatggtaagtttttcgctctctgcctgatcaaccgacgagaaactgacagtcccagggtggtatggctgctcagatccctatcaaggatgaccctgtcgccaacgacaaggccatggagagcgtgcgcgccgacaagctgcgtgaggtccgtgccggccacgacggtacctgggttgctcaccccgctctcgcctccattgcctccgaggtcttcaacaaatacatgcctacccccaaccagctgttcgtccgccggcaggacgtcaacatcaccgccaacgatctgctcaacaccaacgtccctggcaagatcaccgaagagggtatccgcaagaatttga

SEQ ID NO: 15681 - DNA, 282 bp, A.fumigatus
tttccagcggagtatgagttctatcaatttcgcgcaccaggcgactactccacacccgagcggaatgcctccgcgaccgccgcctttctccaaaagaaccctgttgaagcgttgcctgcgctgacggagggtatgtttgggtatagtcttactcgcccgatacataatcaggagtactactacggcatattcgacgcatgcgagcagttcaactgcgagattgagggatggcacacggaaagcgggccgggtgtatttgaggcagtgagtgtccttggctga

SEQ ID NO: 15682 - DNA, 477 bp, A.fumigatus
tttctctccttcttcttcttgaactttatctgggtggcttttcttcatccatcacctcatccccagccattgatcattgcaaaagacaatatcaacatgagccaaatcgaagtacagctcaaggatgtcgccatcctgggcgccgtgaacaacgagcatcgcaagatcctcaccaaggaagcttgcgctttcctcgccatcctccaccgcacgttcaaccctacccggaaagccctcacgcagcgccgtatcgatcgccaggccgagatcgacaagggtcatctgcctgacttcctccccgagaccaaacacattcgtgaaaatgacgcatggaagggtgctcctcccgctcccggtctggttgaccgtcgcgtggagatcactggtcccacggaccgcaagatggtcgtcaatgctctgaatgcggacgtctggacttacatggcggatttcgagggtgagtcacttgacatttaa

SEQ ID NO: 15683 - DNA, 330 bp, A.fumigatus
aaagacaaactgacaggcgtagactcgagtgcccctacctgggcgaacatgatcaacggccaagtcaacttgtacgatgctattcgccgtcagatcgacttcaagcaaggaaacaaggagtacaagctccgtacagaccgcgcccttcccaccctgattgctcgtgctcgaggctggcaccttgaccagaagcactttactgtggacggcgagcctatctctggcagcttgttcgactttggtctttacttcttccacaatgccaaggagcttgttgctcgcggccacggtccttacttctacctccccaagatggagtcccacctctag

SEQ ID NO: 15684 - DNA, 234 bp, A.fumigatus
catgtgcagattatctatgaactgcgtgatcacagctccggtctcaactgcggccgctgggattacatcttctccttcatcaagaagttccgcaagcaccccaactttgtccttcccgaccgctctgatgtcaccatgactgtgccattcatggacgcctatgtgaagctgctcatcaagacttgccaccgccgtggtgttcacgctatggtaagtttttcgctctctgcctga

SEQ ID NO: 15685 - DNA, 489 bp, A.fumigatus
cagtcccagggtggtatggctgctcagatccctatcaaggatgaccctgtcgccaacgacaaggccatggagagcgtgcgcgccgacaagctgcgtgaggtccgtgccggccacgacggtacctgggttgctcaccccgctctcgcctccattgcctccgaggtcttcaacaaatacatgcctacccccaaccagctgttcgtccgccggcaggacgtcaacatcaccgccaacgatctgctcaacaccaacgtccctggcaagatcaccgaagagggtatccgcaagaatttgaacatcggtctttcctacatggaaggctggctccgcggtgtcggctgcatcccgatcaactacctgatggtatgccttttcacgtggactttgactactttcatccttgctaacttccgagtaagaagatgccgcctaccgccgaaatgtcccggtctcaactctggcaattgggtgcaccaccaggtcaccacc

SEQ ID NO: 15686 - DNA, 192 bp, A.fumigatus
agccggtcccagtctccttccctcccacgatcagtcaacccccatcctacccaaagacagcaccaggatagctggctgtcatttcctctccactactccgtgtccatctcttccttgaagaagcctgcgactgcggcgcccctcattggcaacgctcagctcttccctgtgaccttgttacctgccaagtag

SEQ ID NO: 15687 - DNA, 348 bp, A.fumigatus
ggcattcgacgcctgatcgacaagtatggcctcgatacgcaagttcgggataacactcctgtctacattgaggacatggtcccttttaatgagaccatcctccagacacgggaaaagcgattccatcttggtttccaacgcatcctgctgtgcttctatgtcatgatgggcttattcacagtcagtcggaaaggtgctatgctgcaccttcagtacaagcatttggtggtaactctgcagaagaacccgcacggaggacccccagtacccatggttgatttccgggccgagttcatcaagggttttctgggaatgaaagagctgtatgtgactatacatggaccttaa

SEQ ID NO: 15688 - DNA, 225 bp, A.fumigatus
  unsure (33): Identity of nucleotide sequences at the above locations are unknown.
cctagtcggacaaatggcctagtcggacacttncccaccatcatacaggttcacaaatatcaccacaactatatagagaaatcatctaattaccttaagaactattttttgtaccctgggagcatttacaggcatttgcccaactgttcccattatcggtacgagattgcaccctttttgttgggtttcctcattaacctaaacacccaactcccttttctataa

SEQ ID NO: 15689 - DNA, 453 bp, A.fumigatus
tggacactcagtggctccagcctcccggatgaccaaggtcctccttcgccacagcgaaccttaccctctgttgtacagtatcctcaaggaaagggattctcgccgtatattctacttcatgacgtatgcaattactctcttacgttttatgaccgacgactaatgaaatttcatagcttaaatttcacctttatgctggtccaattatcttacgggttcatcactgggtccttgggactgctcagtgacagtatacacatgttcttcgattgccttgcacttgttgttggcctttgtgctgctgttatgagcaagtggccgtcaagtgcccggttcccttatggctatggaaaggttgataccctttccggatttgccaatggaatctttctcatgtacgatttgaacccacctttcaatgagtctaaacctgacaattacccaggatcataa

SEQ ID NO: 15690 - DNA, 432 bp, A.fumigatus
cgagaaggtcaaattggaaaaaaggataccatgtcaacggggcctcccatgtctagcctggatacacagttccccgcaactcatggacatggattcggacactcccgcggccatggccactctcgctcaaagcgttggacacaacctccagtaggccagtcgctgtcttctttgaatggttctgcgactccagtgcaatcggtcctgccttctgtagacgcagtctcacccaatggctctgcgttagggtcgttatcgcacaatcatcaccactcgcactcgcactcgcatggtggagccaaccacccagggagctgcgaccacggacattcagggcattatcatccatccgaaaggacagaagatgctacagaattgcgcgcgcgtgctgttcctgtcatctctaccgattttacgcccagcaccaagtga

SEQ ID NO: 15691 - DNA, 1227 bp, A.fumigatus
ctgacttattcttctagtcgcgaactcttatcaggactgctaaccactctcccctggatcgccttgtcgtggtactacaatcaatatgccaatcggaactcagatatcgatatcgccaacacggacaaagttgacccgaacacgttggccggagggagtctggatcaggtggttctaaggacctgcagcctgacagctgtctctatggtcatgacgggtgtcggacaacttcaatggtcctcaaaagctgggaacaaatccgcggtcaaggttccaaatctgagggcagatttcgcaggtgtagcgcttgctcgcatattctcgattgcgctacctatatacgcagcgctcgaagttagtgggtttcttgtctcattgggcgtgcttcttgcagcggcatcagggttgcccgctcttgccaaaggccgcgccgctggcagcgacactcgcgaaaagctggcccataagaggttcacagttgctctgatacttacaattctggtgttgagctttttcggctgggttggctcttatgattcgaggtcgtacttcggacatctcgccttgttactgtccatctttgtcatgcctcccccattcgcagatgtcggccagtcttcgtctcgggggacaggttttggtgtctccgcttcctcgaaatcagacgctttagcaaggcggatttcgggatcactctctgtcgtctcaccggacgatggcatattgaccttggtactcgggctcgtcgttgggctaatcggcttcgttctcttcggtattccttccctgtcggcattggatgcgatgtacctactggtggcagccggtagctacgcgacatccttactcttttcaagcccgccccatctgcgttcactgcacaagtggggtctcgctacaggtattgtcgcagcaggacttctttcttcgccaccgatagctgctgataatagagtggtctatgcatcccggtgcacgctggcggtgatgtcgttctttgcctctcggtttgatgaccgccggctacgccttgagcgccattctcaccacaatcaacatcatgatggacactcagtggctccagcctcccggatgaccaaggtcctccttcgccacagcgaaccttaccctctgttgtacagtatcctcaaggaaagggattctcgccgtatattctacttcatgacgtatgcaattactctcttacgttttatgaccgacgactaa

SEQ ID NO: 15692 - DNA, 189 bp, A.fumigatus
ggtcgttatcgcacaatcatcaccactcgcactcgcactcgcatggtggagccaaccacccagggagctgcgaccacggacattcagggcattatcatccatccgaaaggacagaagatgctacagaattgcgcgcgcgtgctgttcctgtcatctctaccgattttacgcccagcaccaagtgagtga

SEQ ID NO: 15693 - DNA, 351 bp, A.fumigatus
  unsure (321): Identity of nucleotide sequences at the above locations are unknown.
caattacccaggatcataagtatcgagatcatctacgaagctgtggagcgactttcgtctggaagtcagatgcatcgactgggtgaattgttggccgtcagcgttgctggtctggtggtgaatcttgtcggtatcatggcatttgaccatggccacgcacaccacggtcacgatcatggtcattcacactcacatggaaatgagaatatgcacggtatcttcctccatattctagccgacacccttggctccgtggcggttgtgatatccaccattcttgtgcacttgtcaggatgggcagggtccgacacaagcctctcntcaacgagccgggagtggaaggcactggtt

SEQ ID NO: 15694 - DNA, 480 bp, A.fumigatus
gtacgaccgggaatcgagaagatcggacacttgttgaagtattcggagaacttttcggcatccagagtggctgaagtaacaatgagtctgaggtcgggccggcttttgattgtcttcttcagtagcccaaaaagaacgtcagtagcgatcgtccgttcgtgggcttcgtccgaccggatcagggaatatctcttcaggtcagggtcgagtaagacctctctttggagcattccgtcggtcatgtacttgatcttcgtttccggactcgtgcagtcttcgaagcgaatcgtatacccgacctctgcacctagcctgcagccaacttcctccgccacacgtgtggcgacagacatggccgccacacgtcgtggttgtgtgcatccgatcataccgttgttcgcgtacccagcctccgccaggtactgtgtcacttgggttgtttttcctgacccagtgttcccgacaacaatcaccaattga

SEQ ID NO: 15695 - DNA, 1605 bp, A.fumigatus
cgttctttttgggctactgaagaagacaatcaaaagccggcccgacctcagactcattgttacttcagccactctggatgccgaaaagttctccgaatacttcaacaagtgtccgatcttctcgattcccggtcgtacctatcccgtcgagatcatgtattcgaaagagcccgagcccgattacttggatgcggttctcatcactgtcaagcagattcattagacagaaccacgtggagatatttttacgttttgaccggacaggaggagatcgacaccgcgtgtgagatattgtatgaacgaatgaaagccttaggcaagggtgtccctgagttgatcattcttccggtctattctgcccttcctagtgagatgcagagcaggatcttcgaaccagcacctcccggcggaaggaaagtggtcattgcgacaaacattgccgaaacatctattacgatagataatatatattatgtcattgatccgggctttgtgaagcagaatgcctacgatcccaaacttggtatggattctcttgtggtcaccccgatctctcaggcgcaagccaaacaacgtgctggccgtgcgggaagaactggaccaggaaagtgttaccgtttgtacactgaagcggcttatcaatcggaaatgcttccaacgacaatccctgaaatccaacgtcaaaacctgtcgcataccattctcatgctcaaggcaatgggaatcaatgacttgctacacttcgacttcatggacccaccgccgacaaataccatgcttacagctttggaggagctctatgcgctttcggctctggatgacgaaggtcttttgaccaggctgggtcgtaagatggccgacttccctatggagccggctctcgccaaggttcttattgcgtctgtagacatgggatgctcagaagaaatgctgagtattgttgctatgctctcgattcaatcagtgttctatcgaccaaaagagaagcagcaacaagcagaccaaaagaaggccaagttccacgatccacatggtgatcatttgacactgctcaatgtctacaacggctggaaaaactccaaatttaataatgcgtggtgttacgagaactttattcaggcacgtcaaatacgccgcgcacaagatgtacgccagcagctactgggcatcatggagcgatatcaccataagatcgtgtcatgcggtagggacacgaagaaagtgaggcaggcgttgtgtactggattctttcgaaatgcagcccggaaagatcctcaagagggctacaagacattggttgaaggaacaccagtctacatgcatcccagctcggctctgttcggcaagccggccgagcatgttatctaccataccctggtgcttaccacaaaggaatatatgcactgcactaccgccattgagccaaaatggctggtcgaggcagcacccaccttctttaaggtcgcgcccactgatcgcctttcgaagcgcaagaaggcggagcgtatccaacccttgcacaaccgctttgcaggagaggatgattggcgtctttctgcgcaacggcgccagggaaggggtggtggtggaggtacttggggttaa

SEQ ID NO: 15696 - DNA, 1677 bp, A.fumigatus
aatttggtcgttcaaggagcaaatatggtgtcaagggacgacaagtatggtaacggacgcagcgagcgacggaggccccgtgatcgggacgaagatgacgactatttccgcaagcttccgccagtcgagttggacgaacagcccatcctctacaagatctatgacgggcgtgtaactggtgtcaaagactttggtgcctttgtgaatctcttgggggtaaagggcaaagtcgacggtttggtacacgtttctgcaatgcaggaaggggcacgggttaatcacccctctgacttggtgtccaggggacagccggttaaggtcaaagtcatcagtatacaaggttcgcgcattggtctttctatgaaggaagtggatcaagttactggccttgatctcgtccctcagaagcgcctcgcatcgggtgccaacatggagcgcctcgaaggtgtttcgggcaaggacagatacggaaatttgagttcagaagtgccagtcatagaagattcaaacgggaagccgatgagaaaccggaaacgattgacttctcctgaaagatgggaaatcaaacagcttattgcatccggtgctgtttctgcagccgactatcctgatcttgacgaagagtaccatgccacgttgaccggagagggtacattcgaggaagaagaagatattgatattgaggtccgagacgaagaacctcccttcctggctggccagacgaagatgtccctggagctctctcccatcagagtcgtcaaggctcccgacggctcccttaaccgtgctgcaatggcaggtaccaacttggccaaagaacggagagaactacgtcagcaagaagctcaagataaggctgcggaacaagcggccgagattgatctcagcgcacaatggcaagatcctatggctgcgccagaccagcggaaaattgcagctgacctacggagtgctcaacctaagtccgacgatgcggtgcccggagtggaaaaaatcactatgggcaaaaatcagtcctttggcaagagaacgaatatgtcaattaagcagcagggagagagtctcccagtttttaagttccgccaacaactactcgacgctgttcgcgataatcaattggtgattgttgtcgggaacactgggtcaggaaaaacaacccaagtgacacagtacctggcggaggctgggtacgcgaacaacggtatgatcggatgcacacaaccacgacgtgtggcggccatgtctgtcgccacacgtgtggcggaggaagttggctgcaggctaggtgcagaggtcgggtatacgattcgcttcgaagactgcacgagtccggaaacgaagatcaagtacatgaccgacggaatgctccaaagagaggtcttactcgaccctgacctgaagagatattccctgatccggtcggacgaagcccacgaacggacgatcgctactgacgttctttttgggctactgaagaagacaatcaaaagccggcccgacctcagactcattgttacttcagccactctggatgccgaaaagttctccgaatacttcaacaagtgtccgatcttctcgattcccggtcgtacctatcccgtcgagatcatgtattcgaaagagcccgagcccgattacttggatgcggttctcatcactgtcaagcagattcattag

SEQ ID NO: 15697 - DNA, 918 bp, A.fumigatus
gccgctgcaccactgtcgaaagactctactttccacaacctcaccaccatggcagctaacggcaaggtcgtctcggagatgatcgcctggatcaaaagccagaaattgatcgctccccggatgaaatatgcccccacgttctatcgaaatctcgaagaggctctggatgtacgccggtcgacgcagtctctgatgacccgaggacaaagcacatggaagacaggagacgcgatagacttctgctccaatgatcttctctctctcggactcacgggggaactgcggcgggagttcctggccgagctggcaagacatcccgatttctcgctgcattccgggggttcgcgcgtgatgggcggcaactacgactatatcgaggcggttgagcaggagattgccgacttcctcggggccgagacggcgctcatgttcaactcgggctccaacggaaacattgccatttacacggcgatcccccggcccggagacgccatcgtgtacgacgagctggtgcacttcagcacgcacacgggcatggccgcctcgctggccacgaccaaggtcgccttccggcacaatgacctggacgcctttcgagaggccatgtcctccaccatggactcccatcccatgctccaggacgggtcacgctcgatcctcgtgtcggtcgagtcggtgtacagcatggatggcgacgtgtgccctctggtggagatgctcgagattgcgcgggagatctgtcccaaggggaacttcgccttcattgcggacgaagcccatgccactggagtcgtgggccctagaggcgtcggtctcgtcaagctgctgggcctggaaaatgaggtcgcaattcgcctgaatacctgcggcaaggccttggcctgtactggatgtaagaaccaatcgccccggcagtaa

SEQ ID NO: 15698 - DNA, 1656 bp, A.fumigatus
aaggaggcgtgtgctgcgattagtcgaggcgactgtggatcggctatggtgggcggcgtcaatctgattctcgcacctggaatgtccatggcgatgcaggaacagggggttctctatagtgacggctcgtgcaagactttctcggctgacgccaatgggtatgcgcgtggagaggcagtgacagcgattttcatcaagccgttggcggatgccctaagggatggcaacccaatccgtgctgtcgtgcgagccacatcccacaacgcggacggaaagacccccacactgtcgcagcctagcacggacgcacaagaggctctgatgagaagagcgtacgagcttggagggattactgactacgcggagaccgccatggttgaatgccatgggacaggtacaccgactggggaccccatcgaggcagccgctgtggcccgggtgtttggagacaaaggcgtctacattggatcggtcaagcccaatctcggacataccgaagctgcctccggccttgtatcactgctgaagatggtgaaagcactcgagcatcgcgtcatcccgccgaatatcaaattcaccagcccaaacccaaacattccgttcgcggagggtaagctgacggtccctaccgatccacttccatggccgaaggacagacttgaacgggtcagtgtgaattcctttgggattggtggcgcaaacgcgcatgtcattctcgaatctgccgctacgtataacgtccccgttgcggttcacgaaacaccggagacgccgcaactgctgttgttcacggccaactcgtcaaagtcgatcacgaggatgatcgacggctacaaggcatgggtggaacaaaatccggataaagtcagtgatctagcctacacgctggcacggagaagggagcatttgccgcaccgagcttttgccatcttccgtaatggtgtgctggaaagcgtttcacagcctgccaactccaaggctgcgaagcccccgagcgtcgtgatggtcttcaccggtcagggcgcacaatggccccagatgggacgggacctgctgcggtcgaacgacgtgttccggtccagcatccgattgctggatcaacacctgcagaccattgctggggagaagccgcagtactcgatcgaagaggagctcaagaaaccagccaagaagagccgtctgtccttggccgagttctctcaaccactttgcactgctgttcagattgcactggtcgacacgctcgcgtctgcgggaattcacccagacgcagtcgtgggccactccagtggtgagattgctgcagcatacgccgtcggggctctcagcgcgggagaggccatcaccgctgcccatcaccgtggagcagtgacgagccggcagaagagagtcggaacgatggcggctattggaatgagctgggcggaaaccgaaaagtaccttgtcccgaacgtcacgattgcctgtgacaactcacccaggagcgttacaatctcgggcgacgtcgacgccgtcaagtcggtggttgctgctatcaaggaggcacagccgcagatgctggctagactgctccaggttgacaaagcctaccactcgtaccatatgaaagagatcggcgaggattaccagtcccttgatccccggttttcaccagtc

SEQ ID NO: 15699 - DNA, 699 bp, A.fumigatus
aatcaaaatgcagagatgatccgccaggtgacagactgcgaggcaagcaccttttacgttgaattcacatcaatgacgatggacgaaagtaccggcaccaatggccacggggtaacaatgggctcgaatacgaccaatggggctacccctaacggtgtgtacgctaacggcacgaatggcactttggcccatggggtccttcgcggtgctcaagtgcccatcgccatctgtggtatggcatgtcgtctccctggcggtttgacgacgcccgacgagctttgggatttcctgctcgcaaagaaagacgctcgatgccgcgtgccgcactcgcgctatgacatcgactcatactactcggatacgaagaaaccagggacggtctcgaccgagtatggatatttcctcgacgagagcgtcgacgtcggagcgttggatacgtcgttcttctccatgacgcggaccgaagtcgagcgggccgacccccagcaacggctgatgctggaagtcgcacgcgaggcctttgaagatgccggcgtgacacactggagaggcaagactatcggcacgtatataggcaactttggagaagactggctggagatgtttgggaaggagacccagccatggggtatacatcggcaattcccgttcaaggaaaactttgtcgtgggcgaatccggctctcgttaccaattttga

SEQ ID NO: 15700 - DNA, 231 bp, A.fumigatus
ccgcggccgcacgccatatttcagctcacaaatctccccaacgaaatcttcgcagaccttcactatgcgagccggctgaagggcggtgtcaatcacacctatataattcgacgggaccgtgttctcagacgacttctctgttctggaaccgacatcacttactggctgcgaggcaaagtgaagggccagatgttgctctgctataagccgggtgccaatcctcgctcgtag

SEQ ID NO: 15701 - DNA, 207 bp, A.fumigatus
atttgttggcagaatagcgtcatctttctcaacctacacaagtgtacacaacctgaaaagaagcttgatgactatgttacggttccttttttctacattgtgtatgacttgcgcgggttggctgtaaacattcatctgattacccgcaatgacaacatcattgcaatctctattgctgtaacatataacgcagacgtttcagcatag

SEQ ID NO: 15702 - DNA, 846 bp, A.fumigatus
  unsure (805): Identity of nucleotide sequences at the above locations are unknown.
cccactctgtcttcctacagacacggacgcccgcctttgtcaaaagaggcgctactcgcgtctgcgaatttcacactatcccttctacctgcccgactggcatctcgtatacaggcgttacgaaacctcccttttatcgtcgtttcaaacccacacatctcgaagatctataacaattacgtccactccttatcgactcttctgccctatcagcaacggaaggtcaccacgctggaagaggagaataagttcgcagatgtactggcggacctagtgcatacgcattcaaataccatacccatactggcacgggggtttcttgaatgcaggaagtatatcagtgcagccgatgtgactcgattcctagacacccatctacgagcgaggattggcacccggcttatagcagagcaacatctggcccttcactttgcctcgcagccagtaagtgatgtcggttccagaacagagaagtcgtctgagaacacggtcccgtcgaattatataggtgtgattgacaccgcccttcagccggctcgcatagtgaaggtctgcgaagatttcgttggggagatttgtgagctgaaatatggcgtgcggccgcggctaaagattgggggacaagccgacgccacgtttgcgcacgtacctgtgcatgtcgagtacatcatcaccgagcttctgaaaaatgcttttcgcgctgttattgagtcgggaaacgaacgggagcccattgaagtcacgattgcggcggctccagacgtcccgacccatcaagttcacaatgtgctcggaattaagtcanatgcctcaggtatctaccctgatgccgatgtttggctttaa

SEQ ID NO: 15703 - DNA, 786 bp, A.fumigatus
cagcggttttcagcgagcacatccataataatgtctacatctcgtcggcctccaccagcctacactgccgctaaggattcagcagtgtatggcacgtcccaagtctataggaaaatctcggagagtgcttccagcgaatctggaaggattctcgagacatcattcactatccgtccctgctccggacaggcctgggtggtgccagcggggcatatttgtcgactgactacacccaaaggaccgcaagtgggcgatctcaacatttggaatgcgaataatcctcgagagcgactttgggctgcccgcacgcgtcaaattcacgcttcccatgtgtcagtcggtgaccgcttgtggtcaaacctgccatatctacgacctctcgtcaccataaccggagactctctgaatggtgggcaattgcatgaggttttggaagtcaacgggcaacggaaggagggtgttggctttggtacatcaaaatggggtggacgtgttcatgatttgctcggaacaagatgtgatccctacgtcaatttgcttatgggtggagaaacctttgacttccactgccactcgaacttgacacgcgcagtcatgccttatggcttgactgaattggatgtgcacgatgtgcttaacgtctttcaagtaacgggtctggatgagcagggaaagtacttcatggagacatcgccagctaagcctggagaatactttgagttctttgccgaagtagatgtgctctgtgcactgtcggcttgtcctggaggtatggttccatgttga

SEQ ID NO: 15704 - DNA, 975 bp, A.fumigatus
  unsure (883): Identity of nucleotide sequences at the above locations are unknown.
ataattgcgccaggttcgcaagtgaccctggcgcagctcggtcttccagagtcctttactcctgcacgatttcgcttccccacgcgcatgttccctggcgagaagaagggcgaatatgaaccatataagattcacgaaaagcgacgcgatgttaaacctagcaatggctccgacgcgcccaaggaggacgtggagatgaaggatgcggaaacctctgcgcccgagggtgcagcggacactgtgacggatgagacgccacagaccacggaaaccggaggccaaccggagaatggagagccgcatgaaaacaatggcgaagcagtgcaggagactacacaggaggtgttctatgaagaggatgttacatcggatgaaggcgcgatttatcctatcgaaaacggacggattgtcgattggcctgcctttttcgccctcttaacacatgtttacaacacacttagcccgcctttccacacaccaatcatgctcattgctgagccagtttggtccgctcgtgatcgcgaggcgatcactcagtttgttttcgagaaattcaagacaccggcgttttgtttgatggattctgcactggcagtctgctatggatacggaacatctaccgcaacggttgtcgatgtcgggaaagggaatgtcgatgtcaccgccgtgaccgatttcctggtcaatgaacacggaagaagtatcgccctggaaggttgcggtggatattacatgactgaaaggcttctggaactactggaacccacgggcttcacaagggaaatgtgcgagcaattgaagagaagcaatatcacagagattttacccccgggaacaccaattcctggcaccgcagagaccgcacaacaaggtacccacccancggcatcggcctcgacaggtgcacaagaacgtgtgggtgtcaatggatccgtccctcgtgggcccaggcaacaacactcaagtcggggctga

SEQ ID NO: 15705 - DNA, 273 bp, A.fumigatus
gaacggtttcaagtggtgagtctctctatatcctatgagctttccggaaaatatatactgattttttgctacttcagtcatgtacagagtgaaagccatgtacgacagatgctgctcatcggcgaggaccccaagaaacatatcgaggagttcagcagagagtttctgaacaactttgtcaatttgctgaagactacccatggcgagaagaaggtccacgttaatcaattctatcagcaggttattgctgataaggaggtgagtctcgcgtaa

SEQ ID NO: 15706 - DNA, 396 bp, A.fumigatus
agaaacacacggatactccgagagatggaggaacaggcgcggccagagtgggagaagaagaagactgtcatgagtttggatatcaaaggaggccgcgtgacccgcgtgtatcaatctgccgcgcctgcgcagtcgagctcggccgcggaggagaaagaggaggacgtcgaggatgtgtcatatgaaaagtcgaaaccaactggcggtgaagctttcagtcggaacccattactcgcagctggcggcctgctacgacccgtttggaaggctgcggacgacaagcaagaaaggacagctacaaaagaacgcaagcagacatggcggcgtgtccaagacgacaatgatgacaatgaacaatggattctcgatggtggtttgcacggctataccacttag

SEQ ID NO: 15707 - DNA, 717 bp, A.fumigatus
cgtgaagtcaaaaaaaaaaagtgcggattgtggatgcccctagacacctggcacctggaccagatcctcatccacaagttaaccaacgaccggtggaactttatcatgaactcccgcgtcgaagccaacgagcgggccaaggaacggacgcaggccggccacgacgccaaaaaggacttcttctactacctgctcaacgccaaggatcccgaaacgggcaagggcctgacgacacccgagctctggggcgaggcgaacgtcctgatgatcgccggcagcgacacgacctccaccaccatgtccgcgacgatcttctacctggtccgcaacccccgcgccatggaactgctccggaaggagatccgtgagaatttctcctcggtcgaggagattgtcactgggcccaagctcaacgaactcgtctacctgaaggcgtgcatcgacgaggccatgcgtctggcgcctgctgtccccggcgcgccgccccgcgaagtcatggagggcggcgccatgatcgatggggttttcctgcccgagggcacggactgcgggaccccgacgtactcgatccaccggcaacccgagtactaccgcgagcccgaggtctatatccccgagcgatggatcgagggcgcgacgtgccaggcaggcagcgagtcatggacgaccagcaaggagtccgttgagctggcgccggagggccttctgcccctttag

SEQ ID NO: 15708 - DNA, 657 bp, A.fumigatus
cattctggacacaagacactagcgtatgtcacttacaatcgatttttccacccgttacgctctattcctggacccttcctcgcttcgatcaccccctgggtacaactctaccacggcctgaaaggcgaccgccacctatggcttcaccggctacatgagaaatacggctcccatgtccgggcggcacccaacttcgtctccatcaacacggaccgcggcctgcacgacatctacggccatggcaagcggctccgcaaggccaatttttacaatgccttccccgccatcaagggcgtgtacaacacgcacaacgccatcgacaaggcgatgcacgggcgcaagcggcgcgtgctcagccaggcattctcggaccaggcgctgaagagcatggaggatgtgatgctgttgcatgtgcggcagctctgtgaaattctgaccggtgggctcgacggccccaagggggaaaagagcgcgacggccgttttcaatctgggggactggtttagctatctgacgtatgatgtgatgggggagctgtgctttgggaagagctttgatatgctaatttccagcgggcggcggaaattgatcgagcttgtggatcgcgctgccaatcggcactatgtggtatggccgtctttctcccctcccccctga

SEQ ID NO: 15709 - DNA, 435 bp, A.fumigatus
  unsure (330): Identity of nucleotide sequences at the above locations are unknown.
tcgatggggttttcctgcccgagggcacggactgcgggaccccgacgtactcgatccaccggcaacccgagtactaccgcgagcccgaggtctatatccccgagcgatggatcgagggcgcgacgtgccaggcaggcagcgagtcatggacgaccagcaaggagtccgttgagctggcgccggagggccttctgcccctttagcatcgggccgcgggggtgtatcgggaaaagcatggccttcatggagatgcggctgaccattgcgcggttgatgttcctgtttgatttggaactggccgatccccaaggcgaagatgagaagggccanctggccctggttggaaccatttcaccaaccgccagttacgggcccaatgttgttggtccggaagaaaagtttggaatttccggttttggtgaaaatcccggatga

SEQ ID NO: 15710 - DNA, 681 bp, A.fumigatus
  unsure (242),(416),(546),(581): Identity of nucleotide sequences at the above locations are unknown.
tacatcctagctcctcctccaggaatggcagcgccggggactgctcctcctccggggatgcagcaggcaaacataccgcagcccggtcgacctgcgggtttccctcctaactttcaacctcccccaaatatgcccaacatcaacttctctgcacctgtgatccgacttgggacgtctggcccttcgaaatcagctactccggacacgagcaaggaacgcgaggctccgggaagacgtgcggngttgggttcaacaagtcttgagtctcagcgccagaatgtacgagatgcgatgatgcagctgcagcctccgacgagggaagagattgtaaggactatatttgtggggggtatttaccgagggcgccgcggtgacgagggcatcgagaagattttgcgttccgctgggaatctcangcggtggatccgcgctacggatgccgatgataagccattgcaagttggcttcgcagagtacgaggaccctgaaagtcttcgtactgctgtagaaatacttaagggacgtgaagtgccggtcaagagacanaccccatccgaggaggttggacagaaggagaggangtggaaaagagcacactactggtttgtatactgtccttcaggtgcattttacagatctgaccatgttgcgattaggtggtcgttgacgacagttccctga

SEQ ID NO: 15711 - DNA, 252 bp, A.fumigatus
agagtggaccagacctccctcgacaagactggctccgatgccatgaacgctgcgggtgattactctgcggcttactgtatcatcaacaccgattcgtcatacgctggtcacggcatggtacgcatcaaacccttggtgtttctattagctctgagcaaagaaagaactaactgggaccgcgacagaccttcaccattggccgtggaaacgagattgtctgcgccgccatcagccttctcgctcccctggtag

SEQ ID NO: 15712 - DNA, 183 bp, A.fumigatus
ttaaacgttattcacgacggtctgaatattgtccaatctcccctagatcggctggacacccccaaggtggaattacaattccgcggtggccttgtcaatattaattgcaatgaccctggtattcttggtaatctagcgcgttctagacgtggagaagttgataataatactcaatggcagtaa

SEQ ID NO: 15713 - DNA, 1563 bp, A.fumigatus
gtggtcgttgacgacagttccctgagctatctggaacagtatgaaaactccaggggtgaacaggacccggcggagcgtcaggcgcggcttgatgctgcgcgtagcaaactcgccaacgttctctccgaacttttccatcctacctcgccaacccgcaaggaagactcctccgccattgatcgtgaaggagacaccgcgatgaaggatgctgaaggcgccgatggcacctccgctgaagttgtcaccattccgatcacggttgaagatgaactgtccgacattcctccggaaatgagggaaactgttgccaaggagattgcagctttccgagagcgcagcaaccgcagggacattgaacgtttgaagcgagaagaggagattgagtccatggagcgagcacggaatgccggctcgcgtcttaatcgcctcgcttctcccccacctagcgctcatagtggacctgctgccggggccaacggtgtgccgcttggtccacgagaccgtggcatgccaaatgcaccttcggggcataaggggttcggcgtacaaatccccaaagattaccagaaaggagtgtcgtttgtcaatggaggcgcgatcaacggcgcaactgtgatctacaacgatagagatgatgaggagaccgatgcaagtgacgaagagctagaacgccgacgtcaagagaagagagaggctgaaatggagaagcagttccttgaccaggaacggcgatggctcaatcgtgaacggagcaggactgcagctctggagcgtgagaagaagcgggataaggaggaggaggccaaagcgcaagaaattcgcgacgaggctgatcggcggtatcgggaatggaacgatgacatcgaggccagtcgcaaggttgaggactactatgccgatcggggcgcatggcttcggagccgtgctgccttccgtgctcgcgagatcagcaacgacgaggctgaccgtgcggccgaagaacgagagcgcgctcggtctgcgcagcaacgcgagcaggcacgtggcatggcggacgacttcctcgcgcgccaagccgaggagctggaggcacgtacccaggcgcccagggaaccgcagcgattcaagctttctcttggcgctgcagcccagaaggctcaagccgccaccacccgccggacagtggccgaagtggaagggctgctggaagacgaagaagagccccaggcgaccgccagacgacccctcattcccatcaagttcgacagtgcgaccgaagcggccggtctctccgacgaggagcgtgcgcaagccgctcgacagctggcggccgaaatccccaccgacaaagaaggactatggaagtgggacgtcaagtgggagtttgtggatgagtcagtgctccgagagcagctcaagccagtcgtcgagaagaagatcgtggagtacctcggagtgcaggagcagatgtcggtggacgtggttgaagagcatgtccggaaacacggacatcctcaggagctggtggaacaactggaggaggtgagatccgcgaaacctatcatgaacccacagcagagctaa

SEQ ID NO: 15714 - DNA, 600 bp, A.fumigatus
ctgggaccgcgacagaccttcaccattggccgtggaaacgagattgtctgcgccgccatcagccttctcgctcccctggtagtcggcaaggacctggacgagctgaccgccgactggggcaagacatggcgctacctggtatccgacagccagctgcgctggatcggacccgagaaaggtgtcatccaccttgccctgggagccgtggtcaacgctctgtgggatctgtgggccaagaccctcaataagcccgtctggcgcattgtcgcggacatgactcctgagggattcgtccgctgcattgacttccgctacatcacagacgccatcaccccaaaagaagccattgcgctgcccacggagatcgagcccccccaatcacgaagcgtatcaaaggacgccttaacagagccccgggctgtgccgggcatacactacttaattgctgggttggctccggtttcccccaaagaaaaacctgccctgccgttgcctgaaagggacagttgttccctcaagggcttccaaaccactttcaaaccttcaagggtctggcgcccatcttttggaacgagaggaccgttcccaagaattgaacta

SEQ ID NO: 15715 - DNA, 369 bp, A.fumigatus
  unsure (38),(73),(203): Identity of nucleotide sequences at the above locations are unknown.
aggacagtatacaaaccagtagtgtgctcttttccacntcctctccttctgtccaacctcctcggatggggtntgtctcttgaccggcacttcacgtcccttaagtatttctacagcagtacgaagactttcagggtcctcgtactctgcgaagccaacttgcaatggcttatcatcggcatccgtagcgcggatccaccgcntgagattcccagcggaacgcaaaatcttctcgatgccctcgtcaccgcggcgccctcggtaaataccccccacaaatatagtccttacaatctcttccctcgtcggaggctgcagctgcatcatcgcatctcgtacattctggcgctgagactcaagacttgttga

SEQ ID NO: 15716 - DNA, 1062 bp, A.fumigatus
cacagtccctgtgagattcaggcgaccgtactcacgctgcatcggccggtaaacatccagcttgtcgttgagccactcataagactggcgcgacatctcgaactcaaccgtgcaaagggagtgtgtaatctcctcgatgctgtcacagagagggtgcgcaaagtcgtacgtaggatacatcttccactggccaccagtgcggaagtggcccttctggtcgacgtccagaatacgccacgcgaagatatcccacatctgagggttcggatcgtccaaatccatcttcatacgcagcgcagcctctcccgccttgtacttgccctccttcatagcttcaaactcctgcagcgactcctcaataggtcgcgatcggtgagggcacgcatacctcgctttgccccgcgcaccatccgcctcgccacgctgggccttgatctccgccttggtgcagtggcacacataggcaccatctcgtcggataagctccttcgcaagctcatacagtcggtcgaagttgtcactagcattagtgacccggacaggcttgtatcccaaccagctcacaatatcctcaataccgcgatagtatatctcctcctcaccctcggggttcgtgtcatcgaagcgcaggatgcattcgccgccatggtacttcgcgaacccgaaattgaccgcaattgccttgctgtgaccgatgtgcaggaagccgttgggctcgggagggaaccgagtccggatcttggggtgtttctcggagatgggccgttcctggtatacatctgcgaggaagccgaccttgaacatggcgtcggggtcgacagagcgcagatcagttgcggcctctttggcgttggcggccttaggcttgccgcctcccttcttgccattgttgttattgtttttgccgtcggggttcttgggtgccttctgcttgggagctttcggcttgggtgctttggcggacttctcttcagagggcttttcacctgcgggggcaaggctctgctctgcaggagcagctgcctcctttggtcgctcaggaagagtagtttctcctgttga

SEQ ID NO: 15717 - DNA, 1548 bp, A.fumigatus
  unsure (2): Identity of nucleotide sequences at the above locations are unknown.
gnacgattcgatctcgtgcaacaggatgagtcgaatgtcgcaggtcatactgaggagaactcgtccacaacggctgggtctcagcaatcgtcggataatgaggcccagaaagctaaggagacgccacagacctcacctgttcttgggccatcagataagctcaaacccgacgaggctgtggatgaaagtaacaaggaaggtggtgccgatctcggggtggaagacttcccaacggtagatgagatgttgtctagatcacaggatcaacatcagcaagttactgttggacgtgtggaagtggaggagaacgaaagcaagaaaccgctcgagccaacaaagcccgaacgaagagctctgaccaagcctcccatccgcgtgcgagtgtcccgacagtccatcgctcagaaacaactggaggattctgacgacgacctggaggttgttactgaccccgccaaatgcaggcgtatcgcggcgttcgaaaacctcccggcgaagaagatgcaggaatcagcatctatgctcaagctgaaggcattggctcatcttacttcacctactcgacggagtaagactatgaacacagcagaactctcggccatgctattactccaggcgaggcagcaagccgccaaagaaagacaggagaggatacaagaactacgggccaagggagtaatcgttgagaccgccgaagagcgcgctgctatggaagatgagcttgaaaatcttgtcgaaaaggcacgccaagaagccgacgcgattgccaagaaggagagagggtctaaaaccaaaaaattggaggatgtagatgacgtggacgacgaggaagatgaagacttcgagctctccggctccgatcaagaaggctacggcgatggcaagggagacgaggaagatgaagacgaggaagatgatgaagagaacgagcagggatttgttgactcggaggctggtgaggatgaagagtctgaggacgagcagaccgaagtcatgtcagcagacgagtcggaagtgcccgctgtgcgacgcaagcgaccaactcgagtaatcagcgacgatgaggacgaagatgaaagacaggcacctaaaacaccggccaaaccgactccctcaacagtaaactctgttgaacggcctcagttccctggcatgacctctgacggactgacaatgagcctcacgcaagcctttgctggtacacttggggccagtcaaccagttacccaggaaggttcgccggctattccggactctttgcctgatcctgcacaaatcacccacgatcgccgagattcggagtcacaaatcatcatcaaggatagccaggagcagcgcgccgaatcgacagacatactggcaggttatacacaacccgagagccgagtctccgagtcaccagcgccaagagccatgtcgcagtactcccaaatccctgaccctacgcaggacgccggctttgttctctcgccctttgatccgtcgaagagaatccctaggggacccccccaattcgactatcgaaaccgggcttgtgggacaaaatga

SEQ ID NO: 15718 - DNA, 399 bp, A.fumigatus
atcccgggaacaaccacgcctgttcctgacggaaaatcgaagcatcttcggcgtgggcgagcagcaaacctatccatgattgaagagcaagaagaggaaggattcgagattgatgccagtgcttttgatgttatgaaaaaggcagcgaagacgaagacgcatgttccatttgacccaaagactagcaaggctaaggaaatggtggaagatgccgccgaagaatccgatgacgaatatgccggtcttggaggcgctagcgacgagagtgaagatgaggaagatgcctacgatcgacagatgatcaatgacaatagtggagagacagtagacgagaagcagctggctgctctgaatgcgtgcgttccccgcgtcaactgtccgaagatgttcgcgaactga

SEQ ID NO: 15719 - DNA, 1182 bp, A.fumigatus
  unsure (1181): Identity of nucleotide sequences at the above locations are unknown.
tcttcaccacattggaatatcagattcttgccaaccatggcatcaacaggagaaactactcttcctgagcgaccaaaggaggcagctgctcctgcagagcagagccttgcccccgcaggtgaaaagccctctgaagagaagtccgccaaagcacccaagccgaaagctcccaagcagaaggcacccaagaaccccgacggcaaaaacaataacaacaatggcaagaagggaggcggcaagcctaaggccgccaacgccaaagaggccgcaactgatctgcgctctgtcgaccccgacgccatgttcaaggtcggcttcctcgcagatgtataccaggaacggcccatctccgagaaacaccccaagatccggactcggttccctcccgagcccaacggcttcctgcacatcggtcacagcaaggcaattgcggtcaatttcgggttcgcgaagtaccatggcggcgaatgcatcctgcgcttcgatgacacgaaccccgagggtgaggaggagatatactatcgcggtattgaggatattgtgagctggttgggatacaagcctgtccgggtcactaatgctagtgacaacttcgaccgactgtatgagcttgcgaaggagcttatccgacgagatggtgcctatgtgtgccactgcaccaaggcggagatcaaggcccagcgtggcgaggcggatggtgcgcggggcaaagcgaggtatgcgtgccctcaccgatcgcgacctattgaggagtcgctgcaggagtttgaagctatgaaggagggcaagtacaaggcgggagaggctgcgctgcgtatgaagatggatttggacgatccgaaccctcagatgtgggatatcttcgcgtggcgtattctggacgtcgaccagaagggccacttccgcactggtggccagtggaagatgtatcctacgtacgactttgcgcaccctctctgtgacagcatcgaggagattacacactccctttgcacggttgagttcgagatgtcgcgccagtcttatgagtggctcaacgacaagctggatgtttaccggccgatgcagcgtgagtacggtcgcctgaatctcacagggactgtgctatcgaagcgtaagattattgagctggtcaagaaggtcttcaccacggggctggaaggtaccgcgcgggctcaatng

SEQ ID NO: 15720 - DNA, 312 bp, A.fumigatus
cgttcttcgctggtggaggcaacgacttgtccttccgccctcctcccttgctgcgcaagactacaacaagctcgtcctctggttctacgtcgtccaagtctgactcatcaaagcgagtccccatacccgctgctggagcgtctgtcgcctagaaaagcggcagtcaattactacactgccgctagagagagggagcgcgaacgtgagattcgggccaaaaaccgctccggcggttccaacattacagctctgttgaacaagtatgccagcaaccggctgggttctctgggaggaacaggccaatgggaatga

SEQ ID NO: 15721 - DNA, 1119 bp, A.fumigatus
ggcggtgggaatggttggacgggctcgactcaatgtgttgctggtgcatgctgcagctctataaacgactggtactaccaatgtttctctggcaactgcatgcccagcacgaccatgacgacgaccaccgctacacacaccacttcgacaagcacatcgggcgctacgggaagcttgcccaccagtttcagatggagctccaccaatgcgctggttggtcctaaaaacgatggccgcaaccttgcgggaatcaaggacccctctatcatagaggttgacggtacataccatgttttcgccagcactgctcaagcgtcaggctacaatctggtgtacttcaatttcaccgacttcaaccaagcaggaaatgcacccttcttctatctcgaccagagtggaatcgggacgggataccgtgctgcacctcaggtcttctacttccagccgcaccagctgtggtacctgatcttccagaatggaaacgctgcctactccaccaacaaggacattagcaaccctgctgggtggagcgctccgaagaacttctttagcagcgttcccagtatcatcactgagaacatcgggaagggctactgggtggatatgtgggttatctgcgactcatccaattgctacctcttctcttccgatgacaatggccacctctaccgctcacagaccactctgagtaacttccctaacggcatgggaaacacagtcattgcactctctgactcaaatcccaacaacctcttcgaagcttccaatgtgtaccgcgtcggaaacgagtaccttctccttgtggaagccatcgggagcgatggaaatcggtacttccggtcatggacggcaccctctctcacgggtacctggacgggacttgcgaacactgaggccaatccattcgcccgttcgaacaatgtggtcttctcggggactgcctggaccaagagcatcagccatggcgagatggtgcggtcgcaggtggaccagactatgactatcagcccatgcaagctccgctacctctaccaaggcctgagtcctacggcgacgggtgactataactcacttccgtggaggctggctcttctcacacagaccaattctgcatgttag

SEQ ID NO: 15722 - DNA, 993 bp, A.fumigatus
  unsure (707): Identity of nucleotide sequences at the above locations are unknown.
tgcagcgcacatgtgaattggcttaccagatccgatctcaggctcaaattgatttgccaaatgaaaggcttcatacgcgcattgttcttcatgggcgccgccttaggctcgaatttcaatcagccggtcttgtgggaggacctggctgatctcgacattttccgagtggatgacactttctactattccgcatcaacgatgcattactcccccggtgctcctattctgcagtcgtacgatctagtcaactgggaattcgtcggacattctgtgccaaccttggactggggctcgatctacaaccttgatgggggccaggcctacgtcaaagggatctgggcttcgactcttagatatcgcaagagcaacggcttgtggtactggatcggatgcatccaatttcgcactacatatatctacacggctccttcggtgacaggcccgtggactaagagtggagttatcaacacctgcctctacgattgcagcttgctcatcgatgatgacgataccatgtatgtggcgtatggtgccactaccatctccgtcgcccagctctcttccaacgggctcagccaggtcaaaacgcaagaagtgttcaaatccactatcggtcccattgagggctcgcgcttctataaaatcaatggcgaatactacattttcaccacgctccccgccaacgccgaatatgtcctcaaggccancatcccgtggggcccgtatacagagaaattactcctgaaggacatctcaactccgatcgccgggggtggtgttacccatcaggtatgccacttgcttatatccaaaccatcgaacctatgggaatataaggttggcattgtccaaacccccgcctggagaatggtttttacatgggcctttggttggacaccctacccaatgggggttttaattcccattcctcccctcccgaattactttggggctccttattgggttccccgggttaatcaccaaatattttaa

SEQ ID NO: 15723 - DNA, 186 bp, A.fumigatus
atggaggatcttaaatgggttgaccaatgtatatacgagattgaattggatatcaaccgacgcatgtttgatatcctctacacggccataggtgcctatgttgttgcacaaagggtctattctctcaatgctaccaatactgttccttctagtgcatctgacgtcacgtaccacaggaaggcctag

SEQ ID NO: 15724 - DNA, 444 bp, A.fumigatus
gctgcagtccgcatacacagtgaactcatccacaccggtctcggtatcattgatcgtagcattacgcttgttgaggagagagatcacgtcaccttggaactcaccaggagcggtgacagcgatcttcatcatgggctcaaggacagaagggttgctttccatgaaagccttccggaaagcctgttgggtggcgttcttgaacgacatttcggacgaatccgtcatgtgggtagcaccatcgttgatgaccatcttggtaccaagcaccttgtgaccgatgagcggacccttttcgcaagcaagattgaaacccttctcacaagcgaaaaggaacttctcagagatactaccaccaacgatctgttcctcaaatttgttgtcctcgagtttgccggtgggctccatccagccgacgacgcgggcatattcaccaggacctcctga

SEQ ID NO: 15725 - DNA, 216 bp, A.fumigatus
tgctctcagcgtcgcgatcttttttctgctccgaaaaaaagttcggagaagccaggaacaaggcacgtgatcatttcagctacaaccaatgagatcggggtagttcaaaccatttctactgcgcatgtactctgtaagtttgacatgacggacagcctgggaattactatggcaataaatattatgataatctcagttgtgaatcaatcaaaatga

SEQ ID NO: 15726 - DNA, 777 bp, A.fumigatus
gaagttggccgagtccttgctgttcttgggcttgataaaaagcgagataacaggctcgggcacgaacatggaagtcatggtgtaaccgagctgtccatcggtgaaagtgtcgccagaggcacaatccacaccgaacacggcgcatatttcaccggctccaatctccgatacctcctccatctcattggaatgcatgcgaacaatgcgaggaaccttgaccttcttgttgttgcgagcattgaagacattggcgcccttgcggagggtaccctggtacacgcgaatataggtcaactgcccaaagttgctttcttccagcttgaaagcaagaccaacaaaaggctgggagttgtaagggacaagcttgaccgaagcctcgtcgcgcttccggtcaagagcgaggttttcaacttccgatgggttggggaggtagtcgatgacaccatcaagcataggctgcacggatttgttggccagtgcagaacccatgaagacgggagtgaacttcaagccaatggttgcccggcggatagcggccttgagctgctgctccgtaggctcagtctcctccaggaagagctcagcgatctcgtcgtcgacatcggcaagcgtctcgatgagcatcctcctccgatcctccacgaccgacttgaccttctcaggaatctcatccttaaccacgacagtctcaccgttcggtacatcgttgtaaatggacttcatacgaatcaggtcgaccacaccctcgaactcgtcttcagcgcctattggcactag

SEQ ID NO: 15727 - DNA, 720 bp, A.fumigatus
tttctggcaggggtgaattgcattctagacataaacattgagcgcatgggtcgcgagtaccgagtcgactgtgtgactggcccgcctcaggtcgcgtatcgcgagaccatcggcaaccgggtggagttcgaccacttgctcaagaagcagtcaggaggtcctggtgaatatgcccgcgtcgtcggctggatggagcccaccggcaaactcgaggacaacaaatttgaggaacagatcgttggtggtagtatctctgagaagttccttttcgcttgtgagaagggtttcaatcttgcttgcgaaaagggtccgctcatcggtcacaaggtgcttggtaccaagatggtcatcaacgatggtgctacccacatgacggattcgtccgaaatgtcgttcaagaacgccacccaacaggctttccggaaggctttcatggaaagcaacccttctgtccttgagcccatgatgaagatcgctgtcaccgctcctggtgagttccaaggtgacgtgatctctctcctcaacaagcgtaatgctacgatcaatgataccgagaccggtgtggatgagttcactgtgtatgcggactgcagcttaaacggaatgttcggcttcagtacgcatctgcgtgctgccacccagggcaagggtgaattcaccatggagttcagccattacgagaaggctcagcctcagttacagtatgtacaatctttctaa

SEQ ID NO: 15728 - DNA, 465 bp, A.fumigatus
ctccgagctgatacagatttttcgcgtccaggatgcgccgccacatgttacgccctttaccgcgcctacaggtcgatgaaggccggtgactcggtcgaaatgaacaagatgttccgtgctcgtatctacgcccaattctttacactcgtcgctgttgttgccggaggcatgtactacaagacagagcgccagcaacggagggagttcgagaagatggtggagcagcggaaggcacaggagaagagggatgcttggttgcgtgagctggaaatccgagacaaggaagataaggactggagggagcgtcatgctgccattgaggctgctgctaaggaggctggcaagaggccggcgccgaaaaagcttccagagcaggacgctgctcggtcagctattgagcctgctgatgagaggtctatcggtgtactatctgctgtgcgagatttatggatgcagcaaaagtga

SEQ ID NO: 15729 - DNA, 429 bp, A.fumigatus
aatatgtatctagatgcacagaaagagccccagatctcgttcaacgtgtcatctggcacctatattgtcatcagtctggatatcgatgccccatttccatcactgggcttcctaggacccatccttcactggatacatccgggatttaagccgtcgacggataccactgtcacgggcgagaccatcttgacaacgtctgccccttttgttgcgaactatattggccctgcgcctccaccaggcagcgcgccgcaccgatatgtttttttgctgtacgagcagccggaagggtttaatatcgagaagcatgccccaaagaatggaaagcccgttggtaactggcagaggataaggtatgatctgggtgcattcgcgaaggaagtgaacctggggccagttttggcggcgaactatttccgcagcaactga

SEQ ID NO: 15730 - DNA, 1371 bp, A.fumigatus
gcacacattgacagcggaaaaaccacttgtaccgaacgagtcctcttctacactggtcggatcaaggccatccacgaagttcgcggtcgtgacaatgttggtgccaagatggactcgctggatctcgagcgtgaaaagggtatcactattcagtccgcagcgacgttctgtgactggataaagaagggagacgatggaaaagaggagaaataccacatcaacctgatcgatacaccagggcacattgacttcaccatcgaagtggagagagcgctgcgcgttctggctggtgctgttatgatcctgtgtgctgtgtcaggtgtccagtcccagactattacggtcgaccgtcagatgcgccgctacaacgttcctcgaatttcattcgtcaacaagatgtaccgtatgggtgccaatcctttcaaggctgttgaacagatcaacaccagtctcaagatccctgctgctgctgttctagtgccaataggcgctgaagacgagttcgagggtgtggtcgacctgattcgtatgaagtccatttacaacgatgtaccgaacggtgagactgtcgtggttaaggatgagattcctgagaaggtcaagtcggtcgtggaggatcggaggaggatgctcatcgagacgcttgccgatgtcgacgacgagatcgctgagctcttcctggaggagactgagcctacggagcagcagctcaaggccgctatccgccgggcaaccattggcttgaagttcactcccgtcttcatgggttctgcactggccaacaaatccgtgcagcctatgcttgatggtgtcatcgactacctccccaacccatcggaagttgaaaacctcgctcttgaccggaagcgcgacgaggcttcggtcaagcttgtcccttacaactcccagccttttgttggtcttgctttcaagctggaagaaagcaactttgggcagttgacctatattcgcgtgtaccagggtaccctccgcaagggcgccaatgtcttcaatgctcgcaacaacaagaaggtcaaggttcctcgcattgttcgcatgcattccaatgagatggaggaggtatcggagattggagccggtgaaatatgcgccgtgttcggtgtggattgtgcctctggcgacactttcaccgatggacagctcggttacaccatgacttccatgttcgtgcccgagcctgttatctcgctttttatcaagcccaagaacagcaaggactcggccaacttctcaaaggttatggctcgtttccagagagaagaccccaccttccgggtgtcctacaatgcggagagtgaggagactttgatttctggcaggggtgaattgcattctagacataaacattga

SEQ ID NO: 15731 - DNA, 216 bp, A.fumigatus
agcgtcatatcaaaacatcagaatcacagattgacctacgcctcactcgatgccaaaagtaatgcccttgcgcgaggactggaatcagtgggtgtgcggaaaggggaccgtgtcggcgtcatgcttggaaattcttccgagtatgccattgtatgtcgtctgtcttctaggccttcccatgagctgcgtttgttgctggaaattaatcacacctga

SEQ ID NO: 15732 - DNA, 486 bp, A.fumigatus
actggcgacgaagcctccatgtcaccggatggctacatcacgatcacgggccgtatcaaagatctcatcatccgaggaggcgagaacattcaccctctagagatcgagaactgtctccttacctgccccggcgtggccgatgtgtctgttgttggtgttccagacgagaggtatggcgaagtggtggctgctttcattatttgcaaagagcaggatcgcaggacagtggccgaggacaagatcagagactgggttcgcgagcgactgagtaaccacctcggtaagaatcttctatcttttctttttagcggcaagacatccttcatacctcaatatgctaaccaaaatcaacttgctaatagttccgaaatacgtttttttcctttcaccttccgattctttccccaagactgcgagcggcaaagttcagaagttcaagctgaaggagactgccatcaagattctgaaagagcagagcaatgctaa

SEQ ID NO: 15733 - DNA, 192 bp, A.fumigatus
cattacgccgatattaagccgcctttgattgactctactgttggcgaccacttcgcgagtattgtcagccaatatggcgatagggaagcgtacgtgactaaatcttgcgcatcgatcctgctagacttgagcaacatggctgactctcatgcacttaaagcgtcatatcaaaacatcagaatcacagattga

SEQ ID NO: 15734 - DNA, 1269 bp, A.fumigatus
acggccgattccgataaagagttgtccgctgaaccacaccttcaggtaccccttaatccgtcgtttaatgcaactcaagtcatctcggcgttgagccaccttggagccgcccatttgatcatcagtgccgagtccaatttaccgcggaaagaaccccggagcaatgtcccactactcaagcaccttgtccaggatctctacacaggaaaagtagagtccgcagtggtgccttcagtgaagaatgtcatttttgttgataactcttctggcagagtcaaatggtcggactacaagagcctgacgcctttcacgtcggtcatatcagacaacgtcgctgatgcgaatccactgcctcctcaggatctctcgcctagtgatgtagtgaacatccaattcacgtctggcaccaccgccatgcctaaagcggcatgcctgagccaccgctcaatcttgaacaatggttcccagattggcgatcgaatgcggttgaccgcaaaggacattgtatgctgtcctccaccattgttccactgtttcggatgcattttaggctacatggcaaccgctactcatggctcagccattgtattccctacggaatcattcaacgcccgtgccactttgaaagccgtgcaggaggaaaaatgtacagcactttacggcgtgcctaccatgttcctcgaagagctcggcctgcttcaggaaggcgaagtagaacacaaagggtttgagtttcttcggacaggcatcgccgctggtagcagcattccagaagcgctcatgaagaagctgcataaggtcctcaatctcacagaattgaccatctgctacggcatgactgaaactagtcccgtttcggccatgacagcgaccgatgacccattagacaagcggatcagtaccgttggtacattaatgcctcatgttgaagccaaggtcgtcgatccagcggatcgaagcaagatactccccatcaacacccgaggcgagcttgctgtgtctgggtacttgctaatgaaggagtactggggtgatccacacaggaccgctgaagtgatgatcgcagaccaagaagggaagatatggatgcatgtaagccaaccctatctaactgcgttctcagtctctaggcaccataaggttgcaggggatctgaccgaggaccatagactggcgacgaagcctccatgtcaccggatggctacatcacgatcacgggccgtatcaaagatctcatcatccgaggaggcgagaacattcaccctctag

SEQ ID NO: 15735 - DNA, 222 bp, A.fumigatus
gtaaccacctcggtaagaatcttctatcttttctttttagcggcaagacatccttcatacctcaatatgctaaccaaaatcaacttgctaatagttccgaaatacgtttttttcctttcaccttccgattctttccccaagactgcgagcggcaaagttcagaagttcaagctgaaggagactgccatcaagattctgaaagagcagagcaatgctaattag

SEQ ID NO: 15736 - DNA, 282 bp, A.fumigatus
tgggtcatcggtcgctgtcatggccgaaacgggactagtttcagtcatgccgtagcagatggtcaattctgtgagattgaggaccttatgcagcttcttcatgagcgcttctggaatgctgctaccagcggcgatgcctgtccgaagaaactcaaaccctttgtgttctacttcgccttcctgaagcaggccgagctcttcgaggaacatggtaggcacgccgtaaagtgctgtacatttttcctcctgcacggctttcaaagtggcacgggcgttgaatga

SEQ ID NO: 15737 - DNA, 216 bp, A.fumigatus
atctgtcggaacgtgcctgccaacgacgaccgcgcggacttctttgtctcaaatgctaaccgcacccggatcaattctaacggatatgtgaagaatactgatgtgacacctgctagactcccagatatgagtctgcgaaatggcgtctccttgtcccgcgagggaatgatcacggcacgaatttgctcatatgcgaggaatttgatggcagcgtag

SEQ ID NO: 15738 - DNA, 816 bp, A.fumigatus
atgctaattgattggctgcacaacaagatagtgcacagaccagtcggcggaacaaaaaaaagttgcatgaagttcctaaaacctcgcagtgatcaggataataccaccaagaaattgcggtatagaaattttatctccgctcatttacgccagaccgcagacagagatatcgaaatgacgactcgcaagagaaacgaatttttggatgtcgtctccgacgacgatgagggaagtgaccgcggctatgactctgaggccgcggaggagagcaaaggtcgactcgcgaagcgacgcaagacacacacgcgtgcagacgatgtcagcgacgaggaatcagatatcggccgctcagagtcagaagatgagtcgaaaaccaggctcaagggcaaacccaagtccaagtcccaaacaacggaacgcagcaatgacgacgacgacgaagacgaagcagacgacggagagaaaatgcaagtagatcagtacctcgacgcaacagccacactctcaccttcacagtcacgatcgcaatcaccgtccacatccagcgtcacctccaaaccaacaaaactgaagaagaaaccactcgataaagtccggccgcctaagaagaacaaaacaggcgtcatctacctctcctctctgcccccatacctcaaacccttcgctttgaaatccatgcttgaaacccgcggttttggacccatcaataaaggtcttcttgactccctgaagtggccatcgaaattccgccccctccgccgaccaatcccattaaacggaaatcctacgcctaacggtggggtggaatttcccgtc

SEQ ID NO: 15739 - DNA, 201 bp, A.fumigatus
aaggaacacttttctgtccacgatctctgttttatcaatggccgcgattacccggtagcccgcgacattcttctcacagcctcccccacacctgaactaggcctcttgcttggaattcgcttatgtcgacagcatttccggaccatgggagtcttgatcagtctcgtgttgtatcgagcccaggacaaaatcacttcttaa

SEQ ID NO: 15740 - DNA, 981 bp, A.fumigatus
gccaagacggttgtcgcgccgctcgaccgcgtgaagatccttttccaagcgtctaatccgcatttcgccaagtatacaggtagctggtttggccttgcatcagcggttcgggatattcatcgacatgagggtgtgcgcggtcttttcaagggccattccgcaacgcttcttcgaattttcccctacgctgccatcaaattcctcgcatatgagcaaattcgtgccgtgatcattccctcgcgggacaaggagacgccatttcgcagactcatatctgggagtctagcaggtgtcacatcagtattcttcacatatccgttagaattgatccgggtgcggttagcatttgagacaaagaagtccgcgcggtcgtcgttggcaggcacgttccgacagatttataatgagcaggcgtcggtgccgtcagccgcagctaaagggacagcaggttctgctgtgactactgcagaaaatgtatcttctgcgatgaacaaggtcgttcctcggtatgggttatccaacttctatcgcgggttcacacccacccttctcggcatgcttccctacgcgggagtctctttcctcacacacgacaccgtcggtgactggcttcgctctcctctcctcgctcgctacaccatcattccagcatctgatcagtcctcccacagccagtcacagaaggggtcacgacggccgcagctcaccgctgcagccgaattattctccggcgctgttgccggtcttgtgtcgcagacatgctcctatcctcttgaggttgttcgacgccgaatgcaagttgggggagccgttggagacggacgccgattgggtgttgtggaaacagcagccaagatatggctcgagaagggtttacgagggttctttgttggcttgacaatcggctatatcaaagtgctgccgatgtcagccacagcttttttcacatacgaacgattaaagtggtcactggggatttaa

SEQ ID NO: 15741 - DNA, 300 bp, A.fumigatus
ccacttagccagtctttctgccgtttgagcttgtctagtcacacggagctgcatggtgcgagcagaccggatccccaaccagccctcaaagctccccatgacactaccgatgtattggcgatccgtacggagcgttttcaaccatccctccttaactcggcgggggtgaataaccaagatcccgcaaagcatatcggaatgaccgcccacgtacttggttccactgtgcatcacaatgtcggctccgaactccagggggttctgcagcgggggcggagcaaaagtcgagtccactgttag

SEQ ID NO: 15742 - DNA, 897 bp, A.fumigatus
tatgtcatgactgagtatgacagaccattcagcattgaattgcctgcaaaacgtcaggctgtcaccatggctgctacagttgcgtcttggctagggtacattccctcccttgcaggagacaaagagctcccagatgagccacccaaagcccttccagcttcgtggtactactccccagagatatatcagttggagcgaagagctattttttccaagagatggatcttggttactcacaagctgcgcttcacaaaacccggtgacttccttcggtttgaggaagctggattctcctttgtgttatgccttgaccgagaaggtaacttgaacggctttcacaatatctgccgccatcgtgcatatcccctcgtctcggaagacgagggcaacgtcaagatcctgtcgtgcaaatatcatgggtggtcgtacagcctcaatgggaagttagccaaagctcccaagtttgaagtcgtcccggggttccagaaagagaatcagagtttgttccccgtgcatgtccatactgatgcactgggcttcatttgggtcaatcttgactcttcaccgaatccagttccctgggaagaagacttcgacggggttgaccggcaagaacgattccagaggttcgacttcacccagtacaagtttgaccatacatggcagatgaccggcgactataactggaaaacactggcggataattataatgaatgctatcattgcactattgcgcatcctgacgtggcgaagctgggcgatctttcatattactataccgtttccacaccggggcatattcagcatttctcccgaccaaagccggataaggtagatgaggatatacagaatgccagcacctactactttcccaatgcctgcatgacagtatcgtga

SEQ ID NO: 15743 - DNA, 489 bp, A.fumigatus
cagtatcgtgagttgcttctttctttcacttttgggttctcaacaacctcatatttgttgacttcaaatcaccctaggcctcatttcttctacatgatgcgatgcgtcccgacatctgcaacatcctgctccatggagtacgaagtttaccgacacatagaagcttcggatgaggactttgaatatattgattccttcttcaagagagttctggacgaggacaaacacctttgtaacgctgcacagaaaaacctgaatgctggtgtgtttgtgaatggtcagctccatcctgacctggagagtgcgccactgttcttccagaatactgtccgaagcttgctcaaaagtcacagcgacgaggagagaaagataaacagggagatatggcccgcgcggcagcattcagcaggccaggcgaccgcagaagatgtcgctttttgcttagggttagcgtgctcggcggcaggatctgctgatctggaatggtag

SEQ ID NO: 15744 - DNA, 1092 bp, A.fumigatus
cccataaagtcacggcaaaccatattcacaggtgtcattacttacttcgtaacaaagacacttaaaatggaccattttgacgtcgcagttgtcggactcggcgtcctcgggagcggagcggcgtactatgctgccaaaaagggagccaaagtgattgcgttcgaacagttcgagctgggccatgtgcgcggggcttcccatgatacttcgcggattgtacgaacatcgaattttgcacccgaatatgtggccctggccaaatcagcctacaaggactgggccgagcttgaaaagattaccggctatcagatgttgacgaccactggcggtgtggtcttcttcgctccggattcaccaacatcagcgagcgactttacaagaagtctggatactcacgacgttccgtatgagctgctggacgcccaggaggtgaagaggcgatggcctcagttcaatattccccagagcgtgtctacagtgtacactgctgactccgctatcgtccacgctgcaaagaccgtcagcaccctgcagtctctagcgcgttcccacggcgctattttaaaggacaacacaccagtggaacgccttattccccaggcctccggcggtgtcataatcgagacccccaagggacaattccacgcaggcaaggtgatccttgcaacagacgcatggatcaataaactcctcgctccgctttccgtacacatccccgtctccgtgatgcaggagcaggtaacctacttcaagcccaccgacgcaggtacattcgagccagatcgattccctgtctggatctggcacggggccaactgtttctacggatttccgtgctacggcgagccgacgatgaaggctggccgggattattccaacaacctcatgacgccggagcaacgcacgttcgtgcactcgccacaactgcttgagcagctgacctcctttatgaatggcttcatccccgaccaggaccgccagccgctgcgcacgattacatgtcagtatacgatcacgcctgatcgacgtttcacccccagcccgttggtcttcaccacggggctggaaggatccgcggtggcgttatgcaaa

SEQ ID NO: 15745 - DNA, 354 bp, A.fumigatus
aacccacacggcagaccttcctccaacaaaggcccttactatcgtgtcctgtttacagcccaccacaccatgagatccatcaacgcatctgagaatcgctcaaaattcattatgacggcagaggctctgaacaatgcactgcctgactttcacatggctacaagagccattcatgccgatgattttgtcagtccccaccgcgccattgcacctggcattcataccgcggtgaacttccgctatgcacgcgatccagatgagctagtgcccgaggagaataaagatgtaagatcattgtctggtttcatctctttttccgccctaacgaggacggcagccaaatgcgccctttga

SEQ ID NO: 15746 - DNA, 1047 bp, A.fumigatus
cgaggacggcagccaaatgcgccctttgattcccacatatattcccgctacacagcacccaatgccaatcgcttggaggtcttgttgcgtagcctcatgggcggtgaagtaatcacgtactcgacgggactttcagcttttcacgccatgctcatcctcctcaacccaaagcgaatcttcattggagagggataccatggatgccacagtgttgtggacattatccacagacttacaggcatccaaaaactggatctaacgcagatcgatcaagccggcccaggggatatcatccacgtcgaaacgccactcaaccctaccggcgaggcgcgcaatctcgcctactaccgtgccaaagcgagcgagaagggggcctacctaacagtggactcgacttttgctccgcccccgctgcagaaccccctggagttcggagccgacattgtgatgcacagtggaaccaagtacgtgggcggtcattccgatatgctttgcgggatcttggttattcacccccgccgagttaaggagggatggttgaaaacgctccgtacggatcgccaatacatcggtagtgtcatggggagctttgagggctggttggggatccggtctgctcgcaccatgcagctccgtgtgactagacaagctcaaacggcagaaagactggctaagtggttacaggaccagctgaaggacgaaacgtctcctattgcaaaggttctgagccatatccagcacgcctcgctccaggaggatgacttgaagaacggctggctgcagaagcagatgccgggaggctttgggcctgtttttgctgtttggacgaagaaccccgagcatgcgcgccggcttcccagcaggatgtttatcttccagcacgcaactagtcttgggggggttgagagtctgatggagtggcgggccatgagtgacgcacgttgcgaccacagattgttacgaattagctgcgggatcgaagagtttgatgatatgaaggctgatattctgcaaggactggagtcgctattacgggactttccctaa

SEQ ID NO: 15747 - DNA, 201 bp, A.fumigatus
agccccggcatcgaacaatacgctatgcgtgcctttgcggatgcgttggatgccgtgcccttggcattggccgagaattcgggtctgagcccgatcgagacacttgcggcgatcaagtcgcgccaggttaaggagaagaactcccggttgggtgtcgactgcatgttgaccggcaacaacggtatgtatttgatactttga

SEQ ID NO: 15748 - DNA, 282 bp, A.fumigatus
atcattgatgaagccaagcgctcgctacacgatgctctctgtgtcgtccgaaaccttgtcagagataaccgggtcgtgtacggtggtggtgctgctgaaattgcttgctccctggccgtggaggaagctgctgtgaaggtaagtagtcttggaatccatgttttattacagcaaactgactcatggaattttagagccccggcatcgaacaatacgctatgcgtgcctttgcggatgcgttggatgccgtgcccttggcattggccgagaattcgggtctga

SEQ ID NO: 15749 - DNA, 672 bp, A.fumigatus
aggtggttttcaggttgggggaccttgggagcggcaaggaacgtgggatttcggaactggattaaaggtaggacgggaaagggttgggcggtggctctgggaagaattggttcgtggtcaaaaggggttaatagtgggataagggatttctctcacccccagatgccggacgaggtaacagatgccaagtggggattctggacctgcccgttcgagcctcccaagccgaagacgaagcataagctcgacatcacatccgttgacgagtttaagaagctgcaagactacgaacgcgagaagttcacagagatgatccagcacttgaaagactcaggcgccaatctggtgatctgccagtggggtttcgacgacgaggcaaaccatcttctactccagaacaagcttcctgccgtccggtgggtcggtggtcccgaaattgaactcattgccattgcgacaaatggacggattgtcccgcgttttgaggacctgagcccggagaaactgggaaccgcaggtcgcgtgcgtgagatgacattcggtaccacccgagagaagatgcttgtcatcgaagagtgtgccaacagccgcgccgttacaattttcgtacggggaagcaacaagatggttcgtaggacttgtgcagtgtggaagacagagagacatggctga

SEQ ID NO: 15750 - DNA, 240 bp, A.fumigatus
gatgcagagcgagctcctcagagagtgaagggatctcgcgatgctacagccgccgatcttttcttggctgtcaggctgtataattcatgctgcgcttggcctctagtcaacggctataacaagaatgagggcaccagatgcgatcgacgcataccacaatacaaattgctaggtataagtgtcatcagtttcgtttcgtttagacatttttctctatgcatccgccatgttctacactag

SEQ ID NO: 15751 - DNA, 426 bp, A.fumigatus
cgagcgcttggcttcatcaatgatctaagagaaaagggtcagccatgtctctctgtcttccacactgcacaagtcctacgaaccatcttgttgcttccccgtacgaaaattgtaacggcgcggctgttggcacactcttcgatgacaagcatcttctctcgggtggtaccgaatgtcatctcacgcacgcgacctgcggttcccagtttctccgggctcaggtcctcaaaacgcgggacaatccgtccatttgtcgcaatggcaatgagttcaatttcgggaccaccgacccaccggacggcaggaagcttgttctggagtagaagatggtttgcctcgtcgtcgaaaccccactggcagatcaccagattggcgcctgagtctttcaagtgctggatcatctctgtgaacttctcgcgttcgtag

SEQ ID NO: 15752 - DNA, 2658 bp, A.fumigatus
  unsure (167): Identity of nucleotide sequences at the above locations are unknown.
atctcatcccgctacacaagaatcctgaccaagtacttaaccatgaatcgcccagcccggtcgagcagtatcagaaaagatgcacacacaaatcgctcgccccctcgaacaccaccttcacaagcgtctaactgcaagactttcaagcgaggccttcatccccgtcnctcgttacgcgaaaccttcctagacgatacgaatccagccgacaatgcgaacaacagcagtaacgactcaagtgaagagcgagatccccatgacctttccctgtcgccaaaacatgccgcgcgcacgtccattgtcgacaatatgttgctttctctggatcaattcaccttttccacgggtaattcgattctcgatgactaccgactgttcaactccgtcttcgaatccgaattgtacggtcggaactcgcaggaatctgcgggacccaatcggtatcgcggccatacattctcttcctccctttcatcagaagcagactttggttacgacgacagctcgactcgttatggaacccagccggcgtctgccgccagaggccgccggagcaacagtagctcccagtatcactcaagcctgggacgattcgggagtactcgcagccgggaagggaccaattcacgaggtcaactcaatgactatcgagctgtcacaggggccgatcaaacgactcgcgggacgaggaaaagcagcaaagcaagctcatctaccaacctcgatttcggttcagccctcatccgagggagagcggactcgtctggtgagcgacgttcggccagcttcgattacgggacgaggccgcctttcatttccaccgatttcgattccacgttttatgacagtacagacgctgctccaacaccgagtgtaccggctggcccccggaagttacactcctcagctcaaaatgattatgtcggtgtcttgaacagtcagtcttcgcggacaccggtagcctcccggcggaatagcatcaaatcgtctcgaaccaaccatgctaggaaaattcggccggacaccatcggtaccagctccatcctgcgaggcgcagacagcgagcttgccaatctgaccgatgacgggctggatccgccaccagcaatatcagcatcgctcgacccgcccgctccaagtccgacgatttcgttcaataaacctgctatgctggcctcgccagactcaacgcctgccaaggagcgccagggattcttccggcgcgtgttcggatcctcgaaaaacaccgcttcaggaccgtcggaaagcatccagtctgacagcacattgccccaagagaatgatcccaaggagacaattgcggctggcggaagtctcaggagccgcagacagccgttgagaaccaatgtgtctggcgcaaatgcactccgcgaaggtcaaccacatgtggtgaacaagaagtcgtcttttttccgtcggcggaagaagtcgatatctacgactgacaacctaccacctcccatcattcttcctcaggaactaggccccaaggctgtggagatcctgaaaccggaacccagccctgtcagtagtctcagaaaggtgatgaatccgtaccttgctgacggcattggcgccgcatgtgataagtccaatagtggcccgattcgggtcgcaggtgcaggtcctgcagataatatggatccaatccttacctcggcaaggaacgagaaagaaaatgtttctacagctcccgccaagggcggtcagacatcaaaatacagcctatatccgcctccaaccgcaggcagtggccacgatacttcattcctgatgaacagcagcggagatgaagagtccacagccaggactgccgaaatggattcaacctcctctgttgatcgaaagcaggagaaagtggcggtcgaggatgctctcaattcttccgagggcgacaagggcggtcacacgactgacggcacgtcccatatcatgatcccaacgacgacgaaatccgctccggctctgtcaccggtcgtcgagagtatatctccggcaagtgtgtcgcccctggaagattcagagtacctcaccacggaaaccgccgccgtcaactcggctacgagaactgcaggccatcgccagagatccagctccggcggagaccagcggccgcagcccagcaagctatccatccccgctatgaaggcggatgcttcgtctcaagtctcacctgcagactcggatgaattctttacagccgccaacacccctgcggtgccgtcggaggatcctaagacgccacagatcatcgaggacattgctgaatgctctgacgacgactcatcaggtggcccctcgagctctgatcgagatcaagcaaagcgactgttcgatagtcaagaccaagtggtaggcaatgagcccgctgctgcctggcttggcgatcctggtcgtgcttctatcagagcggcatacatggagctctttgactggtcaaacatgaacattcttgcagcgctacgaagcctttgtacccgcctagtgctcaagggcgagacgcaacaggtagaccgagtgctggatgctttctcgactagatggtgccagtgtaatccacgacatggcttcaaagctgtcggtacgttcactttcccttcaccttccatcacagaatatatttcagatctaacttag

SEQ ID NO: 15753 - DNA, 408 bp, A.fumigatus
cttagaccagatgttgtccacactatctgctattctttgctactcttgaacacagaccttcacctggccgatattgagcagaagatgacaaagaaccagtttgttcggaacacaatgccgacgattcgtcgggttgctgtggaagcagctccggacggattcgaaacctcccgacctgttaatcgatcgaaactgtccacgcaagagtcggcttcgtcgcccggcccctcgcagcagaactcgtccaacaatcccgaggcgtctaatgcagatacagatcggccgagtcaccctccccacaagcttgttaatcggttgtctcgaaccgatctttcgatcaaattgtcgggtgatcctgaaagccacctccgcccggttggtccatgccccattccatgggttcaatga

SEQ ID NO: 15754 - DNA, 1203 bp, A.fumigatus
gaccctattccggcggatttgacttcaatcggcggacctgaactcggctggatccttgatggggttttccaagacatccacatcgaaacaggcgagttgcttttcgaatggcgcgcgtcacagcattaccccgtcaccagcagttacgaagcactggacggtgcggggaaggatcgcaataacgcgttcgacttctttcacataaacagcgtcgacaaggatgaccagggtaactatattgtctctgcaagacatctccatgccgtcagctacatcgaccacgtcaccggaaacgtgctatggactctcggcgggaagttgaacgaattcacggacctgtctcacggacaggcgaccaattttgcctggcagcatgatgcccggtggcacgccaacaacaccataacactctttgacaatgcagcacattcaaacagcgatcccgacagcgaaagccgcggcatggtcatccaactcgatctctcccagcgcacagccgaactgctcgccgcgtactatcatcctcaacagatgagatctgtctcccaaggcaatgtccagattctcgatgaaagtggtcgggtcctcgttggctggggccacagcgcagctttcacggagtacactgccgatggggacttgctctgcgacgtccatttcgcggcttctgcattcttctcgttcggtcgggttgtgtcttatcgtgcatccaagggtacgtgggtgggcagaccgctgacgatccccgacgcggcggtcatgggcgaccgtgtgtatgtgagctggaacggcgcgacggaggtggtagcctggcggctggaagtctgggacgcgcgcgctgttgaggacagcacgtttgacgtggtcgcccagttcgcgaagactggattcgagacggtgattgagattcctgaagagctgggcagtccactttttcgcctggcggctttggatgccgagggtaatgcgttggggtacaccgaagtcctccagaaggatcagggtgtcgatgtggatgaacttcttgacctgcataattggatcgtggccgctgcttttattattagtgttgggggtctgttactcgggttgtatcaatgttgcggctgctgtcaaatccttccccgatgccgtcgtcgtccgaatgagtatcagctggtagcttttggtgataatgataacggtgagaacgatccagtctga

SEQ ID NO: 15755 - DNA, 324 bp, A.fumigatus
atgaccaggtcggtcaaacatacgtacctgtgccaccgcagaccaacctcgacttcgagagtgagtgcttcacgcagctcagctcagctagctagacgaatactaaccggcgcagtttctgtcgagaacaacaaggtctaccagacggtcactatgaacggcgaggttgtttcgcagcaatcagacggtaagcatcatccactgtcaagtagatcagcactgacagtatcagcgcttgacaacgaccttaaatatctctactcctcgaacgagtgctacaccggctcaggcaactgcggccttttgcagggttacagtatgtag

SEQ ID NO: 15756 - DNA, 228 bp, A.fumigatus
ttcctggtcagtgcagctgtacggataaagactaatagggcagaaatcaccaacgtaacggtcacactcagcgctgcggatgaatcgttcggcaagaccatggcgctattctcgtgtactgacgctgggtttgcgacgaccgataacggcaggacttggtatacggattatattgccatccaggagattgattttgattcttcgtcggatgccagtgtccaggaataa

SEQ ID NO: 15757 - DNA, 498 bp, A.fumigatus
ccaattcggggctctgggcacttttatcccgccaacagtgtattcctcgtcatggatttccttgaacatgatttaaaaaccttgctcgacgacatgcgcgaaccgttcctcccttcggaaatcaagaccctcatgcttcaaatcctttccggcgtcgagtttctgcactcccattggatcatgcaccgtgatctgaagacttcaaacctcttgatgaataaccgaggcgagatcaaaattgccgatttcggcatggcacggtactacggcgatccgccgccgaagctgacccagctggttgtaacgctctggtaccgttcccccgagctcctgctgggcgcagaaaagtacgggccggaaatcgacatgtggagtattgggtgcatctttggcgaattgctcaccaaagaacccttgttgcagggtaaaaacgaagtcgatcaagtatcaaaggtaaaacacccgctttcattctacattcagatccgttcgtgctga

SEQ ID NO: 15758 - DNA, 504 bp, A.fumigatus
  unsure (77),(95): Identity of nucleotide sequences at the above locations are unknown.
aacacccgctttcattctacattcagatccgttcgtgctgacagacacattcagatattcgctctcacggcctttcntattcagcaaacatggcntggtttccgttcccttcccaatggtaaatcatttcgccttccacctacatccacatcggggttgactgaaaaccctcccttacttccccgctcaaagttcccctttctcaccaattctggcctgcggcttctgtcgtctttactggcattgaacccaagtgcgcgcccttctgctcaggagtgtctctcacataaatattttcgggaggacccacgaccaaagccaaaggagatgtttccgaccttcccatccaaggcaggcatggagaggcgaaggcgtcgtgagactccagaggcgccgaagcgcggccaggaagctcccgccttggactttgccagtgtattcggtggtcaatccagtggcgataccggggaaacaggcgctggctttaccttgcgtctgggttag

SEQ ID NO: 15759 - DNA, 198 bp, A.fumigatus
cgggacctggcgggggctcttgaaatcggcgatggagttcggcccaagttttgttattccgatagcgtcaccatcacagccaggctgtaccacctccttcccgacttcatctcccaactcaacgctgatctaaacgttactcatcaacgacactattcacatcaatcggcaaaatctactggctttggattttcctaa

SEQ ID NO: 15760 - DNA, 753 bp, A.fumigatus
tccttcataggggccatgtccgccccaacaaaatcgcgttgggccgccgaagaccccgaggacgacgccatcatcgcccagcgaaaacgcgaaaaggaagagaagagacgcgccaaggcagagaaacaacgtcagctggaggagcaagcacgacttcagaccgcacaagccaaacagcagcagcaagcagacgcgctcaatggcgactcggaagctccgcccaagaagcgtcgccggctgtcgaacgaacagccccagacctccgcagtgtcggagtctgcagccaaagcgccggccgagcagacacgatcgaccctcctgcggtttcctgggcctgaatggggaccgtgtcggcttgtggataactttgaacggctgaatcacatcgaggagggttcgtatgggtgggtgagtagggcgaaggatatcaccaccggggaggtggtggctctcaagaagcttaagatggagaattcgccggatggctttccggtaacgggattacgagagatccagacgctcttggaagctcgccatacgaacattgtatatctccgcgaggtcgtcatggggactaaaatggatgagtatgctctcccttcctaccctctacccccaggctttcaatgtcctcttccagcattggtgctgcttccaccccgaaaagttcaagatacaccagtattaaccaattcggggctctgggcacttttatcccgccaacagtgtattcctcgtcatggatttccttga

SEQ ID NO: 15761 - DNA, 480 bp, A.fumigatus
taccgaataagatccgtggactggcacgcatggtgcaggtgtctccggaacatgactatggtagatctgactattaatgggctggcaccaggaaaatactgggcaactgtccgggaagcgggggatatctcgcgaggcgcagagtctaccgggggtatctgggaggccttgaaggctaaggtgatgggcgccgaggcgcccaaggagccgcgcggcgtgtttgggagtgtggatgtggataagcacggtcgggggaatgtcttcttggatcgaccggtggcgatttgggagctgattgggcggagtatggtcgtatccaagagtcaggaaggcccatttcaacgagaggaccctgatacattggtcggtgtgatcgctcgcagtgcgggtgtgtgggacaacgacaagacggtctgctcatgttccggaaagaatgtatggcaggagcgccaggaacaggtctctcagggaatgctgtag

SEQ ID NO: 15762 - DNA, 216 bp, A.fumigatus
ttcatgttcgtcataccaggcgtcaagagggtggaagcgaatctcaaagatcagctcgtcttaatcgagggcacagcgccgcctagctcgatagtcacagccattcaagctactggccgagatgcgattctacgtggaagcggcacgtcgaacagtgtgttatacctccccttcagccgacagacttgtgagggtggcactgatctggtggtgtga

SEQ ID NO: 15763 - DNA, 213 bp, A.fumigatus
aaggggagaccgtcaaggggacttgggcgagaagcggatgggggcctatatgggagaaatcggagtatcgtcagcacacctgatggctatttctcagaaagattcctttcagagacttacggaatgattcatacatggctgttgcaatctagttctctaggagcggaacgagatagcaagcaagacgtgttggagtctagatgggcaaaataa

SEQ ID NO: 15764 - DNA, 402 bp, A.fumigatus
caatttgcgaatccagaggtgcaagcgccggctttaagtactcccacggatgaaatgttctggtctcctgaagacccctcgaagcccaacctccagttcctgaaacagcatttctatcgggaaggtcgtcttacagaggagcaggcgctatggattatacatgccggaactcagattctgagatctgaacctaatctgctagagatggatgcgccgatcaccgtctgtggcgacgttcacggtcaatactatgacttgatgaaactcttcgaagtcggtggcgatccgtccgagacgaggtatcttttcctgggtgattatgtcgacagaggttatttcagcattgaggtgagagatgacttcctgggacgcttgatgatcggggaagctgatatcggctag

SEQ ID NO: 15765 - DNA, 291 bp, A.fumigatus
tgcgttttatatctctgggccctgaagatctggtacccgaacagcctttggctgctccgaggcaaccacgaatgcaggcatctcacggattacttcaccttcaagctggagtgcaagcataaatacagcgagcgtatctatgaggcctgcattgaatcattctgcgcgttgccgctggcggcggtcatgaacaagcaattcctgtgtatacatggtggcctaagtcctgaacttcacactctcgaagatatcaaatcggtacgttcaaagctgcttgaatgttccttttag

SEQ ID NO: 15766 - DNA, 210 bp, A.fumigatus
gtcctgaacttcacactctcgaagatatcaaatcggtacgttcaaagctgcttgaatgttccttttagttccttcactcatgtgagtctacagattgatcgtttcagagagcccccgactcacggtttgatgtgcgacatcctgtgggctgatccgcttgaagagttcggacatcttcaccacaggcggcgacggatccgcagtagtggg

SEQ ID NO: 15767 - DNA, 2064 bp, A.fumigatus
ctctacgtctgctgtattgactccgcgaatctgaccatatgtgacacaggtgctggtatcgcaggaattctgaaggctgttctggccatgcggcataagaccattcccccgaaccaacatttccacaacctcaaccccagcgtaaagccttctttcaagcacctttcaatagcgacttcaccccagccctggcccgttgtgcctcctgacacaccgctacgggcaagtgttaacggatttggctcgggtggtactaattgccatgcaattgtggaaagctacgtgcccgaaattcatgacaatggcccttggggaaagccaaaagagatgagacaggtccccaacggtgtcgccgcaccggagactgacttctcccctatacccctgattttttcagctagctccggaacagccctccgtgccatgctagagaggtatcaagagtatctggagaggaccgaggtgtcccttctacgcctggcaatgacgctcaactctcatcgttcgactctgccagtccgggtctcgattcctgggacctcgaaagctgatgttctcgcagcgatccggacgcaacttgccaaagtcggttcaaatcccggtgccgagattggtaccagatcttccgttccagagtttgaccacgtcagacgccccaagatattgggtgtgttcactggtcaaggagctcaatgggccggcatgggccaaggtcttatggcgaagagtgcgctgttcagacaagtcatcgaggtgatggaagaggcaatggcacaactccccgatggaccagagtggtctctgaaagaggagatcatgaagcctccaaaaacctcgcgcttgggcgaagccgagatttccctacccgtatgtgcggcccttcaggttggcctggtcaaggtgctccggagcgcaggaatcactttcagcatggtcgtcggtcactctggcggcgagattggttctgcctatgccgcgggcaaaatcagcgaggtcgatgccatcaagattgcctactatcgcggggtgtacaccaaactcgccattgggaaggatggaaagaagggcggtatgattgccgttggatttggctacgaagacggtctcaacttttgcgcgatggagcaattcgccgatcgcctcacggttgctgccagcaactcgcccaagagcgtcacactttcgggagacctggacgctgttcatgaggcaaaggaattgctggacgctgaaggcgtgttcaaccgtgtcttacggctcgacacggcgtaccactcgccccacatgtatccttgcgcggcgccgtatctggctgccatcgagcgctgcggtctggtggctggcaaatccaatggaacggcttgggcatccagtgtctacgacgataaccggatgatgacctccgcccaagacaaagacctggaagcggcatactggaaagacaatctgatcgggagggttctgttctcgcaagccgtggaacgtgccctggacgaggggaatggcgactttgacctcgcccttgagattggcccgcatccttcactcaaagggcctactctggagacaatcagacacaagattggctcggagattccttactctggcgtcttggatcgcaaggccgacgacatcttggccctgagtaccgctcttgggttctcatggctgacattggggtcgggggtggtcgactttgccgggtacgtgtctggatttgacccgagcaatgcttccatcctaaacgccccggcgttgcctgacctgccgacctatccgtgggatcataagaaggtcttgtatcgcgagtcccgtctcaacaagaatgtccgccacagggttgatccgcctcacccgctgctgggcagtagaacgcccgatgatacagattacgagccccgatggcgaaacttccttatcatggaggagctgccctggctgcgggaccattgtgtccaagaccagatcatcgttccggcggctacctactccgtgatggctctggaggccgccaagtcctttgcaggggtcttcaccacgcggtggaagatccgcaattggtat

SEQ ID NO: 15768 - DNA, 1143 bp, A.fumigatus
gtggataacgattcccactgtagcctcaacgccatggtctacacacactcaccaaaggagcccattgccatcattggcaccgggtgtcgtatccccggcggttcgacgtctccgtcgaagttgtgggatctactctactcgccgcgggatctcacgagagaagttcccgcggaatcacggttcaaccccaagggtttctacaatgtcgacggggaacatcatggggcaagcaacgcaaccaatgtgtacttcattgaggaggatccgcggtatttcgatgcgggattcttcagcatcgccccgcgcgaggccgaatcgatcgacccgcaacaaaggctcctgctggagacagtgtacgaagcgatggaaaatgcagggcttaccctgaatggaatgcgaggcagcgcgacttcagcctacatgggcgccatgtcggccgattacaccgatacccagctgagagatatcgagaacgtctccaaatacatgatcaccggaacctcgcgcgcactcttggcgaaccgtctctcctacttttttgactggaaaggcccgtcgatcagtgtcgacacggcctgctcgtcgagtctggcggccgtgcatcttggggtccaggccttgcgcgctggcgagtgtaccatctcctgcgtgggcggctccaatatcattttgaaccccgattgctaccttgccgcgaccagtctgcatttgctttcaccgacgggtcgctcacagatgtgggatcaagccgccgacggatacgcccgaggcgagggcgtgtgtgtcttcttcatgaagaccttgtctcaggcgctgcgagatggagatcggatcgacgcactcctgcgagagacatgcgtcaactcggatggtcgcacccagggaatcgccttaccgagtgctgaggcccaagtgtcgttgatgcgcactgcatataagaacgctggacttgacctctcaaaggccgaggatcgcccccagtacattgaagcgcatggtgagcccctggttatcgacaagtttttcgtgactaacccttttgtgtctctcaggaaccggtactcaagcgggagatcccagagaagcatacgccattgccaccacgtttttcccgcctggagaagaccacagtcatcgacctaa

SEQ ID NO: 15769 - DNA, 219 bp, A.fumigatus
aacccagagatgaagcaacctgctctaatacccggaaagaccgatgagtcgagagttggagagattttcggtatcagtatcgctttcacttgcaccaccgttgtcatcgttgttctgaggatctttacacgcctgaaatacgtcaaccagctcaggtcagatgactacattatccttggttcacttgtaagttttctgcccttgaattgcgttgattga

SEQ ID NO: 15770 - DNA, 456 bp, A.fumigatus
cttttctatgccgctgaaatcgcctattatgtcattgtcggagtgaccaaaatttccctcttgatcttctatctgcgcatcttcactacctcgagtttcaactttttgcggaagctgtcctacgtgctcttggtcgccatctcccttctcaccgtcatatacgtcgtcgtctgtgtgtttcaatgcaggccgattgcattggcctgggataaagggatgaaaggcacatgtattaatgttactgtctttttctactgccacgcggacctcaacatcctagcggacttctgcatctacatcatgcccatgccattgttctggacagttaagcgatcggccaaagaacgcgcggcccttgttggaatttttgccgtcggtggcttcgtctgtctcaccggcattatccggctgacctccttgaagacagccatggccagccttgacccttcttgttag

SEQ ID NO: 15771 - DNA, 384 bp, A.fumigatus
cacgtgaaactggatggagcagctctgggattttcattagctataggtcaagtctgctgttcccatataagtcggcgagcggctgacctccctaatatcagaacactaatcttacacagccaagatgcaattcagctccttaccgttttgccgctggcggcggttgcttttgctcaatgtaagttttcctctgttatcaactcgcagctaacgttactaggcgatgacgatgtggcagtgccaaaagctgtgtctctattgtcccagcaggaaatcttccttttgattgatccgtatgaacttgtggatggcaagctggactgttatgtcaacttctacttgcttgagccttgctcaattattaatggtagagttgaacgttag

SEQ ID NO: 15772 - DNA, 723 bp, A.fumigatus
actattcccaacgaaattagagcaaattgcgtgattgatagtggatcctcattatccccacctttcgataaatataaatcacggactctagtgactagtccagaacatcaaacttatgccaaacaacgtcaaagcacaatgacaagcccattctcaagtacgctggtctcgccggccgaattccacgccgccgtgaactcacccacaaacacccgacggatcgtccccgtagccgccggccggcgcacagtacacacccccgcctatcatgcccagcatatccccaactccgtgtatgtccccgcctcaaccacccagcaccagcatgctaacgagcgcagcttcttcgacatggatctcatcagagataccacctcgccatacccccagatgcttcccaccgccgcacacttcgcgtcctgcatagcagccgtcggcatcaccaaggacgacgtgctggttatctacgacgccgtagacgtggggatctacagctcgccgcgcgtggcgtggatgtttcgcttcttcggccaccaggccgcgcatgtcttgaacaatttccgggtgtatgtgcagctgggctaccccgttgccactggcgagatgcgtcctctcccgtctgtgggcgagtatcgtgtttctccaccggacagcgaccgggtgattgcctttgaggagttgagggagctggttttgggtggtggcgagggattccagatcgat

SEQ ID NO: 15773 - DNA, 246 bp, A.fumigatus
aaaagcttctattttcgccccattgtccagtctctgttgtctaacaagcacataagcacctgcaagatctcacgcggccagggagatggtgtgcctaaggcctcaataactgcccacctcacaactgaggcgtcagcgtctaatctactattgaaaggtagatgtagcattggttcatattcaatcaagctctccaggaaggcgcttaatcatcctacgattgtccatgtcatagatgtcaactag

SEQ ID NO: 15774 - DNA, 630 bp, A.fumigatus
aacacgatgtccacccccggcattggtggggatttccagttgttctcacctctcgagtctacgaggagaatatctcaaggaaactccttgtcagttgaccaatcaagtacggacgatgccagtcaggactggacacagtggatgcgatgggatgacgagcaagcatttccagaaactgcaaatgcttcgcctagctccccatttgaccttgcatttatatcgccaagtgcctcttctggacgggaggcatctgatgcgatgcacaaagacttctcacctgatatatctctagatttcaaaagcccttcgcttggatttttcccgggcggagatctgaataccaatgtatcccctcagccagatcatgttggtgcggggtcactgtcagtccactctaactctcccctctcgtcgattggtgcgagccgcaaacgcaagactggaagcgatgacgatggatctacgatgacaagcatgttcaaagctaaacaggcgccatccaagaaacgagcgcataatgtcatcgagaagagatacagagccaatctgaacgagaaaattgctgagctaagagacagtgtgcctagtctacgggcctcctacaagcagggcaaacggcaactccggtga

SEQ ID NO: 15775 - DNA, 2193 bp, A.fumigatus
  unsure (2152): Identity of nucleotide sequences at the above locations are unknown.
gagacagtgtgcctagtctacgggcctcctacaagcagggcaaacggcaactccggtgatgatgacgatgatggtgtcacctcagccagcaaactcaacaaagcgtccatcctctcgaaagcgacagagtacatacgccatctcgagattcgtaacaagagattggaggaagagaataccgcgctgaagatccgattacgtcagttggacaaggccgctgatcagattgttacctctgcggcgtcagtctcatcacccagcgactgtaccgtatctacagagtcaggggcgagctcatccccgagtgtgttctcgcacgcagaggacgttccgagtgatcactctccaacttcttcacaccctcccgaaggattgatcaaagttccggatgcttggaaacgcatgagggctgccggttcaaatgagagcccctactcgcaatcgtacatccaatataagaagaccgacagtcactcgtctcaatctggtggaggacgtatgcggtcgcaccttcccaataagtacatgctgggcgccctcgccgggctcatggtacttgaaggcctaggcacagaaaagaaaacagaatcaacggcaaaagggctgctggcggtacctttgaacctgttgaatagagttcagctgccgtcagaggtttactcaagcgcggcgttccagtacttctggtcgtcttggcacgcgcgcgcaatttcccactttctgatgcttgcaattcttgtcgttggtagcgcttttattgtcttcgtctatctgttcaattcagatccgaggcggcaatactccgcctccaaagtcgctcctgatgttacactttcgtcatgcaacttcagacgacaagcctggcttaccagcattcaacgagtcggtgtaccacgccataggttcttccacgagtggtacgttgttacatctcgatgttttgaatacgttttgcggtgtctactaggatggaaactgtattctttggtcactggcgtcaccgaagaagatgagaaagggcgcgtgaaaacttgggatattgcaatcgacgcgcaattggccggcggcgatgcagaaatcagcaaaagccgtctggtccttacgatatttgcagcaggaacacttcctcgaagcccgatgaggatgatgctgaaagctcttcactgccgcattctgatgtggcgggtcggtgagcctggttcgtggacattcaacgtatcgaatgatgttgcccgcagtctggccaggtatcaatgggatctcgcgcgcaagatgaacgctgcattacccaaggatcatccggattccttaccgagtcatttggccaccttgttaaagattgattgtgacgacgtcatgattgataccatcatccagcgagcagcaaatctgacttggaatcgtccaacgcaagaaggaaccgacgatgacgaagcgctactagatgtcgtcgaggaggaccccgcaattcaatcctcactggatgctcttgctgcttggtggtcaagtcacttgcttcaaggggctcttctcaggtatttcgaggcgagctctggtgggcctgacgcgaagaagagccgcaatgtcttcaaatccaagatcaagctcgctcttgatgtagcgccccagccatctgcagcccatacgcgtgcgctggtcatgatggccgtcttttttgaacgggaccgcgtcgccaacatcggaagcgttcttgccgcactcccgaaggaaaaaggcaagaacaaacaaaaccaagcttctaactttctcgactcttctttaccaatatccgtgcgggaagagatctcaaccgccgtccgatgcgccatgatcgcggcgatcttcaatgctcgagcaactggcgatacctctctaccagcaacgttcacagtagaaaaagcaatccattggtataatcgcctgccccttgacccagtcgagcttactctcctcgaattcgcggtggtttatcatcttctccatatcttggcgtcagacatcgactaccttgcttcgtcagattcgacggcgccgtcctccccgatgtccaaggcatcggacatgttgtcatcatcttcagatgatggtgaagacggtgcttcacagcgcaacaataatatcatccttcatcccatgccccaacttggcccgngttgcttccgagcttatttactgggctcgcattgcttataa

SEQ ID NO: 15776 - DNA, 864 bp, A.fumigatus
aagaatgtcgaagagttcattgaagagaccgactctcgtctgcaatgcaccaccctcgaacagaacgtcaaggactttggtctcacatacttcggcatgggagataagcgccagggtatcgttcacatcatcgggcccgagcaagggttcactctccccggtaccaccgttgtctgcggtgacagccacacctccacacacggtgcctttggcgccctagcgttcggtatcggcacgagcgaagtcgagcacgtcctcgccactcagaccctcctcacccgccggagcaagaacatgcgcattcaggtggatggtgagctgcctcctggcgtgaccagtaaggatgttgtcctgcacattatcggagtcattggtaccgcgggtggtactggtgcggtcatcgagttctgcggttctgtcattcgcggcctgagcatggaggcccgcatgtccatgtgtaacatgtccatcgaggccggtgcccgcgcgggcatgatcgcccccgacgagaccacctttgaatacctcaagggccgacccctagctcccaagtacgacagcgccgagtggaagaaggctgtcgccttctggtcgagcctcgcgtctgatgagggcgctgtctacgacaaaaccgtggttcttgacggcaaggatatcattcccaccgtttcctggggtacttccccgcaggacgttgttcccatcacgggcgtcgttcccggacccgacgacttcgaggacgagaaccgcaaggtcgcctggcaagcgtgccctcgagtacatgggtctcgtggctggcacccggatacaggacattcccgtcgacaaggtgttcatcggctcgtgcaccaacgcgcggattga

SEQ ID NO: 15777 - DNA, 189 bp, A.fumigatus
gtggcgcgaggccggctgctccatgtgcctgggcatgaaccccgacatcctctccccccaggagcgctgcgccagcacctccaaccgcaatttcgagggtcgccagggtgctggcggccgcactcacctcatgtcccccgccatggccgctgccgctgccatcaccggccaccttgccgatgtgcgtga

SEQ ID NO: 15778 - DNA, 1554 bp, A.fumigatus
ctcccaagtacgacagcgccgagtggaagaaggctgtcgccttctggtcgagcctcgcgtctgatgagggcgctgtctacgacaaaaccgtggttcttgacggcaaggatatcattcccaccgtttcctggggtacttccccgcaggacgttgttcccatcacgggcgtcgttcccggacccgacgacttcgaggacgagaaccgcaaggtcgcctggcaagcgtgccctcgagtacatgggtctcgtggctggcacccggatacaggacattcccgtcgacaaggtgttcatcggctcgtgcaccaacgcgcggattgaggatctgcgcgccgcggccaaggtcgtccgcggcaagaaggttgccgccaatatcaagcgcgccatggttgttcccggttctggtctggtcaagcagcaggcggaagccgaggggcttgaccgcgtcttcacggatgctggttttgagtggcgcgaggccggctgctccatgtgcctgggcatgaaccccgacatcctctccccccaggagcgctgcgccagcacctccaaccgcaatttcgagggtcgccagggtgctggcggccgcactcacctcatgtcccccgccatggccgctgccgctgccatcaccggccaccttgccgatgtgcgtgaacatttgaccgccagccctttgctggccaaggcccaaccccacctggacatccaggaggagcacgaggaccccacgacggaagacgagttcgaccgcatcatggacatgccggccgacaatgagccgcacgccaactcttccgccgccacggccgctgctggctccaccgctggcctccccaagttcaccaccctccgcggcattgccgccccaatggaccgctccaacgtcgataccgacgccatcatccccaagcaatttctcaagacgatcaagcgtaccggcctcggcagcgccctcttctatgaactccgctacaaccccgccgacggctctgaaaacaagtccttcgtcctgaaccaggagccctaccgcaacgccaagattctcgtcgttacaggccccaactttggctgcggcagctcccgcgagcacgccccctgggccctccttgactttggcatcaagtgcatcatcgccccctccttcgctgatatcttcttcaacaacaccttcaagaacggcatgctgcccgtcgtcatctccgaccccgccgtcctcgccaccatcgccgccgaggcctccgccggccgcgagattgaagttgaccttgtcaaccaggagatcaaggacgctgccggctccaagctcgcctccttcgaggttgacgccttccgcaagcactgcctcatcaacggcctcgacgacatcggccttaccctccagatggaggacaagatccgtgccttcgaggcaaagcgcaccctcgagaccccctggctcgacggcagcggctacctcaagcgcggtaaccgcggcggcgccaccatgatccaggccgcccccgtccccaaaaccaaccgtggagacgtcaagaccgagcctctggaatggtaa

SEQ ID NO: 15779 - DNA, 405 bp, A.fumigatus
cggcaaggatatcattcccaccgtttcctggggtacttccccgcaggacgttgttcccatcacgggcgtcgttcccggacccgacgacttcgaggacgagaaccgcaaggtcgcctggcaagcgtgccctcgagtacatgggtctcgtggctggcacccggatacaggacattcccgtcgacaaggtgttcatcggctcgtgcaccaacgcgcggattgaggatctgcgcgccgcggccaaggtcgtccgcggcaagaaggttgccgccaatatcaagcgcgccatggttgttcccggttctggtctggtcaagcagcaggcggaagccgaggggcttgaccgcgtcttcacggatgctggttttgagtggcgcgaggccggctgctccatgtgcctgggcatga

SEQ ID NO: 15780 - DNA, 474 bp, A.fumigatus
accaggagccctaccgcaacgccaagattctcgtcgttacaggccccaactttggctgcggcagctcccgcgagcacgccccctgggccctccttgactttggcatcaagtgcatcatcgccccctccttcgctgatatcttcttcaacaacaccttcaagaacggcatgctgcccgtcgtcatctccgaccccgccgtcctcgccaccatcgccgccgaggcctccgccggccgcgagattgaagttgaccttgtcaaccaggagatcaaggacgctgccggctccaagctcgcctccttcgaggttgacgccttccgcaagcactgcctcatcaacggcctcgacgacatcggccttaccctccagatggaggacaagatccgtgccttcgaggcaaagcgcaccctcgagaccccctggctcgacggcagcggctacctcaagcgcggtaaccgcggcggcgccaccatga

SEQ ID NO: 15781 - DNA, 570 bp, A.fumigatus
cgtacgttagacgcccttcattccgcctactgtcacaattcgctaactgatattcttagtgccatttgcttacccatcgccattatcctgtggagtgtcggtttgcttgttttcttcggcttgccgaattactaccggcagatacccgggaaagtcccatccttctacaagtctgtcttccggcgaaagatcgttctgtggaacttcgtcgttgtcatcgttcagaacttcttcctgagcgcacagtatggacggaattggagctgtaagtcgtcgaaccatgggatattgcaatatcctcaagggcagtggctgatatttctcactttctccctgcaacagttctgtggagctccaagaatgcggaagcctggcaggtgggaattttgtgtgcctttttctttggcgctgtctgggccgcgctgctgtacttgttcggttacctatccaagtctcatagctggatcattccagtgttcgcctgcggcttgggggctccacgatgggcccaggtgctttggggtgtctcagggattgggctgtatgttccctgggctggcggggacttag

SEQ ID NO: 15782 - DNA, 594 bp, A.fumigatus
gtgcggccgccagcaccctggcgaccctcgaaattgcggttggaggtgctggcgcagcgctcctggggggagaggatgtcggggttcatgcccaggcacatggagcagccggcctcgcgccactcaaaaccagcatccgtgaagacgcggtcaagcccctcggcttccgcctgctgcttgaccagaccagaaccgggaacaaccatggcgcgcttgatattggcggcaaccttcttgccgcggacgaccttggccgcggcgcgcagatcctcaatccgcgcgttggtgcacgagccgatgaacaccttgtcgacgggaatgtcctgtatccgggtgccagccacgagacccatgtactcgagggcacgcttgccaggcgaccttgcggttctcgtcctcgaagtcgtcgggtccgggaacgacgcccgtgatgggaacaacgtcctgcggggaagtaccccaggaaacggtgggaatgatatccttgccgtcaagaaccacggttttgtcgtagacagcgccctcatcagacgcgaggctcgaccagaaggcgacagccttcttccactcggcgctgtcgtacttgggagctag

SEQ ID NO: 15783 - DNA, 480 bp, A.fumigatus
tcagagggcattggcaaacaaaaaaacttggaaaaaattcatttgttcgggggggtttttcttcccgtaacatataagttcgggggtgatccttctcggtttccagggaagttaaaagggccatggcgttatgtcatatatcggaggggcgcatctcgcaaagcatttcattcagtcgcgggtgattccagaaagggggaagcggattgtacgttgttgctgcctccagggggctccattttctttgccgtgaatttcggtgatgagaatggagtgcctgtcaaacagtgggttttccgtgcatgtgtcattcaaggcacccagcaggcttatgtgatcggcctgtggtattggggaaccagccttgctcaagcaagtaacagtggcattatcaatccccagggcgatataacaaacacttggaggataacgtacgttagacgcccttcattccgcctactgtcacaattcgctaactga

SEQ ID NO: 15784 - DNA, 588 bp, A.fumigatus
gtcgtcgaaccatgggatattgcaatatcctcaagggcagtggctgatatttctcactttctccctgcaacagttctgtggagctccaagaatgcggaagcctggcaggtgggaattttgtgtgcctttttctttggcgctgtctgggccgcgctgctgtacttgttcggttacctatccaagtctcatagctggatcattccagtgttcgcctgcggcttgggggctccacgatgggcccaggtgctttggggtgtctcagggattgggctgtatgttccctgggctggcggggacttagccggggcccttgtttctcggtccctgtggctctggcttggagtcctggattccttacagggccttggattcggcatgatcttgcttcagaccttgactcggatgcacatctgcttcaccctgctggcttctcaagtgctaggttcaattgcgaccatttgcgccagggcttttgctccgaacaatattggtccgggcccgatctcaccagacctgacggccggagtcagctcggttgccaatgcttggttctggattgccattttttttcagctgctaatatggtaa

SEQ ID NO: 15785 - DNA, 1401 bp, A.fumigatus
agacatttaccattccagaggctcggtcttgacgtctccacggttggttttggggacgggggcggcctggatcatggtggcgccgccgcggttaccgcgcttgaggtagccgctgccgtcgagccagggggtctcgagggtgcgctttgcctcgaaggcacggatcttgtcctccatctggagggtaaggccgatgtcgtcgaggccgttgatgaggcagtgcttgcggaaggcgtcaacctcgaaggaggcgagcttggagccggcagcgtccttgatctcctggttgacaaggtcaacttcaatctcgcggccggcggaggcctcggcggcgatggtggcgaggacggcggggtcggagatgacgacgggcagcatgccgttcttgaaggtgttgttgaagaagatatcagcgaaggagggggcgatgatgcacttgatgccaaagtcaaggagggcccagggggcgtgctcgcgggagctgccgcagccaaagttggggcctgtaacgacgagaatcttggcgttgcggtagggctcctggttcaggacgaaggacttgttttcagagccgtcggcggggttgtagcggagttcatagaagagggcgctgccgaggccggtacgcttgatcgtcttgagaaattgcttggggatgatggcgtcggtatcgacgttggagcggtccattggggcggcaatgccgcggagggtggtgaacttggggaggccagcggtggagccagcagcggccgtggcggcggaagagttggcgtgcggctcattgtcggccggcatgtccatgatgcggtcgaactcgtcttccgtcgtggggtcctcgtgctcctcctggatgtccaggtggggttgggccttggccagcaaagggctggcggtcaaatgttcacgcacatcggcaaggtggccggtgatggcagcggcagcggccatggcgggggacatgaggtgagtgcggccgccagcaccctggcgaccctcgaaattgcggttggaggtgctggcgcagcgctcctggggggagaggatgtcggggttcatgcccaggcacatggagcagccggcctcgcgccactcaaaaccagcatccgtgaagacgcggtcaagcccctcggcttccgcctgctgcttgaccagaccagaaccgggaacaaccatggcgcgcttgatattggcggcaaccttcttgccgcggacgaccttggccgcggcgcgcagatcctcaatccgcgcgttggtgcacgagccgatgaacaccttgtcgacgggaatgtcctgtatccgggtgccagccacgagacccatgtactcgagggcacgcttgccaggcgaccttgcggttctcgtcctcgaagtcgtcgggtccgggaacgacgcccgtga

SEQ ID NO: 15786 - DNA, 195 bp, A.fumigatus
gaggatgaacggacttttgggtccagccagataggggggtgttgtcaaaacggccacacagcgctggccttgggtcacacaggtacaaactgtgtcattttagctgcctggggagagggctttgtctgtcatatcgatggagagggcagcctatcctcggattttcagagccacaacgatgcggtgaagtcgtga

SEQ ID NO: 15787 - DNA, 252 bp, A.fumigatus
agcaatccgacagtcagccactccggttctcaactggcagtgagtcttttgcacatgacagtaacctatgattatgctcatctctctggaaactatcctttgtgcagtgacctgaaagagattaagcacttcttggcctctaatccccaacactgggacggtcgctccagcatgactggctgggattctctccagctgacctcattctcaacggtcaccatagtacagatggagtacaaactgcgtcggtaa

SEQ ID NO: 15788 - DNA, 342 bp, A.fumigatus
tgcgaatcacaaagggaaaagggagaataccaagccaccaaccttcgccacagtggctccagtaagcttcggctgcactcgatcagccacaatgaccagtccctctctgaaactgttttgttcacagtggatctgacaatcgatgcgcaactcttgagaaactacggagttcagaccaagtgtcatcgaagctccggtattctaggccttcgcgctactcatggctgtacgaagctgttttcttcgtgcatcgaatctggggctgtggctcagaaggatcttcctgtgttgattttgagcgcactgtccttcgttcctagcgagtcaaacttgcgcttctga

SEQ ID NO: 15789 - DNA, 189 bp, A.fumigatus
tccttcactgtgaccatgagccaatccatgttcgagactgcagcctatgcgactggatactgttcagttgttcagttgaccagagtagtatgccagtaccttacgactttgaagatgccaataaacctgcccactagcaacagttcctcttcaagtgtctcctatctctccgagtatgtaaaagtctag

SEQ ID NO: 15790 - DNA, 699 bp, A.fumigatus
ccggcttcggtctctcaaacatggaatatcctcccgtcaagttcatcatcaaatgctttgaagcaaattaccccgagtcactgggtgtgctactcattcacaacgccccatgggtgttctcaggtccgtttgttcctattgcaggtggagtatcaactgacgagaccaggtatctggcgcctcatcaaaggctggatggatcccgtcattgtctctaagattcaattcaccaagaccatcgctgatttggagaagttcatcccccgtgggcagatcatcaaggaactcggcgggaccgaggactggacgtacgagtacgtggagcctgacgagaacgagaacgaccgcatggaagacacaacggcgcgtgatgcgctgctggcccaacgcgccagcatcggcgacgagttactcaacaccacgtccaagtggattacagccatcaagaacaaggatgaggaggaggcagcagctgccaagactcatcgggatgcattgattgagcagttgcggttgaattactggcaactagatccgtacgtgcgtagtcggaactatctggaccgaacgggggtgatcaaggttgggggcaagatcgacttctacccaaaaagccaaccccagtcggatgttgaggtggccaaggtcgtggaggttgagcacgtggaacagactcaggtgcaggttgttaatgcctga

SEQ ID NO: 15791 - DNA, 825 bp, A.fumigatus
ccggccggacctccctccagacattcttcgactgagaacttgactctgacaatggcgcactcgaacgtccccgaaggattcctcggaaacctcaccgcagatcaacagaagaaactggagcaattatggacaatcattctgactctgtcagacgctctgacatctaccaccacgatagacacaaatgagcctcagcacagacgcaactcctccctcgctcggaccaacacgacggcctcaaagggtagcaccgccactacccctacttgcgctgctcaggtctctcagcacctccagagactcgggctgcacgcgcccgagatcaaacaagtccaacacatcctcacccagattacaccggaggaaattcgagacggtctcctaagcaccgcaaaacacgatcacccagatgcactgctcctgcgcttcctgcgcgcgcgcaaatgggatgtcaccaaggcatttgtcatgatgctagatgcaattctgtggcgaatgaaggacttccacgtcgacgaggaggtcatcgccaagggtgagctgcatgcgctcaaggcgtcgcgagatacatccaacgctgttgccgcaaagaacggaaaggattttctggcgcagatgcggatgggaaaggcgtacgtgcacggtgtcgatcggctgggccggcccatcgtcgtgatccgggtgcagctgcataagcccggtgcgcagagcgaagagacactaaatcaatttatcatccatgttatcgagtctgtgcggctgttactagtgccgcctgtggaaactgctgtaagcaatcgctttctggtggatggacagaactga

SEQ ID NO: 15792 - DNA, 246 bp, A.fumigatus
cgattgcaggctgttgtcttcgatatgaccggcttcggtctctcaaacatggaatatcctcccgtcaagttcatcatcaaatgctttgaagcaaattaccccgagtcactgggtgtgctactcattcacaacgccccatgggtgttctcaggtccgtttgttcctattgcaggtggagtatcaactgacgagaccaggtatctggcgcctcatcaaaggctggatggatcccgtcattgtctctaa

SEQ ID NO: 15793 - DNA, 204 bp, A.fumigatus
tgtgcagtgacagaaatgtcagtcaaagaactaggggcgaggttggcatccctcagatgcctggccaggctgcagcggtcatggatacctatttttctcttcgtgcacaacaatggtattgctattctatccctgagcgtgtttaacgcctgcgcagtaaaagaccccggtaacatctctgggaattgcgtcttttttttttag

SEQ ID NO: 15794 - DNA, 342 bp, A.fumigatus
aagggaagcggctcgatacaacagctgtttttagtcattatggctacggctaccgtcgaactgccttacctcgcgagccattacgctattgcggagtcaacacttactacccttacccaagctcccacggtcgagctagtcaaccagttgctggaggccattaccaaaaaagctcatgaatatgatgagctcaaatccgacaagcttcgtttggaagtggagcttgagaatgcggttcgcagcagcgactcaaagatcaaggtgctgaaaagctctgtggaaaaaagccatacggaagttgaggaggcaagaaagaaactgcacgagtcaggtgggctctga

SEQ ID NO: 15795 - DNA, 960 bp, A.fumigatus
cctacactttctgacacctgtctagaaaatgctcgttcggccctagaatccgaaatcgcgacgctgaagtcctcgactacttccaatgagtccgaagtcaacactctaaaatcccgtatttcctcgctcgaagcatcaaacagggataccctaggacttcttgagtcaaagagtgctgcttacgacaaacttgcggaagaactttccgcccaacacaagaggacaattgaattgagacgcgagctggctactgccgaacaaaatcttcaggcggccaactcggcatcggccagcgcccgctttcgtgaacagagcttgcagcaggagctggacttgacgaagaagaacaacgaatggttcgagacggagctaaagacgaaatctgcagagtacctcaaattccgcaaggaaaagaccgcccgaattgccgagcttcaacgtgaaaacgaggaagcaaactcaacaatcgactcgctaagacgcagtgaaaatgctctcaaaagccgtttggatgaggtcgagcaacgatacgaggagtcgctttcgagcatccaacaactcaaggaggaggctatccaggcggctgagtctttcagaatcgaactggatagcactaatcgtctggctgaattgcaaggaaatgccgcgcagactgccaagcagcgtgtgcaggagtgtcagctcgctctagaaaaagcaagagacgatgcggccgaagagatctctcgactccgcgttgagatcgaaacagagcacgctgacaaggaggctgccgaacgccgtgtcgctgaactagagttgactgttactcaattgcagtcggaaggtgctactgcaggaagatccatgagcccggctcgtggcttgaatggtacaggacccagtacgcctgtccgtcctggaactcccagtggcgcattctcgtcttcaccacggggctggaaggatccgcggtggtcg

SEQ ID NO: 15796 - DNA, 960 bp, A.fumigatus
aataagatctccctggcccttggagccggacgccgcctcaatcatcaaactttcacgtctgtcacgtcattaccagccattgcaatcatgtcgctccagcagcagctcaagagtttcaacgcaagcgttaccgactatgcgaaccgtatgccccagcagagaaggtttgtccacaacggctcgacaagcacttctcaggtaccatcatccacctcaacaccaacaccaggtagcgacgcacagcggaagaggcagaatgcagacatcgtgtactcgcagcctgccaataccggcacgggcaaggacatcatgacacaggtgctctttgcagttgaacacttgaaatcgaagggcgttccgctcaggtattctgatatcgtgtcgtacctctctctccagcaccgctcaagcgacgaaggctaccttcaggcactacggcgaatcctcacgcagcacgaaaaagtcttatatgatcctagtggcgcgaacggggagggtacatttgcttttcggcctcctcacaacatccgcaccgcagagcaactcctgcagaagctacagtctcaaactactgctgccggtatgagcgtccgtgagctccgggagggctggcccaacgtcgaagaaacaatcaacagactggagaaagaagggaaattgttggtcactagaaacaagaaggatgatcatgcgaagatggtctgggccaacgatccctcgctagtgcagcatttcgatgaggagttccgccagatctgggcgaagatcaaagttcctgatcaacaggccgtcaaggaggagctggggaaagctggtatcacaccaacaagcaagaacaagatcgtcaaggtacggccaaaggtcgagcagaaaaaggtcaagaaacctcgtcgcagtggcaagacgaccaatacccatatgatgggcgttctgagagattattcgcacctcaaacggtag

SEQ ID NO: 15797 - DNA, 207 bp, A.fumigatus
gagaataacatcgagcttctcaaaaagaatattatcggagtgaaggtgaggattgagcggttgcaggggaagtttaagatgagtcaggagatgggggcgggggaccgggagggggttattgaggggtttgagaagctggggacggaggttgggatgggcatagcaaagacggttaaagagaggggggacatgaaggataagaaatag

SEQ ID NO: 15798 - DNA, 570 bp, A.fumigatus
gaagataatgatcgtatatgcaagctcttcattgtctatgacagtaatcaaaacccatttcgcaatttgatcccactggcagtaaaggatccccttctgctcagcacggttcttgctctcgcagcaaggcacagagcaaatgaaggccagacctttaatggcatggaagcaccagttccttggactgacaatgcccaacacaatgcacttgttttcaaacatcaggcgatacatggcctgtctcaaatcgtcggggatccagagtcgtgcagatcagatccgactattgcgagcattttccttctcatcttccttgatctggtagagtcaggcaacgatcggtggaatgcccatctggaaggcgcaaaagctctcttgtctttgaacaagtcgttgtcgcaagtccacgatcctggccagacagtacaggaaatacggagcttcatcactaaacagatttacctgtatgtacactctgctctgaacctttctgattctaacacgaaacagaatcgagacacttggtgggacctttgtacggccgaacctattatcaaattttcctgctga

SEQ ID NO: 15799 - DNA, 1419 bp, A.fumigatus
cataaagttctgccgactgaaaagatggcaaagttcactatatattacagaatcccatcaacccgcctggtacagtcccaaagcacggatatgaggattcagtatggtcaggttgtacggtgtcacaaacatatctgtgtccgtgagcgcaataaaagccgtgccgttcaaggctgggtctgtctcaaagacctcactggccggctgataggtatatcccttattctgtcctgttaccttcagctcggtataggtcaagttcagctgcgacaaccaagccacgaacgagggcttgcccgctgtcgtggaagtgacgtagctgttgttcggcccaacggcacgacctggctcatcccaggtaagctcgactttgcgcccggggaatgtgagcggatcgtacttgtcgcgagaaatggcgggtccgcaattataacccgtgacattgttgtggacacaggactggcccgctgggattgtcgaattgcttggatcactagtgcggtttccgacaacttcccatgctgcggtagcattggcgttgatgcggttggggttggcttggttgaccacatgcaagttggggaagttctgccagaccagccgagtgttgttcgccgggcaggacgaaatgtactgggccagcagtgtccagtgccaggattgcgggataccggcagcgaaccatatgggcatgggttggaggccaagaagctggcggaagatagactgctgccgggcctcaatggcttccgcttcgacgaccagggtcgcgacctccttagagtcgagatggctcgactagccccaggtcccggactcgccccagcgggtgagcttgacgttgaagtcgatgaactcgcggaccgtcttgaaaggatagttttatgtgcactggcgtggggcagactcgcccagcatgttgctcatgagggtggcgtggccggcctcgtgcgtggccatgtattcgatcaggcggcggtcctcgacagtgagaccagcatcgagaaagtcctgcgcgctgaagacttcgagaccatagtggaaaaggtccagctcgatatattcctggtggacgcccagagccacggactggtagtcaaaatcgctctgcaccatgtacacgggcacggtgccattggttcccacgccgccggcgggcatgtatggcatcggcattggctcagtcaacttgccattgggattgtagtacgtggcggttgggttgggctgaatggggatagtggccgccagcgtggaaggatactgctcagcaccggtggtggtaggggtgccagagtaggcaccgtgggtggtgacgccagtcgtggcactgttgacgagcggaggagccgcaccgggctcattcccacggggcggttgggtctcaatggcgggaatgttgataacctttgtttctga

SEQ ID NO: 15800 - DNA, 492 bp, A.fumigatus
tccaatgctgaaggaatcactacatcagaggcacaatatgattcgaatggatttgcaagaaactccatgtccttccctgaattaacaggaaataccttccctcgctttggtacaaccggctttggggaggccatggacgctgacgcggagactactttctctattcggatgcaaccgaaacagggccgacccggaagtaacctgaatcatgaagtgcgaatgagtctgaagaatgccatggtgaaatttattactctgactacggtgcaatcatatcttggtctcgaagatgtcttccctatctggttgccaagcatgtacgtcatagtcatcgtggacactctcatctacctcgggacatctctatatcaatctgggaactcgccccgagccaacacacttggaacgaggggaaaaaccgtgccttacaaggttggttggttttgcgaacaaaacatttttgatgccccattgcatggatggctttttctt

SEQ ID NO: 15801 - DNA, 711 bp, A.fumigatus
tcgttgtcacatggcaaagctgctaccagttcgagaccaacgactataaaagcagccaagcgccctgtgaactgcaaaccgtcagctgtgagccacagactttcaacgatcaagatgaagtccctcatctggatccttgccggctctgccgcagcagtcccccttgtgtccaactcagaaacaaaggttatcaacattcccgccattgagacccaaccgccccgtgggaatgagcccggtgcggctcctccgctcgtcaacagtgccacgactggcgtcaccacccacggtgcctactctggcacccctaccaccaccggtgctgagcagtatccttccacgctggcggccactatccccattcagcccaacccaaccgccacgtactacaatcccaatggcaagttgactgagccaatgccgatgccatacatgcccgccggcggcgtgggaaccaatggcaccgtgcccgtgtacatggtgcagagcgattttgactaccagtccgtggctctgggcgtccaccaggaatatatcgagctggaccttttccactatggtctcgaagtcttcagcgcgcaggactttctcgatgctggtctcactgtcgaggaccgccgcctgatcgaatacatggccacgcacgaggccggccacgccaccctcatgagcaacatgctgggcgagtctgccccacgccagtgcacataa

SEQ ID NO: 15802 - DNA, 741 bp, A.fumigatus
tcgagccatctcgactctaaggaggtcgcgaccctggtcgtcgaagcggaagccattgaggcccggcagcagtctatcttccgccagcttcttggcctccaacccatgcccatatggttcgctgccggtatcccgcaatcctggcactggacactgctggcccagtacatttcgtcctgcccggcgaacaacactcggctggtctggcagaacttccccaacttgcatgtggtcaaccaagccaaccccaaccgcatcaacgccaatgctaccgcagcatgggaagttgtcggaaaccgcactagtgatccaagcaattcgacaatcccagcgggccagtcctgtgtccacaacaatgtcacgggttataattgcggacccgccatttctcgcgacaagtacgatccgctcacattccccgggcgcaaagtcgagcttacctgggatgagccaggtcgtgccgttgggccgaacaacagctacgtcacttccacgacagcgggcaagccctcgttcgtggcttggttgtcgcagctgaacttgacctataccgagctgaaggtaacaggacagaataagggatatacctatcagccggccagtgaggtctttgagacagacccagccttgaacggcacggcttttattgcgctcacggacacagatatgtttgtgacaccgtacaacctgaccatactgaatcctcatatccgtgctttgggactgtaccaggcgggttga

SEQ ID NO: 15803 - DNA, 291 bp, A.fumigatus
agtccctcatctggatccttgccggctctgccgcagcagtcccccttgtgtccaactcagaaacaaaggttatcaacattcccgccattgagacccaaccgccccgtgggaatgagcccggtgcggctcctccgctcgtcaacagtgccacgactggcgtcaccacccacggtgcctactctggcacccctaccaccaccggtgctgagcagtatccttccacgctggcggccactatccccattcagcccaacccaaccgccacgtactacaatcccaatggcaagttga

SEQ ID NO: 15804 - DNA, 585 bp, A.fumigatus
attggtagtatccagaagaacccgcgcgaacccacctttttcacgaaccgtgcactcacccggataaggctggagaaatgggcaggcgtggaacacgatgcacgcacggcgattgagctatacggccccaagaacacccagagcctcaagagctgttggtacctcgcgcaggcgctcctgggcctggggcgcccgcaggaggcgtacgaagtggctattgatgcctaccgggcaagtctggcggccaagagcgcgcagacggagaatctgtccaagacggtcctgcgggccaagcaacagatctgggctgcgaaggagactgcccggctgcgggagatgaatgataccctggcgacggtggagtcgttgatcgaggccgatctcaacagggagcttgcggagctgcaggcgaaactggacaagggagagatcgggcagacggggtttgtggaggatcagaaggcgctccgtgcggatgcggaaaaaaatattcaaaacgtccgggacgcgttccgcattgcgtccaacggggatatccaggagagggtaagtggcagttcctcgtgggagagtgttccttgttga

SEQ ID NO: 15805 - DNA, 198 bp, A.fumigatus
tacggacaggccaagttcaagtataatgcctggaaggagattagccacatcagtgcgcagaaggctcaggcgctgtatatcaagcaggtgaatgatttgattaacaagtacggaccccgggcgtatattgacacggtgttggtggggatttgggaagccattgttattggaagatattcccttcttttgggggtttaa

SEQ ID NO: 15806 - DNA, 639 bp, A.fumigatus
aaggcgccagaatccccttcggtaatcgttcaagtggattcttttcatcggacctacgccgtatatcagcgtctctcgcctctcgtctctcgtctctctatccacacccattctactttgcttctcccatctggcttctactctgtcatcatgtctaccgatctgaaacctctccgcatcgtcatggcctgtgacgaggccggccagccctacaaggagatcatcaaggccgccctggagaagaaccccctggtcgagtccatcaccgacgtcggtgtcaactccacctccgacaagaccgcctatcctcaccctgccgtcgccggcgccaaactcatcaaggagggcaaggctgaccgcggtctcttcatctgcggcaccggtttgggtgtcgccatcgccgccaataaggtccccggcatccgcgctgtgaccgctcatgactctttttccgtggaacgttccatcctcagcaacgacgcgcaggtcctctgcttcggccagcgtgtcatcggcattgagctggccaagaagctcgccaacgaatggctcacctatcgcttcgaccccaagagcgcctctgccgccaaggtccaggccatcaccgactacgagcgggaatttgctgctgctcagtag

SEQ ID NO: 15807 - DNA, 216 bp, A.fumigatus
ctgatgaatggacaatacgcacttggccaagagcagcaagccgaatctatcgagtcaaattactgtgaaagtggggagtggagcatcgagtcgaagttcttgaagctgagactgtcccatcttgatattacacagtacaagctgcgtccatcatgccctttttccgacatggatactcttgcgcggtggattgtccttcgctgtcaatcctcataa

SEQ ID NO: 15808 - DNA, 234 bp, A.fumigatus
gttgtgcccgactacctggttgacgggattacttttgagatcatgcatgatcccgttatcacacccagcggcaccagcttcgatcgcatcggaatcatcaagtacgtcgaacagtccggcgtggaccctatcacccgggtgcccatgaccgtcaacgatctgcggcccaactatgccctgaaagctgcgtgcgaggagtttctcaacaagaacggctgggctgtagactggtag

SEQ ID NO: 15809 - DNA, 483 bp, A.fumigatus
gaagtctgtttatttactccctgctgccccaacggattctatcacgtccaaccccaccatccatcccacctccgctatttttcaacccctcacaccacttcccctaatctcaagctgccacaacagaacactctacccaatctattttatcagctgtccataaaacaaacagaaagaaacaacacaatggcctcccttaccgacttcttcactgccttcgacgccgctgcctccaaggagaaattcacccccgccctgcagtcggctgccgcctccatcgacaaggccgctctgcaggctgcgcttgacgccgtcctcgccggcggcgacgacgccaccgcagccgggaacgatgccgtcctgaaggccggtttcgagtttgccacggaactggttaagatgctcgagaaggagcccgggccggaggagaagttgggagtatgtcctttttccctgcacacccccttgggtataacagagtga

SEQ ID NO: 15810 - DNA, 357 bp, A.fumigatus
tccagaccacgcttgacaatgttctactccgagaccctgctgtccaagacggggccgctggcccgcgtctggttgtcggccaaccttgagcgcaagctttcgaaatctcatattctgcagtcggatatcgaaagcagtgtcaatgccattgttgatcaaggacaggctccgatggctctacgacttagtggtcagctgctgttgggtgtggttcggatctacagcagaaaggcccgatatcttttggacgactgcaacgaggctttgatgaagattaagatggtaggtttgattgctctctccgatcaatgcttgccaagctttactgatatgtgtggttctaggcgttccgtttga

SEQ ID NO: 15811 - DNA, 504 bp, A.fumigatus
ccaacccatcggctcttcacagcaccagacgcacggtccacagtagaactgagcactgccgccgaagatgcgctggccggagaatttgcactaacccgcgagagtctggcattattggcaatattaccgattcggagaacggttcgggcggcggggcccgatgtcaaagaggagatatcgttgtggacctcgaatggttccgggcagtcgaaatgccacatcttggtaacagccatgtggttgagcgtaagagtgcctgttttgtcgctgcacaccacgttcactgatcccagggtctcgacgctcggtagccttcgcatgatcgcacctcgcttggccatccgcagcacacccagagccagagtgacggtcacaatgatcggaagtccttccggaatggcagcgaccgcgagagaaacaccgatggtgaacatctcaaggagctttcgaccctgcactaacccgatcacaacaatcaacgcgatcacaccaaaggagatatag

SEQ ID NO: 15812 - DNA, 1557 bp, A.fumigatus
gcgttccgtttgacaaacaataatgagttgacttctaccgttgtcgctcctggcggcatcactttacctgatgtgcttaccgaatccgatttgtttatgaacttggactcctccttgcttctgtcacagacccttaatctggaaccagaaggcaaacgccagggacactcgatggattttggaagtcaacttctacctgatagtagcttccgacgatctgtttctcaagagcctccacgcttggaggaccacacattagttgatttgaactttggcgatgatgatgatacccatatcggccgtgacttcagcatggaagttggtcgagatgctcccgctccccgcccatttgaagacgaccttctcagtgacgccggcaagttcaacgacgttgacttgcagctggacctcggtgaggatgacgctcctctggataagatggatctcggtgaagatggagcccaggaccacttcaatttcgatgaaactttggatatcggtggcgacgaggagctcacacgtgaagctgaagaacgccgacagcagcgcgactctgaatccgcaatgacggaactttccgaagaagaactcaacagactcgaggcagaagatgtacatttgtcgaagggaggacgagggattcttgacgaggagtacgccgacggagaacacgaagatggcgaacagggtgatgacattaccgttcaacaagcacaacgtgccaagcgacgaaaggtgatgccggtcatggatctggatgaggccatcgactttaagccgagtcatattaaagaacaacaggcagatcgatctggaatcttgaaaccggcagcgttcttgcctcgggatcctgttcttcttaccttgatgaacatgcaaaagaacggcgattttgtgtcaaacgtccttggcgcgggccgcggacgtggttgggcccccgagcttcgcgatttactttcattcgatgccattaggaaggcaggtgaattgaagagaaagcgcgatagcggcatcgccgatatggatgtagccgcagccactgcccctgctctggaattcggcgaggaggaagccatcgtgccggtggatgaaggagttggtctcgactcgacccttcaccagcggtcggagattgagtttcctggagatgaagaggaacagggactgcatatgagcgacgatgagggcatgcatctccctgtggaagagatggacgatacaactgtgcaccccgtggatagcggcccggtctccgttggtactaagcacgccgtccacatcctccgcgacgcgttgggcgagtctgccgccgatcaaaagaagagcgtcaagttccaggatctgttacccgagaagagaacgagcaaggctgatgccaccaagatgttcttcgaagttttggtcctggccaccaaggacgcagtcaaggttgagcagggtactgactctgttggcggtcctatcaagatccgtgggaagcgtgcactctggggctcatgggcggaagagaatacgagcgcggaggctgctagccagcccactgaggtcgcggcctaa

SEQ ID NO: 15813 - DNA, 480 bp, A.fumigatus
acggtaatgtcatcaccctgttcgccatcttcgtgttctccgtcggcgtactcctcgtcaagaatccctcgtcctcccttcgacaaatgtacatcttctgcctcgagtctgttgagttcttcttcggaaagttccgtcattgcggattcagagtcgcgctgctgtcggcgttcttcagcttcacgtgtgagctcctcgtcgccaccgatatccaaagtttcatcgaaattgaagtggtcctgggctccatcttcaccgagatccatcttatccagaggagcgtcatcctcaccgaggtccagctgcaagtcaacgtcgttgaacttgccggcgtcactgagaaggtcgtcttcaaatgggcggggagcgggagcatctcgaccaacttccatgctgaagtcacggccgatatgggtatcatcatcatcgccaaagttcaaatcaactaatgtgtggtcctccaagcgtggaggctcttga

SEQ ID NO: 15814 - DNA, 2178 bp, A.fumigatus
acgtccacatcgacatactccctattaggtcctgaagaaaccgcggaacgcctacagacatctctccttcacggacttacaccggcagaggcggagatacgattattgcgagatggtccaaacgaactgccgcatgaggaaccggagcccttgtggcttcggtttctcaaacagttcaaggagacactaatccttcttctgttggcgtccgcggccatctcattttttatgggcaattacgatgacgccgtcagcattaccctcgctgtgactattgtggtgaccgtcgggttcgttcaggagtacaggtctgaaaagtccttggaggcattaaaccgtctcgtgccccatcacgcacacctcatccgcgacgttcccccgtcgagcgctcctcttatgaataactctacaactgctgctttagggccggatatcgaactggaggatcttgcgagcaagagccccagctcggcatcggcggctatcaaagcgtcgagtacggttctggcctccgaacttgtcgccggggatttggttctttttaccacaggcgaccgcattcccgcggacatacggattactgcagctactgacttgaccatcgacgagtcgaacttgactggcgagaacgagcctgtggccaaatatcccgaggcacttcgcagcaccaaggccgcagtctcccactctcccaaaattgttagcccgcctcggtcaccgttctacgacgctcccgccagcggcgccgttggcgcggatatacgtttgaatgaacaacataatattgcattcatgggaaccctcgtgcgatcaggatatggccagggtattgtcattgggactggtgctaagacagagtttggcagcatttcagtgtcactccaggagatcgagagcccgcgcacgccactccagctttcaatggatcgactgggccaggaattgagctatatctcctttggtgtgatcgcgttgattgttgtgatcgggttagtgcagggtcgaaagctccttgagatgttcaccatcggtgtttctctcgcggtcgctgccattccggaaggacttccgatcattgtgaccgtcactctggctctgggtgtgctgcggatggccaagcgaggtgcgatcatgcgaaggctaccgagcgtcgagaccctgggatcagtgaacgtggtgtgcagcgacaaaacaggcactcttacgctcaaccacatggctgttaccaagatgtggcatttcgactgcccggaaccattcgaggtccacaacgatatctcctctttgacatcgggccccgccgcccgaaccgttctccgaatcggtaatattgccaataatgccagactctcgcgggttagtgcaaattctccggccagcgcatcttcggcggcagtgctcagttctactgtggaccgtgcgtctggtgctgtgaagagccgatgggttggtcaaccgaccgatgtcgccatcttggacttgctagacacttttggtgaagatgaccttcgtgaccgcatcagcaggcgcgtggctgaaacccccttcagttccgagcgtaaatggatgggtgtcatcattggcagtgcgcagaacgacgcaccatcctttaccggtgccaataacgtagcctatatcaagggtgctctagagcaagtcttgacccggtgtgatacttacctaaccaaggatggtcgtgaggtcatcttggatgagccgcgacgccataccgtaaggcaggcagcagaacacatggcatctgaggggcttagagtgttggcgtttgcgagcggagcagtcagagacacgcccggaggggggagggtatttggtagcaggaccagtactcccctttcaatcacaagtcagggtgacgaggatgatcgatacaccggactagtttttgctgggttggttggaatgaacgaccctccccgaaaggatgtccacaagtccatcaggcgtctcatggcgggaggagtgcgagtcatcatgattacaggagatgcggagtcgaccgccgtagcgattgctaagaaactcggaatgccagtaagagattctccggggtcgaggcctgttctcaccggtcaggacctagaccggatgagtactgcggaccttgcacaagctgtcttcaccacggggctggaagggtcgacggatgttctacaataa

SEQ ID NO: 15815 - DNA, 531 bp, A.fumigatus
ccaagatcgccagaataccccatgctcttcgagagcgaggaggaggagatggatacttacgccgtcgagctgaattccttcgtggatacggttctcaagatggcgtacgatcacggccaggggcgcaacatgattttttccagcttcaaccccgatatctgtctattgatcgctttcaagcagccttccatccctgtgctcttcttgaccgactctggcgcgtctccagtgagcgacatccgagccagcagtctgcaggaagctattcggtttgcttctcgctggagcttgctgggcgtcgtgtcccaggctgagccactggtactgtgtccgcgtctggttcgcgtcgtgaaggagtctggtcttgtttgcgtatcttacggaacgctgaataatgagccagcaaacgtcaaggtaaggtttcaatgctacccacgcgcggcttctcgatctgtgctaaaactccgaatagctccaagtcgccgagggaatcgatgctgtgatcgtcgactccgttctcgccattcgtaa

SEQ ID NO: 15816 - DNA, 183 bp, A.fumigatus
tgtttattcaaacattgcaatcatcacgtgcgacttttgccttggtgtcagggcaaagtaatccgggctacacttacttccatcatctgcgataatcttgtctacatctgtacatatctgaatggtcgatttcgcatttccatgtgtgcctctacaaagcgtcaaccgcctactgtcacttga

SEQ ID NO: 15817 - DNA, 195 bp, A.fumigatus
gctcaaggactggccaaccagccactatccgaccttgtctaccctcaccatgcagtgattgacccagttatcattcgaacggaccttcctcaacgcccttacatcgttacctccctcaacctacctcccgactcgacgcagaaaaatgaacgccgtagatgcgacggagcactacgaaacaagtgccagcggtaa

SEQ ID NO: 15818 - DNA, 1131 bp, A.fumigatus
  unsure (570): Identity of nucleotide sequences at the above locations are unknown.
ctcgaatgtaaagaccccgccccctccctgctgaccatcgtcctcgacacaaacccccatgcttgggccctcctggaagactccctcccgctctccaccgccatagctaacatccttgtcttcgtcaacgcccatttggcctgcaactacgccaacgaagtcgcggtcgtcgcatcgcacagccaaaaggcgacatggctgtacccgtgcgagaccaaagaggacaatggaaagagcaccagcaagacagggagggatgaagacggcgatgttgccatgaacgggtccggcgccggagcaggagcaggatttgctgcggcccaggtgaacaagtaccgccccttccggatcgtcgaggaacaagtcacccgcaacctgcgagaactcatggactcgaccagcggcgcggacgtcgcggccaccacctcgacgatgatggcgggggcgctgacactggctctcagccatatcaaccggcgatcgattgcgtgggcggacgcgcatggaggaaccgctgctggaccaccgggggcggttgaagctggcagctccggggctggtagggccggngcggatactggggccgagggtctgcagtcgcgaattctgatcatctccgtgagcggttcgacggattcggcacatcagtacatcccgatcatgaactgtatctttgcctgccagcggctccatatccccatcgatgtgtgcaagctgagcggcgatgcggtgttcctgcagcaggcgtccgatgccaccaagggagtttacatgtcgctctccgagcctcggggcctactacagtacttgatgatggcattccttcctgaccaacgctctcggagacacttggtcataccaacgcgcgtcgacgtcgacttccgtgccgcttgcttctgccatcgccgtgtcgtcgatatcggctttgtctgctcaatctgcctgagtatcttctgcgaacctcctgaaaacggcgactgccttacttgtggtacccatctcgagatgggtgactacggtgccaagccggcggttgtcgctcggaagaagaagaagaagaaggctcgcaccaatggtgcatctgcgacggcaactcccacacctacacctacacctacaccgggcccttga

SEQ ID NO: 15819 - DNA, 1125 bp, A.fumigatus
accgagagacgatgtaatgttagcccccgcgggagtcatacgccgcggagcactgaacctatcaagacttgtggacatcggtatctcaccgacaaggccatgattgtggtcagcttgggcaccatggacatgcgaaagcacatggaagcagtgaatcttgaccgtattcctatggttaacgctcattctactcaattggatacggccctgtccatcgtcgtatccgccaatggagctgaaggagagcccgagattattgatcttccggttcaagataacatttctaccgaaccaatcgtcttccatgccgcagacccaagcaaggtcaggcttctgtttgatcttattcccacatatgctggctcaaaggatcagattgtaggacgcggcgttgctctgctttcaagcgtcaagccgacaattgggtcacaccgtatcaatctcaaaggagactccacagttcccatcatggctgccaataccttggaagtcattggctccgtgacattcaacttccttattattacgccttttaagcatccaaatatgtcaataactggcaacaggacatattacaagagcatgagctcgaccatggtcatcggacaccgcggtttaggaaagaatttggccagtcgcagatccttacagttaggagaaaacactttaccgtcgttcatagcggctgccaatttgggagcttcctacgtcgagtttgatgtccagctcacgaaagaccatgtccctgtcatttatcatgattttcttgtcagcgaaacgggtattgatgcccccgttcatactctgacacttgagcaattccttcagcttggtgagagcggcgtgtcccgccggtccacctcaccatatcagtcgcctgacgctaccggaaagaagatgggcagtcccagcttccgtccccgatcaatgtccgttggcgaattcgaatatgacgctgcagagctgaatgagcgaatcaaacacacgcgggatttcaagaagaaggggttcaaaggcaacacccgtggcaatcacatccaagctccatttgcaacgttggaggagctgttcaagaagctgccgaagtcggttggattcaatattgaactcagtgagtttttgtaa

SEQ ID NO: 15820 - DNA, 780 bp, A.fumigatus
ctgactttgagtatagcccaaggagctcttcgcgcgcctgtcgtcaaccccgccgacaagtaccaggacaagaccgagagcctgcacaagtacggccaatatgtcatgtcctgcctgcccaaatacgttcagcagttctctgtgtggaaggacgagctcacgatctacgttcctcccaccggcatcatccctgtcatgagcttcctgaaataccacacggcagccgaattcacccagatctccgatattaccgcgggtgatttccccactcgtgaccagcgcttcgaggtcgtctacaacctgctgagcatccgctataactcccgtatccgtgttaagacctatgcggacgaggccagccccgtgcccagtgtgacgggtctgtacgaaggagctctgtggtacgagcgtgaggtctacgacctgtttggtgtcttcttcagcggccacccggatctgcgtcgtattatgacggactacggtttcgatggacaccctctccgcaaggatttccctttgaccggctacactgagctgcgctacgatgaagagaagaagcgcatcgtcattgagccccttgagctgacacaggctttccggaacttcgaaggaggcaccactgcttgggagcctgttggctctggcgttgaccggaaacctgactcggtatgtctggtaactaactcctgtgaagcgatggaaactaatatggttcaatatagttcaagctccccacccctaagccggagtattcgacaaggactgccaatccgattatgt

SEQ ID NO: 15821 - DNA, 261 bp, A.fumigatus
ccaacgtttccctttcctctccctttcctctttttcaacatcttcgctttcttgtctagagtcctctggatttttcttaccgctttactgtctttccagcgaccgatccatttttttcttggtttcttcgcctctttcaccttcccccttctctcggggtctcggcttacaggtatcggcgtttcgcatccatctgcacatacgtactcgattagtacactctcacaaggacggtcactatgtcgagtcgcccgcaaatag

SEQ ID NO: 15822 - DNA, 393 bp, A.fumigatus
cggatccgttttcacactaggttcaaagcagacttggcgttgaaacatcgaaaggcggccgccgcaaaaaagaaggaagctgaaaagcgcgaaatcgaggcttccagccggaagaatttggcgggggttagggtcgtacagaaaaacctggtttatgtgatcggcctcaaccccacaatacgcgacgagagtcaactgcttcaaactttgcgcgggaaggattatttcggccaatatggcgagatcgaaaaaatcgttgtcagcaaggccaagccaggtggcaatcccaaccagggtatcggtgtctatgtgacatatgccaccaaggcggatgctgcaacctgtattgctgctgtcgacggatctaccaacggcgaccgtgtactcaggtag

SEQ ID NO: 15823 - DNA, 192 bp, A.fumigatus
cgacgagttctggtatgtttgaagtgctttcccatcgctggtgttatacggcagttggctgacaacttcgaccttagccctctgtgcattgaagaatttgatctttccgacaagaacttcaagccatgcccttgcggttatcaggtgtgttgctccttgctgccttctggtgtgcattggtgcaaattctaa

SEQ ID NO: 15824 - DNA, 555 bp, A.fumigatus
ttctattgtagggcgcaatatgggaccaccaaatattgctcatcgtttctccgcaatgagcagtgcaataatcgaaattgtactttcctgcacgagacgggcgaagatagtgatagttatagccgacaggatctttcttcgatgaacacactctctagtcagcgccccaacggaattcccagcggacccagtcacgccattcctgcacatgtcgctcgatcctccgctctgcctacttctcaaccaatgcgccgacaggccagtaaggatgatactactggcatgcgacaaccagacggttctgctctcccctcgtcggccagttgggcaaacaaagatagtgccatcaatcgcacccggcgagccagtctagcgggcagccaagcttcccagagccctcgtccagtgcatgccacggtcgcacagggggtcgaggaagtcaagaaggccgagaagcagtcgcaggagcgacgccagacgcgggcgccttcggaagcacgccctgccaatcttcaaaggtcggtccagacgcggcctgaccccatcgcaccctaa

SEQ ID NO: 15825 - DNA, 1305 bp, A.fumigatus
ctcgaaaatatactcaaggcggtcaagtccccagatttcaagttcattttctccgcagccggtctttctactgaagaggttgctcttattgagaaccatccttcgttcatcgacccatacggtggcgtcaaacgtcgagcaatgcgggagaaggcggagcaggagcgcgcgaagagagaacaggagcttcttcagaatgcggcggccgaggaggaaagccgagaaagtggaagtttgcaacttggtggtgaaccagatgacgctcaccctccaagaggtcgtggaggtcgtgactcccatggtgctattcagccgccgtctcagcagggtaccacgacgaattctgcgattgggtcacccgtgtcggccgctagtcaccagttccagggactcaacctcggcggccgtagcttaaccccacttcagcaacagcaactgatgctgctcaagtccgctggcagccagcaggctggcctagtcgatcccttacaaagtggattgggttcgtccgttctagatcaggcgtctcaagttcggcaaggtcttctccagtcgcaaatggcgcagttcaacgctctacaggcccagaaccgtcagtcttcgcgtttctctttcaccaatgatgccaatgcaaagaaccttcccaacgtcaggatgctcagccagcaggctggtttgatgcagtctgggacgccgaaccctttggcagcacctagccctcagcacggacttgccaacaacttctacactagcggggttcagggtccaccacccggtctgaagacagctggtactcctcccatcagtggaggcggcatgtttgctcaaggtcacggatttaccacaaatgccaatctcggtttgggcggcaatgtcggcaagcaggaagccaacccagaattgatgcgcgagttgttgcgaggtcgaagtggcacaaatactggtggattgcaagggcaagaggccgcaaagcgtgagttcatgtttccttttctccaacagcaccaaaccccccctcccctgactcctgccaatggccttctcagctctttctatggttcccaagcggggactttctccgaagctgggccacagaagcagaagaagaaggggaagaagcacagacatgctaacacttcctccggtggaggcggtgtagttgatcttgcggacccgagtattttgcaggcgaggatgcaccaggtcggcgcaaataccactgctgggcaagcgctatatgggagtcagggtcaaggtgggtacaatcactccatgatgtatggaggcggtttcaaccgctggtga

SEQ ID NO: 15826 - DNA, 1059 bp, A.fumigatus
gatgagtggaatgatacagcttcggcggctccccgggaccgcaatcacgtgactatttcaccgaagcggcaggttttgccggcggtgatagcagtttgctcaaaaaaactgtttctgcccaatcacacgccgccttcctcagaaggaacattgaaatttctcggtcgatcgcagagagcgacagacgtctcggctcaacttggccttagtctttgccatctgtggctgatcctggagtttgtctcgatcatggatgaactctttgatgttttcgaagaccagcctcaagcggcagccaaggtcaccgatgtcgcacccaagcggcccaagaaggacaagagcaagaagcgtcaggtaaatggcgatgtgaaggaaaatggcgcagcgacagagcccaaggaggatattgagattcccgatgcgccaactggagaactcgcggatggggaacaggctgaagcgcctgcgaccgagaacaacgagcaacagcctgatgcgaaacgtccacgactggagaaggaaccgcaacctgtattagcagacgaattcgagacggcgcaggagcgtgaggttgcagcatctgcaggtctacaagccgcaaaggaaacaacttcggtcaagttgtcgcaccaggttcggcatcaagtcgccattccgcccaactatccatatgtaccaatctcgcaacacaagccgcctgagaaccctgcgagggtatggccgttcacgctcgatccgttccagcaagttgccgttgcatccatacagagagaggaaagtgttctagtctcggctcataccagtgccggtaagacggtagttgcggagtacgccatcgcgcaaagtctgaagaacaaccaaagagtcatctacacaagtcctataaaggctttaagtaaccaaaaataccgagagtttgcggcagaatttggggatgttggtttaatgacaggagatgtcactatcaacccaacagcgacctgtctggtcatgacaacagaggtaggccgccatgactcttcaagcgcatcctggatgtttgccgactcatgtgcctag

SEQ ID NO: 15827 - DNA, 780 bp, A.fumigatus
tcgcttgataacaggaaggaggatatttgtgctaaccctattgcagaactccaggaatttgaagaaaagagggccaacatgaccattcctgacgaaggcaccattcgcgaatactacgaactaaggacgcagctcgacaagtatgcagatgacatacaggcagtcatcagccacccagattattctttgccatttatgttaccaggtcgtttagtgcacatcaagcacaaagacaaagacttcggatggggtgtggttgtcaattacaagcaacggaagccaccaaagaattcaacggaggagattcctcgtgacaagaggtatgtcgtcgatgttttgctcaatattgccgaagggccgtctgtggccacaaaaacgtttgaggagttaccgtcgggagtcaggccagtgaaagaagggaaaaactctcggatggaggtcgttccagtccttaccgaatgcatccgtgccatctcgcatatacgcatgaaacttcccaaagacctgaacccaaaagaggcgaaaaacggcgttaagaaatctcttgctgagatccataagcggttccctgatggcattgctacacttgacccgattgaggatatgaatatcaaggacgaaagtttcaagaaactactcagggtaagaccatatattttcttctgcatttactttgtattttgtgcatggctgactatcatcacagaaagtggaggtcctcgagtctcgtttgctttccaacccactgcacaactcaccccgcctaccagaactttatga

SEQ ID NO: 15828 - DNA, 1203 bp, A.fumigatus
gtcatcgggagtactgctgagcctgagaagctactaacagctatggcagttcgaggcgtggtttgggaagagactatcatcttgctaccggacaaggtcagatatgtattcttgtcggcgacaattcccaatgctatgcagttcgccgaatggatcgtcaagatgcacaaccaaccctgccacgtcgtatatactgatttcagacctactcctctacaacactacttcttccccgcgggtggcgaggggatcttcctcgtcgttgacgaaaaaggagcgttccgcgaagagaacttccaaaaggcaatgggcagtatcgcagacaagaagggagatgacccgtccgatgctatggccaagaggaagggaaagggtaaagacaagaggttgaataagggcggaaatgaaggcccgagcgacatttacaagatcgtgaaaatgatcatgctgaagaacctcaatcccgtcattgtcttcagtttcagcaaacgtgaatgcgaggcatgcgctctcaagatgagtactttggctttcaatgatgattcggagaaggaaatggtatccaaggttttcaacagcgctatcgagatgctttccgaagaagacaggaatctgcctcaaattcaaaacattcttcctctgctccggagaggtatcggtgtccaccattctgggttgcttcctattctcaaagagaccattgagattctcttccaagaaggacttatcaaggtgctcttcgcgacagaaacattctcaatcggtctgaacatgcctgcgaagactgtagttttcacgagcgtccggaaatttgacggttttagccaacgctgggtaacgccgtccgaattcgtccagatgtctggccgagctggtcgaagaggtcttgatgaccgcggtatcgtgatcatgatggttggtgaagagatggatcctgcggtggcgaaggagattgtgcgtggagagcaggataggctcaactcggctttccatttgggttacaatatgatactgaacctgatgcgtgtggaaggcatctcgcccgagttcatgctcgagagatgcttctaccaattccaaaacacggctggtgttgccgaccttgagaaacgtatgcttaatcgcttgataacaggaaggaggatatttgtgctaaccctattgcagaactccaggaatttgaagaaaagagggccaacatga

SEQ ID NO: 15829 - DNA, 828 bp, A.fumigatus
ctatcatcacagaaagtggaggtcctcgagtctcgtttgctttccaacccactgcacaactcaccccgcctaccagaactttatgagcaatattccgagaaggtagagttggggacgaagataaaggagacgaagaagaagatttccgaggctatgtccatcatgcagcttgatgagctcaagtgccgtaagcgggtacttcgtcggttcggtttcatcaacgaggccgaagtcgtgcagttgaaggcacgagtcgcctgcgagatcagcacgggagatgagctcatgctcagcgagcttcttttcaacggtttcttcaacaaacttactccggaacagatcgctgctgtattgagtgtattcgttttcgaggagaagtccaaagaaactcctgctctcacgcgggacgagctggcgaagcccctaaaggaaatccaagcgcaggcccggatagttgccaaggtctctcaagaatccaagctggctgtgaacgaggaggaatatgtaaacagtttccactgggagcttatggaggtcatctacgaatgggcgaacggcaagtcctttgctgatatctggtacgtcgtctatctgtcggcgctctcgagtcaaagtccacttcaaaaactaacttgcctgtctcatagtggaatgaccgatgtttatgaaggatccttgatccgggtcttccgtcgattggaggagtgtctccgtcagatggcacaagcctccaaggttatgggtaatgaggaactcgagagcaaatttgaggaagctctgactaaggtgcgcagggacattgtggccgcacagtccctgtacttgtaa

SEQ ID NO: 15830 - DNA, 354 bp, A.fumigatus
gggcttcgccagctcgtcccgcgtgagagcaggagtttctttggacttctcctcgaaaacgaatacactcaatacagcagcgatctgttccggagtaagtttgttgaagaaaccgttgaaaagaagctcgctgagcatgagctcatctcccgtgctgatctcgcaggcgactcgtgccttcaactgcacgacttcggcctcgttgatgaaaccgaaccgacgaagtacccgcttacggcacttgagctcatcaagctgcatgatggacatagcctcggaaatcttcttcttcgtctcctttatcttcgtccccaactctaccttctcggaatattgctcataaagttctggtag

SEQ ID NO: 15831 - DNA, 240 bp, A.fumigatus
aggggtgtctttgcgggtcaaccttccagccaacatcttatagtctcaactcctgcctcctttatccccgttgctatttttcgcttgggggcttcgatgctgtcctggtcgtggatttctcacgagccatggaatggctccctcggttatctgtcctaccaacagagtaaccagtgtagccctcttacccacaacttcccgtggagtgcagagtggctgactccatactcgatcggctga

SEQ ID NO: 15832 - DNA, 273 bp, A.fumigatus
gtttcccttatcggaccaatctacgcttggtcatacaacccctctgacgatacctctcacaacctcccaccgttccatatttctgtctacttgttcctttttgagaggtttttgtcccattcgactactgccttcctgtatactattcatttcttgctgtttgaggggtacttcgtccaatcgttggagactcgattcgataaagacctttgcttcccagtcctgttcgcgtttgacatcttctctgttttgtttgtctgtgataccttatga

SEQ ID NO: 15833 - DNA, 456 bp, A.fumigatus
gaagaactggcgcaggcgaactcgaagatcgaggagctcgagcaacaaaattcatgcttgagagataatttggacgcgaaaacctcggagttggcagaactaacccaagatatcgaacggaagtcaaatgaaattgttacgctgagaagccgaagcaatttatcccagcagaattggttaaaagaaaaggaggagcttttgcaacaggaatcttatctgcagtccgagttcgagcaagcaaaagaagccatgcataactgggagattctcgctatggaggagcgatccataagagagagcctaggtgaaaaggtcatcgaccttgaagagcagctggtcgctcttaaggactcgtatgagaaagtcgcttgcgagcgtgattctcagatagccaccgtggacggtttacaacgtgctttgcaagagattcaatcaggtagagcatatcctgtataa

SEQ ID NO: 15834 - DNA, 306 bp, A.fumigatus
ctatttctagctcggaaacaagaactccgtgacctcgtggaaagctcaaacacccagcttgaggagctaaggcgggctctccaaggcgccgaggcgaaagcttttgaggccgagtcagctcttcaggctgctcagaaggagcttgaaagggtaaagccgtttgaaaaagaagttaaggagaagaacctcctgattggcaagttaagacatgaggcagtgacactgaatgaccatctcaccaaagccttacgattcctcaagaaaggcagagctgaagataatgtcgacaggttagtcagaatttga

SEQ ID NO: 15835 - DNA, 276 bp, A.fumigatus
gttatatcactgaagtcatggagttggatttatgacgaaggctcggctcttaacaggggaatgaacctaaaagtagaccggcaagtaaaccgactaccttatgagatggcacgtactgtgataaaagaggtagatagcagtacagagtatgtagtagatttccccaccttgaagttcccaaacctagaaaatcccaccccactacttcttaatttattttcaggcgcttatcaacgttgcattaagagagagattatttcagagttgttctgctag

SEQ ID NO: 15836 - DNA, 432 bp, A.fumigatus
gactgggaggttaagcttatcagcggtgcaggaaacaagaaggataacatcacagtgatttacacgccatggtccaatttgctgaaagacgggtcaatggcgactggacaggtctcattccacaaccccaaaatggtccgaaaagtttacgttcgacagcgagaaaatgcaatcgtcaatcgcctcaataagactcgcgaagagagattcccggatcttcgcgcagagaaggaggagtttttgaagaagaagcaaaaggaagaacgaagagcaagagacgagcaacgtgccagggaaaagcaggaaaagagggaacgggaacaactcaagtggcagaaagagcatgcctacgatgacctgttcactgaagagaacatgcaggcaaccagcaatcaggatcgagactcggactttttggatgattttatgtga

SEQ ID NO: 15837 - DNA, 237 bp, A.fumigatus
cgcttgacgacagagcagcgcgagcaagcaggccttgcacgcccaggaacatcaagtaacgccggcaagttcaaaatgccgagtatatccatgcaccgtacacccagcacacctaccctagccacagatttcttggaccacgggaacccgaacaaagagtctctggccgaactctggtctaatttcctagagcaggagtcacaggccagtgggaatccagaatcgccgaaaccatga

SEQ ID NO: 15838 - DNA, 270 bp, A.fumigatus
gctaaccgtcagcaaggcgtactccgtggtctgctggattctgacaacaaggctacgatcaacgaatctatgagcgagtcagattgcaagccttttcagccagccctagtcccccgagccttccgtattgagatgcgctggaacgccgaagctgaaggatcgctcggcgactcagtgctctcggccgtggctggcgcgaaagacatcctggttgccttctcgtctgttactccagttttcatttacattagtaaggctaaggtttcttaa

SEQ ID NO: 15839 - DNA, 315 bp, A.fumigatus
aggatgcgatgggtggactcgatacaggtcagatacaagactactagttcatcaactgttcgacgggagggtagcatgtcgatgagcgactttgtgtccggcaccggaaacgactcattcaacggctttcttttccacagtccccgctttaccctttccaggtcgaagcggagctgtgtaaggttcggactcgacagtcgcacctcctccgcaaatgacctgatgtctgggaactgccaaagcattaccgagcaagaaagtcaacggcatatggcaggaacttacctgcgcgatcaagttggcaagtatgcctga

SEQ ID NO: 15840 - DNA, 384 bp, A.fumigatus
agcatccttggaagtcgtcggtttcaatataataatgacgattatgtattatcgatcatgacagaattccaacagaaaatggggcctccagacccggagcagccccaaccaccagagcaacgcgtgcgcaagaggcgcagacgcactatggcctgcacgcaatgtcgcagcagaaagctccgttgcgatcgtgaatatcccacatgcggccgatgtgtgcagagcaaaacccctaccaaatgcacctatgaggatggcttcctgtggcagcaacccaatacagttgcctcgcccgtcttctccgaccgaggttccacaagtactggctcagatgccccgagtcgatcgggcgcccgcactctactacccgggactcggggataa

SEQ ID NO: 15841 - DNA, 1314 bp, A.fumigatus
  unsure (727): Identity of nucleotide sequences at the above locations are unknown.
ctttcttgctcggtaatgctttggcagttcccagacatcaggtcatttgcggaggaggtgcgactgtcgagtccgaaccttacacagctccgcttcgacctggaaagggtaaagcggggactgtggaaaagaaagccgttgaatgagtcgtttccggtgccggacacaaagtcgctcatcgacatgctaccctcccgtcgaacagttgatgaactagtagtcttgtatctgacctgtatcgagtccacccatcgcatccttcacgtcccgtcgtttctcaaggagctggacgagttctgggcgcagaaggacaatcccgctttggtatcaactggctttgtcgtgcaactcctcctagttcttgcctgcgcttggaatctagcagactttgataccctccagctgaagaacgaagctagcctcaagtgctatactccggtcgagtgggttttgcacgtcgaaaagtggctggataacgcgcatattaaacggccagagattacggctctcagaatacagatcctcctgatcattgcccaaaatggtttcgggatgaaacggagccatgcctggcttgctacgggaacgctggtcaaacaggccatgatagctggatatcaccgcgatcctagccggtacaccaagatctccgtcttcaataaggagatgcgcagacgaatctggacgaccattgtcgaactcgatcttcaggttgcccttgagcggngaatgcccccctcggttcaagaatcggactatgatacagctccggcctcgaacatcaacgacaatgaaattcaggagaccagtacagagcttcccagagagaggccgctccatgaaataaccgattcgtccttccaggcggtcctcacgcaatcactcccattgcgtctcaaagcgtgctctctgatgcattctcctcggatcagctgccgctacgaggagattcaacgtctggactgggagctcggaagacatcttcagaagatcccggcttggccgactgcacagaatgacgactgtcagagcaagaacaaagttactctactcaaatcgctcctggaaacgaaaattgctcacagtcttctctccgttcatacccccttcgcaatcgaagccccacgggagccgctctttgcaccctccgcccgatcacgcctagaggttgccaccctcatcctttccaaccaaaagcgccttcatgaaacgtcgaaacaattgtctctttgtaattttggggagtggacagtgcaggcattctgtacagtttgtcagatattgcacgcaggaagtagcacccacagtgagtga

SEQ ID NO: 15842 - DNA, 360 bp, A.fumigatus
atttgtcatatctttatcacaacacaaaggagagaaagcgacgacgcaatgtttcgtatacagctcctgctacaggcctgtgtactcttccaccaagcagtagtcggatcgccgtccttatcgccaaaggaaaaatcggctctcttctccaacacggataagtacccgctccccaatcagggcaatgtcattacccacgaccccaacatcatcgagtacaacgacaccttttacctcttcatgggaggcgtccacatccccatcagcaaggcctcaagtctcgacgggccctggacaagagtcggaacagacctcgatggacccagcatcatcgagaaacagaaccggactcgaccctga

SEQ ID NO: 15843 - DNA, 396 bp, A.fumigatus
tcggatcgccgtccttatcgccaaaggaaaaatcggctctcttctccaacacggataagtacccgctccccaatcagggcaatgtcattacccacgaccccaacatcatcgagtacaacgacaccttttacctcttcatgggaggcgtccacatccccatcagcaaggcctcaagtctcgacgggccctggacaagagtcggaacagacctcgatggacccagcatcatcgagaaacagaaccggactcgaccctgagcgccgacggtggtccagcacaacggctcattctactgctactacacgatcagcacccgcggcagccgcaacagctccgtcggcgtcgcaacgaccgattccctcgacagcgggaaatggaccgatcacggagcgctga

SEQ ID NO: 15844 - DNA, 588 bp, A.fumigatus
cagagtcagcgaatgatgatatctgcgtcaaatctccgctcgccggaagatctagagaccgagaaggacaataagggaaataccgtgctgattctaccttcattcacgtttgtggactgcgtgaagcccgaggatgtgcgagagctggttgaccgctacatcgacacaccgcaagacgcaggaacctcacagtcggactctggacttatttcaagaccgtgcgagtatgattacgtcgtgcttttatgttcgcataaaaggcgagatgcccgttgcggaatcacggcaccgttaatcaagaaagaacttgaacggcatctgcgtcctcttgacctatatcgcgatgcatatgatgagcgccccggtggtgtcgggatattcttcgtctcacatgtcggcggtcataaattcgcagctaatgttatgatttatcgcaagaaggagcagcagatgatctggctggcacgggtcaggccggaacattgcgaaggcattgtgaaatacacccttttacaggggaaagtggtacatccggagagtcagcttaggggagggtttgatcgacttcgaggattgacgagttggtga

SEQ ID NO: 15845 - DNA, 420 bp, A.fumigatus
cccgtgggtcaagacgactgcgcacctgcatctgtctgcaccccgcaatctgcatatcatttcaaattaccgtgtccgtgtccgtgtccatgtccatgtccatgttcgtgcctggtcacggtcatgaggtctcgaaggggaatgcctcaatcagatctacatcacaacacgggaacgggccgtagcgtcaggggcagactgctccgtaagacattatcatttcattgttgcattgcttcaatatttcaatctccattgttcttgcaggtccatgatccatctccccgtccatatccttatacggcaagtgggtatagatgcaagccaaaacatatcatcagcgacagaattcaaactccaactccagagcaagtaaatgaaaaaaaaaacatggattttcctcctggacatccaggctga

SEQ ID NO: 15846 - DNA, 621 bp, A.fumigatus
gctacatccagtttcggttatgtcgagtacgtcaacgcggccgacgctgccaaggcttacaacgccaagaaggacaccgagattgatggtcgcaagatcaacctcgactacgctactggccgcccagccaacaacaacaacaaccaggaccgcgcccaggcccgcgctcggaacttcggtgaccaaaccagccctgagagcgacaccctgtttgtcggcaacatccccttcagtgccaacgaggactcggtctcggagctcttcggtcaatccggtaccatcgttggaatccgtctgcccacggaccccgagtcggggcgccccaagggcttcggttacgtgcagttctcctcagttgatgaggctcgccaggccttcaacgacctcaacggcgctgagctgaatggccgtcccgtccgtctcgacttcagcactccccgtcccagcaacggtgatgctcctcgtggcggccgcggcggttttggcggtcgtggtggccgtggtggtcctcgcggaggtggccgtggtggtcgtggaggcttcggcggtcgcggcggcggtgcccctaacaaggctcgtggtggtatccccgagttcaagggcaccaaggtcaccttctag

SEQ ID NO: 15847 - DNA, 462 bp, A.fumigatus
acgcttagggcgggtccttccggccccgtggtgaagacgtgtttgattcaccttgctaagctacatccagtttcggttatgtcgagtacgtcaacgcggccgacgctgccaaggcttacaacgccaagaaggacaccgagattgatggtcgcaagatcaacctcgactacgctactggccgcccagccaacaacaacaacaaccaggaccgcgcccaggcccgcgctcggaacttcggtgaccaaaccagccctgagagcgacaccctgtttgtcggcaacatccccttcagtgccaacgaggactcggtctcggagctcttcggtcaatccggtaccatcgttggaatccgtctgcccacggaccccgagtcggggcgccccaagggcttcggttacgtgcagttctcctcagttgatgaggctcgccaggccttcaacgacctcaacggcgctgagctga

SEQ ID NO: 15848 - DNA, 429 bp, A.fumigatus
tcgcccatcatggcgaccgaaaaaggggaccagaaccccgaaaagatcgaacaatccttgccacagaagattccatactggcgactggtggtagatcaaggtgtcctcacccagcaaatcatcgactatccctacaaaggctccggaaccgaggaggatccatatgaggttgtttggatggaaaatgatcctcgcaatcctatgacatggactcaactgcgcaaatggtcgctgaccatgactgttgctgtttcgacgttggcagtcgccctggtttcttcagcttatactggtggtgttcgagagattgaggccgagttccatattggaagcgaggttgctacgctcggtgtttcgctcttcgtcttgggcttcgcgattggtgagttctttccaggctttgttcgaagcctacctgtcagaggctaa

SEQ ID NO: 15849 - DNA, 798 bp, A.fumigatus
  unsure (688): Identity of nucleotide sequences at the above locations are unknown.
tgcgcctcaggtcctgttttgggtccaatcattggtggtttcctcggaatgaacgcaggatggcgatgggtcatgggcttcttgggcgccttctcaggtgcagtttggattatctgcactattttcgttcctgagacctatgcacccgttctcctgcgtcgccgcgccgagaagctgtcaaagcacaccgggaaagtgtacgtcagcaagatcgacatcgaccagggcagagttactctcaaggacgctttcaagactgcgctgtctcgcccctggattctgcttttcaaggagccgatcgtcttcctcctgagtttgtacatggccatcatttatggaaccctctacatgctcttctctgcctacccaatcgtcttccagggggtccgtcactggaaccaaggcgttagcagtctcccttttctgggaatcatggttggcatgatgtttgctgtcacctacagtgtttgggacaacaaggtttatttccaagttcaagccaagcacgggggatttgctcccccccgaggaaggcatgccgcccaccctgatggtttcggttgccatccctattggatttttttggttcgcttggaccaattacccgtcgatccattggattgtttgcatcctagccggtgctccgttcggtttcggtatggttctggttttcctgggcatcatgaantatctcatcgatgcctacaccattttcgccgcgtcagtcctcgcagccaattccgtcctccgttcgattttcggcgccgttttcccattgttcaccacctatatgtatga

SEQ ID NO: 15850 - DNA, 513 bp, A.fumigatus
ggatttaggggagtctttttctttttttttggtgatttttttttttttaaaaaaagaaaaaaaaaaaaaaaaaaatctatccttgctggcaggaggctcattctgcaaacaggaatccattgggcgtcctcaatcccggcgtttttggcgctggcctgtgttccgtttcccttcctgttctacaagtacggcgctaccattcgtaagcgctgcgagtatgccgccaaatccgatgcgttcatgcggaagcttgccgagcagatgaagcaagccccagagccagagtctgaggagacagaggagcccgtctttgaccgcacggaggcacctgcccctgacgtatctgatgtcagcgagactgagtccaacgttgaagagcttccggatgttcggcagatgcgcagcagagcctccacacggacggcttcttcgttgcgtcgcgtcgtcagctacgagggaaatccttacgatatcgaccgcgtcaacactcgcgagtcgttcaccaagaaatga

SEQ ID NO: 15851 - DNA, 303 bp, A.fumigatus
tttatcatcaatatgagcatttattcattcggcataaatcactacgtcactcaggtgaaatcactgcgtcactcaggtgtgggtcatctctttgagctgtacaatagtaacgtgtgtcttgtcaagagccacctatatttttcaagaaggaaggacagtattgatgagactgccctgcatgacgtgacgtcgggaactcgggacatcctcgtcgtagctagccttttcaagctaacgcaatcccagggatctcagattttcagtacgagctacgactctggtgagactgaggtcgagaactaa

SEQ ID NO: 15852 - DNA, 618 bp, A.fumigatus
  unsure (243): Identity of nucleotide sequences at the above locations are unknown.
tgtttgctgtcacctacagtgtttgggacaacaaggtttatttccaagttcaagccaagcacgggggatttgctcccccccgaggaaggcatgccgcccaccctgatggtttcggttgccatccctattggatttttttggttcgcttggaccaattacccgtcgatccattggattgtttgcatcctagccggtgctccgttcggtttcggtatggttctggttttcctgggcatcatgaantatctcatcgatgcctacaccattttcgccgcgtcagtcctcgcagccaattccgtcctccgttcgattttcggcgccgttttcccattgttcaccacctatatgtatgaggatttaggggagtctttttctttttttttggtgatttttttttttttaaaaaaagaaaaaaaaaaaaaaaaaaatctatccttgctggcaggaggctcattctgcaaacaggaatccattgggcgtcctcaatcccggcgtttttggcgctggcctgtgttccgtttcccttcctgttctacaagtacggcgctaccattcgtaagcgctgcgagtatgccgccaaatccgatgcgttcatgcggaagcttgccgagcagatga

SEQ ID NO: 15853 - DNA, 435 bp, A.fumigatus
ataggacctctactttgggcacctctgagtgagatgttcggccgtcaaatcatctttactgtcacctattgcgcactcacggcttttaatgctggaagtgctggcgcgcagaatagctggactctgatcatccttcgtttcttcgctggcgctttcggagcctcgcctttgaccaatgcgggcggtgtcatcgctgacatgttccacgccaagcagagaggtatcgcgatgagtctctttgctgccgctccattcttgggtatgtcttcttcttcctcatactgcattgatcgtatgctaatgcgcctcaggtcctgttttgggtccaatcattggtggtttcctcggaatgaacgcaggatggcgatgggtcatgggcttcttgggcgccttctcaggtgcagtttggattatctgcactattttcgttcctga

SEQ ID NO: 15854 - DNA, 213 bp, A.fumigatus
cacttttgtggggaccacgttctggaagcatatgtagacctcgtctcattgttcggagtcatctcttccctgatttattctacggagtggtatcttttttctgttgtagaacagtatcgtggtattgatcttgtcaagcccagtccaacactcaacgcttggggatctgtcatcctcatgtacgttccccctacgttccacagtctggactaa

SEQ ID NO: 15855 - DNA, 2943 bp, A.fumigatus
  unsure (2),(3),(6),(7),(9),(13),(14),(15),(2104),(2143): Identity of nucleotide sequences at the above locations are unknown.
gnnccnntngatnnnccactgagagccgctggatccttccagccccgtggtgaagaccctaggtggactggaaagcagatgataagcatggctcttccatctgggctcaatttgttgcgtgtggagaaagataactctagtctggcagagaagttctcgcccttgacagacggtggtctgctcatccacggtggacagttgatgtatggaatgttttccaagaagactgttggtgctagcggtggtggtgtcattcacactatctttaatgagtacgggccggatactgcggtggccttcttcaatggggcacaaaccattgtcaactactggctgcttcacaatggtttcagtataggtattggtgacaccattcccgacgcgatcacgattcagcgaatcgagaattgtgtgcgagagaggaagaaggaagtcgaagctatcacagcaagcgctacggagaataccttggagcccctgcctggtatgaacgttcgagagaccttcgagagcaaggtttcgcgtgcgctcaacaatgctcgtgacgaagctggtagtgagactgagaagagtttgaaggatctgaacaacgccatccagatggcccggtctggatctaagggttcgacgatcaatatctctcagatgactgctgttgtgggtcagcagtccgtcgaaggcaagcgtattcctttcggattcaaatatcgtactcttccccatttcaccaaggatgattactctccggaatctcgcggatttgtggaaaactcttatctgcgtggcctaaccccaactgaattcttctttcatgccatggccggtcgagaaggtctgatcgatactgccgtcaagactgccgaaactggttatattcagcggaagctggttaaggccttggaagaggtcatggttaagtatgacggtaccttccagaaactctcttgggtgatgggaatcaaattcatctacggagaagacggtcttgatggtgctcacatcgaaaaccagagggtcgacgttatcagatgctctgatgacaagttcagagagcgattccgtgtggatctcatggatcccgagaggagcctgggacctgaagtcttggaacaggccaatgaaattgctggcgatgttgaagtccagagatatctcgacgaagaatgggagcaattgctcaaagaccgggcattccttcgcactgtcgcgaaagaagacgatgagatgatgcagcttcccatcaacgtgcagagaatccttgaaactgctaggagcacattccggatacgtgaaggggccattagtgacttgcatcctgctgaggttatccctcaagtccgctctctgctcgatcgtttgctagttgtgcgcggtgacgatccaatctcgcgcgaggcgcaggagaatgccacaatgttgttcaaggcacagcttcgcagtcgccttgcattccgcagacttgtgaccgagtactcaatgaacaagctcgccttccagcatgttctcggtgctatcgagagcagatttgctaaggctgctgctaacccaggtgaaatggttggtgtgctagccgctcagtctattggtgagcccgctacacagatgaccttgaatactttccactttgctggtgtctcgtcgaagaacgtcaccctcggtgttcctcgtctcaaggaaattcttaacgtcgctaccaacataaagacgccatctatgactgtttaccagttgccgcacagatgccacgataaggaatctgctaaacagttgcgaagcgttgttgagcataccagcctgagatccgttacagaagccactgagatctactacgacccggacatccagaccacagtcattgaaaatgatagggatatggtcgagtcctacttcatcattccggaggatgtcacagacgccacttctcggcagtccaagtggttgcttcgtatcattctcagtcggccaaagctcctggataagggtctcacggtgcaggatgttgctgccaagattaagcaggcttatcccaaggatatcgcggttatcttcagtgataacaacgctgatgagcaggtcatccgtatccgtcaaatccaggattacnaggaagacgaagatgacgaaagacttgaattcgacgtcnctctgaagaaactggaacagcatcttctggatactctcactctccgtggtgttcagggagtggaacgggccttcattaacgagaagagcaaagtccgtgttcttgaggatggcagtctgtttgcaagcaagaccgatcctctctgcaaggagtgggttcttgaaaccagtggttcttccctcggtgaggtcctggctgtccctggagtggacgctacacgtacgtactcgaaccagtttatcgaggtctttgaagtctttggtattgaagctgcccgtacggccgtgcttcgggaattgacccaagtgcttgccttcgacggttcctatgtaaaccaccgtcatctggcgcttctggtcgacgtcatgactgtgcgagggtatctgacaccggtaactcgccacggtatcaatcgtgctgacaatggtgctctgatgcggtgttcgttcgaagagacggtggagattctattggaagctgcagctttcggagagcttgacgactgccgcggtgtatcagagaatctgatcctgggacagatggcgcctgctggtacaggagagtttgacctctaccttgaccaaaacctcctcaacactgttgtgtcgaacaatgcacggttcggtgttatgggaaacattggggccaatgatgccatcatttccgactgcgctgccacacagtacgatactggttcgcccatgcaagaaagtgcattcattggtacccccgaccccgagtcggcattctcgcccattctccaagcaagtgccgagtctcctggcgggttcaccgagtaa

SEQ ID NO: 15856 - DNA, 573 bp, A.fumigatus
caaacgatcgagcagagagcggacttgagggataacctcagcaggatgcaagtcactaatggccccttcacgtatccggaatgtgctcctagcagtttcaaggattctctgcacgttgatgggaagctgcatcatctcatcgtcttctttcgcgacagtgcgaaggaatgcccggtctttgagcaattgctcccattcttcgtcgagatatctctggacttcaacatcgccagcaatttcattggcctgttccaagacttcaggtcccaggctcctctcgggatccatgagatccacacggaatcgctctctgaacttgtcatcagagcatctgataacgtcgaccctctggttttcgatgtgagcaccatcaagaccgtcttctccgtagatgaatttgattcccatcacccaagagagtttctggaaggtaccgtcatacttaaccatgacctcttccaaggccttaaccagcttccgctgaatataaccagtttcggcagtcttgacggcagtatcgatcagaccttctcgaccggccatggcatgaaagaagaattcagttggggttag

SEQ ID NO: 15857 - DNA, 723 bp, A.fumigatus
tgctttttgatctgtatgttgttgttctattcatcgaataaattttgggagtcttatgctgagaggttgccttccagtttcggaagaggttactcggactgtccatctgacgctcctcaagatgatcgactttttgctactcagattttcctcgctctaagctcctctcctgtctcctggacgggagctggctctgggaaattctgtctggtcggttactccttgggcggtggtattgcagcggcattcgcatcgtacttccctaatctactctccggattggtgttattggccccagcagggttgatccgcgactcccaaatcagccttcagtcccgacttctctattcgcgtggtctggttccagagcgcgtactcggtttccttgttggtcgccgcctccgcgctgggcccttgactaccccaaaaccaaagaatgaaaaactgaacgctgcggatgccctcactgaggagcttccctcacaaaccgtgggcaatatgcaggtattgtctcgggcctatccgcatgtctcggttcccaatgccgtttcttggcaggtgaacaaccatgccggatttgttcatgcttttatgtctagtatgcgctttggcccgatcctgaagcagcgacagtgggacacctggacgcgccttggcaagcacctggcagcacagaagcaactttcaacggaagaacaactgacaaatggtcttcccaagtga

SEQ ID NO: 15858 - DNA, 198 bp, A.fumigatus
caaatggtcttcccaagtgacaaagtcctcatcatgtgcggcatccatgatgccattatcgtgaaggatgagattgtacccgatgccacgttggccctccagggaaatgttgattttgagttctacaacgcaggccatgagtttcccagcacattatacgacaaggtagcacaacggatactggagctcttgcaatga

SEQ ID NO: 15859 - DNA, 462 bp, A.fumigatus
gtaagcccaacgcttgccaatacccaaaactgtctgctaaccttcaactcgaggttttttttttcagacggtgactacattttcgttcctaaactccaagaggatgatccttacgatgcggcatgggccggtcttgagcaatgcctatgcgacgcaccaccaaatatgatttccaagtattctctcaaatacgtcttcgagcaagttgtcggagaaggtcaactcgaacatctttcacaattcttcaggcatacattgagcattccagatgcctcatggtcagatctgacaggggaactggtagagcggagccagaaccactgcgtggacttcgaccaaatcttccatatgtacaagtacctctctgaaatggaaattttctccattgatgatttgcggcaagtatcaacgtttctttttcttagttgggactgcatcaaagaactaaacttctatttttag

SEQ ID NO: 15860 - DNA, 1008 bp, A.fumigatus
acatcccggctgacgtggattttcgcatcttggatccagcagcggttgccaatgaagaccgcagagcgcttttcacacatttgggagccgtggagctgtcggttagtgcagttcgatctgcaatactggcgaattatagacccttgtgcaacggggtttgcatcgaagattcgagagtttcatctgcgttacttgtatctgacacacaatcgccgtcagattgaagaagatttctgcaatgtttgtgtttactgcgatcatggtactatgaataatccacacgaagaagagatctacctcccgcacagccatccatatggaccaaaggccctcctagggccaacggagtactcccagggcatggaagtattgctcatgcattcaacatattttgagagcattccatcaaggcctcattcagactacccatcgtggcgagcatggttaaccacttcacttggaattcgcgaacgactaagtcttgtttcatccgatggtgattctctttcagacagctggacctatatcgcggaaactcgcccgggaaagcttctgggactgttgcagtacctctggaagtatcaaagctccgaactgcgccaaaatgctgatctcatcatggaaatccaaagcatgaatgcaagaaagctttgcaacagggacctgcctgatgactgtcggcttgacgaaacatatttgcctctatccaaccttcgggcgctttgtcatcgttttatggaggaagatgaacctttcccgttcctataccttgaagaacttctagatgaggaactctactccaagtggatttttcttcacaacgatttctcagtcggaaaggacgacgatatgggttttctgcttaacgtgctgtattggatccagagcgccaaccctgatgaatccgcacttacctcgtatgagcgactatgggatttgtatattacaattggcgcaaagcatcttgctgccgaggacagagtggtcgctggagacaaaattaagtaa

SEQ ID NO: 15861 - DNA, 288 bp, A.fumigatus
tgtcaaagtcggattgtatcaagaactattcttccagttagcacatgtatgtaccgggaggttgctatcgcacagtatggaagaaatctcactttgaacctagactcacggactggtaaaaaggcaaatatctcctgtttttcaagcaaaggtcttgaatctactgtgagagggaacgccaagacgacctccgcctccgaaaatgccgtattggtttcaagtgtactcaggaggttgcgattgtcgctcgtcggaagctcggtggcagtgcgcctagtgacatggtag

SEQ ID NO: 15862 - DNA, 318 bp, A.fumigatus
cggcatcgtagtctacaagcattccggtctggcgttgccgacaacatgctggtgctggtggacgcctacgcagactggtgtggcccctgcaaggccattgctcccaagctggagctgttcagcaaccagtatgccaatatcaaattcttcaaggtcaacgtcgacaaagtccccgatgtggcacaggagttgggagtgtcgtccatgcccagtttctatctcttccgagcgggcgactatgtggagaaggtggttggcgccaacccggggctgctcgagacctacatcaagaaacatgcagagagtgtccaggggtaa

SEQ ID NO: 15863 - DNA, 828 bp, A.fumigatus
aatctcaggatgtctaaatatgtattgtttggaagaccgtggccgagaagaggtcctccatggcaacggctgtcattgcctaggcgtagtccagccctgataaaaccactgtcgacagggacgacaccaaagccaacatcctcgcggccaaatgggcgtctgcaagtctggccatggttggctggccctatcctcggagtgagcctgttcttgtcagcccacaggcgtcccatgcagctcgagacagacacaggccttcaacgaggcaacctaactcgcgacgaatctcaagacgacattgacctacccaaagaagacgccattctgaccactgcacctaacgtccctcctcccatcacccggacccgcccagttcttctccatgtcccattgacgacggccaccaaaacgcgccaactaaccagtcagtacaagtacgacacatggacattcaatgacaccgtccccggcccgttcatccgcgcgcgcgtaggcgacgttgtcgagctaaccctgaccaaccacgacctcagcggcaacccccacaacatcgactgccacgccttcaccggccccggtggcggcgcagccgtcaccaccgccgaggaacacgagaccaaaaccgcacggttcaagctcctctaccccggtctgtttgtgtaccactgcgcagcagccccagtccccgtgcatatcgctaacggcatgtacgggctgatctacgtgcagcctgaggacggcgatgccctctccccggtggatcgggagtactacgtcatgcagagcgagttctacgtcttcaccacggggtggaagggccgctccaac

SEQ ID NO: 15864 - DNA, 831 bp, A.fumigatus
taccaaatgcatttaatgacacaatcaggactgcaatcgcaagtctcgatgcaggactattctatcccagcacgggatggcttccccttggaagcacgcagctaccgtcctgtcggtgtgccgtcgcctcagcgcctaccggtttacctccatctacacggcggggggtttctgttcggcactctggcctcggaagacgcgatttgttcccgcatcgtcgctactttggccacggaaaatacacctgtcgtggtggtgaatgtcaactaccgccacacccctgagtacaagtaccccgtcccgtggaacgacgccgcagacgcccttcactgggttcacgaccatctggcggaactgggcggggatggcgacaatgttgtcgtcggaggcatctccgccggcgcatggatgactgcctcgctgacgctggcgcagcacctgggcaccgacgagcaactggccaagcgaccgaaaatcagaggacaggtgctcatgatcccaccactggtgggcccggggtgctatgcgccacagctgaaatacctcaaggatccgaagctgtccagttacgtggacagcgagcatgcaccgattctcccggtgacacggatcaattctttcatggacctgctggaggccaagggccacgagacggacctggtgctcaatccggggaatgccactgcggaacaggttcggggattgcctcctacgacgtttggaattgccggtcgagatcccctccgggatgaagggctgttctatgccaagttgttgacagataatgggtgggttcgagtcgagcagcggcactgtgggcaagcatactaa

SEQ ID NO: 15865 - DNA, 2385 bp, A.fumigatus
  unsure (6),(15): Identity of nucleotide sequences at the above locations are unknown.
gcgagngaagctagngacgcaaagggcgctcgcggcgagctgttctatccagagtattactcaatgtcgaaaattatgactggactgagggctggcactctacatcagggcgtcttcaatgtctcgccgtacaactacttggaagggtctgtgaatgtcgcagcttttgataagccactcctcatcctgggtcgtgataatagcaatcgtgctattgcaggcgacgtcgttgttattgaggtcttaccgaaggatcagtggaagtcaccatcgacgaagcttgttgacgaagaagcagtcacgcggaacgacaatccagaggcggaagataatgaagaggtagtgacagaaaaggagcggaaggctctgcaggaagaggtaaaaaaggcgcatggcaagcactctgaaggaaggccgcagcccacagctaaggttgtgggtgtcattaagcggaattggcgccagtacgtcggacatgttgatcaaagttcgacgggtgcgtcagccagctctggacggcggcaacagaacgttttcgtcttgcccatggataaacgcattccaaagattcgggtccgcactcggcaggctagcgacctgttgggccagcggattctggtcacgattgacgcctgggatcgcgattctcggtatcctactgggcattttattcgctctctaggagaactagagaccaaaggagcagagacggaagcactacttcttgagtatgacgtacagtacaaaccattccccaaagccgttctggattgtcttccgccagaaggtcatgactggaaagttcctgccgacaaggaacatgtggggtggaaagggcgaagagatttgcgggatattctggtctgcagtatcgatcctcctggatgtcaagatattgatgacgccctgcacgcgcggcccttacctaacggtaattttgaagttggcgtccatattgcagacgtgtcacatttcgttaaaccgaacaatgccatggatctagaggctagcgcccgtggaacgacagtctacctagtcgacaagcgtattgacatgcttccgcatcttctcggaacggatctctgctctctcaaaccatatgtggagcgctacgctttttcggtcctctgggagatgactccgaacgctgaagtcgtctctgccgaattcaccaagtccgttattcgctcgcgagaggctttcagctacgaacaggcacaaaagcgcatcgacgacccttcgcaaaatgatgagctgactcagagcatgcgcaccctactccgtctgtcgaaaatcctccgtcagaagcgaatggatgcaggagcgctgaatcttgcctccccggaagttcgaatcgagacggacagcgacgaagttggcgacccgcttacggatgtcaagacgaaggcgatgcttgcaaccaacagtctcgttgaagagttcatgcttcacgccaacatcactgtcgcggcgaaaatctacgatagcttttcccagaccgctttgctacgtcgacacgccactcccccgccacagaattttgaggagctcatcaatcagctctcgaagaaacgcaatctggaactcgacgtttcgagctcgcgggccctcgctgactcgcttgaccgatgcgtcgatccagagaacccattcttcaacactcttgtccgtatccttgccaccaggtgtatgacatctgcagaatacttttgtgcgggtgcacatgccgagtcagaatttcgccattacggtctggcctcccccatttacacgcattttacctctcctatcagacgatatgcggatttgctcgtccaccgacagctcgcagccgcgattggatacgaaggcgaagacggtcgggcgcaggttgaaggtgtcatgacacgcaacaggctcgaagacatctgccggaatatcaactaccggcatcgaaatgctcaattcgctggccgtgctagcatcgagtattacgttggacaggcgctcaaggctcgtggggagaagatggcggccgacggcgttgatgcgggtattgaggaagaaggatacgtcatgcgcgtctttgagaacggcgtggttgtctttgttccccgattcggaattgagggtgttgtccgcctggaggattttgtgctccctggggagtcggcggtccggtccgctgaggaaaggcgggagctgctggtgcgacgtgaaagtgatttcgacggtgaggagtacacgctgcgtgtttccgagaagggacatcctgagaaggaacgtggcgtcaccgtcgagctcttccagcgagtcaaggtgaatgttagctccgtgaaggaagaaggaggtcgtggagctggaaagagacgggtgcggatattgattctgggggccgggaagtaa

SEQ ID NO: 15866 - DNA, 477 bp, A.fumigatus
acgccagtaaccctatgtctatgttttacatccgatatcgtagtatggcgagttcaaaacttttacttcccggcccccagaatcaatatccgcacccgtctctttccagctccacgacctccttcttccttcacggagctaacattcaccttgactcgctggaagagctcgacggtgacgccacgttccttctcaggatgtcccttctcggaaacacgcagcgtgtactcctcaccgtcgaaatcactttcacgtcgcaccagcagctcccgcctttcctcagcggaccggaccgccgactccccagggagcacaaaatcctccaggcggacaacaccctcaattccgaatcggggaacaaagacaaccacgccgttctcaaagacgcgcatgacgtatccttcttcctcaatacccgcatcaacgccgtcggccgccatcttctccccacgagccttgagcgcctgtccaacgtaa

SEQ ID NO: 15867 - DNA, 369 bp, A.fumigatus
gaccatgaaaagcagaatgccaataaccagaacagcaacattgccattcaacaccggtttgaggatatccacaacaggcccaagcagtccatggaccggctccagaaagccgcaggacttggcgtgtggtacattcgcatcttgagctttgttagaggccacagtggctgcctcttcggcccctgtatcattctttctacgtttaccagttttaccccctgctttggtagcgccagcgccacgaccacgcggagcaacagcggctttgagggtagcgacaagctcattgccgaatgtggtttggccatcaatggcacccttttcgataggacctatatgttcttagcgttaatccacgttcgttcatga

SEQ ID NO: 15868 - DNA, 2751 bp, A.fumigatus
aggactcctcctctcactacccgaaactcccataccgacttctacacttcctcctccccattaatcaagactacctctgtggacccaaatgacaccgacgagacacaggcagacgtcgaatccgccgtcagtgggcccagtgcaactgcctcagagactttaccggaaggagaactctccagacccgctaccgcatcgggccccatgttgagtatcccagaggagcgcagcagtaagaagcgcgctgtctccccgggcaggcggctgaaaaaggcgtttagctccaattcaaacaagaaggataccaaccgcgaacgaacatcttctacctcgggcgcgagtacgaagagcggcggcttgttgagcagaagaagcagcctctcatcgaaacgaagccagacgatggaagtcgagccccttcctgtgcccccaccagttctgacgaatctcaaggaggacaaacctctgcggatttctgatggtcccaatccaccgagaacgccgccacatactgcgcaccctgcacctcaaacaacagtgacccctcccactccgactgatagtcgctcagaatttcctagattattctcttcccctgatgtcacagagtctccagagtctgtcaaatcaaaggacctaccgtcgggcgtcattgtaagcacgtctgggaacatgatttcgcaccgacgtgtgcggtctgcgtcctctgcgtctcacaagcctagtaaactctcaaactctatttccgtgttgacccctaccgccgaggaacctaaagctccttccaggtctccgtccagcaaccagcaaactggtttcttctcctccgttttttccgccgctcaaaatgccgcgtcgactctgagtagcagcctcaatccacaagccaaggcgcggatggtggcccaacctgaacccgcggcctctgacgaatcacagtctaaaagcacagccgaaggctccaaagagaatgagtggtccaccggggagaagaaaccatctgcaatcgatacactggggtctggggatctgaatttcagccatcttgacattgatgccccttctggtggttctgtttcgactcctgatggtgttgtgatcacgaaacctgatagggtaaccgagaaacgtgccgcatacaagaaagatgaggaggcagcaagacttgaggatcaacacgctgcgcgtgcagtctctatggcttatgaaaaaccttctgaacaatcgtcagcgcatccagcagaggagggcctggagttgcaatcagccaactccctttcccgcgcggatggtgatcagaccactccgagtggtagcatattcgagggtgaaaccggcactcggccttatcgaagcggaagcgtgcgaagtcgactggctcagaggcgtcatcgaggctcttctggtgcgaccgcttcaacggtgggactggccggtgctagcgctattgctctgggagtaccgggcgccaatgccagtgttcctcgcctgacagggttcgctgtagcaagtaagaagagaaaccgggatttccatcaactgttccgtagtgttcccgaggatgactacctcattgaagattacagttgtgccttgcagagagagatcatcctggcgggacgtatctacatctccgaagggcacatttgcttctccagcaatatcctcggctgggtcaccactcttgttatcagtttcgatgaaattgtggccatagagaaagagtcaactgcgatggtatttcccaatgcaatagccatccagacattgcacgctcgtcatacattccggagtctactcagtcgagagtccacctatgacctgatggtgaacatctggaagatcaaccaccccgccctcaagagctccgtcaacggaacaagggttgccaccggtaccggtgataaaacagaaaaggccggcgagagcgaagtcgagagcgatgacgacgaggaagaagagatctacgacgaggatgaggagggtgacaatgctgaaagcgtcttcggaccaggaggcgccagtgcgaacgccagcgagcgctcactccccacgaaaggactgagccggcaagcgtccggtctgcttcagaatggcaatggtacagcgccgactgcgatgcccaactccagcggcgagtcgaaggctggcaaatcgagcccaggtggggatctagatgctgacttcccgggaccagccactcacccgccaacggagtataccgagtccaacggccagtatgacaaagtcatcaaagatgaaatcatcccagcgcctctcggtaaagtgtattcttatgtctttgggccggcatccgggtcgttcattccgaagtttcttgttgaaaaccagaagtctggcgaactccagttcgagagtgaaaagaaaggccttacaaacgaaagcagaaccaggaagtactcatacatcaaaccgcttaatggctccattggtcccaagcagaccaagtgtatcagcactgaaaccttggattttctggacctagagaaagctgtcctcgtcaccctttcgacgcagactcccgatgtgcctagtgggaatgtattctgcaccaagacaaaatatttgtttacatgggcaccgggcaatcaaacacggttttttatgacttgcacaattgagtggtcaggcaagagttggttgaaaggtaatatccgttttcgcagcttcatgaacgaacgtggattaacgctaagaacatataggtcctatcgaaaagggtgccattga

SEQ ID NO: 15869 - DNA, 522 bp, A.fumigatus
ttggattggagtaaacattacttacattctgcgtctactcctcgacccgtcccctccttaccttccctttttccgcactccgctatattccttatggaggaacccgcaatcccggagcctcctccggttccccagactgaaccacaaggtttcagtaaatccaatcggacctggactactcccgccgacttggacaccatgtggagctccggccgcagcaacgggggcgcgtcaatctcatccggttctgatagacccaaatcacaagcaggcgaagtagccgaaaccgcaaaggcaggttccagcgggttctccaagctactgaatgctcggcggaagcgaaagaaggagaaggaacagaagcaaacggaggaatcgtcactagtctcacagaatgacccggacctacaggagagtcgatcaaacgagtctcgcggcgagtccgcgtcggcgaatgacaatctgagcccgccaggcgaagtcatcactcttctaactgacgattctgagcctgaccggtaa

SEQ ID NO: 15870 - DNA, 537 bp, A.fumigatus
acgcggtccttccagccccggggtgaagacgaaactcagaatcagattgctgacgaaaatcggcgcctggcagatcttagtggcgggagttattctcggaaagaggaacaagtccaacaagcaaagatcgaggccgctgaaattcggaaacagtgcgaagagcaccagcagagtgctcgccagctataccaagaagccgaagaagccgagattgcggtcaaattagctgccgctcctatagacaaaatgaaggctgaggttgaccaggcagaatccaacttacgcagtctcagcagggaaggaatcagacgtacaggctttcatgaaaggatgccagcactcctcaaagaggtagaaactgagcggtccttttccaggaaacctgtgggccccattggaagttacgtgagcttgttaaaaccagagtggtcatctatattggagaacgcccttggcaccacattgaacagcttcatagtgacctctaagcgagatatgaacattctttcacacattatgcagagggttggctggtaa

SEQ ID NO: 15871 - DNA, 702 bp, A.fumigatus
ggagttgccacgagcactaatattcgagtccacagaattcagcgcgatgtagtagcaggtcttagacgcgaactaagcaatcaagaacagcaactgcgctccgctcgatctcgcctggagagctgtaagcaagctattgagagacataagcgaagatcaaaagaattacaagttctgttgcagaggcaagaagatcaagttgaagagctcactgacgcgcttgaacgagagactgtcgaggatggacatctggatgtgctacgaacaactcttcaagaggccgaagcagagaaacacctaaacgaagggtctttgaaggacagcgtggatgctatggatgccatcatgaggaaattgaaagcgaccaagcaagagctttccgcaaaagatgccgaaatttcaaccttgcaggaagagctccgggttgctcagggagaggagcatttagtgcaagacaagcgccggaagatcattggtcttaaaaatacagcaattgagcgagtcaatgacatcaagctgaacagaacaaggattcaacaagaaaaggatcgtgttgccgcacgtgtcgtcgaatatgaggagaaggccagtctagtctctccacgtgttgcgattgatgaaggggaaactgccaacagtctgtccaagaagcttgagagactccacggtgatcttcaacgctcgaatcaacagtcagtataa

SEQ ID NO: 15872 - DNA, 252 bp, A.fumigatus
ccatttgtccaggttctaaaagcaactctaaggcatcgtaaagctcgttggctcatcttcaggtcgcacatttcgtctcgtgccaaagctcaatttacatacctcttgagcgaaagaagttttcgcggtcgactattgactgatcataatagcaagctcctcgatttacaggcaggtgatgctgagtaccgtcaagcatggtcactggatctgacgagttacctaggtcgagccggacataacaaaggatag

SEQ ID NO: 15873 - DNA, 1320 bp, A.fumigatus
ctgaccccagtagacattttgccgctgattcggcttggtttggactcgtcagcccattccctggttgacgcagcaatcaaatgtttgccggttatccttcccgttttggatttcagcactgttaagaacgaagtttttcctccaatcgcctctactttcagccggaccagcagtcttgccatcaaagtgcgctgcctggacgcattcgctgtcctttgtggaggtacaactggcgacgacgcggcctccgaggacggtctgagtggcattgctacagtaaaaacgccgacaaccgttaagtcttccatcctagacaaatataccatacaggagaaacttgtcccgtcgttgaaagcgatcaagacaaaagaaccagccgtaatgatggccgccttgaaggtctttggacaaattgggactattgtcgacactgaattcctggcgctggaggttttgcctatcctgtggactttcagccttgggccgttgctgagccttcgtcaattcgaagaatatatgacggtaatcaaacgcctttcctcgaagattgaacgtgaacagacgaagaaattacgggaactttcttcgggaccggaggctactggttttcagaccggactcggaagctctctcagtatgtcaaacgatctcatgcagtctgaggtggataccacaagaaacaactttgaacgtctcgtccttggtcgagagagtactactcccagtagtcagggccttgacccgtggcaggagttggcttcgcaagcgccagctccacagatctctactcagaaaaaggctgccgatgcttttccctggtcttcagtcagcagaggaggtcctcagtccaacctaaatactcgatctgtcacgcccgattacagtatgagctctttcccatcgttagagcctgttgcgagagagaaatctccaatcgtggcgcagacggtccccacatcacaaccatcgtcatcgaccgcttggagtctgcccggcctcctcgaatattcagcacaatatgcagggcaatggaattggcagcatgactggtttgaccatgggtgcattgaccggtatgaagtcgccgaacaagcccgtttcgggcggcttgtcgcagcagtcctccaattattccgctttctcaattccacctcctccgtcagcaccaaatatgacggcgtcgtttgttaccagctctggtggttcgactaccgttggcagggcttcgcttgtagggaatcccccggcacctgccaactccttaaaccccgtttcaacctcaatgcagactacgcagaagcaaggtctggaaaagtatga

SEQ ID NO: 15874 - DNA, 945 bp, A.fumigatus
cgagcagtttggtcgcttgatcacagagctgcttttgaaggtacccgcatcacactacggcaagtctctcccgagtcagagccgatctacgatctcattatcgccctctacaatgcctgtaatggtgattgggtcagtctcgcccggaagacgaaagtcagcgacgaacaccttcgcttctttctggagtacgccgctcagtttctaggaaattgcggtaactataagggctttggtgactcaaaatttattcctcgcttgcctgttgccgcgttcgaggccttggcttccataacgccggatgcaaaggcagcgttcgaaaaggccaatcgcaccggcggtggaatctatgagacaagtaaccagtcgctcatgcatctgggttatactgaaggcggccatatgaccacctattaccctgattcgccttcgatcaccaaggatgagattacagccattggagacctgatggagcagaagggcttgccattggaaaatacacggcttaagaagttgccgtctggcgatttcgagctattgattgcttcgggtgtctcctcgcctccatccagagaccgggacctcggcgacgttgagtctctagatctagatggcaagttaaagggaaagaaggttcaacttgtttttggtgatcatagggaggagatggcaaagattgcccacagtgtcaaacaggcttctctgtactcagccaatgagaatcagaagcggatgctcaatgcctatgctctttccttcggcgccgggtcaattgaagctttcaaagaggctcaacgcatttgggtgaaagatcagaagccgatcttggagaccaatctaggtttcgtggagacatacagagacccccacggagtaaggggagagtgggaagggtttgtagcattagtaagtcacgttctacgactagttattccaggtggttag

SEQ ID NO: 15875 - DNA, 420 bp, A.fumigatus
  unsure (241): Identity of nucleotide sequences at the above locations are unknown.
gttaatttggagcgcacccgtgctttcggaaagttggtggatagtgcagagagtatgatacctaaactcccgtggagcaaggatttcgagaaggacaagtttcttagcccagatttcacgtccctggaagtcttaagctttcagtcttctggtgttcctgccggcatcaccctaccaactatgacgacatcccccaaatctaggcttcaaaaacttttactccgggaatttctgagttgcnaaacccccaatgaacctgttccctttatcccccaagaaagacttggagttctccgcaaataccgcaatcttcctttccaagtgcaatttggcttcccaaacttccccggccttgaacgggaaaatctctgccggaaacggtccccggaaattacccttcaagtttccaaccccccctga

SEQ ID NO: 15876 - DNA, 930 bp, A.fumigatus
  unsure (168): Identity of nucleotide sequences at the above locations are unknown.
gtttggcaggacctcccaaattttagggagttcacgttcatttccttccgccggagggttctgtcagaatttttttaccatgatccagaacttccccagtcagtccagttgaatttggaatatacgtccccggacttcgcgctggactctaatgtgactactgctgcngacatgttctcactgggacttgttgtcatcgccctctataattcacctcatgtctctccgctgcaatcgcattcaaatttgagctcgtacaagaagctgttaagctccccatcatccactccgtcgcagggcaacaatttcctctgcgcgggtgccattccaaaagatctctcgtcgcatctattgcctaagttgataacaaggcgaccagcccagcgcttgaatgcccgggaatttcagcaatctcaatattttgacaatatcctggtatctacgatccgctttctggagtccctgccagccaaaaatgcaaatgaaaaatcacagttcatgcgaggattacaacaagtgataaccgagtttcctccaacagttctggaaaagaaagtcctgggcgctttattagaagagttgaaggatcgtgagctgctgcccctgacgctgcagaatgtttttgccatactgcagcgcgttgcaagcgcacgtcgaactctttcggagaaagttattcctcggctcaaggaaattttcttcgcgcatcaatcaggaaaagggactgttcaggagcgtgactccaagaaggatgcgggtctaatggtagtgctacagaacatgaacattgtggccgagaattgctcagggaaggaatttaaggacggtgagtcaactattcattattcttttgctcttgtgactgaccccagtagacattttgccgctgattcggcttggtttggactcgtcagcccattccctggttga

SEQ ID NO: 15877 - DNA, 246 bp, A.fumigatus
ctaatggtgacgtcctatctgaacagctccaggaatgctccctcttctcgctgccttgaggcgtctgccgtcgaatcaccggttgctctccatccaccgcccatctactactacgatcacttctctcttacccctcagctgtctgcctcgctcttcgctcctcacccaacgattcaatttctcatcttcgactccttcctttgcaagctttatccctctttcgacgtcttcagaagccgcgtctaa

SEQ ID NO: 15878 - DNA, 249 bp, A.fumigatus
gacattgcaatgacatctggtcctcatcaagaacaggcccgtgagatgtactcgagcttgcggaaaaacttggtcgaaaacgtctttagacaatggaaggagacgggatttgcctgggaacagtacaaccctgaaaccggaaaggggcagcgcacccaacacttcacaggttggaccagcatggtagtgaagatcatgtcaatgcctgatttgcctgcgaacaagcagataggccatgatgagttgtaa

SEQ ID NO: 15879 - DNA, 810 bp, A.fumigatus
tcactaagtctccatctgttgacgatcaccaccgagctttctgcgaacgggctaaagccaagatggatcttgttgccggtgttcgcaaagaaggcagccggtaagtacttcgtgaagttttcattaccgtgtagttacttcatgaatattgactgtaacagtggcggccgcggcgagtttaaatggtctgatgtgaaggactcggcacatcgtgagaattatctcggccattctcttatggcccccgtcggtcgctggcaacaaggtcgtgatctacaatggtataccaagggcgagacaaccgcggaagagcaggctcgacgagatcgtgaggagctacaacgggtcaaacaagcggaggaggaagccatggcacgagccttgggcctacccctgccagtctcgagtgggagtgccaatgcaaaccttacacctttaggggaaagggagacggagactgcggttcaggatccagctgataggaagagagaacggagaagcgagcagagtcggagtccaggaaggcaccgtatacgggatcgcgagagcaacagagacagagacagagaccgcagagaccacagacaccacagacaccacaggcatcatgaagaccgcgaacgtcatcatcgaaaccaccgtcaccgatcgagatccccgtctggtgatcgtgaacaccggaggagacgatcgagttcgcggtccacaagcagagtaagggccggggaagacggtcaccgcagacacagagaagaccatcgtcgaagacatccaagggatcatgactccgatcattatcgacgccggtga

SEQ ID NO: 15880 - DNA, 1125 bp, A.fumigatus
cagtgggtgtggatacattctgaaatgacagcctggagctggtttctgtttcattgcgatagattagccaggaaaaatacttttaatctcttcaacctccggtgtggtaaggtgcgtcgccattctgacgtagttaccaagccctgtgttggattcatgattaaccatataccccatcgttcattcacagtcgacatcctcagctcgagcccaacactatactggcccaaaaacatggaaaaccaccccacggccctctccatcatcgaggcggaaaacctcacccacgccctcccggacaaagtcatcttcatcacaggctgctcctccggcctcggcgccgcgaccgcccgcgccttatccaacacaaacgcgacgctcttcctcgccgtccgtgacacccccaaagcccgacacgtgctggccgaccttctcgcctctgcgtctgactctgactctggttctcgccttgcctctgatgcagacggcaaatgttcgacctcaacctcaacctcaacctcgcaaagcgaaatccgcctccttcacatggacctagccagtctctccagcatccgacacgccgtgacctccttcctctcacaaagcgacaaactcaacatcctcatcaacaacggcggcgtaatggccacaccagaaagccgcacagaggacggcttcgagacccagttcggaacgaaccacctcggccatttcctgctgtttcagctcctaaagcctcttcttttgcggtctgcaacaccacagttccactcgcgggtagtgagcgtgacgtcgtcggcacaccggaagagcgggatccggttcggcgacttgcatttcgagacagagaaatatgacggggcgctggcgtatgcgcagagcaagacggccaatatctatatgatgaatgagattgagaggcggtttggggggcaagggctgcatgggcttagtgtgcacccggggctgatactcacggggttgcagaagttcactgacaggagagtgtcaggagaagcctttcgcaattctaccgagctattgaaagacacggaaacaaagttgacgactcgagacggtgagaagcggaggagagatgatagtattatcaaactattaatatga

SEQ ID NO: 15881 - DNA, 378 bp, A.fumigatus
accccgccgtctggctctgcgattctctcaagcactcagaaaccgctcagaaacacaactgccatccgcattaagttcatcatgtcaagcacaatcgatcatgtgggcatccacgcccccaaggatcagtttgagagcatcatcgactggtacaagaaggctttggccccgctgaactacagggaaataatgcgcttcccaggagccgtcggactcggctctgaacatccagatttctggatctccgagaccgacgagcagtgcggtggcttccactttgcttttatcgcgcatggtaggtttcctctcgtccctggagggccaacggctgatgatcagaccatgctacggttgacgcttttcaccaggctgctatag

SEQ ID NO: 15882 - DNA, 195 bp, A.fumigatus
ctgctggtcgaagacggagcagacgtccatcagaaggcatacttgggtcgctcggcgcggtcactcgctgcagatcaaggacacgtggagagtgtgagatggcgcatagatcaaagggctgatatcaatgaaagcgatgggatcagtcgaacgccgttgtcctgggcaatgcaaatggactcgagaggcggctga

SEQ ID NO: 15883 - DNA, 243 bp, A.fumigatus
ctctggtgctcatgtgtagctttagatggacggctttcctcctcgtgctggcctagcctagccattggcgtcccccatgtctaccttgtctcccttagtatctggccatacagaactttactccagctgattagtcatttcaattcagggactttcttgcacggagacaatattgtgactcaaatggcgtatctgagctttcctttcgagagctccttctatcgggactactgtcgatgttaa

SEQ ID NO: 15884 - DNA, 810 bp, A.fumigatus
ggtctcgctattcttactgtcctgaaagctggctttctcggttctgctcggtttggctcagggattgtcgtcgctcgtttggccgatggcacatggtccgcaccttcggctattgcgaccgccggtgccgggtttggaggacaaattggatttgaattgacggattttgtgttcattttgaatgatgcagcagcagtgaggacattttcacaggttggaactttgaccctgggtggaaacgtgtcaattgccgcagggccggtgggaagaaatgccgaagctgcgggcgcagcaagtaccaagggcgtggcagcggtgttctcgtactcgaaaacaaaaggtctatttgccggagtcagcttggaaggaagcatgctggtcgaacggaaggacgccaacgagaagatgtataacagtcgagtctcagcacgtcaactccttagcggtactatcagacctccgcccgctgccgaccctcttctccgggtgctgaactcccgcgcattctacggcaatggcagaaacggagacaccatgtacaatgatattcccatctatgatgacagacatgacgatgttgtctgggagggccgaaggggcgaggcatacggtgaggggcaacggcgtgaccgcggcggttttaacggcaccgatgactacgagtatcgcgacagacctcgcgcgagtacttgggcagacgacgtttacgatcggccccccgcaggtttggcccgttctttctattatggttcacgccgatgctttcgacagatacggcgcccgcagtcggagcaacaccgttccatttga

SEQ ID NO: 15885 - DNA, 1338 bp, A.fumigatus
  unsure (159),(183),(234): Identity of nucleotide sequences at the above locations are unknown.
ctccgtctccttccgcagacgaaaatgacgcatctcgtttattctgggttccagctcggttgcatccagagctggctcccaaggagttcaaatccttcctcgaaactaaggcggaacagatcagacgaaaatcgggcgaaattctcggcttcgaacacngtggggcaggggggtcgcttccgncgaaaaaagtctatgttgtcccgacagattgacaccctcccaggttacacngatgggcgcgagccgtttcagccggaacgatcgcagtcgaggaacaagtctttgagcccgaatttgcttcagcttgaatcggtaagtgaggactccaagctccaaaccccgagcgcggcgtcctttttggacggagtccagaagctcaccatagaagaggatgtcccgatcttgcctcccgcaccccccgggcacagtctccgccgctctacccgaacacaatacagaaaagccggtagtttgaggaaaggtgaaaaggttcccttctcaaagcgagctggtagggcatcggacacgaacgaccgagcctcttcaatcactagttcatctgcggacgagcccccctcaggtctcacgcgagtggctaccgatccaacgcctagcacaagacgcgcacaggccgagccgcattaccccatacaggccgctgtcagctcttctacacagtttgacaatagcagggcgaatggctggccggaaacgaatcttggagacaggacaaatgcttctcctcaggcccgccatcagtggcactctcgcatcagctccaatggccgctcaaccttgaatatcccccccaccgaacaaagagtgccggaaattatcgagacacccccagccgaatctccggcaactcccacaacacccacgacatccacgacacccacgacacccacataccaccacagttacagttcgggccgggaggcatcgcaagatgcgccaccgacactgccttcaaaggattcccctcttcgagatccgagtacaaccaaacgatcgggagccgcacggctgccggggaaggagagctcgaaaactctcaatgactttgcgaataacccacaaccactcccgggaaacacaacacggacggacaacctctcattcattcctacaatatcggaagatcgcaagcccgagcccaaaaagtccaaagataagaaagattcggagggtagtcgcaagtcgagttggcactggttgctcggctctgaggagaaagacaaggataaggacaaggaaaagaaaaaggacaaggacagtgatttgaagaaaagcgaatctaagtcagcgggatcgacttcacgccggtctaagtag

SEQ ID NO: 15886 - DNA, 570 bp, A.fumigatus
actcccgcgcattctacggcaatggcagaaacggagacaccatgtacaatgatattcccatctatgatgacagacatgacgatgttgtctgggagggccgaaggggcgaggcatacggtgaggggcaacggcgtgaccgcggcggttttaacggcaccgatgactacgagtatcgcgacagacctcgcgcgagtacttgggcagacgacgtttacgatcggccccccgcaggtttggcccgttctttctattatggttcacgccgatgctttcgacagatacggcgcccgcagtcggagcaacaccgttccatttgacgaagattacgtctattccgaccgcaagcccagccgcccacgcaaacccaagcctgttttcgggcagcgcacaggacagagtgctcttctgcgggcagatcagccgttcgcattatacacatttgatgcagatcaggaaggagacttgggctttaagaagggagacattatcacgatcttgaagcgcacggacaaggccgaagattggtggacagggcgcattggcgacagggtcggcatctttccgaggtga

SEQ ID NO: 15887 - DNA, 189 bp, A.fumigatus
actagtctaaatattctggaatttgttagaaatagattgtcatttgctcagtatgtgattacttttttgttaaggacactcattattcgagaaatcatgtaccctatgaactggatcaaagcggaaatagcagaacctccaaccttgtccagggtaccttactttgtggtacctgtttctatcgcctga

SEQ ID NO: 15888 - DNA, 744 bp, A.fumigatus
  unsure (688),(712): Identity of nucleotide sequences at the above locations are unknown.
gcttcaccgagcccctctgaggctggcggaggatacgggacgcggagaggccatgtgcctcaattatctattagtgacccaagccaccatgtcacggaagccattgggcatatgtacgaagacgattacgacaggcgggagtccaaacgtctcagcttcctttcttccccgctcagcgaatccatctcgataatccctcccagcctcgccggatccgaagactccgcctcaccgcagtcgctgcacgtacaaaatcgctcgaacgccgtggatagtcctcagacgaatggacgctcacggccatcactggtttcctccaagtccgttgaccgggacaccagcaacccgacgtctcccccttcgacggacacagctaccacctcattccctttaaacgacgtcgactacgaatctgatcccgctgcggtggcccaggagctcagtaacctagctgctatccggcggatgtctatggacgtcacagcaacaggagatcccgaccttcccagtttctccgtaccgtcgatagctccgtctccttccgcagacgaaaatgacgcatctcgtttattctgggttccagctcggttgcatccagagctggctcccaaggagttcaaatccttcctcgaaactaaggcggaacagatcagacgaaaatcgggcgaaattctcggcttcgaacacngtggggcaggggggtcgcttccgncgaaaaaagtctatgttgtcccgacagattga

SEQ ID NO: 15889 - DNA, 588 bp, A.fumigatus
atgatttcaactatcctgagccaagtggtccagcttatcccagctccatgccgccgcacatgtactttcccaactcgaccattaggcggccaacgagcactgagcctgagaactacgaactcaaaccgagactgggggacaacgggtggtccactcccgtgtaatgtgagaaaccccacatttgacagtagtcatccacccccatttggttcgattttcttgaatcaattccttgctgcgcaacgaagtggctcttgcgcacgggatattcgcttttcctttgtcacttgtcccatccggaatgtcccccttgtcttcctagcagaagccaattggcgctgcattatctttttacccatctccttttatcttggttttgctcatatccctcatcatcatcatcatcatcatcatcatcattatgctcttttgcccctgcggatatgtttcctttctgttcacggtcactttgcattgataaggccttgcataagcgcgctgggaggagtccggactagctctgatttgtgttctctattcgtttctttctgcttaatgtgtgacacgaccaggacgaagcatcaatag

SEQ ID NO: 15890 - DNA, 489 bp, A.fumigatus
gttttggccttttccggggcgaccttgcgtcgacgcagcagctcttcttcggccagcaaaggagcaatgtcattgtcgacgccaaaatcacccccaagcctcttttgtgtcaacagtctctgtcgcaaagaatcaggatccagattcctctccttagccagcctctgcacgaactcctcgtccacctcgtcttcttcctcctcctcattcagattcccctccactccctccgcttctggtaaaaggacgagcttctcgctgacttttgtcgtgcgtggaggtaaacgcggttgcgccgcaagtcgtcccatcgttgctgcggtgttggccagccgacttccgcttccaatcggaccagagccacctgcactacttcccgcaccgatcaatccaccagctgcagatgctagacgagagcgtggccgtggttgtgtcgtagtcgagggtggaccacgttgttgcatggagggaacgtcggaagcatactga

SEQ ID NO: 15891 - DNA, 237 bp, A.fumigatus
ccggctgcaccagatcaaacctggatcattatcgtcctcatccttatctccatcgttgttacaacctccgaggtcttcctccgctttggtctgctctcggctcgcgaaaagaatccctcttcgacttcctttggcgccatgcttttctctcgcgcttcaaatccggctatctgctcgtgtcctgcgcagggtgcgtttgacatgaatgcaactgggcttgggtcgcattattcctag

SEQ ID NO: 15892 - DNA, 1158 bp, A.fumigatus
gcaatcgcggtccttccagcccgtggtgaagatcttactccaaaacttcaagtgcatgcatctgacgataatgcaaaggatggttatacaaccgatcacgagactgataggattagtgccaatggctcgactttaaagccagctcctaaatctggcgcgccagctccgaagaaacgggccaatgacaaagattccacgacaaaacgaacaaatcctaccaagagcaagtcttccactaatagcacgctgacgggacgggtcaccaagaagacagagaggaaaccagcatcgaagacggagggcaaattcaaatcggcagagtttgttcaggaatcggacgaagatgacacagacatgccagatgcaccagtgcccacgcccgcaccagcaccagagaaggcgaagccagagcaatcaaaggtccaacctaaaaccaaacagactgcgtcgagcaatgtcggagatctctcccacgcgttgacgcccaaggcgaatcagtttgacgccccgcctccccgtgccgaatcaagctctcaaaatgccattaggcctgtcgctgcgaagaggccgccgtccaaccgggcaccgaaccagagatcacctcaaaaaccgtcgcctctcggatcctcccccccagaaaatgcatcggactcccaaagtcgcagtcgttcttcgagtcaaaacgacacttctagctcctcgtcctcccctctcatcacgcagttaactaaaccaaacaaggtcacaccgtcgactggtgcgatcaagacgaacggagttaccaagacaacagagtctgtgaatcctctgaagcgcaaggctgagacagaccggccatctgcaaatcagtccaagacaacaggccgcacaaccggaaacttagaacacaagcggaggcgggcggtcagtacttgtagtggcagcaccgggagcgcctcgccgcctctcagccgtgagatactgcgccagcaattacgcgagaagtcgcagaaattcaagcagtactacgccaagtatcgtgcggtacatgactcgttggcttcgcatccagacccaccgcggggggagttggagcgattaccacgacagcatattcgtctacaacgaatgaagaaggaaatctgggacgagcacggacgacttcgggatggtctataa

SEQ ID NO: 15893 - DNA, 519 bp, A.fumigatus
aagtcaatctctgtaagtccatcccagcagtgcctcggctccagctcctttccccaagctaacaagcggaatccgcaaatagcatccaacatgctcgacgtacccaacttcttctgggagagcgaaccaaccctctacccgctctacaacgccgtccgcgaatacctcgagatcaagccgcggatccaggtcctcaacgaacgatgtagagtattccttgacctcgcggagatcctctccgactcgatcgccgataacagaacatcccgtgtgtccttcccactgttaacccatctgactgactttctcactaaccggctgcaccagatcaaacctggatcattatcgtcctcatccttatctccatcgttgttacaacctccgaggtcttcctccgctttggtctgctctcggctcgcgaaaagaatccctcttcgacttcctttggcgccatgcttttctctcgcgcttcaaatccggctatctgctcgtgtcctgcgcagggtgcgtttgacatga

SEQ ID NO: 15894 - DNA, 1548 bp, A.fumigatus
  unsure (1034): Identity of nucleotide sequences at the above locations are unknown.
gtgacggactcgcgtgagcaacaacctcaacctgttcgtcgtgcctccggtacacgctttatcaccgtcgataatgtccttcagtatgcttccgacgttccctccatgcaacaacgtggtccaccctcgactacgacacaaccacggccacgctctcgtctagcatctgcagctggtggattgatcggtgcgggaagtagtgcaggtggctctggtccgattggaagcggaagtcggctggccaacaccgcagcaacgatgggacgacttgcggcgcaaccgcgtttacctccacgcacgacaaaagtcagcgagaagctcgtccttttaccagaagcggagggagtggaggggaatctgaatgaggaggaggaagaagacgaggtggacgaggagttcgtgcagaggctggctaaggagaggaatctggatcctgattctttgcgacagagactgttgacacaaaagaggcttgggggtgattttggcgtcgacaatgacattgctcctttgctggccgaagaagagctgctgcgtcgacgcaaggtcgccccggaaaaggccaaaacctacgcagagcggctacccaaggcccgtcgtgcggaaaagttggcgcgtgttactgcttattgcacggcgcaggcttacaagatgagttcgttggcggcatttgtcaaggacaagcatggcggacggactaagctgtacgatgattgtctgtatacggcgtaccatttaccgctgttacctggtcttgagggctatcgagtgcgaagcagtccgatggtgaagaaacccggaggcaaatctcttctggatgaggaaattgagagaaacgagcttcgcgaccatcatgatgattatgtcatggacgcagaggagcattctgtcgggggtcaccatcaaagacatagttcattgcacgatgctagcgaatcattggtgctggatggcacattgatcaacaagttcgaggaggacttacatcattccgaaagcgataccgtgaaggagggcagcagagtgtcagtccntggtcatcggccagcccaagggtctcctgcctcaacggagcccgcacgcctaccgtacgatgtcgcagagatgtttgttttcagctacggcgtagtggtcttctggaacctgacagagagacaagaaaaggatctgctagccgatctggcgtttgcaaactcctctactactggatcccgcataccactggcaaccatgcccttggacgaagaggactttgaaacagaagaatttcacttcgaatactcgaccgaaatttcacggcctcgggtattcaacgacatgatcaccttgcgcagcggcgaccacatgattaaactagctatcagccacggcatcgcgcaaagcaccaagctctgcttttttgaagaagtcatggcgcgccaaatggccgaggcgaaggacgtcccacgcagactcgccatgacaggcaagctgggcatgaagcgcgaagaagatcttccgtatcctaggcaagcttttcaaaagccgcgtagaagtcaatctctgtaa

SEQ ID NO: 15895 - DNA, 429 bp, A.fumigatus
  unsure (167): Identity of nucleotide sequences at the above locations are unknown.
cttgactctacccagatccgtgaagagcgagccgcagaatatgagcgggcgcttgaagagcatcggaggcagctcgaaatgctcaggaaagaaaatggagacagtgacgaagaaacgtattccagcaatggggatgttgacgagcaggatgaatgggaaggattcgntgagcttcctgcagttgactatgtagccgaatatatcgatgaagacaaatatactaccgttactgttgaagagatggatgcgtccagagaaggcttactcagggctgcggagggcgacaagtcagacgaggatgaggacgagcgaacgaaaacgaagatcggaagccgatgtcaaatccacaaccacaaattcagccgagaagaaaatgaaggagaagagcaagccaaaaaagaagaaaaagaagttccggtacgaaagtaa

SEQ ID NO: 15896 - DNA, 315 bp, A.fumigatus
ccgaatatatcgatgaagacaaatatactaccgttactgttgaagagatggatgcgtccagagaaggcttactcagggctgcggagggcgacaagtcagacgaggatgaggacgagcgaacgaaaacgaagatcggaagccgatgtcaaatccacaaccacaaattcagccgagaagaaaatgaaggagaagagcaagccaaaaaagaagaaaaagaagttccggtacgaaagtaaggaggagcgcaaagttactcttatgaagcagcggcaagccaaatcgagaaaggccaaggttcggcgagaacgaggatag

SEQ ID NO: 15897 - DNA, 438 bp, A.fumigatus
gatgcatatcggcctcataacgaccttgagtcggagaagcttaccttctctaacattattgtagagctcccggatatccctgacgacattgcttatgacacgacgtttcctcagtttcaacccaagaatttggccttgggattggaaagtgtgtacggagacaaccaagtcggagaggatggccttaccaaacgacagcgcaaattccaggaggactcaattgcgttcgacaaaaaggtggacgaaatgattttgaagcagcttgaagagatcggattcgaggacaagacggaattggaccctcccagcgagcctcacgtggaagaggtacctaaacgacgcctcgaggtgcgccgtgctaaattgactatgacgaaacccaagtataccagcaatatctgtcttcaccacggggctggaagggccgcgctcaccaac

SEQ ID NO: 15898 - DNA, 339 bp, A.fumigatus
agaatgaacgccctccgcctcgaggctgatgaggcccagaacaaggtggaagagctcaaggctaaagtgaagaccctggagcaagagaatttggcaaaggaacaggagatcacatccctcaaccaccggaaccagcttctggagggtgaggtcgagaagctcgaggctgcacttaaggaggccaaggagtctgccaaccagagtgctcagcacgacactcagaacgaggcccttcagagacgggtgcagttgctggaagaagaggccgaggaagctgaccggaatttgcgggagacaaacgagaagtatgactcggcctgttccgtccatatcccctaa

SEQ ID NO: 15899 - DNA, 354 bp, A.fumigatus
caggctccttctagtatacttgctacttcatcaaatatcaaggccgccaccagcgttctggaggatcttagctcacaactgagcacctgtccttcggattactatgtaatcgcatctcagcccggtgtgcacagcagcgatttcgcgactcgcaagtccgccccccgcctgggcgcaaagctgaccgggaacgacaaagcaattcgatccagtatgattgtcaaggaggttgcaggtgttctggaggcaaagcagatccagagtataattgagaaggaatgcggggcgcggtctactttgatcgatgcatctggtgagttcgagagacttataagcttcagaagtcgagactga

SEQ ID NO: 15900 - DNA, 321 bp, A.fumigatus
catcgcatgttcgttctgacggatgataaagatggcctccttgccaatatcattgaccgaatcccttcttcgaagaagtatacgcttctctacgtgacatcgccgagggagtttgagggatccgagggtgtcgtttataaagccgaggacagttaccaggaccctctccgcatggagctgaagcgggactactcagcccacgaaagtcaaagtactcctgcatctaacaaatctcttttccgagagtatcaataccttaccccaggtacgatctctgaaggttttctgcaatgtccaaacgtagtgactgaccacttctag

SEQ ID NO: 15901 - DNA, 234 bp, A.fumigatus
tctctcggtctgcctgatgatcttcagtgcacaactgtgcagtaccaatctgtctttgctatgcggcctatccacctgttttacagcatagctctagcctctaacggccacgagcctgacactatactctattcgttgcttgatactctgcatggactgcttcttattcgtccctcaacggatgagtctttcccaacggtccaaggaacactgatctcgttttcaagctgttga

SEQ ID NO: 15902 - DNA, 237 bp, A.fumigatus
gtgcttctctttcgtcctgtgtggcacttgtcccctttgctgactcttctcgcggaaaaggtgagcatgcaagatttttatcgtgtcccactcaaacagccttccctcccctccttcccgtattacttcttgctgctgttgaggagcaatggcggtagcagcggcaacagggctgaagcacatctgaaaccggttacgtcacgtcatcagcaagtgattcgacaagatggacgatga

SEQ ID NO: 15903 - DNA, 285 bp, A.fumigatus
ggcaaactcgcggccatgcagcagcccaaggacacggacccaaatttccctgttgacggagggggctgtcgacctcagggcgagacccatattgaaacccaacgatcggtggatcctaacatgtctatcgaagactacaaccgcgttatgctgcagtatacccagcgacgcatgtcgaccttcctggacatgggcaacgacggcggtcctcctcccagtcgcaacggccggagtagcgacagcgtggcaaccctttccaagcgtgtttttttgtaccactactag

SEQ ID NO: 15904 - DNA, 318 bp, A.fumigatus
cccattcgacgtttcactctcgtcttcccttccttcgaaacccgcctccgaacgattgtatatttcccggcctctaccaagcaacacgggttgcaacaacatcgaaatcgccaacgcgccaactacgacttcgacacacgaataaaagcgacaatcaacaaaaatgcgtcctataactatcctctgcaccctcgctacactctcaaccacactggccgtcccattctcccaggcatccaaatcaaccagcgcatcaagatcgacctcttcttcaacagtgccggcaagtctaccctcgccaacactcagcggacctaa

SEQ ID NO: 15905 - DNA, 1458 bp, A.fumigatus
gtgcttaactccgaccagggtcactcataccttcgactaaacgtcatgatcatatttaggtatatcgactatctgggatgccagggagtcaatctcacccgcgcgaataactactatgcccgctatactaccagtacaatatgcagcggactcgttcaaagctcaaagacccactgcaatctttctgaccagcagtcaaggccgctttgcgccgacacttgcgccttgatggccacgagcgaggcggaaatcgtcgtcaatgctgacctttgccggacaacaggcagtaattatatgagtcaaattcggtcagactttaccatatgctccttgcctgccgactcactcactggtacttgcatttccggcgcggataacgaaccccaggagtgcggctataggtcgaatttgatcggactatgtggatattgtggagccagttcacccaactcaactgattcatgctgtgtcaatgcggacgccgcgagccgctgcgaaggcgttacgattcccaccccaactgtaaccctgcgaccaatattcacctcaacctccaacttgacagcagatgcaggtgctcatgacggtctatcgggagggcaaatcgcaggtatcgtcatcggatctgttgcgggagccgccctcctggcagctcttatctttttggtcctcttttgtgtacggcgcagacggcagtcacgggattatagtgctctcaataagcccaatccgcaacggagagggattccagcgatgcaacaggataaaaatcagcaaggcttaccctccgtgccaggcggacgggtggccaggatgtctgctctgcgcgaggtcccaagcttgtctcccacacgctctcgtaactctgccgctcgctttggaagcaccaagcacagtgatacgtccgactcagaaggttacggggcgagcccgggcgcaatgtcaaagaggattccgccggtcactggaagacgccatggatctctctccagcaactccgcccttgctggcgcttatagtgacacctcacctcgctcaggaactgttggccaattctcttcacccgaaggcgttgcgagtggacagtcggagcaattgtcttcgttccaagattattactcatctgatgacatacacccgggtgataaggtagctgtcctctgggcctatcagcctcgggcaggggatgagtttgccttggaacgcggagagatgttgaaggtgatcggtatctgggacgacggatgggcgaccggcattcgcgtgccagaaactgcagaagactatgacgccagacaccgcaagcagcgggacagtggtgtatctaatggatcacagagattggctgcctctccatcgcctactggggatatcaaggcattcccgctggtatgtgtctgccttccacagcattggcgaaagatcatcgaaggcgggcaggatgaagatttttcgtga

SEQ ID NO: 15906 - DNA, 240 bp, A.fumigatus
tggagtctgtttaattacctatcacgtactttcgaggctaaagtgaccggcaatgcgcaagagaagtacctaagctattgtgccgtgcctgactatctatctacctactggctaagcggccgttacccccttttattattcttcttctgcaccgcgcctggatgcagactgccctctgccggctgcgaatctgtgataatcgagtcgacttggggttcaagaccttactttgacccttga

SEQ ID NO: 15907 - DNA, 849 bp, A.fumigatus
  unsure (85),(131),(171),(337): Identity of nucleotide sequences at the above locations are unknown.
ttcaagggcccgaagcgtaccaaaacaaattctgccagaatgtcgaattcgcctttactaaagtgttctaagattctgcccaggnacgtgaatgagcaagcactgccaagcaaattccaattccaccaagnctttatttggggcttgttcgtcgccggctcttggctgtcntactctctttttttccagccatatgatttgggctcaaagtatagctatgctgtgacatttctcatgttgatcattataagctacggtggtatgatgtttgccagcagctacgtgaagaaagagcaacagttctggtattgggtcgtcacggcatggactgtgtatntgcacatcaaatcactccgcccatggcatggctcaaaagatactcggttctcgttctcaccatttgcaagatgtatgacagttgggctggccatctcttatcggattctcagacgctggaatcaaacaggccaaaaatttgctgctgagccagatattgcgcgagatttctttcctcgccatcagaatatcttgtgggccttgattatactgacttactttgatacatgcatgcatctttgtctcaattcacactcgagtaatatctggcgttctgcagctatactgacgacaatagcggccttctttttcaagctggttttcgtggcgtccgactctcccgagcttctttacgagtctctcctatcacccatacagaaaagccttgaagagatgccattggttctacctgcaagactcgtcttctgtggaattgccctactggtggtgacatcgttctgtatgataaatgccacgcagaaacgatcttctctaacaggaggcgagtgttga

SEQ ID NO: 15908 - DNA, 603 bp, A.fumigatus
caaacattagtgattccgccgggcaatatatttcatgaaagcctgaccctcttcttgataacacagtcaaaagccgtcaatatcccgatctttctgatgtttcgactgcaggctattattcttgattttctgaaaatgagcgctattgaagtgacccttacgtccttgctttcgcagaatatgacattttttgcatttggaggttcgaatgcaatatcttctgtcgatctttccaacgcatacaacgggattggcagttatagtgttgtgctagttggagtcttgacattcataagcaattgggctgggcccatatggtgggcatccgctgctcggcttctctactcaaatccaacctttgcggaaagatacggccaaagaaccctcctaaccttccatgctgcaacgtctttgatgtccgttatggcggcttgtacaatgttacggacacatcttttcatttggacagtcttttcaccaaaatatctttatacattggcttggactattctcaaccatatgttcatcaatttacctgctacggcgaacgtgtcgcaagttttgaactggcaatatgcgtttcattcagttgcttgtcgttaa

SEQ ID NO: 15909 - DNA, 327 bp, A.fumigatus
gatcacgatttttcaggtgcgggtggggtactagtagttccttatctagctagcagttccaaaaatgccaaaaaaactgccccggtctacaaagggtatctaaaccacggcgtaggtttgtttctcttcatcatcattctatttactaatacgatttttctctctgtcctttttcatcttgtaattcttttcccttgcttatttgcttgccttcacgctctccctttgattctttacctgaccacgcccgttcccagcatcttctcattgaacaatggatttgaacagccggttatagtttgttccgcacaagaacttcctagttaa

SEQ ID NO: 15910 - DNA, 618 bp, A.fumigatus
cttggcatcagtaacggtgtctacacggccgcaggctctcaggccctcttcgacacagctggcgcctcatggtgcggtgcaggatgcggcaagtgctacaacttgacatcaactggcagtgctccttgcactggctgtggcaccggaggagccgctggggagagtatcatcgtgatggtcaccaacctctgcccctataatggcaatcagcaatggtgccctcaggtcggtgccacaaacaactacggctacagctaccactttgatatcatggcccagagtgaagtttttggcgacaatgtggttgtcaactttgagccggttgcctgtcctggccaggccacttccgattgggagacatgtgtctgctacggccagaccgagactgatgagactccagtgggcatgacgcccggaggcagcaacccttcccctctgacatcgacaaccaccaccaagacaaccaccaccgagacaaccaccactaccaccactggtggagccactcagacgctgtacggacagtgcggtggcagtggttggactggccctactgcctgtgcttcgggcgccacgtgcaaggtgttgaatccttattactcccaggttctctcataa

SEQ ID NO: 15911 - DNA, 639 bp, A.fumigatus
agcagctgtccttcctgcggtcgtgttgaaaacgggcaaatactggcactgctgatgaacaaaaacagcaccaccctgtacagcctaaacggcgttacctacgacacgttgaaagactggataatttctggcgtgcaggagtactacagcaccctgcagactacctggcccgatctcacacccttccaccaggctggcgggaaagtgatccactaccatggcgacgctgatttcagcatccccactgcttcgtcgatccgctactgggagtcggtgcggagtaccatgtacggcaacctgtcgtacaaagctggtgctaacgcattgaatgaatggtaccgcttatacactgtgcctggtgccggccactgctcgaccaacgatgccatgcccaatggtccatgggctcagaccaacctcgctaccatgatagaatgggtcgaaaagggagtgactccggtcaccctgaatgcaacagtgctccagggcgagtatgaaggcgagacccagcagctctgcgcgtggccattgcgtcctctctggaagaacaaaggaaagaccctacactgtgtgtatgaccaggcgtccatcaacagctggcactatgacttggatgcagttcctatgcctgtatattag

SEQ ID NO: 15912 - DNA, 462 bp, A.fumigatus
cgaaccaatcacattatcacggcccccaattcctcgttagcagatacattcctcaagccaccacggtcagtcattcctgggctgtcgacgcggagaaggctagatgagtacaacaaggttacatcccatctgaaacacgagactcaaacaagtataaaggcggaccgatccgaccgaaaaatcctctctcgctcctgtcatttcactatattcatcttcgacaccatgcctgccaaacctattttggccttagccctcatcgccgctgtctcagcagccaagcctaccgtctacctcatccgtcatggtgagaagcccagcgatggaggtaatggattaagcgctcaggggcttgagcgtgcgcaatgcctccgcaatgtttttggcagtgcttcaagctacaacattggttatatcatggctcaaacgccaaagcgaagtatgatgactgtatttttctga

SEQ ID NO: 15913 - DNA, 372 bp, A.fumigatus
tatatccatccagatggcaaacgcgctcgtccttacgagaccgtagagcctctcgcagaagacctgggtctaactgtagacacgtcctgtgatcgcgatgatcccaagtgtgtcagagatgtggtcgaaggctacaccgggtcgggcaatatcctgatttgctgggaacacgacgccttgacggagatcgtcgacaagttgggcgacgatgacgccccatcgtatcccgatgaccggtcagtagtctttaaatacaaactcaccattccatggctgaacaatctcaggttcgacttgatttggaccgatccctatccctactccgagatcacagcacagaccagcgagcaatgccctggtttggatggttag

SEQ ID NO: 15914 - DNA, 591 bp, A.fumigatus
aatcctcattctagacacacacgagtccgaacaacgaccagtcgccgaagaaccatgaagatggactccgttctcgtgcatgcatatgaacaggaggccaacgacgcggatggagtcgatcaggttcgagacgagtattccggctccatggctggtgtgaaaagcacatatgctccaaacatgcgcgttgccagcaacgagaagagcggaaacagagcgctagcgaaggatatcgcggtcgggatgcgtttaccgtcgttcccggtggtcaaccaagccgacggatccaccatttccctattgaacctcatgtcgagtggcggctgctggagactgattgttttctctggcgacttgcgacggccaagggtgtgcgaacgactcacttcgtttgctgagagcttcactcaacactcccacttggcacatcaacagcagactgagagcccacaaaggcgcggtcctccgcttcaaaccctcttggttcatgcaaatccaaggatgagcatcagcctcctgaatctcccgattatctttcatccatctgatggtgagttggggcgggactactggaagacatgccgacgatga

SEQ ID NO: 15915 - DNA, 405 bp, A.fumigatus
caacctcgtcgcgaaaatcatcgtcacagcctcgagctgggaggcggctgtgcgaaaggcgcggcgcgtgctgggcggtacccgcatccaaggcgtcccgacgaacctgcccctgctgcgggggatcgtctcgtccgcggactttctcgcggggagggtcgacacgcagtggctcgagaagcatcttccggcggtcctggggatgggcgagcgcatctccgcctcgcttgcctcggttcaccagccgtcccaccgggcggtacagctcccgacatcctccttgctcctcttccgccgcggcgacgcatggagcatctccctctcccccctcggcccatcccggacgtcccaagaagaggcggaaacccgacaccacctgcgtctcacccgcgtcctccgcaatga

SEQ ID NO: 15916 - DNA, 1959 bp, A.fumigatus
atagatacacttagatccatgatgaaaaagctcctggtagccaacagaggcgagatcgcagtgcgcatcttgcacgctgcccgggagctttcccccccggttcagaccgtcgccctgtcgacccccaacgacacatcgcattgtctcctgggccaccccgaccagactatcgcgctcccctctgcagcctcgtacctcgacatatcactgctcgcgcagatctgccagaaacatgccatcgacgctgtgcacccaggctacggcttcctcagcgaatcgcccgaattcgcgcgccgcatgcaccagattggggtgacggtcatcgggccaggggccgagatcctcgagcaaacaggcgacaaactgcaagccaaagcgctcgctacgtcctgcagcgtaccagttctgccgtcccattccgcgcaatctctcgacgagatccgcgcgtttgtcgagaaagtcggataccccgtcatgatcaaagcagtcgacggcggcggcggacgggggatccggctgatccaccagcaccaagcatctgagctggggagtctggtagcaagagcgcggagcgaatccccctcgcagaccgtcttcgtcgaaaaggccgccgtggacggcttccaccacgtcgaggtgcaggtcctcggcgacgggaccgggaccgtccaccacctgcatgaacgagactgcagtgtgcaacgccggttccagaagatcgtcgaatgtgcgccgtcgcttctggaccggtcgattattgagaaagtcagcgaggcggcgctgcgcatcgcccgcaccatccggtaccgatcactcggcacgttcgagttcctggtcagcgagagcacgtcggatttctacttcctcgagatcaatccccggctgcaggtcgagcataccgtcaccgaggccgtgacgggggtagatctcgttcaggcgcagctgcgattagcccggggagagtctctccagcaaatcctggcggagtgtgcgcccacaccctccgcgcgatccatccagctgcgcctttgcgccgaagaccccagcgcaaacttcgcgctgagcatcggcaaaatcaccgacttcttcgtgccgtccggccacggcgtccgcgtcgacacgcacctctccccgcccgtaaccgtcgcctccgactttgacaacctcgtcgcgaaaatcatcgtcacagcctcgagctgggaggcggctgtgcgaaaggcgcggcgcgtgctgggcggtacccgcatccaaggcgtcccgacgaacctgcccctgctgcgggggatcgtctcgtccgcggactttctcgcggggagggtcgacacgcagtggctcgagaagcatcttccggcggtcctggggatgggcgagcgcatctccgcctcgcttgcctcggttcaccagccgtcccaccgggcggtacagctcccgacatcctccttgctcctcttccgccgcggcgacgcatggagcatctccctctcccccctcggcccatcccggacgtcccaagaagaggcggaaacccgacaccacctgcgtctcacccgcgtcctccgcaatgactttccctcctcgctcaccgccgagatcgagtataccacgccatcggcgtccattccatacacactccacctggcagccgccggcgccaacaccgccgccagcgccctcgtctcgggccatcgccgcggcgacccgtccaacccgcggcatattgtgctcccgctgtcggggaagttgatcgaggtgctggtgcagcctggtgagaccatcgcgcaagaccaggtggtggcgtttgtgaagcagatgaagatggagctggaggtacggagtccgcgggcgggacatgtaacgtgggtatttgaggggagcgatggggaggaggatgtggtcgaggggatgttacttgtcgaactcgatcctgttcctgcgagtgtgaccaaggggaagctttga

SEQ ID NO: 15917 - DNA, 603 bp, A.fumigatus
ccgtcgcctccgactttgacaacctcgtcgcgaaaatcatcgtcacagcctcgagctgggaggcggctgtgcgaaaggcgcggcgcgtgctgggcggtacccgcatccaaggcgtcccgacgaacctgcccctgctgcgggggatcgtctcgtccgcggactttctcgcggggagggtcgacacgcagtggctcgagaagcatcttccggcggtcctggggatgggcgagcgcatctccgcctcgcttgcctcggttcaccagccgtcccaccgggcggtacagctcccgacatcctccttgctcctcttccgccgcggcgacgcatggagcatctccctctcccccctcggcccatcccggacgtcccaagaagaggcggaaacccgacaccacctgcgtctcacccgcgtcctccgcaatgactttccctcctcgctcaccgccgagatcgagtataccacgccatcggcgtccattccatacacactccacctggcagccgccggcgccaacaccgccgccagcgccctcgtctcgggccatcgccgcggcgacccgtccaacccgcggcatattgtgctcccgctgtcggggaagttga

SEQ ID NO: 15918 - DNA, 429 bp, A.fumigatus
aagactaaaaagcctccaggcgtctcaatcaactctcctcccacctgtcgaccgccaggctaccaccagactactccgacgtcctgtccaccatcagcaccctcaaggaaatcgccgcaacccccaacccctctcgccgcggctacgcacgccagaaacaagcaggcaagctctgggtccgcgagcgcatcacccagctcctcgaccccgactcgttcgaagagatcggctccgtgtctggcaccgtcgcctggaaacccaccggtcccacgaccgaagtccccgagtccttcacgcccagcaacaatgtccagggcttcgggaagctccacggccgacgcgtcctcctcacagccgacgactttagcatccgcagcggccacgccgacggctccacggccgacaagaccatctacgccgagaagctag

SEQ ID NO: 15919 - DNA, 636 bp, A.fumigatus
atcggtctcggcgccgcacgcgtcgtctcgtgccatttctccgtcatggcggcggatatcggcgcgctgttcaacgccggtccggaggtggtcgccaacgccaccttcgaggaaggactggattttcaggacctcggcgggccaatggtgcactgcaccaatggcaccattgataaccttgccgccaatgaggccgagtgcttcgagcagttgcggacggtgctcgggttcctgcccaaccatggaggcgaggcgccgccagtggtgaagtgcgaggatccagtggagagagaggatgtcggcttgcggagtgtgatcccgcgtcgggcggcgaggatgtataacccctacaccatcatccgatctgtcgtggacgcgggctcgtggtttgagatcggaggactatggggccggacggcgatcggggggctggcgaggctgggggggcggccggtggggattatcgcgaataactgcgaggtgaacgggggtgcgctggatgcggcggggagccagaagctggcgcggctgctgaagctgtgcgatgtgatgaatctgccggtggtgcagtttgtcgacgtccgtatgtcttggtcttttccctttccccttgctactgtaaggaaagtttgctga

SEQ ID NO: 15920 - DNA, 360 bp, A.fumigatus
gacgcaggtggtgtcgggtttccgcctcttcttgggacgtccgggatgggccgaggggggagagggagatgctccatgcgtcgccgcggcggaagaggagcaaggaggatgtcgggagctgtaccgcccggtgggacggctggtgaaccgaggcaagcgaggcggagatgcgctcgcccatccccaggaccgccggaagatgcttctcgagccactgcgtgtcgaccctccccgcgagaaagtccgcggacgagacgatcccccgcagcaggggcaggttcgtcgggacgccttggatgcgggtaccgcccagcacgcgccgcgcctttcgcacagccgcctcccagctcgaggctgtga

SEQ ID NO: 15921 - DNA, 657 bp, A.fumigatus
aaagcctccaggcgtctcaatcaactctcctcccacctgtcgaccgccaggctaccaccagactactccgacgtcctgtccaccatcagcaccctcaaggaaatcgccgcaacccccaacccctctcgccgcggctacgcacgccagaaacaagcaggcaagctctgggtccgcgagcgcatcacccagctcctcgaccccgactcgttcgaagagatcggctccgtgtctggcaccgtcgcctggaaacccaccggtcccacgaccgaagtccccgagtccttcacgcccagcaacaatgtccagggcttcgggaagctccacggccgacgcgtcctcctcacagccgacgactttagcatccgcagcggccacgccgacggctccacggccgacaagaccatctacgccgagaagctagccgtcgcgctcaaactgcccgtcatcaagctcgtcgacggcagctccggcggcggcagcgtaaccaccatccgcaaagaaggatggagctacctcccctacgtgcgcatgtacgcgcaggtcgtcgagcagctgaacaaggggattccgaatctgggggccgtcgttggacctgctgtatttgccccttccccctcccctttcctcccctttcctcgttccattcctttggactaa

SEQ ID NO: 15922 - DNA, 516 bp, A.fumigatus
cagcaattgctagccaaggctgacacctcacctcaatcaggtattgaccaaatggggacgccatggtccgatggagttcctggtctttcgcaaagacccattccgtccggcagcagttttctttacaaatggaatgcgggacagtatggcagctatatgtatcacgctcacagcagagggcagattgatgatggcttatacggagcgatttatatccgtcctggtgacgaagtggagaaacccttttggttgataagtaatcgtacacgtgaagtcaaggccatgcgacgagccgaagaaaggacaacccccatagtgctgagtgactggcgccagttgacgtccgaggagctgtggcatgcggaagaggcaactggactagacgcatactgtgtgaatgcgctattagtcaatggaaggggctccgtacagtgtctagaccgcagtacgttggatcggtatagcgcggcaaagtgggcatttttgggaaactcttcgctgactgatattgggtaa

SEQ ID NO: 15923 - DNA, 1086 bp, A.fumigatus
tctgaagctgactctcccagctgcgcgcccccgacgattcctctgctccaaggggactttccacacaactttagtgccacgccaccgacactgttttctggctgtactccgtctcagggatcgacggagctactcctcgttgatccacaagcttcgtacgccagctttgacctgattagtgctgctggtgtgtcgatgcctactttctcaatcgacgaacatcccatgtatatatacgccatcgatggaagatatatcgtcccggttcgagtggatgccatcaccattggcaatggaaaccgttattcggtcatggtgaaactggataaaccggctggtgattacaccgtgcgtgtagcgaacgccggaatcaaccaacttattactgctaatgcgagcatgtcttacaacacgcttttcagggctcaatcacgtccttcgcagccatcaatcgacatcaccggcgcaaacacaacagcggacgtcgtgatcctcgacgagagcagggtgatccctttccctgtggaggtaccggcgcaagacgttgcccagaccttcttcctagatgtcgcccggttcaacgcgtcctaccggtggattcttggaagctcggacttcccgctctccgtggaggaatcgcccccacttctgttcaatcgctccgccgccaagcccgatctttcgatttcaacgcgtaacggaacttgggtcgatctcatcttcagagtcaccggccctttacagccaccacaccctattcacaagcactcgaacaagttcttcgtcattggtcaagggaacggtgtcttcaattatacctcagtgactgaggcgcggaaacacattccggaaagcttcaatcttaatgccccgcagatacgggacacgttcgcgacgcctcccagtgtatccggccccacttggttggcaataagatatcatgtcgtgaatcctggcgcattcttgatccattgtcacatccaaatccatctgagcggtggtatggcgctggcaatattggacggcgtagataagtggcctgtggacattccccaggagtaccagcttgcggcctcaggatcatag

SEQ ID NO: 15924 - DNA, 660 bp, A.fumigatus
cctggattgcatctcttcctcccgacttttcatacaccaccgtcgaaaaatacatactccgactcggagttcaagagactctgtcgcggcatactcccatacaacaatcaataccacatctacagcgatctctggatttgccatacatggaaccagtatcgttgcgcgcgcattatcgtctccgagatgatactgagctgtctacgtcgactgcaccgcaagtcaccgggcgcacgcgctgtcagcgaactgcaaagtcactgcatcaggatccgcagcagcacgcggcagttggctgcggacatctgcgccagcgtaccctaccatttcggcgttggcagcacgggtgatagtcagacaggctctgtccccctcaacgagtgtcacaccgcaggtctcgtgctgctgtggccgctggtcatggccggtgcaaccgagggaaagaaccaccctgtgcgcaagtggggcattgactgtctgcggctcatcgggcacggtatggggatcgatcaggccctatctttgatcgatgttttagaaaccgaagcgggggtctatgactgcgtgggcgatgacggagtgctcatagaggagagcagctccgccattgtgaagaacaaggttttggcaaccgcttggaagcatttggaggataaatga

SEQ ID NO: 15925 - DNA, 483 bp, A.fumigatus
ttgcgtctggacaaggccatactgcacaaatcggaacttttgttagccagtcatgccacttgttcaaagaggaagcgggcgcactgcagcccagtaagtctcttcggaagttataaagcaatggattccccctgttgcattataccctgcatcgttgcatttgcactgagttggcatctgctcagtcgacatgggcttctttcgcgatggactgacttccttaggcctgcttctgttatgctttgtttcatgggatcagctggtgtggtgcgcttcaaaatcacactgacatgggaggactggactccgactggtattgcgcggaaaatgattctcaccaatggccaatttccagctccgccattgtacgtgcgacagggcgatgatgtcgagtttttggtagataatcaacttccctttgctaccgcagtccatttccacggtaaagcttgttcactgacagcaattgctagccaaggctga

SEQ ID NO: 15926 - DNA, 957 bp, A.fumigatus
cacataggagggttcaggccatataccgcgactggccctctccgctgtgcacacccggtggtaccacttgctcgcacagcttacttattcaggaacgggtttctgcatccacacattgtacctgtgcgaccgaacaaaatagcaacttattggtttactatggtcttctgtgggaaacccagcaaaggatgcggccaatgccgatcgaggaagatccggtgcgaccaggagcggcctgcttgttcgcaatgcctcaaaggcaacagggtctgccccggctaccgagatgaactgtcgctgatgttccgcgatgaaagtcagcaggttgtccggaaggcccggaatagtgctgccgcacgcaagtccaaaacacaggaaaggaaggcggccaggcgaaccctttcgccgagtgagagtagcccggagtccacatctggtgcgacgacggtctcggtcggccggagtagcgatgtgattgacttcggccacgagagcccggtgcagactgagctgatagagcggcaaccactgacgaggatccagccgtcgtaccagaccacgcaagatgaggcggtctgttacttcctccggtacaaccggtggcctgggtttcactggatgttagacctgagtcccgagtttcttgccagctcgggcttttctgtgagccacgaggctatgaaagcgagtgtcggtgctgtggggacggcgatgcttggacgggttcggcaagacatgtcgatgattatcgctgctggagcggaatatgggttcgctttgcaaatgttagccttcgctgtctcagatccagcagaggtgaaagctaactcgacactgggagcggtcttgatgctggccatttttgaggtgagctgcctttctagcctcgtttttctgcacatgcattgctcagacatctatccaggtcgtgaccagccggacaacacaaaatattga

SEQ ID NO: 15927 - DNA, 222 bp, A.fumigatus
gcggcgatgcagactcacgatttgctagacaaagatggatcgatggtgtctctgctggataacaacaaaatcgagaattccttggaagatttccaaggaaagtctagcaacgacatattggcgttggatatccaacacagggagcatgtatatcatgagaatcatgagactagctatatatactctggcggtagaaagagggacattgctctctatcattga

SEQ ID NO: 15928 - DNA, 207 bp, A.fumigatus
tactcgggatatgcatgctcaactttattatcggtcattggatccggcgctcatgttattttgtacattagacaactttctcactatgtcacttcttttcagaagaccagtctcctctacatctgtttcgtcttgaatccctgcactcattcaaccaccctttctctggtctaccaccctatcaagacttctgaactccgagcttaa

SEQ ID NO: 15929 - DNA, 516 bp, A.fumigatus
caaagacacttacggagtggcgacatcgctaataagtcctgtattgacccccaccataccgacctccagcgcctctgcaacccggaaaatgcgcttgacgtttccgctgaagaagtagccggcaaggccgacctcggcacgattggccagctcgacgacctctttctcggtctcaaaggggaaaattccagccacagggccgaacgtctcctcggaggccatcaacatgtccttgctcatctcggcgaggacagtcaattcgtagaagttggggcccagctcggggactttttggcctcccgcgacaagcttggctcccttggcttgagcgtccttaacgtgctggtcgaccttttcggtagcacgctcgtggataagcgggccgtgagtgacaccgtccccgaagccggagccgagcttgaagttcttgacctttgccgcgaagcgcttgacgaattcatcatacacacctctctggacgtagatccggttagcgcagacgcaggtctggcctga

SEQ ID NO: 15930 - DNA, 738 bp, A.fumigatus
tcactcaaaaacacaccggaggtgggagaggtgatcaccacccatcctgaagtccgcaaggtttcattcaccggttcgaccaacgttggtaggctgctcatgaagcaggcttcgtcaactatcaagaaggtgtcctgggagctgggtggaaacgcacccttcattgtgttcgatgatgtcgacgacctcgatgccgcagtcgccggggccattgcctccaagttccgtagctcaggccagacctgcgtctgcgctaaccggatctacgtccagagaggtgtgtatgatgaattcgtcaagcgcttcgcggcaaaggtcaagaacttcaagctcggctccggcttcggggacggtgtcactcacggcccgcttatccacgagcgtgctaccgaaaaggtcgaccagcacgttaaggacgctcaagccaagggagccaagcttgtcgcgggaggccaaaaagtccccgagctgggccccaacttctacgaattgactgtcctcgccgagatgagcaaggacatgttgatggcctccgaggagacgttcggccctgtggctggaattttcccctttgagaccgagaaagaggtcgtcgagctggccaatcgtgccgaggtcggccttgccggctacttcttcagcggaaacgtcaagcgcattttccgggttgcagaggcgctggaggtcggtatggtgggggtcaatacaggacttattagcgatgtcgccactccgtaa

SEQ ID NO: 15931 - DNA, 378 bp, A.fumigatus
tggcctccgaggagacgttcggccctgtggctggaattttcccctttgagaccgagaaagaggtcgtcgagctggccaatcgtgccgaggtcggccttgccggctacttcttcagcggaaacgtcaagcgcattttccgggttgcagaggcgctggaggtcggtatggtgggggtcaatacaggacttattagcgatgtcgccactccgtaagtgtctttgtcaaagggaatgctactgcattgtgctaactctcgctagattcggtggtgttaaacagagcggtttcggccgtgagggcagcaagtacggaatcgacgagttccttacgatcaagagcgtgacgtttggcggtatgggtgagccattgcagtcgtag

SEQ ID NO: 15932 - DNA, 528 bp, A.fumigatus
gtgttgtcaacagaggtgagactcatcttcttaccgaacaacaagatttgctcgctaacacatttcctaggcgacccatatcctgctgaagttgctgcaactgtgcatgctgtcatgcaaagattgaatttcagcaatccttaccgactgtgctggcagtcccaagtgggaccgtcagcttggcttggagcccaaactagcgatacggtcgaaaactatgtcaaacgtggacagaccgatattattctagttcccattgccttcaccagcgaccatattgagactctgtacgagttggatctggaagtgataaaggaagcaaactccccgggagtcaagagagccgagagtttgaatggtaaccccattttcattcaggcattagcagacattgcccaagagcacctccgtaagggagagaagtgctcactacagatgactctgcgctgtcaaggctgtaagagcgaacggtgcctggaacagaagaaattctttgctggcgaccgattttcttctcttgtagtttag

SEQ ID NO: 15933 - DNA, 1491 bp, A.fumigatus
gtcttttggttgtttccgtttctgcttctctatatgttagggtttgctggtgttgtcgtccccaagatcaatctggttctttctctcgtttgcagggactatctttccaagaaggcttcacaggatcctaactttacgtatctgccggtcattattggggaagacaaccctcagtgccaagtgcctgaggtgcaatctctcgtggctcaattccaactctacctcaatttgattgcaggaatcctatccgcattggtcagtccgcggctcggtcatgtgtcagaccgttatggcaggacaaggctgatcgctttgagctcgctgggagctgtgcttggtgaaacactcacagtccttgtagcagcgaggccagagcgattttccatcaacctgctcctagtgggagctctactggacggcattggaggctcatttactacgattttggcccttgctacctcttatgcttctgattgtactgccccagaaaaacgtagcgtggcgtttggatatctccacggcgctctcttcgttggattggcgtgtgggccactcgttgcagcgatcgtcctgaagaagaccggggagataatacacattttcgctgctggcttggctttccatgcgctgttcttcttcatggttctgctcgtcattccagaatcgctgtcaaaggagcaacagcaagttgcgcgagagaaacaccggagaaggtttactcaaaaggaaactgctggctggttttcttcttcttcttggttacagcatttgaacccaaagaacctcataacaccactctccattttgtgtccccctgttggacgccccagctctctttttccgaaccgcaagggcgcaagccctgccctgcgaagaaacatcatacttcttgctgccatcgatacagtcgtattcgctgttgccttgggcagcgcccagcttgtgatcatttatgctgaattcatgtttggttggggaaatatcgaatccagcatcttcatctcgatcgtcagcactgtgcgcgtgctcgttctttttttggtgcatcctatcctcacacgcatcttccacaagcgtaccgccgaacagcgtgttatccccgggtccaatagagtggagcttgtgattatacagatatccatctttttcgattttcttggctatgtgggatacacgcttgtacgaagcagtgcgctcatgactctttcgggcattgtcgccgctctaggaagcctagctacgcctacgctgcaatcatcgttgacgaaacacgtgccccgtgagcgagtcgggcaaatactcggtgctaaagggctcttgcatgctctggctcgagtgatcgcgcctactttatgcaatcttgtctacagcctgacagtgggtaaattcactcaaacagtcttcgtttctctggcagctgtgttttttttggcgatctgcagtagcttctatataacaccaaatggttcggaaatattcccttttacctag

SEQ ID NO: 15934 - DNA, 474 bp, A.fumigatus
  unsure (8),(39): Identity of nucleotide sequences at the above locations are unknown.
acggctcntcacaagccttacgtcgcgttccggtacgcngaccttctgacggaagaaatgtacacaaagttgctggaagatggattcggcaacgggaaaggcgggcgcgctgtcgcgttcacacagtacccccaatattcgtgctccaccacgggtagctcgctgaacgagttgtggaaatggagaaccaggcttgagggtaagcgtgcaaatggcaacatggaccccgctggtgccatccagtggagtgtcattgatcgatggccaacgcaccctggcctcgtggaggctttcgcccggaacattgaggagcagctgatgacatacccagaggagaagcgaaacggtgtcgttctcttgttctcagcccacagtctgcccatgagtgttgtcaacagaggtgagactcatcttcttaccgaacaacaagatttgctcgctaacacatttcctaggcgacccatatcctgctga

SEQ ID NO: 15935 - DNA, 1281 bp, A.fumigatus
  unsure (47): Identity of nucleotide sequences at the above locations are unknown.
attctgcttcgcacagggtgtgaagccgtgattctggcggcgcgcgntgaacctcatgactccgaagctacacatacccagttggagatcaccgggcacagtggagtggatgatgaacctctcgctcttggagagaatgctgtaacagccgcgcagtttcccccaggcgtcccattgccgcctgtgaagcgccttccggccgaattcgagtgccccatatgtttcaaggtgaaaaggttccagaagccatccgattggaccaagcatgtccacgaagacgtgcagccgtttacttgcacttttccgcactgcaacgagcccaagtcgttcaagcgaaaggcggactgggttaggcatgagagtgaacgccacagaaaacttgaatggtggacttgcaccgttcatgattgccatcacacatgctaccgcaaggacaatttcgtacaacatctcgtccgagagcataagatgcccgagcccaagatcaagaagacgaagacgaaaggagtagggcccgcagctgaaacacaggaagaaagcagtcgtgagcgagaagctgagcagctgtgggagctcgtggaccagtgccatcatgatacctccaagggcccgcgggaggaaccctgccgcttctgcggtaacgtctgcagcagctggaagaagcttaccgttcatctggccaagcacatggagcagattgccatgcctgtcctggcactagtgcaagaacgacatctgtttccaaacatagatgctgatgttgccccgaaagcagtcagttaccctggctcgatcgcacaggaagtaaccagcttttcacctcaactgaatggcatcaaagccgagccggaggcgccaatgaacttcgaagccggtcaatccgagccccctactggatttttgaatccgacgtacccaccgacctccacaaccctacatcaagggtttctatccgctggaccagacgtgtacactgcatacggatcgcaggcgggctttgcggggcagcaattcgtgtctcttcatcagaactctgtcacctacccgccactgctgaacactgggtcgcgacccagaataacgacccaagagctgagcgtgttgcagaatccgtaccagctttgcagctcacctacagatatgcgcgcgacgtatgatcctcagggcacactgcatatgtcaccccctccggtagagaacggccaggcctatcacgaccagatcacgcaagccacatcgtattcatacgacggctccgtgggttattcccgccaattttaa

SEQ ID NO: 15936 - DNA, 207 bp, A.fumigatus
  unsure (63): Identity of nucleotide sequences at the above locations are unknown.
ctggagtccctctcaacacatcggctttcaatctgcagcccatgggaaagccctatcagatcnacgactacattgaccggcggcgctcccaccggacaatacagcaccccctcagaaaatgatagccagtacaacggtctcgcgtccggtgattcaggataccgggagtcgaaacctggtttaacccccgcccccatactggttctt

SEQ ID NO: 15937 - DNA, 837 bp, A.fumigatus
  unsure (293): Identity of nucleotide sequences at the above locations are unknown.
ccagtatcacatagttataggattgaacgaatatcagtagcacgattcatcaacatgcctggtctcactctgcatctccttgctcttgctccttcaaccaccgccgagtccttttttcgccagctccgccaatcttccgccatcaagatcattctcgcctctcgtccacaacacatcgtcattcctcccaccttcattgactccaatctgctgacgaccacaaaatgggatctccttgtgctccttcagccgtcttcgaggacccaagaagcagcccgtgaatcacttccgcntaacctccaacccttcgtgcaacaggagtaccgtcttgccgtcggcgtcccctcaaagcttctatccaactacgatgaccgcgacagatctctcaaacgagccgcctcctccatccctctaaccggttctctggcaaatgctcaccagaagccttcctcaaagaatttggaactctccccagatctgctcgcttacatggacaccctcacgcgtacacacgatggccccgtcaccatgctaaatctgctgcatttccaccaccccaacggaaagaaaagctactaccaatacggacaggctttcatccccgtcgctggtaagcgcggcgggaatgcaaagctcgtcgggaatgtgatcagacccgcttcgaccgcccaggtcgactcgcgtggaagcctcgatcgaccagagacagattggtggaacgaaatctcgctggtgcattacccttccatccggcacttatgcgatatgctggctggagaggactatcaagcgattaatgagaagtatcgcttatctgtacattgcgccttcctttga

SEQ ID NO: 15938 - DNA, 201 bp, A.fumigatus
gcgaacacgatatccgtgactgcgagaaacgctctgtacagactagtcggcctggtcacttcgaccctcacattcggcggccgctggacaccaagcgcgatcattgtgaccaagactgccccaacgatactggcaaacgctgcagtcatcactcagtgtcaactcgtcactgctcatacgacagatcttacaaatcactga

SEQ ID NO: 15939 - DNA, 486 bp, A.fumigatus
ccaaggggcgtgatactgatcgtcggcattgctatcctcaccgtttacaccggctacgtaatggggcaattcaagcaacggtatccacatgttcatagcattgcggatgggggcgaggtactctttggctgggtcggacgtgagatccttggggcggggctgctgctctgcctggtgtttgtgatgggagggcacattctcaccttcactgtcatgatgaacacactgaccgaccatggcacatgcagtgttgttttcggggtggtgggactgctgatttcgcttatattgagcttgccgcggacgtttaagaggatgtcatggttgtcagtgatttgtaagatctgtcgtatgagcagtgacgagttgacactgagtgatgactgcagcgtttgccagtatcgttggggcagtcttggtcacaatgatcgcgcttggtgtccagcggccgccgaatgtgagggtcgaagtgaccaggccgactag

SEQ ID NO: 15940 - DNA, 234 bp, A.fumigatus
ccaacaacggcagccgcccatccagccttctttggcttcatttccgagatgaaaacccccaccgactggccgaagacgctgtgttttgttgaaatcatcaacacgaccttgtacaccgtcactggggttgttatctaccggtttgctggtcaacatgttgcttcgccagcactgggctcgaccagcccgttgatggccaaggttgcgtatggaactgcaattcccacggtatga

SEQ ID NO: 15941 - DNA, 204 bp, A.fumigatus
acgttcgcgccgccgcccttattggctcttataggcgtgccccgcatcactctcgctgccaatgaggaagcagattttgtttcagatggccaatctggacttccgaagatgagcagtaggctgaccacattttccctttttttctcttacattctttttcgtttttgggaaaccggtacgggccggtgtcagaaagaggcataa

SEQ ID NO: 15942 - DNA, 201 bp, A.fumigatus
gttgacctactccgttcagcttctggtgaacagctcaacaacacagaggaagcagcccttcttttctatcttttccctggtccgggggaaaagtggggaaggatacatccagaaaccgagcaagtctgttgtctcaaggatatgggtctctccggcgaaataaagattgatgaaatcaatttaaaggggttgaacggttag

SEQ ID NO: 15943 - DNA, 1218 bp, A.fumigatus
cactctgcggaatcggtgatcgcagtgacgagccgatcaagcaacatatcctcggcatttctaattttggtgagtactcggtcgctgttcggagccgcaggtgtgctgacacacactcttgtccatgaaactcggcttagtgctggaatagaggacaaaccggcaaccgaactccgtggatcttatcaggcattatcatttgcaaagagatgtggcagagtggattacgcggggttggatggccctgctaggaagaagaggaaaaggggtaagaaaagctcaaatgctaccaaaataccgaacgagagctcctcccaaaagcatagcgacgccgcgtcacccggacaaaccgaacaagctaacacttgcgcgggggtggcaaccgataagtcactggttcctggagagccgaaggtcggcggcactgctcccgcacctcacggccaagaatatcccacgagcaatagctccgctctgccagaggtggaagcggagaggcactctgcattggattcgccttcatctgcaacggaaggcgtgcctcgcccggatcatcagaaagaacctgattgccctagtttggcagctactcacatatgctctgggtcgacctttgacgttaatggcgccggctgcaatactctgctcccttcaaggctgtcttctatgccaactttgtgcgcgtcagccatgagaacgatcgaaacgatattgacgaactgtgtagagttgaattatgcgctgacacaatacaggcgtcaaaaaaaggatgttactataacaacgaaaatcgaggatatccggggctacgttgaagagattactcagttgaaatacgcagacgccatgcatattgtgaagaaggacaacgctctttttgcgagcaaggctatgcaggctcggtacaacgaaacagcatactgggacatcatcttgaagggtgccaagttcctcgatcctgcaaagctgccgactgctatgggccgccttgatgatttcacgagggccgagaagcacgccatgagaacattcatggaagaagccggatatggcacaagttacgcaaatcagcaacggtgccgcagactttggaggaacctatcccagatgcgaaatgctggcgtcgacagaatcccactatatcgcacgaaggaatttgacagcttctgtcacgaatatccgaaagacaccgagccctctctgctggagatgatttaa

SEQ ID NO: 15944 - DNA, 468 bp, A.fumigatus
aaaactaacgcaactaccagggaatactctgctctcaagagtattgtgatggcctcgccgaacgaggtggtgaagatgcccatcaacgaacccgccaagggcaagaagcaatcccagatcgaagaatacgtcgacttctacaacggcgcaggcgtccaacacattgctctgctcaccgacgacattatccgcgacattaccaacctcaaggctcgcggtgttgagttcatcaaggttccagatacatactacgaagacataaaggtgcggctgaagaaagctggcctgactctccacgaggactttgagacaattcgcagcctggacatcctcatcgactttgacgagggaggatatctgctgcagctgtttaccaaggtatgtcactttccgttcagcaggcggccgcagacagtcacgctaatagagagaacagcacttgatggatcgccccaccgtcttcattga

SEQ ID NO: 15945 - DNA, 732 bp, A.fumigatus
cagctcttatatcgcgggctaatctcttccttgacaagaacagcttatcatctcttctcacttgacttcaatatggctccctcggctatctctacgagccctccaccaaccgatcgggtttcctctagtcttgccagctacaaaggctatgaccatgtccactggtacgtaggcaacgcaaagcaagccgcctcgtactacattacccgcatgggcttcaagcgtatcgcctaccgtggtctcgagacaggatgccgcagcgtctgctcccacgtcgtgcgcaacggcgacatcactttcatcctcacttcgccgctccggtcactggatcaggtcgaccgcttccctcctgaagagcaggaactgctcaaggagatccatgctcatctcgagaaacacggtgacggggtcaaggacgttgcttttgaagtcgactcggtggactctgtcttttatgcagcgacgaacaatggtgccaagattgtttctcagcctcggacccttgaggatgacaacggacaggtgcgagtggcaactatccagacttatggcgagaccacgcacactttagtggagaggggctcgtatcacggcgccttcctgccaggatatcgcatggaaaccggggtagaggacccgatctctcagctgctgcctggcgtgcacttgaaccggattgaccactgcgtcggaaaccaggactgggacgaaatggataaggtttgcgaatag

SEQ ID NO: 15946 - DNA, 447 bp, A.fumigatus
  unsure (368),(390),(407),(417),(441): Identity of nucleotide sequences at the above locations are unknown.
cactaccgcatcatccatttcttcagctgcaatatcaaaacaccaaacaagatggcttcaggcactacaattcaacccagtcggccttccctgacatccaacgactctgcagtcctacaagctctcttcgacgccgaatcatccccttcctcagccgtcgcaatcgacccatcactctccccattcccagaatacctccacatctcagcgagcgaccacgaatcccttaaagcccgcgagctgagcatcattcgcagcctccaatccgacgatgtctcaatggacaccatcacatccggcatcagggacctcgacgccctgatcactgagcacccgacttacccatctgcctacgtcaacagagccangccctccgcctacacattgaanaaaacgccaaagcttcnaccgacccanaagagctatcttccaccctggaanacctga

SEQ ID NO: 15947 - DNA, 258 bp, A.fumigatus
ctgttctccggaatggttttcctacgtctcacggtcaaggtctacccccgcgaacagactcagtcctcgtcgtccttttcgatccgctcattcctgggtgaccgtgatcgagatgcttcgggccagaactctggacaggcagcggggaagccggcttccttcctgctggtcctggagaaacccgaagatgtgacgatgggtggattggcaagcatgatccgggagaagtggacgaagctaccgccgaacgctgagtga

SEQ ID NO: 15948 - DNA, 1611 bp, A.fumigatus
caggacgcgccaaaatggcccagtgtttacgagaaagactacctgcggcatggccagcctttgaccagcttgccaaccagtcagcagcgtgatgcgctggctggagttcactcgctgaatggccccagggttgtccgcaatatccctagtatctccgggccatcgcccctagagctagccaatgatactccacgcgagttaatgcgaagcccctccgaactggcgctaccaccggcgctgcggcacagtacaattatccgaaagggatgggacaacgctgttgatatcttcgtgaccatcctactattgttctttggtgccttcatctacttcaattcccacaacatacaggaactcgccaaacagaaactggacgtcaagaatatcatcgcgtcctatgctcagccaccattgtcgactccctccactcctgttgtcgaaagcactcatttcaagcgtgattcgagtcctagcaggccgatatcgaatctcaccgtcgaggtcacagtacccgaagagcaacaagaaggcgatgcaaccccgaaatcgaaacgagacaggagtgccgttggccccgattccacccctcgcgtgaaaattcgcgaaccctcccgcggccctgacagtgacgacgatgtcgaggaactggaccaggccgcttcgcctgagaagcccaagaaaaaggcccgtcgaggtaggcggggcggaaagaaccaccgacgtgggaagaagcctgattcggaaggtgaatcaaaggatcaggcggaccgagtcgtggaccaagtgaacaacctgcagcctcagtcccgtctggaacccgacctccagttagtgcggaccgtatcaaacgatattattgaaatggacggtgttcttcaaattggtcgtctcagggtattcagtgacgttgttctgggccatggtagccacggaaccgtcgtgtaccgtggatccttcgatggtcgggatgttgcggtcaaacgcatgttggttgagttttacgatatcgcctctcatgaagttggactgttgcaggagagtgacgaccataacaacgtaattcgctatttctgtcgcgagcaagcggctggcttcctttatattgctctggaactatgccctgcgtctctccaggacttgattgaacgtccgggtgactacccccaactggttcagggtggcttggatatgcccgatatcctgcgtcagatcatcgccggtgttcggtacttgcattcactcaagattgtgcaccgagacttgaagccgcaaaatattcttgtggctatgcctcgaggacgcacaggctcgcgctctttgcggctgctcatctctgactttggtctatgcaagaagcttgacgataaccagagctcgttccgagcaactacggcgcatgccgcaggtacgtctggctggcgagctccagaattactggttgacgacgacaaccgttcggccatccaaggcggcgagtctcagcataccgagtcttctgagccagcagtagtggatccgcaaaccaacagacgagccactcgtgctatcgacatcttctccctgggctgcgtattctattacgtgttgacacggggttattcatccctttga

SEQ ID NO: 15949 - DNA, 1116 bp, A.fumigatus
ttcaacgatgcgagcgctctatcatccatggctctggcgggccccggccgcgccgttcgagcccgtcctgcccaggccagcagttcgtctgccggcctggcaccgcagcttcacgcgcggtctctgcaggattgggaggttgaggactttgtcctactggcgaccgtcgacggttccattcacgcacgcgatcgcaggaccggcgcagctcgctgggccctggaggtcccaagcagccccatggtcgagagcatctaccatcgagccaaccggtcgagcttcgatcgggctcagcccgaagatgattttctttggattgtcgagccgagtcaagatggtaatctgtatatatatagtcccggcccggatgcggggctgcagaagctggggttgaccgtcaaggaattggtggaacagactccctactcagggacagaccccgccgttacctatacggcccggaaggagacaactttatataccgtggatgcgcggacgggtaatatcctacaggttttcagctccagaggtcctatcacctctgggcacgggtgccgcaaggtcgacgggtttgacttggaagcggaggagtgtgatacaccttccggcaccctggtgcttggtcgtgtcgagtatgcggttgcgatacaaaacactgagaccggtgatccgatctgcacgttgaagtactccgaatggacggccaacaaccgcgacatggatcttcagagccagtactttcggacgatggaccagagccatatttacagcatgcatgatggcgtggtgttgggatttgatcactcccgaatggatcgtcctcgttacacccagcgcttctcgtctcctgtggttcgtgttttcgatgtcgcccgccccatcaacgtcgaatcacccgaagccgccactccgcttgtgcttctatcgcaacccctgcagccacctgatccggattacggctcgttggatgacagagacgcgagagtgtttgttgattgcacttcagcgggcggatggtttgcaatgtccgaagaaactttaccctctcgtgacaggacgcgccaaaatggcccagtgtttacgagaaagactacctgcggcatggccagcctttga

SEQ ID NO: 15950 - DNA, 552 bp, A.fumigatus
  unsure (51): Identity of nucleotide sequences at the above locations are unknown.
tcccgatccatgttgttatctgacccgttcgcaaccggaaagctcatgtanggttcttttatagcctttcgcttatttactgacctcttccccagacccgacgccagtgctgttctgatgcatccctttttctggaacccgtccgaccgtctcagcttcctctgcgacgtatcggatcattttgagtttgagccacgggaccctccttcggacgctcttttgtgtctcgaatccgtggcttgccgtgtgatgggccctgagatggatttcctacgtctgctgcctaaggatttcaaggacaacctcggcaagcagcgcaagtacacgggctcgaagatgttggatctcctgcgggcgctacgtaacaagcgcaatcattacaacgacatgccggcacatctcaaggcacatattgggggcttgccagagggatacctgaatttttggaccgttcggtttcctagccttttgatgagctgccactcggttattgtggagttgcgtttgacgaagatcgaccggttcaaacgatattttactccggttgagtag

SEQ ID NO: 15951 - DNA, 270 bp, A.fumigatus
ttccagagcaatataaaggaagccagccgcttgctcgcgacagaaatagcgaattacgttgttatggtcgtcactctcctgcaacagtccaacttcatgagaggcgatatcgtaaaactcaaccaacatgcgtttgaccgcaacatcccgaccatcgaaggatccacggtacacgacggttccgtggctaccatggcccagaacaacgtcactgaataccctgagacgaccaatttgaagaacaccgtccatttcaataatatcgtttga

SEQ ID NO: 15952 - DNA, 1797 bp, A.fumigatus
ttatggctgggcagcagaggtttttacagtctgcgctatgggtatgcacatgtctggcattcagccttcgctcgcattcattctctcctaaggttgacacttaccataggttccttcctccccattaccctggagcaaatggctcgcgaccgcggtgttcttttttccgataaggtgacaccctgcagtgctaccttgaatgatccatcgaggacgtccatccaagcccggtggacgctttcttcaagatatgatgccggacgaccaacagtggcgaaccagtgtgtggtctacatattcggtgtcgagataaatactgcaagtttcgcaatgtatacattctctgtgagtgtctttattcaagccatcttaatcatatcgatgtcaggagccgcagaccatggaagtcatcgaaagttgcttctaatggctttcgctgtgattggctcggtctccacaatgctctttctgggtgtagtgcctaagatctatatggtgggggcagtgattgcggttattgcaaacacatgctttggtgcctcctttgtgcttttgaattcattcctacctctgttggtacgccatcatccttctgtgcttcggagtgctcgtgaaccgcgccctgctttggatgattctcgcgcccaagaaggtcattctgataccacaaacggtattgaacatggcattgagtctaacgtcacctcgcctctgcttcatgcccgtcagggaaatggcgaaaacgccgaagcggacatgcatcctgcaactcacattacagtttctcaagagctgaaagtatcaacccggatatcttcttttggaattgggattggctacatcggtgctattatcctacaaatcgtctgcatcctcgtcgtcatcgctaccaaccaaactacgtactccctgcgtctcgtactgtttctaatcgggctctggtggtttattttttcaatacctgccgcgctctggctgcgatctcgcccaggccccccattggctaccactcatcacgggaagcacacccgctcttggatcggttacatggcatattcctggaagtcgctttatcggacagcagtgcggacacgtcatcttaaagacatcttactgtttctcgccgcttggcttcttctcagtgatggaattgccaccgtcagcgggactgcggtactctttgcaaagacacaactaaatatgcaacccgcagctttgggactaatcaatgtgattgcaatggtggccggtgtcttgggggcgttttcatggggcagtttttcacgagtattcaatctcagcgcgtcgcaaacaatcattgcatgcattctcttgttcgagctagtgcccctctatggtcttttgggatttattccagcaataaagagcctcgggtttttgggtctccagcagccgtgggagatgttcccactggggattgtgtatgggcttgtcatgggcggtctatcctcttactgccgcagtttcttcggagagttgatacctcctggcaacgaagcagcattctatgcgctttatgccattactgacaaaggttcgagcatttttgggcctacaattgtcggcatcatcaccgatcgctacggtgaaattcggccggcatttgtgttccttgcaattttgatatttctcccgttaccactgatgctccttgtggatgttgaacgagggaagagagatgcgcttgctcttgctgcagaattacagccatcaggcgctcaaacatacggaacgcttcccacaaacgaggaccgcgcaccgccaagtgagctatag

SEQ ID NO: 15953 - DNA, 435 bp, A.fumigatus
gagaatctccggcagcagaccaacggccattgcacccctccgaacgacgttcccacgtcctatatccttctactctccctcccttcgaggtcttctgacatttccgccacgatgaacactgctcgtgtcgcccgtcttggcctgcgtgccacccagcagttctccgtccctcgcactgccgctctcaacggtttgaggacttatgctaccccggctcagaacgtcaagccccccgtggctctcttcggcgttgatggaacctatgccactgctctggtatggctcgcatttctccctggattatccttcaatgctctgcggatttggtcacagtctgcgtttttttcccgatccgttgacccggcccccctctctccgcctgcaaatcgcgtcaaaatgcatatcgttcatccgggaattcctaaagggcattga

SEQ ID NO: 15954 - DNA, 408 bp, A.fumigatus
tacactgcctctgccaagtcctccgctctcgaccagacgtccaaggctctctccagcctcgctcagaccttcaaggccgaccgcaagctgaccagcatcatcgctgcccccaccctcagcgccagcgacaagcagcagatcatccaggaactccagaagatcgccggtaacgacaagggcgacatcatcaagaatttcctgcagaccctggctgagaacaaccgtctcggcctccttgagggcatctgtcagaagttcgagaccctgatgggtgctcaccgtggtgagatggaggttaccatcaccagtgcccaggtgcgttttgactattgcgttatcatgtcggacttgttgcttacactcgtcttccttccaggaactcgacaacaagaccatcaaccgccttga

SEQ ID NO: 15955 - DNA, 261 bp, A.fumigatus
tgggtgctcaccgtggtgagatggaggttaccatcaccagtgcccaggtgcgttttgactattgcgttatcatgtcggacttgttgcttacactcgtcttccttccaggaactcgacaacaagaccatcaaccgccttgagaaggccgtttccaagcacgagctcagccagggcaagaagctcaagatcgttactaaggtacgcacattgctctattccatcattcatgaccacctagctaacgtctgtgtaacaggttaa

SEQ ID NO: 15956 - DNA, 1095 bp, A.fumigatus
gtcgatttttccgtgttccaagctgtggcaaaagccagaaggacgtccatgcttggtaagtggttcccagagaacgagacggaccacgaaattctgtggggcattaaggacgcccaaccctacgttaaggatgcctttcaatcgccatatcgtcaaagaagagaaaaatgcgattacccctgccacaagggaacaaagttcgctgcttggtatgcctttgatgagggagacggcatccctccaggcgagtgcgcagtcgtccgcttcaggttctcccgcaagaacgagcaattcatcgacgaggaagtgctggatgatacaatcgagcagcgaagggcagaagctgacgatttttactaccgaatcagccctcttccgatgagtgacgatctgcgtaatgtccaaagacaggcattcgcgggcatgatgtggacgaaacaattctaccacttcatttgggaccaatgggcgaatggagatcccggaatgataccaccacccccaggaaggaagcatgtgcgcaatcagcaatggaagcatctatacattgatgacattctgtctatgccggactcttgggaatatccctttttcgcagcttgggatacggctttccactgcatcccgctggcgatgatcgatccggatttcgcgaagaagcagctggacctgcttactcgtgaatggtatatgcacccgaatggccagctcgcggcttatgaatggaactttggggatgttaaccctcctgtccatgcatgggccgtcttcagaacgtttaagattgaacggaagatgtacggccggcaggaccttgacttcctggagcgcgtcttccagaagctgttactgaactttacctggtgggtcaaccgcaaagactcagaaggtaaaaatgttttcgagggcggtttcctggggttggataatattggattgttcaaccgttctgagcctcttccgactggaggtgtcttggaacaagcggacagtactggttggatggccttctattgtctatgtatgctcaatatagctcttgaattggctaagcatcgccgaacttacgaagacagtgagtcaacattctactag

SEQ ID NO: 15957 - DNA, 807 bp, A.fumigatus
cagctgatccgtcacagcttttactacgatgcgatttcttacggcgagccatggacacaacagctccccgtgaggtcgctggttggcttgatacctctgtatgcggttcttacactcgaacccgagctgattaaccaattcccttcattcaagaagagaatggagtggttcattgaaaacaggcaggatgtcgcagaaaggaacattgcaagtatgaaacggcgcgggaaggacgaccgcctcctcctgtcgctggtgagtaaggatcgtctagagaagattctcaagaggatgttggacgaaaccgagttcttgtccaagcacggtgtccggtcgatgtccaagtaccatgagaaacacccctattccatggacgtcaatggccagacattcagagtcggctatgtgccaggtgattccgacagtgggttgttcgggggaaacagcaactggcgcggacccgtctggctatgtgtcaacttcttacttgttgagtcccttctccggttctacatgttctacggagattctttccaggtggagtgtcccacaggctccggagactacatgcatttaggccacgttgccgaggagatccagcatcgtctgcagcacctcttcgctcgcaacgaccaaggccgccgagctgtcaacgatggctcggatctcctcgattacgatgagcactggaaggactacatgtggtttcacgagttcttcgatggtgacaccggacgcggtctaggagcgtctcaccaatgtggatggactggcctcatcgccaaggtcatccacgataccgggtaa

SEQ ID NO: 15958 - DNA, 486 bp, A.fumigatus
gagcgtctcaccaatgtggatggactggcctcatcgccaaggtcatccacgataccgggtaagtttatcttcgggagcctgaaactcccatctatacacacctctaaccttctctgcagaatcaactgccgcctcccacataccccacgctcccccttcgctgccgcatcgcactacttcgacgacatcttcacccgctctggccggccccgttcgagccgcaagcccagcttccggcgctcctcgaccactcgctccatcggcaaccgcagcgatttcgaatcaaccttcgccggtgccgagactcccgccgcagatatcctgtcagaagacgagcaggaccacagagtcccccgcaacggagtagatgagcatgtctccaattacgtcgccagccagctgcagcgcgtgagaagctccgcatccatcggggcttacgaggatgagtttgaggcgcaggctgaccgtacgccgaacggtcattag

SEQ ID NO: 15959 - DNA, 1416 bp, A.fumigatus
ttcagtttcacagaactgctcgcggagcagcagctctcagatctcttgcctccttcactacgatatctcctcgcgatcgctacacatcgtcatcctcgctatctattacgaattttaaactcatacgacgaagtctacgcactcctgtctctcattgtcgagcgctactatctccgcacctttggcggttctttcaccgagaacttctactccctcaaacgagaacgagtcttacggaccaagaatggcgagattccccgggcgcagctcggcgcgccaggtccggtgcgagagtctcttaagctgcgttcctcggacgtgtggaagaacctttttgtcatggttggaatcccctatctgaagcgcaagctggacgagggctacgacatacacgccgcaccgcaggcgtcgctgattctgggcggcgggccacgatacaatcccagcgacgaccttcccccccgcccaacaatccgccagcggctgatgtactactataaatggtttctgcggaacgtctacccctccgtcaatgccgcatactacttctccatcctagcgttcaatctggcctacctcttcgacaacacaaaatactcctcccctttcctgtggctcatcggcacccgaattcgccgcctaggcgctgccgatcatcgcgccatcgccgaagtgctagacgccaaacccagtgccagcgctgctggcgcgcgctcccgccccggttcaggactcatgggtatattaagtccgcagaatctctacccacaactcctcgcctcgatgcgatacttcattccggcgtcgattttcgcgctgaagttcctcgaatggtggcacgcaagcgacttctcgcgccagctggctcgcaaagcgacggaggtgctcgatcttcctgcccccgtcgtcaacggcatggttcctccctcggaaagaatcaagaaagtagattcgcggaagggcaaggaagccgcttcgaaggacctcaagcccgcgttcaaaagcccccgccgccggatgcagccacccatctcggccacttcgtacctacctatcttcaccgttcctctcccacctgcagactcggatagcgcgtctgcctgcccgatctgccttaacacgctgacgaacccgacggcgtgccagaccggctacgtattttgttatgcttgcatctttcgctggctgaatggggaacaccagcggcagctggattttatgaatggcgagagcgcgggtgctgcctgggaggatgagaatgaagataatgaggatggtgcgaaaagcagagaggaaggctctgcagagaagaaagtcagtcgggagggcaagtgggagagtggcaaagggagatgtccagtcacaggacgcagggtgctggggggtactgaaggacttagacgagttctaatctga

SEQ ID NO: 15960 - DNA, 240 bp, A.fumigatus
ctaactactgtcttcacgatggaatacctacccagtcttcagcaggagtttgacgagctcaagccgtcgctcttcggtaagcgaactgaccttagaagattggattcgagaacctcaactgattcagtttcacagaactgctcgcggagcagcagctctcagatctcttgcctccttcactacgatatctcctcgcgatcgctacacatcgtcatcctcgctatctattacgaattttaa

SEQ ID NO: 15961 - DNA, 276 bp, A.fumigatus
tttggaggaacggttggcccaagtcaaattcctagttcaaggggaagaacaaggaatttcggagcgggattcatggaatgcattcaaccttgttcggcaatggagttttcctgggtctcgtgcaagaatcattccaagttcaacaatatcaaagactacacgcgaccctggtttgcctgggccaactcggtctttgcccagactatattgaagattgcagcggagagaccacatctgatatttggggagggcgcgaagccgtacatcgtccagtaa

SEQ ID NO: 15962 - DNA, 414 bp, A.fumigatus
attcgtcgaataaggcaatctacgagagaccccggaaacggctgcgcagatactatcactcggaatatccactggacgatcaagacaatcacgatcccgacaacccaatgcaacgacgcgacttcatcctggcaaaaacgaagttccgcacctacaatctctcagcctcgacattcgttgacctcgtcaacgacccccacccatcatcaccaggaggcagccacatcccccacgatcgcctccgccttcggacagtctcccggaaacgcaaaagccccatcgacgaggcaagcaacaccctccacaaaccagaattcaccgacgacaatggcaaccccatggaccacggcgaggagcggttcacctctcgcggaatccacatgtggccgcccgagaacgcccccgcagagctga

SEQ ID NO: 15963 - DNA, 549 bp, A.fumigatus
tcaatccatctagcgaacatcaatcgaaaaagcggctacccgatcgtcaatatgggctacgacacaaaaacccccaaatactgctgcggatccgtggtggacaatcaatgcaaagacggtgatccctttacaatcggaaacggggcggtgataccagaggtagcagctctagctggttacgtgaaagcttcagcaattaccgataccacctgttcgaattctttgtcaatcaccacatcgtcaaattctgcgtcaactgccattaccgcctgtccaacatcaacaggggataatacatcaccctcgtcccacgacctggctatcggagtaggggttggtgtgcctttaggcgtcattgctctggcatccattgtctgggcactgtgggagcgtcggcgcaggctactggtcaatatcagcatcaatatctggcgcacggcatatatcaaccacatcctgcggagctcgcgactggacaaacagggtcggcatcggagttggacagcgacgggggtgcaaaatgaactagatattgggtcagtgaggtga

SEQ ID NO: 15964 - DNA, 183 bp, A.fumigatus
acgctagccgcggctccttccagccccgtggtgaagacgctgttcactaactccgttcttccagcccgcatattcgccaacggtcctttgcgcgctaaggaggctactggttacatttcctcgaagtatcctgttattgtaagtgactgtcgcattgacatggaaacgaactggtctaattga

SEQ ID NO: 15965 - DNA, 210 bp, A.fumigatus
gatcacgaatatgatgctgtcgttgtcggtgctggtggtgccggtctgcgtgccgccttcggtctggcggaagccggattcaacactgcctgtgtctcgaagctcttccctacaagatctcacactgttgccgctcagggtggtatcaacgctgctctgggaaagtatgtcaatgaaatgatggagttgaatattgggcgattgtgctaa

SEQ ID NO: 15966 - DNA, 261 bp, A.fumigatus
ttttttttctttcggttagatgctaacaagatgtcctgtagcactcaaaccgctgtcgccgccgccaaccgcaaggagtcccgcggtgcccacgctcgtgaggactaccccgagcgtgatgacgagaactggatgaagcatactctcacctggcagaagaagcctcacggtgagatcaaccttggctaccgtgctgtcgagcacaggaccctcgacgagaacgagtgcaagagcgtgcctcccttcaagcgtgtctactag

SEQ ID NO: 15967 - DNA, 297 bp, A.fumigatus
gagatgactctccatctcgcccgtcaagccaacacttgcaccggcagcaagcaatggtatgtttgctccaagggcaacttccgtggctgttgctcaattgatccgtgcaatacgggtgtatgtccggatcaagagagccagtctacattgtcgacgtcgactacttccaccacctcgaaacctgcctcaaccacaacggcgatctcgccaacgacagccatcactactgcgccttctacaagctcgcagggagacatcccgggcctcattccgactcgaactgtgactcaggctgtt

SEQ ID NO: 15968 - DNA, 1485 bp, A.fumigatus
  unsure (930): Identity of nucleotide sequences at the above locations are unknown.
aatgatggagttgaatattgggcgattgtgctaatgccgatttgcagcatgcatcccgacgactggagatggcacatgtacgacaccgtgaagggttccgattggcttggtgaccaggacgccatccactacatgaccagagaggctcctgctagtgttcgtgagctcgagggctacggatgccccttctcccgtaccgaggatggccttatctaccagcgtgcgttcggtggtcagtccaaggaattcggcaagggtggacaggcctaccgttgctgcgccgtcgctgatcgtaccggccacgctcttctgcacactctctacggacagtctttgcgccacaacactaactacttcatcgagtacttcgctcttgatctgctgatggaggatggtgagtgccgtggtatcatcgcctacaaccaggaggacggtaccctgcaccgcttcaaggcccaccacacagttttggccactggtggatacggacgtgcctacttcagctgcacatctgcccacacttgcactggtgacggtatggccatggtcgcccgtgctggtttgcccaaccaagatcttgagttcgttcagttccacccaactggtatttatggtgctggttgcctgatcaccgagggtgctcgtggtgagggtggttatctgctcaactccgagggtgagcgtttcatggagcgttacgcccccaccgccaaggatctggcgtctcgcgacgtcgtctcccgttccatgaccctcgagattcgcgagggccgtggtgttggtcctgagaaggaccacatctacctgcagttgagccacctgccccctgagcttctgcacgagcgtctgcccggtatctcggagactgcatccatcttcgctggtgttgacgtcaccaagcagcccatccccgtcctgcccaccgtccantacaacatgggtggtatccccaccaagtacaccggtgaggtcttgacggtggatgagcagggtaacgacaaggttgtccccggtctgtacgcctgtggtgaggccgcctgtgtctccgtccacggtgccaaccgtctgggtgccaactctctcctcgacctcgtcgtcttcggccgtgccgtttctcaccgtgtccgtgacatcgccacccctggcaaggctcaccgtgagctgagccctgacgctggtgcccagtccatcaaggacctcgacttcgtccgcaacgccgatggccccaagtcgactcacgagatccgtaacgccatgcagagggccatgcagtctgatgtcagcgtcttccgtacccaggagagtttggatgagggtgttcagaagatcaccgccatcgacaagatgttcgaccaagtcggtaccaaggaccgcagcatgatctggaactctgaccttgtcgagactctggaactccgtaacctgctcacttgcgcgtatgtatcctttcagcctttgattttttttctttcggttagatgctaa

SEQ ID NO: 15969 - DNA, 195 bp, A.fumigatus
tccgtgcaatacgggtgtatgtccggatcaagagagccagtctacattgtcgacgtcgactacttccaccacctcgaaacctgcctcaaccacaacggcgatctcgccaacgacagccatcactactgcgccttctacaagctcgcagggagacatcccgggcctcattccgactcgaactgtgactcaggctgt

SEQ ID NO: 15970 - DNA, 1473 bp, A.fumigatus
  unsure (574): Identity of nucleotide sequences at the above locations are unknown.
gtgctacaggacatcttgttagcatctaaccgaaagaaaaaaaatcaaaggctgaaaggatacatacgcgcaagtgagcaggttacggagttccagagtctcgacaaggtcagagttccagatcatgctgcggtccttggtaccgacttggtcgaacatcttgtcgatggcggtgatcttctgaacaccctcatccaaactctcctgggtacggaagacgctgacatcagactgcatggccctctgcatggcgttacggatctcgtgagtcgacttggggccatcggcgttgcggacgaagtcgaggtccttgatggactgggcaccagcgtcagggctcagctcacggtgagccttgccaggggtggcgatgtcacggacacggtgagaaacggcacggccgaagacgacgaggtcgaggagagagttggcacccagacggttggcaccgtggacggagacacaggcggcctcaccacaggcgtacagaccggggacaaccttgtcgttaccctgctcatccaccgtcaagacctcaccggtgtacttggtggggataccacccatgttgtantggacggtgggcaggacggggatgggctgcttggtgacgtcaacaccagcgaagatggatgcagtctccgagataccgggcagacgctcgtgcagaagctcagggggcaggtggctcaactgcaggtagatgtggtccttctcaggaccaacaccacggccctcgcgaatctcgagggtcatggaacgggagacgacgtcgcgagacgccagatccttggcggtgggggcgtaacgctccatgaaacgctcaccctcggagttgagcagataaccaccctcaccacgagcaccctcggtgatcaggcaaccagcaccataaataccagttgggtggaactgaacgaactcaagatcttggttgggcaaaccagcacgggcgaccatggccataccgtcaccagtgcaagtgtgggcagatgtgcagctgaagtaggcacgtccgtatccaccagtggccaaaactgtgtggtgggccttgaagcggtgcagggtaccgtcctcctggttgtaggcgatgataccacggcactcaccatcctccatcagcagatcaagagcgaagtactcgatgaagtagttagtgttgtggcgcaaagactgtccgtagagagtgtgcagaagagcgtggccggtacgatcagcgacggcgcagcaacggtaggcctgtccacccttgccgaattccttggactgaccaccgaacgcacgctggtagataaggccatcctcggtacgggagaaggggcatccgtagccctcgagctcacgaacactagcaggagcctctctggtcatgtagtggatggcgtcctggtcaccaagccaatcggaacccttcacggtgtcgtacatgtgccatctccagtcgtcgggatgcatgctgcaaatcggcattag

SEQ ID NO: 15971 - DNA, 894 bp, A.fumigatus
cttcggctaatctctccgcaagtttttcaacctgggctactgtcccacccacagcacgatatgtcgccagatgagtacaaactgagtcaggatgttttgattttcctgattgaaaaccaggaccacttccttttcggaatgaatggtactgccgcagatgaacagaccctgaaggaggtcgagggcggtactactcgccggacaacgacgaactccaatatcagacgctcagtatccagcgcgagcggtggagcggatagcttccgcaagtacgagaatttgcgtcggaacgtctccgtgtcctcgaagcattcgcgtcattcgaacaactctcctgggccggtgacaccaacctccttgagtggtgttggagtccatcgaagcaacaccttgccatctaaaatgtcaccaatatcttccgcgaggtatggcagggttcaggaatcgaccagtgttcaaccctctgggcttaacccttctgtccagaactcccggtcatccagccgcgccccgactccgcgggaggaaactagccaaacgacgccggcgcctccgtcaggatccaacgccgactctggcactgcatacattcactcgtccacccatggcccaatgccaaaagtcgccgaagatcgtgcgcccgtcgccgagaagccggtcattcaagaccctctaccgaccctggtgtcctcccctccgccgccggtcgaaacgccaaccaaagagcgaaagttgtccagtttcttcaccaagtcccctccgcagaacggtgagctgaaagaaaccccgtcagccaaatcgcctgaaagaagaagcggatttcaggaagtgccagcgaaagtgctcacagttcttccctgtcactacaggcagccccaggtgaatctgttgtga

SEQ ID NO: 15972 - DNA, 624 bp, A.fumigatus
atctcactcgttctctacatcgtcctcacacactccttcgaatactccacaagggcgctcctgggcccaatcagtcctgtcctcatgacttcagcttcaccctcccccctccgcgcagccaatggcgcatcctccggcacagttccccctccagccatgaaaccctccgctccgcccgtgaatatcctcccaacgcaactcgctcgcacatactcgttcgtgcatcccgccgcgctgctggccatcttggctacacggttccaggcgctggtcgctgaccccgtggcggaaatgctgaatacactccccttcttggcactcctgcaggtgacatacgtgatggtgtgtctgccgcccgcggggtcggtgctgccctcgccgccggcctctccggtaagcgacggcgacgagaaggaaaaggagaaggagaaagagaaagagaaagagaaagagaaagagaaagagaaagagaaagagaaagagaaagagaagaggaagctcccgcttcgagcggggaagctcccccggaagaagaaccagacgcatgcggccggtttgtccgcgaagttgacggtacgcacccctttgtcttcctcattgtcatcacagttcattcaatgctga

SEQ ID NO: 15973 - DNA, 309 bp, A.fumigatus
cgtggttgtggtggacagcctgccctcctctccctgatcctcactttcctcctcgcgacccccgtcctctccctcctcctcgttctcttcggcgcccccctgacaactcacaatgccgagacggtcctctgcgccgcgcacatggcgctcctggcttcgacggcgctgatctacgtgcatggtgttgacggcgctgtgtggcgcgaggtatgggcgtttgcgcgcccggctgatgccgtctggggcggtgcgctgggaacggctctcggggcgtggtttggggctgtgccgattccattggattggtga

SEQ ID NO: 15974 - DNA, 1008 bp, A.fumigatus
aagaagaagcggatttcaggaagtgccagcgaaagtgctcacagttcttccctgtcactacaggcagccccaggtgaatctgttgtgagcgtcgtcccctcggctacacgggcaaacgaagcagatggtgaagccggaggggcaaccccaaggcctcctaacacgacaaattccggagatgatgccaccatcattgtcgctgaggagaagccagcggttcagaatgacttgcacaatgcagacaattcgctgagaccgcatggttcgcgcaccccctccatgaactctcgctcctcattcacagatcattcggatctcgatcaaacagacgagaaagcggaccgtcgggagcaccgacggagttggaggttccatcgatcgtctaaacgcagcaacgaacaaatcgggctcggccttgcatcgccacccctttccgcatcaaatcccagtgctgagcgcagcaccacctcagttgctagttggcaccaatccagcaaaagctcgccatcggatttgcagcagttcgccagcgaatcatcccagcaacctttgagcctggacgctgagataagcaatagcgcagctccaaaggaaagcatagagcccgagaagcggagcctctttggaaaattcaaagccaaggttgcacaggttcgggatggcgtgagagacccggaacgagaccgtaccaggagcccggcgcaaccggattctgagagacctcattccaaccataccatgtcccctgctggcaaggacagaatcagcagtggacctgcgccaattgaggtgccaaaggagagcagagaagaacaaacgcgctctccagtatccccaatcatgtccagctccggcctgcccccggcgatcccggaggaacctcgcactccggagagtcctatcatgtcgcgtaccgatccggacttggataaggaagcatcagccgctgtccctgcagatcctagcaacccatcgcacactgaagctctcccctgccgcgcagcctga

SEQ ID NO: 15975 - DNA, 540 bp, A.fumigatus
ccccgtggcggaaatgctgaatacactccccttcttggcactcctgcaggtgacatacgtgatggtgtgtctgccgcccgcggggtcggtgctgccctcgccgccggcctctccggtaagcgacggcgacgagaaggaaaaggagaaggagaaagagaaagagaaagagaaagagaaagagaaagagaaagagaaagagaaagagaaagagaagaggaagctcccgcttcgagcggggaagctcccccggaagaagaaccagacgcatgcggccggtttgtccgcgaagttgacggtacgcacccctttgtcttcctcattgtcatcacagttcattcaatgctgatgctaacgtggttgtggtggacagcctgccctcctctccctgatcctcactttcctcctcgcgacccccgtcctctccctcctcctcgttctcttcggcgcccccctgacaactcacaatgccgagacggtcctctgcgccgcgcacatggcgctcctggcttcgacggcgctgatctacgtgcatggtgttga

SEQ ID NO: 15976 - DNA, 498 bp, A.fumigatus
ggaagacaaaggggtgcgtaccgtcaacttcgcggacaaaccggccgcatgcgtctggttcttcttccgggggagcttccccgctcgaagcgggagcttcctcttctctttctctttctctttctctttctctttctctttctctttctctttctctttctctttctccttctccttttccttctcgtcgccgtcgcttaccggagaggccggcggcgagggcagcaccgaccccgcgggcggcagacacaccatcacgtatgtcacctgcaggagtgccaagaaggggagtgtattcagcatttccgccacggggtcagcgaccagcgcctggaaccgtgtagccaagatggccagcagcgcggcgggatgcacgaacgagtatgtgcgagcgagttgcgttgggaggatattcacgggcggagcggagggtttcatggctggagggggaactgtgccggaggatgcgccattggctgcgcggaggggggagggtga

SEQ ID NO: 15977 - DNA, 600 bp, A.fumigatus
atgaactgtgatgacaatgaggaagacaaaggggtgcgtaccgtcaacttcgcggacaaaccggccgcatgcgtctggttcttcttccgggggagcttccccgctcgaagcgggagcttcctcttctctttctctttctctttctctttctctttctctttctctttctctttctctttctctttctccttctccttttccttctcgtcgccgtcgcttaccggagaggccggcggcgagggcagcaccgaccccgcgggcggcagacacaccatcacgtatgtcacctgcaggagtgccaagaaggggagtgtattcagcatttccgccacggggtcagcgaccagcgcctggaaccgtgtagccaagatggccagcagcgcggcgggatgcacgaacgagtatgtgcgagcgagttgcgttgggaggatattcacgggcggagcggagggtttcatggctggagggggaactgtgccggaggatgcgccattggctgcgcggaggggggagggtgaagctgaagtcatgaggacaggactgattgggcccaggagcgcccttgtggagtattcgaaggagtgtgtgaggacgatgtag

SEQ ID NO: 15978 - DNA, 321 bp, A.fumigatus
gcaccagcaccagcgcccacaaccccaatccagcatcagagggggaagatactcaccaatccaatggaatcggcacagccccaaaccacgccccgagagccgttcccagcgcaccgccccagacggcatcagccgggcgcgcaaacgcccatacctcgcgccacacagcgccgtcaacaccatgcacgtagatcagcgccgtcgaagccaggagcgccatgtgcgcggcgcagaggaccgtctcggcattgtgagttgtcaggggggcgccgaagagaacgaggaggagggagaggacgggggtcgcgaggaggaaagtga

SEQ ID NO: 15979 - DNA, 2025 bp, A.fumigatus
ctgacaccaccgtcggatccttccagccccgtggtgaagacagcggcagtaacccctggtctcctctcgggcacgagccggaccgtgtacctgggcaacattcccgccgaaacctccgcggaggagattcttaatcatgtacgtagtggacagattgagtcggttcgcttgcttccagataagaactgtgcctttatctccttcctggacagcaactcggcgacccacttccattcggatgctatcctgaagaagctggccatcaagggcaatgacatcaaggtgggatggggcaagccgtcccaggttccaacctcggttgcgctggcggttcagcaatccggtgcctcgcgcaatgtatatctgggcaaccttcccgaagagttgacggaagatgagctgcgcgaggatctcggtaaattcgggccgattgacaccgtcaagatcgtgagggaaaaggcgattgggtttgtgcactttttgtcgatcagcaatgcaatgaaggccgtttcccagttgccccaagaagccaaatggcaggccccgagacgcgtcttctatggtaaggatcgctgcgcgtacgtgtccaagacccagcagcaaaatgcggcacaattcttgggaatcgctcctggctacgcgcatatcttgaactccgcagaccgcgatctgatcaccaacgctctcgctcaacagtctgtcgctgccgctgccgtggccacctcagctggcggcgtcaacaatctgggcaacaggaccatttacttgggcaacatccacccggaaaccaccatcgaggagatttgcaacgtggtccggggcggactgctgcaccatatccgatacatcccggacaagcacatttgtttcgtgaccttcattgatccaacctcagccgcctccttctacgcgctgagcaacctgcagggtctgatgattcacaatcgccgcctgaagattggctggggcaagcactcgggccctctccctcctgccattgcactggcagtgagtggcggggcttcccgcaatgtgtatgtcggcaacctcgatgagacgtggacagaggagcgcctccgccaggacttttctgagtacggcgagattgagttggtgaacacgttgcgagagaagagctgcgcttttgtcaactttaccaacattgccaatgcgatcaaagcgattgagggaatgcgcaaccgcgaggagtataagcgattcaagatcaactttggcaaggatcgttgcggtaaccccccacgacaaactggcaatggtggacagcatggtcggaatggagcgggtctcgaaggaacccagtctccgcccccagcgcttaacaactttcaaccaaatctgagccaatctggctcccagtcgagtcccactcgccatgctctgtcacctgcgcccggctcgactggctctcaaaacggacatcagcagaaccgtcaccctctgcaaaccgtgtcctcgccttctggtatcttgaatgtgggcgccaacaacccgctgaccatgtatctgaaccaaatgtccgctcagcagcaggctcaggaccaggagaaccgactgaatgacccgatggctctggctgcccttcaatcgcaatcgcaaccccaggcccaacaacagtcgtactacaacgctgccagcagcagcgagctcacgaacggaagcatcgaggctcccatgcaccaacgcaagccctcgagtggatatttgaatgtgaccaatggctcctcagggccaagccatcacgcaactgccagcaccagcagtttgagtgtgcctcgtgcgcagcattctcgcaccgtgagcttaccctcgttctcccaggagccctttggccctgtctcgagccagcccggccatggccgctcaggtgtcgctcaccagccccaagcaagtttctccagcttctcctcggccctgggaggactgaatcacgcgggatttgggctggctatccagaacgaatcgtctctgcccggatgggctgaagaggaaatcggtgcaaaataa

SEQ ID NO: 15980 - DNA, 285 bp, A.fumigatus
cccatcttgacgcatacagccgaaaacaaccccgcaaacgactatccggacgaggacctgtcgtgggacgatgaagaagatgaccccgcagccatctaccacaaatatcgaactcatgacgcgtctgacgacgaggaattcgactctgcggattcagcaaatgaggggcggcgcgcaggccgggttggagttggatttggatttgggctcgactcgcacgtggattctgacgaggacagcctggacggcgacggtcccaatcacgatcgaatgcgacggtggtaa

SEQ ID NO: 15981 - DNA, 384 bp, A.fumigatus
tatcatcacttgtattgctatgtgggcaggatcttcttaatatctgtcttctacctctgtcttttctattctgtttctcacctttttgagccgttctcggccgctgactttcagtgcgctacgagagagtgggatgagacgtcggctgataccctggactggttcggcgctggcttgtcctttgacgtttcattccccctatttacattcttggtgccacttcaacgatttcaagctgagcatacggcccacccacgttgcatgttggatacggacaagggttatatagctgtggacgtcatggtccacgatggcaagggcgactgcaagccatgggaagatgaaagatatgggacaagaattaacaaaaatgaaatcaaatga

SEQ ID NO: 15982 - DNA, 1383 bp, A.fumigatus
catgaaactacagatattcagtctgaacttcaccagaccaaacggcgttttacggactttgtcttccagcgggtccaggtcagtggcaatgctcgggacagcggctcctcgagtcctgcatccctggctgccccatcacgcacactgctcacccctaggtctgtgagtagctctgcgtttccagcttccagaggtgctgctcgcccttcgggtccagggacgggcgtcggcgcgaccgtcccactggttcgagctacttcccctggggccgagtttcgggaggagcagcgcctcgctgctgtgcgcaaggcagcggaggagaagctacaccgcgcactgcatccgtcgagtagggttgcgggtgcggatctagtgagctctactactgttggcgggacgcaggagtcttctgtgtcgagcgggagggagagtccggtttccgcgtcgccgcgctctgttcgtcggttccagatttccaggtccagtacacctgtgaatgttctgcggagcgcaggtggcggcgtgcagaagcggcgaggggacggggcggtcgcagtgctggtggagaagttacggagggctccgcattcgaggcaggcgtcgttggtagctgatgcggcggcgcaggctgcgacggcggagggggaggaccgtggtgtgaatgtcccggagccggctccggagccggagcctgttcggcccaggaaacggcctgtggtcaatcaggcggagagaaaatggagagaggagcggaagactgccatctccgctgcgaaggaacacatcacgaaggtgctggagaaggaggcgcatgctcgcaagagtaactgggaggatgagtcggaacggctggctcgcgagtttgagcagattgccttagagctggagggaggtagagagacggaaccgccggtgcagcagccagtagcgcagccgacagcacgtcctactgtccccaagcctccgttgaagtaccagccgcgcacacctaataaacctcgagggacgacgccgcgggaaacgagcgttgtagaaattccagacgtccagcctccagtagaaaccgtggcgcaagaggatgacagtgacggcgagtatgtctacgatacttacattcgacaacccctgccagaagggacgctacttacgaacccgctgaccgatcttgaaacggcccacgaaatatggtttcaacagaatggaattgacaccactcgccaggatattggagtcatcgtcatcacacaagaggacgaagagtactgggaacattttgcagaggatgacgaggacgaagagtgggatagcgaggacgcagattcgaatggtatgctcagtccacccgtccaaactctctgcatgcacagtgctaacccatcttga

SEQ ID NO: 15983 - DNA, 1065 bp, A.fumigatus
  unsure (599),(625),(646): Identity of nucleotide sequences at the above locations are unknown.
tgtctcctggtggacaaccaggcacactgctgcggacacctgggaaaagtcatccgctcggaatatccaattcccaaagtaatacagcctaatcgcatatatggccgaacatcggctctgagtgtgtcagagatcacatttccgagtttcttcgtagcaataagctgctccaggatggctggaccgaacgacaaccatcgattctcggtcctaatcatcaacccaaacacatcaacccacatgacgaacgcactcaaacccatcctagagagcttggattatgcagatatctacttcaattacttcacggcgccttccagtgagtctgtcacacttccggatgggcgcattatcaacggagtgcccagcatcaactcgggagaggattccatcacatcagccttgcattgcaggccttttgtcgagccgcttgttccaaaatatgacgcatttcttgtggcatgttattccgctcatccattagtgggcatgctaaaagaggcgatcacagagtatgagcggacgtcctccagaaaagactccacattaccggagtaccgaaagaaatatgtgacaggcatattcgaagcaagtgtctngacttctctctccctggttagctctntccatttaatgggagacgcanattttcataaagcccaatcgagggacacattcggcatagttacgactgggagcatctggagagacgaactgacaagagcggtcgcagagatgatagtgaattctggtggcggcggcggctctaccgctcgctttgccggtgtggagaccactggattgacagctagtgaattacatactgcgcctgccgaagaggtgagcagaaggatcagcgatgcgacagagaggctcatcaagagcacgtcacatcctgtaagtgccatttgtatggggtgtgcaggaatggcaggcatggaggaagcggtgcgagatggctgtatcagggcatatggtgaacgacaaggccgacgagtgaggatagtggacggcgtagtcgccggggcaggcatgcttgtgacggcctgcaaggcaggattctga

SEQ ID NO: 15984 - DNA, 240 bp, A.fumigatus
aaaccagtatacgaatttaccctccacaaatgcgctgcagtttatatctcttctgaatctgagctgagcttgcatggacaggttttgaactcaatacaaagtggaccctacaagaatatctacaatcccgagaacttcttcatcggtcagcaaggcattggcgctggaaacaattggggtgccggctacgccgccggcgaagtcgtacaggaggaggtcttcgacatgatcgaccgataa

SEQ ID NO: 15985 - DNA, 240 bp, A.fumigatus
cagggcttcatgttcctgcattcgatcgcgggaggaaccggctcgggacttggtagcttcatcctcgagcggatgaatgacaggtttccgaagaagttgattcagacatactccgttttcccagatacccagtcggcggacgtcgtggtcaatccgtacaacagtctgctagccatgaggaggctgacacagaatgctgactctgtggtaagtttcccatccatgagaccaccaaattga

SEQ ID NO: 15986 - DNA, 369 bp, A.fumigatus
ccaatgacgtccctgaaggctactaacactcgtgtcagatggttctcagtcgttatggggactgggatgatttccaccgccctaaatactcttccttataatggtcgctggctatactggatctcgatcgtcgtctttgttctaaatgtcgctatcttcgcagtgtgtagcattctgagtgtgctccgctacactatgtacccggagactcttaacactatcatgaatgagcctgctcagtcaatgttcttgagtacgtttcccatgggactagcgactattgtgaacatgatctgctttgtgtgcgtcccagcgtggggaaattggacgagagattttgcttgggccctgtggatggttgatgtcttc

SEQ ID NO: 15987 - DNA, 636 bp, A.fumigatus
cctcactgttccatcagattccgtcttcggcagttgaagggttaccacgactacacccacactttaatcttcatcatgcctttggttgtgccatccgctacgccgagagtcattctcggcttgatgacctttgggccagatgagtccgaaggtgctcgcatcacgtccctcgacgactttaacaagtgcttggatcatctccagcagcaaggttacaacgaggttgatactgcgcgaatctacgtaggaggaaaacaagaagctttcacagctcaagccaggtggaaggaacgtgggctgactctagccacgaaatggtacccccatacccccggtgcacacaagcccgacgttcttcgtgagaacctcgagcgttctttgaaggaactgcaaaccgaccaagtggacatcttctacctgcacgccgcggatcgatcagtgccttttgctgagactctcgaagccgtcaatgagctccacaaggagggaaagttcgtgcagttgggtttaagcaattatactgcctttgaagttgcggagatagttatactctgcaacgagagaggttgggttcgacccacaatctaccaggcaatgtacaatgctatcagtgcgtatcctcctgctgtgacctag

SEQ ID NO: 15988 - DNA, 573 bp, A.fumigatus
aatgtctgctataagatttcgttcgaattgcatttactgacgccgataaacacagcgcgcaacatcgaaacggagctcatccccgcctgcaagcgctacggacttgacatcgtagtctataatccgctagctggtggcctgttctccggcaaatacaagaccaaagacattcctgcggaagggagatatagtaatcagtcttcaactggagccttgtatcggggacgttatttcaaggacgcgacattcgatgctctacgactgatcgagcctgttgcccaaaagcatggcctaaccatgcctgaaattgcgtttcgctggatccatcaccactccgcgctcaacatgaaggataacggccgcgatggtgtcattattggcgtgagcagccccgcgcagttggaaaacaatctcaaggatatccagaagggccccttgcctcaggaagttgtcgacactttggaccaagcctggttgattgcgaagccgactgctccaaactactggcatctcgatttaaaatacacctatgatactcaagcggccttgttcaagcctaaacccaaggcgtag

SEQ ID NO: 15989 - DNA, 3624 bp, A.fumigatus
gcggctccttgcagccccgtggtgaagaccggttctgggtctggagactttgggttagcggcatactatgcggcgtggcagcacgctcagcagactggtgatgacagtgactggaaacagtttcaattcaagagacgaattggctggaagcctactggagatgaagaatcagcgagggtgaaggtgggggagaaggctacagactctcagcccggtttgcacgactcgccacgcgtcagtaaggcctcagccaatgccgaaatcagcgctcaagtcgaggaggctgtagcacgagaaatccagattcaggaggaacaggcacaggctgaggaggcgtcggaagcaaaggatgagggtactgaggcattccctgatctaccacctgaggtggccgccgtctccgatgcgaccgctgagcagtctcgattcgtttccgaccagattgtccaattagcctcgggcaaaaagtacgcagagatccctgctgctttcgaatcgcttctaagagatggcctcactccaaccgttggggcatacaatgccttgttggaatctgccgtccgccttcacaccgacgtttcacatgccattcccaaagcactcgatgtctattcagacatgcttcgccgcagggtcattcccgatgaagacacctatcgcacactggtcgagctttttgtggtccgctctcatgagacgatcaaggccaaagagtcattggagcaggaacgccttcgctatggaggcatggaagagcctggcaagtttatgctgcactcgagtcagttggagcgcgatctgctcgctgaggaccactctctcgctattgctgtcaaattgttcaacaccgccactactcgtcactcagatctggtcttttccctcgatatgtaccgctatcttatcacagcatgtgcgaaagaaggccaagtggaggatatgatccgtatctatgcccacatggagtcacataaggtgacgccacatgcgtctatctttccgtcgatgatcgatgcctttgcgtctaccggcgatctgaccagtgctgtggagtgctataatgaatacaaggatctcgcgatttctgacgataatggaacattcagcattgttcagcgtttggacggtcaagtgtacgctgctgtggtcagggcttatcttgcagccggaaaggaagagaatgccttgcgattccttgagcgcatccgtgcatcgtttgatgaagtcactgaaaaccgtgaagctcgccaggaggcggttgagtccgtaattgtgcaggatggtctcgtgcagtactgtctcaagtcaggtgaacatgcaaaggcattgaagcacgccaaggagcagctacgcggtgatgctttggatcatgccatggcccgcatttgcgtcactgcggcggatgccggtgatctcaacaccgcctccgaagcgtacggacgcctcccctcagacccgattgtgcgtcagggccccgccattgcgatgctggcgttgcatgtgcggcaaggcaatgtgtcagaggctcgacccctgtggctgatgctaagcaccgtgggtcaggcaactccggatatggttcagccgacggttatgtacgcagtagccctggccaagagtggccaggttgacgaagcccttcttgaagcccgcaatatgtttgcccggattcgcaactcctctgccaacaacgccgccgtactgaattccatccgtgaacaaattaatgaaagccttcaccttatcggccgtgttctcatgcagactgctgctgttctctccccacaggctgccatgaacctcatttggtctatgactgagaatggtggtctcgtctctccccttgctgaacatgctgttgccagccttggacctttaggtatctctcagcttgctgctcccgatctggcgctcgcactgcaggttcaagctggtatgcttctcaacaacaactccatggcctttgatgtcgctcaccccattcgcttctcccacatgcttgacatcgctctggccacgagactcccactggatactcacactactgccttggtcgatcaagccgtcgccaagctgttcaacagccggcctgacatggtgaagagatggcaggaccatcttagcatgacgtcctctccatcgtctttcctttccggtcatcactctcctgtttcggaagtttcgtctatgacgcccgtatctagcgatgactctttcgatccatatgcatatgctaccgacttccgtggatcttctattattgccgaggagctggagagtgcaagcggtcgcgcagagtcacatctgaatgaggctttaactcggcttcggaacatgcgtcgccttggtcgccatcctcgctatatcacctatgccaagctcattaatgctgctacgaaggttggccgtgccgacctagtgcaggagattctaagcatggctcgtcgtgatgttcctctgctgccgcagtaccatgctgtcaagtatggctggatttccatccttgacgccatggttgcctcgtgtttgactctcggagaccgcagccttgcggccaagtaccacaacgaactcctggagctgggttcggcaccatctgcaaatacctttggcctctacatcactacactcaaggaatccaccaagacgtttgatgaagcaaccgaggctctgaagatcttccaccgtgctattgccgaaggagttgagccaacatcatttttgtataatgcgcttattggcaaacttggtaaagcgcgccggatcgacgactgccttctatatttcgccgagatgcgtgccaacggcatccgccccaccagtgtcacatacggaacgatcgtcaatgctctctgccgtgttagtgatgagcgttttgccgaggagatgttcgaggagatggagtcgatgcccaactacaagccgcgacccgctccttataactctatgatccagtacttcctcaataccaagcgcgaccgcagcaaggtactggcctactaccagcgcatgcaaagtcgcaacatccagcccaccatgcacacatacaaactgctcattgacgcttttgcgtccctggagcccgtggacatgcctgctgctgagaaggtgctggaaactatcaaggcctccggacaacagcccgaagccgtacactatgcatcccttatccatgccaagggatgcgtgatgcacgatcttgatgctgccttggatgtttttcagtcggttgtatcaaaccacaaggtgcgcctgcagccatgcctctaccaggctctgctagaggccatggtggccaatcatcaggttgctcaaaccgaagccatagtcaaggacatggccgatcgccgtgtggagatgactgcttacattgctaacactcttattcacgggtgggctgctgcaggcaacgtcgccaaggccaaggcggtctatgacagcgttggcatcgacaaacgggagcccagcacctatgaggcgatgactcgtgcatttttggcgtctgaagaccgcgagggagcctcccgcgttgtccaggagatgctgtctcgtggctatcctactgctgtagccagcaagatccttgacctggttggaggtggtgcgccagttgctgccatctaa

SEQ ID NO: 15990 - DNA, 228 bp, A.fumigatus
tttccggccgtagatttccgatgtcgactacccgcattgatggcggacgacgctcaaaactcccccaccattaatcgtcagaagtcatcacccttcgctaggctcacgcagctacacagtctatgcttacgggtcgcgtatgtttacgcactcagtgctctctccatcgcattcgtctggcaacaagccattatagccaccaccaagcgtggtatcttcacagtatga

SEQ ID NO: 15991 - DNA, 330 bp, A.fumigatus
aggtccaaggctggcaacagcatgttcagcaaggggagagacgagaccaccattctcagtcatagaccaaatgaggttcatggcagcctgtggggagagaacagcagcagtctgcatgagaacacggccgataaggtgaaggctttcattaatttgttcacggatggaattcagtacggcggcgttgttggcagaggagttgcgaatccgggcaaacatattgcgggcttcaagaagggcttcgtcaacctggccactcttggccagggctactgcgtacataaccgtcggctgaaccatatccggagttgcctgacccacggtgcttag

SEQ ID NO: 15992 - DNA, 510 bp, A.fumigatus
tggagggatgggcgggcgcggggggctcgggtgctgactctgatgcttggtagtgtgtttttggcggtcaagtacgcttcgctagggatgaaggtgacctccgcggcgaagccgtacccctccggctcgatcatctgcacggcgtccgttgctgggctgcgctcgaacgcggggtcgaccgattactccgcctcgaaggcggcggtggtgtcaattgcccagacgtgtgcgtatcagttggctggtaccggcatccgcgtgaatgctatctgcccgggtctgatcgagacggggatgacgcagcaggtgtttgacgcggcgcgagctcgcggcacggaacgcaaaatcgggcagctaaatcccctgcagcggggtgcggttgcagatgaggtggctcgcgtggctctgttcctggggagtgatgagagtagctacgtcaatggacaggcgtgggctgtatgtggggggttgagtgctggccaccctttcgtgccgggaaagttggcctag

SEQ ID NO: 15993 - DNA, 1035 bp, A.fumigatus
cagcaacaggcctgttttcctcatgatgttgagatttgcactggcaagagccagcctcactgtgttcaccatgcctttgtcctgcagcaagattcatcacacaccctctatggtattgccttgcgtgtctggtctcgagccgatgacaagcgcgctgagacaattcgtgagctgcggaagaagacggaagccgatttctatgataaccccgatgagacctactggatcccttactgtcttagcttcctttcccgctatcctctttacgatctactgggagattacctgcgtggcatgtggattcactggaacaaggctaccaatcttttccacgctgaagaggtctcgcgaattttgagcttccctgctccacgcctgaacgatcttgttcgtatcgacatgaaggactacgccttgtgctatcagttcccttcgtcgcccaccggtttccaaaacttcgccatgtggcccttgttcacctgcctgtccatccccaacatcgtcggcgtggtcgaggccgcagtgtcgccaactcgccggatcatctttgtcagtcattacccagctatgctgaccattgctgctgaaaccgttcggtactgtgtgcgggtctacgaatggagcggcctgtatgttccagttgtccatgctcgtcacatcaaggatcttgttcaggagcctggtccctatattctgggtgttaccgccgaatgccgaactctattcaacgctccctctgatgccttggttgtggacttggatcggaactttgtgctcacttccagtcctccgaatgtcctcactcctggtcagcggacgaaatttatcgaccggctgacacaggccctgaacggtgatgtctctccttccggtgttcccaatcacctgcggtccgcctatgcgggtggcaagcttattcccgccggtcaaattatcgtcatgagaggcgaggtcgagagtatccaggatccttcctggtggaaccaggatgcggtcatgagcgtcatggatcacgtttgcgagaaactggtatga

SEQ ID NO: 15994 - DNA, 1116 bp, A.fumigatus
ctcaataatactgaccttgcccagttcctcaagttccaggccttcgcagagcagctcacgaaggagaccgctgagctcaaagtcaagatcgagaaccacaagcgagagaaccgccgcctcagtggcctcattgaccaacaaaaggacgacgtggcacgtctcacactccgtttgtctggcaccgagaagcagcgtgatgacgccctggaggcgcttgtgctgcaacaggagattgccgaggagcttgagcgtgagaggaagcgcaatcagaaggagcttgcctccttgcagcacaccaacgcttctctcgccaggcaacgcgatgaggcccaaagggtggttctgcacctccgcagtctcatcaacggccaagcacatcacatggaacacattgttcgctcgatcagtagctccgcggagctttctgagcttgtggagcaggccgaagagagccaggagaacgaggagaatgctgcaccagaggagactaaggagcgtgcagaaaaggccaagagccttgctccaaacatgacccccgagttggaacagcatctactgaacctgggtaaggaacaaaagcgtcttgcccgcctcagcatcacggatgtggcggatcgctacctgcgcgacaagaccgatgccatttcggacatcatccgcagcatcagcgagcaatgcgctgccgctgtcgaaggcttgcatctggctcaagatgccgaagaggacgacgcagacgagtcggggcagcggacacccgatggcaatcacctggctccagactttgatggcaacgatggacgttcgacccgtgagggaagtgaagttggtgatgataacagcaccctgcacccggatcatcggatctccagcgttcccccgactccagacctggttcacaaccgctcaagtacgtcgatgtcaatgatcagcagctcaacattcccggagaggtcgagccaacaatatgggcctggagaggtcccaacccggatcgtcgaggacgacgacgagcgtgcccacgagacggatggtcttgacgaccacaccgagacaggcactctctctaaacagggcagcgaagatttgatgcggtcaagcccccggctgctcgtgtga

SEQ ID NO: 15995 - DNA, 1257 bp, A.fumigatus
aacaaaaggaagatgaaattcactatctggtcgagcttactggcactgccaaatgccctggcacaccctcgctccgtccaggaacgcagcaacttcgctcatccaggactcctccacacagccgccgacttctctagaatcacgagcaaggtcaacagtaaagcagagccatggttcaccggatggaacaagctgtccagcagctcgtaccaatcgctgagctacaacgccaatccacaggcggtcgtgtaccgcggcagcgacgggactcactcggagaactatgcgtcgctgtatagggacattgcagcggcctatatcacagccatctactggaaagtgaccggtgacacggcgtacgcagacaaagcagtcagcatcctcgatgcctgggctgccaccctaacggggatctccggatcgtcggacaagttcctggctgcgggaatttacggctacgagatagccaatgcggcggagatcatgcggacatacaacggctggtctgcgcagaatatagccaagttccagaacatgatggtcgaggtcttctatccactcaaccacatcttcctggaacagcacaacggtgccgccatcgaccactactgggcgaactgggacctgtgcaacatcgcctcgatgatgtccatcggggtactcactgataatcgcaccatgtacgacgaagccataaactacttcaagaccggggctggaaatggccagatagaaaagatgatttggaagctgtaccaggtggacggacagacactgggacaagggcaggaagcgggccgggaccagggccatgcgatgctggatttcgctctgctgggagtcattgcccagaccgcttacaaccaaggcgacgacctgtttggatacttggacaatcgtattcttgccgggtacgtctccatgatctgcccatgcgcatgccatactgatctgaacagagcggagtacgtcgccaagtacaatctgggcaacgatgtgccctatacgacctacacgaacagcgacgttgcccaaaccgtgatcagcaatgccagccgtggggatatccggcccatatgggagcttctttacaaccactacggagtgtggaaggggctgaacgtcaagtacaccaagcaatatcgtgacctggtcgtggaagacggcgctggtgcggaaggaggcggaggaaactatggaccaaacagtggagggtacgatcagctgggatttgggactttgatgtatactttgtag

SEQ ID NO: 15996 - DNA, 414 bp, A.fumigatus
tttggcggcaatccggaccatgtcgttatacacggggcatcggctggcggtggttcagtctcgtttcacctcacagcgtatggaggccggaacgatggccttttcgtgggcgccattcctgagagtccctggtgggcccctcaagtgaccatctccgagtctgagatactctacaaccgcttactgcaggccgtggggtgctcgacgctcgcgtgcttgcgcgcggtggatgcctctgcaatccaaaaagccaacttgaacgcaccagaccaaggcttaattagctatccggccggactgggaaagttctggcccgtgatagacggggatcttgttcgagatcggctctacgcttcctttgagaagggaaagttcatacgggtgccgttgatggtggcgagtgataacagatga

SEQ ID NO: 15997 - DNA, 429 bp, A.fumigatus
acatatcatgtaccccagataagctccagagctcaccctctacagttcggccccatttgtgttggaacgggccagagcaccacatcgacgagagcggaggattgtctctttatcaacgtgtttacgccggccgatgccaccgaacactcgaagctgcccgtctgggtgtttatccagggcggtgcctatgcgactaactcgaatgcaaactacaacgggaccgaggtcgtccgggaatctggaaacaatatcgtctttgtcaacttcaattaccgcgtgggagcgcttggattcctagcgggcgcggaagttcaacgacatggggatttaaacgttggcttgctcgatcagagagaggcattaaagtgggtgaaaaggcatattcgtcaggtaaggcataccgtcgattgtatggctttggctttctaa

SEQ ID NO: 15998 - DNA, 627 bp, A.fumigatus
tggtggcgagtgataacagatgaagggtcctcgtttgcatataatgctaccagtccggccgaggtctctgtcttcttgcggagcttttatcctcgcctaaactccgagctattgcagacgatcaacgatgcataccccaagatggaccctgttccgcaacatgcagcatactttccctcagtctcggccgcctttggcgatgcgacaatcgtatgtccagggatccatatcaccaacaacatggccagatttttcgaacacgggtctgacaaggtgtggaactaccgctataatgtccaggatccgccgcggattgctgccgggcttggtgtcacgcacaccttcgacctccaggccatcttcggtctaaattatggcagtagtgtcagcagtagcatgagggatataacgccaatcattccagttgtgatgcactactatatcagcttcatacgaacactgaacccgaatctgctcaaggctgatagcgctccattctggaagccatggggggatggagaaagattgaaagtccaaacaaatgcaaccgccatggagacagtatctgccgtccaatgggatcggtgtagtctatggaagcgattggcgcccgtgttggagggttaa

SEQ ID NO: 15999 - DNA, 192 bp, A.fumigatus
ctcaaggctgtgcaagctgaagatctgcgtcccaagcccaaaccagagccagggctgacactgtccgtgctctgcaccgctgccaccgactgggttctccgcatcccatctcaggtcatttcagccatggactcattgatgctctggaagtctactctgcacggcatcgagtctgagtcatcagccatctga

SEQ ID NO: 16000 - DNA, 195 bp, A.fumigatus
cgttggcagttggcactgtgcaggactgtgtctgaggaccagctctacgaggccactgaaaaagcaattgtagatgaaaaacacacactagaaaattatcgactgattctgaacaacatggaaatgggtgatcctccaggagcccgtcacgtctctcaacaatccccaactcgaatcccaccagctcgacaatga

SEQ ID NO: 16001 - DNA, 579 bp, A.fumigatus
atccgattttgttgtacaccattgtccaaggcgatgaatagcttgtcgtgggccgtcttcttcatcctccttataccccttcttgtcatcagactacgaaaagcgctggcctcatattttcagaaaccagcccagcatgcaggctgcactgatgtcaagcgcatggcgccatacccagcccaacccatcagaggaagggagcgataccgggtcatgatggacatccggaagctggacgtggagaactggctcacagtcgacaagaactacatggacgagcatcttgtgcggagtcgactgctgcaggaggaaagggaacaggttctccaatgtctgccagagtcgtacgatgcttgtctcgaagcgctggaggaagtggttgagtttctttgccagcgatttccgcacatatttgagcggaagcagtccgggaacgagtcgaccatccacaatcgaatgacgggggaaactttcgtcttcgggggggagaacaaacaggtggatcctctggaaatcgccgtccggctcaccatggagtctttaccacaagggcccaagcatcggcgaaaaggaaaggga

SEQ ID NO: 16002 - DNA, 1461 bp, A.fumigatus
  unsure (1435): Identity of nucleotide sequences at the above locations are unknown.
aatatcttactcactatcaccaagtcgaccgcaggacgcacagcagcgagcaagatcccaccagaggagggcgatggcgatgggtccgcagactcacactcaagcacaagcgcgagcacaagcgcaagcacaagcacaaccgatcgcaggaagagcctcctccctcagcgcagtatccccagtggggatcgagatcgagatcgagatggtgctgccccggtgcgccagcagcagcaattggagacacggttacagcggggaagtcggatcttgacgaagacgccgggagcacagaagaagcaggaagagggcgtttcggtgtccagcacagcagtgccagccacagctacgctggcgaatactcgacgacaaagtttgatacgacctagcccgttgaaaacggggacagctacagctacagctacaggcgcaggcacaaggacgggaacgaatccgggcgggagggctgctacaacgccgaagagcgcgacgttcagcgtgcaaggattgtcgacctttccgatgaaaagggatggggttgcgtcaatgtccccgaagagaacggagatgccgccgccggcgcggccgactcggtcggcgtcgatgagacagcctttgaaagctggtactggtactggtactggtactggtgctggtgcgggtgcgggttccgggaccccggcgactggggttaggcatgtgcggcaccggagccagattgtggcgccgtcgtcgagccagggtcaggtttccaggaggagcgactcggaatcttctgggtcgacgcctatgacgacccccgggttggcggctgggacgagaccgagcgggcagtttacaacgtatcagcagcagttttcgccgaggaaggtagtgagacccgcagcttcatcggttgccagcgcgtccgcgcatggggaggattcactgatcccgacgtcgtggccagagatcgcggcgcttcagacggaattactacagttgagcttgctacattcgtcgtcactacagcagatggcagcactggaggccgagtcggaggaacagctacagaccaagtatgacgcggtcgcgaagacgtatcgcgcgatggtcggggaagaaaagaagcgccagcggttgctgaatggacaagccttgaatcgctggctagagaatgccagcgaacatggtggtcgcccgaacttcgccgcgcagatccaggccttttcgcagctcgtgcaggaagtgtgtgatttgaccgacagtctcgaagggaagtatacgatgcttgtccagaaattcgaggaatggttccggaaagtgcaagcgatcgagagcatgcgacttcatcgacagcagggagatgcaaaccacgtggttttcattgacccgctcgatcgcgtatggaaggacgaggtgcacgtcatgattgtgacgcctgtcttcacctacntggagagacgacatccgcgcttgatt

SEQ ID NO: 16003 - DNA, 939 bp, A.fumigatus
ccgaaaatctaccaacaactcgcccgtgctcccctcttcacacgcacgtcacaaacaaagttgcaaaaccttcttgagagggtgcagcatatccttgtcctacgagccttgcgcatttgttcaagcgacgaaccttccaccatgaccggcacatccccgaatctctacagccttcccaacaccgacgctttggccccgcacttgagggcctatgtgctccggtgtcagaactccgccatcaatcgccataacacgttccgtgtcgctgtatcaggcggttctctaccagcagttcttgccaaggctcttcttgcaccttcaaacggttctcccgaggacactgtgcggttcgacaaatgggacgttttcttcgccgacgaacgtgctgtccctcttgaccaccctgatagcaactaccgcctgctcaaggatgagcttctaagcaagatccccgccgaaatgggcactcctaaagtgcatcccatcgacgccgaccatgtcaacgatgatacgcaggagcttgccgacctgtatcaggaggaattgatgcgctcgttcgcggccaaggacagcgtcaagctacctgtctttgatcttattcttttgggttgtggtcccgacggtcacacctgcagtctctttcccggccatgaactgttgcgagagaaggatgcctgggtggccgcggagacaaactctcccaagcccccaccgaagcgcataactctcacattgcctgtcgtcacacatgccgttagtattgctttcgtcgccactggagcgggaaagaaggagatcctaaagcagattttcgatgcggaggagggacgggaactgccctcggcgctcgtcaaccaaggtgctggggaaaaagtgagctggttcaccgatcatgctgccgttgatggggtctccttccccagacgtggaagcttgtag

SEQ ID NO: 16004 - DNA, 306 bp, A.fumigatus
cccgttgaaaacggggacagctacagctacagctacaggcgcaggcacaaggacgggaacgaatccgggcgggagggctgctacaacgccgaagagcgcgacgttcagcgtgcaaggattgtcgacctttccgatgaaaagggatggggttgcgtcaatgtccccgaagagaacggagatgccgccgccggcgcggccgactcggtcggcgtcgatgagacagcctttgaaagctggtactggtactggtactggtactggtgctggtgcgggtgcgggttccgggaccccggcgactggggttag

SEQ ID NO: 16005 - DNA, 369 bp, A.fumigatus
gcatgtgcggcaccggagccagattgtggcgccgtcgtcgagccagggtcaggtttccaggaggagcgactcggaatcttctgggtcgacgcctatgacgacccccgggttggcggctgggacgagaccgagcgggcagtttacaacgtatcagcagcagttttcgccgaggaaggtagtgagacccgcagcttcatcggttgccagcgcgtccgcgcatggggaggattcactgatcccgacgtcgtggccagagatcgcggcgcttcagacggaattactacagttgagcttgctacattcgtcgtcactacagcagatggcagcactggaggccgagtcggaggaacagctacagaccaagtatga

SEQ ID NO: 16006 - DNA, 282 bp, A.fumigatus
cgtggcagacaaagccggcatgtactgatcagacaggactccttctatcacaatctctttgagggcgtcaaaattcttgtgcagctctcgggcaacctcgtccacgaatttcatattattgagtcgcttgttggatgtcagggcgggctgcagaaggtctgcaatggcttcggactggataatgcaaccggctcgccagatctgaaggcacttgccgagatcaatgtcccacttttcgtcctcggaagcgcgcgagatcaattcgagaccctggcaaaatga

SEQ ID NO: 16007 - DNA, 363 bp, A.fumigatus
tcgcaagaaaacaccatgatcgcaccagctcccactatcacatacgaatcccttcgcaacatccctttgtcatatgccacatgctcaatcggcagcagcaacgccgataccctcccccggaagctcgaagcgatcagcaaagccggcttcacaggcatcgagctatcattccccgacatcatcgactatgggtcacgggatcccgaactccaagtttcccccggaataactcccccaaatttctctctttttcccgggaaaaattccgaaagctctggtgtaacccaacaaatccctaaaatgaataatagtttcaggccggttttgcgcaaatttccaagggctgtgccccctcgggttctt

SEQ ID NO: 16008 - DNA, 1602 bp, A.fumigatus
ggaacccagattgaccaagttaggagtttactgcgaacgcccatcatgccatcatcacaagacccaattcagagattcaagcgcatcggcattgtcggagcggggaatatgggctcgatgatgacctttgccttctccgagctgggttgcgatgtctcggtatgggacgtggatccgaagaatgtcgattcggtgatgaagtttgccaaagacgcacagcatctgaagggcaagatctacgggtactacaccatcgacgagtttactaagagcctggagggcaaggcggagcggaaattattcctcttttccatcacacatggacatccggcagactccgtactggggatgatcaagcatgacctgaaggccggcgacatcatcctcgacggaggaaatgaaaactaccgacggacagagagaagacagagggaatgcgctggaatcggggttcactggatcggaatgggtgtctctggaggttaccagtccgctcgacacgggcccagcttgtcgcccggtggagatgccaaagcactcgagctcgtcatgccgcttctggagctctactccgccaaagatcgcaagacaggccagccatgtgtcacacgaattggccccggaggctcgggacactacgtcaagatggttcacaacggtattgaaggaggcatgctctcgaccctcgctgaggcatggtcaatcctccacaacgggttaggtctcaactatgacgagattggcgatatcttctccaagtggaactcagacggcgagctcaagaacaattatctccttcagatcggcgcagatatgttgcacaggaggaggacacctcagggggactaccacggcgaaggtgctagcaaagatgacggctatgtacttgacgatgtgcttgacaaagtggtccaagacgatgacaacaccgagggaactccgtactggtcgattatggagtcggctgagcgtcacgtctcggcgcccactcttgccacagcgcactacctgcgtgtggccagcgggaatcgggaagagagactccgagttgcgaagaagcttcatatgcccatccccaagccaattgagacgattaaagatcgcggtgcgttcattgagaacctgcgccgagcagtgtactgctccttcttggcgtcattttgccagggtctcgaattgatctcgcgcgcttccgaggacgaaaagtgggacattgatctcggcaagtgccttcagatctggcgagccggttgcattatccagtccgaagccattgcagaccttctgcagcccgccctgacatccaacaagcgactcaataatatgaaattcgtggacgaggttgcccgagagctgcacaagaattttgacgccctcaaagagattgtgatagaaggagtcctgtctgatcagtacatgccggctttgtctgccacgttagagtacttgaagtatgaaggaggaacgatgctgccaaccaaatttatggaggcacagatggactactttggcgctcatgcgtacaacaagcccagtgtgccaggtgaagatccaggtccagtcagaaaggggccccatcattatgagtggaagccagcataa

SEQ ID NO: 16009 - DNA, 546 bp, A.fumigatus
tctttaataaatttagagcctgtccgtatcgccgttattggtggtactggtctgcgcgagctccccggcttcactcaggttgcgtcgttgtcgatcaccacgccctggggcagcccctcctcgccgattacgatcctgcaccaccagtgctctcacaacaacaagaccgttgccgtcgctttcctcagccggcacggtactcaccaccagattgcacctcatgaggtcccagcgcgcgccaacattgctgctctgcgctcgattggtgtccgcaccatcatcgccttctccgccgtcggtagcctgcaggaggaaatcaagccccgcgatttcgtcattcccgaccaggtcattgatcgcaccaagggtgtgcgcccatggactttcttcgaaggaggtgtggtcgcgcacgttccgtttggcgaccctttcgacgagggtgtcgcgaaggttgtgcgagcctgcggtcacagcctggagggcgagggtgtcgttcttcacgaccggggtactctgatttgcatgggtacgtcatttgtgctctga

SEQ ID NO: 16010 - DNA, 726 bp, A.fumigatus
aacgtgcggatactgctcacgctctcaaatatcaaagccctgcaggcagaattcgtcccacatctagtcacgaacttcgagacttcgttttctgtgaaattgacggaagaagccaagactattcgcgacgtcctaggtcagatcgatgaccgcctattccaatcgtataccaagccaacagtcaacaaattgaataccatgattgtcagcggcatcactgaccctgaatgggagccgtccagcggtcgcccagagcaagtacgcccctatgtatatagcgtcttgctcacccttgtgcttgttcacacggagatctcgactactattccttcctgcgtggcctcgggagcgagccgttcaccacccgctgcgccatctccgttgttgaacatggttctcacacacttgctgacacaaatctccacgtctctcctgaatgcgttccgctcacgcccttcatataccttggctgcactgatgcaggcaacccttgatactgagtttatcgcacaaaccctatcacagtactccacagaggaagcatccactgtgcaaagccagatctatgtggaactggatcagcggactacacacgaagccagggctcggcttcaatcagaacttggagagatgaggagcatactgaagcggcttcgggagaggacaaagggcgaattcgcatgtttcaagaaaccgaggagtgggacaggccataaagcagcttag

SEQ ID NO: 16011 - DNA, 933 bp, A.fumigatus
cggtttccagacagaagcttttccccagttgggttcgaaggagaaagccgcagacatcaccggctgtccgaaagtgagaccaggaagttacagaccggagtcgtggagttggtcaacctgattcgcgaaaatgtgctgtcgttgtttgctgatccgcctttggatgatgcttccttcctggcgtctccaatatcaccagcaaccccgaatagtccgataagccaaggcgtgactcccacagaatcacgcttcaaactcgacccgaagaacatgccaatacccacgcccaagcgcggggagttctgggaagactatgccttctggccgcccttctcgaattcactcagtggggttcactatctcggccaattcatgatcatcatcggcaccgcggcgagcgaaatggccgcattgaatcctgtagcaagtggtggtaacactcatgatctgctcaagtctcttgtaagcattgctcgtgagcgctccgtccgggttgcatgtgcggcctggggcaaagacgcagagatctgcaaaatgctggaagactggacgcgcgatcccgagagcaaggatctgaccaagatgcccgggctattcgtggcctttgaaagtgcaattcttgggagaatgcaaaagatcctttacatatcagaagctatggctaaatcaggggctgtggatgtcgttacgcaaccccctgccaagctactccagatggtccgcacccaatttgtttccagtgtttataaggcgctcagtggtctcgtggagaacgcggaacatcctgtcggtctagatgagggtagcgaatggatcctcgccgggtctgcggtacaagtccatggttctgattccacttcacctgctttggctgcggatactgtggactctcaagatagggtaggactctctctcaacctgcttccgtcttag

SEQ ID NO: 16012 - DNA, 1533 bp, A.fumigatus
  unsure (1519): Identity of nucleotide sequences at the above locations are unknown.
cacgaggtcaagcaactgatccacagttcccccttcgaccctgagccttggcgatataccagcatgacggacatcgaggttgcgaattactacaaccttccatcggcctaccctgaggaatggcctgctgagcttgatcagagcgaaccctccgacgatgaagaagctctgggccgtactccttcgcgagccaggaggtcccgatacttcgccctcgaacgcagtcacagtgggaaggccctcagccttggacccttcaaaggaagcaatgcgagggaaaatcttgccaaggtcgatgaacccgatcctcttgggtctggcgacagcgtccttcaaatcctgaaaaaacgaggactatccttggaagatgaatcccgcttacggaaccggttcttgctttcgtcaacctcgttttcccccgcccttttcctctcccaagtccactcagatgcgtcaattgagtcacttcttgaaggactcaactttctctcaagatctatcgaccagaaatcggcgtcattgaaagtcctcgtcgaggcgaacttcgagcgctttgtacgggccaaagcaacaatcgatagcgtctatacggagatgagaaaccaagggaaagaaaaacatgtgccactgactcaggcacatcgcaggtcggctgggcatcttcggagtatttccggggcttcgcgaagcgcgcctcttgcggacgacaggcccggaaagaatgctctaacaaaggaaagcgactatggcatgaaaggaatacgagtaccactattggaggcttcagtcaaagctgaagaagtctggggcccagcgttgggcgggcgcgagcgagaacagatgctcaagtcagttgtcgacacgatggagaagcaccgggatgtatacgagattggtggactcctctcgaaatctattaagctgagggactacgactctgtattcgaacaatatacaaaagcacgaacgttggccaagagcgctaagcatattgcacacaaggcaactagcagtgggcgatctctgacagatgaagaaacgcacgctatcctcgccatgggtcggatgtggatggatgtggaccatcagatccaggcgttcaagcgcgatctgtggagacgtctcagcgatgcgcctaccacatcaaccactgccactgcagacggcactgtggaagaatacatggagttgatcggcgctctgctggaattgggcgtggacgacaaccctatctgggtgtggctgctcagccgctatgacttcctcaagactaaaattggtgccttctgtggacgctgcaagatggagattgagatcctccgacgccggcttgctggcggcgacaagccaacacccaaagctgtggcgtcctatctccgcctggcaccacgagaagaatcagcggagctgcaaggcgtgctggacaccgatcaggtagtcgagctttgggaatgtattctagcgtatctcaacaaattgctggcatcgcagggtgggctactcggcgaagtgtttgaanttctgggaaagtag

SEQ ID NO: 16013 - DNA, 234 bp, A.fumigatus
gtaatccctgcttgtttctcaaccctatgctttctgtctaaacgtgtttcaggtgtgactgtcggagctgtggtcattccccagggtatggcgtacgcgaaacttgctgccttgcccgttgagttcggtctctattcctctttcatgggtgtcttgatctactggttctttgctacttccaaggatattaccattggggtcagtaacactaccttttgttccctccgcgcatag

SEQ ID NO: 16014 - DNA, 1329 bp, A.fumigatus
cccgttgcggtcatgtctacgctggttggaaccatcgtcctcaaagctcaaaaggagattccggatgtcccgccttatatcatcgcatccgccatggccatcatctgtggtgggatcgtctgcgccatgggtctcctccgtctcggctttattgtcgacttcatcccccttcctgcaatttctgccttcatgaccggatcggccctcaatatctgctccggtcaggtcaaagacctactaggcgagactgccagcttcagtacccgaggtgcaacctacaatatcatcatcagcactctcaagcacctccccagtgccggacttgatgcggcgatgggggtctctgccttggccatgctttatatcatccgttctgcctgtagctatggcgcaaagcgataccctcagcgcgccaagactttcttcttcctgtctacgctgcgtactgtcttcgtgatcctattctacacgatgatcagcgccgcggtgaacattcaccgcagacagcaccctgcatttaagcttctaggaaaagttccccgaggctttcagcatgccgccgtcccggtcgtcaatgcccgaatccttaaaacatttgccggtgaactcccagctgcggtcatcgtccttttgattgagcatattgccatctccaagtccttcggccgggtcaacaactataccatcgacccatctcaggagctggttgcgattggtgttacaaatctgctgggcccgttcttgggtggctaccctgccaccggatccttttcccgaactgccatcaagtccaaggcgggagtgcgaactcctctggctggctgcattaccgcagtcgtcgtgctgcttgccatctacgccttgccggctatgttcttttacatccccaaggcatccctcgcgggcgttatcatccacgcggtgggcgaccttattactccgccaaacaccgtctaccagttttggcgcgtctctcccttggatgcgatcatcttctttatcggtgtgtttgtcaccgtcttcacctccatcgagattggaatctactgcaccgtcgctgtttccgcagccgttctgctgttccgtgttgccaaagcgcgtggccaattcttgggaagggtgaccatccactcggtcatcggtgaccatcttgtgcaaggtgatggcaagtatggaccggccaacggatatacccccgccgatggccaaggcaattttcaacgctctatcttcctccctatcgaccaccccgatggaagcaaccctgaagtcgaagtacagcagccgtatcccggtatctttatctaccagattctccgaaggatttaa

SEQ ID NO: 16015 - DNA, 384 bp, A.fumigatus
ggtcacggcatactatatcctatcttccagacatctcctggtccattcgaacgcttgtctacctacacaaccattatgtctgccgacctgaaaaccaagattggtcacgggctggccaaaggcctggggatcaagcttccctaccgcgaccctctgggtgctaatgctgacccggtgacccggggtgagtccatgttctccgttggcaccgtggatacctattcctacgtcgaaccagagcccacatcggcggaatggctcagagaactctgcccaacttggcgggatgttggccactacttttacagacttttccctttcttgacttggatcacgaggtacaattggcaatggttcttaggagacgtggttgctggtaagtaa

SEQ ID NO: 16016 - DNA, 507 bp, A.fumigatus
gcatattgccatctccaagtccttcggccgggtcaacaactataccatcgacccatctcaggagctggttgcgattggtgttacaaatctgctgggcccgttcttgggtggctaccctgccaccggatccttttcccgaactgccatcaagtccaaggcgggagtgcgaactcctctggctggctgcattaccgcagtcgtcgtgctgcttgccatctacgccttgccggctatgttcttttacatccccaaggcatccctcgcgggcgttatcatccacgcggtgggcgaccttattactccgccaaacaccgtctaccagttttggcgcgtctctcccttggatgcgatcatcttctttatcggtgtgtttgtcaccgtcttcacctccatcgagattggaatctactgcaccgtcgctgtttccgcagccgttctgctgttccgtgttgccaaagcgcgtggccaattcttgggaagggtgaccatccactcggtcatcggtga

SEQ ID NO: 16017 - DNA, 1683 bp, A.fumigatus
ccagaatgtcaccatccagtaaaaggatggctccggtctagtgcgttgcaaatgtctatggtcccaaagccctcgagcgggctcccgttctggtcacatatgggcggtacggcaaggacattcattaccgcgagtatgcagtcccatttgcgccgctgttcatgtgcccagattgctgacccgaccagtttccaccccaagtcattcagcgaagtcaacccggagcaccgctcggagcattccgcgtgggagacgcccgaccccggtttctggaccaagcacggctatgcgattgttcgggcggacgagagaggcacaggtcaatcacggggcaagctggacaccatgtcgcgcgaaaccagcgaggcctttttcgacgtcatcgagtgggcagcggaacagccatggtcgaccggcaagattgggctgctgggtatcagctactacgcgggtagccagtggagagtcgccgcgcgccagcccaagggcctcgcctgcattatcccctgggagggcatgtcggactactaccgggaccgttgccgccatggaggcatcctgagtaactcctttatcaaattctggtgggaccggcaggttgttagcaaccagtacggtcgccccggccgcgcagcgcggaactggggccctgatactattgaaggcgaccttccggaggaggaactggtggccaaccgacaagaccagacaatcgacaacgcggagaattacttccgcgatgatatctactacgcgtccaaggaatacaccccgtccgacatccaggtgccgttgctctccgtggcaaactggggtggtattcttctgcatctacggggaaatgtggagggctatacgcaggcgggcagcgagctcaagtacttgcgcttcatcaccggtcgacatgacctccccttttactacgcggaagaagtcgagattcaacggagcttcctcgatgcgttcctcaagggggaggatcgtgtcggctggagcaacggaacggcgcccaaggttgaccttgttctacgcaagggcgacgtcggattcgacaacgcggaagccgagaaacagtttcctcgtcgcgtggagaatgaatggcccattgcccggacgcagtacaccaagtactatctgacgtctgaccgtcaactagtcaccgagccccgacaggaacgaccggggaaaatcacctaccgcgctctgggaaccttggacaacccccagctggtgcaattcaccacggcgccgtttgagcaggagacagagatcaccggacatatcgtcgcgcatttgaatgtgtccatgagcccggagccgggcgcaccgacaccgcgggacattgatctgttcgtgaccctgcggtacatctccccggagggcaaggaggtcttctacaccggcacggcaggcgacccggtacctctctgcaagggatggctgcgggtcagcatgcgaaaggtgaacaaggagcatcgccgtcatcgaagctatctgccccatcgcgactactactccaccgatgcgctgccggtgattccgggcgaggtgtacggcgttgatgtcgaggtgtggcccacgaatgtggtcgtggagaaaggaggcaggatagtttttgaggtttcgtctggggacacccagggctgtgggattttccagcataactccccgactgaccggtag

SEQ ID NO: 16018 - DNA, 642 bp, A.fumigatus
  unsure (635): Identity of nucleotide sequences at the above locations are unknown.
cttacttctgccctcctgcaccttggacaaacacaccagaaagacacacaaggtcctcccgttacacctctataccaaacaatactgcctaaaatgccctccaaacccaagaacattcgcccccttcaacgctatatcaccactcacgatgcctccggcaaggccatcttctccagcgccctgtccgaggaaatgcccgtgaccaccatggcggatggcgccgacttctcgctcgcgtacacctcctcgcacttccccgccaaactcatcaacgacgacgatatccccgagtatgcgaactacctctcgagcccgccgggcatcgtgatcagtacgggcaccgtgtgccggatcgtggatatgcagcctggggcgacgagcccgatgcaccgcactgtgagccttgactatggggttgtgctggagggggaggtcgagctggtcctggactccggggagaccaggctgatgaagcggggggatgtgagtgtgcatcggggaacaaaccatgcgtggaggaatacgagtcagacagagtgggcgcggatgctgtatgtacttgtgccggcagaggccatcgagattggggggaagaagctgggggaggaggtacgggagatacgggtgaggcctantacttga

SEQ ID NO: 16019 - DNA, 540 bp, A.fumigatus
aaggatggctccggtctagtgcgttgcaaatgtctatggtcccaaagccctcgagcgggctcccgttctggtcacatatgggcggtacggcaaggacattcattaccgcgagtatgcagtcccatttgcgccgctgttcatgtgcccagattgctgacccgaccagtttccaccccaagtcattcagcgaagtcaacccggagcaccgctcggagcattccgcgtgggagacgcccgaccccggtttctggaccaagcacggctatgcgattgttcgggcggacgagagaggcacaggtcaatcacggggcaagctggacaccatgtcgcgcgaaaccagcgaggcctttttcgacgtcatcgagtgggcagcggaacagccatggtcgaccggcaagattgggctgctgggtatcagctactacgcgggtagccagtggagagtcgccgcgcgccagcccaagggcctcgcctgcattatcccctgggagggcatgtcggactactaccgggaccgttgccgccatggaggcatcctga

SEQ ID NO: 16020 - DNA, 231 bp, A.fumigatus
tttcattgtatacattgttgtctcgggaccacatcgggagcggagatcataggattctctgatctgattctctctcgccctcgcgctcccccgtgggtctacattcccgagtcctacgattatcaatctaacaacaacggccggatcttccgagtcatacaattggagtctattcatacgaaagcaactatcatatcacagccatatctgtctatgccttcgggggaatga

SEQ ID NO: 16021 - DNA, 723 bp, A.fumigatus
  unsure (571): Identity of nucleotide sequences at the above locations are unknown.
tgtccagcgatgctgacaaccaacacacagaaatggcttctggtacaccgtgctcatctccatgaaggtctcaaggctgccgctctggcaccaggctccggcatccccgctgagctgcacacctcgagcaaagtgattgacatcgatccgcaccgtgccaccgtcacactcgaagacggacaggtggttcagggtgacgtcgtcatcgctgcagatggcgtgcattccgttgctcgatccaaattgccccgcgccagcaacgttgcaccctatgactgcggcagaaatgcattccggtgcttgatgtcccgccaggcggcactggacgaccccgaaactcgagaactcgcaacggaacggggcgtgatcgacatgtgggactcacccgagcggagagtggtcatctatccgtgtcagaacaacgagatcctgaactttgtgtgcctgcaccccagtacaatgactgccattgagaacggcacggagtggaatcactcgggcggcaaggaatcctcgattgaggtgtccaaagactttgacccgctgttggttaaattgttggggcaggcanaaggcgaaacgctgcgaatctggccgttgtgggacatggacacccttcccaaccggggtctaaagttcgatggctgtccctgggggattgcggccatccctttcttggcccaatcttggtccgggagggggcctggcctattgaaagaatgg

SEQ ID NO: 16022 - DNA, 564 bp, A.fumigatus
ggcttgccgaagggtggacatgtcactgctgcgagagcccagcttctctcagataaagcggagcaaaggctatgttggggagaggtcctgtttcgaggaaagttacatctaccgttttcgaggtgtaagtgctggccaagacattcaaccgccatggggagcaacgacttgaacgggaccgagcaggatagcctccaaattctaatagtgggagctggtattggcggcttaactgcagccattgctctcagacagcaaggccaccgcgtcagcgtgagtgacccggcgttctcatctgaatctgtagggaactctcacgcatcacacgttcatagttgttcgagcgaagccgttttgcgaatgaaatcggggcagcaattcacatctccccaaatgccaacagtgtcttcttacggctcggggtggatgcgaccaagttcggagcggtcgaaacagaaatggttcgtgttcaatgcaaaccaggtcaacgaaggccacatgctaagaagtgacagcttcgcgagcgctcaaccgacggggaagtcctttcgactgttccagtga

SEQ ID NO: 16023 - DNA, 186 bp, A.fumigatus; identical to SEQ ID NO: 10610

SEQ ID NO: 16024 - DNA, 921 bp, A.fumigatus
ttcaaggaacatcagcagaagattgtgaatgaactcagcgggatagacggaaagatgttcaagaccgatacgtggacacgtcctaatggtggaggcggtatttcatgtgtcttgcaggatggaaatgtctttgagaaggccggtgtcaatgtttccatcgtttatggtgaattacctcgccccgctatcgagaaaatgcgagcggatcacaagtcgtttgtcggcgcggatgttgactctctgagcttctttgctgctggtctctcactggttctgcacccacacaaccccatggctccgacagtgcacctgaactacagatatttcgagacctcggatccaaaggatcctatccatggagagaaaaactggtggtttggcggcggcacagatttgacaccgtcatacctcttccctgaagatgtcaagcattttcaccagactatcaaggacgcctgtgatagacatgatgcgacatactaccccaaattcaaggcatggtgtgacaagtacttccacttgccccatcgcggcgaggctcgtggtgttggcggtatcttctttgatgatcttgacgccagtttccttgaaacctcttctacttcttcccagaaccctcaagagaccatcttctcattcgtctccgatgctctcgcatcattcctaccctcctacgtccccattatcgaaaagcgcaaggacatgcccttcactcccgcccagaaggaatggcaacagcttcggcgtggtcgctatgtcgaattcaatcttgtctatgaccgcggaactagctttggtttacgtacacccaacgctcgtgtcgagagtatcttgatgagcttgcctcgcactgcatcatgggcatatatggaccctgtatccggaacacgtaccgagggtcccatgtcggaagaagaataa

SEQ ID NO: 16025 - DNA, 1752 bp, A.fumigatus
gcgagcggatcacgcaaccgagcggatcaccaaacgcgttttgacttctatttcaaaagctgcagtgctcagccagccactatgccaccaaaagcgcgtataaactcaaaaaattcagttgagcaggagggaagggtcctacttgcagtatcagctttgaaaaataaggaaattctcaatattcgtgaagctgcgcgtgtctataatgtgccttatactaccctccagcggcgcctaaaggggcatacttttcgagctgaattacgcgcaaatggccataaaatgactcagaatgaagaggattcacttattagatggattctatctatggatcaacgtggagcggctccccgaccgtcccatgtacgagaaatggcgaatatcctgcttgcgcagcgtggttcaactcctacccagactgttggagagaaatgggtatataacttcattaatcggcatgatgagatcaaaacccgattctctaggcgctataaccaccagcgtgctaaatgtgaagacccaaagattatcctggaatggttcaatcgtgtccagatcgcaataatgcagcatgggattacactggaagatatgtacaactttaatgaaactggctttgcaatgggcttagtagctactgctaaggtagttacaagagctgagatgcttagtcagcccttccttatccagccagggaaccgcgaatgggttacctctatagagtgtattaactctactggctgggtgcttccaccatacattatcttcaagggaaaggtccatattgagggctggtatcaagatacagccttaccagcagactggcggatcgaggtcagtgagaatagatggacgactgatcagattggattacgatggcttcaaaaagtctttattcctgctactaccagtcgtacaactggtagatatcgactattaattcttgatggccatgggagccatctaacaccacagtttgatcaaatctgcactgagaatgatatcattccaatctgcatgcctgcacattcatcacatctcctccagcctctagatgttggctgtttctctcctcttaagcgtgcatatagccgcttgattgaggataagatgcggcttggtttcaaccatattgacaagtttaatttccttgaggcctatccacaagctcatacggcaatcttttcagcagataatattaaaagtggcttttcagcaactggattaataccactgaatccagatcgggtgctcagtcagcttaatatccagcttagaacacctacaccaccaggcagccgatcaactaattctatcccaaaaacaccttacaatctcaagcagctgaagaagcaggaaactacgcttaagaagctacttagggagcgtacatacagccctcctacccctacaaaggctgtgctaggtcagattatcaaggggtgtgagatggcaatgaataacgctgcccttcttgcaaaggaaaatcatgatctacgtgctgcacatgaaaagcaccttcaaaagcagaagcgatctaggcggcagatagaaactgcagtgggattatctatccaggaagggcaggagatcattcaacgcagggatcaggctgctgaagctatcccaactatccctccagagcaggtagtagatacagaacaacgccctcaacgggcacccccacgctgcagtgactgccatattctaggccataggcgattgcaatgtccgcagcgcaagaataactag

SEQ ID NO: 16026 - DNA, 267 bp, A.fumigatus
tgttcgacagccgggggttctcgtctcccccaccgacatccgtatgcaccccggaaaaccacacctggagcatctcctggccctcgttcctgtgcgggatgtgccacacgatcggctgaaacgccgtgcgctcctcgtccagcgacagcgcatggaacgcatagcgcacattatcctgcaggattgtattccgcagctccagcttctcgcccgcgtcccggcccagccacgccttctggaacccaaccgtatcccacaccccgatga

SEQ ID NO: 16027 - DNA, 990 bp, A.fumigatus
  unsure (982): Identity of nucleotide sequences at the above locations are unknown.
ccaggcgtggccggactgggcgtcagcgccaacgtgcgagccgcgtacggcttcctggccgacaactacaacgacggcgacaagatctatttctttggcttctcgcgcggcgcgtacactgcccgtgccgtcgccgggctcgtctgcaaatggggtctgctgaccccgcggggcatggataactttgcgctcgtgtatgatgatttctacaaccaaaagattgagggatacgatgcggagcggcgcaaacgaatggggttccgagaccccctgtcgcggttcacgcacgagatcatcggggtgtgggatacggttgggttccagaaggcgtggctgggccgggacgcgggcgagaagctggagctgcggaatacaatcctgcaggataatgtgcgctatgcgttccatgcgctgtcgctggacgaggagcgcacggcgtttcagccgatcgtgtggcacatcccgcacaggaacgagggccaggagatgctccaggtgtggttttccggggtgcatacggatgtcggtgggggagacgagaacccccggctgtcgaacatcactctggcatggatgattgcgcagtgcatgaagcacaggcagctgagatttgacattgacgagtatctgttcgatgatcccccgcgacccgaggaaagcgagatggctccgtgggcgacaagcctgggcaaaatcgaccacagcagcatcggacgaacattacaaggtaagctgggaggcagatccactcgcaaaccgatggggtacaacccgacgggtcaggagtccgatatcacgaacgaattcattcacgaatcggtccgggatcgcaatctggccaagtggccatgcgccgcgctcaagggacgccccgatgagaagagctggactctgacgtctggcaagcagatcgccgaacttcctgcgttgcagatggaaaagtatatgaagggtcgcattcggacagtgcatgtcaccgagnaggattaa

SEQ ID NO: 16028 - DNA, 663 bp, A.fumigatus
caagcagcatcgtggactagataccgcacactcacccctaaatctcgtgctatacctttgacaccttcattcgtatcctacctccgcgccaacggaatcgttctaccaccagagaccacacggccacatggcgatgatgacatagacacattttccgacgatggtgcggatgaggagtcagatccatccgttgaatggcaagagatccactcccagatcaagtcaaccatctcagagtttggcggcaaagtgacaccaaagctaaactggagtgcgccaaaggatgccgtatggatgtcagcgacgaacgatcttcaatgccgaacgccaaatgatatatacctcctcctgaagagcagcgacttcatcacacacgacttggagcatccatttgacggttgtgtgcccgatccagacgattcgtccgaggcacctgccacccagcccgatatcccttactacctcgtcctccgcaaatacgtcaacttcaacccctctcttgaatttcgttgctttgtccgtaaccgcgtgcttttgtgcatgtgccagcgtgaccagaatcattttgacttcctcttctcgctgcgggatacccttcgatcacgcatccaggcattcttcgacgagaagctcaaagacacattcccagaccccaacttcgtt

SEQ ID NO: 16029 - DNA, 2097 bp, A.fumigatus
  unsure (175): Identity of nucleotide sequences at the above locations are unknown.
gaagcttgcgctctcaggctttgcagttcagggattgattcaaatacagaaacagagcgacgagcactgggtgctcagctttcacttctccaccgctgcacacaggcgattgcatatctactgagaaagcgcgtttatacactgctgcgggcgaaactactggtgctttctcgtntacttcacaaaaccctttcacagcagaagaccgtcccgccattcctggacaatttgcgcaaccagttagcgtcccttcggcggacactcctgaaaagaatcgacaagcggctcgcgtccgcaaagtccatcgttgacgatacaatcgagtcattggccgcttattgcctagcgacaagctcctcatcagacgatgctattcgccattttcaccacgttcgcctggatgtcattggaaacctgctgggacttcatgagtcgtcaggcgagaatgtttcgaacgcgctacagctttacatccaaactctgcaaatgtcgaagactcttctttctcgtcgactgtcagatgtgctcaataagttgaaagcaagacctatcttggccgatcctgacatcctcagtctcgatgaactgagtgttgacgtgctgggccgttgggttgctgcagacgtcaagaatttcactccttggatcaaactaagtgagctgtcgaaaccagaagcagaaaagacaattaaacagtggtcaagacaagcattcgacgctttcatcaaaggctgcagtcacaccttgacagactggtgcaatttctctgaattacttgctcttcgtcgcaaaactttggaattatggctcagctcctggggctcaacacctactcattcgcccatgaacatcctcggaggcattcaatctgttttcaatgagcggcttagccaaatattatcacatcaggccaaagaattggagcaattcggccgagctgtttcttctgtggtcacaaattgggacaccaacgaacacgttgaagctctctccctgtgggatgacgaactaatcaatcttgactactcagatggggcggccgtattcaaacaaacaatcgcagatagattgcttggccgcgacgcagacgtatccgcagtattagcgaagtacgaaacctggcttgcggccattgacaagtccaagcagtatatcaatgacatgaaacgagtgcgatggaccgacatcctcgaggaaggagaagaggaagatgcagacatggatataacacccatattaaacgacgacgacactgcgttgttgacaaacgcgctccaacaatctgtccgagagtcgttcaagcatttgcagtcatccttcgtcgagattctcggttcctttggaccttctcatcgagacaagaaagccgcctttctgctaaaactcgttaggctggttaggaaggacctgcccgttaacttcatttcaagcgatttctccctgttcaaagacatcgtccctcagctgcaagaaatccttatcgcacaggtagtcacacttacagagccctcgaatctatggcccaaacgcgtctcccaaacaaacgaaatattgcaaggccggaccctttgggagggtgaccctgaacttccggtccagccttcaccagcaatcttcaaattcctccgacatcttgtagacacgatggatgcctacggcttagggctttgggacgtgtctaccactcaagcactgaaggaaggaatgcgaaaagagctttgggccaccgccgcagctactcttaaggctttggagtcggtaaatgatcaagaaggaagcgcagtatcgaaagaagctcaagcagtcgagaatggagacaatgataatattgagcagtcggaagccaatgttgcgatcggagcgcaaaacaccgacgattacaagatccagctctactttgatctgctctacttaagaaatgctctgtcgatcacgaagtcagctcaggactctttgccagaccctgtagaaagcctcttcagcagtctaaactcgaatccgacgacggtcaaaattcttgagcaacgagcgcatgattattggaaacggacgcatctgttgttcgggctactggaagtggggacagagcaattatga

SEQ ID NO: 16030 - DNA, 1107 bp, A.fumigatus
tcttgcggtagccccaactcttccataatggcttccccacggctaccatttctgtatccgcattttatgcgcgcgattagaacatgcgaaccctccacgtaccgcacgattcggggtcgcccacatagtcgttcatttcatgccagtcgatatcgcggtcaggaagcatatcaccggcgctatggccctgccgctgaggctaacttgcctcctccgtcgaaacctagggaagagttgtccaaagagcaagtgtctaaaacaccagcggtgaaggacggcaatcacaaacttgagcaatcgcggtcacaagatggtaccaagggcgatgttctggacgcttcacataaggaggatgatgacccaaaagcagcgcaatctcatgagagccagtctccgaatgactcacagacgcatgaggagtccgagctcgaccttgacgaccctgacatccatgcagtctccccagtttccaccgaacgtccaagccaagatcggcataaacctaattccctcagcgataatccacttgaaggtgttcttcatatgccttcaccttcgtcgcccttaacccctacagaaacatctcgttccgatactaaaccgcacctggctcctgtcccgtatgtccatcacttcgatacctactccctcgtctgcgacttatcaaaaggcggcttcacggaagcgcaatccatcaccatcatgaaggctatacggactatcttgcataagcatctagacattgccagacaaagcctgacttctaaatccgatgtggagaacgagacctatctgttcaaagcggcctgttcggagctccagtattccctccaaacagctcgaaattccgaaatgcagaggcagcgtgcggccagagcacaattagaacacgaggcggatattctttcccagcgcctgaaccaggagcttgcgggattgaaagacgacattaagggaatgttcaatgaccacaagatggcgactcgagaacagcaacggagcattgatacatcggttcaggaactcaattacaaaattactgtttctttgaacagcgacggcaaaagtgaaattcttcaacggggctggaagatccgcgtcaaagtc

SEQ ID NO: 16031 - DNA, 3261 bp, A.fumigatus
ccgcaaccaactgacatctcggtagatgcacaagactaccccgaaaaccacacgtactttgtcttcaccacgtccgaagatcctccctcaagggtcgttacagttatggaaaatgctcagtccaggtttttaggtgttgcactggaggatttcctgacatatatcgatgagatcgtccaaaacgcgctaaggctaccggcgtccgaagccgatgacgacgagaaggttggctatggggttgacgacactgactttgtcgacgacgacgacgataacgacgacgacgttgactgggatatggaaaatgaaccggtatttggcatttcgcgggcagacgaaaagcatctattgaaaactctgcgccgcgatcttcgcgccgtgaaaaacgcgggtcttaaagtaggttgtctgggaacactgacaggcgctgtaatcgtgtcagtctcctgtcgtatcggtagactaggggtatctgaggaggccatggaagcctggaatgttcgcgcttcggaatacctggttctactcatgcgttatccagggacctatgtggattttcaggaactgctggcgctcggaaaagcaaagtatcctgcaatccagttccacgtcgggttatgtgactcttacaagcctactaccgaagacgccatccgagcctttcaagggaatctttcactgtccgaagaaggcctcacagggaccgcccgattgagatcactgtttatcgagcaaccactggattcactcctgaacgaacgattcctccggattatggaattgcgatatcatctaggcctgtcatggacaggtgctgagctttacattcaacaaaatcaaggcaggaggccggactatggcgctataaccgacgactattttgagccagacacctggagtgcctccgccccggccctatttcaaaatgaccatataggtcaaggccttggggtggacaaattgtccctaccgttgatagcaatgcagttcactctccgccacttcgtgaagtgcacagaattctgcttagtctgccattgcaaaatcctcgaccgttttgaagcaatcaagccgtacgtttgctccagcagtttgtgcttgttccagtacatggcgctcggcatgggcccgagcttggaacatgagattcaattccaccctagtgttgttgatttactcatcagtttgacatatgctcgggcagtatccggtaaactcatggattttcccatgggcctgggtctcaaggtccctggggtcctaaacatgaataggcttgacgagatcgaatatcatctggcaaagccaaatgacggaaattcttctccggttccgacctgttacagtggcaacttggtcgctgcaacaatggtctgtcgtctggataagcgtgcacatctgaaacccggagactgggtggtcatttttcagactggaacagatctgaaggacgggccctggcattgtcgagtagaggcgattgatgtaggtactcgcgaggtgcaactctcctctcccactgtgaagggacagcagctctcagcaaccgaacttctgcttggcccatcacaggtcaaaatcatggtttatgagaggaatttcgatgaccttgacgtcaatgagaaaagagctgcggtcagactgctcctcgacaccctcccaaatgttgataagatgaaaacctaccttgcggattctgataacaaaaagctggctggttggagggacgtcatttccccggcagcacttgatgtgttgcgctgggtcgttgcgtcaaaccgctcgttcatcctggaggacgataccacgcattccgatcatcgagtgagtggaatggggtcatacaagcagtttaggcttgttcaaggagccccagacaaagagcagcgcttcagagccgccgtcgccgctaacgtcgccatgaccaagacagattacccgaccatctttgcctggcacggaagtccagtgtggaactggcacagtattctcagagaaggtctgcacttcaaagaggttacaaacggacgcgcttatggggacggtgtttatctatcaaatgacttccacacatccgtaggttacacccgcgaaggactcgactactcctggccgcagagcaatttgaagatcaggatgctggtttctctaaacgaactcgtcaatgcgccagctcagtttaaacataccaatccacattatgtagtcacccaactggactggatacagccaagatatctcttcgtcaaatgccaaggtgcagggctcggcgatggaacagcaaatgcaaaaccatcagcaatttataatcaggatccgaagtatccagcccggggcccaagtggaactcccatctgcattccaatctctgctctgaacagtcagcggagacatagcttgggcgttgctaaccgaactgattctgacctcgccatatccgcatctcctgaaagaaagaagcgaaagcgggaagctgataagctgcctactcccgacgtctcgacaaacagcatgatcttagaggaagatgacgttgctagtgtggccacagcatttgacgaccttcaggtcctcctgtcagaggacgaatgcgaggtagaggaggccccaacaaccaagccgctcaagaacggtgaagcaagtgactttgagcctggaactctcaaaaaggactcccttcccttgctcgcccctccccaatacgcaaccgcaccagcgaccaaagttctacagcaacatctgcaagcgaccctcaaagtccaagctcgagagtcccttcatgacctcggttggtacattgacccagagttcataaccacagtataccagtggatcgtggaactacacagcttcgaccccaagctcccgctcgccaaagatctcaagcaagcgaatatgaaaagcgtcgtgctggaactgcgcttccccccggccttccccatgtcccctccatttgtgcgcgtgatccggccgcgatttctggagtttgccaatggcggtggtgggcacgtcaccgccggcggggccctgtgtatggaactcttgaccaattcaggttggcttccgacagcatctatcgagagcgtgctgctgcaggtccgaatggcaatcaccaaccctgaaccccgtcctgcgcgtctggcgctgaatcggtctcgctcggactattctgttggcgaggcggttgaagcgtacaaaagagcgtgcctggcgcatggctggcagatcccggaggatatccagcggctttcgtgggcttaa

SEQ ID NO: 16032 - DNA, 282 bp, A.fumigatus
atgtctgtcaatttgatgcagacatctcatgataactgtattattgcatggatcttttctgtctgcctaacctttgcctatcccctcaatgacgctggaaggcttccgcttacttccactgacgtcatatcaccacctcgctctcaccttggtttctttggctcgcccagcttccagttttttacttataagacaaccttcaactcaatcattgtggacacatctaacaatttttatttgactataaaagttcgtcgtcgacggcatttggacgacggatag

SEQ ID NO: 16033 - DNA, 1452 bp, A.fumigatus
aagttcgtcgtcgacggcatttggacgacggatagcagtgctgctgaagaggacgacggaaacggaaatatcaataacgttctctatcccagacaactcaaacaagcatcaaatcctccacaaaccaacggtaccacaatggcgactgttactccagaagtgacagaagcggcaatagcggccggtattcacaaggataccgagaagagggccaatgaggcaatcatatcatccgccgcccccggatcgacaactgcagagcttgcgaaggctgttccccttgaacagcgatccaatgtgcccggtactttcccagagactcctggacaagaagcaggaacgttttccgtcaaccctatcccggcttctggtaccagcggcaatccaattagtctgaaacctggtgagaaggtacccgaccccagcactttcaccagcaacactgtccagtctactgctcggacagatcctaccggttatacgcaggatcccagtgctgctactgttctcgagcccgtgggtgagcccagtcagagattcagagatcctggtgttaccattcaatctgcagcacccaactccacaaccgccgctcttgctgcttctgtcccactcgagtcccagaggccccacggggccgccgagggtgtagccgatgaggtcccgaaagtcgtgagggaatcgatcgctgagtcccacagagaccccgaggccgctgcaaacaaggaggctgtcgaagagaagaaggaaatggagaatgaactccaaaaacgagtcaccagggatgagtcttgtggtacacctgctccgagcatctctgctgtaattggttcaactcaaacgagcggcggagcacctgccgatgaagtacctgaaccagtgaagcactccattgccgaagctcacaaggaccccgaggccgctgctaatccagaggccgtcgaggagaagaaggagatggaggatgagctgcagaagacagtccccagggaagaacatgctggcgcgcctgctcccactgccactgccgccaccactgaaagcgctcctcgagccacaggcgttgagcctcaatcgcagccattgtctcccggtgccggctcccctcaaggccctaccgttaccaccggtgttgcttcagcgaaggccccggaagtttctggtcctggagctggtgccagaacaggtcaaagtgagggctccacaacagttatgcctagctcaattcccgataaagctgtcggtccttctgagcgccagaccgaaggaaccccggccccttcacaacccacggctgctcccgccactacttctcctcaggtacagacagcaggcaccactaacggtccatccaagccagccggccaacgcaacggcctgaggaatgaaatgaaggaggagaagaagaaaaagaagagtttctggtcccggctcaaggacaagctcaagtag

SEQ ID NO: 16034 - DNA, 2376 bp, A.fumigatus
  unsure (2290): Identity of nucleotide sequences at the above locations are unknown.
gacgacatggcaagtcctgagtccagtctgttgagcgcttcagctgtttctcaccgcaagtctggcgaccaatactctttccggtcgggaacttccaagtcatccctcaacaatccaaaactgctggagacggttgaggatgcgatcagaagattgattttgcccgagttgaaggaactcaaaaaggatcaaaaggtcatctcaaacacctccaaatttgaacgtgatctcaatgcttcccatacctcctctgccagctctcggtctcgggatgagctgggtcggcgtctgtccaagcatgccagtgcgccagatgtcatgaaaccaaaagttgtcctgaacaagaatagcaaggacgaaggagtcatactctcaggagagccggtgccggcaacgaaggagcgccgcacaggcaaggatagcgagaagaaactcgaaccgacctatgcaatctggggcaatcgccccgagctgaccgaacaagaaaagttgcggagacagagaagcaaaggattgcgccatgcggaaaaggccgcaattgtaggcactgcattgaccgcggccgctctgagacgtcatgaatcgcagaccagcatcgataaggatgaaagcagaagaggtgacgacagagaccgcgccgaggggatcaatgagacggagctcgttttccagagacataacgtggcgcccatgccgttgcgcagtgccgtcgagacggaattgacccgcgactccctgttgtcacatcgaagcgcagagactgaaactccacgcaaagaaagcaaagtccagggagtatctcgcagctcacccttgaaagttaattctcctgtctctcgcactcccaatcggacacccttgggctcacagcacgaattggcgctgaaacacagcaatctctcacaccacgacctctcattgcacagcacttctaatccttcccttcatgatcgggatcactcgcccgtcagcgaggccgctgctggggctattgctgctgcggcagcggctaacctcttagacgtccattccgagcgtcgagactctggcttcaacaacgactcgcgccgacgcacgctcagtcctatccagagcgtagccagctatcgaagcgactctcaatcccagcagtatgagcatgagcagcatgaatattccgagggcgagagggagctggagccgcgactgtcgattgaatcactctcctcagcgccaagtacgagtctcgcgaggtcaacacgaccagacggcttgacaagtcatagtgagattctaaaacatcgggacgtcatcgatcatgagctgggatatgaggaaacgccaaggccaacaccccagaacgagagctggcatgaaggctcggaattagacggacccaataaccgacactctacggcagacaccattgacagcgagggcaaacggttgaccaactacactgatgaaagcgaagtcagctatatgaagaaaattggccagggccagcgtgttgctcaggggatcggtgcaaatcctcaatacgtccaacctattgccgttgaatcagcggttgcttcgctccttgatccttcaatcctggataccaagtctaatcagtcaggcgggaacctttcacagcagaacctgcctcgcatacaagacgaccgcagtcctgagtcgcaccagcagacagccaatacgtctcgccagggtagccctctcaagcaacgccaagatgcatccagtccggatgagacgtctttcccgagaagaatgggcgccacatcgcctccccaaagtgtggctcagtccctcgaggatcccacccaatcgcctcaaatatatgctgatgaacatcgcaatacaggaagtcccataggcgatgatcgggacgtgagccccgactctgaatcggaaatcaatacaaatccttccatcatccaaggcccgatagggggtgttgctcaggatagcaactggacgtatcaccagacaccaccaaagggtgatcagtcgccgcattaccacgagcatgctgacgcgggtgccggtagagcgggcctaggagtagagtctatggatcaccatggttacaacaaggattactacgctgcggacgactatggacctgacagctactttgatcaaccgtatgctggtggtcacatgttcggttcgcctttgggtgccaaagacgagggctatgtgtcggccgccaatcctctgtcaccaggtgccgatactcccgagccgctcagtaaaggatttggtggaatcgatgccaatggcatgagtcttttcgacactcccntagaggccgacgacccaaccggggccttctcaccagaggaacctaagtggctattcacacggcattggttctcctctatacgatag

SEQ ID NO: 16035 - DNA, 1440 bp, A.fumigatus
ctcactgttcgtgacgctcagcgtaatgccagggatactgaaatcctggtaactctggtcagaagtgcagcggagatgcgcaattcattggaggaaatgaagaagttcatcgctcaacgggacggcatgatcatggaagcaagcgacaagcagcatgaacgtgtatacaaagctatcggtggaccgcgcccactacctgctagcggttcaagaaactttcgccaggctgcggaagatatggaggacatgcgttcgaagagaaagagcatattcaaacgggcactcaaggggctgagtctcaagtcttcgaatgatttgaccaagatcgaggagatgctggaacagcttctcgaggaggttgaagccctgcgcgcaggtcaggacgacagattcgcccgcagtgtaaatcgaacagcgagtgttgatccggaagggtatgagcctgagggtctcgctggttctggctctccaggaacagggtacctctcaacatcttctcgacctctccaggaatctcgtaacaatgaacaaaaaagagagctcgaaaatcgcgttagcaccgtcccggaaggtgatgaggatgacgattacgatgatcgcggacagtttttgagcccgaacgtgccgtcccaggagaacgcggatggacatcgtgagagggctgagtctgcgcctctttcaactccacctcgagtgccggtggcttcgggcgctctcagcaacgagactagcccgaagacggaaaaggcacgcaaacacaagtcgagcagctcttccttctttcccaagatctcccggtggtcgaaaactaccgcatcttccatgggagataatatccgcaacagtctccaacccggacgcaaggaacgcccttacctcgatgcgtcacgttctggatccgatatcaacggaccatacaagtcggcagactggtacgatccggaaggcgatgaccggctgcgttccaactacaccctgaacgaccagcagcaggagaatcgacctccgtcgcctctcgtcccatcacaggtttctgaggctccgaagtaccgcgctcatcgcgacagtctcgatctgcagcatccccaaccgcgccaaggccctactgggcgctaccaatctcagctagagacgcaggcgcagatttacggaatgccaatgacaggggcgacttcggatcaatggggttccaatcccagcgtgtctgctactaatccgaatcagaatcggtacagtggcggcgccagtcgactttcaccaatctcggatgctggctactcacaaacaagttcgagagctgggcgacaggggcccccgagacctcccaagatcatggacgatggtccactcgtccctgagaggcctcccaaaattaaggaggagcgatcatacgcggagcgtgttgcctcccaggtgagccccctttgttccttacattag

SEQ ID NO: 16036 - DNA, 369 bp, A.fumigatus
caacagggagtcgcgggtcaattccgtctcgacggcactgcgcaacggcatgggcgccacgttatgtctctggaaaacgagctccgtctcattgatcccctcggcgcggtctctgtcgtcacctcttctgctttcatccttatcgatgctggtctgcgattcatgacgtctcagagcggccgcggtcaatgcagtgcctacaattgcggccttttccgcatggcgcaatcctttgcttctctgtctccgcaacttttcttgttcggtcagctcggggcgattgccccagattgcataggtcggttcgagtttcttctcgctatccttgcctgtgcggcgctccttcgttgccggcaccggctctcctga

SEQ ID NO: 16037 - DNA, 198 bp, A.fumigatus
aagtacgcggactacaacaactctcaaggcggctacggccagtacaacccttacggtggccagcagcagaacaatgcctacggcagccaacaacaaggctacggccaggccccctaccagcaagccaataacatggagcagggtaatggtagctatggtaggagtcctcatatcctaagctctggagtatatctctaa

SEQ ID NO: 16038 - DNA, 558 bp, A.fumigatus
gctctggagtatatctctaatgcgctgcctcttacagaaatgtccgctatgggtggctacggcggtcagcagcagcagccatccggcccgactgcattgctgaacaaatgcaaagaaatcaacgatggtattgccgatctgcgagccaagagagagggccagctcgccgccgcacagaacgctttgcttgactcgagtaccggaaaggaagatcaggcctcccgtcagacactcgattacatcgaagacgagatcaacaacggtttccgttatctccgagacctcctgaaaaagatcaagcagacgcctggctctggagacacccgggttcagacccagatcgatgtcaccagccggaacttgcgtcgggagattgagcagtaccagagggcccagtcggatttccagaagcggctgcgcgagcaggtgcgccgacgatacgagatcgccaacccagaggcatctcccgaggagatcgaacagggtgttgacaatgttctgatgggccaagagcagagcttccaggtacgagagcatggctcatccccaatatcttga

SEQ ID NO: 16039 - DNA, 606 bp, A.fumigatus
gttaccggcagcagaaccagacaggccaatgacgccagacaagctgctttggagcgatccgccgctattcgaaagatcgaacaggacatgattgaactgggccgtttgtaccaggaagttgcggagctggtgcatcaacaagatgctgctgttgagcagatcaaccaaggcgccgaagatgttgtcgacaatgtccagaatgcgaacacccagattgatcatgccatcaagagcgcgcgcaacgccaggaagtggaagtggtatgcgctgctcatcgtcagtacgtgtcatctttggcctcagtgtaaaagcatcaacctgactgactgcgactttagttctgatcattgccatcgttgtcggtgtcgctgttggtgtcacccaggccaacaaagcgtaaaatggccatccttgaaagatgcttgcatcaaacggcttgcagaatacgtttgtcggctgcttatgatctactccgcgctcggaaatctgcgtcgctacgtcaggcttctcgatatccccgtatctcgccctctgcattatcctttcgttatacatggtccacgcaatgcggaagcgaaagtcgataaattcggtgaggcatcataa

SEQ ID NO: 16040 - DNA, 372 bp, A.fumigatus
cttgcagtaacactcctcgctatccttgcgagcaatgcgattgctctccctctttcccctgcgtttcctgttggcgaactcaagtatatcctggacaactcccaggccaaggtgttggtcgctactcagaagtatagggataaggcgcacgacctgctcaaagccggattgaatacggagcccgtactggatatcaaggagaagatccaggtgggtgcgacgagctcgcacccggtctcgttggaggacctcaacggtgagagatcgctgggagggatgatgctttatacttctgggactacgaaccggccggtaggcatcgaattttccgttaattctgttgagactccgacaggctggaagaacttctag

SEQ ID NO: 16041 - DNA, 867 bp, A.fumigatus
aaaggcgtactcattccccaatcagcacttaccgcacaagcgtcttcgctattagaggcgtggaaatatacccccgaagatcgattgcttcatcttcttccgctgcatcatatccatggaactgtcaatgcgatcgtgacgcctatacttgccggatcttgcattgagttcatgtttccgttcaacacagacgctgtatggaacaggcttgcagagccatttttaccgaacagcacgaataagagtaagattacattcctcacagctgtgccgacaatctacaatcgactactctcaagctttcctagcttacgtcccgaaattcaagaagccgcgaagaagggcatttcgcccgagaatctccgcttgaacatttctggctccgccgctctcccgacaccgaccaagcaagcctggcaggatctcagcaacgggaacgttctacttgagcgctttggcatgactgaggtcggaatggctatcagctgtgggctcgacttcgcagaccgcgtggatggaagcgtcggctggccgctgccatctgtggaggctaggctggtcgacactgagacgaatgaagtcatcaagcctggagaggagctcgacgccaatggccgtgagcgggaaggtgaaatccagcttcgtgggccgacaatattccgcgaatactgggttaatgagaaggctacaaagggggccttcgtggatagcgaagatgggaaaggcaagtggttcaaaacaggcgacgttgctacccgccgagtagtccggaacgccggcaaggggaccagcggtaaatgggccaaaggcccaagtatttcatccagggttcttcaccacgcagctgcaaggaccacgcttatgtat

SEQ ID NO: 16042 - DNA, 330 bp, A.fumigatus
gtattcatcgaagcacactcattctttgtgctcaactcgactaatcgtgacgacaggtttctgagagatgcatacgcggatgtcgacaaacactaccccggtgatacctggaatgaacccggaaacaacgtttacggctgcatcaaacagttgttcctcctcaagaagcaaaaccgcaagctcaaggtccttctttccatcggaggctggaccttgtctgccaatctcacccagggaacaagcacggatgctggacgcaacacgtttgcccagtctgctgcaaagctgctccttgattacggctttgacggtaggttttccctttcatga

SEQ ID NO: 16043 - DNA, 672 bp, A.fumigatus
  unsure (330): Identity of nucleotide sequences at the above locations are unknown.
cattcaaatctaggaccaaacaattactccaagcttaagctgagagagatgacaccttttctcgacttttacaatctcatggcatacgattacgccggaagctgggactccgttgccggccaccaggccaacctcttcccatccaatggcaacccctcttccaccccgttttcgacgatccaggccatcaattactacactcaggtcggaggagtcccgccttccaagatcattctgggaatgccgctgtacggccgtgacttcttgagcaccaacgggcccggcaccctctactcgggcaatggagctgggagctgggagcatggtgtntgggactacaaagctctcccccaacccggagcaacggaggtctttgaccaacaagcaggtgccttttggtcctacgatgcaggcgcccgcaccatggtctcgtacgacaccgtcaccgccgccgagatgaaagtgaatttcatcaaggagcagggcttgggaggcggcatgtggtgggaagccagcggtgacaagggaggaaaggcggcgaataaggccgatggcagtctcattgggacttttgtggaaggcgttggcggcgtaaatgcactcgaacagagccagaataatctggactaccacgagtctcagtttgacaacctgtgtgctggtttcccttga

SEQ ID NO: 16044 - DNA, 213 bp, A.fumigatus
  unsure (20): Identity of nucleotide sequences at the above locations are unknown.
catgatagaaccacccgtcngatccttccagccccgtgtgaagacctgcgtggtggggccaagaagcgcaagaagaaggtctacaccacccccaagaagatcaagcacaagcgcaagaagaccaagctcggtggcctcaagtactacaaggttgacggcgatggcaagatcgagcgtctccgccgcgagtgcccctcccccgaggtatgttaa

SEQ ID NO: 16045 - DNA, 621 bp, A.fumigatus
cagaacggggttcatgtgttctcagtacaactacgattggcacccgagaaccctcatccgacaccagtggaggattgctacgctgggctcacctggctatacgaacatgcggaggagttttccgtggatcgcagtcgtatagccacgatgggtgagagcgcggggggactgctggcggcgggaatcaccctgatggcccgcgatcgaggattggcgcctccgatcgccaagcagatcctcatttatcccatgctggatgaccgaaacacggtgcccaatcctgagctggaaaatttcgctctgtgggactgtaatgataacatcactgcctggactgcgcttcttgggaccgacattggcaaggacaatgtctcacagtatgctgcgcccgcgcgcgcagtaagcgtgcaaggcctccctcccacgtacattgatgttggcgaactagatatctttcgagatgaagatattgcctacgcggccagaatagcatccgccaacatcagtgtagaactacacgtataccctggcctacctcatgcctttgaggtctatgctccgcacattgaggcgacaaaacgtgctactgcggatcgattcagagctgtccagacgctctag

SEQ ID NO: 16046 - DNA, 294 bp, A.fumigatus
  unsure (40),(105): Identity of nucleotide sequences at the above locations are unknown.
gatttcttcccatcaaagtttttctacccccttaaacctncgtcagtcgccatttgcggccttatctcggtggcaagcacccgtcatatacaacagtttgctatncattcggccatctactacaccttaacaacctcaacttcctggcacttctggcataattactttccaattgccgaaaacaaaggaacaaaaaccattcttgggggacattacaacgacatttacaacacaattccctttctcaatcgggctcatttccgataccaccgggcttccgcgtcttccttttaa

SEQ ID NO: 16047 - DNA, 228 bp, A.fumigatus
ggaacaggcatgatcatgccgaggaactttaatcttacttctgatctaacatggtctaatatcggctctggacgatgtcttttggaatgtcgtcagtcacctggaccgtcctcatacagtacgtatctcagatgctcagccctcgtcaccaaggctcaacatcttaaccaggctcacaatgccttcggatcttccactatgatgattctcactctcaagatcatatag

SEQ ID NO: 16048 - DNA, 534 bp, A.fumigatus
gacaagtacatgcgttccgttgcagacttcctcaacctgcaagaacgcaccaagcgtgacatggagaatgcccggaatttcgccattcagcggttcgccgtcgacttgctcgagagcattgacaacttcgaccgggctctccttgctgttcccgctgagaagctcaaggccgaagtgaccgagtccaacaaggaactgatggacctcgtgtccggcctgcggatgacccagaacattctgctgaacactctgaagaagcacggtctggagagattcgaccccagtgagcctgctgaggacggcaagccccaaaagttcgaccccaacgttcatgaggccacgttcatgaccaaggtcgagggtaaagaggatggcgatatcatccacacacagaccacgggcttcaagctcaatggcagagttttgagggtaagtcattcttctttaagtagctttttttcccaggggtctaacccgtggtttcacaggctgccaaggtcggcgttgtcaagaacaactagacgtcgaacttga

SEQ ID NO: 16049 - DNA, 600 bp, A.fumigatus
aagctccatattcctttttcatctctaaaatatccctcctacatcatgttccaaagaactttgctcagacaggcccaggccgccaagtccattgtctctctccgtgccacatctaccacaccttcagtcatccgccgcacgtcacagttgcaatcacagctgctgtccgttcggccggttgttcgtcagccgacttaccgcttctactcaacagagaaccaagctcagaacgctgagaaggccgaggccaaggagaatgaagctgctgaggaatccccagaggagagcctccgcaaggagctggaggcaaaggaaaaggaaatcgtggatctgaaggtattaatcactctttgtggttggtggaacattcactgttgggatgaccgccagcccatgtttgcaggtgctgattttgtacataggacaagtacatgcgttccgttgcagacttcctcaacctgcaagaacgcaccaagcgtgacatggagaatgcccggaatttcgccattcagcggttcgccgtcgacttgctcgagagcattgacaacttcgaccgggctctccttgctgttcccgctgagaagctcaaggccgaagtga

SEQ ID NO: 16050 - DNA, 414 bp, A.fumigatus
tcaacacaactgtcccgcattccaaatctaaacatcatggactctgaatatgaggcttttatcactgcacagagccagagagactaccccgcacctgcaagcatgctctcagcaatcaagtcccttttggtggatccttccactccaccatccgcggcagctcgggcagcagtgttaggctacatccaggagtctaacccagaccccgactacacatcactatggcctctcctttttgcaactatcggtaaattcactgagcagaacgaccgcctggtggcctttgttgcagacctgcagagtctgacggaatgcaacggagcctttagtcgactggatgggctcagtgaatacatgacagaatttgtctttgactgtatgtcttctccaagatcaactctaaattcaaactaa

SEQ ID NO: 16051 - DNA, 495 bp, A.fumigatus
tggctttcaaaagatataaaggtgtctcgaaaaactgccaaagattgtgctcatcaacaggctgctacacgactccccagcaagatccaggcgtttgaagtcaatcgcaagaccttatcctataactccaagatgccatcgttctttcgttctctggctctctatgccctcttggctggtgctctggtggcccaggtcaccaatgcctacccccagcctgctctcgttcattcggaagatgcagccattcctcatgacactatcaccaccgaacccatctcaatggtgcgttccattgaggacgatggtgatctgtaccagcgttcgaagcctttgaaaattgccaaagaaccgactaaaagctacagctgtccagcgacaaataactatggaagcaacacatacacctctggacagctcaaagctgcttttgtcaaggcagcccaatacgccaatgatggcaagcagattggagacagttggtttgcagcctga

SEQ ID NO: 16052 - DNA, 1230 bp, A.fumigatus
gcgaaagacggggacattctgtatatctactaccgggcggaaggtatcggcatcacttttccttatatccgacattttccgatgatgactccccttgacaaaagcaaaaggagcacaccacaacaactccaaccagggagtccaccatgtcttccaaaaccaagacaaaagtggcttgtaaggtctgtaatcttcgtcgagtcaaatgtgatcgaaccgaggacagggcgtgcgtcaactgtcgagtggctggacaggaatgcgagccgatcatctcacgacgtggaaagtattgacgctgctgccacgctggttatgattcgagacactaatttttttggcagatacaagcgttccaatgttagaaaacatcgaagtggatcagctcgtcgagctcactctcaagatgggaaccactcaaccccaagcactcaacctccactaactcgagagagtgttggtccgcatcccatacagtatgagacggctggggaagaaaccggtgaatctgatcaagtgcactgcccaggtttcattcacatggttaacaacccagctcgcggcatggaggtggtgtactacggagattctttcaatctcaactacgtcctacgcgagatgggtaatccgttccaaggcgattttgacagctcctccttgaagcttcgcattgaggagttgtatttgaaccgcttaggtcagtcgaccaaggatcagctcgacgctcatgaatgcagccagcgtatccgcttagaagaaatgggcgcattccaacggctcgacaaagagataagcgacgcccttatccagacattcttcgctgtagtgtacccactctgccctatcttcgatctttcggagtttcacaccaagtacagggcagaacacttctccccgcttgtgttgcaagcgctgtactttgtcgccgcatcgcattgtgaacagtcattgatcgaaaaagcagggttccccaatcggcatatggctacctttacattctatcaaagagcaaaggcattgtacgatgcaaattatgaatcagatgcgattgctacagtccaggccttgtaccttctgtcctattggtggggtagtcctttggaacaaaaggatatgtggcactggacggggcttgctgttggccttgcacaaactctcggtttgcaccagaggtcagttgatatcgctattgccttgaactttgtattgactaactgtccaattcagtaa

SEQ ID NO: 16053 - DNA, 306 bp, A.fumigatus
tggcaagcagattggagacagttggtttgcagcctgattcttgaagacatcgttgctcactgctacttaggacactacccgcatacctttggtaacggcgaaaagcttcccttcccctgcggcagaagcaccatggaattccccttggatcgagaccacccgggcactgtatacagcggccagagcgtgaagaacttgccagatcgtattgtttttgaattcaaggatggcaagaaagaggcaaaggccaagttttgtggagtgatgcgccatggaaacaacggcgattttgtcaactgtccttaa

SEQ ID NO: 16054 - DNA, 507 bp, A.fumigatus
tcgactatctcggccgccggcggtgcgccctcgccggcctcagcctccagctcgccgcccacatctacatgggcgcgtacatgggcctgcagccggggtcgagcaccaaccgctccgcctccaacgccgccatcgcctctgtcttcatctacgccgtcggctggtccatcggcctctgcaccatcccctacctctatggcgcggagatcttccccacgcgcatccgcaacgtcagctacgcgatcagcatgtcgctgcactggttcttccagtttgctgtcgtccgcgtcactccgaacatgttcgtcgcgctcgatgtgtggggcgcctacgtcttttgggcgatcatttgcttctctgggctcgtcatcttgggcatctggatgcctgagacgaagggcgtgcccattgagcggatgggtgatctcttcgagggaccgtggtacttgcgctggcgagcgaagccaagacccatcagttccttttcaccttctccggctgggatga

SEQ ID NO: 16055 - DNA, 426 bp, A.fumigatus
ccatggatgttgtgtccatcggtaggttacgatgaaggtggctttagcgccagtgtcaacctgaaatcgtttgtgagcgatttccatctcgcagcttctgaatggacgaataacaagaccgagctggccaaccgcagagccaacatcacctcgttcaacgttttgggtgctgcgttgggcgccttgctcgcattggacttgaacgatcgtctgggccgcctgcgctcgtggcgattagcttgtctgatttgggcggccggtctcttcgttcagattttctcttctggtatatatggtctgattctcgcggcgagactttgcagtggactaggggcgggaattctcaccgttaccacgccgttgtacttatccgaaatcggtatgggttgcctgatttggactcaattggcggacactaaatgttga

SEQ ID NO: 16056 - DNA, 1095 bp, A.fumigatus
actgacattgtcaaaggtttcttcatcaattatgccgccagtctgcatatggccccaactcggactcagtaccgtctcgtgcagtccatcccactaatcccagttgggattgcgttctttgcgtccgtgattgcacccgaaacgcctcgctacttggtctccaagcaccggcatgatgaaggacgatccgtcctcgctcgtctgcgcggcagacaagtctccgacccagcgatcgaagacgaatttaaaagcatcgatgcgcaagtgcgcaccaaggcgatggacctggcgtccgtgacccactgggaagccttcaaagagacccaactcaaccccaactaccggcagcgattctggttgctgatcgccatgcaaaccatctcccagtggactggcggcaacggcatcacctactacgtcgccaccatcttccagtacgccggaatcgacggcaacgcgcgctcgctcgtctcctcaggcgcctatgggatcgtcaagctggtcttcaccatggccttcacctggggtctgatcgactatctcggccgccggcggtgcgccctcgccggcctcagcctccagctcgccgcccacatctacatgggcgcgtacatgggcctgcagccggggtcgagcaccaaccgctccgcctccaacgccgccatcgcctctgtcttcatctacgccgtcggctggtccatcggcctctgcaccatcccctacctctatggcgcggagatcttccccacgcgcatccgcaacgtcagctacgcgatcagcatgtcgctgcactggttcttccagtttgctgtcgtccgcgtcactccgaacatgttcgtcgcgctcgatgtgtggggcgcctacgtcttttgggcgatcatttgcttctctgggctcgtcatcttgggcatctggatgcctgagacgaagggcgtgcccattgagcggatgggtgatctcttcgagggaccgtggtacttgcgctggcgagcgaagccaagacccatcagttccttttcaccttctccggctgggatgaacgcgggcgatcctcctggtgagaagaggcccggctgggcaaatgcatctgtctga

SEQ ID NO: 16057 - DNA, 327 bp, A.fumigatus
accccggcagtggacgatacatcggaaatcgagatttggactcctcacggagttatcttcccagaaggcactcattatccgccgacgcaggctcattcgacgtcatgttttatgaggatgtgtggactggcggagattctcaacgagatcctcatccacatttacgaccctattcgacaggtgtccgaggccgagttccatgattgcgtccaggagcaggcgaggaacttgacagaatggtgggatgagctgccggactatctgaagctggtggtcacagagctacctccctactcgccaccaagccatatcgtgatcctgaagtga

SEQ ID NO: 16058 - DNA, 546 bp, A.fumigatus
cccacatcatccgatcgtcagaacaaaaaaaagtgcttacaatctccaggtgatatgaagatcaacggtccgtattattcggatacccttctcaatgcgattctctctcattcggtacgatggtgcaagtctgaacccaaaattggccccattctggaatccttcgatggcggcgctcaattctccgaccgcgcggtgacggggttgtatgattcattgagagtcggctatgctggcattcccaccattcagacgttgctcatactcagtgcacaagagtgcggccggggcaatcgaacccaagcatggctgtacagcggcatggcttttcgattgttggacgatctcggcatctccattgatagtcgcaagtatccggatgctgctcaattgagcgatgaagacatcgagattcgaaaccgactcttctggagctgttatttctgggacaagctggtgtcattgtactttggcaggtcgccaactatgcaaaactctcacgtcagcccgccgcgaactatatgtgagttgtctctcctggtctag

SEQ ID NO: 16059 - DNA, 516 bp, A.fumigatus
tttcctccagtcatcaccacagctctgggcctcatataccatgaactggagaagttccgaattgacatccacatcaccctcccaccatcgcagtccgaacatccatcctcagaacccgcctcgcaagcacactccccaactcacagtcaatcccccagccagcaccccggccagcccgctctacatttacgtagcggctcccgtcatgtctccccagccggccaagcgcccaccatgccaggctccctccccgcaccgcgcgtcacaaacgcgcccctgccgcaccagggctacgcattccagcgatctgtcggggatttcgaaccgtcgcagacgggcgtgccgcccctccctgctacgcatctactaggcggcatgcccaatgcggcgatgacgctggacaacccgggtccgtacgagattacgcccgaggtcttcgaagcgttctcgtacgcggagcctatcacggctaacatggcttctgcttttgagtcggcgtggggcaggccaggatga

SEQ ID NO: 16060 - DNA, 468 bp, A.fumigatus
gctgccggactatctgaagctggtggtcacagagctacctccctactcgccaccaagccatatcgtgatcctgaagtgagtttgtccccgctacgatttgatggcacaatttataacggcctcctccacagttgcttgtatcatacgatcaatatcctccttcatcgtccgatcctttgttccaagagaaaccgagagacgtacgatcaaagtcacctggtgcaatgcatgacctcggcgacagccatattgtcactatacgacctctactgtcaaacgtttggcgacgcgcatgtcgtgctctctctagcatactccgtgtacacggctgcatcgatcttcctgctggagattcaggcgctaaaatatgccgcgccgggtactcttaacaaactcaagttttgcatccttgcactcgagcgagtcaaggtttcaagtcctggtacggcagagcccttctcccgctga

SEQ ID NO: 16061 - DNA, 384 bp, A.fumigatus
caagcccatgctgatttcctccagtcatcaccacagctctgggcctcatataccatgaactggagaagttccgaattgacatccacatcaccctcccaccatcgcagtccgaacatccatcctcagaacccgcctcgcaagcacactccccaactcacagtcaatcccccagccagcaccccggccagcccgctctacatttacgtagcggctcccgtcatgtctccccagccggccaagcgcccaccatgccaggctccctccccgcaccgcgcgtcacaaacgcgcccctgccgcaccagggctacgcattccagcgatctgtcggggatttcgaaccgtcgcagacgggcgtgccgcccctccctgctacgcatctactag

SEQ ID NO: 16062 - DNA, 2730 bp, A.fumigatus
ttcggatctaatggcgattcccatcagcggatttccacacgaatgaccgagggacgagcaagcggcgagctggagggcagcacgctcgggagcagctcacgcgatggagacagggcccgacgcagccaacgaagaacagcgagttcgagctcctttcttgtcgattcatcatttttatccaagtcaaagagcatacggaccagctctcatcggccacggcttttggaatcgcatcgcaatgagaagcgtggtgctcccgagagcgatattgcaacaccgaagaagaggtcacggtttccctggagtcgcaatagagagtcagtggaagggtcgtcggtggaagggtcgtcggtgattgctggtccccaggaggctgcaggaacagaaacgtctggtccatcgtccgcacagcaacctccaacgtcggagccgctgccagctagggcggacaataatgaggctgtcccaggtttggatagggattcactccagattgttaatctggctctgaacttgagtgaatcccggaggagaaataatctcggtcgatccgtctcgactcgcctttcaggggctggggggtcggttccctatgccgatagtgcaacgttgactacgggcgccggtcgtggatatccaactcttcatacgcgtcgtgattatcctcatccggggatcagtcaccgggccacacccctgcctggtgaattagccgtgaatccagcatccgtactggatttactacctaatgctgctggagaagagaccttgcctcacgcattctcaacgagtacgcttgctcgggccgataaagctaggcgtcattttgagctatttcacctctatttgcgtctactcccttcgctcccgccactgagacatcatgggacgcaagatgccacagacgcctcatcagcgtcaaaggctagctttccccaggcgcgagactacaatcctctccaggcgattcgaaatcggaaagtccggttccgtgagcgacgcccaattgatccggagtcggaaggttggtatgacgttgctagggtgcgtgaatgggtgaactcagtccagtttcagtatggcgacagaagtcacctgccttctgaatgtctaaagctgccgccattcgaacgaggcgagaaggatccgccacgagaagaacccgatgatccagatctgtttgcagcgtctcctccttccagcttaaggcgagtcagccgcactagcagcaccaaagcggctcgcaggccaagatttgactgggcaatctctccggctgagcttctggctgatgctgcgtgggttgaagagggccagaataagagcaaaatggtggacaaggatgggaatcttttgtttccggacccagcacagttacatccttgtggtgaaatgccacctacatctgcccaggcgcatatgcaagccaagtcgccgtctgcgggcgcacgacacgcggattctgatacgtctttctccaatgcgcatcctgcattgggagccgaattcagaagcgtcaatcgtggaaggcgtcggcacagatatcatagtgctgcacatggtttccacagcagaggtacttcactgaccagcataggcaccaaggagcgcaaactgggattgcggtcaagtagctcttcgagtgtctccgccactggtgaaagacactcgtggtatcatcatgcggacaatgcaggtggatctgccgcatcaaaacttacccgagctcggagcgcgcgagtaaactcctctaccactgccccagatgaagaacatggcctcgatgcaggaccgctgccgtctcagacctcgactattcaaccaatgtgggccaaattggacgagcgaagcggctccttgtcatccgccgcaagtcgtcaggatccttcttctactggcactccgcctgttccccttggatacttccctagcattgcgtccaatttatctcctccttcaagtcgctcaccgtcgccatccaaacgacaagttgctcacggaattattgctcgccatgcgcgtagcaaaagccgctcacgcccccgggagatcctcgaggacaagttgatctccgcgacggatactgccgaaaatctccaacagtatattcctgatgccgcatatcgagctggcaaactcgaaccaagcccaattcccgatcatgtgtctccattgaaccaagctgacaagacacggacccacacgcatgtccgcaagggatcattccaaccggaatcgcggctgcgcggaatctttaaagggcccggaaaaattgcagagatcgtaggcaacgaggtctcaaaaatgggcgacctgataatgaagaaggacgatccagctcattcaaggacttcgtcgttggagacagctcttccctccgaggatagtgcattagacgagggcgaggaaacgaagggtgaaaagagatccgggcccaaagccctcctacgccgacttccgacattctcggatggaactcctcgcaagcattctgagcgtgtaagcgccaagggtcttttgcaatcgaccgcggctttggcgaccccatctcgacggatcgagcaagaagaacagtgcagagcttcggccctggatagtcctatgaagcagggtccagatgcttcgttccatgatgcacaggtgtcgcagacgaagaatctcgatgctccaatgctacagaagaatgcacaccttctggcggagaaaattggtgatggcccaaagaattga

SEQ ID NO: 16063 - DNA, 933 bp, A.fumigatus
agcagggtccagatgcttcgttccatgatgcacaggtgtcgcagacgaagaatctcgatgctccaatgctacagaagaatgcacaccttctggcggagaaaattggtgatggcccaaagaattgagcctgagttccaggcggtccggagccagatcgagaaaaggcagattaaagatccatcggttcctttcagcatgatccgtcctccggttacggggcttgcgcaggcagagatctcggctgcagatcgccttcaagacaagcttcgtggtgcatcaggtcagtcaaggacatggagcatctccaaccgcagcatctcgacttcggtggactccggaatcccggatcgaagggaaatcgagcgtacaagggcgcttcttctcacatcgggtatcaaagcacgggaaatcactcgccgggccgaatcgatacgcagtccaccgccagactttctacagaaagcctactccggctcccctgtgccccaggtcatccgcctctatgaattcgatgtggcggctaagggactgctccggcgattagagacatctcatgactcgtttcggcgaactatagaggattaccctagagcctcgggcgccttgagaacgcaattggcgcagctggaagacctggtcaaccagactcttgccccgcgcgttcgagccctggcagatgacgccgaaaatctcagtgtcgaactcaacaccacaagcacactggcagtaaagcacttgagcgacaaactcgacaagggcattcggaagcgccatcgacgattgcgctggcttcgccgtacaggctttgtcatgcttgaatgggcgcttgttgcgatgctgtggtgggtgtggttaatagtcatggccttcaaggtgcttcgctatatcttccgaggagcaattgcgggcctccggtgggttctgtggttgtga

SEQ ID NO: 16064 - DNA, 1773 bp, A.fumigatus
caatcgcgtatccttccagccccgtcgtgtagactgggacgaccggaaggattcaacatcatccgaaatggaaaaaaccagcagtggtatacggtcagggctcctctcttgcatgcattcctcttccagcgcatcgtcatcgatgaattcacttatgccggtaatgagcgactcgcgccacttctggcgctacgagctcgttcaaagtgggtgctctcaggtacaccaccgttgaacgactttgccgatgttaaaaccatcgcacccttcttgggaattcatttgggagttgatgacgagaatacatcattccagaaccatcgtctgaaggttctgcgcagaaaccgctcagacgcagaagtttttcagtcctggcgggctccgcacagcgaggcatggcatcgcaaccgtcatgaagttgctcaaagatttctaaatcagttcgcacgtcggaatattgcagacattgacgagatcccttgttcagagcaccttattctgattgatcagtccccggctgagtgtgcaatctacctggagctgtacatgcagctaatgacgcacaaaaagcagcttcgtcgaagcaggcgcggacgattcaaaaatgatcagaatgagcgactggacgaaatcatcagcagcagtatgtcaacagaagaagctctgctcaagcgctgctgctcagtgacgctgaaagagcgctgggaggagggaaagccagaagccgtcacctgcagttctttgattacaactcgggaggagcaactggctaatcttcgagccgaattttcgagcaagatgaaattggccatctggctctacttcacatgggatctgaaatatgaaaaatttcacaaattcgctgaaggcatcctcatgcatcattttggtgacgaggttgtgactactgcagcctttctgcttttcaagtctgctatgtgcgcatcgcatccgaacgactggaagcttttcttcaccgaaaagggatccaacccgaggaaagagaacagcccagaggaagccgaaactgggacgaccgtctcgcaggaaaatgcagggagccttgagggcgacaagatgacagaagaacgtgtggccggcaagggagcacagaaacgccaggcaaagaaaacgaagcgtgctgaggttaataaagaccaatgcagcgagcttccaatcaagccgacgatactcgatgacttcgaactgtgcatggatgaagttacatccatcttgcggaacatactatccgagtgggttcggcgtaaaagagctctgagatttcttagaaccgtgcggatgctccaaactaacagggaaacgcctgggtgccactgctgcagagaagaagtacagtcgcgcagcgacttaaatgtcgttggatcctgcggccatgcactgtgtaaggactgcactgagaagacggttcgatttgaagaatgcatcgtcgacaactgccgtggctcaggtaccaaattcaacatgatcagcgctgcatcgcttggtttcgaagaagaccgaagcactcagtatggaggaagaaagatggacaaattggtcgagatcgtcaaagagattccaaaccaggagcgggcgatccttttcatccagtttcctgaactcattgatgttgcgtccaaagcatttgatttggcaaaaatcactcacgcagtgataacggcgcgtgacaccaagaagattgaagaatttaaaaagggtaacgaaaaggttgcgatactgcagctgggtagcgagacggctgctggtttgtaa

SEQ ID NO: 16065 - DNA, 453 bp, A.fumigatus
cggcgcgtgacaccaagaagattgaagaatttaaaaagggtaacgaaaaggttgcgatactgcagctgggtagcgagacggctgctggtttgtaagtggccttcccctaccattctttctcttctttctcatccaattttttttcacagaaacctacagtgcacaaatcacgtcatcttcctctcgcccatgctagcagagacgcagtacgattatgattcctcgatgacacaggcaattggtcgcgctcttcgctacggtcagacgagacgcgttcacgtctaccacctgctcatgaagagaacaattgacgtcaacattcttcaggagcgacgtgggaagatcctggtcgagcggaatggtcaggctgttttggtaaaagccgatgaatgcctcgctgaagaagccttaagttgccaaggacctgccttggttgtggataacttcttgtga

SEQ ID NO: 16066 - DNA, 528 bp, A.fumigatus
cagatgagcttgaaagcagtcagtttggctagacaagcagccagcaagacgctctttcagtcagtccgctccgttcaacctctactgctcgtctcaacatccccgctttctacagcttgtcatcccaccactcttcccaccacccaaacagcagccagacccccattccgtccttataagagaacaatgtctacgacagtccccgaccgctacaagctcattttcttcgtgccacactcgcacctcgaacagtgcaaagaggccatcttcgctaccggggccggtaccttccccggaggcaagtacagcaagtgcgcgttccagacgcccgggcaaggacagtttctgccttctggggatgcgaatcctgccattggaacggttggacagttggaaactgtcgaggaaatgaaggtggagattatgtgtctgggacggtcgataatgctgcaggcggttgaggcgttgaagaaggcgcatccgtatgaagaggtggcatatgaggtttataagatggagaatgtttga

SEQ ID NO: 16067 - DNA, 393 bp, A.fumigatus
caccctgccacctatgtggctgccgtatcaccaaaaatcctccaaaccatccaggagcacctgggcatcactgccgggcacacaacagaagacggccttttcaccttcatcgaggttgagtgcctgggcgcctgtgtcaatgcccccatggtgcagattaacgacgactactacgaagatctcacgcccgagtccatcaaggcccttctcacagccctgaaggagtctgccacagccgcagagagcggcaaggaagttaaggtgcccgcgccaggccctctgagcggaagacactcctgcgagaacagtgccgggctcacgaacctgcaaaatcctgtgtgggaccccgagacgatgatgcggaaggacggtgccttggatcagcaggcttaa

SEQ ID NO: 16068 - DNA, 348 bp, A.fumigatus
ggaatcgcgaacttaatgagagggttggttcggaaagaaattatgctgaccgtctgtccgttgtcgaacgtgcgacttcggtgcgttcagtcggtggaacaagtgcccattcggaagttcctggacgccggggtcaagttctcgatcaatagcgatgatccggcttactttggaggctatattctcgataactactgcgctgttcaggaggcgtttcagctttccatcctggagtggagggtcattgctgagaatagtgtcaatgagagttggattgatgaagcgaggaaagctgagctactcaagcgcattgatgaccatgtacagaaacatactgtcgttgcttga

SEQ ID NO: 16069 - DNA, 297 bp, A.fumigatus
catcgcaacaagcctaacaacaacccctctatccctttcaagttctccgagcagaatatgaaactcgtcgatgagatcctcaaacgctaccctccccagtacaagaaaggtgccgttatgcccctcctggacttgggccagcgccagcacggctataccaacattagcgtcatgaacgaagtcgcccgtatccttgagatgcccccaatgcgagtttacgaaatcgctaccttctacaccatgtataaccgtgagccggttggaaagtactttgttcagctttgcaccacggtatga

SEQ ID NO: 16070 - DNA, 186 bp, A.fumigatus
ggagtcttttcggcctcggcgaggctgtcctcggatcaatcgccaaccaatccaacggccagccatccatggcccaagcctctagcggtcccagaatttggtgttactgccctttcaaccagtgtcggcgacactgaggtacaaatgaactcggccaagatcgagcgatccatcggtttccaatga

SEQ ID NO: 16071 - DNA, 357 bp, A.fumigatus
tcaatatttcacaggttcgtccaagactaccgggcagaaaaaacaattatgtcgctgcatcgactgtccgcacctgtatgtaaggtactgcgagatggccgcgtggtctccgtcccggcggagtctgtcctccttggcgacgttgttcacctcacagttggcgacatcgtttctgcggacctaagaatgatagacggcacaaatgtatcaatggatgaggccttggctacgggcgaatctttgcctgtgaacaagaccccggacatttgcctttctttccacaatatgccccatggggacggaaccaccatggcatattccggatgtagcatgaaccaaggacgggcaacttggaat

SEQ ID NO: 16072 - DNA, 189 bp, A.fumigatus
gttaacattttcggtcctgtccgtctgtatcacgtctctctgactcggctttccagaaatggcctgtcaagtgcggaagctgccactcgcttggagcgggatggcccgaacagggtgcaggagatcgagggcgtatcgacctggaaaatactgctgaggcaggtttccaatagtctaactatggtatga

SEQ ID NO: 16073 - DNA, 453 bp, A.fumigatus
gcgaaagtgggcatggctgactttgcctggactcaacagtatctgactcttcttcctgctcttctccatgcttcgcttctggctctaatctcagcttctgttcccctatcgatgacctttgctgcatgcatcctggcagtcacatcgtcgggagatattatccgccagccttctgttagccaagcggcagccgcgaaatctcttcacgttctggcattctccagcaagggccatctacttctgagcgaaagccagagaacattcgacttcgctacatgggaaaaagttcatcagcatgcctccgcaatctgtcgcggcacgttggccagcaacgccgatgacgatgtcagtatgggggaagagggaggtgaacaagggttggagaaatttatgcgggagactattgaggacaaagtctaccaggattatgcttggaagattgatgcggcgtga

SEQ ID NO: 16074 - DNA, 471 bp, A.fumigatus
tcacaaattcccccttccaaggcagtcggccctacacctccgctaattcattcgcgggctttatcatcgctcatggcttcctcttcttcaagccatggccccctgaaaccccagtccgacacccttccctctgaatgctcagctctcttgtcatcttcatcaccgccgctctcctcggcaaccccgctatcagatccaacttctccagactcttgtcccttgacgtccaccactgtcggtgtatcgctccttcgggattatgccagtcatatagatccttctcagtcgacaaatgatcttcatgtgaaccaatccacctccgggctgtccaacagtagggccaacgtgccgcagaagcttgagcttcaccagcaggaagcgccgcccgtcgcctcgttaccgacgtcccctttcctctcattccgcactgcgggccccttgggttcgcagcatcgcaagaacgcatcgtca

SEQ ID NO: 16075 - DNA, 234 bp, A.fumigatus
cataccttgccaaatatagaccgccccttgacccacatcaacaaaaaaggccgtccagtctctcaatgcgcccactgtcgcggcctacgcaagtcacggacaacccacaccaggtgcgagtgtggtgataagaagaagaatagccacaaaaatgatttagatcccaacgctgttgacaaacgggatctcaagcgtgagcatgttggcgatggcacattggttcagtatttctga

SEQ ID NO: 16076 - DNA, 1374 bp, A.fumigatus
gattttacagaggactcccgtccaaaatgtggctgcactcatggtcagcgctgtatctgcgcgctgaagaaggaaccccatctagatactgttccggaaactggcctgcctccgcatccgcctgcagcaccgtcggagcagccaaagaagccgcagttgacttcggccaagtcggaaagcacgctcactatcttccgcgatggtcaccacaagccggctcacaagcataatgacatggcacacaagtgtggtctgccctacacaatcccgcgctcacataccatccacactacgtccgatgttccgcgccgatcggttgaatttctgcctttgactgagcccacgtttctggagaaggcctttaccagcctagtgcagtcggaaacgcagtcgaacggttcgcaacagcgacttgtcaattctgaacatggatcgcccgatcatggtccagctgccgctacggaagatattaccacgacggtacctccgctcgacatgtcttccttcttcgctcaagctcagccgtctatgggccagtcttctggcggcgcagcggagtcaatatcgacgcccctgggtcagatccccttgaatccgcttgatcctgtcatgaccagcatgccgcctctcgatgtctcgttcccctcatttccgacaacgactgcgacaacgtcgacatccccagtgacctccctggcgctccaagatccctacaaggagcctttcttcgcatcgcccgacagcgacctgccgctgaactccgctgcctttagcgcgcctccggtcgattggtccaatttccctctgtattcctcagatgttcccactgcgaccagcacacaggctccttcctacgcgagcttcgactacaattcgatggcgcccggattcaccgccccgtcctcgtctggtgacatctccgaagctgaggattttgggccgctgtcgggtctgggaaatactagtggcgatctgcatgatatgcacagtgccagcgatggttcggatttcgatcatttccgtatcagctccgcctcctcgttcattggcctgccgcaagctcagctgttgtcttcaaacaaccttgaggcgatcgacatcgacgagttcctcaagtccgccaacgagtcgactgccgccttggaacatcagctacaggccagcatgggggtagaacctaagcccgtccctgcgcaaaacacctttgtccctttgactgatgcagacaccttcaagcctatgcctgattcgacgacgagcctgccgatgacgacgtctcctgcggagaccatgtggcctactgcgatgtttgattccagtgctccgtccatggatgacagtaatggcaacttctataccccgccctgggtataa

SEQ ID NO: 16077 - DNA, 255 bp, A.fumigatus
ggcgccatgtacctcttccccagcatcaccctgccccccaaggccgtcgaagccgccgctgccgaaggtcggaacgccgacgaattctactgtctgcgcctcctcgacgcaacgggtgtttgcgtggtccctggttccggctttggacagaaggagaacacgctccacttccgcacaaccttccttgcccccggcactgactgggtcgagcggatcgtcaagttccacgccgagttcatggccaagtataaatag

SEQ ID NO: 16078 - DNA, 423 bp, A.fumigatus
gtacactatcctatgaaccgaatatgctcccaatgtgaacttaagttgttgtacattgtactaacgggctgttcgacatcttatagtctccaaacagagttgatgcagctgatgatgtccccctcgcccggcatctctgcctttcccaacgcagacggcaaccttctcaactggacggccacgatcagcggacccaacgagacaccatacgagggattgaccttcaagctctccttcgccttccctaacaactatccttactcgcctcctacggttctctttaaaacacccatctaccacccaaatgtcgacttctctggccggatctgcttggatatcctcaaagacaagtggagtgccgtatataacgtgcagagtgttctactgagcctgcagagcttgctcggggagcccaacaagtag

SEQ ID NO: 16079 - DNA, 1638 bp, A.fumigatus
cgatctgccctttcggattgtctcgaaaacgatcggtcagggtgcctatgcctggtatgttctgatgctactaaatttagcttgttgggtttgtcaaattcaactaatgcgttgcccagtataaagaaagcctgtccgtcgaataccgataaccccatctttgccgtcaagttcatccataaagagtatgctgctcgacatggcaagatcagccctcgacaattgcaaatggaagcgacggtacataaacacatcggcgatcataaaaatataatttcgttctttcagaccggcgaggataacgtatggcgatggatcgcaatggaactggccgagggcggagatcttttcgacaagatcgaggccgacgagggcgtgggcgaggatatcgctcatgtgtacttctcgcagcttatcagtgctgtgggatacatgcattcaaaaggagtcagtcaccgggacatcaagcccgaaaacatgctcttaactgccgacggaaatctcaagatcgccgattttgggttagcgacgttgttcgagtacaaaggggtcaccaagctctcgacaactttttgcggcagtcctccgtacattgctccagaggtcatatcgtgtagcaaccgccgtcaggtcaagggagcgggttatcgcccagatttagtggatatctggtcgtgtgggattgtactcttcgttttactggcgggaaacacgccatgggacagtccgacagacagcagctacgagtttcatgaataccttgcgacaaacgcgcgaacgagtgatgaactctggcagaagctgcctgcggcaaccctttctctgctacgcggcatgctgaacgtcgaccctagtaacagattctctcttgaggatgtgcgacgccatccttggtttacccgacagaatcggtaccttgctctagatggcaagctcagagatcctatcaatctagcgacgactatgttcgaatcactgcatatcgatttcagccaggatccgctttctcgacctcacaggactagcagctttgacccggagcagatgaggtttgacgacggagatttaaatacggaacccagaatctcctccactcagccagaaatgccgagggccgagatgttggtagactgggatacacctcacacggcggatgtattttcgtccactcaacctacgggaaggccttcctccagcgacgacatgttactggcgagctatctagaagatgagccctccatgtcgcaattttcgcctcatccttccgtgccgctcagtagaacacaaaaggctcagcgcttccgtgacattgtacccgctcgccctatgactcgctttttctccacgtgggaacttaagattctggttcctcttgtgtgcgaagctctccaccgcttgggggttcctgttcctagtgtgcccgcggtttctccaggagacacatctgcaacgatccgagtcgtcactagagatggcagaatgtgcacattgcaggggaaagtagtcctcgaatgcgtttcagacgggctgtttgagattgagtttatgaaagtaaagggcgaccctctagaatggcgacgatttttcaagaaggtggctgtcctctgtaaggatgccgtctacatacccgataattga

SEQ ID NO: 16080 - DNA, 429 bp, A.fumigatus
attaatgtggacaatcgtgcaggggtatattcgtcatccaaagcggccgtcatgcagatctccgagacgctgaggttggaattggcccccctgggcgtcggcgttgtttgcctgatggtgggcaccgttagcacctcgtttcatgagaatgagccgcgggtggttttgcccgcgggctcgcgctatgcggccatcagggatgtcattgcgcagtgggcgacgggccagtcggggccgaaggggtgctcggttgaggagtttgcagagtcgattgtagatgatgtgttgggggccagcggcagcggcagcggggggttggtctggaagggaccaaatagtgctgctgttaggatcttgtcacgctggtgtcccgtctggctgttggtgagtcattgggttacgtttcctcggttgaatgtgtctcgctaa

SEQ ID NO: 16081 - DNA, 318 bp, A.fumigatus
ggtaatgataatcgctgtgaatattgtatgtatgtttgtatgattcattcacatgcttctggtaacactttcgacctgttctctcaactgttgcctcgagacggacagaccggcccgtcccctgcaaggcttcggttgccttcctgtccagttcagtccgtcaatttggcccctcgcgtcgtgttcgactttctccgatatttgatgatgtcaataagacagacaggattctcgatagattactccgaactgccaacggcaaccatcaagcaagtcgagcccgcgccctactttagttacggcgaatccccgacatga

SEQ ID NO: 16082 - DNA, 549 bp, A.fumigatus
atcgtccaatatacgactgcaatgcccacaaccaagtccatcctcataaccggctgctcggccaacagcatcggcgcagctctcgccctctccctcgccaaacgaggccaccatgtcttcgccaccgcccgctcccccgctaagatcccctccccactgaccaccctctccaatgtcaccctcctgcagctcgacgtgacatctccggcctcggtcgctgccgccgtccaggccgtgcaggatcacggccacgggctggacgtgctggtcaataacgcgggagcggggtataccgtccccctgctggatgcggacctggaacacgcgaagcgagtctacgagacgaatgtatggggtgtggtacggatgatacagggattcgcggacctgctggttgcccgtcgggggagggtagttaatctgagcagtgtgggggctgtagtgaatacgccttggattggtatctgctttcccctcttgtcaattttttttttttttcttctctctcatctccgtctgactgctgctttcggctggataatagattaa

SEQ ID NO: 16083 - DNA, 579 bp, A.fumigatus
gatgtcccgggaaccaggggttggtttgccaccaatgggaagaggtatgcatttcttcggcctgaaatcacaccgcggacagttactacgattggcaggcaattgtcggccgtgacgacacatgcttcgaccgtcgccatgctcaacgcgacgtatcgacaatggagagctagtttggcggccatcgaggacgtccctggcattgtgtggtccgtctcgctggagccgctcccaccggcgatctatgctcgggcttctacgacgaattgtctgggtctctcgcagacttctggcgccctggttgtcaccctcctcaatgctacgtgggaggatgaggcggatgatgcaaaggtggagcaggccgcgcgcgccctcgttgacagaatcgaagacgacgcgcgccagttggatgcctacgagccatacgtgtatctgaactacgccgccgcctggcaggacccgatcgcttcctatggaaaggcgagtgtcgagaagctgcagcgagtgagccaggccgtggatccaaagggggtcttcaagaaccagatgcctggtggtttcaaacttccttcccagtag

SEQ ID NO: 16084 - DNA, 207 bp, A.fumigatus
ctcaccaacagccagacgggacaccagcgtgacaagatcctaacagcagcactatttggtcccttccagaccaaccccccgctgccgctgccgctggcccccaacacatcatctacaatcgactctgcaaactcctcaaccgagcaccccttcggccccgactggcccgtcgcccactgcgcaatgacatccctgatggccgcatag

SEQ ID NO: 16085 - DNA, 540 bp, A.fumigatus
caagaggggaaagcagataccaatccaaggcgtattcactacagcccccacactgctcagattaactaccctcccccgacgggcaaccagcaggtccgcgaatccctgtatcatccgtaccacaccccatacattcgtctcgtagactcgcttcgcgtgttccaggtccgcatccagcagggggacggtataccccgctcccgcgttattgaccagcacgtccagcccgtggccgtgatcctgcacggcctggacggcggcagcgaccgaggccggagatgtcacgtcgagctgcaggagggtgacattggagagggtggtcagtggggaggggatcttagcgggggagcgggcggtggcgaagacatggtggcctcgtttggcgagggagagggcgagagctgcgccgatgctgttggccgagcagccggttatgaggatggacttggttgtgggcattgcagtcgtatattggacgatttagtcgcgatggtgtatctgtctgtctgtctgagattgagattgagattgacaatgtga

SEQ ID NO: 16086 - DNA, 192 bp, A.fumigatus
  unsure (63): Identity of nucleotide sequences at the above locations are unknown.
gctggcttacacgcagatgaagatcgcactctgggtatatgtggtgtccgaggtggtgagcanctgaatgcgaaaaacaagtgcgatgacgctggcgacgattcccctgcacctactcagtgtctcttcgcgtttctggtatcgggggggttcacgtacatcatggcggtcgaaaagatgatcaagagcttc

SEQ ID NO: 16087 - DNA, 510 bp, A.fumigatus
ctcagggggctactatggccttgggaaacatgtctgggtggtcgaaatggacaatgtgatcgtcgtgatgcaggtatggccaagcaaacccgtgcaattgatgagacggatggactgattattcaacagcttctgttagcatatgtcctcatctatgtcgttgctattcccttgatcaagctctctatcatcctgttctaccgccgcatctttggcatgaactgggtgatgtggatttgtgtactcttgaccgttggctactggttctcatgcactgttgcgttcctcgtttgttgccgaccattatcatattactggacacagtatcgggaccccggcgggggcaaatatatcttcaacctctacccattctacatcggcaacgcggcggccaacgtcgcaacagacggtataatcctgatggttcccatccctctggtctggaaactccagatgcgaacggcacagaaggtcctggtgtccagtatcttcctattgggaggattgtag

SEQ ID NO: 16088 - DNA, 216 bp, A.fumigatus
tctgaatcgtcccagaaccaccaccaggatctcaccgtactactaactctcttcgaattctctatcaaaggtcaaaaaatgttctctacaaacccagctgacgtatccgcccgcctaagccttgaaggcttgcgtctcgaacctgcagcgaagtactccctcctcccatatccaatcctccagcgttatttagccgacacttctcctgatccttga

SEQ ID NO: 16089 - DNA, 342 bp, A.fumigatus
tatcatttagatagctatgtcttcccatttgagccaaatcccaattggtccaagttctatgtcagcggaccagagatccaagactacatcgtcaagaccacggacaagtacggtctcagagacaagatcacattcaacacgaagcttctacaggcggcttgggacgaaggagacgggaagtggaaactcacgctggaacagggaggttcactcatcgaggacgtcgccgacatcgtagtggacggcagtggcatcctaaagtacgcaactatcacctctgggcgtcacgtaagagacttacttgggacagtcaatggaaatggcccgatgtcgagggattga

SEQ ID NO: 16090 - DNA, 276 bp, A.fumigatus
cgacatagggatccggactacgactggacaggaaagggaattgctgtcattggcaacggatcttctgctctgcagatcgtcccagaactccagccaaaagctgcaagaattgtcaactacatccgccgcgcgacctgggtgtcgacgaatctctgtggcaatctgaccaaagatggcatgggcacgaactttgaattcacaaaagaggacaagcagcgttttagagatgaccctgaggagtttctcaagtaccgcaaagtcgtcgaggcctcgtag

SEQ ID NO: 16091 - DNA, 474 bp, A.fumigatus
tatccccccagggtcaactctgttttccgactcatgctctccggctccgaagagaaccggttcctgttcaagctcgtcgacagcgttatgcgagcccggctgtccaaggacccagagctagccgacaagctcatcccaaagtatgaaattggatgccgccgtctcagccccggagacggctatctcgaagccctgcaggcagacaacgcggagattcgcttcgacagcatccaacgcattaccgagaccggtattcagacagacaaaggcatcgaggagtttgacctgatcgtctgcgctactggattcaacgcctctttcattcctgcctgggatctcgtcggccgagacggacgccgtctcgacgaggagtggaaggagaagcctgaggcatatttttccgtctgcgccgccggtatccccaactacttcatgtttgctggcccgaactgccctgactacggcatctactga

SEQ ID NO: 16092 - DNA, 312 bp, A.fumigatus
aaagtgacaactaccagcaaaatgccttcaaaggaatcattctcagcttcaaatggccacctccaggatggctggtctgttgacccaagtcaatttgcgtttacgcctcgaaagctccgggtggtttgcataggcgcgggtttctcggggttggtcctggcgtacaagctgaagcatgagagaccaatagactttgtggattatactatttacgagaagaatccagaggttggagggacgtggtacgagaatgtctatcccggggttggatggtttgtccttagctttctctacgttgggagtatccgctga

SEQ ID NO: 16093 - DNA, 204 bp, A.fumigatus
ctacggcatctactgacgtattccagatcggtcgtcgtcaaagactccgttgtcagtgactacaacatctacgcgcaggagaatcttaaacgcgccgtctggtccaagggctgccatgcctggtacagcaagaagaccacgggagagggcgtcacggtcacggcaatgtatccgggaagtgtcttgcactacaagggtgagtga

SEQ ID NO: 16094 - DNA, 297 bp, A.fumigatus
tctcagaaatactctgcaagtcactatcagcatgagcagcatgagcagcatgagcagcaggttctaaacaacctcagacgacctcgagatactcccctaaagccccctccgtccactcccacaacttctccgccaaagcatcatcgcctgccgccctatgcagcttccccagaacccccaccggctcataaaaccccccgttcaccaactcctctttccgcgccgtcgccgcccaaagctggttatacgcaccctcctccggcttcatcaactgaccaatattcgtcacatagataa

SEQ ID NO: 16095 - DNA, 207 bp, A.fumigatus
ttgaaaatggcaaacatcagaaacatccgccatccaatgttctcgatcgcgtgcggcgtcacttgcgacatcataaagttgaacagccactgcgacgccgcccccaccgtcactcccacctcgcgcgtgcgactcgagaagatttcccccacgtacagccatggcagtgggccccaggacatgttgaagctaaacgcctcggcatag

SEQ ID NO: 16096 - DNA, 915 bp, A.fumigatus
gacctgcatggactccctcagctggcaaaacaccctaacaatgtaccaggaacagccggcctcggggccgcgacggtactccatctagcgaaacacactcatccgcccgcacacatctacatcagcggacggaacgcccagcgcgccgacgacctcatcaaacaagtatcggcttccaactcggccacacgcctctcgttcgtcccctgcgacctggcatccctcgcctccgtcaacgaagcagcagaagcagtcctccggcgatcgtcccgactcgacatcctcatgtgcaacgcaggcatcatggcacagccgccgtcgctgaccaaagacggctacgaggtgcaattcgggaccaaccatctcggccacgccctgctgatccgacgctgtctgccgctcctgcagcgcaccgccgaggaatcttccgacgcacgcatcgtcatcctctcctcgttagccttccggggccacccctacggcgggattgtcttctcggacctcaaaaccgtccagcatttcaccgcctgcgccctcggcccctggatccgctacgggcagagcaagctcgccaatctcctgtacgcgcgagagctcgcccggcggtaccccgccatcacctgtgtgtccatccaccccggtgtggtgagcacggggctggtggagaaccagacccgggggaaccgggcgtttatctatgtgacgaatattggtcagttgatgaagccggaggagggtgcgtataaccagctttgggcggcgacggcgcggaaagaggagttggtgaacggggggttttatgagccggtgggggttctggggaagctgcatagggcggcaggcgatgatgctttggcggagaagttgtgggagtggacggagggggctttaggggagtatctcgaggtcgtctga

SEQ ID NO: 16097 - DNA, 270 bp, A.fumigatus
gttgacattgccgctttcatgcagcttgtgtcccagactacgagaaaggctacaggctacgagacactgcgcaagatgggcaaaagactgggcctgctgcgggccatttatctggtgtcggccagttgcatgggctcgtttgcttttgcgtttgacactggggtaatcagtgcgttgcaatccctagtccctatcagagaagaaaaaaaagaaaaaaaaaaagaaaaaagaaaaaaaaaaaaagaaaagaaaagaaaatcggccagctaa

SEQ ID NO: 16098 - DNA, 1341 bp, A.fumigatus
ccaacaggcggcgttctcacgctggaatccttccaaagggactttcgatatactcaagcgcagaaaaccaccgtcaactccaatgcagtgtcgattcttcaggccggcgcgtttttcggatgcttcttcaccaccccggtggcctcgcggctcggtcgccggacggggctgatcatcagctcgctggtgttcacgctcgggacgatcctgcaggtcatcaacacgcacacgctgggcaccttttacgccggccgcgtgattgccggggtggggatcggggccgcgacggtgctgatcccgatgtacgcggcggagatgtcgcccaaggaggtccgcgggcggctgggggcgtgtttccagtggttctttgcgtgcggcgtcatggtcgcgtactgggtgacgtacgcggtgtccaaggaccagccgtccgccaccaagcagtggcagatcgcgctggggctgcagctgctgccgtcgacgttgctgctggcgggcatgtgcacggtcaaggagagcgcgcggtggctagcggcccagggacggaccgacgccgcgtgggattcgctgcgatgggtgcgcggcggcgaggagacggccgatctgcggcaggagtttgacgagatcctcacgggcttgcaggaggaggcgcgcgtgcgggagaactggacgtggcgcgagctgctgctgcccgccaatcggtaccggatcttcatcgccgtcacgatccagctgtgtgcgcagctgacgggcaacacctcgctggcgtactatgcgacccagatcttcgcggcggtcggcgcgggcacgtcggccaagctggtgacgggattcttcggcgtggtcaaggtggtcggggtcagtgtcttccagctgttggtcatggatcggatcgggcgcagagtcccgttcatggtcggcgccggcgccatgggctcctttatgctcatcatcgcgtgtgtgctggcgacgcatccgacgaaagcgtcccccgggggtgcggagacgggagcgacgacgcacgcgggcatcgccatgatcatcatgacctatgccgaggcgtttagcttcaacatgtcctggggcccactgccatggctgtacgtgggggaaatcttctcgagtcgcacgcgcgaggtgggagtgacggtgggggcggcgtcgcagtggctgttcaactttatgatgtcgcaagtgacgccgcacgcgatcgagaacattggatggcggatgtttctgatgtttgccattttcaactattccattatcgggtattcatggttctttttgcgggaggtcagttttccctctgtccttgtcctcgttggtcactacgactcataa

SEQ ID NO: 16099 - DNA, 411 bp, A.fumigatus
ctgggcccctcattccactaccaggctgataagatatccttatattgcagtgccataacccaacttatacagcaggctttgctatcttcaagagtgtgggaacacggttgcaagatggtcgtttcccacaagaccgagaaatccggtccagcaaacgtcctcgcggctgacgatgccgtgccacaagcgcgaggacagcaaagggagctcccacagcagttctcggcgagctcagctctatcatttgcttatgttatcacaaactcctgggttggttattccggaaccttcccaactgcgttaatggctggtggagggcccgctgtgttctatggcgttatagtggcggggatcgtgtgctttataatcagtacgacttgcgttccaggattgtctgtagtaatacgctga

SEQ ID NO: 16100 - DNA, 198 bp, A.fumigatus
ttcgataatgctgtctcagccctgggtctcgccgagttggcatcggcgtttccgtccagcggaggacagtaccatttcacctatatggtttcgtcaccaaagactcgaacaccttgtgcgttcgtatgtggctggctgagctctcttgcctggtgtctggccacagtgtctggcaccatttttatcggtatgtcatga

SEQ ID NO: 16101 - DNA, 906 bp, A.fumigatus
gaattctctgagcaggctcgacttacgatgagaagctcaagcgattcttgcgctcgggtcgttcctaaacgaggactactatcccaggcagtggcagacatacctcgtctttctcgctctcataatcctggcaacggcaatggtttgtcttctcgctcactggttgccgcgattgcaggaggtcatgttctggagcagcatatctgcctttgtggcgtgtcttgccgcggttctcgggatgagcaaaagcaagcagtctgcgcgcgttgttttcacccagtaccagaacgagacgggatggcccgacggcttgtcgttcctcatcggactcgggacctgtatgtacatgttctctgctaccgacgcagcgacccatatcgccgaggcatgtctcatgacttcccaatggctgcacctcgaaaaaagactgactcttcgcaggaggtcccggagccaggccggaatatccccaaggtgatgtgcctaacgcccgtgattgggattgccaccacgttaccgtttgtggtggctaccttattcgcgacagtcgacctaggcgaggtcgtccggtccgaactgcctatcctgacgctgtaccatcaagcaacgggcagcaaagacgtcaccgccattttcaccatctggctgattttcaactactttggaggcacagtcaccgggctcgcggcatccggccgcatggcttgggcgtttgcccgggacaacgggctgccattttccggaacgttagccactgtgcatccgcgattccaaacgcccgtcgcctcgaccgttgcctgcgccgtgctgatggccctgtatggtctcatctacattgcatccagcacggcatacagcagcatcgtctcgatggtcttcaccacgggggtcgaaggatccgagcta

SEQ ID NO: 16102 - DNA, 498 bp, A.fumigatus
gtccgttcgagagcgttctacatcttgccgagcagcccgagctgtgcagaggacctctctgcgggtcgatcgagggcgttcttctttgtgttatccagttgggaacgtttatcgggtacgtggaaccggctcagaacagtagctagtactcacggcatcagttactacgaagactcaccgaatgagtacaccttcgactccgcaaacacctatctcacaggcctgggacttggcctgttggcgtcgacggctgtctctctctccccgacgctggcggaccttcccttggccggggcagaggtcgtgcgcgtggctttccgtcttggagtgctggttgccgatgtctctcagaatcttcaacccgctgatgcgacaggcgaacgagactcatgggcctacgtgattcccaatgtcgctcctaaggaagccgaagaggagctggctgttatccacacgcgcaaagtgagttccactggagtgttaccgtataccagctaa

SEQ ID NO: 16103 - DNA, 702 bp, A.fumigatus
tctcgtctaccttggcaggctcctcgatcgagctgtctcatgttctgctcactcactggcatggtgatcatactgggggcgttccggaccttctccggatgtatcccgacttgtccgattcgatctacaagcatacccctggcaagggcccagaagcctatctcagacggacagaccttccgtgtggaaggcgctactgtccgtgccgtacacacccccggccactcgcatgaccatatgtgtttcatcctcgaggaggaaaatgccatgttcaccggggacaacgtcctgggccatgggagcagcgcggtcgaggtgcttagtacctggatgtcttcattacggatgatgcagtcgcttcgctgtgcggtggggtatccggcccacggcgcagtgatacgcgacctgccaagcaagctggacctagagctcacgcagaaggcccgtcgggaggacagggtcgtcgagacgttgaagcagatgaagacagaggaccaacggaacggagcacgggggaaaggcagcgtcaccgtccagcaactggtgacggccatgcatggacatgatttggatgagcaggtgcggacaatggccttggagccgtttgtggacgaggttctgcggaagctggcgcaggatgaccgggtggcgtttgaggttagaggaggccagaaaaagtggtttgcaatcgaatacacctaa

SEQ ID NO: 16104 - DNA, 204 bp, A.fumigatus
tctgcagctcgcattttgagatacctgtgttcgatcggtattttcaagcaaaccgggccggatacctttgcaaacaataggatttcggcggcactggtgtcgaatgagcccttgcgcgcctacgttcagctggtgaatagtgagggcttcacggcctccgtcttcaccgacaggggctggaaggacacgcgttcacgcgccgag

SEQ ID NO: 16105 - DNA, 468 bp, A.fumigatus
cggacacgaataaaacaccacaagatggaacggcaaccaaagtctctctgcgacgcgacgcaacttcttgagactgccaacattatctctgacaccgtccagaccatcattgcggaatggtcggcggaggcgaaggcaccacaaggctctggcaagcaaaatgctccaatgcttcctagtcgggaactgtttgatgctcagcggaccatcctagccgcggctggcaagctgaccgagttggtgtcggatccgagcgcacggatcctggaagtagcaacgcagtttcaggaatcccgatcgttgtatatcgctgctgagcggcgcattccggacctccttgccgccggggatgagggcggcgtgcacatcgaccagatcagccagaaggctaaaatcgaaccccgaaagctgggtgagtctgcacctgagatgagggttacgagcaaggtctccctctcctggcgataa

SEQ ID NO: 16106 - DNA, 822 bp, A.fumigatus
gtttttgcgtacggacatgtctatatgctggccctccatcaaacccaacggggcgtgccgtgttcggaagtccatgatgctctcgggctacagggagctcggtcgatatactttggacgtccgactggtcggtcaattctctcagatccaattaggccgaggccgatgcccactgtaacagtgatcatttactctgacattcgcttcctattagaatttccctcggtatttctttgcgcatatgtccccccagtccagagaacagtaatcatggccaatgagaaacgaggaggatatcgacaaatcaaccaagcgctgaatatatgtgcctgggagggctatttgaatgagcagcacgcacggctgcccactcttgaggatgtcgaacaaatcagcccccgcgtgctgcgtgtcctgggtcagaatgaaggcgaggtacgcatagccgacggctactatacatgtagttcccggctgatcgaaggacctcagttcacgctccaaggaacaaacacttatatcgtgggcaccggccgtcaccgtctgctcatcgacacgggacaggggattcccgagtgggccagcctgatctcgtctaccttggcaggctcctcgatcgagctgtctcatgttctgctcactcactggcatggtgatcatactgggggcgttccggaccttctccggatgtatcccgacttgtccgattcgatctacaagcatacccctggcaagggcccagaagcctatctcagacggacagaccttccgtgtggaaggcgctactgtccgtgccgtacacacccccggccactcgcatga

SEQ ID NO: 16107 - DNA, 852 bp, A.fumigatus
  unsure (51): Identity of nucleotide sequences at the above locations are unknown.
ttccgtaattcagtggaaccatcaaaaggggaagccataaggagctctttnacgatcaacgggaaagcagcctctctcgcacagttcaaaaattcgctcagttcattcgccattcaaatcgacaacttgtgtcaattcttgccgcaagacagagtgagcgagtttgctgcgctgactcctgtggaattgctccattcaacgcagagggccgctgctgggccagagatgatcgagtggcatgagagtctgaagaagctccgagctgaacaaaagaagttgcagttagataaccagagtgacaaagatttactagcaaatcttgaaaacagacaggaaatgcagcgagtagacgttgagcggatgcggcaacgggcccaaattaagaggaaaatcgagatgttagagcatctccgaccagtcattcaatacagagaggcccgcaacgagctgaaccagaagaagaccgagcaaagaagactccgaaaagagctcgaggatttggaggctgaactagcacctgcactgagagcggtcaatgtgaagcaggactattgctcgaagttggatgaagtggtcaagtacaagaagcgatgcttcgaacaggcagaccgcgacgctatggagatcgtgaagaaaattgaacaatttgacgatgcgctgaaggatcttaataaccaaattgaggctgaaaaaaaaacaggccagagttacaggcagcaagcgaccaagatccagcagacgattaacaggctcaatcgcgagctcaatgaacaaccggccgagtttgatatcggctggtataatgagaggattgtgggtgcgcgcttcgagtgtgatcagaacgtatgctga

SEQ ID NO: 16108 - DNA, 924 bp, A.fumigatus
ctgtcttctcagaaagaaaagcgtctggcgaccagagagcttgaggcgaaagcgactgaaattcagcaagctcgactgccgcttgttgaagagctcaagtcgaagaacgaccagattagacgagcagagcaacagctgcagagtctcgcctcccaatctgggcagcaagaagccaagcttcgtaaggcatcacgagattcgtatcaagcttacaagtggttgcaagacaatcaggataagtttgagaaggaagttttcggaccgccaatcgtcacctgctcggtcaaagaccccaaatatgctgacgcggttgagtcattattacaaagaacggattttactgccttcaccacgcagactcgaaatgactttcggaccctgcaaagagccctgatcatagatttaaggcttcatgacattagtatcaggacttcaacaacacctctggaaagttttcgtccacccgtctcggacgaagagctaaggacgttggattttgacggttgggcgaaggactttctcagcggtcccgagcctgtgctcgccgttctatgtagcgaaaaccggttgcatcaaacccctataaacttgcagggcatctcggacgaaacattcgccacattggaaaatggttcgatcagttcctgggtagctgggaagcaaaactaccagattgtccggagacgggaatatggccccggtgcggtttctacccgtgtgagacaggttagaccggcgcagatctggacctcccaagcagtggatgttctagggaagcaagagatagagcgggaaattcttgccttgaaggacgaactaagtcgagtaaaagaaaagatggaatcagagcggagccgactccacaggatgggtgaagagaagaaggaactagatcgtgagagggtaagtcaacggcaatcctag

SEQ ID NO: 16109 - DNA, 195 bp, A.fumigatus
gagggtaagtcaacggcaatcctagaactctttactttggctcactctttccaccaggctacacttgaaaaggagaaagccgagaaacagacggcacttatcaactatagagctattcctgaaaagattcgtaagtcgtccaatctacctattctctcgtctgtcgatcgtcctcgtctcacgtcacgaaaatag

SEQ ID NO: 16110 - DNA, 1110 bp, A.fumigatus
caggacactcaggatgctgttgagaaccttcgcagactacaggaggaagctactcagcttagcatacgtcttattgagggcctttcggattgcacgacgttgagagagcgcagtcaacatcacaagatgaggctagaccagaagtcttccgaggtgaaagcggcgcatgaagatgttaaaactcgatctgaagctgtaaggaaaatggtcgatcaagcaaacagagcgatacggctcgtcaacgagcaagaggacttgcgtgaattcatgcccacactggttgagtatactttggagcagcttgaagcggacattgattcagaaagagcacatctagaacttgtgcaaggaggcaacgcaaatgtgattaaggagtttgaggaacgcgaaaagcagatcgataaattgcgagacaaagtttccgagttccagaatcaacttgcggagtatgaccatgccatcaacgaaattcgtggtaaatgggagcccaagttagaggaacttgtgaagagcatcagcgacgctttctcagactccttcgctcgcattggatgtgctggtcaagtcaccttggataaggcagaggacgaggaaggtcccaacggcgagccgggaggcagcaatttcgaccagtggtcaatccagatccaagtgaaatttcgagagaacgagaacttatccatacttgattcccatcgacagtcaggcggagagagagccgtcagcaccattttctacctgatggctctccagtcgctgtcggcctccccgttccgtgtcgttgatgagatcaaccaaggtatggacccacgaaacgaacgtatggttcatggtcgtctagtcgatatcgcttgcgctccagcgcgcaatggaggtggcggacaatacttcctcatcactcccaaacttttaagcgggttggtctataaaccaggtatgagagtcctctgcatttacagtggtgagcatatgcctgaggattactacttgctcaattttggcggagccatcaaacgcatgagggctttgaatgccgagaagaaaggcgaagcaagggctattgagggtgatgctcataggaacaacggcgatgttgatgtctacggataa

SEQ ID NO: 16111 - DNA, 471 bp, A.fumigatus
  unsure (362): Identity of nucleotide sequences at the above locations are unknown.
atccgctctcgagaagtcgcaacgggagcttacagatacaaagattgccctgacgcgagcctccgaaaaggcagtgaaggaaggagtagacaagacctctacggagacactaatcaagaacttgcggcgggagatcgaggaactgaaacaagaaaagtccgaagcagagaagaagatcgacacactagacaagaaactccaagcaatgggaaatctgcacaaagagtccgaaacccgccaccaggcccgtctccgcgagagcgaaaagaccgagagagaagcagcagttctacggaaacggctcgcaagcgtcgaaaacgagaacatacgattgaaagaagacctcgagcgcctcaaggaancgcgagtctggcggcacagatgacgacgccctcgacgaagctcgaaagacgaaggaaagatcgcgcccgggaacgtcccattccgcgaacctccgaaaggacacgttct

SEQ ID NO: 16112 - DNA, 339 bp, A.fumigatus
atcctagaactccatttgtctataggaaatacatatatctttatggtttggggatatgaagggtcggttaggcgtatgtatgagtggagactgagtactcgtagacgatcagtaagcggttgtggtccgtgcacatctggtggatcggggaaagttgtccgttccgtacacaaacacctagataagatcccctccaagtcctcccctaccacacgtcactgtgaatacctcgaacgatcacacaagatggcggacgaagaggagcgcataaaggccgagaagctggctgctgcgaaaaaaagagtaagcctggaaaaccgacatgcggacgacccttga

SEQ ID NO: 16113 - DNA, 777 bp, A.fumigatus
tacactttcgaacaggtagcgcagctccagaaacagaagaaaaaggccagcaagaaggccgctagcacagaagctccaaaggaagcggatacaccgaaagagaccgccgcccctaccgaaggagcccccgcagaagtccccgcagaggtgaagccagatgaaactgagtcaatagagaaggaagcgcaaaaggaagaggaacagcaagcggagctggagactgaatcaaaaccagaacttggagttgaaaccgcagctgagccagaaaagcgccctgagtcgccagtcgaacccatgcccgaggcgcctacctccccttctccagcgccggatgctgagccccagacgctggacgtcaaactagatacccctcgcgcgggccatactcggcaaccgtctctttcaatccagtccaagatgcgctcgtcgtcatttcgaaaaggctccgtctctcaaggaagtgcctcgacgtcaccatcgaatgccttgaagtcgccctctttgcctcctttgaccggtaacggtgattccgtgcacgaggtttatcggaaacagtcgatgcggattgaggagctggagaaggagaacaagcgactagagaagcagctggaagagtcgacgagccggtggcggaagacggaagagcagcttgaggatcttcgggaagcgagcgtcgatgcggcggagttgagagataagttggagaaatccgagcagaaagcggcggagatagacgaattggtgtggttttgtctatatccaagcaagcattgttaa

SEQ ID NO: 16114 - DNA, 660 bp, A.fumigatus
  unsure (637): Identity of nucleotide sequences at the above locations are unknown.
cctagccaacagaaggcagagatcgccgctctacagaggcagaactcgcaccttcaaaatcggtcgcaccgcaacaatgccagcatctccgtgccagttccgtcagagtcgcctcctgccgaccttgtacaacagcttgagtccaagtcggctaccatcgaggccatggaactagagatttctaatcttcgtgcgcagctctcggaacaatcctcatccagcagtgctcacgaggctcagatagctgctttggaagagagactctctcatagtgaatccgctctcgagaagtcgcaacgggagcttacagatacaaagattgccctgacgcgagcctccgaaaaggcagtgaaggaaggagtagacaagacctctacggagacactaatcaagaacttgcggcgggagatcgaggaactgaaacaagaaaagtccgaagcagagaagaagatcgacacactagacaagaaactccaagcaatgggaaatctgcacaaagagtccgaaacccgccaccaggcccgtctccgcgagagcgaaaagaccgagagagaagcagcagttctacggaaacggctcgcaagcgtcgaaaacgagaacatacgattgaaagaagacctcgagcgcctcaaggaancgcgagtctggcggcacagatga

SEQ ID NO: 16115 - DNA, 597 bp, A.fumigatus
gagacggagccttttcgaaatgacgacgagcgcatcttggactggattgaaagagacggttgccgagtatggcccgcgcgaggggtatctagtttgacgtccagcgtctggggctcagcatccggcgctggagaaggggaggtaggcgcctcgggcatgggttcgactggcgactcagggcgcttttctggctcagctgcggtttcaactccaagttctggttttgattcagtctccagctccgcttgctgttcctcttccttttgcgcttccttctctattgactcagtttcatctggcttcacctctgcggggacttctgcgggggctccttcggtaggggcggcggtctctttcggtgtatccgcttcctttggagcttctgtgctagcggccttcttgctggcctttttcttctgtttctggagctgcgctacctgttcgaaagtgtatcagccgtcagccagtttctctcaagggtcgtccgcatgtcggttttccaggcttactctttttttcgcagcagccagcttctcggcctttatgcgctcctcttcgtccgccatcttgtgtgatcgttcgaggtattcacagtga

SEQ ID NO: 16116 - DNA, 234 bp, A.fumigatus
acgttttgcttcatgtatatccattatcattattacttcattacttcagcctcatacaacgtaaaagaccacaagagtactgaaggagatctggaggtgacctgctataatgacaagctgtctacaaaggaagtggatggtgtccgagactcagtactgcgttcaactgaaggaatcctccgtttttccaaaaggctcttcagcatggctgtaacggttgaagcagctctttga

SEQ ID NO: 16117 - DNA, 390 bp, A.fumigatus
tctggtaagtacctcagtcaccgcaaatgtttccctagagaatgcattaatcagatacagtacacttttggatgtccccaactgggcaatcatgattttgctgagtttgtcactgctgtaacggcaggctctgggtacagagtcacacattcggatgatccagttccaagggtcttttctactcagccttggatcaacaagacttggcagtatagcacaacttctcctgagttttggattaccacaggaaatggcgtgccagtcacagccagtgatatacaagtcatcgagggcattgacaacaagagtgggaaccttggcaccactggttctgatacttcagctcatatttggtatattggcaacatgagcgggtgctcaactaactga

SEQ ID NO: 16118 - DNA, 510 bp, A.fumigatus
gcaccactaccaccatcatcatcttcttcctcttcttcagctctcttacactcctgtccactctctgcaattccaacactacaacaatccaaacaacccaacctctacgcactagtacacttttacattgcaagcagacgctcactatccctcacaatgccaaagcagcgcaagttccaaatccacgaggccagcagctacagaagcttccttctgattcgccccgacgaccccgacctcccggctctaaccatgctcagagaagtgctaaaggtcctgcaagccggccatggcaacttctccccccgccgggagtccttccctgacacccaggtaggcgatctaattttcgagatcatatccgaagataattctttcaagggactgaccgatgctgctgtgcagtgcatctcacagcaaatcgaaaactgggactacgatcaggacatgatccgatgggagcagtttgtcgagggaatggtgttgattgattataggtatctgcactag

SEQ ID NO: 16119 - DNA, 471 bp, A.fumigatus
actgaaaagctaacgccaagtatacatcatccgggtaacgtcactggcttcgtggcaattgacaacacaaatcaattgatcgttctgtcattccgcggtagccggaccctaggcaactatatcactgattcaaaataccagcaggtgcctgctatttgcccaggttgccaagtgcataaaggctattactgggcctggggaaacttttcagcatttataatgcaacctataaaccagcttgctgctatatatccaagctatcagattgtcttcactggccacagttttggaggtgcactagctacgcttggggcagcacttgagggaggaaatcctagcagacctattgatctggtaagtacctcagtcaccgcaaatgtttccctagagaatgcattaatcagatacagtacacttttggatgtccccaactgggcaatcatgattttgctgagtttgtcactgctgtaa

SEQ ID NO: 16120 - DNA, 222 bp, A.fumigatus
gcgggtgctcaactaactgagctcttttcttcccgtcaggaaaagaagatgatgtttctgtttccaagggtgtctattttgagtgcctttgaattgaattataaaaatgacacattatgctggaccgtttcgtccttgaagactttcagggttcagattagcaaacccaacaagatcaatgacaaactttgcaatatcgctcaacccacagcgtatgactag

SEQ ID NO: 16121 - DNA, 357 bp, A.fumigatus
tactgtcgcaccgggtcagatcgaacaagaactcatcagaaacaggagggcgacgaaaaggtcgaagaggaactgctcgacagaattaaaactctcaacagcgagttggacaagatggcgccgaatacacgtgcgatggagcgtctcgaaagcgttgaaaacaaactgcgaagcactgagaaggacttcgatgaagcacgcaaacgggctcgcaaggccaaagaagacttcgaggaggttatgcgaaaacgatcggatctcttcaacaaagcgttctctcacatctcggagcaaattggacccatctaccgtgagctgactcgcagtgccaattatccattgggagggcaggcgtaa

SEQ ID NO: 16122 - DNA, 2871 bp, A.fumigatus
gggtcccccttacgcttgtcctttgatcccggcggtgacgcactttcggaaagtcttgaatacggagctgactatgaacgtcttaaagcagaagccgaggaggcagccgagcagcagactatccagctcaaccgacggagaggtatcaattctgaaattaagcaataccaggagcagaagcgtgaagccgagaactatgctaggaaggcagaggaacgtgatcaggccgagatcacgcatattctctggaagcttttccatttccagcggttgattgacgcatccagcgcggatatccagaagtaccaagaggagctcaaggaatatcgtcgcggggtcgagaaatacgagaaaaatgtcgagagcgccaaggtagatcatgcgaaggtcggcagagatgtggccaaggcagagagaaatattatcaagaaggagaaagatatcgaagaagcgaccaatgccttggttcctgtggatgagaaggttgacatcaccaggaaaaaggtagagaggtttgcctctcggattgccgaaattggcaaggaacgtgattctcaggcggccaatgtgaaacaattggaaaaggacctcaaagtggtcgaaaaagctcaggcccaatgggaggctgaatggcataagacaatgagtaataagggtggtcaactgagcgaatctgaccagcaggagtacaaaatgctcaaagaagaagtcagcaagcgatcatctgcggagcaaatcaatctcgacaatctaaagcgccaaagaaagacggaagccgaggcctacaacagtttgaagagcaagtttgactcaacggagtggcaactcaagagcgtagaaaatgatacacagactttgacggagcgcaagtcagccttgaatgacacagtcaagaccacttctaaggagattgaccgcaagaagaaggaattgaacgcgctcacctctgagcgccttcgcatctcccagatgaggacagaacttgaggagaaagttcaggtcgtcttgaaaaagcttcttgaggctgatgatggcaagaagcaaacagagagggaactaagagccaaggagctgatctcgaccttgaagcgcatctttcctggtgtgaagggccgtgtcagtgacctttgcagacctaagcagaagaagtatgccgaagccgttagcaccgtgctcggccgtcacttcgatgccatcgtcgtcgataatgagaagaccgccaaggagtgcatccagcacctccgataccagagagccggccaggcaacctttatccctctggagaccatccaagtcaaggctttcaattctaatctgaaaggcatccaccgaggaatgcgcccagctattgaaacggtggactacgatgactccgttgcaagagccatcagctatgcctgtggaaacgccattgtttgtgatgatttggcgacagccaaatacctttgctatgaaagaaacgtagacgcaaaagccgtcacactcgatggaactgtaatccacaagggaggtttgatgactggtggtagaggccctcaacaaaattccaagagatgggaggactccgaggttgagaatcttcacaagctcaaggacaaactgatggccgacctcgccaatctgcccaagggccatcgtagaggcactgaagaggagactttgcaaggtgaattggtgggcctggagcagcgcctagcctacgcgcaagaggaactcaaggctctcgaaagaaacctcaagagcaagcgcacagaattggatttcgtgaagcgccaactcgaagacttgcgacccaaatacatggagcgccaggaagctctggaggaactcgaccagaccatcgcgcaatcgcaagagtctgtcagcaggattgaggacgaaatctaccgcaaattttgcaagcgtcttggttacgccaacattcgtgaatacgaggtacaacaaggctctctgcaagaggaggccgctcagaaaaagctcgagttcacaacgcagaagagtaggattgagaaccaactcagcttcgaaaggcaacgacttcaggcgacgaacgatagaattgccagtcttcaggcacagcatggacgggaccagagtctaatcaaggaactcaaagccgagcaagagcaaatccggaatcagctggacgaatacaatgctgagctggatgttcttagggaacgactgcaggaacagaaggaggcttatgcacaatcagcggagaacctcgcaaggcaacgcagagaacttcagagacgcagcaaggacgttgaaggtgtcctaaagaatattagcgctttggaggccgaaatccagcgtaactcctccagccgatatgctgttctaaggcgctgcaaactcgaggatatcaacatccctctcacggaaaattccaaatcgcttgaccaactgcctatcgatgacattgttcaaacagccgaccccgatgcaatggacgttgatgaggaggccaatgacggaagtggtatagtgcaagactatgggattgaagtcgattttgactcgctaggggagtctctcaaggaggttagtactgtcgcaccgggtcagatcgaacaagaactcatcagaaacaggagggcgacgaaaaggtcgaagaggaactgctcgacagaattaaaactctcaacagcgagttggacaagatggcgccgaatacacgtgcgatggagcgtctcgaaagcgttgaaaacaaactgcgaagcactgagaaggacttcgatgaagcacgcaaacgggctcgcaaggccaaagaagacttcgaggaggttatgcgaaaacgatcggatctcttcaacaaagcgttctctcacatctcggagcaaattggacccatctaccgtgagctga

SEQ ID NO: 16123 - DNA, 450 bp, A.fumigatus
ataatgaaccataggtacttggacattgaggactctgacgagccatacctagatggtatcaaatatcacgccatgcctcctctcaagcgtttccgggacatggagcatctatccggtggcgagaagactatggctgcgctggctttgctctttgctatccattcttaccagccatcccccttctttgtgctggacgaggttgacgctgcgcttgacaacaccaatgtggctcgcatcgccaactatatccacgaccatgcggcccctggcatgcagttcatcgtcatcagcttgaagactggactgttccagaacagtgaagcactggttggtatctaccgagaccaggtcgaaaacaccagtaaatccttgacacttgatgtaagtttgccttcattcttccagccgccatttcaagtgctgacctctcctgcagctccggaaatataa

SEQ ID NO: 16124 - DNA, 195 bp, A.fumigatus
ctgagcccctctacgcatactgctgcactgctgcactgctgcactgccactaccaagcatcaaaagctccccccgagtcccaacaagcagcttcaaaggcactgggaagctcttacctcccgcttcagcactgtgtctcgccataactatatcgtaggtagttgcagggggtatggccctcccaagctccgttga

SEQ ID NO: 16125 - DNA, 495 bp, A.fumigatus
ccccgcttttttcgaaaagctctctgcggggcagacccccgaatatctgtaagaaacacaaccgcgcgtccatcttcacatgctcaaaagaccaggtacatcggctgcagcgacagtcgcgtccccgccaacgagatcatgggtctcgaagccggggaggtcttcgtccaccggaacattgcgaacctggtccccaacacagacctcaacgtgatgtcggtcattaattacgcagtccgccacctgcaggtcaagcacattgtcgtctgcggccactaccactgcggcggtgtcaaagcggcgctgaccccttcggacctggggctcctcaatccctggctccggaatgtgcgcgatgtgtaccgtctgcatgagcaggagctggatgggattcaagatgcaactgcgagatatagacgcctcgtggagctgaatgttatcgagtcttgccgaaatgtaatcaagacggcggcggtgcagcaaaaactttcatga

SEQ ID NO: 16126 - DNA, 195 bp, A.fumigatus
ggtctggcgcaaaactggtgtaccatggtgggtagcgatggccacctttcttatggcagtacattgctgacccaccgttcatgcacagaccataatgttgctggtttccattacgacatgtacgagcgaaatgaggtacagaactgttcagcacttgcaacccaggctgatcggcttacggggcaaccagcgtga

SEQ ID NO: 16127 - DNA, 375 bp, A.fumigatus
gtgttgaagagggagctcggctgccgacgcccgcgagtaatgccattggctgcgagcttttcagccaggaaaagcagctgcatgcctcaggcagacatatcgggccccacgaaagaatgtcacacagcccatttctctcccgacccgaaaatactcgtggcgggatttctccaagatcatccggagaatcatttcatctcatccccgtccataatggagccctccgaccaaaaagtggacactgttccacagtatctcaaacagtctcatgagcgtatctttgagaacaatcgcgcctgggtcgcgacgaaaatgaaagatgaccccgcttttttcgaaaagctctctgcggggcagacccccgaatatctgtaa

SEQ ID NO: 16128 - DNA, 336 bp, A.fumigatus
gaaaggtggccatcgctacccaccatggtacaccagttttgcgccagacctcattccggaggaatggactcgaccgagcggctcattgatttggcgattcaaactcgcctgtttagtttgagcaattgtgacggttgggccattgctgatgagcccttttttgttgcggatctgggtcaggttatccgccagcatcgccgatggagggtaaacctgccagatgtgctccctttttatggtagtgcccccatccccctcccatcccaggttctggcatccctcgtcttgacgctaattgtcggcggctgcagcggtgaaatgcaaccccgatcctaa

SEQ ID NO: 16129 - DNA, 756 bp, A.fumigatus
gctagggttagatgtgtgtggggtgagtttccatgttggtacgttgcttccagcgccattgtttcccaacgtattcacgagctcttatcagggacgggggcctccaatgcatctgcctatgtgaccgccatccgggatgccaagattgtcttcggatatggcaagagcttagggtttgacatgaaccttctggacattggtggaggattccaggactctaacttggaggatattgcatgtgttctgagacctatactcaaagaagagtttcctggggtccgcttgcttgcggagccgggtcgttactatgttcgcagtgcctacacccttgcgtgcaaggttctgtccagacggcgtcacagtggtacagatcatcacgacaggcccgacatgctctaccagaacgacggggtatatgggaatttcatgaacgtactgattgagaaagaaacagtgcggccatccttggtcgcgtacacgtggccattccacagccgcggcaatgatactcggcggaaactcgaggagcatcgatacacgacctggggccccacttgcgacagcatggattgtgttgccaaggatgtgcccatgacctccgagatccgcataggcgattggctcaagtacaagaatatgggtggtgagtccttccatgccagactgtccggtatagaactgaagactctgactatcctgagaagcctacactatagcaacggcgactcagttcaatgggttttcaaaccagtatga

SEQ ID NO: 16130 - DNA, 498 bp, A.fumigatus
ttgtcggcggctgcagcggtgaaatgcaaccccgatcctaatctactcagacttctagcaaatctgggcactggctttgattgcgcgtcgatagaggagctacgcacagttctcagtctaggggtcgatccatgtcgcatcatcttcgccaacccctgcaaatctgtctcgtcattggtcttcgcggctcgaaccggtgtgacgcgaacaacctttgacaaccttgatgagctagataacatccgaacctttctgcccaatgcagaactggtcctgcgactttatgccagcgacagtgacgctctgataaacctgggggagaagttcggtgccacagttgaggcctcgttgcctctgttgcaacgagcacgtgagctagggttagatgtgtgtggggtgagtttccatgttggtacgttgcttccagcgccattgtttcccaacgtattcacgagctcttatcagggacgggggcctccaatgcatctgcctatgtga

SEQ ID NO: 16131 - DNA, 414 bp, A.fumigatus
aagtttttgctgcaccgccgccgtcttgattacatttcggcaagactcgataacattcagctccacgaggcgtctatatctcgcagttgcatcttgaatcccatccagctcctgctcatgcagacggtacacatcgcgcacattccggagccagggattgaggagccccaggtccgaaggggtcagcgccgctttgacaccgccgcagtggtagtggccgcagacgacaatgtgcttgacctgcaggtggcggactgcgtaattaatgaccgacatcacgttgaggtctgtgttggggaccaggttcgcaatgttccggtggacgaagacctccccggcttcgagacccatgatctcgttggcggggacgcgactgtcgctgcagccgatgtacctggtcttttgagcatgtga

SEQ ID NO: 16132 - DNA, 426 bp, A.fumigatus
gacaccactttccatgctaaccaaacgatgtttaggaaatggatcaccaacggcatgtttgctgactactttgtcaccggctgccggaccgaaaaggggttctctgtgctcctgattcctcgcggcgaaggtgtcgagaccaaacaaatcaagacctcttactccaccgcggctgccacggcatttgttcaattcgagaacgtcaaggtccccgtcgagaatttgttgggcgaagaacacaagggttttatcgtgatcatgagcaacttcaaccacgagcgcttcaccatggtctgcgccgtcattcgcatgtgcatgaccgtcaccgaagagtgcatgaagtggtgcaatcagcgcattgtcttcggaaagaagctcatcgagcagcctgtcatgcgtcaaaagtacgtttccctccaccgttga

SEQ ID NO: 16133 - DNA, 2850 bp, A.fumigatus
atttcttccctatcgaccctggctcccaaaatctatcctcgcagtcgttggttagcgcctccgccgacctcccagctcaggcgccaacccctctttcggtttctcccctcgatccttcgtccctcgaatcgagacagacagaccaggccagggcggcttcttcgattctttcgtctcctcatcggccctcacgccacccgccgcgctcagctgcgcctctggggtcttaggcacgaaacgatccccgctttccgccaccgagcacaagcaagggtctatcgcgccatcgttcagcagcaagctagaagggcacgtagacgaatctcgggcaagaagggtatacttgagcttctgcttcttgggcggaggggactgcccaggcgactgggtgctggctctgttggagggtcgcagcttgtcccgcgcctgaaaggtctgcgggtagcaggacaagccccggatgcagctgcaagatcctcgatgtcccagtacgagtcatccgcgtctacatcatggggcgccgggggtggcgggcggcgcaagaaggtgtacgagtatctgaaggcggctaatgagctacggcagacatacacggcgcaatgggcggcgcagaggaataaccaacgtgattacaatgaggattactacaatatcccctgtgcgttttccgatgtggaaatcacgcggtctggaaatgaggaaatggttctgttcccaagctatgcgaggagacttgtgaaggggaaacggccggaggttcaggcccgtcagcgccgcgattcgacttcgacgattgatgagtaccgcggtgtgtcggacgatccagggccagcgtccgaatggccacgatacgaggacgagcatgcagttgtggctgtcgatgtgcgaggctgggtctacgtacctcaccgcggcccgatgacccggaaacatcgcttgctgattgcgctggccaggaagttgagcggcatacctgctcctaacactacatcggctgatgatggcaacgcgactgtagcggttggaactcctacgaaaacgagcggggctagcgaggaggaaatggtggatcaagagatgcagtctatcatcaataacgcggagaagagcgcagatcctgtgtggaagggcagtgcttccgctgatcgcagttcaagtgctgcttttgagaaagccacgcaaatctcgcagttgagcaaagatgagctgacagttgcaaatgcacatctcatggagagactgcgcccctttcttacaaatcccagggcggcaatgcctgtgactgtcttcttctacaatgacgagcaaagccaatcaagaaacatcatgacagacgaatccggccacttcaatctccgtgcagcactgtcatttgtaccaactcacatccgcgtgttggcctcggaggaactgtccgctacaaaagagattcaaatcatcgagccaacaggtgtcagcttgattagtgacattgacgacactgtgaaacattctgccattacaaacggcgcgaaggaaatttttcggaacacatttgtccgcgaactggccgacctcacagtggatggtgtcactgattggtacaatgagttagccaagatgggtgtagagattcactacgtctctaacgcaccatggcaactttacccgttgttagaacgttatttcaaactggttggacttcctccagggtccttccacctgaagcagtacagcggcatgctgcagggaatttttgagcctactgcagaaagaaagagaggctctctggaacaaatcctgcgggattttcctgaacgcaagttcatcctggtcggcgatagtggagaggcagatctggaggtctatactgatatcgtcctggcaaatcctggcagaatcctgggcatcttcattcgtgatgtcaccacgtcagaccataaggacttttttgacaagtctgtcgatcatctagaaggcgtccctgctcgaagtcacagtacttctgtacttgtcgatgactcggattcgacagcaaagcggcctccattgccacctcgtccgccgcgcgaatccccagggccatctacagatgccgctagtattgacaatggtgacctgatcgatctacgggacgaagaaggggagaagaacgtatcggtaactacgcccaagcctgcaaacctccgtatgccgcccatgaagccgagcaaaccctcctctcttcgagccgtgacaacgaattcggagtcgacagaaaatggagcttcttctcaaactcaggatgtcatccggcgcaagcctgcccctccagtaccccctcgccgtcaaattgcaacaggtcaagaggaatcgtcgagctcccctagagcaccggcgcagagtacaagttacgctggcggcgtcccgaatgcagcccagtcggtcactaactccctcccagcggggacaaagcagttaccgatccgtcctaagatttctgacggcaatggcacggttgatcaaccatctgacgcgacaaggtcggcacgtcctaagcaagcccctccgcctccaccgccgcggcgtacaattacagggatttcgactgcgacttcggatagccccgttgaccggccagcatctcaaaaaatagtgtcatacccagcttcagccgctgctgccgcgtatcaattcgcttctgaacgtctcaatatgtctgcgtcgccagctacttcactgcgatcgagagcttcgaccccgtcgctgagtcgctccagcaccaattctgtgaacaatcaaccagactcgtcatctgttccacctcctccactgcctaataagagagaagactgtggcgacggcgttgggaacgggctaacgagctcctag

SEQ ID NO: 16134 - DNA, 675 bp, A.fumigatus
  unsure (37): Identity of nucleotide sequences at the above locations are unknown.
tccttattcctacacctaactccgaccatctcaatcntccataacccttcttccctcaccatgtccaagactttcacccgcgccgaggtcgcgaagcacaacaccgaggactccttttggtgcatcatcgaccaccgcgtttatgacctgactgacttcctggacgcccacccaggcggcagcgtcgtcttcgcccaagtcgccggccaagacgcgacaaccgatttttacaatctccaccgacaagaggtcatcgacaagtaccgcgaccagctctgcattggcaccatcgagggcgagactcccgagattgtctctcccgagccgggcagcctgagcaccgttccttatgccgagccgctctggctgcggccggagttcaagagcccctactacaaggaaagtcatcggcggttgcagcgggcgatgcgggagtttacggatcggtatgtgacgcctgaggcgcaggagaaggagagggatgggacgtatattagtcagaagttgattgataagatggccgaggagaatgtgttggctatgcggttggggcctgggaagcatttgcatggacggaagttgttgggcggtgtggtggatgggaaggagtttgattatctgcacgatatgattgttgcgcaggagatggttcggagtaacgcgagaggtgagtaa

SEQ ID NO: 16135 - DNA, 240 bp, A.fumigatus
cactttgcaggtttccaggatggaaacatggccgggatggtcatttcgttgacagctgtccagcagtggctgcgcaatgctcctctacgcgagaaggtcaccgaggaagttctgtcggggcgcaagaagatgtgcttggctatcaccgaggcatttgctggcagtgatgtggccggtctcaagacgacggcgaagaagacaccagatggaaagcactacattgtcaatggcactaagtag

SEQ ID NO: 16136 - DNA, 462 bp, A.fumigatus
agtggtgcaatcagcgcattgtcttcggaaagaagctcatcgagcagcctgtcatgcgtcaaaagtacgtttccctccaccgttgacagtcttccgaaatgtatgttgctaaccgttgatgctaggctcgctcgaatgatctctctctgcgaatccaaccaggcctggttggaatccatcgcttaccagatgtgcaatatgacctatgctcagcaagctgctcacctcggcggtcctatcggcctcctcaagtctcacgctacccgctgcgcgcaggagatcgcagaccacgccacgaatatctttggcggccgtgggataacccagagcggaatgggcaaggttatcgagatgttccatcggacatacaagttcgatgctatcctcggtggcacggaagagatcctggctgatctcggcgtgaggcaggccatgaagaaattccccaaggcggtgctgtag

SEQ ID NO: 16137 - DNA, 486 bp, A.fumigatus
ggagtaagtttgcccttgtccgagccagaacgagctgggtggattgatgtcgtcagagtgaccaactaccccaatctcaactttaccatcatcatcaatcccagcagtggtccaggaaacggctcgcagccgagcccgcagtatgcacaccagatccagcggctgaatgcgtacccaaatgtgcggacggtcggatacgtgcgcacagggtatgccagccggaatctgaccaccgtgctgcaagaggtgggcatctactccggctgggccgcggtatcgcccagtcttgccatgcacgggatctttttcgacgaggtgcccagcgagtacacgacatccgcggctgaatacctggctacgatcaatgcagcggccaagaacgcctctgggctgaggacagaccgaacggtgagcaacctgtctctgttttttcgtacttgtgtttcagtacgctgtccaaagcctcgaaagtgttctggtgtctga

SEQ ID NO: 16138 - DNA, 1206 bp, A.fumigatus
cagatacgaagactgaccgacgtgcaggttaccgcagtctcagctgaacatgctgcccgcttcgaaggcctaaggaccttcgtaccggacatccttgagaaaatggcagtcgtgcctcccgcacatcgatcactggttgacacgcgcgcgattcacatctatgccgttgactggccatcgaaaatggactacgcgcacatgaatcccttctccgtctcccccgacggtgtcgactacactggtctaggctgttttcaaatgggtcatgactgctctgagaaagacatcagtgacctcctcgaggcgcaacgcagcattcgagacctagatcttctcgaccggatccaggtagaggagctgcgccgtatggcggcggacctgcgtgctctcctgagatcgcagaaggcttccatccgtgcaggtgccatgtcggccacgatccaagaattgattgatctgctttcttctggcaacggtgcggaaaatgacagacttcggatctgggtcggtttacactctggattccgcacgcgcagtgagacccaggtctggggcatgtacgaggctgatgcccttacgggctcgttggatatcttcatatccggaaagacggtcgatcggacaggcaccatcttgcacacgttcctatcgcgtcgcaatttcagccggtatgagtgcttcaaggcggaaattgccctcgctgatgccaggaacactctgtctcccaaatgggacctccctccgcggctggtgaacgacatcgaagacctcagtcccgcagaggccttgctttggatgcagcggctgacattgtcgacctgcaaagaatcgtccgctttagtagccaaagtccgcacctgctgtgaatatcagctactggaggtcccaactctaagccagttgcgatctatggcatcgacgggttatcttagcggggaagtgtcggccaagcagcttgttgaaggacgtctggcctggtatcagagccagggttgcgcatccctcgaacccagaagtgctctggcgctgtttcaagagattgacgctcgtcttcctggggtcctcatcaaggcagacagcacgagtctggcaaagataaccgaggttatggaggccattctgcgacccggccagattgatatcagggcagactttctggccctgtccgtcttgtctcaccgcggtctaaagagcgtgctaagaaaa

SEQ ID NO: 16139 - DNA, 990 bp, A.fumigatus
gggagacgccaattatcaaccgcccccgcggccgtcactcgttatcttgaccgcttgaagagggaaacgaaacctctccgctcgcggagctctgcaaagttagaactgaagacattcggcgtctaccttgggtcgatacccagccctcccagctccgagcaactgtccatcctgtcgcaatgggacgttgtcgtggtcgaccctcttcaacatggcgtgctgagcggcatatacaattattgttccgccgcccacgtccttggtcggctgcatgttccaagtttggtaaacatcgagacaagcatcacaattgatgaagtgattcaaggcttgtgtgtcgttgcccaaacagtcatctcgaacttcacccatccgcaagcaagggagtcgccatttcacggagtcctcctcgcagactggcggaagcatttccaaccagttgtcctcaaccaattggtccaatacctcaatggcattggcctggacgtatggctggagatgtccccgcctgactatctcagcgaacgtgaatgccgcgacatcgatggaagccgcattctcggcattgtctaccgcaacggcacaatattccccaacggcaaccagcgcgactactttcagatggaaaagatgcggacggtcatgcgagttgtcgctgcccaaaagaccatgggaggctgcactcacgccatgtgggagacagtcgaggatgacgtggacgtctctcaccatgtcctcggacggaccttcaagtggtgcgcttacaacagcgccatgacctggatcggtccctggtccgctctgacagacgccaacgttgccgctcgtcggacagtaaagaatgagcccctaggggcgttgatgtggttgaaggaggatgttgtactcaagactcacgacaactggcgcttcaatgacagggtcagtatccactccactgtagcagatacgaagactgaccgacgtgcaggttaccgcagtctcagctga

SEQ ID NO: 16140 - DNA, 201 bp, A.fumigatus
tttgagagctgcgatggaagtcagtcccctgaaaatgtctcttttaaaatcgttcagcgtaccatcctctgtgccctcactgattatcttgtcttccttttcgacatgcttgatctccgtcaaatcacttactcggcggagatccgcagcaattccgcggatggcaaagaagagagacacgccttattagttagcttttga

SEQ ID NO: 16141 - DNA, 1914 bp, A.fumigatus
cagagacgccaaacacttcttcgggaaatggagaggaagaacaagatcggtggtatcgttgatcgccgtttcggtgaagacgatccgaccatgacacccgaggaaagagccgccgcacggtttgccagagaaagtcagaagaaactgcgcaaggagtcgatgttcaatctggaagacgacgatgaagacgatttccaactcacgcataaaggccagacgttaaccctcggcgatgatgtccctcaagacgattttgaagaggatctgcgtggattggaggaggatcaatcagactcagaagtgccgcggaaaaggaagagaattcttgataatgacgagctggaagattttgtctttgatgatgaggatggagaggatcaaccggagaggaaaaaatcgaaacacgaagtcatgaaggaagtcattgccaagtcgaagttctacaagctagaacggcaaaaggcgaaagaggaagacgacgagcttcgcgaggagctcgataaaggcctccccgacctcttcgacatgttgcgcggtgtgaagccgccaccaaaaccggagcctgcaaaggacgatctggagtcgatgaacccagaccgtgcagcgttgctgaaagggactgcggataatgaccccaataaagagtatgatcaacggttgaaaaaattgacgttcgacaagcgttctcagccaacagaccgtaccaagacggctgaagagaaagccgaagaggaagcgcaacgactcaagacccttgaggaagagcgtcttagaagaatgcgtggtgaacaggagagcgacgaagaggaggatgatgaagaaggagaaagcgaaacgggaggcgaggactctaacgatgagtccatcccagacgatgcggaggcatttggtctgaagcagccttctcctcagacaaataaaggccccgagatgggcgttgaagacgaggacgactttatcattgacgacgatcttgttgaaacgaggtcaaatgtgagtctctcattcgacgaaagcgacggcgaagagggatcgtctgaagaaaaatcggaggaggaagacgaggaagaagatgaacttatcaatgggcttacacttcctaccagcaaatctggggagtccacagtagcagctgatggtgccggaaagagaagtgaagggttggcctacacctacccatgtcccgaagatcatgaatcattccttgaagttatcaaggatgttcccatgaacgacctgcctactgttatccagcgtattcgagccctgcaccacccacgactgcacgccgacaacaagacgaagttagggcgcttcgctgccgtccttgtccgtcatgttgcctatatggctgagcaacccgaacatcctcctttcaacgttctcgaggcgatcctacgtcacattcactctctggccaagtcccacccggaaagcgtatgtatggcttacagaaattatctccgtgagattgcgacggaccatcccctcagcctgcgcgctggagatcttgtcattttgacaggcattgcaaccacctttccaacttcggatcatttccacgcaattgctactcctgcctatttatgtctcgctcggtatctgggtcaaggagctatcaattcgctcggagactacgcaacaggtgcctatgccgccagcctctgtctccagtaccagaccatttcgaagcggtacatgcccgagttcatcaactacgtgctcaatgccctctgcaatctctgtccgacagaaccaaccagcagccttggattcttcccggcaaggggatctcaagaatcgctgcgactgatcccctctaaacagctcaaccctcgaaagctccgattctgggatatcgccaccgcgcagtccgatcgcaggggcctgcacaaaccgaatagagatacgcgt

SEQ ID NO: 16142 - DNA, 462 bp, A.fumigatus
ttcggtcatctcaaaagcggtgcggcagaatttccccccggcgagagcggtgagcctacttttttgcggacaatcattgaaaaatgcatcgtcttaaaaatttcggtggagcactggacgactttacttcaacaccaacacatcaccatgccgccttcgcagttaaaacagctgaaggcgtcgcttcgcgagagtggtgttttagcgccgcagcagtccaagaagcaaaaacgccagaatgcgaaggctggcgtcagcgctcaaaatcgtgcgcaacggaatgctgctctgcaagcaattcgagatcgatttaatccgttcgagatcaaagtgacgtcccggaacaagttcgatgtgactactagagatgggggctctaagccggccgccggtctctcaaaggccggagtgacgaagtcacttggagaagaaaaggttggttggatgtcgttcaaaaggtag

SEQ ID NO: 16143 - DNA, 354 bp, A.fumigatus
gtcagcgccacccaccaagtctccaccctgacatcaagcccaaataagtgccacccaaccgacggagccacggactccaagcaaaagcgacaaccatcagaacctaacaaccacgaccacgaaaccggaaataaggccacacaaaaaaagaccatggtctgcgcaaagtgccaaaagaaactcaagtccacggaactggtcactccaggcgtcaaacgcaagagtgaaatgtactatggctcgccggcaacgaccctaggcggtggtggcggagctggacctggccctgctacgaaatcgaaaccgacgttggggaataccggtattggaaaggtatgctctatctctttctga

SEQ ID NO: 16144 - DNA, 1257 bp, A.fumigatus
tcattgtaccagacacgcgaagagtacctgaacatcccgccgccaacccgccttggtgtttctcagtcatccaagtctctaccctcggccttgaaccggtttcagaaaaggcttgttcaccagctgatagaggtggaatatccttcattggtggcaatcagcagacccgacttcatccaaatcatcgactacaatgaggaacgtgagagatctgtccgcgagcaaagagtgaagaaaattcaggagcgcacctggaaacaaacaggctttaggtgggtagctgaggctttagccggaggagatcttaccaatctgcattccggctacttcattggtatcatggcgagctccgctgctgtagaaccaaaataccctctgaacgagttttcagacaaactcaagcagcgattgaaagagcataggcctgttcttgttggccataacattttctcagatcttatctacttttgccgttgcttctttgggcctcttccaagcaaagtggaagagttccagtcaatggcgcacgaattgtttccggttttgatggacaccaaatacatggccacacacaactgtggttccatcaatcccaggtcgtcactctcagagcttaacgaaaacttggcgaagaaagcaattccgaaaatcagtgcgcatgacttccttgatcgtcagtttgaattgatggctaagaagacaacaggcatacacccgcaacattccaagtatactactcagaaaattgaccatgaagcaggctacgatagcttgctaaccgcccaagtttttatcaggctgtctgctcagctccgcgagggaggggtagaaccactgcaacagaagtccactaaagatgctcaagacacatcgtatctccagcaaacgtatcgagaggttgcacccgatgcctatgctgagggcagattgcaaccaacatctggaagcgcacagaaagcttttgagcagaagccaagaccaatcagtacagaatctcccaaaccgccaatgagcagagtcctcgaaaccagatttgatttactagaaattgaggaggccatagatgaagtcgacagtaatatacctattaatgaccgtagattgtcattgggtcctaccgattctgtggaggtcatgcagaaggctgtcaatggcgagctcatccctcgcctgggagcggagttctggaaagtatacgggaacaagttgcgagtctttggcacattggaaagagtttgcgtgatgggagcgccgtga

SEQ ID NO: 16145 - DNA, 315 bp, A.fumigatus
tcgcctgcacaggccgctgaacgtaccctggaacaatctgctggtgtgaacatgaacacctggatggttggctatcaccctgttggccaccacgtctacaacttccgacaccccaagaccgaccccgcaactggccaacaatggctcggcgagaagacattcttcataaagggtcgtatcatggctggacaggctgacctgtccgccaacgtacagggtctgcaggacttcaagtggctggctaaggaggagattgccaaattcgtgctcccccagtactacagcaacatcaagaacatgctggctgagcggtaa

SEQ ID NO: 16146 - DNA, 729 bp, A.fumigatus
cttttccgtactttgattaggtcgttttctgacttctattcagggccttcaatagtcgactctcgtgtctgcagaagctgtcaagagacactcgttcgccgcaattatgcctccacggctgcgcctagttcagcttcagaaaccgtttcaactcctgcctcaacatttcccgtcgtcaaacctacacacatcatcaaggccggcgtggccctatcgcgtcctccgcaaatcacccgtgatctcacaccattcgaaaaggcgtactttttttaccagaaacggctgaacgagcgactggcactcccatttacaaaatatttctatttcaagcgaggtactccagctgacgaggactggaagcgtaagattcgggagcgtcagacgccggcacgcgacatcggcaaatataacgcgtactcgaaggaagcatggaatgacgaattgctcgtgggagccgttgagtccgaaccagagcatcagattgagatgcttgtgcgggatgcagagagtactgccaatgccacttctcaagatacgagcaagaaggaggagattcccagacccttcccccgagtgacggaggcggaccagaagaatgaccagaggagcctgaaccgggctctgcagagaaccctctatcttcttgtccagaccaaggagggatactggaaactccctagttcgccggtcgagacaggggagtcccttcgcgtggtgagtagtgattga

SEQ ID NO: 16147 - DNA, 1284 bp, A.fumigatus
ctgtggaggaaatgcaagttgcctgcgccgcataccaacttcctagccgccaaggcagattctgtgggagaggagcaacactacttaccagggcgggtggacgagacccagaggctcacacggtcactggatggcccctttgtatcccaatgttttagctcgctctcgccctgcgttccgatcacaagcctgcatcctcgcaataatcttacaaaagggggcaatcggtacttgataggctgttattgttttcatcttgcatcctcgactccccaatggcaccactatctcttgagcaggcgcaggcgattgtggacgatatccaggagacaaacggcggcttgcctcccgaggaaaagcaagcgctgtcgcagaggtcattgcgagcttacaagaatctgcagactattgctggcagatcgattgtacatgtggccgaagacctgtacgacacggacacgcggttcctcttcgagctcattcagaacgcggaagataattggctatggccatgctgttagccaagcggaggagccatttctcgatctcactctacatgaagatcatctaactgtggactcaaacgaggacggatttactgagaatgatgtgcgggctatatgcagcattcaccagagttcaaagaaacagactggcggctatatcggccacaaagggattgggttcaaatctgtattcaaggttgcatacaaagtatctatccagtcaggacccttttccttctactttgagcaccaccagggggatagtgggttaggcatgatcactccgttcaacgaggagcctcaggagctaccccctagtgtgaacactcgaataaccctcttttttataagcataagcgacttcgaggctcgtgcttcagagctgagggagatcccggacaccatgctgctctttctccgtaagctgcagaggctcactgtgaatatcccctccctgcagtcgcagatatctttcacacgctttgaggacaaatcaaagcacttaatcacactcaccaaagagacgaatggagaacaggtgacaaaattctaccatctcgaaaagaccaccctgtccaatctcccacaacatctcagtcgccctgggcaacccgaggttgacctaatcctggcgttcccagtgcaggaagactacagtcctctcatccaggcccagtatgtgtattccttcctcccgatgcgtgatgaggggttcaatgtgagtaattttctcttgttgaggactttgatcgaatacactccgctaatatctgtgtag

SEQ ID NO: 16148 - DNA, 426 bp, A.fumigatus
tttctcatccaatcggactttatcacacaagccagtcgacaaggagtccatcgttgcgatagaaactatgctattcgcgagggtattagccatttgtttctccaagctgtcgcctatttctgtaagcatacgtcgcttagatacgaatggctacagtatcttccggggacgcacattcgcgatcccttctgggccgatcttcgagagatgatcttcgactgcctaaagggatccaagattctatattcccgcagaggaatcttgaaatccccaacccagcttgaacacctgtcatcacagcactgcgatcgccatggccaccctctaatggacgatatcgagcccgaggtttacctggcgcagtcctacgactggaacagacatgctgagaatttgatggaacttggtgtgaagaacctgtcgtaa

SEQ ID NO: 16149 - DNA, 315 bp, A.fumigatus
tcttacaaaagggggcaatcggtacttgataggctgttattgttttcatcttgcatcctcgactccccaatggcaccactatctcttgagcaggcgcaggcgattgtggacgatatccaggagacaaacggcggcttgcctcccgaggaaaagcaagcgctgtcgcagaggtcattgcgagcttacaagaatctgcagactattgctggcagatcgattgtacatgtggccgaagacctgtacgacacggacacgcggttcctcttcgagctcattcagaacgcggaagataattggctatggccatgctgttag

SEQ ID NO: 16150 - DNA, 183 bp, A.fumigatus
tggatgaccatatccttctcgggtttagggacttcctccaagtctgcaaaggaaatgaaacagttttttttggcccacgaccgtatactctctgtcaaattggacagctcatccctaattgactggtcctcctttggaatgtatccattgtttgctaccatcgacgtcttcaccggggaatgc

SEQ ID NO: 16151 - DNA, 1104 bp, A.fumigatus
aacactcggaatagatttgcagtcatggccgacgagcagaaggttacccctgcggccaccaacgccaatgctgaggccgagaaggatgttcagaacgttttggcggagctaaagggcgaagccggggaagctcccaagccttccgagcagcccactgaagacaagaagggggaagctccgaccgaagatgcagaggaggctcgcattgtagccgccgctgcgaagctcggcgaacagtcggcgaaagctgaggagcagaaggagggcaaggccgaggagcgcgatacacgaggccgtggaaaccgtcgcaacaacgtcaagtttgatccctccacgctggaggtcacagacaaccacgatgagatccgcaagcaggttgaattctacttctccgattcgaaccttcccatggacaagttccttctttccaaggtgggcggaagcagcaatcgccccgtccccctcgaactccttcactccttcaagcgcatgcgtcgcttccagcccttcagcgccattgtcgaggctctgaagtcctccaaaactctcgaactgaccgataacgacacttgcgtgcgccgcaaggtgcctcttcctgaatcggtgaccgagaaacccgaccccagcgtgaccaaggttttcgaagaccaggccatgagccgtagcatctacgccaagggcttcggagaggaaactcctactacccagattgacatcgaggccttcttcgccccttacggacccgtcaacgcaattcgtctccgccgcacacacgatcgaatcttcaagggcagcgttttcgttgagttcgcgactgaggagaagcagaaagaattccttgcgctggatcctaaaccccagtggaagggacaagatttgctcatcaagagcaagaaagattactgtgaagagaaggttcgggacatcgaagctggccgcatcaagcccagtcgtggccgtggtggtttccgtggacgtggccgtggcggcccccgcggtggtgacaagcgtgactggcgtgagcgccgggcagaagatcagaagaacggctttggcaagcctcagggcgagcagcgtcgtgaggttcagaaggacgctcggtaa

SEQ ID NO: 16152 - DNA, 291 bp, A.fumigatus
ccagtggcagtcctcttccgcctgaagccaggagtcacgcaggaccagctcaccaactgggtcactgttgcggagagcatggtgggtaagatccccggtttggtttcgctgaaggccgggcagccgttgcctatcagtgttccccgtgccaaggggtttgatatggggattgtggctgtgatggagtcccccgacgctgtggcttcttatgctacgcatccggtccaccttgagtttgtttccgcctaccctgtgacaggtgcgtttgaagtggctgatgagggactgtag

SEQ ID NO: 16153 - DNA, 1152 bp, A.fumigatus
attcttcgcggttaccatgattgtcctcttcacgttactgaggtgggatccaatatccccattcttctttatgagaccatgcatgctaatttggcacacaggggaattttcttgcctgtcatgatcgtgaccctcccgctcccggttcacttgagacggcgattcccggctcagatggtacttatgcttcaatggttcgcgttcgggatgttttccgtgctgcttataatcccttggcttttgtgcgtctacagactggtgacacattcaccgggcagaaccaagcgtatcaagcaagttttggatgaccgaaccgctcccaaaacagttgttgttatgccagtctataaggaagccccggaaacactaataagggcaatcgattctgtcgttgactgtgattatccagccaactgtatccatgtgttcctctcttacgatggctgcctcattgacgaatcctatcttcggctgattgaacaccttggaattccgattacgctggagagctatccacagagcatagacgtgacgtacaaagacgccagaattacggtctctcgtttcaaacatggagggaaacgacattgccagaagcaaacgttcagactgattgacatggtatatgcggattacctggagcgccacgacaaccttttcgtgttattcattgactccgactgcatccttgaccgtgtatgtctgcaaaacttcatgtacgatatggagttgaagccagggagcaaacacgacatgttggcaatgacgggggtcattacgtcgactacggaccgaggctcgctcctcacacttctgcaggacatggagtatgtccatgggcaactgttcgagcgctctgtggaatctagctgcggcgctgtgacttgcctccccggggctctgacgatgctccggttctctgcgtttcgtaaaatggccaagtactacttcgcggacaaagccgagcaatgcgaggacttttttgactatggcaagtgtcatctgggagaagatcgctggttcacgcacctcttcatgggtaggcgctccggaaacgttatccaatccagatgttgcgcaggcgccttttggcaagacctgaggctgtggcaaacattcccagcagtccttttaaagccacgtccggtgctg

SEQ ID NO: 16154 - DNA, 219 bp, A.fumigatus
tttggcacacaggggaattttcttgcctgtcatgatcgtgaccctcccgctcccggttcacttgagacggcgattcccggctcagatggtacttatgcttcaatggttcgcgttcgggatgttttccgtgctgcttataatcccttggcttttgtgcgtctacagactggtgacacattcaccgggcagaaccaagcgtatcaagcaagttttggatga

SEQ ID NO: 16155 - DNA, 1476 bp, A.fumigatus
ctgtctgctctatctagtcatgcattaccgaggcccagaaaataccagggtgcattgtacaaggagaagccgacgaaaaaccaacgcagaaaccaaaatcaaaaccaaaaccaaaaccaaaaccaaaaccaaaaccaaaaccagaaccagaaccagaaaaacaacaccaatggtaaacatcgtgctccctacgtcgaagatggtcccgatagcgatacttcaaaaggcagcgcgcccccgcctgctcctagtccaccacctacgagcactgagaagccctctgccacaaccactgaggagtcgaagtcggttaacgttttggactatctcgtgacggcagatacccccaacgcatcgaaagtctcgcttggcgagcccaaggagcaaaggaaaatggttgatcatgctccttctgtcttcgagccgagcaaggcatcagtccaagtcgagacggataatgatgacgaaaagaaggactatgacgtggcctatgaggagaatggtttctcatatggggctggtccgattcagccatcggtgtacccaggcaaagctcccaatgtttccatggagttcatgaccccagcgccgaagaagaagaaggatcgtacacgcggagagaatgacaaagccagtgctacgaccagcgacaagaaacgcaagcgccgtaccgatgatcacaatatggacattgactctccgatggcagaggccccatcgagtgttgtcaacaacccgggtacaccgatgctgaaacactcgggtctcactggtggtttgaatcgtatgatgcggtctccatcgacagaagatgggaatgagtcgaaggaggattctcgacgacggtatcaggacccgtcctcgcccatcaagcggacccgccgcgatcataaggatggtgacaacgattcgggtctgggtatttctataaaacaaaaggcaggacgccttgtctcatccatgtttggaggatctgccgtgtcgggaagcagcaacaacagccaggagccggaggctcgccggtcgaaacaatctcaccgtgtggccagtccgtcccaggatcagatgccgtctgattcccggaagacaaaacgaaaggtcagcgctcaggcaggaggggaccggccctcccagcggctaaagcagatcgaatataacggttcccaacacggcgacgacggccgtgaggtggttgtttatcggcaggagaacatccctaacgacttacagcgacaaatggctgcccattttctttccttggtgacgaaggggccagagagctcacgaggcttctctgttaacaaggtattgaagcggttccatcgcgagtttaccgacgaattcgatgacgatcgtggccgcggccaagggcggagccgtgcagatcgcgagcggagaattgaggatgagaaggacttgtggcgcacattgagattgaagcggaacgagcgaggagaggtcgttctcttcttctga

SEQ ID NO: 16156 - DNA, 2475 bp, A.fumigatus
ggcccgtcgacaacaattcgggttcccccgtggcgaccgctgaataataacaccccgcgccggaagaatgccagaagaagaggcagaggcggccgtggcggtcgtggctctgttcgatttaccccaacagttcccaacacgcaatccgaagctcaggaaacgtctcaattaccagaaagcgaagtttcgtcgttgaatgtacagccgaacgaatcatcacgggccgcgagaggatcgaggggaggaaaacgaggtgggcgagggggaggcgcatccctcgacaaaggtcgacgacgtggccgaggacgaggtgaagattcaaaggctgtgagcggtgtgttgggaggacggacattcgagggacgattgtcgaaacccgagcgggcgtctgacgaggatcaaccagatattgcgggggacttgagcttgagagctgatgcgcctgaatttgtccccgcagcgcctgcggatggagttataccgaacggaatcacgtcctcggcagcgagctctacgataggaaagggcaagtcgaagcacattcaggctcgcccgccgaaagtcacgaccaaatctacagcgcctgatatcgccacccggatacatgaagacatcgcgcacaatctctatgaatgtccgatttgtacaagcgagctgggccggagatcgcgagtctggtcgtgcgggttatgctggactgttttccatttgagttgcgtcaagaaatggtcaaagaatgaaggatctgccgcgcaggatgctgcgcgtcgccaggcagagggggagcccagtgcaccgcgcgcgtggcgctgccctggctgtaatctcccacatgagatcttcccgtccacatattcttgttggtgtgagaaggaagttgatccgcgtccgttaccaggccttcccccacactcgtgcggtcaaacctgctcacggccccgcaaaggctgtccacatccgtgcgatgcgacttgccacgcgggtccttgctcaccttgtaccgcgatgggcccgactcaggattgtttctgtgggaggaattcgtcaaccaagcgctgccaggatacggattacgagaacggttggagctgtggggagatatgcagtgacttgctgccttgcggcgaacacacgtgtactcgaccgtgccatgaaggcctatgtggggcatgtgaagtcaaaatagaaggtcgttgctattgtggaaaggtgcagaccgagatgctttgcagctcaaaggatgaggagtttgaaagccaaatggcgcgaggagacgatggtacgatcgatgagtggattggttgtttcagctgcggagatcggtgcagtcgtcctttcgattgcggagtgcatttttgtgaaaaagattgccatcctcaggatgcacatcccgctcattgcccgcggtcaccggatgtcgtttctcactgtccttgcgggaagactccgttgacggagatgtcggacttctctccccgcatgtcctgtgatgaccctatacccaactgctcaaagccttgtggcaagatgttggattgcggacactcatgcgaccagacctgccacaccggtccgtgtggttcgtgtcgacgcaagttgccagttagttgccgttgcggtcgcaccacggttgtaactgtgtgccatcagggcatgattgagcctccttggtgtttccgtgtttgcaaagcaggcttgcactgtggccgacacgcttgcgctgagagatgctgccctggggagcaaaaggccattgaacgtcaggcgatgcggcggaagttaaaggcacacttgcgacccagtgacgaggacgttgaagccgaacatatttgcacgcgagtctgtggtcgtccgctgaaatgcggaagacacacatgcccggaaatttgtcataaggggccctgtaatacttgccgagaggccatcttcgaggacatcccgtgtgactgcggtagaactgttctgtctccacccttaccttgtgggactaaaccgcctgcttgctcgttcccctgtgaacggcctaagccctgtggccatcctcagacacctcacaattgtcatacggacgaagagagctgtcccaagtgcccgttcctcactgagaaggcctgtctttgtggcagacgggttttgaagaatcagccttgctggctggcggagacgcgatgtggcgaggtgtgcggtgaaccgcttaaatgtggttctcattcctgccagaagacctgccaccggcctggtgagtgcgaggatgcctccagaccttgccagcagccttgtggaaagaccaagtccctgtgcggtcacccatgcaccgaaccctgtcatgctccatatcagtgccccgagaagacgccctgcacgtctacggtcacagtaacatgtggctgtggacgacttcgtcaatcacggcgctgtaatgcagcagcggcatcgaaaggaccggtaccgcaggcagtcttcaccacggggctg

SEQ ID NO: 16157 - DNA, 1935 bp, A.fumigatus
  unsure (556): Identity of nucleotide sequences at the above locations are unknown.
atccgacaagactcccagggacgtgaaatctatttcattgtgcggggcgaagttgaagtcctcacggaaagaacggacgcacaagaccgccattctctagcagcttctatcgagaatccaccattcgaggtcaaagcaagactcaaacaagggcaatactttggagaggttgtgagtctgtcgctggcgccccgcaggacagcgacggtacgctccgttactgcagtcgagtgcctcatgcttagtggcgatgtcctcgccgaattctgggacaagcttccccaaactgtccgccagcaggtcgagaacacggccaaggagagacttcagtctgcctctgatggtgacgttgtcatgtcagatgcaggaagcgctgatcagcccaccgatggggagttcaaaatcagagctgctcggagacaatcaatgccgcttttgacgcttacagagacagagttggatagcccgcgagctcccagtgccatggaggatcagaatgtgctgaaaccctcagatcctgacccttttctgaatgttggcttggacaaggttcgantacgcagccggcgcggttccgtcgccccattgacaccagacgaagtgtctggggagcaacagcgacaatcccctccgtctgggactcgttcgactaggtcgtctcttcactccctttccgacacatcgactttgtcgacaacacagaaggcacaccgcgagtcgcgcggcgataatgtcggcattctaccggataatatactcgtgaggattttccaacacctggagcttcacgaacttatgcgccttcgagctgtctctctgcattggtctgagattcttaccaaatcctctgaactcgttcgttatcttgatctgagcatatacaatcgcaaacttagcgatgatgttttggtcaaaataatctgcccttttgttggggaacgacctcgccacgtcaatatcagtaattgtttccacatcaccgacgagggcttctcgaatttagccgctacatgcggcgctaacgtcgtcagttggaagatgaaaagtgtctgggatgttactgcaactgccattcttgagatgactggcaaggcgactggtctacaggaggttgatttgagtaattgtagaaaagtcggggacacgctgctggctcggataataggctgggttgctcctggacaacataagcccaacggtgagactggaaagatgggcaaagcagctctgaagcccacgatgcagactgaagcgggcactgtatatggctgtccgcaattgaagaaattaaccttgtcttactgcaaacatgtcacggatcgctcgatgcaccatattgcgtcgcacgctgcctccagaatcgagcagatggatttgacccgatgtacgaccatcactgaccaaggcttccagtactggggaaatgcccaatttatcaatttgcgcaaactcacgttggcggactgcacttatctcaccgacaatgccattgtttacctaaccaacgcagccaaacagctacaagaactggatttggtaagcttatcactgttacaggagctatcttgcagtaccgctgaccgtgaccagtcgttttgctgcgctttgtcagacacagcgacagaagttctcgcactccaatgctcgcagttgacctatctcaacatgtcgttctgcgggtccgcgatctcggacccttccttgcgcagcattggactccacctcctaaatctcaaacggctatcagtccgtggctgcgtccgggtcactggcgtgggcgttgaagcggtcgcagagggctgcaatcagctggagtcgtttgatgtcagtcagtgcaaaaaccttcttccatggctcgaagacggcgggcccctcagatacaaaggcaaaatcgacttcgaaaccgttgcgcagaatgggcgagtgtttcgatga

SEQ ID NO: 16158 - DNA, 285 bp, A.fumigatus
cttagaatgctgttctttgacttccatttttggagctacgaacagatgaatagacgaatctcaaacaagcggctgctttcatgcttcttgaggatctcctggttcttggtttcagcatatcctttgtctttagatcaccaaaacttcattatgttttaccggcacaacatctttcataacctctttgtgaccatgaaagccaagacaaaggaaggaaaattgaagggtaagtccgggcccattcaatgctattctttcaacatcaacatttatctttgttactga

SEQ ID NO: 16159 - DNA, 579 bp, A.fumigatus
caatttccttggaatcctcccccggctaggcaagtgcatgcccaagccccctatgatgtgcatgctcaagcccaagcggcagggcaaggagctggccgcatgccacttcctgcaaaccttcctccggtaggacagggaacactgtattttacatttcccccagaccctcctcaggccgggcaaggacctgggcaaatgccgcttcccgcaaaccttcctcctacccaacagcgtacctttcccccagatccttttcttgtagggcaaggagctggtcaaatgcagcttcctgcaagcattcctccgccaggacaggaagtaggcaatcttgcacctcctccagatgttcgcctggcgggaccaggccctctcaactttccgcctggcccgaacctccctccagtaatacaagagcctgccaattttatacctgccccaagaaccccttcgccagagcaaggctcttcctccgatcaatccagcggtggtaatccttaccggacatcttctgaggcgagtgcagacaatgatagcacgaactacggtgctactaacactggtccagctttcgtgtcttaa

SEQ ID NO: 16160 - DNA, 258 bp, A.fumigatus
attcgagaagccctcgtcggtgatgtggaaacaattactgatattgacgtggcgaggtcgttccccaacaaaagggcagattattttgaccaaaacatcatcgctaagtttgcgattgtatatgctcagatcaagataacgaacgagttcagaggatttggtaagaatctcagaccaatgcagagagacagctcgaaggcgcataagttcgtgaagctccaggtgttggaaaatcctcacgagtatattatccggtag

SEQ ID NO: 16161 - DNA, 342 bp, A.fumigatus
gttcgcctttgttgcgaatttatgcctgaggcccaaagaagtgccgccccgctgaaaaattccccgaactcttcgattccgttgcatggtaccagacacgacttaatcatcactcttgagcggttggcactgttgctggggccagtatgcgaaaaatctccgaatgtgatcatcacaggcaccgctggtgtagggaaaactgttcattgcgagaaattagcgcaggaggtcggcttgcgacacctatcgataaaccaggttgccaaagatcgaggttgcttcgaaagctatgaccaggatttggaaacctggatcgttgacgaggacaaagtacgtcgctga

SEQ ID NO: 16162 - DNA, 222 bp, A.fumigatus
catgatcatgcttcttctagaaaatacaaggaggccaaattgcaggaaaacttagattctgagatattcggcatcttgtcagaggaagcgcgcgaagcttttgacgaacagatagtcgtggagctcaacagtgaggaggatgatgatgtagagactaactgtgcgaggatttcagcctggatagaatcctggaaagaaagccgaccggaaaacagagagtga

SEQ ID NO: 16163 - DNA, 180 bp, A.fumigatus
  unsure (17): Identity of nucleotide sequences at the above locations are unknown.
cggctcccttgggttanaaacccctcgaatctttccccaaaccattggttcccctccctgaagttgacggattatccaatattgcgggaaattgagatccctccccggttggccgaggttttcaactgggccctgggatttccatttccgattaaacccctggtgaatccccccatgaat

SEQ ID NO: 16164 - DNA, 471 bp, A.fumigatus
gaaagcttggaattcaatatctatcacacgtggatgaaggtgttgaagaagaaactctacaagatgattgtccccgcgatcatcgaatctcagtccgttcctgggttcgtcaccagtgaaaccaatcgattcctcgggaaacttcttccctcaaacaacaatccagcgtacagcatggataatctcctcagccttctgaacaatgtctacaaagcaatgaaagctttctacttggaagattctatcattactcaaaccgtgacagagctgcttcgccttgtcggtgtcaccgctttcaacgatctcttgatgcgaaggaactttttatcttggaaacgtggccttcaaatcaattacaacataactcggattgaggagtggtgcaaaagccatgatatgcctgaagggacattgcagctggagcatttgatggtaagttggtttccaagagacagtagtgattttaactga

SEQ ID NO: 16165 - DNA, 222 bp, A.fumigatus
agctacctccaagtgcattgtaagtttggaactgcggaactgatcatgcaatatagtaaacatttcttgagcgcactgggacacgacggcctcaacaagatgcttgactctttcgaagaccgaagtgcagaagccgtttgcacatttgctttctgtcgtggtcctggagaagaaccaatacttttccagggaaggactgaggtaaacggcacacccgtctag

SEQ ID NO: 16166 - DNA, 360 bp, A.fumigatus
agactaattggtcgattctttaggctatctccaaaccagatccagaagcttctgaatcaatatcttgtcgctgactacgaacagcccatcaatggcgagatcatgaaagccgtagcctcgcgtgtcacagaaaagagcgatgtactcctccttacccctgttgacatggaagacagtggcccgtatgaaatcgccgagcctcgtgtcatcacagccttagagacatacacaccatcatgtgagtgcttcaacgaaatggtttccagaatactaatgatatccagggctccaaactccgcgtttgaaacgtcttgcagaaatagtctcagcacaggcaatggcccagcaagagagacttga

SEQ ID NO: 16167 - DNA, 1305 bp, A.fumigatus
tcgcccatcattgcgtcgtttgcagctggcagatttctctcctttgacacgcttgtctgcgactataattatctgcgccagcgacctctgtccgggctgataccggctccgggtcttccgcctttccgtataagagcggtcgaaatgccctcttcttctgccgacgacatcccagcaactccccgagtcatatctccttcgcctgtaccgtcgagtgagtcaagctcacgggatggttatgccggaccgaggactcggtcggcagcgcgacgccaacgtcttgtagatgtatccgaggagaaaagcgaaaacgtggatgcggactcgaccaggtcacgcagtcgcagcccagcagctcctgctcgtttaactcgcacgcggcgatctaatcccatgataccagccaggaaaccggagccttcgaagaccaacggccgcatatcgcccaccgacttactttcgcctaattccgccctgggcaaaggccgggcacacgacatctctcgttcaccctcacctctgggcttgatccccctccacactcgctaccgcagcttcatccatcgtcacgagataccgcgcaagctcctccatggctccatcggctttcttaccctttatctgtatagccgaggcgtccagactctccagatcaccccatggctgctctccgctctcgtccccatcgccgcgacagactttatccgccatcgctccgagacgttcaataaaatctacattcgctgcgttggtgcgctcatgcgggagacagaagtgtcgggctacaacggggtgatctggtacctgctgggcgcatacagcgttctgcgtttcttccccaaggacgtcgcggtcatgggcgtcctgctcctcagctggtgcgacaccgcagcctccaccttcggccgtctctacggccggcacacgttccaactgcgcaagggcaagagctttgctggtaccctggccgcctgggtcgtcggcgtcgtcaccgccgctgccttctggggctggtttgtcccccgcgtcggagcctttcccaacgatcccgagggttcgttcatgtttaccggccgtctgaacctactccccgatcctatcaagggtctcctgggttggactgccgattccgattcctcgcgcggagtcatcaccggcccgctggcactgggtgtcatgagtgttgtttccggtattatcgccgctggaagcgagttcatcgacttgttcagctgggatgataacttcactatccccgttcttagtggaatcgggctgtggggattcctgaaagttttcggttaa

SEQ ID NO: 16168 - DNA, 189 bp, A.fumigatus
aatgatgatggcgccaacatgatgtttcttaatgggttcctcgagacgcaaaagcttctctacaactgggatcaggaaagacagcgtctttccgctgccagtgactgcctccactacgacatccttatgcgccatgaacagaggaatagcggatgcttgcactggggtcatgcgggtgaagcccattga

SEQ ID NO: 16169 - DNA, 1137 bp, A.fumigatus
ttcgattgtaccagtctgcaaatgacctatcttacgacacccccctcgcacaagttcgccgctttgaaacgcatcgtttcttcagttcagcccactcccttgaaaacgatattcttcgtctctacctgttctggtgtcgattatttgtctgcaatcctcccattgctgcttggtgacgatttcctcttgattccactgcacggcaaacaccaggcaaatgtccgccaaaagaacttcaaccgcttcatcaactcacacgatccggccattcttctcaccactgatgttgctgcgcgtgggttggatatcccgtctgtcgatctcgtcgtgcaaatcgaccctccatcagacccgaagtcgttcattcatcgatgcggccgtgctggaagagctggccggaggggtctgagtgtagtgcttttgcatccaggacgagaagaagattatgtttctttcctagaggttcggaaaacaccggttgttccattttctccatcgatttctttctccgacgccgatgcggctgctgccacggctactgcccgaaaggctgtgttggccgatcgtgcgctgcatgaccgaggccagaaggcgtttgtcagctggctcagaagctacagcaagcatcaggcgagcagtatctttcgtgtctctgaccttgattgggaagctttaggcaaagcctggggtttgttgaaattgcctaagatgcctgagttgaagaacttcaccggtgacaagacgctcggcatgagccttgactgggacaattacgcatacaaagacaagcaaagggagaaacggcggaaggagcttctccaagaggctgccgagtctggtgccactcaatccacgtcaaacaagagacgagccaccgaaagtgtcgcatggagccaacaggctgagtcgaagaacaagaagctcaagcgacgtgagcagaagaagtcaaagcaagagaaggcgagatgggagaagatgacggaggaagaaaaacagaaggttcttgagacggagaagatggttgaggagctgaggaagaagaacgaggaagaaagacgactaagacgagcggtagccaaagccgcaggcgcgaaggctgatggtgacgacgaggaagaattccagggatttgattga

SEQ ID NO: 16170 - DNA, 351 bp, A.fumigatus
tcgtcgaatcgaagtgcggatcgaagtgacggtccgattctgcactcggctgctgtcatggctccgaaaccaccttcaggcacttcattgagggcctgggatgcagtgacaccagccctgtcagaatgggtcttagaagcaatgtcctcaatgggcttcacccgcatgaccccagtgcaagcatccgctattcctctgttcatggcgcataaggatgtcgtagtggaggcagtcactggcagcggaaagacgctgtctttcctgatcccagttgtagagaagcttttgcgtctcgaggaacccattaagaaacatcatgttggcgccatcatcatttcaccaacaaggtag

SEQ ID NO: 16171 - DNA, 639 bp, A.fumigatus
gcattgatttctgggcgcgcggcagccagaattgtggaaacgctcgatgctgagtatgttattagagaacttgcatcacagatttataatgtactatcatcattactcgccttccatcctccttcagctgctgcgatcaacccctccgaagacgacgatgcgcctcgacccaagtttccctcatctactctcaaagttgttccgcagctcctcctcggtggttctactactcctgcagaagatctgagtacgttcctgaagcgttcaccgaatgtgttggtctccacgcctggacggcttctggaattgctttcttctcctcacgtccactgtcctcaatcctcattcgagatgctggttcttgacgaggccgatcgactgctagatctgggattcaaagagactttacagaacattctgcgccggcttcccaaacagagacggactggtttgttcagcgccagtgttagcgaggccgttgaccagattgtccgagttggtttacgaaatcctgtcaaggtcatggtcaaggtcaagggtggctcaggcgttgacgataagcggactccagctaggttggtgcctctctactttatacttgaacagcagtctaattcgattgtaccagtctgcaaatga

SEQ ID NO: 16172 - DNA, 381 bp, A.fumigatus
gctgacacaatcttaggtttcgccggcaacgattcaccttcgttcgtcttccctactgctattgccagcaaggtaggcgcgggaagcgcgggcagttctgggagtggccgaccacctgttgcgaataagccatcatttctgggggcaggctctgggtcaagctcgaacttgtcagcaaagcgtggaactgaagatttggattttttcatcggtgatgaagctctggcggctgccaatggacctggctacggcatcaactacccgattcgccacggtcagatcgagaactgggatgctatggaacgtttctggtccaattcgatctttaactaccgtcttcacccacgggagctggccggacccgcccttaatgtaagggaa

SEQ ID NO: 16173 - DNA, 201 bp, A.fumigatus
catggcttggcaactacgtatttggatctccatagttggtttgctccatacacgaggcacctacctagtagtactgttactgcccgccttcacctccccctcatcctcatcttcctccaccactgttattcctcggtgcttcctacaggtctccccctttactcaactaactgctcaatcgatctcttgttcaatttctga

SEQ ID NO: 16174 - DNA, 474 bp, A.fumigatus
ctggccgcagatattggatactcccctcttctatcctcaattgaagtctctcatcttcaatatgagtcaaccacagagaggtggaggtatctctgccatcttcgtccatgtaggggcgggatatcacgaccatggaaacgagagagcccaccttcaggtatgcgaaaagtcagtcttccagccacctgcgaatccatgatctacgtcgttcacgtatcagcttttggtctgactgccagtagcgcttgtaaagccgcaatgggcattttaaaaagcggtggatcagctctggatgctgttgagatggccatcattgtaatggaggatgacgagattacaaatgctggctatggaagcaacctgacgattgaaggagctgtcgaatgtgatgctactattgtcgaccaccatggcaggagcggcgcagctggagccgtctcgcgtaagtttctcttcttctcagcttcacaatag

SEQ ID NO: 16175 - DNA, 516 bp, A.fumigatus
cagtacgtcctttcttgtttctatatctgccacgaagacttggagctcgtgtctaaccttatgcctcatttagccatgttgtacaacaatcttctgtcaatccctgtgcttctggttctcactttcctgatggaggactggtcttcggcaaacatcgcgcgcaatttcccctctactgatcgcaacggcatcttatttgccatgattctctccggtctctcgtccgtgtttatttcatacacctctgcttggtgtgtccgtgtgacttcgtcgacaacctattccatggtcggcgctctgaacaagctgcccatcgcactctccggcttgatcttcttcgatgctccagtcactttcccgagcgtttctgctattgttgtcggttttatcagtggcattgtttacgccgttgccaagattaagcaaagtgccaagccaaagactggtgtgctgccaatgtcgaacccccccgtcagtgctagcagccagagcatgagagactctctgcgctcctga

SEQ ID NO: 16176 - DNA, 264 bp, A.fumigatus
ggttcatcggttccatcatcccccgcgggggcggatatcaagcaggcagttgaaagtagtggagacgtaactgccaaggtgtcgactctcaatgctggctatatctggatgctgatcaactgtctctgcatttcgtctaacttcctgggaatgcgcaagcgaatcaagttgacaaacttcaaggactttgacagtacgtcctttcttgtttctatatctgccacgaagacttggagctcgtgtctaaccttatgcctcatttag

SEQ ID NO: 16177 - DNA, 1668 bp, A.fumigatus
gcagagccgtcgttgtccaggaatctggcatgtggggaagattctgattgcatcaatcgcgctaccaaaattgagtgcgtgggagattgcagctgcggtgccgaatgccagaatcaacgattccagcgcaaagagtatgcaaatgttgcggttatcaagacggaaaagaaaggcttcggccttcgtgccgagactgatttgcgaccgcaccaattcatcttcgaatatgtcggcgaagtcatcaacgaggctcaattccggcgacgcatgagacagtatgatgaagaagggatcaaacacttctatttcatgtcccttagtagaggagaatttgtcgatgcgacgaagaagggcaatctgggtcgtttctgcaaccactcgtgtaatcccaactgctacgtcgataaatgggttgtgggtgagaaattgcgtatgggaatatttgccgaaagagctatccaggccggcgaagaactcgttttcaattataacgtcgatcgttatggcgcggatcctcaaccatgctactgtggcgaaccgaattgcaccggctttattggaggaaagactcagaccgatcgtgctaccaagctttctaatgccaccattgaagctttgggtatcgaagatgctgatagctgggacactgttgttgcgaagcggccgcgaaaaaagaagatgggcgaggatgatgaggagtatcttgatagcgtacagcataagtccctagatgagaacggcgtcaccaaggtcatggcggccctcatgcaatgcaaagaaaaatggattgctgtcaaattgctgaggcggatcgagcgctgcgacgatgaccgagtccgccatcgtgtggtgaagatgcatggctaccagatattgaattcccagctcaccttatggaaggatgacttcaacgttgtgttgcagatcctcaatattttggacgggtttccccgtcttacacggaacaagattattgattcaaagatcgaatccaccgtccagccgctgacaacttgtggagatgagcgagtcgagaagaaggcagccgcacttttgcagcactgggcgactctggaggttggatatcgtatccctcgcatgaagcgagatccaaatgcggttgcttcggtcagccagttcgggcggagagagcatactactgatgagcagaaacgctctcaatctcgttcacgatcaagatcccggtcgttggatgctcctcgagggccagcgaatccaggtcggaagagcaatggccccaggaattctcagcatcacggtgcccgtcagttccgccgccagttcaaccctctgcccccgggatggtttgcagccgaatcacacggcaggacttattattactgcgcccgtggggatgtcacctggactcggccgattcatgccgcacctgaggccgaagtcccaggccaacaggcgaagaataaagccctacaaggtattatcgataatatcttgaatgctaaggagaacacgccgaaggagaagaccgtcacacctggcacgccgcaagcttctagagaaacggcaagtctcaatgaagggcaggagaggtggagaagttacagtgaagagaaacagaagaagctgtatgagaacacggtaagctcactcccaagagcagctgttgttgtccttgagtacaggtag

SEQ ID NO: 16178 - DNA, 555 bp, A.fumigatus
cgcatcgccagagcggtaccacagatcccccttcgtgaagacatcgcgcaggaatttcttggacgtggcgctttcattgcgccagtagccttggaatgcttgctcgttgggcacattgacgaggatctcgccgccttggtcgtatggggcccgcatcgcaaaccccgtcttggggtcccgcaggacatcgccggtcgtgggatcgatcgccacaggcacgaacgtgttgtgcattatggcgcgcatgagcaggccgtggtgaccgacactccccgccgtaaacgggcccttgttgagattgaacagcccgaaaagcccctcggtgctgttgaagaactcggccacggcactgatcccgaacctttgctggaacttctcccagatgtccggtcgcagtccgttgccatacatgcagcgaacgctgtggttgcggtcgtccggcgacggcggtgcggccagcaggtaccgggccacttcgccgacgtacacaaagaccgtggcgtgggagtctcggatatcgcgccagaagttgcgcacgctgaacttcttgcctag

SEQ ID NO: 16179 - DNA, 1356 bp, A.fumigatus
cgaggaaaagccgccaagggtcttggaaatgtctggtttgtgttcctggaaacagcagcgaagtacccggatatggtgtgcatgtggacacgggagggaatctatacctaccgggacgtccagaaccttgcctgccagtatgcgcactacttcctggcccaaggggtcaagcaaggagacctggtggccttttacttgcagaaccgggccgagttcatgattgcgtggcttgctctttgcagtattggatgtgcccctgctgcgatcaactataatcttaccggtgatgcattggtgcattgtctcaagatcagcggagccaagcttgttctggtggatgacgatgaagcatgtcgcgcgcgcatcgacgacagcagagcagctatcgaaggcccactcggcatggaacttatctacctggaccactcgttcgcctcgcaagtctccagcttccccacgacgaagccacccaaggagttcgcacagagcatgtcgggcgcggatccggccatcctcctgtacacctccggcaccaccggcatgcccaagggctgcgcattcaccatggcacgattgtacagcacgctggctctgcgtcgcggatcaatggaggacaccgacggtcccggcggggacatctggtacagctgcatgccgctgtaccacggcacagccgccgtcgccatgatggtctgcctcaccaccggcgtcagcattgccctaggcaagaagttcagcgtgcgcaacttctggcgcgatatccgagactcccacgccacggtctttgtgtacgtcggcgaagtggcccggtacctgctggccgcaccgccgtcgccggacgaccgcaaccacagcgttcgctgcatgtatggcaacggactgcgaccggacatctgggagaagttccagcaaaggttcgggatcagtgccgtggccgagttcttcaacagcaccgaggggcttttcgggctgttcaatctcaacaagggcccgtttacggcggggagtgtcggtcaccacggcctgctcatgcgcgccataatgcacaacacgttcgtgcctgtggcgatcgatcccacgaccggcgatgtcctgcgggaccccaagacggggtttgcgatgcgggccccatacgaccaaggcggcgagatcctcgtcaatgtgcccaacgagcaagcattccaaggctactggcgcaatgaaagcgccacgtccaagaaattcctgcgcgatgtcttcacgaagggggatctgtggtaccgctctggcgatgcgctacgccgccagagcgacggccgctggtactttctcgatcggctcggcgatacctttcgatggaaatccgagaatgtgtaa

SEQ ID NO: 16180 - DNA, 483 bp, A.fumigatus
gctaacccgtccacccctgagcaattcgaaagtcgaaagtcacaaaaatcactaatggactccagtgcaactgccgaggtggccgaaatcctcggccgataccccggcatccaagaagccaacgtctacggcgtcctggtcccccaccacgaaggccgcgccggctgcgcagcgctccatctcagcccggaggcgcgagaggcattcgactttcgcggtctggctgcgtttgcgcgcgcacgactgccccggtacgctgtcccggtgtttctgcggatcgtggagacgtcggcgcatatccacaaccacaagcagaacaaggtgcccttgcgcgaggaggggatcgacccggctaaaattgggagcaaggtgcctgaggggcgggacgataagttctactggcttccgccaggggcagatggatatgttgagtttgggaagagggagtgggagacgatgctggcgggaagtgctcgtttgtag

SEQ ID NO: 16181 - DNA, 477 bp, A.fumigatus
ccgcccgacccgacctctcctccactcgacgtcgcgacccctgctcctaccgccgagatcccagccgagcaagcttccgtcgacgcaagtcacagcgacagcgacagcgatggcaagataaactggacaaacaagctggctatcgaagcgacggagtgcgttttccgtggcgtccgtctttctgttcctccctttccgtttagacaacgctggaatgaagctgcttgtcacgagataggcgagcgaaagaacagaggcagaaagcgcaagagaagagagtatgaagaatgtgacgacgaggagtacgagtacgttgataacgggaactttcagaggatgtacgataccattgctgctgctgctcttgcgacgattgcggccgcgaacaccacttcgcatccgacgaaacggcggaagaaggcgatgaaaaagaagcagggtggtggtagtcccggttctgcgggtagcccagcctga

SEQ ID NO: 16182 - DNA, 207 bp, A.fumigatus
aatgggaataagacgaacgagagagagtcatttcccctgcttcataacctgcgtgagggaaaatgtgtcccacaatccaatatgactcgatgtgtgagctacttctacgtttacaaatacattgtattacagggtccggattacattagcggaaatattactgtttcattacattacctgaaatactgtttatgtaagatagtctga

SEQ ID NO: 16183 - DNA, 228 bp, A.fumigatus
gggactgttgacttttacgattgggttgattgtatgtctcttttcgtccggctgggacggcaacacactgacgaaaccctccagagcttcttctacctcccccagtcaccaacgcacaccaagagcgtcctctacccccggtcctggtacaccgagcgcgaggaagtcatcatgatcaacgtatgtcccaccattgttcctgctagccccgttctaacagatgcatga

SEQ ID NO: 16184 - DNA, 333 bp, A.fumigatus
caatgtgatgagggcaccacaatccaactcgtctgctttctcgccgcggaattccccgtccagcttctcaccaaacgcttcggcttcaagcgcgttttgccctgcatgatgatggcctggagtctagtctcctggacacaagcatggatgacctcccgtgcttcattctacgtgacgcgcgcgctgatcggcgcctgcgaaggggggttcatccccggggcgattctcttcgcgacctatttttataagaccggggagttgtctgtgcggctgtccttcttttggtccacattaaatgtaagtcctcctaactccctggctgtcaatcgataa

SEQ ID NO: 16185 - DNA, 279 bp, A.fumigatus
tggaacgaggttgcacgtattatctcctcgttgctagcagcggggattctacagatgcgcggcgtccgcggcaaaacggggtggttctggctgtttctgattgagggactgttgacttttacgattgggttgattgtatgtctcttttcgtccggctgggacggcaacacactgacgaaaccctccagagcttcttctacctcccccagtcaccaacgcacaccaagagcgtcctctacccccggtcctggtacaccgagcgcgaggaagtcatcatga

SEQ ID NO: 16186 - DNA, 846 bp, A.fumigatus
ccccgttctaacagatgcatgatccagcgcctcctccgcgacgacccctccaaaggcctcacgcacatccacgaccgcgccacgctcaccgacatcctgaacgcctggagcgacaagtccatgtggggattgtacctcatcggcctggtcgcgtacatcccgcagtcccccgtgcaggcatatctgtcactcaccctcaaacgcctcggcttctccaccttcgacgcaaacatgctctccatcccctccgccgcgttgcagatcatcctcatgctggcgctatccaagagcagcgaattcttcaaggagcggacattccactgctttatcggcgagctgtggtcgctgccgctgttggcggcgttgctggcgctcccggcccatgggcataactggggcaggtttgcaatcacgactatgatctcggggtatccgtatttccatccgattgtctcgtcgtggatctcggagaatacgtttgatgtgaagaagagagcgatcacggcggcgacgtacaacgtgattgtgcaggttgggtcggttatttcgtctcgtaagttccttcgcatgctggctttggtatgtcccaagaaggctgacggagcagaaatctatcgggcggatgactcgccctactactacaggggcaacaaggtgctgatatccatctgtgtgctttcgctgatcgtctttgtcgcccagcgtgagttcctgcgttatcttaaccggcagaaggaaagaaagtggagcaccatgtcggccgaggagaaggtcttgtaccagtctgatcaagaggccagagagaaggagggtaacaaacgtttagatttccgtttcaagtattga

SEQ ID NO: 16187 - DNA, 504 bp, A.fumigatus
ctgaacagattgcgaataccgaccaacatccttgcccctccgctctacgtatatcacatgcgcatgtatccggtttggcccatcgtcaatgccgaaagcctcatctcggtactacaggaagatacagaacgaaaggatctgtcaacctataccctggcaacagccgtcgcagcagccaccctggctcaactcaagctcgaagattcgactaccggcgactcgcccaccgcagacgccttcgcggccgagtgcttgcatgcccgtgattcgtgtggatataggtcaaaaccaagcttggacaacatccggacatcgttcttcctacatgtatactacgagaaccaacagtccggagggagcgagtcgctgctttatctaagggaagccattaccatggcgcaaatgatgcgcttacatcaggaggcttcttacatcggactcagtccggaggagcagcaactccgccgtcgcatactatggctgctttttgtgacggaacggtaa

SEQ ID NO: 16188 - DNA, 546 bp, A.fumigatus
cggaacggtaatttccatctatttatgattcgtggctatcctgacactgtgtgtaggggtgtttgtatcctccaccagttgccggtgatactcaaaactaacatctcgacccctgggcttgacgtcaatgacgagccgcaagtcttacctgcattcctgaaactactcaatctgttccgccttttcgaaaagtccaagatgttcgatgtgatagagtgcgagagcgtcggacctcatgacctcagcagagcgggaccggacggaagattcctcaaactgctacaggacggcctgcaggacgggtcggcactactggatcatacctcggacgtgcagaaagcagatctatgtgttacccggcattggatgcgtctcatcctgtggaagaatctgtcaagaaacaggaccacatacgcacattcaccgacttcgcttttctcaccgttgtttccagtgatggtcgcaaaggagctcgtggccatagtaactcagttaccaagaccggcgattgaggcgcatggcttgggaatggtacgattgtcctaa

SEQ ID NO: 16189 - DNA, 597 bp, A.fumigatus
gtgtctatcaacatgccggcttcacgatcaaacgtgaccaaacgtgcctgtgacgggtgcaagatccgcaagatccgttgcggaggcggccagccatgcgtggcctgtaccaactcgcgcatcagatgcacttacattcgcgttcagcagccgcgaggtccgcagcgtttgcgctcgacgacaaagtatctcatcgagcagacgcagcgtggactggacgctccaaatggcagatgcgcctctgctccagttgaacaggctggtcatcaaggccatcaaacagagaggtatgtattgaatctcagctctcatattttggaaccttttctgactgaacagattgcgaataccgaccaacatccttgcccctccgctctacgtatatcacatgcgcatgtatccggtttggcccatcgtcaatgccgaaagcctcatctcggtactacaggaagatacagaacgaaaggatctgtcaacctataccctggcaacagccgtcgcagcagccaccctggctcaactcaagctcgaagattcgactaccggcgactcgcccaccgcagacgccttcgcggccgagtgcttgcatgcccgtga

SEQ ID NO: 16190 - DNA, 189 bp, A.fumigatus
agatggcccgttagcgaaatgaaacgtcaagaggatatgttacgaacgtaccactgtgactgcaaactcttcaaggtagatatgaagcgccgtttcgacggcgccacctccaggaacgatactaccactctcaagagtgcgcttgacagcgcaaagagaatcgtgaaccgaacgctccatctcatctaa

SEQ ID NO: 16191 - DNA, 675 bp, A.fumigatus
agactgacactcaatggtgatggttcacggctctacacactctgtagggatggcactgtatacgcatactccacgtcccacctggtacttgggcatgcacctgaactttctctgtacaatgatcgtccaagacgctcaggcggttctgacaaggaaggcctgggtccattgtacggatttcgccatccgcggttacaggtgtcttcattctacgtcagagtcagtgtccgcaaggccgttgcagacaaagtggaaatgttggctgttggaagcagtgatcactgtgccgttctcttcccgactgacgagagattccttcattctcgcgtccagaatccagctgttgatttgaacccccagtccccagggatgtcattcactcgctctggcttacgccgcactaattcagcagttggcttgtccggacgactggaggataccgtgccgatctaccaatcagggacaccattggttgagggccacaaaaaggaggtgtcagctgtttcctggtctgtagatggggagcttattacagtcagcgacgactatagtgccaggtgttggcgcgaagggcctgatgctcgggacctgcgagtcggtggcgagaccgaaggtagacgatggaagtgtggctgggctgacatcgagaatcaatatgacgacgatgatgaatga

SEQ ID NO: 16192 - DNA, 456 bp, A.fumigatus
cgcctgctcgactcgatcctcgtttgcataatggccagtcaaacccccgctgacacttcggttgctgctgaccctgtcacccttcctgatcgcagccagaaccccgctgatgctgataaggccgctccccaaggcgagacctccaagaatgccgccaagaaggcagcaaagctagcaaagcaggctgctgagaaggctgagaaagctgcaaacaagggcattggaaagtcggaggctaagaaggctacatcaaaggcgcctaagaagaagattgaaggggctgctttgatcggtatcgatgtttccaaggaggaggactttcctgggtggtaccagcaggttcttacaaagggtgacatgctggattactacgacgtttctggatgcttcattctcaaggtacgatcgtttgctgttcttcacccacaggcggccgaaggatccgagcaatgcggt

SEQ ID NO: 16193 - DNA, 1047 bp, A.fumigatus
gtcggagatggcaccacttccgtcgtccttattgccgccgaacttttacgacgagcaaacgagttaatgaagaaccgtatccaccccacgactattatcaatggctaccggctagccctcagagaagctgtcaagtatatgaatgagaacatcaccacgaaagtcgatgcgctcggaaaggacagcctggtcaatattgccaagacttctatgtcgagcaaaatcatcggcgcggacgcggatttcttcgccaatatggtcgtcgatgccatgttgctggtgaagaccacaaaccagaagaacgaggtgaaatacccagtcaaggctgtgaatcttctcaaggcccacggaaagagtggcacggaatctatgctcgtcaagggttatgcactcaattgtaccgtcgcgtcacaagccatgaagacccggattaccgacgcaaagattgcttgtctcgatatgaacttgcaaaaggagagaatgaagctcggcgttcagatcacggttgatgatcctgaccaactagagaagatccgtgagagagagtccggcattgttcttgagcgggtagagatgatccttaagtctggagcgaatgtcattttcacaactaagggtatcgacgacatggttctcaagctcttcgtcgagaggggagctatggctgtcagacgctgcaagaaggaggatctgagacggattgcgaaggccactggagctaccttggttagctcactctctgatctcaacggcgatgagaaattcgacgcatcaaacctcggatatgcagaggaagttgtgcaggagcggatatcagatgacgagtgtattctggtcaaaggaaccaaagtccacacctcggcctcgatcatcctcagagggcccaatgactacagcttagatgagatggagcgttcggttcacgattctctttgcgctgtcaagcgcactcttgagagtggtagtatcgttcctggaggtggcgccgtcgaaacggcgcttcatatctaccttgaagagtttgcagtcacagtggtacgttcgtaa

SEQ ID NO: 16194 - DNA, 429 bp, A.fumigatus
catatcctcttgacgtttcatttcgctaacgggccatcttcacagggttctcgtgagcagctagctatcggcgaattcgcccaatcacttctcattgttcccaagacattggcagtcaatgccgccaaagactcgtctgagctcgttgcccagctccgcagccgtcactgggcctctcaacgcatcgaagaaagccccgccaacaaggacgataaggctatcgcaaagaagaagaactacaagaactatggtcttgatttgaccaagggacgggtccacgattgcatcaaggcaggtgtcttggaacccagcatgggtaaggtcaagcagttcaagagtgctgttgaggcctgcatagccatcatgcgtatcgataccatgatcaagctggaccctgaaaggaaggaggatgacggacacggtcactaa

SEQ ID NO: 16195 - DNA, 264 bp, A.fumigatus
caggggattgacattctccagatatatctgccagagcctaaagatctggacttgttcgggatgcaagacgaggacattcacattaacctgtggctgaccaaacagaaaattatcatcggtctggtcgtttgcttccggctgttcgacgtgatggtcccaggtgttttttttttgtcggcctgcgcatctggactatcaccgtcgtcttcttcgggttcaagtgtcttccctatggttaacggctgccgtaacgacaatggctag

SEQ ID NO: 16196 - DNA, 186 bp, A.fumigatus
aaggtgccatcagctgggggaatgattgcaattgaccccaaggttcaaatggcgctggggactagtttaaggccagggtttcaacggcctagctgttcctataggaatataactatgctcctactaatcatgcatcgtatgggcaagactagatctttacattctggtatttcctcactcccttga

SEQ ID NO: 16197 - DNA, 723 bp, A.fumigatus
gcgcgagagctcaccgatgagaaatgtctccatatatatatctccgcttgctctgttgaatgtcgtttgagatatcgcgcctccactccttgcccaacagcgttcaaccggctcctccagacggttaccatggatcccttcccatcggaaccctaccgatccgcacgtctcctttatcgtgcgccagaggataacccagcagatgatgcattcttccacgctctctacgccgaccccgtggtcgggtctatggcaactactgccctcttacgcccgctcagcacaaaggagcggaaggaattgcgagcaaagctttctgatgtattcatgtcagtcatgatatgtattatcccggacgagggctctgataaggagcctgagacaattggtgtggtctcattaaaaaaggaagcctctgacttcgctcataatcgcacgtacgagttagggatcagtattgcgcgccagaaccaagacaagggatatgggtctgaggcaatctcatggatgttagactgggcttttctgacggcgggtctacaccgcgttgagctggtggtcgctgagtggaacgagagggcacaaaaggtgtaccgaaggcttgggtttgcatccgagggacggaagaggcagtgtctgtggaaagctggaaggtggtgggatttactatttatgggcattttggcgcatgagtgggaggcgaagaaggctgctggctcttga

SEQ ID NO: 16198 - DNA, 429 bp, A.fumigatus
cctccagtttccagaacccccccctgggttccatctccgttcatcatcctcgctccatcgcatcgcaacgcattcaaaatgtcgacagatcattcggcaaggtcgccccgcccccgggcttgtgtgagatgccagcagcgaaaagtcaggtgcgatcacaaatccccctgtgggaattgtgtcgcatctgaaacgcagtgtgttactgcaacgctcactccgcgacgtcgtcgatttcaagagaaagttttattagaccgtctgcgccattacgaaggccttcttcgccagcataacattgatttcgaacctctgcatccccaggccaagccggaccctgtcggcgcggctgtctctcgggcgtgtggacggtcagaaccggcgagggcacagacccctgtccagtcgcaggcagtgtttgacacctga

SEQ ID NO: 16199 - DNA, 201 bp, A.fumigatus
tttagacgagtgagtactcatcagaagggtgctagtggtctagcatgtatctctaattccctagagctacacctgattttcccagtgcgcttcaatctagagactacacctcaccactatggattagcgaggattcggttcgacattagctgttcgatcatgcaaccccaccaaaaaggtaagaagttattaggtatttag

SEQ ID NO: 16200 - DNA, 678 bp, A.fumigatus
gtctccgtttcgccgcagacagaccctcgctcgctctcctctatgctggccgcggccctccgaattgcacaacggatggggcttcacaatgagtcgacgtacactccatacactgccgtaaaagctgaaatgccccaaaaaatctggtggtcattggtgatttttgatcatcgcatgtgcgagatgtccgactacaaggtcaccacgttgacacccacttgggactgccagattccgttaaacgtcaacgacgttgagattcgacccgacaccaattcctgggcccccaacaacgagaagccgactgaggcgctgttcgcagttgtttgtagcgagctcgccgaccggattcgccataccaccttccacattaactttgtcaacccggtactggcggcggtggctaaggcaaagaatcctggccgcatgtccattcctgcagacgatgagatgttgactatccagaagacaatcgaggaaaaatacctcgctttttgcgaccccaccgacccgctccgttatatggcaatctggacgacgcgcggctacctggccagaaaccgcctgctggagcactatgcgcggcacctgacgtcgccagcaatgcagcagacagacgctcagcgcaacgctgccctgttctacgctctacagatgttggagtgcgatacgaactga

SEQ ID NO: 16201 - DNA, 813 bp, A.fumigatus
gcagccggactaacacattacgcgcaggccttggagacgaatagaggagaactcaagaccctcaagcaagaattggacgagaaggtggctgaattgaacgaaacccgggccacggagattgagatgcgtaacaagctggaagagaatcagaaggccttgacagaaaacgagaagcgccagcgatactggtccgagaaactctcgaaactgaccctgcagaacgtgagcgatctgggtgaggaacagcagcctactgagctccagatgtacaccaaggatgagctctcagaaatgaacaaggagtcgctgaaggcagtcattgctgccctcgaggagaagacccagaacgcctccgtggacctgtctgtgattgaggagtatcgccgccgagcggctgagtatgagtctcgcgccgctgatttggccacggctctggcatctcgtgatagcgccaaggctcgactggacggtctccgatccgctcgtctgaacggattcatggagggcttcggcattatctccttgcgtctgaaggaaatgtaccagatgatcaccatgggaggcaacgctgagctggaactggttgactcgctagatcccttctcggagggtatcttgttttccgtcatgcctccgaagaagagctggaagaatattggtaacttgtccggtggcgagaaaacgctctctagtttggcgctcgtctttgcgcttcaccattacaagcccactcctctgtacgtgatggacgagattgatgcggctttggacttcagaaacgtgagtacattcactacctcgggacaagactag

SEQ ID NO: 16202 - DNA, 459 bp, A.fumigatus
tcgcctagcgcgggtccttccagccccgtggtgaagacccttgaggaagaaatcgaagacctccgagcccaaaagggcggtattgaggaagaaatccagactctccaaaacaaaatcatggaagttggcggagttaggctgagaagtcaaaaggcgaaggttgaggggctgaaggaacagatcagtctcctcgcagaagaaatttctaatgcagaaatcggaaaatccaagaatgagaagctaatcatgaagcatcagaaggctcgtgcggaagcagaaagggagctggaacaggtcgcggaaggcctcgagaagctgaatgccgacgttgagaaccaagcaaatgacgcatcaggttggaagcagggagtggaagaggcacaagaggtaagagtgcaacagtcaccaatggtgagcagccggactaacacattacgcgcaggccttggagacgaatag

SEQ ID NO: 16203 - DNA, 303 bp, A.fumigatus
actatggcgtccgaatacatggatacggagttcatggtacaatcacgggtttcggttccctctctgtttacgtctctgtttactttcctgtctccttctttttcttctttttttctcacgttcctcatccacgcttctctacccgaatgtgtggacaagtcacaggtcaccctgggcggatacgtcttttttttttttatcttgattccccttcgctgtcttcttacttacatcgcttttactcccgcttttaatgttaattacgaaggaaggcagggattgccggcgcttggttcctcatga

SEQ ID NO: 16204 - DNA, 1446 bp, A.fumigatus
catttccatatcagtcgtggcttctgggtgctcatggaagctttcagtgtgagaaaagactcggtgctgacaatgccgctctaccagctctctttaacgcatttctgcgaagtgcatggtcccacctcgatcatttgttcgcaggtcctacccttttcatgctctcagtgctatcctgagacctccgatttctcgcccgacgatacccccgcaacttctcacgatacccagtcctctcatggcatgcgcaaccgcctcggcgacgccagggataccaaagcaacgaaacgcccagacgcatccggcgcaacagttggcaaatctcccaagattgaagattcgccatatttcctgaagaatcaaccaaactcgagcgaaccctccaagttgaacattctggggggagctgacggtgatacttgcgccagctgtagcttgactctccccgacgatgtgagtaggcagctgcccccgggcgctccaggcaccgcgagtcgcgacggcaagggaaggaatagtagcccagttttgcgatccagagaagttgtctactcttgcgggacgagtcattccgacggtgacgacagtgcgcatgatctgcacggccatgcctcccttccagattccatccactcgtcctccgtcgcctccgatgcttcgtgtcacactcacattctcacatatctatcactccggggccctccgaacccatcagattatgcactactccgccgctcctccatccgcactctcagctgcgagcttctccctcgcggcctgtcctcgggaccactgtgttttggtgatgcgactgcgggctatactatcgcttacgtcttccgcctgcccgatcccatggctcggggcaaaaggcgtagctatgcgcttgtcgcgttggccggcaaggatgcgggcagggccttccgcgcgtgcccggtaatatggcgtgcatttgggagaatcgcaaccggcatcgtcaattccgccgagaaataccaggaggaggaggcaaagcgtctcgaggaacagaatgacgcagcgaaccgggccaacaatcggcactacactcccgtctcgtccttcctcaccggccgcagagtcgatccggatggtcagccccgccggcttgggcagattcgggcgcggaacctctccgaaattgtgggcaatcagtatatcttcgccgaaatacatgcgcactttgttgctcttttgcaacagctcggctccatgtttggcgctgtgccaatttcggaagaacgattcatttgcagcacactaggcgacgacgtcgacgtaaaatcgcgacgcggtacgtcaatcgataacggaaaggactcgacatccaaaggcaagtcggagagtgactttggattatcgggtctggatttgtcttctggccctaagcccatccctatcgcggctcgtcgaactgtcattgcctaa

SEQ ID NO: 16205 - DNA, 240 bp, A.fumigatus
cttctcattcttggattttccgatttctgcattagaaatttcttctgcgaggagactgatctgttccttcagcccctcaaccttcgccttttgacttctcagcctaactccgccaacttccatgattttgttttggagagtctggatttcttcctcaataccgcccttttgggctcggaggtcttcgatttcttcctcaagggtcttcaccacggggctggaaggacccgcgctaggcga

SEQ ID NO: 16206 - DNA, 684 bp, A.fumigatus
ttgatccctacaggcgaatacatctacaaaggccgcaaattcaacgcgcgcaaagataccacagaccagaaatacctcaacatccccatctaccgcttctacatccgctgcacgcgctgcagcggcgaaattaccttcctgacggaccccaaggcaatggactacaaggcggaaaagggagcaaagcgcaactttgagccatggcgggacgccaagaatgatatcgaggagacggaacaggagacgctggaccggctggagcgcgaggagaatgaggagcaggagcggttggaacgggataagatggccgagctggaggagaagatgctcgattcgaagcgtgagatggcgatcgcggatgcactggatgagatccggacgcggaatgcgcggatcgagcgaaatgaggcgctcagtggtgacgtggcattagctcatgttcggaatgaggtagatgaggcgcggctgagggaggagaaagaaattgaggaggctgcccggagggcattcacaacggagacgggcgagaaggtgaagagacttgtggaagatgacacaatcgctgggacgacgccgggctcgagtcagacggaaacgccccctccgccctcattcgctagggttaagaagcccaaaaagcctctgtcttcaccgcggggttgcgaggagcgatctgagttaaga

SEQ ID NO: 16207 - DNA, 2163 bp, A.fumigatus
acggattcgtggaagagtaatagactaacgtgctctcaagacagcgattccgatgccttctggctcgcccaagtccatttctctaacaacaactacacgcgcgccttggccctcctctcccggaaagacctcatctcccgaagtaccgcttgccgctatctcgccggccattgctatataaaacaaaatcagtttgaccaggctttgtcagtgctcggcgaccataacccaactcatctgatccgcagcagcaacagccgtcgcaagctgcagcacctcactctgcgcaacggcaagactacagcatcgcggattgaccgcaacgaggagagggaaagggaggatgcgaataacatccggtttgaagcggcaatgtgctacctgcgaggcctctgttttgcaaagcagaatgcctttgatcgggcccgtgactgctacaaggacgcggtgcgcattgacgtccagtgctttgaggcttttgaccagttgatgaagaattcactcatgtcgccggctgaagagctcgaatttttggaatctctagattttgatgcggtatcctcacccgatccgtcggtcgcacaggaggcggctcatttcaccaagatgctctacacaacccgactgtcgaagtactcgtcgcctgccatcctgtccgacgcaaccgagaccctgtccacgcactacaaccttgcggagaaccctgatattctcctttctcgggctgaagctctttacacccagtgccggtttgcggaggcgctcgagctgacatcttcgatcttggccacggaggcaagcaccacacccaatgtcccggctctaagtcaccttgggcatcctccagcggtttaccctctgcatttggcctgtctgtacgaaaccggggcaacaaatgcgctttttctgctcgcccacacgctggccgaccatgcgccggaagagccgtacacataccttgcgattggcgtctactacctgtcagtgtcaaagattgccgaagcacggcggttcttctcgaaagcatccttgctggatccgcattccgcaccggcgtggatcgggtttgcgcatacttttgctgctgaaggcgagcatgatcaagcgatagccgcatacagtacggccgctcggctgtttcaaggcagccacttgccgcagctgttccttggtatgcagcatttagccttgaacaacatgtccttggcccatgagtatctgtctgcagcctacgcgatgtccacgggggcggctgctggcacggtgccgtccatccccgccaacccttccggcgacgcccatggcggtgacccgctggttctcaacgaactcggcgtcgtactctaccaccaaaaccatctcgagggcgctgtagagctattcaatcaatcgctggctttagcgacggcacttcattgtgagccgggtgcctgggtggctacacgcgcgaatttaggtcacgcactgcgccgtatcgggcgactagttgaggcgcttgctgagttcgacgaatgccttcggatcggcgcgggcggggcaggagtcgcctacggtccgtttttgggcggcagtggcagcagcgcctcgggtgtcgcatcgtcgggtgtcgggggctacgaagaccgtggcttgatcggatcccttcatacctcgcgtggccttgttctgctggaacttggacggaccatggaggcggtaacagctcttcatgaagctgttcgcgtccttggggcgagcggaggcggggatgcggctggcggcgcgggtattgctggcactcttctctcccgtgctttggagatctgggctctggagtgtcatgagggggactctgcaccgccagaggatcttgagcgagtgaccaccagccgcagttcgactcgttcgcgcgacaagggcaagggaaaggcatcaaggcggcgcggcatgacggaggaagaatggacggatgaagtcccgaccacgggccctgcaacggagacattggaacaaaaggtggagatggagctagatgacgaggcagatggtctactgcgacatgcaatgagtcgggttcgtggggggcgaggaagacgacgactagatttcagtcccgacgctgaggccactgagactcctggtccggcaggtgctcgtagtcgggggtccagagcccgttcgtga

SEQ ID NO: 16208 - DNA, 639 bp, A.fumigatus
attgagaaggaggttgcagacgaattccccgagaaccccatcctcagcggtgtcgtctacctcccaaccacccagaccagtcccggcgtcatcgactacccagaaatgctgaacctgattgaactgggaacttatcccgccaatgcacctcctacgcacaaagcagcggccagcaagcttgtcgaccttatgaatcaaggcggtggtgaggccaaacttcacgacgatatccaaatcgcgcggtggaccaagctgctcataaacgcgtcatggaatcctatctgcgcgctgagcatgtgctcggacggtgactttctcctgtcatccgagccctttgcattggagcttgtctggggcatcatgatggaaatcgtggcattggcgaagaagctggggatcccccaggtggacgaggaagcggccagggtgcggcttcagatagcaacacgtcgcgctaaagaagggactggccgcgatcccagtatgctacaggacgtcaaacagggtcggttatttgaagtcgaagcaattgttggaaacacagtgagactggctcgggaacatggcgtgagcatgccccggttggaaactgtgtacgcattggcaaagggaagatatgaagccctttcccgaaagtaa

SEQ ID NO: 16209 - DNA, 567 bp, A.fumigatus
gggactatactcacggaaccaccacgaatcacaatgtccactcccccaataacagacgagatctcaatccgcctcgcccatcaagacgacatcccacagctcaacattatcgaaacctccgcagcccagctcttccgcagagtccatctcgcctggatcgccgactccccgcccctcgatccggccaccctgcgctccatgatcgcgcagaagaacgtatgggccgccgtgacctcaaacaacacagccgtaggcttcatcgccgtgcaagatctagacgggatgctgtacattgccgagatggacgtccacgcagactggcagaggagggggatagcgcggatgatgcttgaggaggtggaagggcaggcgagagatagggggtatgagtatgtttctcttacgacgtatcgggatctggaatttaatggacggttctatgcgaggatggggtttgaggaggtggacgtggatgtcgctggggagggacatgcacgggagttggaggagcaggcaaggggtggacatgcgagggataggaggtgtgtgatgcggaagagagtgtag

SEQ ID NO: 16210 - DNA, 189 bp, A.fumigatus
acgcaaatgcagctgacatatccctctcgcatcttctccccgggcagattttctcgcgatcgcccccgtttcaccgacaatctcgatgttatcaagtttctctgcaaggatctgtggaccattcttttcaagaagcaagtggataatttgaaaacaaatcacagggttagtacacggaagcgagtctag

SEQ ID NO: 16211 - DNA, 393 bp, A.fumigatus
gtacgcgagcaaaccagggacaatgtcgagctgaaagtcgtccttaccccaactgtagcttcaagattgcaagctgatccaaatcttcgggtaatggtttattgcgcagcggacagtggcctcaatcaatataccaagtccgatatcgctttccctcaccaagttgagctcaaagcgaatctggacgaggtcaaggctaatctgaaagggctcaagaataagcctggtacaacaaggcccgcggatgtgacgaattatatccgcaaaaagcctgggtatcccaatcatattgttatgacttatgcgcttacgcaaaaggcaagccgtccctttcagacccacctatgctcagctcattccatcatgtcaatgcccattatatattcttcctga

SEQ ID NO: 16212 - DNA, 237 bp, A.fumigatus
ttcgcagtgaagaatagagcggaggattccgacatcgttgccacctccactgtcatgtccctgaaatgccctctttccacgctgcggatcgaggtcccctgtcgcactgtcgtctgcacgcataaccagtgttttgatgcatcgtcgttcttacagttgcaggaacaagcgcctacatggtcgtgtccagtttgttccaaggccaccagttatgaatcattgcaaattgaccagtaa

SEQ ID NO: 16213 - DNA, 753 bp, A.fumigatus
ctcagtgagcgagaagcggaacgtgacctggagcagcaagaaattgacaatgctgtgcccttgacagaggaagaacaggcggaaaaggcccggatgtccgaagaaggtttcgcgacatggaatcgccgggacttccagcagttcatcaacgggtctgccaagttcggccgtactgattatgaagggattgctactgaagtggacagcaaagatgcagctgaagtggaagaatacgctaaagtcttctggaagcgctacaccgaaatccaagactaccccaagtatatccgtatcatcgagcagggtgaagagaagctccgaaaaatgagccatcaacgcaagatgcttcgcaaaaaaatggaaatgtaccgcgttcctctgcagcagctcaagatcaactacacagtgtctaccaccaacaagaaggtttacacagaagaagaagacagatttctgcttgtgatgctggacaaatatggagtcgatggcgagggcctttacgagaagattcgcgatgagattcgcgagtcgccccttttccgtttcgattggttctttctcagccgcacaccagtggagattggccgtcgctgcactacgctattgaacactgtcgctaaagagtttgaggttggagcgaatggcgaagccggcaagggacgggggcgtgatcgtgaggaagaggatgaagagaacgaggaagtcggcgcaccagccaagaagaagagcaaaaatggcgcagtggtaagttaa

SEQ ID NO: 16214 - DNA, 2283 bp, A.fumigatus
gaagacgactctatccgaagatttcgttatctccttggcctcaccgatttgttccgccacttcatcgaaaccaaccccaacccccgaatcaaggagatcatggcggagattgaccgacagaacgctgaagaagacgctaaggctaagaagaaagggtcttcacgaacaggaggcgcaggaaatgatagacgtcgccgaaccgaacaagaggaagatgccgagctgctgaaagacgagaaaactggtgccggtactgctacggtcttccgggaatcccctcccttcatccagggcgaaatgcgcgattaccagattgcaggattgaattggctggtctctctacacgagaacggcatttctggtatacttgctgatgaaatgggtctgggtaagacactacagaccatctccttccttgggtatttgcgacatgtctgtggtatcactggacctcatcttgtcgcggttcccaagtccaccctcgataactggaagcgtgaatttcacaaatggacaccagatgtcaatgtccttgtgctccagggtgacaaggaggaacgccataaactcatcaatgagcgactccttgacgaagatttcgatgtttgcgtcaccagctacgagatggttctcagagagaaggcgcaccttaagaaattcgcatgggagtatattatcatcgacgaggcgcatcgcatcaagaatgaagaatcctcactagcccagattattcgtgtattcaattcgcgcaatcggctgttgatcaccggtacaccgcttcagaacaatctccatgagctttgggctcttctgaacttcctattaccggatgtgttcggcgactcggaagctttcgatcaatggttctccagtcaagacgccgaccaagataccgttgtacagcagttgcaccgcgttctgcggcccttccttctccgtcgtgtgaaaagtgacgttgaaaaaagcttgctgccaaagaaagaagtcaacctctatgtgcctatgtcggaaatgcaggtcaagtggtaccaaaaaatccttgagaaagatattgatgcggtcaatggcgctgccgggaaacgcgaatcaaaaacgcgcttgttgaatatcgtcatgcaactgcgcaaatgttgcaatcatccgtatctttttgaaggcgccgaacccggtcctccttatacgactgacgagcatctcgtgtataattccggcaaaatggtcattttggacaagctccttgcacgcatgcagaagcaaggaagtcgagttctcatcttctcgcagatgagtcgcgtgctcgatattctggaagattactgtgtttttagagactacaaatactgccggatagacggtacaacggcgcatgaagaccgaatcgccgccatcgacgagtacaataaaccgggttcagataaattcatcttcctgcttacaacaagagcaggagggctgggtatcaacctgacaactgcagatattgtcgttctttacgatagtgattggaatcctcaggctgatctgcaagcgatggaccgtgcccatcgtatcggtcagactaagcaagtcgtggtgtttagatttgttacagaaaatgctattgaggaaaaggtcctggagcgagccgcgcagaaactgcgcttggatcaacttgtcattcaacaaggccgtgctcagcaacaagtcaagaacgcagcttccaaggatgagctgcttggcatgatccagcacggagccgcaaacgttttcaacacaaaaggtgcaactggtgcattgtctaatgacaagcagttgtctgatgatgatatcgatgctatcttgcgcaagggtgaagagcggactgctgaactcaacaagaagtacgagaagttgggtatcgatgatctgcagaaattcagctctgagagcgcatatgaatggaacggccaggatttcacagaaaagaagaaagatattggtattaactggatcaacccagcaaagcgggagcgaaaggagcagttttactccatcgacaagtactaccgtcaggcgctagccaccggcggaaggacggcggaaacaaagcctaaggtccacgcgcgccgaagccggaaatatcctacccatgatggcaattcttcccaccggggcttcaagaacttcaagagaaggaaacagcttacttccataaagaaattgggtacaaagcacagcttcctgagggccctgaagaatagctcagtgagcgagaagcggaacgtgacctggagcagcaagaaattgacaatgctgtgcccttga

SEQ ID NO: 16215 - DNA, 624 bp, A.fumigatus
cgcctgacggtagtacttgtcgatggagtaaaactgctcctttcgctcccgctttgctgggttgatccagttaataccaatatctttcttcttttctgtgaaatcctggccgttccattcatatgcgctctcagagctgaatttctgcagatcatcgatacccaacttctcgtacttcttgttgagttcagcagtccgctcttcacccttgcgcaagatagcatcgatatcatcatcagacaactgcttgtcattagacaatgcaccagttgcaccttttgtgttgaaaacgtttgcggctccgtgctggatcatgccaagcagctcatccttggaagctgcgttcttgacttgttgctgagcacggccttgttgaatgacaagttgatccaagcgcagtttctgcgcggctcgctccaggaccttttcctcaatagcattttctgtaacaaatctaaacaccacgacttgcttagtctgaccgatacgatgggcacggtccatcgcttgcagatcagcctgaggattccaatcactatcgtaaagaacgacaatatctgcagttgtcaggttgatacccagccctcctgctcttgttgtaagcaggaagatgaatttatctga

SEQ ID NO: 16216 - DNA, 216 bp, A.fumigatus
cgccggatctggcagctaacttccaccctagcttttatcagcattatctccgcggtgattatttgtatgatcggcgtaattataaagcatccgggtggaaaggtcatggcaactgtcgacacggacttggtccatgggttctctgccgtcactaacatcgtctttgctttctgtgagttcctgtcttttgtagaactcgaactccaacccgactaa

SEQ ID NO: 16217 - DNA, 297 bp, A.fumigatus
atcattggagcattgcagcatttctattcttttgtattatacaccaagcttggtattttgctgtttgggtttacgaagaagttgctagaccaggggaaaacgcccatcatgattcagagtgtcaatgatcctcctctatccaaccccgagaatttacaagagaagggcattgctagccgggatgcatctttggccgaagacgagaagaagtatgccgctacgcttgcttacaggcaagatgcttttggcgatgagtcgaatgcggaggtcaaatataaagtcatgaagtggtggtag

SEQ ID NO: 16218 - DNA, 291 bp, A.fumigatus
aactcgaactccaacccgactaactggcacgcagccgggcacgcagcctatttcggtctcatggctgaattgaaagatcctcgcgacttccccaaggccttgatgctgctgcagagcgtcgatgtctgcctttacatcatcgccgccatcgtcatctacgtctacggaggtgacgagattgcttcaccagcactagggtccgcggatccgctaatctccaaggttgcctacggcatcgccttgcctactgtaggtccacaccggcatttgaaaacatgtctccagtactaa

SEQ ID NO: 16219 - DNA, 243 bp, A.fumigatus
ctcgttcatcttcagactgccctcttcgcttcctggttcacgtacgggctcagcggtattttctggctctacctcaaccggggccagtacttgtcctccccgcgcaagatgtttctgacgatcgtcaatctcttctgcctggtctttggcgccgtgctttgtggtctgggcttgtacgtctccggaaaggcgatccatgataaccccagcagtatgagcttctcgtgcgctaataatgcttaa

SEQ ID NO: 16220 - DNA, 525 bp, A.fumigatus
atcttcttttgctttagttctgtcattcttttggtcagtctcggtatcatcgcaacgtacacgggatatgttcttgggcaattcaagctacagtacccgtgggtacataacatgggtctggccggtgaggtggtctttggcagctggggccgcgagattcttggagcagcccagatgctattgctcgtcttcattatggctagtcatattctcacctttgttattgccatgaacacgctcacggatcacgggacctgttcaattgtgtttggtgttgcgggcttgattgtttccttcatattgtccttgccgcggactctggcgaagatgtcctggctctctctagtttgtaagatgacctgctgtttgacgccggatctggcagctaacttccaccctagcttttatcagcattatctccgcggtgattatttgtatgatcggcgtaattataaagcatccgggtggaaaggtcatggcaactgtcgacacggacttggtccatgggttctctgccgtcactaa

SEQ ID NO: 16221 - DNA, 1014 bp, A.fumigatus
  unsure (143),(157): Identity of nucleotide sequences at the above locations are unknown.
gacttgacgaagcctctgaccatacattcttctactccggactcgaagtccccggttgggacccttctgttgaagctcaatgactgcgaaaagatatctctgccgaaacaagagccagagccgagatcagacgcggcgcccgnagatgtcaaagagnaagaccctctcaatgacggatactatttccgcgcccaccggagaatggagcgccaggagaacaagctccgaaacatcgagcgcgaacgcgcccagcatgagaagatgcagctggagcgtctattagacgagctcaaaggtcacgactggctccgtgtcatgggtattactggcgtgcacgagcacgagaagaagctctacgaacccaaacgcgactatttcatgaaagaaatcgcaagcctgatcgagaaattccaaatctggaaagaagaagagaaacgccggaagctcgataaggacaagccctcgcgccgcgccgagatatcaccgtccaccgctcccacgaacagagaccacactacctcccagaagcggaaacgtagtgatcgcaccccagatactaccgccgaacgcccaacccacaacggcgccgccaccgccgacggcgaaagcgacggcgaacccccagacccaagcgacgtggacgcctgggccgcgcatcaactccagcaggaagcccgctccgcaacagccggcaaacggcccaagtcatcgaccgaggccccacgacgtcgcaaatcctccgccaacaaatcctccaccgcaccgcccgctgtcgcaaaaccagcaacccctccccctcccgataaacccttcacctcattctacgcaaagcctcatctgcgcgaggctgcgctctcgccacaccgcaagggccgcgtccgcctggcgttcggccaccccatccccaagatggaggtgcgcgaattccagccgcctgcggatatcctgacgcccgaggcaattgactcctgccgcaggaagcggagacggatgagaagggaaagtcgcggctga

SEQ ID NO: 16222 - DNA, 549 bp, A.fumigatus
tcgagaaattccaaatctggaaagaagaagagaaacgccggaagctcgataaggacaagccctcgcgccgcgccgagatatcaccgtccaccgctcccacgaacagagaccacactacctcccagaagcggaaacgtagtgatcgcaccccagatactaccgccgaacgcccaacccacaacggcgccgccaccgccgacggcgaaagcgacggcgaacccccagacccaagcgacgtggacgcctgggccgcgcatcaactccagcaggaagcccgctccgcaacagccggcaaacggcccaagtcatcgaccgaggccccacgacgtcgcaaatcctccgccaacaaatcctccaccgcaccgcccgctgtcgcaaaaccagcaacccctccccctcccgataaacccttcacctcattctacgcaaagcctcatctgcgcgaggctgcgctctcgccacaccgcaagggccgcgtccgcctggcgttcggccaccccatccccaagatggaggtgcgcgaattccagccgcctgcggatatcctga

SEQ ID NO: 16223 - DNA, 5025 bp, A.fumigatus
  unsure (257): Identity of nucleotide sequences at the above locations are unknown.
tggttccaccggccaaccccaagggcgaacaattccatcaccctggcagccaacggttcaatagagtcccacgaaacagccatcccgttacttggaccttcggatgcgaattcccgtggtatcaaattcggttcgccaacgttgaacctttctttgatggaaatattgtcaacgctgagtagcggcggaactctttgctcggcatcgcggaggctgacgcttactgaccttggaggaacaatcaacgaggcaagagntcccgtgatgatggcaacccgtagcttagcagcactcattcggcccgcacagttgaacacccttcaatatttgtggacaatgggagaaaagctcaatcggacagtcatcgaaaacttcactcaaaaggcgcacagtaacgatctgaatggggactctgttccagcattaaggttgttagtcaacgcatatggtcccaccgaagcagccattaactgcacattcttcgcaccggtcgagtatcatacccgtgggtcaatcattggcgagccactgcccacatgctcaatatttgtcctggatccagcatcccatacccccaaacctattccagctggtcttgctggagaacttgcaattggaggacctcaggtcagccaaggctacttgaatcgcccggaagaaaccgccaactcctttgtccatagccctgagtacggatacctctaccgaacaggggacttggctcgcattgtctgggacgagaaaggagcacaagtcatcgagttccttgggagaatcacatctgaccaggtgaagatcagcggtcgtcgagttgagttgggggagatcgagtctgtccttgccacgttgactggagtgagagaggtcgtggcggtagtccccaagcgtgatgcatcggtacaaggcagtgagcaaattgtagcatgcattgtggcggactcacttagtgaagacacagcaccggaatttgtacggttagctgatgaatgtgcacatcgtcatcttgctgcatatatgtgtccgtcttcctatgtcttctttgactcaatcccgcgaacaagctctggtaaggtcgaccgtaattctatcagcagcatgctgcaacaaggcaaagatagcggcatgaagttctacatgccctcgaacgacgttccagaagcgcggggcatggcgcgggccgaatgggacccccttgaggatgagaaagctctggagctacgtaccctagtcctcgatctcgtcgcacagaccactggccaggatatctctgtgatcaaacccaacacgagcctttacacactgggattggactcgctgggctcgatgcagtttttacagaagctgagagataaatccctccacaatttatctgtcggtgatgtactacagtcaaataccgttaacgggctactcacactcatcctgaatggtaaaacgaatctaagaggacttaccaatggacagcttgcggatgattcacgtatgtccctggcagagcacctgcaagcattcaacgacacgaacctatcaagatgtgcgaaaaggcttagcatcagccccgagagaatccagacagtcctgcccaccacagaaacgcagtctggtatgctaacgagcttcttacgtacctcaaccgatagctcgtttgctactcggtcttacatctatcattctgtgatttcgctcgagcctcatgtggacattgagcggctcaagaaagcctgggagtccgtgattgcaagttatgattccttccgaacaaggttctgctggattgatgatgacatggctccttttgcgcaatgtatcctcaaagaagatgcagcgtctgcaccgatgtgggctattaatcatactttcggggattccatgcatgaagattccctgaccagggcgcttcgagaagccgaaaacacaatttcccttgactccccatggaaactatcattactcgagtcttcaggtgacaaggtcatcatattgagcatgttccatggtatattcgatgggggttcgctgcaacttcttttggaagatgtttcttccgtttatgatggacagctgccagcacccagaacgtcgttagagcatgttgttgtaaaccattttcaggcgaaccaaacagcaacatcgaacttttggaaggaatatctcaacaaatattcgccaattgctttcccttcacttaccgcctacagacctccagctgtcaacgctaccggctgtgtcgaaatcactcctcgcacgacccatgacattcttaagcagcaatccagaacaatcgggtccacaccactttctgtcctccaagcagcctgggcctctcttttactcgcgtatactggcacgcaagatcatgacgtggtcatgggaagtgtgatatctggacgttttgatcccgactccgaaatctgtattggtccgactttcacgacgattcctaccaggttggcgcttggccaggttcccaaagccgggggattctggacaaacaaatctgtcgtcaatcatttagcgagtctgaacgcaaaagccctatcccatctacaaccgcgtcttggctcgttagtcactgctgatagtaaacttccctatgacacggttcttgcctaccaggacttcagcgccggctccagcaccagtagtatatggaagtcaattgatcatcccccaatggcgaacgattacgctgtgatgatcgaagtttggcctgccagggactcgtcattgaccctgcgcgcaagcttcgctctctctcagatggaccgcgacggggctaaggtgatgcttcatcaattggacgacatcattgcatttattcttcagaatccggacggagatttcgagaatgctctgttatatacccgtcctgatctcaaggcatcatacaacccaatgcccaaggaggcagatgaagtttcggatggagatcttatacataccaagtttgagaatcatgcaaattcacatccagacgacatggcgcttctattcaagtatgacctcgaagatgacggaaatctacagaacatttcatggacgtacggggagctcaatgcacgagctgataatttggcagcatatctttgcgagacgtacgacaagttgacaaacaaagtagtacccatttgtatcgagaagagtccggcgatgtatattgcaattctgggtattctcaaagctggcggcgcatggtgccccattgacacattttcccccgcacagcgtcggcacgatctaatcaaacgaactggagctggagtactccttgtctccagtgaggatggagagcaacctaaggatgccattcccatcggtatcgacgtcgtcgatgttaaaaaatatgctgatcccctggtgagttggccgagtgtcggcagatggagctccaagaaactgtcgagtccggcgggccttgcatacctgatttggacaagtggaaccactggtgctcctaagggtgtgcctatcacgcactcggctgctgtgtcctgtttcaggtcgctcaagaaggacataccatccgacgtttctggcggtgttgtgcgatgcttgcagttctctcagtacacattcgatgtgtctattcaggacctcttctatacatggagcctgggaggggtgctcatctctgcaactagagagatcatgcttggctcgttcgcaaagctggcgaataccacacgagcaacccatgcgcatctgacaccagccttcgctgctggtgtgccgaggaatagttgtgaaacgctggaggtaattaccatgattggagagaagctaacacagcatgttgctgacgactggggcactgatatgcgagcgtacaacacatatggccccgcagaagtgacaatcgtctcaactgtccgagaatttgggaacgactgcttgaacattaagagcgccaatgttggctggcccatggaaagcgtctcggttttcgtcacaagaaataagcaaattgtgatgaaaaacgcagtgggggagttggcgctgggtggtccccaactttctccgggatacttggatcaagaggatgtcaccaaagcgaagtacgtttggagcgaagaagctggacagattctatactatacgggagatcttgttcggatgcttgcagacgggtcgttagagttcatgaaccgtgttgatgacttagtaaaaattggtggaattcggattgaattgagcgaaatcagcttcgcgctgggtggttgccacccactggtcgagaatatcgagacgctctatattgaccgcccagatcggccgagcaaggtccttgttgctttcctctctgcctcgaatgcgactggagccgatgccggtgatgatcttctactactcaacgattctgctctgcagattgctctctccacacgcgagaaggcgcatacggctctcccagcttatatggttccgtctgtatacctcgtgatgaagcgcattcctcgcacgcaatccgctaagacagatcgtcgcgcgctgcaagctgcatatgcttcggtggatattgaggactgggagaatcggatgaatcctgaaaacaatgctacaggccacccgacagacgacctagtggcatccgatgcaatggaaaagattgtgcatatgatagcctcccttatcaacatttcaccttctattgtagctaaagcgagcaggcttagaagtctaggtattgactctatccacgcaattcgtctcgcatcaagactcaaagaggccgggtatcgactgtctttcattgaagtcatcaactgtgtcacagtgcaggatttggcccgattatgcacatcctcttccgaggttgatgcattgccggctgccgagtttgatattaacctcttcaatgatcagtggcacgacatcgtggcctcgaaagttgacggcgaattcttcaccgtgagagcaacgccgatccaggagagcctgctgagtgagacaatgggtacttatcacctgtactcgagtaatcactttgttccaccacgggcctggaaggatccgcgaattgcgtat

SEQ ID NO: 16224 - DNA, 1458 bp, A.fumigatus
attgctttcttccagccggcgttaagagccgatatcgattcgctggcaggatttggagggcgaaacagtcggaacgagtttttaaagccgatcagcaggatctcgacgcaggggtcggcccaattccgccatactccccttccgggaatctttggctcgattccattaccggctgccttggtcgcaggcctttgggcgtgtcgcaacgtcgcgtatcagagactgaagctgcgggctcacgtgcgcggtgtcttcaccggcgaatgtctggtgggcctgctggacgtaatcagtgcgctgctagctctgtctactgttgggtatttcgcatttgttgcgaaaccatggtggctgacaaactttctgggtttcagcttctgttacggcgcgctgcagttcatgtcaccatcaacgttcaaaactgggtcacttattctgggctcgttgtttctctatgatatctactttgttttttataccccgttaatggtgacagtcgctacaaaactagatgtaccaatcaagcttttgtttccccggccacctgctcctggtgaagccccggatgttgtttccttggcgatgctgggcctgggggacattgtcattcccggtatgatggtgggactggcgctccgatttgatctgtgtctctactacagaaagaagggtatcgaaaaagcgcggctcgaatccaaggggcaggatatcatcaagccccaataccagtgtgcaaccggcggctggggtgaacgtttctgggcttggcccgtggcacctcgtggacatgagctagagccgccgtatagggatgcaaagtcctttcccaaaccttatttcaaggccagcttgtttgggtacattgtcggaatgatatcgacccttgcggccatgcaatactccaaccatgctcaacccgctcttctttatctagttcccggagttctttctttcctgtggggaactgcgctcctcagaggagaactccgtgagatgtgggagttctctgatgccgaggaaagcgacgaggagggtatgaatgagaaggaggaaaagaagggagatgaagctcaagctaagaacacaaagagtctccttatgcgaatcctgtcgggcgatatcaaagcagtatactctgaagagccagaaggtgccacggagaaaaaggaggagaggaaatccgaaagtatggagaccaaggattcagcgcaagctgatggaggatcagatgacaaatcacaaggtgcagacgaggggaaggaattggacttggtttcaatatccatctcgctgcccaggaaaggcaagaccagatcaggtaaaacccagactaacagggttgagttacccacaagcaagaagagcttgtctgtcccgagtgcagcgaatcgtgatgacgagccaccggccaagagacagcgaagaagtcctagaatcgccgaagccagtgcctcttag

SEQ ID NO: 16225 - DNA, 1251 bp, A.fumigatus
ttcagctatactagaatggctcccgctgcagcatcgacagctgcaccgtcagctccgccatccctctcactgccaccgtctcaatttgcgcggctccaacctcacgcctacctccttgcccatctatcacctcctccctcaagcaatcagccctctattcgagccaatggccgtgctacctcacagttccgcgttacttctgcgaacacgggctctttaacacatacgaacggcagtgccgtggtaagaattggcgacactgcggcggtctgcggggttcgcgctgaaattcttcataccgatgacattgcctcgtggagtgtatcgcgagcatcggcacctgcttctataaacaaacggcggaaattaattgataccactgagaagccgactgtgacagccaatgatgacaacgatgacgaggacgacgaatcccatatccaagatcttaatttgctcgtgccgaacctttcactcagcactggctgcgcacctggatttatccctggcgctccaccctcggcgctggcgcagtcgctgtcacatcaaattttatcactcctacatagcacccgcttagtgcgcgcagaagatctgcgaatttggtatcagccgccgaactggggagcagaggagttggaacggcataatgaggatgagcagatggatgtggatgctcaagagggcgatacaagtgccaagagccgagaaatcaaagcgttctgggtgctgtacatagatgtgatgatcatctcgttagcgggcaatcctttcgatgctgcgtgggccgctgttctggcggcgcttcgggatacgaaattgcccaaggcatggtgggacgtcgataacgagatggtggtgtgctcagaagctgtttctgaggcgcacaaactgtctttgcgaggtatgcctgtcgccagctcgttctgcgtcttcgaggcagatgcagcttctgggtggagaaaggtcattattcctgatgctgaagaagagaggaagattgaggaaagtgacaggaaaggcatccagcgaaggtggattctcgctgaccccgatggatatgaggagagtttgagccaggagaggatttgtatcgtggtcgacaaagagaacggggaacaagggaaaacggtgattgtgaaaatggagaagaacggcggatgggcagcggacactagagagctgaagcagctggttgacatctccgcgcaacgatgggatgatatgaaacggatccttgatagctgctga

SEQ ID NO: 16226 - DNA, 189 bp, A.fumigatus
attgacgaatgctctctgattgctattcagccttcaccaactacatacggattggatgcactccctcacaagtctgcacgtaagtttgctgcatgctacgaagccgtctacatttggtcttctaagttatgtcactctgctcactgtacgaagatcctctggaaccgatgggtcctcaggggaagatag

SEQ ID NO: 16227 - DNA, 282 bp, A.fumigatus
ccgagcacatgccccgagcaaaagaagacttttacccggaagaggtacgccccaagcaacgtttattccaaatctctattgactcatcagatcgaaaccggcaacaccgaagcctcactgatcgccaacgaagccgcatactttgcagaggccgtccggctacgcgagaaatatgcagaccagatccagatcctcattgggttcgagattgactggattcggcccgagtcgcggactttgagtcttcaccccgggggaccgaaggaaccgcgctatgcgtat

SEQ ID NO: 16228 - DNA, 198 bp, A.fumigatus
ctcgccatgggcgtcatgggcaccctgttcggtggtatctacctctccactcgcggtggtggtcagaagaagcaggctactcctcccatccaggcctcttccaaggacgaggagaagttcatccagtatgtttgcgtccactctagacatttgttgtccaacgttgctgtgccaatgacccccagcgatctccaatga

SEQ ID NO: 16229 - DNA, 372 bp, A.fumigatus
gtgacctgtcttctatcacacgctctcctcaagacctgcgcagccatgccgttctcacaccacagccattcgggccagttctgccccggacatgccaaagactcactagaagagattatcaaattagccatctcaaaaaagttcaaagtcttctgtctgaccgagcacatgccccgagcaaaagaagacttttacccggaagaggtacgccccaagcaacgtttattccaaatctctattgactcatcagatcgaaaccggcaacaccgaagcctcactgatcgccaacgaagccgcatactttgcagaggccgtccggctacgcgagaaatatgcagaccagatccagatcctcattgggttcgagattga

SEQ ID NO: 16230 - DNA, 369 bp, A.fumigatus
acgacaatagtgttcaacagcgatgactattgggtatatgaacgattgaagcggtacgcgacgagaatggaagtcatcccagtctgcgaccttccgaaaagccaggcaatggcggcgctcaagagataccgtaagcagtactttaacgaggacctatcagatcaatcccttcagaccatctacgacaaagtcggcgggcgattgtcgtttttgaatcgcgtcgccaaggctagggactacatgaaactctgtgacagcatttgcgaagcggaaaagacatggttcctcaacaagtgctggatcctcggtgaagaaatggacgatgatgttatggaccagcagaaatatgcggtacgtctacaactttga

SEQ ID NO: 16231 - DNA, 234 bp, A.fumigatus
gctttccttgcgtcggtcacaatgcctttgtggattttaagcgctgatgctcctgcgactacaggccgtgacgtcttgtcgtttactttcctcgctcatctgccgaactactctctattgtggtccttctatggcatccgaccaaccaccattctgggatcatatggcattactttaatttcaacggcgatcccgttcattcttctccgccgcccctcctccggtccacaatct

SEQ ID NO: 16232 - DNA, 495 bp, A.fumigatus
cagaaagattataggatagcgggatactcttaccatcggtattacaagtacctaatattgcagaagatggacaatgctttcagtcctggtgatccggcacttgaggttgcaggtgtggaatatggaaagcatcattaccatcacgacgagcactgggttgtccgtgatgagcaggagaaactcgacaggatcattcagggaagatccggtggccactactacctcatcattggcgagaagggtacgggaaagacttctatgctccttgaggcgatgcgaaagaccaatggagatggcgttgccatgtttgaagcgcacggtgacctcgagatcttccgaatccggctcgggaaggccctggactttgagttccacgaagagtatgtgcctgctgcaactttatattcatcagagcaattgcttatagaatttctacagttatatcggaagtctgttcagcatcagaggtccacgagacaccactgccctgcttga

SEQ ID NO: 16233 - DNA, 474 bp, A.fumigatus
ccgatccgcctgccttggctgacacgaaaacagtccgccgcaatggtgctggccaaagcactcgtggacaaagaaaaggagatggaacagacttatgaccccgagaagggccatataataccagagatccccctccatgaggctcgccagatcatgaccagagccgacttcattcagagctacgatcatgagaacatctttaccattgactcgcgcggtatggttcgagctgattctgtccctatgcagaacgcattccgggaaatctgctcatggccaggtttcgaggaacatctggaagcgaccctcaaacggattggagacattgagagcttgggacgaacccgcgagcttacgcttaaggatctctgggacaagggcaaataccagattaccatgcgggatcccaagggtcgcgaaaatggtactgttgagttctcagtcaaggaacgagaggagggggatgatgattga

SEQ ID NO: 16234 - DNA, 183 bp, A.fumigatus
atgcttcgattccacaacatcttcagagggtatctctcaggcacagcgcatccgaagaacaaaaacagaaataatgaccaaattcaagacgaggacctctacaaaacgatgaagcgatcatttaccgtcagctgctatgccagcgagatgacgcagcagattctgaagtatcagaacaactaa

SEQ ID NO: 16235 - DNA, 636 bp, A.fumigatus
ttttaccgtcttcaggtgtcaagccaagagcaggttcaggatgtccgccaatcgatcgttgagttgcccagcaccttccagtacacttgcttccacctcgaattcaacggcaagcgcatcaatgacttcgttgaattgtctgaggttgaaggcctcaaggccgattccgagatcgtcctcgtggaggatccttacacggaaaaggaagctcggatgcatgtggtcagattcagggacttggttggtgctgcaggtgaccgttcagacaatctgcacggtctcaacgccggtctgtcgctgcacgatgctgttaccgccgaggccgctaccgatgatgtgaaggagcactctttgtccaagtacgacatcgccgcttctccctctctggagactatcctccccagagccgaggcccctcttcccaagactgtcaagtcgatttcgctatcagcatggaaccctcctccttatcaccttcggcaaaagggtcacctgctctaccttcaggttaccaccaacgagggcgagcagttccagattacctctcatgtttctggcttctatgtcaacaagtgctcgaatcacaagtttgatcctctccccagtaatgccgtgcgatctcaaggagccgtcagt

SEQ ID NO: 16236 - DNA, 207 bp, A.fumigatus
aacaacaacaatgataacaatacatacatggacatgttaaaagtatggagtgaactgagcaacctcatctacaaactagctatgaactcctcactttgctggttctacctgtatgatcctcgtccccagcttcattttgctggggtacagaaggagggtagccgtctatcgagtcagaagggattaagagcatcaggaggaaaatga

SEQ ID NO: 16237 - DNA, 369 bp, A.fumigatus
gcagctaatctgaaaacttacattgaagaaaccagccaaagacatgaagttaagactggctggaacattttcaatgacaaatgcgcggctacgtctgtcgttgtcaaaatttccggcgaatatgccagttgggcagcctttttgagtgattggagcacggccaataggcccataattcggcaggccctgctcatatactcctcccggtccgtttctggctccgcagatttcaacgttagcttgagcgttcaaggagccgatttccgaacggccgcgaacttggatatcactggcagcactgccggctatcccaataggggtgaagcttgctgcatgtggggacagctgcccgctattagatgtgtttag

SEQ ID NO: 16238 - DNA, 1014 bp, A.fumigatus
atcatcatctctccatcggacacggattatattgatcaattgatcccatcaataagggagtatagtgtcagcaatcgaacgtctcaattattgcagtccctgtccaagttcgccagcgatcaagaagccgagatagaaccaatatgcaacacaaaccatcaggaatttgtatcttcaatcaatcaccttctgcgtatcagggaaggaacagtgagcttgaccgcggagatccttgacctgaatcaatctatccaagctagcaccgaacgtctcgccgaacaaaagaaggctctggtagagtcgcgcagtcaccgacagaatattgatgagacgtctcgtgccatccaggactgcttggaggttctacgcctggctaatcaagttcatgatctactagccaagaaaaaccactacgcggctttacgggcgctcgaggaactccaaaatgtgcaccttaaggacgtgacccaatataaaattgccgacatgattcaacgctcagtaccagcgacccagcgagcgatagcggaagccgtgctatctgacctgaatacttggctctacagaatccgcgagatgtctcagtttctcggagaaatagctctctaccatacagaatgccggaagacaagactaaaggagagggcagagaaactaccatacctcagacatttcaaactgaactctgctattgagctggtttcggatgagcacgaagaatttgatttattacagaatgaggaactgcaagttgacttcacccccctttttgagtgtttacatatccatcaatcactggggcagatggacaagtttcggacggaatacgctaatacccgtcgccgacaaaaagagcttctaattccctccacgataactttggttgatgaggacggagcctccctacacaaccttctagaagaaatggcaggctttgctatcgtagagcgtgctaccatgaagagagtgccagacttgaggtcatctgtcgacgtagagtcacccttctcctga

SEQ ID NO: 16239 - DNA, 1431 bp, A.fumigatus
agaggagaaggggagcatcccgaatgggagattgattcctcgccatatgaatcgtcatctgacgattccaccaccgattcctccgatgatagcgatgacgaagacgatgactatccgatcctctccgccgaagaaacggcgcggattttgatgatggcagaaaatggttctgatgacgagggagaaggaaagggtagatccggcggcaccctgaggaccgcaaacgaaataccggaggaagcccctccaatcccagaaatcactgtcacgcctgatatgaagatcgtacatctgggacatgtggaatccatcgttgaaaacaccattcttatcgcagccaacatttccggagaataccaagtgctcgagtcaggttctctgctctgtcttgaagatcgaacagttgctggcgttgtatctgagactttgggacgggttgagaaaccattgtatgcggttcgatttcccaacgctgccgcgattgaggagcgtggtctctccaagggaaagaatgtgtactacgttgaggagcattcgacattcgtcttcactcagcctctgaaaggattgaagggaagcgatgcatcgaacttccatgacgaagaagttggcgaggatgagatagaattctccgatgacgaagcagaggccgagtataagcggagattgaagcagaagcgacaggagcgcaaggaagccaggaacgaaaacggcgggccgtctaggggcaggagaggaccgcccggtccttcgaaactcagccagaccgagctcaactacgacgattccccgacagcggaagacggctacactccacttgcccgcccgaagaatctgcatgaaatgatgagtcaacaagaggcgcctgttgagggcgagggatcttcgagaaacccagccttccgtggtggcaggggtcggggtagaggctctgaccgtggacgaggcaatcgtggccgtggtgcaggaggctcaagagaaactcgtgagcatagctcacaccacgaccgttcgtcttattctcagcagccgagaccgttcgatgcccaggctcaaccctcaaactacagccagcagccgagctatcctccggctcagcagaatgtctatgggatgcctcagcaatttgctccgttccaaccttttgctcagcagcctcagcaggcatttcctcaaagcgcctcgccgacgcaattcaacttccaaatgccattccaacaagcttatcagccgccgaacctctaccaaaacttccctgccatcaaccctctgtttctagcagcaatgcaacagcagcagcagccacaacgacatacgtctgaacagtctcaggtgcagaatcctacaatgaatttcgatcaggtcaaggctcagttggatctcttgcggcacctgagtaacgcgaatcaagggccgccaggcccacaataa

SEQ ID NO: 16240 - DNA, 885 bp, A.fumigatus
gcgctgttcttccagcgcctggtgaagacatctatcatcactctctacgtccagcatccggttctgctcgagcctcctcaagagaagcatatgcctggacaaaagccgatgtatcttacaccgaaggaacaggcaaagatccggcgtcagcgacgaatggccgatctcaaggagcaacaagcgaagatccgattgggtctcgaaccggcccctccgccaaaagtcaagaaatcaaatctcatgcgggttctgggcgaagaggctgtcaaggaccctactgccgtcgaggcgcgtgtgaaccgagagattgcagagcgtcgcgaaaagcacgaggctacaaatgaggctcgaaaattaacaaaggagcaaaggcgagagaaaattgccaagcaacaggagaaagatgctgaaatgggtatttatgtctccgtataccgaattgacagtcttgcaaacggacgccatcgtttcaaagtcagcaagaacgccgaacagaacgcgctcactggagtttgcatcatgcatcctcggttcaatctggtcattgtagagggaggtgctcactctatcaccaactaccggaagttaatgttgaatcggattgactggacagagaacgcggggccaaacagtgtgcgagaaggcaatcgcgaagcctctgcctcgtggttgtcagcagaagacgagaagaccggtgcattgaaggatcttagctccaacacatgcagcctcctatgggaaggccaagctaaaagtcgttcattcaggaaatggttgggtgctagagtttgtgagacagactcgcaagcaaaggatgttttggctcgagcaaagatggagaacttttgggttttggcaaaaagtgcgaagcccaaggaggtgtag

SEQ ID NO: 16241 - DNA, 837 bp, A.fumigatus
ggcgtcgaaatcgcggttgactacttatttttccagaaattcgccattgtgccgtggaacattgtcgcttataacatcttcggaggcgaaggccgggggcctgatattttcggtacagagccgtggacgttctacatcaaaaatctgcttttgaacttcaatatatggtttgtgttggccgtgtctgctgcgccgatacttgttcttcaggctatattccgttctcaagccacgaacgtccaaacgctcttacggactgtgactctggtgacgccattttatatgtggttggccatcttcacaatccagcctcacaaagaggagaggttcatgtatcccgcctacccgttcattgcactcaatgcagccatctcctttcacatgatcctctcttacgtcgggtcaagtaacccaaaagagatcattggacgattgtcaccgaaggtcaaactgaccatggtgatggctgtaattcttatggctattaatgccgggctactgcgaactcttggtatgatcacggcgtacaatgcgcccctaaaggtgatggagccgctgcaacagttggaaatggcccaatccggtggctttgtgtgctttggcaaagagtggtatcgattcccttcatcatactttctcccaaacggaatgcgtgcgaaatttatcaagagcgaatttcgaggattgcttcctggagaatttccggaagccccaagctattccagtctcttacggggcacctcgcaaatccctgccggtatgaacgatcggaacgaggaagaccttggcaaatacgtgagtgatgattgtctcatcttggttctagtccaaagctga

SEQ ID NO: 16242 - DNA, 894 bp, A.fumigatus
ttccttcgagtctctgtcctcgagaacaatcagtatggctccggccagaaaggagacccagtcaacaaatggctctcaaaggacgaagccacggtatctcaacctaccatagcatctctcgcgtttcagctaacaatccgtgctcctcgcagctcccgaccagttcctttctatctccctttgaatgtcacactatatgtgttcctaatttccaattttgttgctgcggcactcgctccgattcaagactgcgatgaagtcttcaatttttgggagcccgcgcactacctagaccacgggtacgggctacaaacgtgggagtattctcccgcgtattcaattcgaagctggctctacgtttctgcccatgctggggttggcaaaatagtgtcgattttctctagtgataagacatccgaattttatactatacggttcgttctggcagcagtctgcgccgcctgcgagacgagactatactcagcaatctgtcggacattgaaccccagagtcggcctcctcttcctgatcattgtcgctttcagtccgggcatgttccatgcgtctgcagcattcttaccgtctagttttaccatgtatacttccatgctaggtcttgcatcttttctagattggaggggaggccagaagacggcgcagggtattatgtggttcggtctcggagcaatcatgggctggccatttgccggagctcttatcattcctcttctccttgaggaggtcgcgatcagcttcatcgcagggactctgggaaatttgtttgtggatatattcaagggcattattagatgtctcgctattctggtgcgcttcttccgcttactccttctgcgattctcgctaagcgatatagggcgtcgaaatcgcggttga

SEQ ID NO: 16243 - DNA, 564 bp, A.fumigatus
tcctggcactgctggtgcagttcctcccggcatgggccatcaacgacccggccaagtcggccgccccctaccacgatgaattccctctcttccgcagcgccaacatggcctcgccagacaaactgtccaccggaatcggcttccactcgttccgcatccccgctgtggtccgcaccaccaccggacgcatcctcgccttcgccgagggccgccgacacaccaaccaagactttggcgacatcaaccttgtctacaagcgcaccaagacaaccgccaacaacggcgccagtccgtccgactgggagcctctccgggaagtcgtcggctccggcgccggcacctggggcaatccgaccccggtcgtcgacgacgacaacaccatctacctgtttctctcgtggaacggcgccacctacagccagaacggcaaggacgtcctccccgacggcacggtcaccaagaaaatcgactccacttgggaaggccgccgacacctgtacctcaccgagtcccgagacgacggcaacacctggtccaagcccgtcgatctcaccaaggaactga

SEQ ID NO: 16244 - DNA, 690 bp, A.fumigatus
attccctctcttccgcagcgccaacatggcctcgccagacaaactgtccaccggaatcggcttccactcgttccgcatccccgctgtggtccgcaccaccaccggacgcatcctcgccttcgccgagggccgccgacacaccaaccaagactttggcgacatcaaccttgtctacaagcgcaccaagacaaccgccaacaacggcgccagtccgtccgactgggagcctctccgggaagtcgtcggctccggcgccggcacctggggcaatccgaccccggtcgtcgacgacgacaacaccatctacctgtttctctcgtggaacggcgccacctacagccagaacggcaaggacgtcctccccgacggcacggtcaccaagaaaatcgactccacttgggaaggccgccgacacctgtacctcaccgagtcccgagacgacggcaacacctggtccaagcccgtcgatctcaccaaggaactgaccccggacggctgggcatgggacgcggtcggccccggcaacggcatccgcctcacgaccggcgagctggtcatccccgccatgggccgcaacatcatcgggcgcggcgcgccgggcaaccgcacgtggagcgtgcagcggctgtccggggccggggcggaggggacgatcgtgcagacgcccgacgggaagctgtaccgcaatga

SEQ ID NO: 16245 - DNA, 1242 bp, A.fumigatus
tgttgtccagcaacgagcaagatgcagtcgatgcgcttcatgatcctggcactgctggtgcagttcctcccggcatgggccatcaacgacccggccaagtcggccgccccctaccacgatgaattccctctcttccgcagcgccaacatggcctcgccagacaaactgtccaccggaatcggcttccactcgttccgcatccccgctgtggtccgcaccaccaccggacgcatcctcgccttcgccgagggccgccgacacaccaaccaagactttggcgacatcaaccttgtctacaagcgcaccaagacaaccgccaacaacggcgccagtccgtccgactgggagcctctccgggaagtcgtcggctccggcgccggcacctggggcaatccgaccccggtcgtcgacgacgacaacaccatctacctgtttctctcgtggaacggcgccacctacagccagaacggcaaggacgtcctccccgacggcacggtcaccaagaaaatcgactccacttgggaaggccgccgacacctgtacctcaccgagtcccgagacgacggcaacacctggtccaagcccgtcgatctcaccaaggaactgaccccggacggctgggcatgggacgcggtcggccccggcaacggcatccgcctcacgaccggcgagctggtcatccccgccatgggccgcaacatcatcgggcgcggcgcgccgggcaaccgcacgtggagcgtgcagcggctgtccggggccggggcggaggggacgatcgtgcagacgcccgacgggaagctgtaccgcaatgaccggcccagccagaaggggtaccggatggtggcgcgcgggacgctcgagggcttcggggcgtttgccccggacgctgggctgccggacccggcgtgccagggatcggtgctgcggtataacagcgatgcgccggcgcggacgatctttctgaattccgcgtcggggacgagtcggcgggcgatgcgcgtgcggatcagctacgacgcggacgcgaagaagttcaactacgggcgcaagctggaggatgccaaggtcagcggggcgggtcatgaagggggttattcgagtatgaccaagacgggggattacaagattggggcgttggtggagagcgatttcttcaatgatggcactggcaagaattcgtatcgggcgatcatctggaggagattcaatctgtcgtggatcctgaatggtcctaacaattag

SEQ ID NO: 16246 - DNA, 1374 bp, A.fumigatus
gaccctccctggcggatctatctactgtatccatgtaaacattcccaccatcgcgatgcaaatgacgacaacctaattgttaggaccattcaggatccacgacagattgaatctcctccagatgatcgcccgatacgaattcttgccagtgccatcattgaagaaatcgctctccaccaacgccccaatcttgtaatcccccgtcttggtcatactcgaataacccccttcatgacccgccccgctgaccttggcatcctccagcttgcgcccgtagttgaacttcttcgcgtccgcgtcgtagctgatccgcacgcgcatcgcccgccgactcgtccccgacgcggaattcagaaagatcgtccgcgccggcgcatcgctgttataccgcagcaccgatccctggcacgccgggtccggcagcccagcgtccggggcaaacgccccgaagccctcgagcgtcccgcgcgccaccatccggtaccccttctggctgggccggtcattgcggtacagcttcccgtcgggcgtctgcacgatcgtcccctccgccccggccccggacagccgctgcacgctccacgtgcggttgcccggcgcgccgcgcccgatgatgttgcggcccatggcggggatgaccagctcgccggtcgtgaggcggatgccgttgccggggccgaccgcgtcccatgcccagccgtccggggtcagttccttggtgagatcgacgggcttggaccaggtgttgccgtcgtctcgggactcggtgaggtacaggtgtcggcggccttcccaagtggagtcgattttcttggtgaccgtgccgtcggggaggacgtccttgccgttctggctgtaggtggcgccgttccacgagagaaacaggtagatggtgttgtcgtcgtcgacgaccggggtcggattgccccaggtgccggcgccggagccgacgacttcccggagaggctcccagtcggacggactggcgccgttgttggcggttgtcttggtgcgcttgtagacaaggttgatgtcgccaaagtcttggttggtgtgtcggcggccctcggcgaaggcgaggatgcgtccggtggtggtgcggaccacagcggggatgcggaacgagtggaagccgattccggtggacagtttgtctggcgaggccatgttggcgctgcggaagagagggaattcatcgtggtagggggcggccgacttggccgggtcgttgatggcccatgccgggaggaactgcaccagcagtgccaggatcatgaagcgcatcgactgcatcttgctcgttgctggacaacattatggtgggagacggtcgaggagatttatagccatcgtgtgaaatcacatcctgattga

SEQ ID NO: 16247 - DNA, 501 bp, A.fumigatus
  unsure (473),(488): Identity of nucleotide sequences at the above locations are unknown.
ggccttgacagcgcgacgaaaggcgcgaacgtggaggtgaacgtggagaaagaggagaaagaggagaaagaggagaaagaggagaaagaggagagagaggagagaggagacggtcgagatccccccattacagctcccggggttcacgacgtgaatacgaggcagactcatactcgtcgagtcgcgactaccgcgcgagagaacgagaggaccgctactccagccggagagacgaccgtgaatgggaccgggaccgtggtgatcgcggcgaccgccgacgcagagatttcgatgacagaccatctcgacgtgaccgtgatagagacttgtttgacgagaaaccccggagagaacgagggggagaccgcgagcgcgaccgggagaggaaagaacggaaaagaagcacaacccccccacgcaaggagggagcctacacccgacctgacagatgtaccatctgttctgactagganacgtcgtttgacgcnagtgggacattaa

SEQ ID NO: 16248 - DNA, 663 bp, A.fumigatus
  unsure (55),(340),(471): Identity of nucleotide sequences at the above locations are unknown.
gttgcgactgcgcgacgtgtgtgtttatctatatcgaagttgtggttaacatttntagccatgttcccctttcccggagcgcttcgccagcagccaatgaaccccagccgctttcaagcgtttatgaaccagtcaggtggtggatctgcggataattcagctcttaagcctccaaactcgcgtcaggccaggcgtctgttcgtatacaaccttccacctggcgtgtccagcgagcaccttgtgtccttcttcaacctgcaactcaacggcctcaatgtcattcaccatgtggacccttgtatctcggcacaaatatctgaagaccatagttttgcactcntagagttcaagacacccaacgacgccactgttgctcttgcctttgatggcatcacgatggaggagcacgagcccgtcagtggagctgagaacggtgcccccaaggggctcgaagtgcgccgacccaaggantacattgtcccgaacggcagtgcagatcaagaataccaggagggtgtgttgctgaatgaggttcccgactcgcccaataagatttgtgtgtccaatatcccgcaatatattccagaggagcccgtgaccatgctgctcaagtcgtttggcgagctcaaggtcttcaccacgcggctggaaggacagatatcc

SEQ ID NO: 16249 - DNA, 462 bp, A.fumigatus
cagcgcgacgaaaggcgcgaacgtggaggtgaacgtggagaaagaggagaaagaggagaaagaggagaaagaggagaaagaggagagagaggagagaggagacggtcgagatccccccattacagctcccggggttcacgacgtgaatacgaggcagactcatactcgtcgagtcgcgactaccgcgcgagagaacgagaggaccgctactccagccggagagacgaccgtgaatgggaccgggaccgtggtgatcgcggcgaccgccgacgcagagatttcgatgacagaccatctcgacgtgaccgtgatagagacttgtttgacgagaaaccccggagagaacgagggggagaccgcgagcgcgaccgggagaggaaagaacggaaaagaagcacaacccccccacgcaaggagggagcctacacccgacctgacagatgtaccatctgttctgactag

SEQ ID NO: 16250 - DNA, 1338 bp, A.fumigatus
ctatttcgagcctctagatggcacaatgttcctgaaagtgacgaatggcgatgtgtactccatggtcgacttctatctttgaaacaagacccgcaatatctctactatagaacatatcgctcgcttatctctcaatcaacgaccaccccccgaatacaaccctcctcctcctcctctccgcgggcggagtcaattggcgctgtgaatggcccacatggggagatcacgcaaatgggatcatcaaatgacttccatgacgacgagaccctagagcttctgaagcattacctcaatctctcctcgaatcttacggacctctatacccagtggtcctcgcaagacccgaacttcaaaaaaaaggcaccccagttcacaggaatcaggatactgcgccaggatgcttgggaagcgcttgtatctttcatctgtagcagtaacaacaatatcacgcgcatatcgcaaatggtcgagaagttatgcgtcaactatggtcccctggtggccactgtcggcgaccgcgcataccatgacttccctcctcccgaggctttgaccgctgacgatgttgagggtcgcctacgaagtttaggttttggttaccgggccaaatatatccaccagacagctttgattgtagctaaagagagagagcaaggctggcttgattcactacgaaatccagaatctcctgttctcggagttcagcccgtgcccggcgatgaaatgagaccggagggtagacaggggtaccgtcacgcgcatgaacagctactggggctacagggggttgggccaaaggttgctgattgtgtctgcctgatggggttggggtggggagaggcggtgccggtagatactcatggtgagcgactctcaacatgtcttctatggattacttatgttaactctctatttttagtctggcaaattgcgcaaagagactacaaattcggcagaggcgctcacaaatcgctaacgaaagcaacttatgacgccgtcggcaaccactttcggaaactctggggcaaggatgctggctgggctcatagtgttctgttcacagcggacttgagggcattctcggacaggttagctggtgcgtctggaaagatagatgtcaaggttgccgtgagggaagagggcgaggacaaagagtctgttaaggttgagacagaagtcacgacctccacggcttatgccttgaaaagacctgcgactgagaagttgttggaatcaaaggatatgaaagaggagagtaaaggaaacgagaaggccgtcattcaagcctcacagaccacgacgacgagaagaatgtcaaagcggcttcggaaccgctga

SEQ ID NO: 16251 - DNA, 552 bp, A.fumigatus
ggatcgctcttctttccagccccgcgggtaagacgtcatggccgcacggcgtcggggatgcacggaaaaggcgaggatggtgtaggagcccgaggagatgccggcagccccgatgccagcaatggctcggccgacgatcagggtcacggagtttttggcgacggcgcagatcaacgatccaacctcgaagagcaggacggcggcgagaaagctcagcttgaggggaaagtagcggtagatcttgccccaggtgccttggaaggaggcgagcgtcagaaagaaggcggacccataccacccgatatccgccaccgtgtggaactcgtcggtgatccgggggatcgcggtggacacaatggtggtgtcgagcgagatgaggaagatggcagccagcagaccggccatgatgacactgagggcgaagccagagggatactgcatctcctcctcgggggccgggtctttgcccatgacggaatcattgggagagctactcagctcctgcttcgactcttcgatagacggacgggacataatggtcgatgtcagtag

SEQ ID NO: 16252 - DNA, 975 bp, A.fumigatus
tttactgatcccatcgagagattaagttggtcaccgaatagaaccatcaaggtagttcggagaccgaaaagtggctatgtctccatatgtctccgacagtgctcagtatatgtatccgagtgctcacatcaacaggtatgcaatcctagacctcaagcaaagctaacgagcaagagaaccatggcgcccggtctgctagagaacaacaccctgagcggcaccgccgcaccgcgcacggaattcaaagccatagtcaacgacctgcgcgagctacaggcacatgtgcagcgcgtccaatccgccatcgaggcgcctgaggttcagtcctggctgaatgagcagctgcatcatccggaccagctccccgacaaggagctagagcagctggcattagatctggtcgacagtatggacaagcttcaactgcagctcgtgccgtccgtctccttgttaactgatggcttcttcggtaagcggggagtcctccaagcacatggagtttccgtactgacagtgtgtctcgaggctatctcaacagtaagacgctctggaccgtcgtcgaagcgcaagtggcagaccgactggcggaaaacggtccccagcctgtatcaacgctcggtctgcggtgcggcattcagcccgagcggctcgcccagctgctggacaccctcgtcagcaatggcatcttcgcctacaatccggccgacgacacctacagcaacaaccgtgcatctctcctcctctgccacgaccactggacccagtggcacctctgggccgatctgtaccccaacgagttcttcgacgtcagccgcgccatgccccaggccgtccgactcggcgagagccgcaccgccgcccagatcgcctacggcaccgacctcgacctcttcgagtacctcgccaaggagcagaagctggcaaagttccagaagacactgggcgcgggcgccgtcgcgcaagcccgcggcttga

SEQ ID NO: 16253 - DNA, 552 bp, A.fumigatus
attatccctgggaggagatcggcagcgaacccatcctggacatcggcggcgggtccggagcattcctggcctcggtgctccgggcgcatccccaccctccgggggagtgtcatggatatccagtcggtcactgagctgatcacgccggagttccgcgagccgcatggtcgattcagcgatatcgggtcgcgcgtgcagcagctcgtcgtcggcgatttcaccaagcagatcccgccgtccgcggtgtacaccatgaaatggtgtctgcatgactgggtcgacgacgatgtgctgacgatcctgaagaatgtgcgccggagtatcgtgccgtcgtctgtcagtcgcttcctggtcgtggagtcgatcaagtcgcccggccgatcaggccgtttgccgcgatacggcgatctgatcatgatgatcacctgcaatggcaaggagcggtcgctgaaggactggaagcggctgggagagttggccgggtggaagttataccaggtgcatcgggtgcgtcgcgcctggccgtgtatcatcgactttcggccgatgtga

SEQ ID NO: 16254 - DNA, 582 bp, A.fumigatus
cagggccaaaagccacagatattgtatgcccctacccttgctaacttcaccaaccattaccagttcttggactgttccacactcgtcagaatgtccgagcgaccctccgatcttgtagtcaacaggttggtgcttttcgtggtcaaaggtgagtcgagtcgacgcatcagcaagtctcctctcatgcagtcaactacaggcaccgccacgtccacacacaacaccgtcaaaccgttgattctcctcgaagagctcggagtccctcacgatatctatgtcgtcgaaaaggtgtctgccccctggttcagcgagatcaatccccacaagatggtgcccgccatcctggaccgctcccccgacggccgagacaccctccgcgcctgggaatcgacgtcgaccctgatgtacattgccgatgcatatgacaaggacgggacctttggcggacgcaacgtgcaagagaggtctgagatcaacaactggttgactctgcatacggcggcgctggggcccacggccaagtactggctgtatttctacaagctgcacccggagaagttgcccaaaacaatcgagaagtaa

SEQ ID NO: 16255 - DNA, 579 bp, A.fumigatus
gacgctctggaccgtcgtcgaagcgcaagtggcagaccgactggcggaaaacggtccccagcctgtatcaacgctcggtctgcggtgcggcattcagcccgagcggctcgcccagctgctggacaccctcgtcagcaatggcatcttcgcctacaatccggccgacgacacctacagcaacaaccgtgcatctctcctcctctgccacgaccactggacccagtggcacctctgggccgatctgtaccccaacgagttcttcgacgtcagccgcgccatgccccaggccgtccgactcggcgagagccgcaccgccgcccagatcgcctacggcaccgacctcgacctcttcgagtacctcgccaaggagcagaagctggcaaagttccagaagacactgggcgcgggcgccgtcgcgcaagcccgcggcttgacagtagattatccctgggaggagatcggcagcgaacccatcctggacatcggcggcgggtccggagcattcctggcctcggtgctccgggcgcatccccaccctccgggggagtgtcatggatatccagtcggtcactgagctga

SEQ ID NO: 16256 - DNA, 432 bp, A.fumigatus
ctctgcatacggcggcgctggggcccacggccaagtactggctgtatttctacaagctgcacccggagaagttgcccaaaacaatcgagaagtaattccggcctctctcatttgcccgggaacagtttgtctaatatgggttgcagactgcgcagcaacattacggtgcaatatgatattctagaacgtcggctcaacgaacccggccagcagtacctggctctgaaggaccgaccgaccattgcggatatcgccaccttgccctttgccatgaagtccacggcggaactgttcggcctggagtttgagaaatggccaaagctgcaggagtggtcggttcgcatgggtgaacgtgaggccgtcaagcgggcctggcagcgcgtcgcggggtttggccatggcgagaaagagtatggcatgttagaggcgtga

SEQ ID NO: 16257 - DNA, 642 bp, A.fumigatus
gcggggagtcctccaagcacatggagtttccgtactgacagtgtgtctcgaggctatctcaacagtaagacgctctggaccgtcgtcgaagcgcaagtggcagaccgactggcggaaaacggtccccagcctgtatcaacgctcggtctgcggtgcggcattcagcccgagcggctcgcccagctgctggacaccctcgtcagcaatggcatcttcgcctacaatccggccgacgacacctacagcaacaaccgtgcatctctcctcctctgccacgaccactggacccagtggcacctctgggccgatctgtaccccaacgagttcttcgacgtcagccgcgccatgccccaggccgtccgactcggcgagagccgcaccgccgcccagatcgcctacggcaccgacctcgacctcttcgagtacctcgccaaggagcagaagctggcaaagttccagaagacactgggcgcgggcgccgtcgcgcaagcccgcggcttgacagtagattatccctgggaggagatcggcagcgaacccatcctggacatcggcggcgggtccggagcattcctggcctcggtgctccgggcgcatccccaccctccgggggagtgtcatggatatccagtcggtcactga

SEQ ID NO: 16258 - DNA, 633 bp, A.fumigatus
gtagatatagatgcgtttcgtgcggtctgtttgttgctactgtctccggtctaccattatcgtcacgtcaaatccagctctctactgacatcgaccattatgtcccgtccgtctatcgaagagtcgaagcaggagctgagtagctctcccaatgattccgtcatgggcaaagacccggcccccgaggaggagatgcagtatccctctggcttcgccctcagtgtcatcatggccggtctgctggctgccatcttcctcatctcgctcgacaccaccattgtgtccaccgcgatcccccggatcaccgacgagttccacacggtggcggatatcgggtggtatgggtccgccttctttctgacgctcgcctccttccaaggcacctggggcaagatctaccgctactttcccctcaagctgagctttctcgccgccgtcctgctcttcgaggttggatcgttgatctgcgccgtcgccaaaaactccgtgaccctgatcgtcggccgagccattgctggcatcggggctgccggcatctcctcgggctcctacaccatcctcgccttttccgtgcatccccgacgccgtgcggccatgacgtcttacccgcggggctggaaagaagagcgatcc

SEQ ID NO: 16259 - DNA, 723 bp, A.fumigatus
  unsure (189),(206),(207),(211): Identity of nucleotide sequences at the above locations are unknown.
gcagtagctaaaattgatagagagacaattccctggtccccctgcttacagaacgcaaagagcatgcaacatggggaaagcagcgttgtcaagaccctcatggggggaatctggtactttgcctacgggtccaacttacgcctctcggtcctggagaatcgatgcattaaagcaatggatatcaaggcngtcattgtccctcgcanntacntgaccttcgacatctttggcatcccgtacgcggaaccttcctttgccagcgtcgccccctttgcccgcgagaagaaaaccaccctgcgactgggcgattcacccgcttctcgcgacgttccgccggttcagggactcgcctatcttttaaatcccagggattaccggcagctggtcatcagcgaaggcggcggcgtggcttacgatgaggtcgaggtccatgcctcgatcctcgacaaggacggcaaacccgaccccggcgcgaccctgattgctcggaccttgcaagccaagtacccctggcgacctaacggtgcgcccagtgcgcgctacctggtgagcggccccggaacagaatcatgctctgcgatactgatcggaaacagggcctcatctcgacggggtgcaaacagaatgagccgctcacggcatacagcgactatattgattccttaccggcctatgagccgccgacatccctccatgccaaggtgggaggtcttcttttcctga

SEQ ID NO: 16260 - DNA, 414 bp, A.fumigatus
aatccagggggcattctgctgatatcatccagaccaatgttatcgtggacgctcaagcgatcaacatcgacaacccgtactgggtcaacggaacgcaatacaatcctcgacggttcttcagtctcaacaagtctgatgtatggtcgccgtccgcagtttctagtttcaacctcactgacgttgcaggtccgccataacatgtggcgcttcgggtttggacctcgccaatgcctcggcaagcatattggcgagcggatgctgaaggcgattgttgctgagattattcgacagtatgtcatctcgatctcggctgacagtgctttgaagaatgatctgcaggaggatagctgggtgggcttgcccgcaacgcggattcagtgtgtgccggtaggacgcgaggtcgagaagaattaa

SEQ ID NO: 16261 - DNA, 2439 bp, A.fumigatus
tttccgcagagaccggtttcctcccttctatcacatttcgagaacctgtcccttcgccgatcaccatccgcctttacagctactagtccgcatgattcgactccctttctgaggacgcccgaacctgtcgacgaagtgcgctccgcgcgcgcttctctcgaccttcctcgggctcaatccccatggaatgcgacgggcaaacctcagaatgcccagcggtacgatcggacaaatggcggattttcacggcgaagcggctccccgggaagatctccaggcaggaggcagagcagacccatgtcgatgaacttccactcgccaccgcaactggcaccgactttaacggttgactcgccgcgatcacctccgcggggatttgggtcccaaaaccatactgagcgtaccatcaactccaggatgtcccgcagtccgccggacccgtctcggggctcgttgccgccgccgaccaaccgaccgacaacgcccagttcctcgacgttccagcatctgcctggtcatctatcgccagcgcattctcattcggggagcttcatcggtgagagtccacccgatcgaaagcaaaaaagctcttcgttgcctccgcccatcgatcgagcggagaagccgaaggtccctgcaaagccggcagccttagcttctcttgagggcgcaactctggcactgaaaccggagaagacaacgtcggaggatcggatatcaccgttcagcacgcccccaggcagtcccgagaagccgtccgtcaagccatcatcttgtggacgtccgcagatgccacgctccccttctcggccggtgactgaacccccaagccgccaatcattcgatgacaggggccctgtgccgtctgcgcatgctcttcgggatgcgcgcgagcttggcttttcgcgcaggagacccatcccggaaccgacgcgggacatgaaaccattgatggtacaggtcccaccacattcaatgaagcagacggagcctttgtcggctgcgccgctgtcagctcgcaggctccaagccaccgatgctcccaccgagcctcccagcctcccgccacgacattcgtccttggcgcgaaggagtggcgcatctccgtctaggccgtcgcctcatctggagggctcttcgcatcctgaaccatcgcctagaccgcaatcattccaaccgccccccagggagaaccagactcccctgcaaatacaccgacagccgtcgttctccagagacgccaagccagggcaggcgtcttctgttcctgaacggcagttggcccgcgcggacacattcggacaggatcccgtggacgaaccggcaatctcgcgaactgactatcctgacgcatcgaccactaatcgtcgaccgcccctactcaagaacggaccaagggaaatccatacaagatatgacactcgtttgatggatgtatgcggtaggcatgtgtgtacaacaggttatttgacccgggtatgggatctcacgaacggagaacaaatcatgagtctcagccacggtgagactgtcaagagtctatcgatagcattcaagccaggtactggcctggaagatgagggtcagcggctatggctgggcatgagcacgggagaaatccatgaagtggacatttccactcgttcgattgtagcaacacgcttctatccctcgcgccgtgaggtgatcaagatcctccgtcataagaaggagatgtggacccttgacgacgagggacgattgcttgtctggccgccggacgagtctgggactccgaatcttcagtacagctaccacaacccctatgaccgagtcgcccggggacatacattctcgctggtcgtcggagacacattatggctggcaaccggcaaggaagttcacgtatatcggccaaacgctcgtgacgatgtctcatttaaggtcttgaaaaaacctctgggctcgcagcacactggcgatgtcacgtccggtatctacacgactcgagatgggggacgtgtgtatatgggccatgcggatggcaaggttaccgtgtactcttccacagattacgcttgtctagcagtcgtcaatgtaagcgtttacaagatcaactgcttaggtgtggttggtgattatctttgggcggcctataagacgggcatgatctatgtctacgacacgaggaccaacccatggatagttaagaaggattggcgagctcatgacggtccagtctctagcttcttactggatttcagtagtgtctggaccatgaaccggctgcaggtgacctcgttaggagacgacaattgcattcgtctctgggatggaatgctggaggatgattggctgggtaagttgatattctgcaggtccgatggacgaaaagcgaaaactaacgtcaacagaaactcgcatgcagagcagagatgtagaattctgcaagttccgtga

SEQ ID NO: 16262 - DNA, 321 bp, A.fumigatus
gtagaagtctgggctgcctcacgtgtgagtttcgctgattcgtctatagagagcttgttgttaggaagcaagaagaaagacggcggagagaaagaacatatgagccgtcagtaccgggtatggatggagcatctgactcgttgtatcaacgactgcatgcccctcgaggagtcgtacgtccttcttcattcagcgaatctcattgggctttttacctgcgtctttgttaagcacaaggagcggcagcggatcaagaacatcggtgctgcagaggtgaagcggggtatgggaggattgcacggaaacaaggtacgtatatga

SEQ ID NO: 16263 - DNA, 711 bp, A.fumigatus
ggtactgcgttgattttggtccggttgctgattgcacagggtgccctgattcttcgcttcatcctagacgatagttctctctgcttcgtgaattgccatttagcagccgggcagtcgcaaacggctcaccgcaacaatgacattgcagccattctcgagtccgaagtgcttccagtagagaatagccttaccactcgggcaaaccactttgtcagcggtggtgatggaacaatgattatggatcatgagatttgcattctgaacggtgatctcaattaccgaatcgactcgatcccacggaatgtgatcatcgaggacattcgcaacaacaacctcgcaaagttgcttgagcgagaccaactgctcgcatcgcaacgcaaaaaccctggtttccgactccggtcattcacggaggcgcccatcacgttcgcgccgacgtacaagtacgacgtcggcacggacgaatacgactcgagtgagaagaaacggtcccccgcgtggtgcgatcgcgtactctacagggggctaggtcggattaagcagttggattaccgacgacatgaggtccgagcctccgaccatcggcctgtaagcgcatcattcaagctccgcgtcaagactgtgttgccgcaagagcgtgccgcggtgtgggaatcatgtcaacaggaattccagaaagagaagcgcaggctggcttctgaagctaggtga

SEQ ID NO: 16264 - DNA, 264 bp, A.fumigatus
tattctgcaggtccgatggacgaaaagcgaaaactaacgtcaacagaaactcgcatgcagagcagagatgtagaattctgcaagttccgtgagatctcggcagccattgtaacttggaacgctggcgcgtctacgccaggtagtgtccgctccagcaacttcattcaggaggcaattcatcccgagaatccacccgagattttggtcttcggcttccaagagcttgtagatcttgagaataagaaaatcacagccagtgagtag

SEQ ID NO: 16265 - DNA, 210 bp, A.fumigatus
caagctcgattactgcttggaacatgtcatcggcgtaggttttgtcttctggtgttgaatcagatcaagaacaatgtccctttgggtactttgttccacgtaaagctgatgatcaggtctgggctatggaatatcctgttcaatcaggcattcgagaccattggctttagtcggttccggatgtacaagtcccatagcatgagggtctga

SEQ ID NO: 16266 - DNA, 549 bp, A.fumigatus
ttgatttggacattcattatacctcggaaaggcaatatgtccactgtgattcttggaggaggcatcatcggatcttcaattgcctactatttatctgaaaatggatcgtccgacgagatccatattgttgaggcatcgtctcagttgttcagtgctgcatcgggctatgctgcaggtttcctagccaaggactggtttacgccagctcttgcatccctgggagaactctcattcaatctgcatcagtcgctggcggataagaatggagggagacaggaatggggatacatgaaaagcacagcactgagcctggacttttccaagaacaacaacaaaagaggtgcttctggagacgactggctgagtacaggagcaagtcgagcagaagcagctaccagctccagcagtcctgtccatgtggaggtacccgcctggttgacgaagcagaagaaagggatcatcgagaaaatcagtgatgatgacactgttgctcaagtgttagtaatgattattgcgaactctgccacatggcgaactgacggcatttag

SEQ ID NO: 16267 - DNA, 897 bp, A.fumigatus
ttattgcgaactctgccacatggcgaactgacggcatttagagacccattgagattggcaagatttcttatggagagctctttgtcccgtggtgtcaagttgcacaacccagctaaggccacttccgtcattacagatcaagtcagtggatatatcaccggggtcaaagtcatgaatctggatgctcagactgagtgcacacttccatgcgcgaatataatcatctgtgctggaccctggacaccgcaagtctatcatgaactgttccctttatctcgtcttccaatcccaatcacccctttggctggatattcgctcgttgttcgttctcctagacacacactccaagacgagcgggtaacatacgccaaccgcagtcatgctgtgttcacgacacaccctgattcatgcggcttctgtcccgagattttttctcgtcaaggcggagagatctacatagccggtctgaatgatacgcatatacctcttccagctcaggcgggggactcgtgcaaattaatggatcagaatgagatgagacgactgaagaaggcggcggtccatctgatgggagcacaagaggaaggcaatgtagaatcaacagacggcattgccaacaggaatgacttggagattttacgtgaaggtctatgctttcgacctgtctccgcgcatggagttcccttcgtcgctcgaattgacgatcatttgctgggtgggcccaaaactggctctataaatagatgtgagaatggtatcacaaggggaggagtctttgttgcgtcaggtcatggtccttggggaatctcattgtcactgggaaccgggaaagtgatttcgcaaatggtggagggagttgagcctgatgtagatgtgggtgggcttgctatagtgtga

SEQ ID NO: 16268 - DNA, 405 bp, A.fumigatus
tcgttcctcccaaatcaagtgaccccggactctttctactgtcgactgatcaccatggccaactatctcgcctccattttcggtacagagcaggacaaggtcaattgctccttttactacaagattggcgcctgcagacacggcgacagatgctcccgcaagcatgtcaagccatcatactcccaaacgatcctgatgcccaacatgtaccagaacccagcctacgaccccaagaacaagatgaaccccagccagctgcaaaaccacttcgatgcattctatgaggatgtgtggtgtgagatgtgcaagtacggcgagttggaggaattggttgtctgcgacaacaacaatgaccgtaagtgctatgttgcaaatcaagctctcgagaggactatcgctaactga

SEQ ID NO: 16269 - DNA, 342 bp, A.fumigatus
gtccataatgcagatctcatcggcaacgtctacgcacgattcaagtatgaagaagacgcacaggctgcgtgcgatgcgctcaattcccgctggtatgcagcgcggccgatatattgtgagctatcacccgtcacagatttccgagaagcgtgctgccggttaaatagcggcgaaggatgtgtacgaggcggattctgcaatttcattcaccggaaagatcccagccctgagctcgaccgtgagctccgcttgagcaccaagaagtggctcaaagaacgaggccgggacccgagaagtgctagccggagtcctagtccagagcctaccaggcggagatattag

SEQ ID NO: 16270 - DNA, 201 bp, A.fumigatus
ctgagaaaaatatatttctctacccaggcacttctagactttactcatattctattctttgtgttcctctccgaaaccacacttttatactatgtaagacaccatataagtactcttgtagagatggctaactacctatactcttccactcatgtaaccctgagctggcctgtgaaaatactcccaagaggtctaggatag

SEQ ID NO: 16271 - DNA, 186 bp, A.fumigatus
  unsure (162),(163),(169),(170),(172),(174),(180),(181),(183): Identity of nucleotide sequences at the above locations are unknown.
gatttctattcactattctgcttgctagacctttctgctgctgttgatgtatattcagattgggtagatgcttgtgacgcagttgcgaaggatacagctagtaaattcgatggtgatgacgatgtacttgctgttcattctcaggagcattcattccctaanncccttnnancncaaccnngntga

SEQ ID NO: 16272 - DNA, 210 bp, A.fumigatus
cgactcgtaggaggctctgcaacgcttgctgttgaaaccctgaaggcgaagggtgtgcccgaagatcgaatactatttctcaacctcattgcaagtccctctggggtcgcagatttcgcagaacgctttccaaaccttagagtagtaacagcgttcattgaccaaggcttgaacgaaaagaagttggttgaaatctctcccagtggatag

SEQ ID NO: 16273 - DNA, 432 bp, A.fumigatus
gcattaaaatcatatggagaagcatatcctctgaccaattgcagtatgataagggataaaaatacaagccgtgccgattttattttttactccaacagaattatccgactcttggtggaagagggattaaatcatctaccagttgtcgagcgatccgttacaactcctgtgggtcgtgaatacctcggggtcagatttgaaggaaagatatgtggtgtctcaataatgagggccggagaagcaatggaacagggtcttagggattgttgtcggtcggttcgaattgggaaaattttgattcagagagacgaagaaacctgcaagccgaaactcttctacgaaaagctcccccttgatatcgccaaccgctgggtgctactccttgatccgatgtttgcaaccggtgcgtcaggtcctgtattttcgatatga

SEQ ID NO: 16274 - DNA, 189 bp, A.fumigatus
tccgggaacaggaacaagcgcttgtcgaagggcaagaagggtgttaagaagaggaccgttgatcctttctccaggaaggacgaatactctgttaaggtatgtcgacgtggactgtgtaagtcgaccgcagctaatctatatcaggcgccttccactttccagatcagagagtatgttgcacgcatatga

SEQ ID NO: 16275 - DNA, 552 bp, A.fumigatus
ctgaattatagtgtcgggaagactctggtcaaccgcaccagtggtctcaagaacgccaatgactccctgaagggtcgaattttcgaggtctcgctggctgacctgcagaatgatgaagaccatgctttccgcaaggttaagcttcgtgtggacgaggttcagggcaagaactgtttgaccaacttccacggtcttgatttcacaaccgacaaattgcgatccctcgtgcgcaagtggcagtcgctgatcgaagccaatgtcactgtgaagacgaccgatgattatctccttcggctttttgctatcgccttcaccaagagacgcccgaaccagattaagaagaccacatatgctcgttcttctcaaatccgtgccatccgcaagaagatgattgaaatcatgcagagggaggcagccagctgctctctcgctcagctcactcacaagctcattcctgaggtcattggtcgtgagatcgagaaggctacccagggaatctatcctttgcagaatgtgtgtgaccctgttattcttactcgggatgaagactaa

SEQ ID NO: 16276 - DNA, 1305 bp, A.fumigatus
agccggaaacagaagggaggtctcgaagagcagctgggtgatggacttgacagtgcggtcgttttcaccgtcggcctcaaccttcttcttcagctccttgatgatggaggacttgggagagatctcgaaggtcttcttggaggacatgtaagagctcatggaggtgtcacgcagagcctgagccttcatgatacgctccatgttggcggaccagccgaactggccagtacggatagcgcaaggagagccgacgagcttatgggacacgacgaccttctcaaccttgtcgccaagaatgttcttgaggctcttagccaggttctcgtactccttctcctccttctcgcgctcagccttctcctcctcggtctcctcgagctcgaagtccttggtgatgtccaccagcttcttgccatcgaactccttcagctgagtgaaagcgtactcatcgatggggtcaaccaggaacagaacctcaaagttcttctgcttgaggctgtcaaggaagggagactttgcaacagccttgatagactcgccagtgatgtagtagatctgcttctggtgctcaggcatgcgggtgacgtagtcggcgagggaggtggcctcgtcaccagacttggtagactggtagcggagcagcttggcaagagtctggcggttctgagcatcctcgtggataccgagcttgatgttcttgctgaaggcagagtagaacttgtcgaactgctcacgatcctcggcaatctcgttgaagagctccagagtcttcttgacaatgttcttcttgatgaccttcataatcttgttctgctggagagtctcacgagacaggttgagaggcagatcctcagagtcgacaacacccttgatgaagcccagccactcggggatgagatcggtggcgtcatcagtgatgaagacacgacggacgtagagcttgatgttgttcttagtcttcttggtctcgaagaggtcgaaaggagcacgcttggggacgtaaaggatagcgcggaactcgagctgaccctcgacagagaagtgtttgacagcaagatggtcctcccagtcgttagagagggacttgtagaaggaggcatactcctcctgggtgatatccgcagggttgcgggtccagatgggcttggtcttgttgagctcctcctcctcgatcttgctctccttcacagtcttggtcttcttcttcttcttctcctcctcctcctcgtcatcgacctcctcgatcttggccttcttctcctcatccgtcttcaccacgcgactggccggatacgcgcttcacgg

SEQ ID NO: 16277 - DNA, 1554 bp, A.fumigatus
  unsure (1152),(1164): Identity of nucleotide sequences at the above locations are unknown.
gttgcatctaacgtacgagtaggatccgggaaaacctccctcatcaaatctatagtacaggcttgtgaggatatcgtgcatgtcgaccccttcccctcactatctccttcaaacctgccagctcgcgcgcaacccccaactacagcagcggtgatctcggaaatctacgctagcaccaaaccctaccctgcgtggtggtcagatctggaggattctcgcgttctgcggcggagaaagagcagtggcgatattgttcttgaacgaaatctatgctttgtcgatactgcgggcaacggcttgactagagtcggacaaactgatgctattatccatcacattcagcaacagctgctgagggccacgacggccgtgacttcctcaaacaccgatttcgaaaatctactcgctggcaacggcggagcacaagtagacgcgattctatacctgatctcagagagtaagtggtctacattaagctacctccattgctccaatagtgctgacctccaagatacacttgacgaggatattgagtgcatcaggaagctctgcgtctggacaaatgttattccccttatatccaagtcggatcttctgactccggaccaaattgcgactctcaaatcgtcttttcacgcgaaagcccagatggcgtctataaaacccttccactttggggatgcaacttccgccgcggcagacggattctcgagtcactcaccatttgccgtctcatccgcgaaagtagatgatgaagatgtcatggatgctagcacattgatgagcccagactatgtgcagcctctggcaccttctgaactctcgctacttgtaaaaaagttgttcgatctcgacaatatggcatggatccgacattctgctgccaagaagcttgttcagagacaacatgaccaaggaccgcaatgggaggtctcacggcacagcaccaacccttttgacggacagagtactgtatctagatgtacctcctccatcttctctgctagttatcttgagggcaccatgtctccgcctagcggacgcttccccagctatactatggcccgaatatcggattatacacaacgtgaggagaagatggcccgcgtacagttggcaaagtgggcctcggacttgcagcgaagccttcanaatgaacgaganagatatgcggccttggccagaggagaaagggccgtctggctcaccgaaaggctcggggagtgtgttgtggatggctcgctggtgccgattaccaaaacccccggattttgtggacttcgctttcctatggataacgcaggcggtcgcctgttcgtccgcactcaggatggcaaaaatatggaatatcgagttaccagtataagcccgcacgatcccttgggtattgtgtggtggtccgacgacctcaaacaacgagggtgggcgattgtccagatcgtcggtagcctcggtgtagtaggagggcttgccttcttacttgcgagaacctggggactatcatcacgcagtctgtctgagtggcgctttgactgttgcagcacctgcaattaa

SEQ ID NO: 16278 - DNA, 1362 bp, A.fumigatus
agcgcgtatccggccagtcgcgtggtgaagacggatgaggagaagaaggccaagatcgaggaggtcgatgacgaggaggaggaggagaagaagaagaagaagaccaagactgtgaaggagagcaagatcgaggaggaggagctcaacaagaccaagcccatctggacccgcaaccctgcggatatcacccaggaggagtatgcctccttctacaagtccctctctaacgactgggaggaccatcttgctgtcaaacacttctctgtcgagggtcagctcgagttccgcgctatcctttacgtccccaagcgtgctcctttcgacctcttcgagaccaagaagactaagaacaacatcaagctctacgtccgtcgtgtcttcatcactgatgacgccaccgatctcatccccgagtggctgggcttcatcaagggtgttgtcgactctgaggatctgcctctcaacctgtctcgtgagactctccagcagaacaagattatgaaggtcatcaagaagaacattgtcaagaagactctggagctcttcaacgagattgccgaggatcgtgagcagttcgacaagttctactctgccttcagcaagaacatcaagctcggtatccacgaggatgctcagaaccgccagactcttgccaagctgctccgctaccagtctaccaagtctggtgacgaggccacctccctcgccgactacgtcacccgcatgcctgagcaccagaagcagatctactacatcactggcgagtctatcaaggctgttgcaaagtctcccttccttgacagcctcaagcagaagaactttgaggttctgttcctggttgaccccatcgatgagtacgctttcactcagctgaaggagttcgatggcaagaagctggtggacatcaccaaggacttcgagctcgaggagaccgaggaggagaaggctgagcgcgagaaggaggagaaggagtacgagaacctggctaagagcctcaagaacattcttggcgacaaggttgagaaggtcgtcgtgtcccataagctcgtcggctctccttgcgctatccgtactggccagttcggctggtccgccaacatggagcgtatcatgaaggctcaggctctgcgtgacacctccatgagctcttacatgtcctccaagaagaccttcgagatctctcccaagtcctccatcatcaaggagctgaagaagaaggttgaggccgacggtgaaaacgaccgcactgtcaagtccatcacccagctgctcttcgagacctcccttctgtttccggcttcaccatcgaggagcctgccagcttcgctgagcgcattcacaagctcgtgtctcttggtctga

SEQ ID NO: 16279 - DNA, 228 bp, A.fumigatus
aaacgaccgcactgtcaagtccatcacccagctgctcttcgagacctcccttctgtttccggcttcaccatcgaggagcctgccagcttcgctgagcgcattcacaagctcgtgtctcttggtctgaacattgatgaggaggccgagactaccgaggaaaaggccactgaggaggctgctcctgccgaggccaccactggcgagagtgccatggaggaggttgactag

SEQ ID NO: 16280 - DNA, 204 bp, A.fumigatus
tcttgtgctttcaagacagatttctatccagtcctagcaataatgatgattggtcataacatatacattaactacttaagtaccccgctgactgcgctttatctacccaagagtgaaacaagccatggacaagcaccggtcgatgacaccatcaggatccatccatgggtgatgcaccatttcgatagagccacagccggctaa

SEQ ID NO: 16281 - DNA, 1263 bp, A.fumigatus
ctccaaattctcccaaattccgtgattcgcgcgcagaagctgtgtccctcacaccatggaatcaatccctatatcgttgcgaacatttgcagcctgatcagaaaagaagtcaccgagcatctggacgtcattgactggtactcagataatctcgaccaaagccatgtcagactagtccgcgcgctgcaatccatgcagggcatgtggtctctggtcccgctgggcactcgtcctccgccgattgcaccggcaccttaccaggagaacagatgtgaagcatgtatcttggcaagggtagtccaggagccgatgttcctgcagaacctgcgcgtcgcacttatcagccggactagaactagatccaaacatcgtgcgcctaggctgttggcgttcattgaccaagctatcaactattacggggatcgcgctctacagtactggcatgcaagcggccaagcggcatttgatttcaaggctgccaggaaagcggcggtgagagcgtacaagaagcgcccgcagcgcattcatcgccgcgaggactacaccgaccacctgcgcaagcatccaaagaacaaaggcaggtctatcagactggagcccggacagcgagagtcagctgggttcgcagaggcacccggctatgtgacaagtcaacgtagtagtgatgatgatggtgatgacatgcagtccatcgtcgtctacatggaccacagcagcgctgagcagcaaggcttataccgaaacgccagccaaagagcgagggtgcactctcaccacgccgagatcgtcaatgaacgggacacggtcgctgacgagatcatcgcgacctacgaggccttcggagccagagattgggcgccccgttccactacaaacctgcccgctggagtgccgcctgttcatcccctatccgtccccggggccgaccactcggtgatctcagcgtctcgctacgatgaggaccaccccatgggtgaaccgagctacatgcctccgcgcaacaactctgactggcggagtgccggtaacggagccgccctcggcaccttggaagccctgtcgaaggagatcggggaattggcgcttggaggacccccgggcgaggacaccgaagagcttgcggaccgatactgcgaattgctgagcccagtggcgtatcactctgactcagaatatagcgagacatcttggatggacgacccggtgcgtgatgcggggccgggagacactacctgggaccttgtgtgcaaagagagctattaa

SEQ ID NO: 16282 - DNA, 600 bp, A.fumigatus
cagtttacagtcactttccactctcgccatcatcggctttatgtcccatacgccttcggcgccctctataatcacccggtggaaggcttccttcttgatactgctggtgctggcattgggtttctggtaacgcgcatgacgaaccgtcaggccatgtggttcttcacatgttccactatcaagactgtggacgatcattgcggctatgctttcccctgggatcctttgcaacactttactaacaacaatgcggcctatcacgacattcaccatcaaagctggggtatcaagacgaacttctctcaaccgttcttcactttctgggatcgtctttttaacactaagtgggagggtgacgtcaaactccgctacgaaagatctcgagaggcggcacagaaacaagtcgatcaggatgcctcttcagcggcagcatcttcaaatgaagagaattcgtatgagggcccagtcgtctcgccagacgcacccgccgactctaacgcacgagcacggttgcgcagaaaaacggtgactttgtctccccatgttgacagtctaaagggtgtcaatcatggagtgacaagcagtgtccttcaggcctga

SEQ ID NO: 16283 - DNA, 333 bp, A.fumigatus
  unsure (13): Identity of nucleotide sequences at the above locations are unknown.
atagtacttccancgtcgctgttaaaactgtcaatggggagtctcatctactggtactttatccctgcggtacagttcacagtgggagtgtttatcgtcgatacctggcagtatttcctccaccgggcgatgcatctgaatcgctggctttacggtatgtactttgattacgaagctttggtcactcggggatctcccactaacagtttacagtcactttccactctcgccatcatcggctttatgtcccatacgccttcggcgccctctataatcacccggtggaaggcttccttcttgatactgctggtgctggcattgggtttctggtaa

SEQ ID NO: 16284 - DNA, 354 bp, A.fumigatus
gtatttaatacttttatgtatcaactcacgcatggagcaaccgaagctgctggacgtcttcgatcgatgcgaaagatgttattcatagccattcttcatgttactgaatcatgctgtactaatatgtggaccatgcattcttggtcctttgtcctgtataatgagctttacttggatatctttactcagtgcaatgtgtatatttctcaactcgactttccaaaactccgaaactgctatcgaaacaaagcttcaaacattctcccgagtcctctcatctcccttgcgttcggtgtgcaacctatgattttccttggaacaaccccaaaaaatcaatctcccaatcgtccttaa

SEQ ID NO: 16285 - DNA, 228 bp, A.fumigatus
gtcagagtgatacgccactgggctcagcaattcgcagtatcggtccgcaagctcttcggtgtcctcgcccgggggtcctccaagcgccaattccccgatctccttcgacagggcttccaaggtgccgagggcggctccgttaccggcactccgccagtcagagttgttgcgcggaggcatgtagctcggttcacccatggggtggtcctcatcgtagcgagacgctga

SEQ ID NO: 16286 - DNA, 933 bp, A.fumigatus
caaacccctgcgaagattgcgatctccaagttttttgatggggaaggacccgatcccgttgaggaagctcgcgctgctttgaacaatccacctccgccccggcctatccgtcaaacgcgaaatctcatgagcgatgacctgagcacgcaattatcaccggccgctcgagcgtcagaacctgccccccggattgtgactcagtccgaggaccactcagtttaccggccgcctttcttactggcgctattatttactccgttcaacatcatatatcgattactgtgcacctcgttccgcctcttcagcagcttatttccgttcttgcctcgcctacttaataccactgccaacccagctctgcagggtgctcgaggccataactatggacgtcggcctcttggaccacaggatacagccgccaggttcatccgcgagtttgaggaggaatacgggtctaatgctgtgggatttctggaaaacggatacaatatggcgctggaaaaagcccaccgggacttgaagttcctcctagtggttctcctttcttccgaacatgatgatacaaacgcctgggtccgagacaccctactctcgcgggaagtcgttgagttcatcaaagaccctcagaatgaagtgattgtgtggggaggcaatgtccaagactctgaggcatatcaagtctcgaactccctccggtgtaccaagtttccttttgcggctgttattgttcacacacccaatgtgtcttcaactgccatgtctgtcgtgtgtaggatctctgggacaacatcgccatccgagtttgtggagaagctccgagcagcaatttcacagaataaagaagctcttgaacggattcgggcctcacgagcggatcaacaggcttcacgcacaattcggtcttcaccacggggctggaagatccgcgtacaa

SEQ ID NO: 16287 - DNA, 297 bp, A.fumigatus
acgagagcagacactcaattaccagctcagattgactacttccattctcttgtcccgctggacctgaaccaccagaagaatgcaactatttttggctttccgagttgggtgtacaaagcgcaatccagcaaagatgggaattactacgcgctccgaaggttagaaggtgtgcatcccttcatccctcatttgtataccgcaaagtcggtcaaggctaagtggctctccaggctttcggttgacgaacgagaaggcgattcgatccgtccaggcttggaagcgggtgtgcaatggtag

SEQ ID NO: 16288 - DNA, 258 bp, A.fumigatus
atgctcttgctgatgattttgaccctaatccccttcattctcctgcttttccctcgcctttcggacaacgccctggacattgcacccccactgaaggcagacccataccatctgtggaatctttttggcctggtgcaagaaggcgcaaacgcagatctggtgtacggtttccaatcgctaatcgctcgtttcaggctgctctccaaggaaatggcaacggccctatcacatttacgagcccgtttgatcctttcgtaa

SEQ ID NO: 16289 - DNA, 621 bp, A.fumigatus
aaggtgtgcatcccttcatccctcatttgtataccgcaaagtcggtcaaggctaagtggctctccaggctttcggttgacgaacgagaaggcgattcgatccgtccaggcttggaagcgggtgtgcaatggtagtgtggtgacagttcacgatgctttcaccagtagaagttttcaggacagctcgctgatcttcgttaccgactaccatcctctttcaaaaacgctcgctgaacagcaccttggcgctgggcagcaaaggtttcaaggtcgtcataatgtgcagcacattcccgagcagattctgtggggctatatgacccagattgccaacgcattgaaggccatccacagcaatggtcttgctgctagagtcattgacgcaagcaaaattttactgactggcaagaatcgcattcgactcaacgcctgtgctatcatggatgtggtccagttcgatagccagcgtacagttgccgatcttcagcgtcaggatctggtcaatttcggacaactcatcgtcacgttgggtgccaactcgccgacggtcatgcacaaccctacgaaagctatggagcactttacacgtgcctacagtccgtcttcaccgccggggcggaag

SEQ ID NO: 16290 - DNA, 234 bp, A.fumigatus
atgaaggtgggcacatttttcttctctacctcatccccagagatcaaatctccgcggaatcacattgctgatatcggtgtccttctagacatggatgtcgacacaatgtctgttaagcacactcaaagtcgctctaagaagccaggacgtgttcaaaaacgcaagaaggcccgttcttccattgtcttccaaacgcatcctttgaaaacaaaaaagggatctcgaaggaagtga

SEQ ID NO: 16291 - DNA, 330 bp, A.fumigatus
ctgaggcattttgacattaacagcctaatccgttccggagcggctctacctttcacggcccatgccagctctccaacggtcactatgccacggcttaaggccatgacaactggctccgtgccgtccttcttggacgtcatattgaacatcgcagagtctgatacgtcttctacccttgcatatcaagatacatggctagcgcagataaaggcgcagggaggtcagcttgttatgtacggcgatgacacttggatcaagctatttccgggagtctttgataggtgtgacgggactactagtttcttcgtatcggtcagtcataaccactga

SEQ ID NO: 16292 - DNA, 462 bp, A.fumigatus
tatcgcagtcgacatatgatgacaaaacaacgagagatggactcgatcgttgctctaatttatgccgcaatggaggaacaggaacatcttcagtcgaccctgtttgttctgtgcggagatcatggcatgaacgatgccgggaatcatggtggctcgtcaccaggagaaatttcgcccgccctgcttttcatttcaccgaaatttcagactaaaacaaccccggaagacagtccagttgaagcatttagtgacttgcaatactatcggactgtcgagcaggtggatatcacgccgactctggcagggctccttggtttacctattccgctgaatagtctcggcgttttcataccagagtttctaatgatgtgggataatggtattgtcgtcagcttccttctgtctgtaacgtatttgaaaactgacatgttgcctcttggctctagatgctcacagaattga

SEQ ID NO: 16293 - DNA, 1293 bp, A.fumigatus
gactcgggttttgatgctgagatcatctccactgacggcccatcgatacaagccgatattcccagagatgcacaggatgcaaagccgcgattttcgaccacgacgttggcggtggaagggatgacgtgtggtgcctgtacgtctgctgtggaaggaggactcaaagaagtcagaggcgtcaaatcgatcaacgtctcattgctatcagaacgagcagtggtggagcatgatgcttccgtgatcacgccggaacagctcgcggatattatcgaggatcgtgggtttggcgcgacggttctggaaacctcaacgccgcaggacgttccccgaggctcgctggaagacgcagatgctacatcgcgcctcatgaacacaaccgtttctatagatggtatgacatgtggcgcttgtacatccagtgtgcagagtgcattcgatggtgttgatggtgtggttcagttcaacatcagcttacttgctgaacgcgctatcatcgtccatgaccctactgttctctcggcccaacaaatcaccacaatcattgaagatgcgggttttgatgcaactatcattgcttcagagccgaaactgtctacgtctagctccatgaacagcgtaaccctgagtttacacggcttgcgcgatgtagtcgcggcaaatgatttagaggactcccttctccggagacctgggatttactcggcgtccatcaatatgggcacatataagcttgcaatctcgttcgattctgcgaagattggcattcgtaccattgtggaggcgatcgaggctgcgggctacaatgccttgttgtctgaatcggacgacactaacgcccaattggaatctctttccaaaaccaaggaggtccaagagtggcgacatgcgttcttgttctctctctcatttgcggtacccgtctttgtcctcaacatgttgcttcccatgtatctaccgaagctcgacttcggcaagctcccattatgcgcaggcgtgtatctcggggacgtgctatgtttgttgctcactatccctgtacagttcggtatcggaaaacgattctacgtgagcagctacaaatcactcaagcatcgctcgccgactatggatgttcttgtcatgttgggcacatctgcggctttcttctacagtgtctttatcatgcttgtggccatgtgcacaatggccgagaaacggccccgcaccgtctttgatacaagcaccatgcttattaccttcattacactcggaagatggtcttcaccacggggctggaaggaaccgcgcatgcgt

SEQ ID NO: 16294 - DNA, 306 bp, A.fumigatus
gcgccagacaaccaagctcaaatggatcaaatacatactcgggccatcgaggctctgcaacccttcatccacttggccaactcaaacagtgctacctccccgcgattcattgccaacctaattacaaatgcgacctcaaatccgcacacctacgtcttcgccgagctgctcgaaacgcctacgatccaagccctccgctccccaaacaccccagaagagttccaaggctacctgacccttttggaaatcttcgcttggggaacatggcaggactaccagagtgagcacgccagcccttcgaactga

SEQ ID NO: 16295 - DNA, 1002 bp, A.fumigatus
gcattatcctcgagtgaagcttttccagctgacatttccagcgtgtggttctcgcttgtgcttactctgatcgatcgacttacacacactgtcccatcgaacggcctccagaggatcgtcaaaacatggaaaggcccggcagactcacttgcggcactatctccctggccgaaagacttcagccaaggcatagtaccggtccaatgccactctcacaacgactattggcgctcagtgccactatacgaggccctcgcggcaggctgcacaggcgtcgaggcagacgtctggcttgagggcagcgatctgctcgttggtcacggcaagcgctcgctgactccggatcgtacgttaaggagcctctatatcgagccactgacaactatcctctcgaacctaaacgcagattcctccgccaacagctcagcaggcgtattcgagaccgatcccacaaccagccttaccctcctgatcgatatcaaatcggacggaaatgcaacttggccggtcctcctcgaccaactggctcctctacgctctggtggatggctatcccactggaacgggacgagcaaaacccttgtcaatgggcctgtcacggtcgtgggaaccgggaatacgctgtttgatttggtactggcagaggaagatcgctacgtcttcttcgacgccccgctggatgagcttgcgcagaactccacctacaccgcagaaaacagttactacgccagcgtctctctgcaaaaatccgtcggcgttgtatggccctggggcccaacggacaaccagaaacaggccatgcagaagatgatcagcgctgcctcggaaagggggctactcgctcggttctggagtatcccctcctggcctgtcagcctgcgcatgagattatggcggtttttggtggatagtggggtcggcatgttgaatgtagatgatgtagttgaggcgacgaggtggaactgggactggtgtatcgtggcggggttagtgttgtgttga

SEQ ID NO: 16296 - DNA, 486 bp, A.fumigatus
cgcaattcaacaacatgcagctttttaaagatggttgcctctgggcctgaggcctttgccatcaatttctcaaatcgcttcacactcagcaacatgaccgggtcgtttccacctcacctcgtggatgacattcgttctctctcaaattctgacggatacgctgttaaagaagaactactaaagagaggggttggagcagcttacgcagcttacactgtaccctatcctttgcagagcggtccaacaaagtatgctccaatggccaaggaacccggaagtactatccctgtgaagacgaaggctccggcaccgcagttcacagcaagtgtttacacaatcgcaacgactcggcttcctccagcgacagtgcaagctacactttctgcatctgcaacgtactctattgtcagtgttgagaacacagtaagtggattattggacggccttgacaataaacgcgcttcttctgatagacactttccctag

SEQ ID NO: 16297 - DNA, 360 bp, A.fumigatus
attagatcttgcttagatctctatcatatccagctgcttttagattattgtgtactgcatgagacctacatcctcaatatgaatattctacagtgcctcttcaccttactgctacttccatgtacattagcagatgttgacttcaccgtgccaaccattggcacgaatttcaagggtggcgacgttgttacagtgcactggtgcgagtcaggccagcctccacgaatttcggaactgtcacaatacgatctttccctctacgcaggaggagataaggctgatacccaggtgagtagctgggcactacagacagctcacgggctcctgttaacggaaagagagccaactagtatgaagtag

SEQ ID NO: 16298 - DNA, 297 bp, A.fumigatus
tcctcgtttcttctggcgctgttggcgttggtttgcggaggatggatgtggacgagagacccaaatatcttcctcgcatacaggtataagccagcgttctcaagtcctgcaagggtagatgttctgaccggttacatttttcaggcgctagcagctgtcggacaatgcagactcatgagcctgtgggacggtttattttcacaccttcgactccctgtagcgcagatcctcttaaccaggaatgacattgcggatgtgaggactcattcactgcaactctggaccaaagatatctaa

SEQ ID NO: 16299 - DNA, 849 bp, A.fumigatus
tctgacaaaactcacaaggaaatcaaattcggtgataatgacactttatcggccataacggcggccatggtgaaggccgactacctctttttgatgacggatgttgactgcctatatacctcgaaccctcgtcacaacccggatgctaagcccatcgaggtggtttccgacatctcttctctggaagccgatgtgtcgtctgctggttcatcactcgggactggtggaatgagcacaaagattgtagctgcaaaattagcaactagtgccggagtgacgactgtgattaccaagagttccaaaccgggcaatgttctcgagatcgtaaagtatctccagcaatcacaacgaggtatcttgggacagtcttcaacggtagagacaacgccgtcagagtcacaatcaccgttgtcgccgcctctacatacgcggtttttaccttcagacacaccaattcaatcccggtcattctggctcctgcatggtctcaagccacgtgggagtctgtacatcgaccatggggcatatagcgctcttttgaacaaagccagtctcctaccagcaggtgtcgtcggtgtggatggccacttcggtcaacaggaagccgtgcgactggttgttgttgagcgactctcgccagactctctcaacggagacttcctccaccacgggcaggaacccagggaagttggccgtgcactggtcaattacggcagtactgagattgcacgcataaagggtcacagaagcacacacatttactccttgctgggatatgctgatagcgaatacattgctcttcgggagaatatatccttttttcggtcggatgattccgtacgccaatag

SEQ ID NO: 16300 - DNA, 198 bp, A.fumigatus
atagggacgagctccatagttgatgagaatacccacgagcccattctctcgatcttgaccttaatcgtcgagacagccgccaagctacgtagggatgggcataatgtagtcctcgtttcttctggcgctgttggcgttggtttgcggaggatggatgtggacgagagacccaaatatcttcctcgcatacaggtataa

SEQ ID NO: 16301 - DNA, 183 bp, A.fumigatus
gagaacgggaacctcacagctaaggcatcacgcccaatggaaatgtggtggcgccatgattactcagtagaacccgcggttgttggcaacaagctggagctccaactattctgcacaacgccatatgtggaagatggtgcgcattttgacctgatactattcctcaagcttttattggcttga

SEQ ID NO: 16302 - DNA, 747 bp, A.fumigatus
cttgaaagcaagacatcccgcttggctaaagcgacccaaaccacgcacacatctcaaacatctacctcagccatcgtcagcctccccccttcagtaccgactgcatcaaatcgctaccgctccgtcaatgattattcggtgaaggatgtctcgaagaatcctgttaggtatcgtttgaaggatactcctggccatgggaaactacgggaggcccagggcctttcagaactggtgtcaatggcgactgcgaaggacaagaaattgaagctgcgcgctgtcatttttatggtagacactgcagctttgaccgaggaaaacacgttaagagacaccgcatcctatttgcacgatgttcttctcgctcttcagaaacgcgctttgaagagaggcaagtcttccgccaaggtagcatcggaaatccccgtcctcgtagccgccaacaaacaagacctattcacggccttgccgccaggctctgttcgtgaaaaactggaaaccgagatcgataggatccggaaatccaagagcaaggggctcatgaatgccagcgaggacactgctacggttgaggacgaagatgataccttgggcagcatcgatgcgcaggataatttcagcttcaggctactagaagatgaggtcggtgtgaaagtcgacgtcgttggcggagttgtaaaaggcgatgaggagggcaatattggagccggtgtgaggagatgggaagaatggatcggacaatgcctatga

SEQ ID NO: 16303 - DNA, 894 bp, A.fumigatus
actcttatcctgacctttactgggctcctccggggcggtgggaataacttcggaatcgtcaccaagttcaacctctataccattccgagttctgaaatgcgaggcggaacccgggtctttgccgaagatcaattcagcaatgtgatcagtgcctttgtcagcgtggtgaacggcgcctccgatgatggcaatgcgcagcactgggtcgcgtttgtccatacccaaggacagaacgtcgctgcggccgagatcacatatgtcaagaacgtcagcgagccggtgattttcgcgccctaccgtgctattcccgcggtccaggataccacagcggccaggaccttggtggagtactgtgacgccgtccaggagctcaatcccgacggcctgcgggagatgtactggacgctcacccttcacttggacgaggactttgcgaactgggttactgggtacttttactccgttcttccgcaggttttgagcatccagggtatcaatcctgccctcgtcaatcagggcattacgatccccatgctcaagaacatgacgcgcaacgggggcaatgcactgggtctggacgcctcccagggtccatttcacctcctgatgatgtcgatctggtgggagaatgctgatgacgacgacaaggtacttgcatgggcgaaggatttctgggaaacagtcaccgccaaggcgaaaaaggatggcgtgttccatgactatgtctacatgaactatgcgagccagtatcaggatgttatcgcgggttatggggctgccaataaggccaagctgcagagcattgccgccaggtatgatcccaagggtgtctatcagacgctgcagccggggtatttcaagctggctggcgcacctgcctcggattcactttga

SEQ ID NO: 16304 - DNA, 228 bp, A.fumigatus
tatcaatcatacttcatgtgttctacagatgaagaatatatttctgcatttatcggatactactactatctcacatttcagagcgtcatacttggaagatataatccttgcactaacaatggctacaatatgcctcaatgctcacacatcaagaggttcctaatatataggtgggtatttatccacataaaccaagttaaccagtacattatgcatgtttacacttga

SEQ ID NO: 16305 - DNA, 810 bp, A.fumigatus
cacccacctttacgtttcttctcaaccccctccctcattctttcggctttgtggtgcagcatgttgcgattaccggctttcctaggcgttatctgcgcctttgctctcggacagacgagcaaagcatcgtccagtgcctttgagccagacaatttcgatgtcaacgccgcgctttataatcttggggtgggatgttctacgatccctgccctgaaggcactgcagccccaattcaaccaaaattgcctggtcgtgcaactgtcagtaacctccattggtaaatccaggacatatatacgaaggactgatgtttcacagtgtggtgctcttggctttctgtacggcccaagtagagcgttcgcgcagaataccactgcgtactccaacgccacaggatcgtactggtcagcccagcaggaggaagttcgtcctgactgcatcttccagccatcggtaaacaccgatgtttctatgattgtccttctcgcaaggtataccggctgtcccttcgccatcaagagcggtggccatgctgcctttgcgcgtgcatcgagtatccagggaggaattactgttttgctgaaggacctgaacaccatcactctaaatgacaataggtccgtcgtgtcagtcggtcctggtaatgtctgggtccaggtatactcggccttggagccctatggccttgctgccatcggcggccgggtttccacgatcggtgttggagggcttacgacaggaggtgggatctcgttctactccaatctatatggttgggcttgcgataacgtcgagagcttcgaggtatga

SEQ ID NO: 16306 - DNA, 474 bp, A.fumigatus
cggtatagttctatcctgaccggcctgcctgccggcacgtatggatccgggaataattggatggaaagcgaatggcatgtccaaaactctccttttcccaatctctattgggctacgacttcttggaacatgggtgcggctttctggcctttgatcttcgtgcctcttaccgaatcctccggtcgcatgcctggctacttcgtttcatatattatcctggtcgctacactattcggatcggccttcgcacacaattttgctacaatcgtagtcacccgcttctttggcggtggagcgtcgtctgtctcgatcaatatcgtcggagggagtatcagcgacgtgtggcaaggtggcaaagcccgtagtctgcccatgtctctgttcgggtttacaagtgtgatcggaattgccctgggcccgttcatcggctctgcaattgtgcaaattaagaaggatgacccgtggagatggtaa

SEQ ID NO: 16307 - DNA, 702 bp, A.fumigatus
  unsure (70): Identity of nucleotide sequences at the above locations are unknown.
acttgccctgtaccaaaggtatgcttgtctgtttggttgcaaggggggggaaaaaaaccccaagggttgngacatcttgatctgactagtcccagtatctgcctgagttattacatgacgttgttcctcgaactcttcattgcgatcatgaaagagtaccagcaagaccatcgcgccgatgccgagctgctttcgtccttcgcagcccacatgaacttcttctccgccaaatcctcccctacatctcaagcgtccaaagccgcctacatgactagtctctgtaccgacattgctctcgccatccagatgctcgacgatggcttcccgcaacaaacagccctgtcgaggccaaattctgtcccggactctccaggtctcacgaccacctctactgcgtcgacctttggacctgagatactcgagagctcgtcatggccggcgggcatccccacctcatatataggagatccctcctgggaattatcctcctttgccactgacggaaaccttaacatgaagatgcacgaaacgcaggccaagtcttacgagcagtatggactttccgctgaaagtacccccactgcaggatttgcctacagatcagacctggcggggatgggctcgatggagtttgatgcaatgcttgatacgtttgcttcatatgatcatgtaggcgcacttctgcatagcgaccgaatttag

SEQ ID NO: 16308 - DNA, 300 bp, A.fumigatus
gacagtagacagataccccgatctgaatcaaggctgttggggtttagccatcggtgttggcaagtctctcttccccataggggtatgtggattaacgatcgaggctgctggaccgtcagctaccacatcatgtatagtctcggcaaccgagttaccaagcactctcctacccgcgggtacagcatggtcctcagggctgcgatgacggtgcggcttgcgtcgtggctgggtcttgtctctaccatgcagtgcattcccggcgctgtggttggtgttgcgctggtgaatatggacctgtag

SEQ ID NO: 16309 - DNA, 282 bp, A.fumigatus
ctacctagtggtcctatttgtatgcataataatccgctttgggttcctccgtataaaatacaaacaagcttactgcattggaacaatatgcatgagcacaaactgcatgccgcgcataaccctgttgatcaagcatttatttcgctgcagtcgagggctcaacggagcggggtaacaaccgtgcgccgattaacacagatcgatctgaataacttcatctccaaacacccccccccaatcgtcgctaaactcctcgatcccactgtcatcacgccaagatga

SEQ ID NO: 16310 - DNA, 576 bp, A.fumigatus
atctactattgcatgctggtgctggccatcgtgggcgcaggcgggatctacaccgggaccaatccgtcctacacgacgagggagctggtgcatcatttcaaggcggccgacgcaaagttcgtggtctccgagccggagattgtgacgtctattcttgcagccgtcaaggagcgaggcatccccgaaggaaacctgctcatcttcaatgtcctgggacaggaagtacccgccggtcgacgatcatggacggatctcttcagccacggcgaagaggactgggtagcattccacgacctgcaacgagccaaggaaaccaccgccgctcgactattcagcagcgggacgaccggcctccccaaagccgtgaccctcacgcatcacaacctcatcgcgcagcacgagctggtcttcgaggcgcatccccgcccataccaggtttcccgcatcaccgcgatgcccgtcttccatcggcgccgcggtctttgcacacgtcggcgccatcaaaaccgggcacaccacctacatgatgcgccgctttccacctcgaaccgtacctggtgtggcacgagaaatacc

SEQ ID NO: 16311 - DNA, 213 bp, A.fumigatus
  unsure (210): Identity of nucleotide sequences at the above locations are unknown.
acatttttcttccgccttctgattgataccccctccaaattggcgcgttgtgttgatcatgtcccagtgatatttggtgaaatcgtgcctcagtcaatatgcgtccgatacggtctcccgatcggggcctggatggctccctgcgtcctagtgctcatgtacatcatgtccccagtcgcttggcccctggccaagctgctgtacagtatntga

SEQ ID NO: 16312 - DNA, 300 bp, A.fumigatus
ttcccttccctccgcaggacgtgtgtttgtccattaaggacccccagcccgcccaccaacacacgcccgcctcaccagcccaccgtccccatcccccaagtccaacccggaagtccaagtccccggcccgaaggcaattccttcctccactgccccccttatccctggcgagcgccgtgtgcgtgtccatcaaggacccctagcccacccacgttccgcaacacgcgctgcccccgtttaccttatgccactgcgaggataccgagccgaaaacgtcaacatctagggaaggaggaatag

SEQ ID NO: 16313 - DNA, 2703 bp, A.fumigatus
  unsure (1249): Identity of nucleotide sequences at the above locations are unknown.
atgggtgatattcactctgggcccgtttccggcccggttctgttgctggtttcccagtttcaccccccaaaagcctcgcttgacaggagaacattcactcgatctcgcttacctgttgctggagcaagtttggtgatacttgacactcgtgttgtgtttcccctgcctcctgctcattatctctctctccttttctgctctctctctctctctctctctctcctactcctctccttctctgcgaaatcatctcatatcaccatctttcaatcttctaaagcgataatcaagcaaatacttactcgtcaatcaagatatcttcatatcaaagaatctcatcaaggagccaccaagcgcttctcgtctctcggcaacatttcaaaagacaagaatcttgtgttgtcgaattcttttccctccaccaccctcccaagcacgatgacttctcacgttgagatgtacttcctgtacggagaagcctacgacgaaactgccccagttacaagggtagaggcctggatcagtcagttcgcttacgcggacttgacgaccggcgccgcgctttcctttgcgctcgtcactcttctgggggtcatggctctgttttgggaggatctcgctccctggatctcggccgtcgcgaagagactcgtctcaccgatccttgccgtggttgctgcagccagttcgctcgttatgcagctggttagcatccgctctcgtcaggagctcggcaccatcgtgcagggttgggtcaagcagccgattgtcgactgtcgcctcgtccgactcgtctccgccgtggtcagctggtggttcccctccaatcaacccctgacaacagtctgccggctagccggttcatttgtctgcggtatgaccgcgtacgtgtggctcttcttccctctttcgcagttcctgtctggcttcgccggcgggctagtgactgagacgaaggagatgtccctgtactgcatgggcatccacggacggtggaccgtcgctagtcggcttacctggcgtcagtgggggatggtcgccttctgcaacggtgaggagaccggactcgagctgcgcgcgataatcgaggacgattggcaactgccccgtcttttcgacctcgacggcgagatccaccacctccgaatccttgctttcgtggttgccagtgtctcgctcgccatcacggcggcatggtcgttccgcgctctctccgagaccgccctgttcgcgcgtgttgtcgtcgttntccagcagccctcgtctccgggccagagagcggaccatgtcgccggcagcgagacacagctttctgggtcgtccatcaacaggcggcaggatgacttgatgaacctgatcagcaggtacgaaggcatcctttccgaaaaggaacgtctcctgtccgccacgacccagaagcttagggcgaccgagcaacggctggaggatggctgggctcaagccaagcggctggctgccctccacgtcaaacgcgacgaggaaactcgcgcccgtgagtcgaccgacgttgctcagttgcgacgcaagctcgcggaaacggaggcacggctcagcctggcccatggtagagcgagagcggtggaagatgatgccactgcgagagtgcggtccctctgcaatcaagtggccgagctggaacagcagctgcaggcccagagggaacaggcagggaacatttccctgggcgaagtccattcgctcagagccgaactcgaggttcggaatgaccagctcgtcgcagtcgagcaccgcctggccgccgcagagacccgagagcgcgactctcgtggccgggcaaacgatagcgaagccgaacgtcgccaactcgccgatcgcgtccacgagctcgatgctcaagcccaggaactcactgcccagaacgaggtgctccaggccttgtgcgactccctgtcgcgggagtgtggttctctggcggcaatccagcgggagcgtgataacgccttcgggctgatatccgccctgcagcacgagctcgtgtcgacaagagcgacggcggagaccgcatttagggaatcccaggagtccctcgctcagactcgcgcagccgaatcaaccctccgacaatccatgcaggaactcaggcacacctgcgacttgactctcgcgcaggaacgtgcggccagtgctcgagctcaggctcgggcatccgaacttggggcggaggtcgaagacctccaaaccaaggtcgggctggccatgagggacgcacagagggcccaggagagggcggagtctgcggagaggaccatcgggatcctccagacccgcctgaccaggcatgaggacgctgcccggggcgcgttgcaagagatccccaagcgccagattggcaacttggggtccatctccaccgccctggccgagagcgaggtgaaggtcgcccagcagcaggccgaaatcaacgccctccgatgccaagtcgagcagttcaagctgcagggaccgtcgggcccgatcgacaaggctgtccaggaggacgttcagaagctgcgggctgcccttgatagggtacggagagagcggacggaggatcaactccgttgggacaagagagtgcgtgagctggaggaggacaaccgaaagctgcgcgtctctctgtcgaacgcagaggcagcgtcgggccgccgccctggcggtcgccggcctcctactctcccctga

SEQ ID NO: 16314 - DNA, 816 bp, A.fumigatus
  unsure (803),(813): Identity of nucleotide sequences at the above locations are unknown.
aggacattctcaaccaatagcaccgatacggccctctctccgcacgacgacagcgtagctatgcaggaaaagtcgacaaccatcgccgcatacgcagccggagcatccctggcggccgtggccctcttctacgtcttcgggccaaattacacaatcgacggcgatgactcgaacgacagtaaccgcaaaaaaagcattgtggggctgtcgaatccggcaaacgactgcttcatcaactcggttctacaggcgctcgcgggtctgggtgatctgcgtgtatacctgatcagggaattacatcggcgtgaactggatggaccggacgtatataactcactgccagaggcaaatgagacgccgcgggggatgacgcccgagagaatccgcgaactacaacagggtacgatcacgcgagctctgaaagagatgctggaccgattgaatgagcgtccgatttacaagaagaccatcaccaaccgggctttcatccaggctctcgagtacgcattccgtactcggatcagccgcaatcagcaggacgcgcaggaattcctccagatcgttgcggagcgtctttgtgacgagtaccatgccgggttgaaggcacgacagcgtgcacaaggtcttcctgcaacgctgccaggctcgggcggtgaagaatcggtgcaaagcagtgctgtcgagaagggatctgctgaaatcgaagtgcggattgacgatgggactgagatgggccttccggcaatcatcgataacaaactgaaagagatcgacaagcgtcttcaccacgggggtcggccganccgcgctagncat

SEQ ID NO: 16315 - DNA, 324 bp, A.fumigatus
ggagttggagcagttaaatcgagattcgtccatatacctttcttcggacgacattctcacgcaatagttgtacagatcggcgcccccctcgtcgaggaaggttcatgggtaaaggacgcacccaaagatgcctacatcctcggtctgaaggagcttcccgaggacgattttccgcttgagcacgtacacatctcctttgcgcactgctacaagcaacaggctggctgggagaaggtgctcagccggtggccccgcggaggcggcaccctcttggacttggagttcctcacagatgagactggacgccgagtagctggtgggtga

SEQ ID NO: 16316 - DNA, 255 bp, A.fumigatus
aattatcttggtttgctatgtgtcacatattggggaaggctcacgttatgtacaggttctgctttggccattaagaactgggcctggcaattgacgcatcctgagggcgagccgcttcctggcgagactccctacgcaaaccaggatctgttgattgagtcagtgaaggagtcgttggagtctggcaagaagctgtccggcaggccgcccaaggtgcttgtcattggagctgtgagtgtgcatttgatgagctga

SEQ ID NO: 16317 - DNA, 207 bp, A.fumigatus
tctagttttctaggtggccccttcagagagattgtcgaggatgcagacattttcatcaactgcatctacctctccgctaagatccctcctttcgtcaacaccgaaactctgtcttctcctaaccgccgcttgtccgtcatttgtgacgtgagcgccgacacgtatgtttcactctggactcttgaggagaaaggacgttctcactaa

SEQ ID NO: 16318 - DNA, 309 bp, A.fumigatus
cattctggtcttgtcttactcagaaccaatcccaacaatcctatccctgtctattccatcacaaccactttcgacaagcccacagtcactgttcctcttccggaactggcccagggccctccattgagcgtgatcagcatcgaccacctcccctccctccttcctcgtgaaagctccgagatgttcagcgaagccttactgccgagcctactgcaactcaaggatagaaagaacgctcgtgtctggaagcaagcagaggacttgttcaacgaaaaggttgctaccttgcccgagtcgatgcgcgcttaa

SEQ ID NO: 16319 - DNA, 372 bp, A.fumigatus
  unsure (23): Identity of nucleotide sequences at the above locations are unknown.
tggatcgcgtgtcctgccagccnccgtggtagaagatctgagcccctacacggcactgtcatcgacctcttcgaccaatggattaaaaaatcccccgagagagttgcagcagagtggcaaggcaaatctctcacctacggggctctccacgacgcctctctccatgttagtcgcgctttattattggccggtgtattgccacgcgcccgagcgccgctgttgacccaaatgtcactggagattcttccgccagtgatcggaattttgagggtagggtcctgctatgtgccaatagatgtggccgcctggagtcgtgtccgcatcgaggcccgcgctctccgagccggcctccccggtagcggtcatcactag

SEQ ID NO: 16320 - DNA, 258 bp, A.fumigatus
cttggaagtgggacatcccttcttaagggtggccctgccagtctgttcattgaatacctgattagtagttcaattctctggtccgtcttacagtgtattggtgagatggctgttgtgtaccctctgctgtcggcttttgtacagtggactatgatctttattatcccagcagctgggtttgctttgggctggggatactggttttcctactggattaccattactaatgagcttcaggtacagatcacgacgctataa

SEQ ID NO: 16321 - DNA, 255 bp, A.fumigatus
tcattcattaatggctttgaaggattcattaccatcctccctacatgtgtttttgcaatggctgggtcagaaaatgctgccttggtagcgacagaggttgcaaatccccgacgatcagtccccaaagctgtcacgtccacctggctccgtcctggactcttctatatactagggagcctaatgattacactgactgttgaccctaaggaccccaacctgtttgggggctttggaagcaatgactcgcccttgtga

SEQ ID NO: 16322 - DNA, 360 bp, A.fumigatus
ggagatgaaggagtccaatcatggcaaggtcctaatctcagagcctggtttggctgctggatatctcaacaatcttacattaacagcaaaaaaaatatcaaatggaacggcgagcgcttctacaggacaggggatctcgcacgcacgactgaagatggacagctgatatgggcaggttgtgcggattctctcgtcaagaatcgcggcttcctgatcaatatggagaccgaagttgaaccagcaatacaggcttatcctcaggtcaacttatctgtggcttttcagtggcgtgataggcttgtgtgttgtgtacagccatccacagttgatgttggaagaactacacaaatttatgcatag

SEQ ID NO: 16323 - DNA, 297 bp, A.fumigatus
cgagagcaggtccaatatgccggcggtcccgtctacacactggccctgctaggcttcaaagtctcgcttttggcctcgtacctccgtatcggcgggttcgtcaaggcctaccgcaccgtcatcatcgccgtcatcgtcgcctgtgtctgtaaccagctggcttttacgttcgtgctgtgttttgcctgtcgcccgatcgccaggcagtgggatatgtcgattcaaggcagctgcatcgataccgttgcatcttactacggtaggtccgcccgttctggtgcggccgtgccagactaa

SEQ ID NO: 16324 - DNA, 492 bp, A.fumigatus
atcgtcttcgtcgatcatgggccccttcttcaccaacggcacctgcgacccgttccacccggtctcgaagccctgcacgctgggcaactacgtggtctacgcggtcaacgtgagcagacccgagcacatacgcacggccatgcagttcgccacgaaacacaacatccgcgtggttgtccgcaacaccggtcacgactacaacggcaagtccacgggggccggcgctctggcgatctggacgcaccacctcaaggacatcgagatcaaggactggtccgaccagcactaccagggcaaggcgatcaaggtgggcgccggcgtgcaaggcatcgaggcgtaccgggccgccgacacgaacggcctcgaggtcgtcggcggcgagtgtccgaccgtcggactggccggcggctatacccaaggcggcgggcactcggcgctggcgtccaggcacggactggcggccgaccaggtcctcgagtgggaggtgattga

SEQ ID NO: 16325 - DNA, 855 bp, A.fumigatus
cggacagggcaatttcctcgtggccaaccgcgacaacgagcacgcggatctgtactgggcgctgagcggcggcggcggcggcacctacggggtggtctggtcgatgacgtccaaggcgcacgcggggacgccggtgtcgggcttgaacctgacgtttaccaatgccggcatctcgcaggatacgttctacgaggcggttgcgctgtaccattcgacgctgccggccatcgtcgacgccggcgccatgagtgtctggtatttcaccaacaccagcttctccatctcgccgctgacggggccgaatatcccggtcgccaagctgcgggagctggtccggccgttcaccgacggactgacccggctggggatcacgtataccacctacgcggcgcagttcgacagctacttggcggagttcgaggccatgcagagcccgatcgaggtcggcatcgcgcagtacggcggctggctgattccccggtcggtcgtgcagaccaacaacgccgagctcaccgccgcgtaccgcgccatcacgtccgatggcgccaccttcatcggcgtgggactcaacgtctcgaccgcggtcaccggcgacgtctccaacgcggtgctgcccgcctggcgcgacacgctgatcgacaccgtcatcacgacgccctggaactggaccgctccgacggccgacatgatcgcgctgcagcacaagatgacggacgagtacattccccggctggaggcgttggcgccgcagtccggggcgtatctcaacgaggcggatttccggcagccgaacttccagacggcgttttatggtgcgaactatcagaaactgcgggccatcaaggccaagtatga

SEQ ID NO: 16326 - DNA, 363 bp, A.fumigatus
ccaggaacaagtctcgccttcgactgcatcatcatcgccctccccctccccgtcctgatcaccctccgcctccagcgccgccaaaaagccgccctcctggccgtcttcgctctcggcttcttcgtcaccatcatccagatcatccgcatctttaccatcaagaacctcaaaacgtacacagatagccagcctatcgttctttggtctgtcattgaaattagcctcggcgtatgtctcccccacccattccccccctcttcccccaaccatcacttgctccgatccagtcatcgctcgcttcagtcatcgctcgctacactcctctcgcttcgcaagctcgctaacctactgacgggcaggtaa

SEQ ID NO: 16327 - DNA, 1461 bp, A.fumigatus
gaaactgacaaagcaagctatgaatcgtcttcgtcgatcatgggccccttcttcaccaacggcacctgcgacccgttccacccggtctcgaagccctgcacgctgggcaactacgtggtctacgcggtcaacgtgagcagacccgagcacatacgcacggccatgcagttcgccacgaaacacaacatccgcgtggttgtccgcaacaccggtcacgactacaacggcaagtccacgggggccggcgctctggcgatctggacgcaccacctcaaggacatcgagatcaaggactggtccgaccagcactaccagggcaaggcgatcaaggtgggcgccggcgtgcaaggcatcgaggcgtaccgggccgccgacacgaacggcctcgaggtcgtcggcggcgagtgtccgaccgtcggactggccggcggctatacccaaggcggcgggcactcggcgctggcgtccaggcacggactggcggccgaccaggtcctcgagtgggaggtgattgacggacagggcaatttcctcgtggccaaccgcgacaacgagcacgcggatctgtactgggcgctgagcggcggcggcggcggcacctacggggtggtctggtcgatgacgtccaaggcgcacgcggggacgccggtgtcgggcttgaacctgacgtttaccaatgccggcatctcgcaggatacgttctacgaggcggttgcgctgtaccattcgacgctgccggccatcgtcgacgccggcgccatgagtgtctggtatttcaccaacaccagcttctccatctcgccgctgacggggccgaatatcccggtcgccaagctgcgggagctggtccggccgttcaccgacggactgacccggctggggatcacgtataccacctacgcggcgcagttcgacagctacttggcggagttcgaggccatgcagagcccgatcgaggtcggcatcgcgcagtacggcggctggctgattccccggtcggtcgtgcagaccaacaacgccgagctcaccgccgcgtaccgcgccatcacgtccgatggcgccaccttcatcggcgtgggactcaacgtctcgaccgcggtcaccggcgacgtctccaacgcggtgctgcccgcctggcgcgacacgctgatcgacaccgtcatcacgacgccctggaactggaccgctccgacggccgacatgatcgcgctgcagcacaagatgacggacgagtacattccccggctggaggcgttggcgccgcagtccggggcgtatctcaacgaggcggatttccggcagccgaacttccagacggcgttttatggtgcgaactatcagaaactgcgggccatcaaggccaagtatgatccgaatagcctgttttatgggacgaccgctgtgggatcggacgagtggaccgtcacgtcggatggacacttgtgcaaggccacgccatag

SEQ ID NO: 16328 - DNA, 300 bp, A.fumigatus
ataccgcggtgcaatgcttccgtagcaagcatgggttgggtgtacaatctcaaaacccccgaccctcacagccaagtcccccgtgtcattgccatctgcctggtcttccccattgtcgccttcctggcggttcttttgcggctatatgtgcgcatccacaccaaacgcgccgccggggtcgatgattatgccgcgctgttcagttcgattctggccatcgcctatggcgcgataagcattgcgcgtgagtctctccaacacaacactggagttgcaatggcgatgatgctgactggctga

SEQ ID NO: 16329 - DNA, 213 bp, A.fumigatus
caagtcaaacagaccaagaacccccacccgaatgtggacgccgcctccggagtcctcttctaccactacggcttccagcagcctctatactacaccgtcacctttggcgtcagccgtgctttgggaccattggtgcagctcatctgggaccgggccttgggcttacccatcgagcgacccaagagtatcaatctgctgggattgaagaagtga

SEQ ID NO: 16330 - DNA, 345 bp, A.fumigatus
acgtcaggttcaagcccgacaccggcgtccccgcgtgcgccttggacgtcatcgaccagaccaccccgtaggtgccgccgccgccgccgctcagcgcccagtacagatccgcgtgctcgttgtcgcggttggccacgaggaaattgccctgtccgtcaatcacctcccactcgaggacctggtcggccgccagtccgtgcctggacgccagcgccgagtgcccgccgccttgggtatagccgccggccagtccgacggtcggacactcgccgccgacgacctcgaggccgttcgtgtcggcggcccggtacgcctcgatgccttgcacgccggcgcccaccttga

SEQ ID NO: 16331 - DNA, 1518 bp, A.fumigatus
agtatagctccttcacatatcctcttacaagtatacactgttcgactgccgtacgggctatggcgtggccttgcacaagtgtccatccgacgtgacggtccactcgtccgatcccacagcggtcgtcccataaaacaggctattcggatcatacttggccttgatggcccgcagtttctgatagttcgcaccataaaacgccgtctggaagttcggctgccggaaatccgcctcgttgagatacgccccggactgcggcgccaacgcctccagccggggaatgtactcgtccgtcatcttgtgctgcagcgcgatcatgtcggccgtcggagcggtccagttccagggcgtcgtgatgacggtgtcgatcagcgtgtcgcgccaggcgggcagcaccgcgttggagacgtcgccggtgaccgcggtcgagacgttgagtcccacgccgatgaaggtggcgccatcggacgtgatggcgcggtacgcggcggtgagctcggcgttgttggtctgcacgaccgaccggggaatcagccagccgccgtactgcgcgatgccgacctcgatcgggctctgcatggcctcgaactccgccaagtagctgtcgaactgcgccgcgtaggtggtatacgtgatccccagccgggtcagtccgtcggtgaacggccggaccagctcccgcagcttggcgaccgggatattcggccccgtcagcggcgagatggagaagctggtgttggtgaaataccagacactcatggcgccggcgtcgacgatggccggcagcgtcgaatggtacagcgcaaccgcctcgtagaacgtatcctgcgagatgccggcattggtaaacgtcaggttcaagcccgacaccggcgtccccgcgtgcgccttggacgtcatcgaccagaccaccccgtaggtgccgccgccgccgccgctcagcgcccagtacagatccgcgtgctcgttgtcgcggttggccacgaggaaattgccctgtccgtcaatcacctcccactcgaggacctggtcggccgccagtccgtgcctggacgccagcgccgagtgcccgccgccttgggtatagccgccggccagtccgacggtcggacactcgccgccgacgacctcgaggccgttcgtgtcggcggcccggtacgcctcgatgccttgcacgccggcgcccaccttgatcgccttgccctggtagtgctggtcggaccagtccttgatctcgatgtccttgaggtggtgcgtccagatcgccagagcgccggcccccgtggacttgccgttgtagtcgtgaccggtgttgcggacaaccacgcggatgttgtgtttcgtggcgaactgcatggccgtgcgtatgtgctcgggtctgctcacgttgaccgcgtagaccacgtagttgcccagcgtgcagggcttcgagaccgggtggaacgggtcgcaggtgccgttggtgaagaaggggcccatgatcgacgaagacgattcatagcttgctttgtcagtttc

SEQ ID NO: 16332 - DNA, 1218 bp, A.fumigatus
cccgctggatccttccagccccgtggtgaagaccgatattataagattgagccgacccagcggaccgctgagcaaaagacactcgaaactggactcagtccaaaggaagaaatcgccattgctagcaagctgatcacacccctggaaggactcgaacagtatggttatgtgaccaggaagcctacaaaggaagaagtcgagaatgcacggaggggagtcagcgagtcaaagggctgggagaagtgtgacagatgtggcggacgatttcaagtctttcctggccgtcgtgaagatggctcattgaccactggaggtcagtgcacataccatcctggcaagccatactacccaccgaggagacaaacagaccatatcaccggtgctagagatgcatactttccttgctgcaacgagtccatcggaacttcgtctggctgtaccaagggaaacacgcatgtgttcaaagtatctgaatctaaacgcctggcgtctattcttcaattcgaagagacaccaacccaggccgataaaggaccccagcagccggtctgtttcgactgcgagatgggatacacaactctcgggcttgagctcattcgtctaacagctgtcagctggccccaaggaaagctccttttggacatcctcgttcgacccatgggcgaaattctggacctcaactcgcgcttctcaggcgtgtttcccgagcattatcaaaaggcaattccctataaaagcactagcagcccttccactactggggatggcgccttgcaggttgtggaatcaccagcagcagcacgtgcgctcctgttcaaatttttacaacccgatacacctttgattgggcatgcaatcgacaacgacctcaacgcttgccgtattatacatccaacaatcatcgataccgttctcctctatccacacccacgagggttgccaattcgcatgggcctcaaagctctcgtcaagaagtatttggatcgagacattcaaacaaaaggcagccaaggccatgattccaaagaagacgcgatagcgaccggtgatttggtcagggtcaaggctgccgaaacatggaagatcttgaagtccaaaggatggcggatagagggcagtaagctcatacctccgcctggtgcaaagggtgcgtcagaggattcgaagcttgggcctggggccggccacaaaagaaaggatacggaggtgatgccttga

SEQ ID NO: 16333 - DNA, 249 bp, A.fumigatus
acaactgagaactgggctattctctattatagcaacatgaggcgttggctctcttgcttacatgatgctatgttgacaaacctcctgctctgccatcgacatgtagtattaagttcaggatggcagttagtctctgaattggacaactgcggtgatttttacaacaatgactgctttcgagaatcggatatgatcctggatgctttcattgcccctcctgatcagttggccccgcgttggacatgttga

SEQ ID NO: 16334 - DNA, 303 bp, A.fumigatus
catctgcgatcagacttcgcggtaatctacctctgcgacattgacgaggtaccggaattcaattccatgtacgaacttttcgatcccatgacgatcatgttcttctggaggaacaagcatatgatgtgcgatttcggcacaggtaacaacaacaagttgaattgggtgcttgaagataagcaggagttgatagacattattgaaactatctacaagggtgctaagaaagggcgcggtctcgtcgtgagtcctaaaggtcagcactctcttttgttgcggatctcattcgggctcgtatattaa

SEQ ID NO: 16335 - DNA, 201 bp, A.fumigatus
tacatcatcaacgcttcgcagcccgcgagcgacaagatcttcgatgtctccgcctttgagaagtttctccacgaccgcatcaaggtcgagggccgtgtcggcaacctcggtgacaatgttgtcatctcccaggttggtgagggcaagatcgaggttgtcactcacatccccttctctggtcgctacctcaagtacctgtaa

SEQ ID NO: 16336 - DNA, 237 bp, A.fumigatus
gactccactgctagcgaaaagtttcatctacactcctctctcaaggcgcaggataatcacctctttgcgaccacatactccctgttaatcctccccaaaaaaaccccccatcagtcacaatggcccccgttgctgtatgttatcactccacaaactgctttgctgttcctccatgaggaccggacatggtgcgcttctcgtcttcaatcgcggattttccacaagacgcggttctaa

SEQ ID NO: 16337 - DNA, 726 bp, A.fumigatus
gcacttccttcgggtgttcgggtcgtactgactggccagcccacctaccagtgcatggaacagtgggacgctttgcacgccatgctcctctacgagatcctcgagatgggcatcgcgcccgtcgacgagtccgagagttggaaacagaagcgccgcacaaaagggctgaaatcgccctttctctccaagatgacccagtgcttctcgcggtcgcaccttgagttgcacgatacggccctgctgccattccccaacggccacagcaccgcaaacagctcctgggtcacatgggccgtggccgaaaccgtccgccgcacgatattcctcgccaacattgtccacttcttcagccaccgcgatctccactcccggcgccaatcgccctactacgagcccctcaacgatgagctcattctgaagatgccgctgccctgcgatcaagcgctgtggagcgctcgcaccgaagacgagtggcgcaaagccacccccgcgtctcccggctcgccaggcatcactgacgctttgtcaactttgggccctgttggtgacctcacgggccgggggcagctcccgaatggccaataccagcagccctcgctcgaaatgcttttctccaagttcgccatagacgacctccgggcgacttgcgtgacgaatgcgggttttgccgactcggatgagctgcggtcgcttatcattctctgtgcgctggagcaattcgcgtga

SEQ ID NO: 16338 - DNA, 249 bp, A.fumigatus
gcactaagtcaggaaacgaaaacacagggaactgacgggacttgggactcgcacgcaacttctaatagctcccctgatataggccaggaagatagccaaggttacatcgatggcaccgccttcatcaatgctagaccccgcgcttaccacacaggggatggcttcggatccttcgtaaatctcacctgttcattgtcggtccttcttactaatcctttgtctgtcttcttaccaaggctacagacatag

SEQ ID NO: 16339 - DNA, 1074 bp, A.fumigatus
tgtctagaccgatggaccccaggtgacctcctcttgcgccatcgacgacgatgtctgcgggcgaacaaacccaagatacgccgcagagcctgtaatgcctgcgtgctagcgaagaccaaatgctgctgcacccagccgatctgctcgcgctgtgccaaacggggcattccttgcgaatacgtgtgtacggtcaacacagcaaccaccattgtctctgactcttccgactcctcgcccccgtcgaccagagatcaccccagacctgatgaaacccgcgtgagcacgacagacttcccgtcgatatggagcccgcgaagcatgctgggtggtcccagtgccgaaattttcgactcgtggagctccccgaacgtcatctggaccgtggatcccctcgatttcccctcgttgccctcgtcagcaggcttagttgacgaagtcactgtggacccggcactggccatcccgaccagccatccgagcctcacatttccgagggcatcggcttcgtcgcagccgctcagtacgccgagggagatttccatggtgccgccaggtccagggaccaccaatacatccctgaccggtctgggcggcagtcccgacgtgccgggggtgcagccatccaactacatccgtctgctggcacagtatccgagactgttgcttcaggacgatttctactgtccgtttgtgcaccgcaccctgttcagcgagcaagtcgcggacatgacgattctgccccacacatccatggccatttgctgcggaagtgccttgggcgtcaaagacgccgccggatacgtcaagcgagccatggacgcgcaacggcaaagcttgatcgagtcatatgtaagcacttccttcgggtgttcgggtcgtactgactggccagcccacctaccagtgcatggaacagtgggacgctttgcacgccatgctcctctacgagatcctcgagatgggcatcgcgcccgtcgacgagtccgagagttggaaacagaagcgccgcacaaaagggctgaaatcgccctttctctccaagatgacccagtgcttctcgcggtcgcaccttga

SEQ ID NO: 16340 - DNA, 1236 bp, A.fumigatus
  unsure (10): Identity of nucleotide sequences at the above locations are unknown.
cgtaggagantacaggaagacagaagccggcccggcccggtctggtacagaccgcaagcaggtggcggtaccgaggcatatatcaaggaagagccggtctcgccgccgcccttcgccgacacggcacccgcaatccatcctcaagaaaggccaatctatattgacattgcctcgcctcgccctccctatacaccagtatatgagagaatcgaaccggtgcgggagcctgcatacgagctcgatccttatcatgaagctcacgttgaagcgtcatacccaagaacggtttcgaggcttagtgctcggcgcccaatacgcgatgaccaagatctacggagggtcgcaagcttgcaccaggcccggcaaccagagtatactcgggagtacattgagcgacccagctctcgctcgctgcgcgctgcatcctacgctattgtggagcgtcctccgcaagaaagagtcaggtactatgacgacccgccgcaaacttatgccaggcactacgccccggcggttgagtcgccgacatcgccgcgctaccaagaggcctggatccaaggaagtacgacggcgcctccacggcgaatactgatagacgagcatggaaatcactatcgtgagaggactccgccaccaagaatgcaggcaatgcctccacccccaggtcgaatcccgcgaggcgatgtctacgatgacggcgtacgtcctagtggtagcgttcgagcagtctccgttgttgaggatccatattgtggccggagatacgtgcaggaaatgccaccgccgccactagcttatcgacgggtgacggattaccctcggcccgccccgagcgaaaggcgcagctacgtcacgccactggttgatgacagagagccttaccgacgcagcagtagcgtccaagttgccgggtatcctacggctcgtgcgacctacgttgaagaggcgaaaattccgcgagagaggatcatcaggatgccaagtgtgcggccccctgctcctcgatatgaggagccccgggagatggtcccgcggattggaagcgtccgcccagccgaacgagatgtaagtgtttatgtagacgatgacgctcgacggcctagagaatatatcgagcgacctgtttatattgcgccacgtcctctggcgagagaagaaagatactatgaaggggagccggagcgggttgccctcgatgggagagaggcagttcatcaggttccccagcgttattga

SEQ ID NO: 16341 - DNA, 198 bp, A.fumigatus
  unsure (120): Identity of nucleotide sequences at the above locations are unknown.
aagaagaactcctacttcagctgttgtatcctttggaacattttaatcagttcacacaaagtcctctatactgaatgttatgaacaacatctccccgaatcgcctgcggaaggtatccanctaactcctccattcaagcttaagagaacaattcctgttttcctgatcatattgaagcagcctaagcccttctcatga

SEQ ID NO: 16342 - DNA, 333 bp, A.fumigatus
atcgtcatatacgtctttgctcgtgtagtactagctcttgccaagctctctgttcagccgaatatgcaccctctctcctctttgatcactcccgagtcgcgcgcaaggatcgaggccaacgcttggccagtatttgcgagtctcagctgggcactcgttatgtacatcttccgttggcatccagagacgcttatgtcgagtttgagaagcagcatggtatacatgtatgtcttaaccccaaccgcacaatacgttcaggtactaatggtcttcagctactccgactcggatcactgggattcattccgcaacttcttgatatacaacaagtag

SEQ ID NO: 16343 - DNA, 993 bp, A.fumigatus
gtctttcttaatagcaaacccaagaatccgcgcacagcgcgcattctcaaggcccgtgagccccagctcatcgaaccccccaagagaaccctgttcatgcatggctcaaaatgtcccaccgcacttaacacagttctgaagacattccactcgctgacggtcccgcactccgtcctcttccacaagaagaacgagaacattcacccgtttgagagtgccgagagcctcgagttccttgccaacaagaatgagtgcggtatcgtcgttttcggaagcagcagcaagaagagaccaaactgcctgaccgtggcgcggatatttgactccaagcttctggacatgtgcgaattgatgctgctccctaacccggacggagattcgatccccccgatcaacaacctcaagatgcagatcggaattggtttacggcctatgctgctgttcgcgggtactgcgtgggatgactctacctctactgctcatgttatgctgaagagcatgttcattgatatgttcaagggcgaggagtcggataagatcgatgtcgagggattgcagtatgtgttgatgattgccgctgaggaacctaccgacggcctggctcctgtcattcatctcagatggtacaagcttcgaacaaagcgcagtggacacaaactcccccgtgttgagctggatgagatcggccccaagttcgacttcaagatcggtcgtctgcacgaggcacccgagagtgctctaaaggaggccatgaagcagggcaagagacctaatgagaacatgaagacgaagaagaacatcggtatggatatcatgggtgacaagatcggtcgtgtgcacttgggcaagcaggatctctctggccttcaaacgaggaagatgaagggtctgaagcgacgtgctggtgtggagtcagatgaggaggatgcggagatgatggacgtggacgaagtctcggatgatgagggacggaaaaaggcgagaacggaatag

SEQ ID NO: 16344 - DNA, 477 bp, A.fumigatus
  unsure (7): Identity of nucleotide sequences at the above locations are unknown.
acagtgnatttccacgcggcgctaagatactggagaacttgtagcctacatctgtgctcgagactggttgggatattttgttcttctgggtatgatttccgctccgttgtgttcgccgtagatgtgctaatcaacttacaggtcgctcgtatgatcatgcttggtatcaagctgaccggcaaagtgccattcaaggaagtgtattgtcattccttgatcagagattccgagggtcgcaagatgtccaagtctcttggtaatgtcatcgaccccttggatgtcatggagggtatcgagcttcaggctctccatgccaagctacttactggtaaccttgccgagaaggaggttgcaactgctaccaagtatcagaagaaggcattcccgaagggtattcctgaatgtggtgccgatgcgctgcgtttcgcccttgtgtcttatactactggtggtaagttcggatattgcctggcctaa

SEQ ID NO: 16345 - DNA, 1044 bp, A.fumigatus
gattgccgaatcaaagaactgactgactctggcctaggtggtgatatcgcattcgacatccaggttattcacggctaccgccgtttctgcaacaagatttatcaggctaccaagttcgtcttgggcagactgggtgatgacttcaagcccttgcccgccccttcaaagactggccgggaatctctctctgagcgctggattttacataaattcaacaccgctgccaaggaggtcaatgaggcgctggcgcagcgtgagttctctgtcgccgcttctacgacttatcattactggtacggccaactttgcgacatcttcatcgaaaactcgaagtatctcttggctcctgaagtgcctgccgaagtacaggaatcggccaagcagactttgtacactgctctcgagggcgctctgactcttattcaccctatcatgcctttcgttacggagcacctgtggcagcgcttgcctcgcagacctggtgacaagaccatctcgatcatgaaggctcgttatccccagtacaacccagagttcaacgaccccgaagccgagacagcttatgagctcatcttgaatacctccaaggctatccggtcgatccttgcccagtatgagatcaaaactaagggcgatattattatccagacctatgaccccgtcagctacaaaaccatctcggacgaagtgactagcatcaagtccctgggtggcaagtttttgggggagctcaccgttgctgacctcgagaacaccaaccctccttcaggctgtgtcgttgcccccgtcggtgcccaggccgctgtgtacctccgtgtctcgaaagaggtagctctggagcaggaggagaaggccaaggccagcttggagaaggcacgcgagactgttcgccgccaacagactctcgtcaatgccgctggatggaaggagaaggttaagccagaggttcgtgagcaggaagagagaaagcttcgggatgccgagagtgaggctgctcggttggaagagcagattcgcgaatttgagaagcttcgcttggaatag

SEQ ID NO: 16346 - DNA, 1179 bp, A.fumigatus
caagtggtctcagctgatcccagagcagaagtcctagagtgttccaacattgcctggcctaattctggcatgtggtcccgcgggcaacgtgtcttcaaatacaatgctggaagcgttctgagtgacgcaaagcaagaagaggacctgcatgcccactcgccaactcgacatgagaatcgaagcgtggtagctaacagcaaccgagtcagtaacccagcggcgtatacagcttggccgtataggaattatccacctcccccacctcagtggcaaaataacaacagggagacaacatggacgtatcaatctactcaagaacctctcatgacggaccctttcatcgatccacacatccttgaccccactgcacgccatcgaggggcaagaccgtcttgggaggacgtgtgtatgcctgattatatctccaattcatccagtagccgcgctatatccagcatgaccggtataagctacgagcatagcaagcaaccaagcattgttgctcctatcgatgaggaaacatattctcaacttttcgagggagtcagtccgccaaagcctctcgcctgcatttctcaagcacccaagaatacgtcatcagcattgcctcctgttgcttctaaactttctgctgctggcgaagagcgttcatcatcttgtgtcaagacagcaaggcgtccctcaattctgaaggagctttcacagccagtatccagaagcgtctctggttccagcgccaaatccagtctccctgccgaggcattgctggaagctacagcaacttgcaaactgcacgttagtcctactacacagatcaggagcaagaaggagggaaactgttcggataacaaagagaatgaggcctctagcgagacaccacgtcgggataatgacaaggtcgaccgtacacctgccaagctcaccgtgcgcacgagtggaaattttgagacacccgtcgagtccagacgacgccgttctaccacaggttctgctcgtggaggcgtgagtctcatcactgaaagggagacggtgctcctcagtccgtccaagaacttacccgtggtcgaaaatcatgtcacggtagtggaaaaccatgatcaacacacaagctttgatgactttctggatacgaaacttcaaatcgtcgacaccgctgccgatacaatcgagattaattaa

SEQ ID NO: 16347 - DNA, 351 bp, A.fumigatus
tcgtcaatccgagaaatcaacatggccacaaagattgctggaggcttacacagagcgcaggaagtgcttcaaaacacatcctctaaaagcaagaaattggtcgatttagaaagagatacggccgatgcgcatacccagcagccattgactacggatcacggtgtacgagtcagcaacaccgatcaatggcttagagttacgaatgaccgccgaactggcccatccttgctggaggatcagattgccagagaaaaggtaaacatattgcatgtaaatactctcaataaatatggtattgatgatattcgcagatccatcgctttgatcatgaacgtattcctgaaagagtag

SEQ ID NO: 16348 - DNA, 498 bp, A.fumigatus
cacccagatcagccgcctgggcatcaattgggaagagctgccaatcaaccgtccagtgtgccctgtgctcaaccacaaccgcgacggacagatgcgccatcgaatcacgcaaggcacggtcaactactggcccaaccgcttcgaagccgtgcccccgaccggcaccaagggctccggagtgggcggcgggttcacaacctacccccagcgggtggagggcatcaagaaccgcgccctcagcgacaaatttcgcgagcaccacaaccaagcccagctcttctacaactcaatgtccgagcacgagaagctccacttgaagaacgctttcagctccgacctcgaccactgcgacgacccccccggtctagaacggcttccccggccaatcgctccccgatttcgaactcgagctccccccaaaaattccccaaattggcggggcccccaattcctcccaagggccctcaagcccaaaccatcgggcgacgcgcctcggcc

SEQ ID NO: 16349 - DNA, 1134 bp, A.fumigatus
ctcctgctgctgattccgtcagatctgactgtgctatcagtccatgctgtcaagccggagcctcacaacgaggtccctcaggcccaaacagcccacaacaacttctgggattttgtgtacttgcacccagaagccacccacatgttcatgtgggccatgtctgaccgcgccatcccccgatcctaccggatgatgcagggatttggtgtcaatacttttgctctcgtcaacaaagaaggaaagcgacactttgtcaagttccactggatcccccatctgggtgttcactctctcgtgtgggacgaagccttgaagctgggaggccaagaccctgatttccatcgcaaagacctgatggaggctatcgacaacaaggcgtatccgaaatgggacttcgcaatccaagtcattccagaggagaagcaggatgactttgagtttgacattttggatgccaccaagatctggcctgaagaccttgtgccccttcgtgtgattggagagctcgagctgaaccgcaacgtcgacgaattcttccctcagaccgagcaggtcgcattctgcaccagccacatcgtccctggcattgacttcaccgacgatccacttctccaaggccgaaacttctcctactttgacacccagatcagccgcctgggcatcaattgggaagagctgccaatcaaccgtccagtgtgccctgtgctcaaccacaaccgcgacggacagatgcgccatcgaatcacgcaaggcacggtcaactactggcccaaccgcttcgaagccgtgcccccgaccggcaccaagggctccggagtgggcggcgggttcacaacctacccccagcgggtggagggcatcaagaaccgcgccctcagcgacaaatttcgcgagcaccacaaccaagcccagctcttctacaactcaatgtccgagcacgagaagctccacttgaagaacgctttcagctccgacctcgaccactgcgacgacccccccggtctagaacggcttccccggccaatcgctccccgatttcgaactcgagctccccccaaaaattccccaaattggcggggcccccaattcctcccaagggccctcaagcccaaaccatcgggcgacgcgcctcgg

SEQ ID NO: 16350 - DNA, 345 bp, A.fumigatus
tattcgcagatccatcgctttgatcatgaacgtattcctgaaagagtagtccatgcgcgtggcactggcgcattcggaaacttcaagcttaaggagagcattgaagatctgacttatgccggtgtgttgacggatacatccagaaacacgccagtctttgttcgcttttcaaccgtccaaggaagtagaggtagcgctgatacagtccgcgatgttcgtgggttcgctgtcaagttctacaccgatgaaggcaactgggacattgttgggaacaacatccctgtgtttttcattcaagatgccgtcaagttcccagattttggtacgtatagctcctgctgctga

SEQ ID NO: 16351 - DNA, 441 bp, A.fumigatus
accgcaacgtcgacgaattcttccctcagaccgagcaggtcgcattctgcaccagccacatcgtccctggcattgacttcaccgacgatccacttctccaaggccgaaacttctcctactttgacacccagatcagccgcctgggcatcaattgggaagagctgccaatcaaccgtccagtgtgccctgtgctcaaccacaaccgcgacggacagatgcgccatcgaatcacgcaaggcacggtcaactactggcccaaccgcttcgaagccgtgcccccgaccggcaccaagggctccggagtgggcggcgggttcacaacctacccccagcgggtggagggcatcaagaaccgcgccctcagcgacaaatttcgcgagcaccacaaccaagcccagctcttctacaactcaatgtccgagcacgagaagctccacttga

SEQ ID NO: 16352 - DNA, 279 bp, A.fumigatus
agtttccgaatgcgccagtgccacgcgcatggactactctttcaggaatacgttcatgatcaaagcgatggatctgcgaatatcatcaataccatatttattgagagtatttacatgcaatatgtttaccttttctctggcaatctgatcctccagcaaggatgggccagttcggcggtcattcgtaactctaagccattgatcggtgttgctgactcgtacaccgtgatccgtagtcaatggctgctgggtatgcgcatcggccgtatctctttctaa

SEQ ID NO: 16353 - DNA, 888 bp, A.fumigatus
gttgtagaagagctgggcttggttgtggtgctcgcgaaatttgtcgctgagggcgcggttcttgatgccctccacccgctgggggtaggttgtgaacccgccgcccactccggagcccttggtgccggtcgggggcacggcttcgaagcggttgggccagtagttgaccgtgccttgcgtgattcgatggcgcatctgtccgtcgcggttgtggttgagcacagggcacactggacggttgattggcagctcttcccaattgatgcccaggcggctgatctgggtgtcaaagtaggagaagtttcggccttggagaagtggatcgtcggtgaagtcaatgccagggacgatgtggctggtgcagaatgcgacctgctcggtctgagggaagaattcgtcgacgttgcggttcagctcgagctctccaatcacacgaaggggcacaaggtcttcaggccagatcttggtggcatccaaaatgtcaaactcaaagtcatcctgcttctcctctggaatgacttggattgcgaagtcccatttcggatacgccttgttgtcgatagcctccatcaggtctttgcgatggaaatcagggtcttggcctcccagcttcaaggcttcgtcccacacgagagagtgaacacccagatgggggatccagtggaacttgacaaagtgtcgctttccttctttgttgacgagagcaaaagtattgacaccaaatccctgcatcatccggtaggatcgggggatggcgcggtcagacatggcccacatgaacatgtgggtggcttctgggtgcaagtacacaaaatcccagaagttgttgtgggctgtttgggcctgagggacctcgttgtgaggctccggcttgacagcatggactga

SEQ ID NO: 16354 - DNA, 2166 bp, A.fumigatus
atccagtcaaggagcagtccaaccgttataacccatcaacgtttgacccgtgacccatctaattccgtcaagatgctgccgaagttaccctccaaaatagaccaagctccagagccgtatatctctcatcctggtgctgatcacaaccagcaatcttctctctctcgcaacggctcgcttttgaagtctaagcagaacgataagggccccgcggtcctgaagaagaaactgagcaagcggaaggcatacgaaattgcacgggagcaagagatccggctaatggcctcaagccccattgacataccttggcgacccggtacactgccaggtgagagagtatctgtcgagacacgacgagctcctagaactcatagtcgacggtccgaccgccatctctctgatcttagtttgcctgtgcgcgattccgctgcctcgtctgtatccgattgctccgaatcttataccttcaaggtcaacagtttagctgcctggacccctcgtcccatcattcgatatgtggaagcgccgcgtagctcggctgccagaagtcagaaatcagccgaggtaccaggccgcaaggagaacgccctcaatttttccatttcggaagaggaactgtactcgaagcagcgcgtggacgcattggctgatagtcttgatgcaagtgcattgcgtgagctgcttgagagagatcgtcgccgaaaggagaagcaaaggattgaagaacaaaaaaggctacgtcgcagattgcaacgtcgcgcagaacgccagcggagggaagaggagcaggaagatgagtctcaacgccagcactctcacgcccaaggaccgtcagctatcaaccgaggccaggccattgtcgggaagaatgcggaatctacgcctgatgatactgggactatgtgcaagaatgatgagacaaaaatttttctttctggcgacaccgctggctcctggttgcgggatgcttccaaggagcgaagtcgccatacatcttttgagagtgtccatgtcgttggcaacctcgatgacagctctgttacaaaactcaagttagctgagcgtccgagttttacccagtcgcacgacatgggaatgtcacacaccaccctgtcgccgtctccatccaggcgtggactgagcagtcccacttcctcccaggtatatggcgttgctcgagaatccacatcggatgtttcaaggactgttgaatccgaaagacgtctgtccgaccatagcagtacacggggtggtgctttggcttcattgtttcgacgcagcagctctcgtctcaagcgtagatatcgcgaacgttttcaagaccagtcttcagaattatccaatacatctcatgaatcttttttcaaagtgccaactcagtcatcggggcccccgccgtactctcctccaaaaccgttccttcgatctggcgtcattaaacgctctcagtccaaattcactgaacacttcggcgacgagcctttgtctccgccggattcgcgccttcaatcccctgaaattccggaggagccctccgatcaatttgggaaagaaaatgacacgcttaatctgcatgtggaatctcactatccaattcctggctcagaatctgacctccaggacgcgagcaagatcccccatcgctcgtggggtgatgaaagtctagaggatggtgcggacaatgtcccattatcacagtcgctagcgtcaattgattccgagggatcgtggatgtcagggcaatttctgcgtcgtatttcccagaggaggagcaatcttatccatcgcagcaccagtttgtcacataaccacaccgaagaagggcacgaggactcggtcaaggacgacgcaatgcctcaaaaagagcactttgttcgattcgaaagcgaccatgatgacactgaaggaccaagcagcagtgtccttgacaatcaagagaaggattccaacgtccgcgcgtcgcaagatggaacctggcattcagaaattgccaggaggcccgttgtcgtgaatccaacaattcggcccaagtcaaacgagggccttctgataaggtcgatccagtcactgtcccccatatctgcggacgaggaagtcagtcctatcgaagaacacccatccgaacatgaatacatgcatgatgagggttgtggacaggcatgttga

SEQ ID NO: 16355 - DNA, 543 bp, A.fumigatus
  unsure (147): Identity of nucleotide sequences at the above locations are unknown.
caataccgcagggcgttcgagaagggtcgccagcctgccaacacccgtattggtgctaagagaatccacctggtccgcacccgtggtggtaaccgcaagttccgtgccctccgtcttgagtcgggcaacttctcgtggggttccganggcatctcccgcaagacccgtgtcatcgttgtggcctaccacccctccaacaacgaactggtccgcaccaacaccctgaccaagtccgccgtcgttcagattgatgccgctcccttcagacaatggtacgaggctcactacggccagcccatcggccggagacgccagcagaagaccgccgagaccaccaccgagaagaagagcaacagcgtcgtgaagaagcaggctgctcgcttcgccgaccacggcaaggttgagcccgccatcgagaagcagtttgagtccggtcgtctgtacgccgtcatcgcctcccgccctggccagagcggtcgtgtcgacggttacatcctggagggtgaggagctggctttctaccagcgtgctatccgcaagtaa

SEQ ID NO: 16356 - DNA, 1191 bp, A.fumigatus
agctctgagctgtcaatcaatgggatgatccttacgtttttctttttttctttttctttttccaaagagttgatggtcagtccagtagaacttcttttccatctgacgtacaccgaccagggccaggcgaccggaatcatcaactcgactccgcccgtgcgtgcacttggaaactacaacaaccatattcaactttctacactcctcaactatccactgacgacagtcatgagcaacaaaacaataaaaacccgcctcctcttgatatcagacacccacaacacgtcccctcacccgcctccctccccgcacccctaccggcaccccctcccagaagcgcacatcctcatccactccggcgacctcacaacaatcggtagctaccaagaacatgcaaccaccgtagcaaccctcaaatgccaccccgcagagctcaaactcatcatcgccggcaatcatgacatcaccctcgacgaggcttactacgccgccctccctccaagcagtttcaaaacccgttccggacgcgaggatccggccgccataaaacaactctattgcggtcccgaagcgtacgacgcagggatacgctacttggacgagggcgtgcactgttttagcctgagcacaggggcggagttgagggtgtttgcgtcgccgtatacgcctgcattttgcagctgggcgtttgcgtatccccggggcagggatagatttaatcccctgcccgaggacactacagcttcttcggctttaagttctgccggcgcggatgccccggacggggtggtgcccgacttcccatcagtggatatcatgatcacgcatggtccgccggccggggtgcttgataccgtcgttcacggcgggagtgtaggctgcgaggggttgtttgctgctgtgaagcgggcgcggccgcgggtgcatgtctttgggcatatccacgaggggtatggtgcgctgcgaggggagtgggggccagatatgacgctgggagggacgaaggtggtgtgcgatcccgacaaggtacgcgaggagcgcggggcgtatgtggatgttagcgcggactccgggtgtccgctacggttcggggaggaaacgctgtttgtgaatgccagtgtgctgaatgagcggtataaggcagtgaatgcgccgtgggtggtggacttggatttaccggtttcttcctga

SEQ ID NO: 16357 - DNA, 192 bp, A.fumigatus
ttccctacatcaaccgcaaacatgggtatctcacgcgactcccgccacaagcgttcggccaccggtgcgaagagggccacctaccgcaagaagaggtatgacccccgagtcatcctttttctgacatctctgacaataccgcagggcgttcgagaagggtcgccagcctgccaacacccgtattggtgctaa

SEQ ID NO: 16358 - DNA, 651 bp, A.fumigatus
  unsure (481): Identity of nucleotide sequences at the above locations are unknown.
tattttctggaaaacattgctgaaactccgaaaccacccttttacacgacacgcaagcgcaataccccaaataaatttttccttttacttgcggatagcacgctggtagaaagccagctcctcaccctccaggatgtaaccgtcgacacgaccgctctggccagggcgggaggcgatgacggcgtacagacgaccggactcaaactgcttctcgatggcgggctcaaccttgccgtggtcggcgaagcgagcagcctgcttcttcacgacgctgttgctcttcttctcggtggtggtctcggcggtcttctgctggcgtctccggccgatgggctggccgtagtgagcctcgtaccattgtctgaagggagcggcatcaatctgaacgacggcggacttggtcagggtgttggtgcggaccagttcgttgttggaggggtggtaggccacaacgatgacacgggtcttgcgggagatgccntcggaaccccacgagaagttgcccgactcaagacggagggcacggaacttgcggttaccaccacgggtgcggaccaggtggattctcttagcaccaatacgggtgttggcaggctggcgacccttctcgaacgccctgcggtattgtcagagatgtcagaaaaaggatga

SEQ ID NO: 16359 - DNA, 1356 bp, A.fumigatus
agacaagactacgagggtcaatttttgcagatcacctctgtcagcgcgcaccgggacatgacgcatccggtctaccaacggtcgagaattccactggctgtcagggatcatcttttgatctcggaaccgtctcagttctcctcgacgttgaagagacacgtccagggcacggatgtgcgagagcaatgggttgaaaagacgatctttacgaccgccgagcccttcccgaacattctccgccggagtgagattgtcgccgtggaggaggttgcgttgtcgccgctgcagacggctgtcgagcgaacgtggcgtaaaacgcaggaactgtcgttgcttgagcgacgagctgcctcaggcgaggatcagggcctgtccagtctgacagaggcgctgcagcagctacttgacctcaactctccttcggccagctgcgtggccctctaccgtcaattcctggcggaagttgacgaagacgacactgaaaaggtggaggagtcgaccgacccaatgaagaatgctctggccgtggccctcatggaccatgccttggccattaagcatgctcttgcgttgtatgcccgaccggcgcaccaggccacacaagccgaactcatgcgtcaattcgaggaagcttttgccccggaactcgtctctctcaatcctgtggtggccgagagcccggcaactcaacggcagtctccggtttccgcagaaaaccggcaaaagcagtcgcagtcgcgctctatcagtccccgcaaccacgttcgcaagccttcggagaaaccatccgtcagccaacggatcagcattatgaaccctttcaaacgagcgaaccacgcaccaaacgggtcagtagccaccgtgattgacatgaagacggagggaaaagaccatgacgatgatactgcaacaatctacagtcgaaccaccgctcagtccgggacgacccatacaaaacgccggagcttctttggggaaatggtccacaagcacggctcatccattgcagcctctacggaagacgtacaagaacagctatcgagaagcggttcacgctcgcaggacaaccgcagtcggagcgggtcccaacaccacgggccgtctggggacgattctatttccagcatcaaggggggcggggtggccaaagccacttctgtcagagacaaccactcggtgcggtcttctgaccgcagtcaggtcggatcccccggcggccattcatatagccagtctcacagcggaggcgtccgcgactctgtgatgaaaaggttgagccttttcaagggagtgggtcgcaagaccagtcgtttggagatccgacccgagacgaacggcgttcttcgtgaagaataa

SEQ ID NO: 16360 - DNA, 321 bp, A.fumigatus
tccgtactatttaaccacgctgttcgagactccaggcgatccatatccgtttcctacctcactcctgatatcaatccccgacgcaatcgtcattgtcgaccatctacattccgcccttttccgtatcacagtctaacaccatcgtcgactgaaattatttgttccacactatccctgtacatcgcctatgagtatgctgtcctccaggtattaaaaccgattcagacggcccatgatccttacatgcgcaatgcacctattttcgacggctttccttctctatctccatggatttcttctcgcgctggtggctttgggtag

SEQ ID NO: 16361 - DNA, 207 bp, A.fumigatus
aaccgattcagacggcccatgatccttacatgcgcaatgcacctattttcgacggctttccttctctatctccatggatttcttctcgcgctggtggctttgggtagcgccgactccgatgtcgatttcatgagtgttagagccaagtttctaaaggattacagtgggaaaggaggtgagccgggagagaaatatttcagtaagtga

SEQ ID NO: 16362 - DNA, 495 bp, A.fumigatus
caaacactaattcgcgcccagatcttcccatgggacaacgacctcgacgtccaggtaaccgagccgacaatacacttccttgctgaatattacaacatgaccgagcaccatttcgaacttccaggagtggacggcgggcgaaactaccttctcgaaattaacccgcaatatgtggttcgaactattgaggatgcagcgaacgttattgacgcgagatggatcgacacctcctcaggacttttcatcgatataactgcagtccgcaaggatgacgaattgagaaagaagggccagcaaggcgctctcatgtgcaaggatggccatagatttgacgtaagcggccgcggtacaagggtaacacgagatggttacttaccgctttctaggagaccgatatcttcccacttcggaatagttactttgaagactttcctgtcaaagtaccctacaagtacactgatctccttgtggaagaatatggctccaaggcattga

SEQ ID NO: 16363 - DNA, 183 bp, A.fumigatus
atagataaatgcgcgctggatatcagcatttgcattgccctccagccctccagccctcccgccgtcccaaggccgtctcactccgagactaggaagaagaagagtacgtttaagaagaacaacaactacgacaactacggcatcatcatatcggaaaaccaccatggatgcgaacccacctag

SEQ ID NO: 16364 - DNA, 786 bp, A.fumigatus
cggacgctgattctactaggtatcggtgcgctggtgaccacgtttggagtaggcgaactatccgccgtcaatgccatcgcaggcgcctatgcagagagagctccagtcgtgcacattgtggggactcccatgcgcgcctcgcaggagtcgcgtgcaatgatccatcatacctttattgatggcgaataccagcggttcgaccgcatgcaggaacatgtgaccgttgcgcaagtcagcctgagtgatcaccgcacagcgcctgccgagatcgacaggatcctgctgcagtgtctgctgcacagtcgtccggtgcgcattactattcccgtggacatggtccccgtccttgtccccactgcggggttggcgtccaagatcgagatcccgcctcccgtgcgccagccccaggtggaggaggcggccctgacggctgtgctggagagaatctacaacgcgaagaagcccatgattctggtggacggggagacaagagcgtttggtacggttaatgaagtgaatcagtttgtcacgacgacgggctggccaacatttacgtccggcttcggcaaagggttggttgacgagactctacccaatgtctacggagtgtatcggcctgctcacaaagaatttgtcgactcgtgtgacctggtcctggctttcggaccacactttagcaacaccaacacctacatcttcatggtgagaccgcaggacgagacgagcgttctattcaacccaacctccgttcaagtcaataaagacatttaccgtgatcttcccgcc

SEQ ID NO: 16365 - DNA, 201 bp, A.fumigatus
ccatatgaacgcaaaatgaagcttttcctgtcttcggtacggttctggccattccgtggcctattattaccccttaatacaccttctgaacctcacgatgtcatgtccaatgcatgtttttatcctattagcgcagaataccggaaacccgaaaaactatcgaccatcactcctaaactaggctccctcccctccatctga

SEQ ID NO: 16366 - DNA, 336 bp, A.fumigatus
tcttccttctggcatatatccaggaacggggccaaaagtgacggtccaaggcgtgaaaggcacagaacacacagtcagaaacaaagacgactcaacatggactccgacactctacccctcgcgcaatacctctttaaacgtctgcgtcaattgggtgtagactctatattcggtgtccctggtgattacaacctgactcttctggatcacgttgtaccctcgggactcaagtgggttggaaactgcaatgaactcaatgcagggtatgctgcggatgggtactcgcggatcaaaggtacttgccatgcttcctcctactgccttgacggacgctga

SEQ ID NO: 16367 - DNA, 357 bp, A.fumigatus
tttcttagcccagaatctctaggacctcgatgtctattatctatagtatgttattgccaaaactgcgcttgcaccgagaaccgtttttcgagcaggcagcagcttgactacaatggcggggtatacaagaggacctacttttacgaacctcactgcactaataaggatacttatattctgggtgtctatccccaagctttggaaacttgttccttgtacggcagatcctcatccccccggagcaactccaacgggaatctttctttccgccggttcatgaaccgtcagaacagcacctggacccaaacaagcccattcggaatcaccagcaccgttagattaaagcggattccctaa

SEQ ID NO: 16368 - DNA, 1089 bp, A.fumigatus
tgtccgagttttgaagcactgcgactgaaagtcgctatcatgagcgaggtcaaccttgacaactttaagtcgcttgacgcactgaggaaggttttcagtacatatagggagctttcactcaccgaacgcccaatagtctttattgtgatagggaacttcgtccagaaggccacaatcaatggaggcggccatgctggcagcatcgagtacaatgagtactttgattcactctccattatactagccgactatcctgaacttttacaacactctactttcgtctttgttcctggagataacgatccatggtcgtccactttcacagcgggcgctgcctcgatagtaccacgtcagtcaattccggatatgtttacgtcgagggttaagcgtgcgtttgcatcggcaaattcggagtcgaggctatcgcaagcttccgagcctgcgggcgaagctatctggacctccaacccatcacgtctcaccgtttttgggcccttgcatgatatcgccatatttcgagacgacataacaggaaggctgaggcggaacgcagtggctactaagcaaggcgagaatgagcgtgattctgcattttcacaagatgcgggagccgaggctggtcttgccactgctaataatgaaactgatgctcaggcctatccggcagatgccaaagctcggcagtctttttccagtgcgcacacggcacgaaaactcgtgaaaacaatactagaccagggatccatttccccatttccgcaatcgatgcgacctgtcttgtgggatcatgcatcatcgttgcaattgtacccgttgccgacagcgtttatcttggcggatcctgaagtggcaccattttgtatgacctatgaaggatgccatgtcatgaatccagggagattcatctctgaagaaggatcgacatgtatgacatgggttgagtatgatatattgaaaaatcgagggcgtgtgaaagaggagcggctgtaccaaatcataactgcaattcttttggttttacggattttatttcatgtgctgaggccaactgaattgagtaaagcagagaagctgatcgcatgtaactaa

SEQ ID NO: 16369 - DNA, 195 bp, A.fumigatus
ccaagtattatgctgagcgccggtgaaacatccatcgagggcccgaataacattgctgactccctcagcgtctgcaaccactccatttccaagacctttccaaccgtttcccttggaatgatacagtgtgcctcgcagcctggctttgaattggtcgtggcctggcccagcctccgggctactcaattcccttaa

SEQ ID NO: 16370 - DNA, 2598 bp, A.fumigatus
gagcgcgtgattttccagccccggtggtggaagacaataaacagaatcatcagtgccagacttgcattacatgatctaatccctcacccgttccggacctatcgagttcacgacggccgagttacttttgtcgtgcgcggtgagtttgagctcgacttatccatcggagcagaaagcgagctctcccaattcttcttcgttgacatccgctttctttactccccatcctccaacattccgaagggtcgaatgtccaatgagattgatgctaaaatcaatgagaaactgcgtgatagcggcttgacaggctgcttcaatttcctgcatggcttggtattgaccaataaaattcatatattattcaagcaggccatcgagttggctaaaggcctttggtcagaaacattacgtgtcgagcttttgcatcgaaccttggttatacaatattggaccctaaaaccggggcctaagagttggattgagattggggtcaagagcggtaatggggatgctgacagccaaggcttaggggtaccgtgcctgggcttgcgttggatgagggacggccaggaggtcaacagtagagacatcgagttcgatccagaggatttgtcaatggagtgtctgctgcggagtgtcattgctctacatatatcttacttgctctcgtcagcttacggcatcctaagtgaatattcgctgttctcctccggcactttgtcttcacacgctattttgaatgtcactgagcctggcgaatgtcaactctctgtccagctcacgggctccagacatcttcgggtatccattgagccgatgtcaggagccgtcatcttgtccgcgacccctggtctcttagaacgtttcgaaagtgatgccagtctggataggtctaccatcgatgatctagtggcccgtgtttctcggcttcgttgcattgcggccatagaggaacttgagtctaatgtcaggattttgggttttgaaacagtcagtcccaagggactcagaaacgatattcggaaagtttttccagctaatgtcttgcgcttttccctcttctggcaccctttgtgggagcgaaattgggtcgtggctgcaacaagcagcatcacaagtgacaactggtgggttgtgcgacttcgccgatcctcagaggttgcaacagatttttcggtctctgatacaagtgttccactttgttcagggcatagcatgagcgatacctttcttgctacaagccaccaaactcgctcttcctcatttcccgatttgggctactgtctttctgggatggtagcaatctatgccaacgtcagctatctatccgatttgcattcagttgagtttcacccaccattgtgcgcattgaaggttgaatccgatcttcaaatcccggatattttcattcgctaccaagtgtcgaaccttcctcgggcgcttcagctagttttgcccgcgggtctgaagagaaagaaccttctcaaggatacagtgcgccttgccttccatgggattgatcgtcacaagaatagtgccatatttgtggcgtatggcaacttagtgggaccttggacagatctgtgcacattaatttcaaagtcggacagctccctagttttcaagcaaggaggcagtggctttgcccttcggcttctcgctccggctggtcgcccagtgatcgtacagctttttaaaagcttgcagactctagagtgcacgttgtcaattctcgatttccttcggcaaaggagattgacacctcagtcgttatcgcttactcatatagcctttgcttacggcccaggaagggatctctcagctactatcgagatggggttgtccgaggtaccctcttctgcggagcttgaccctgttcgcgttctagcgaggactgaccccttgctttgtctcactctgggtattcgatttaagcatccgaaccctcatcgccgggtccaggggtctctcgctgccattttaaaccatgcttctaatgaagctggtttggatttcgtaaccgaggttctctcgtttacacttcccttgatgcgagccttggagcaaataacatctaacgcgtctcgccaggagccgttcaggttacaggtgattgtgcgcaatgcttacacattcctcctccattatacctatcagggcttccggtttcaactcacaacgcgccagcattcgggccaattgacttgggtattaagggaattgagtagcccggaggctgggccaggccacgaccaattcaaagccaggctgcgaggcacactgtatcattccaagggaaacggttggaaaggtcttggaaatggagtggttgcagacgctgagggagtcagcaatgttattcgggccctcgatggatgtttcaccggcgctcagcataatacttggttacctcgagaaactaaatctgagcaggattactcaactcagccagcaccggagaaccagagtcaaaccggggcaccatcgcaggctggcatggctaatgatactaagatgacggcgaacttcgttaatgacaaaagtcttcagcgaaaccctgtggtttccaacgctgcagatgttattacaattgactga

SEQ ID NO: 16371 - DNA, 522 bp, A.fumigatus
cacgtctgccacgttcgtctggatcggcgagcgcacccgccagcgcaatggtccgcacctcgaatatgtccgggggatccgcaacccgatcgggatcaaagtgggaccgaccatgcacccacaggaactggtggacctgttggatctgattatacgacagccccaagaccggcacgatccccaagatggccgagtgacaatcatcacgcggttgggcgcggatcaggtcgagacggtgctgccgccgctcatccacgccgtgcagaaagccggccacacgccggtctggatgtgcgacccctgtcacggcaataccaccgtcacgccctcggggatcaagacccgctgtgtcgagaccatcgtccgggaggtcatccgcaccttcgaggttcatcgagccagcgggtcgttcatgggggggctccacctggaacagacgggcgaattcgtcaccgagtgcgtggacgcctgggacacttcttgcgagcgggacttgacgacaaactaccgcagtctgtgtga

SEQ ID NO: 16372 - DNA, 1368 bp, A.fumigatus
  unsure (202): Identity of nucleotide sequences at the above locations are unknown.
caaatcatactgagcatgttgagcccagacctccagccgggaaaggtgcctccgccgagccaaaacggcgtggaattgggctcatcggatggttggacgccccagagttggcgaaagcgtccggcgattgcgcaggagattgaatacaaagaacctttgcaactggaggaagtcctgcgcacgttcgttcctttgccgcccntgttcagcccggtcaagattgaactggcccgcaaacactttgcggcagcggctcgcggagaagcctttatcatccagggcggagattgtgcagagagcttccaggacgtgcggcccctgatcgtgcagcagaaggtgcagctgcttcacgaacagtcgcggctgctcagggactcgctgggcctgcccgtgatcacggtgggaagaatcgccggccagtatgccaaaccgcgatcctgtcccttcgaaaccttggccgatgggtctcaggtctacagcttccggggcgaaaacgtccacgggttccatcccgacgatcgcaccccggaccccagccgattgctgcaggcatatttccacgcccgggcgacattggatctgatgaaagcctgcccgccactgcggacgcccccgtccgtcgatgccatcgcgtcgccgggaagggacctcttccgcacgaatctcccgggggagccgggacaagggcccatcttcacatcgcatgaagccctccacttgccgtacgagagcgcggtcacccacggccgctataacacgtctgccacgttcgtctggatcggcgagcgcacccgccagcgcaatggtccgcacctcgaatatgtccgggggatccgcaacccgatcgggatcaaagtgggaccgaccatgcacccacaggaactggtggacctgttggatctgattatacgacagccccaagaccggcacgatccccaagatggccgagtgacaatcatcacgcggttgggcgcggatcaggtcgagacggtgctgccgccgctcatccacgccgtgcagaaagccggccacacgccggtctggatgtgcgacccctgtcacggcaataccaccgtcacgccctcggggatcaagacccgctgtgtcgagaccatcgtccgggaggtcatccgcaccttcgaggttcatcgagccagcgggtcgttcatgggggggctccacctggaacagacgggcgaattcgtcaccgagtgcgtggacgcctgggacacttcttgcgagcgggacttgacgacaaactaccgcagtctgtgtgatccgcgactgtcgtacatccaagccttagccgtggttcggtcgttcctggatcatgtctgctgctcgacatcaaaggcccatggtctgtga

SEQ ID NO: 16373 - DNA, 606 bp, A.fumigatus
cttaaatcccctggccgggaagatgaggccgcatatcgtccagcaaatctacaactgcctgtgaagatgaagcacctggtcgcattcaccctcaatgccgctctcgtgctgggggtcgttgtcctccaacggcgtgacgagtccacacaacaacagcatcctctccttgacagctttcgtcattccccaggcatcgcaaccgatgacgcgctggttcgtcagtgcatcgcaccgggcgtggtctgcgtcgacaaacatggggccaaccttccttatcccttctggcgggattctccgaacggcacctacgccaccaacctggcggacatcgagttcaccggcggccgaggccaacccaagtcgacctcctgggagcaggtggaacgagcggactttgtggtcttcgacgaggagcgtggacggaagctcctgggcgagaacccccgcgtggactttgtcttctccgtcaatccgtgggcgctgcacgaggcgccgacgtacgtgccgggcctccaccagatcttcttctcggagctctcgcccatgctggagcagttcgtcatcgagttgaaggtcgacccgcccaccctgtccacattccgggcg

SEQ ID NO: 16374 - DNA, 579 bp, A.fumigatus
gacgaccgtcgacgtgatcggccggcaccaggtcagctttctcttcatcacccccccgattgcagcccgcctggcgcgcgcggacttccaggcgtccggcgtcgacgtccggagtgtcaagtggctcctcacggctggcgcccccatgcacgacaacctgcggcagacggtttccaagcaattcgggggcgttcccttggacctcgaatggggcacctccgagaccatgctcattgccatccagcgcgacgccgactcccgccgcagtgggtacagtggcaccctcgtgaacggaatgcaggccaaagtcatcagccgggtcaccggccaggaactgggcgtgggcgaggcgggcgagatcctggtgcgcaatcggctgtgtcgattcaagggctacaaggacaacgaggtggccaatcgcgacttcgacgccgaaggctggttccacacgggggactatgggcacctcgacgagaattgcaacgtcttcatcatggatcggatcaaggagctcctcaaggtcggcggcggctacgggacgcacatctccgcggcggagctggagaccgtggtgtttga

SEQ ID NO: 16375 - DNA, 1221 bp, A.fumigatus
  unsure (1101): Identity of nucleotide sequences at the above locations are unknown.
ggcttggatgtacgacagtcgcggatcacacagactgcggtagtttgtcgtcaagtcccgctcgcaagaagtgtcccaggcgtccacgcactcggtgacgaattcgcccgtctgttccaggtggagcccccccatgaacgacccgctggctcgatgaacctcgaaggtgcggatgacctcccggacgatggtctcgacacagcgggtcttgatccccgagggcgtgacggtggtattgccgtgacaggggtcgcacatccagaccggcgtgtggccggctttctgcacggcgtggatgagcggcggcagcaccgtctcgacctgatccgcgcccaaccgcgtgatgattgtcactcggccatcttggggatcgtgccggtcttggggctgtcgtataatcagatccaacaggtccaccagttcctgtgggtgcatggtcggtcccactttgatcccgatcgggttgcggatcccccggacatattcgaggtgcggaccattgcgctggcgggtgcgctcgccgatccagacgaacgtggcagacgtgttatagcggccgtgggtgaccgcgctctcgtacggcaagtggagggcttcatgcgatgtgaagatgggcccttgtcccggctcccccgggagattcgtgcggaagaggtcccttcccggcgacgcgatggcatcgacggacgggggcgtccgcagtggcgggcaggctttcatcagatccaatgtcgcccgggcgtggaaatatgcctgcagcaatcggctggggtccggggtgcgatcgtcgggatggaacccgtggacgttttcgccccggaagctgtagacctgagacccatcggccaaggtttcgaagggacaggatcgcggtttggcatactggccggcgattcttcccaccgtgatcacgggcaggcccagcgagtccctgagcagccgcgactgttcgtgaagcagctgcaccttctgctgcacgatcaggggccgcacgtcctggaagctctctgcacaatctccgccctggatgataaaggcttctccgcgagccgctgccgcaaagtgtttgcgggccagttcaatcttgaccgggctgaacangggcggcaaaggaacgaacgtgcgcaggacttcctccagttgcaaaggttctttgtattcaatctcctgcgcaatcgccggacgctttcgccaactctggggcgtccaaccatccgatga

SEQ ID NO: 16376 - DNA, 1995 bp, A.fumigatus
gccccaccaaaagtgaaagagaatgccggagttacgtctacggccagcctcatccagatcgtacttgtcgtcacgcagggcgtggcaggaagaaggacgctatcgggaccgtcaccaactccgggggttgtgggtccatcaggactctctgcttcgtctcttcacatggcagcccttgcgatggataggcattgtggactggcggatatccagagtggagatacggccctcgacccgtatttaatcgctttccgttcatcacgttgttccctcgagtcaacgctttcgaagaacaggcgccgtaccgaggatacggggacgcatctacgataccaacagacttccacagctgtggcgaatctcactgttgtcccggtatcccacctgcagattcattctactggcttggcggcatcaaccatgatctttgaatccaaacttcctctaccctccgtgcccaagaccgatgtgttcaactacatctttcaccagggcagacgaccatatccatggagtcgagtgctctaccgcgtcgaccagaccggtgaaaccctgacgctggcagagctcgaggagaaaagccgacgcttggctgatgctcttcgctcggagtatgagatcatgcccaaggatgtcgtcggcattttcgccaaggacagggtatgttgggagcaatctctctctctctctctctctctctctctctctctctctctctgcgtcgtttcgtgcttgcggctaacggcttgggagcagatccaatatccaatcgcctattttggcgctttggccgccggagctacggtggccctcatccccgtgcagcaagagatgtccgaaacggacattgcgactcgactagtgcagtcgcaggtgaagctgctgatcaccgacagcgacctcttgcgcctcgccgaggtgtcgacggacttggcgggcgcggttcgcctaatcacgctcgacgacagtccgaaccaattgtgggcatcgctggagcgtcttttggcccgcggccgccctgacgctgacctcttccggctggaatcggaggccagcgccgaggagtacgatgcgtttctgaaccgcacgagcggatccacggggaacgtcaagtccgtcctcaccagccatgcccatttcattgccacgatggaagggaccatcggcacgatcccggacaatacggaccccgaccatgatgtgtggctctcgcccctgtccctggggttcttcatcaacgccaagctccacatgggcctcaacatcctgctggggatccccgtggtcctcatgaacggccccctcgatgagacgaccgtcgacgtgatcggccggcaccaggtcagctttctcttcatcacccccccgattgcagcccgcctggcgcgcgcggacttccaggcgtccggcgtcgacgtccggagtgtcaagtggctcctcacggctggcgcccccatgcacgacaacctgcggcagacggtttccaagcaattcgggggcgttcccttggacctcgaatggggcacctccgagaccatgctcattgccatccagcgcgacgccgactcccgccgcagtgggtacagtggcaccctcgtgaacggaatgcaggccaaagtcatcagccgggtcaccggccaggaactgggcgtgggcgaggcgggcgagatcctggtgcgcaatcggctgtgtcgattcaagggctacaaggacaacgaggtggccaatcgcgacttcgacgccgaaggctggttccacacgggggactatgggcacctcgacgagaattgcaacgtcttcatcatggatcggatcaaggagctcctcaaggtcggcggcggctacgggacgcacatctccgcggcggagctggagaccgtggtgtttgagcatcccgcggtggccagtgtcgtggtcgtgggcattcgcaatgacttcacccagctggatgagccgaccgcgtgtcttcaccacggggctggaaggagccgcgct

SEQ ID NO: 16377 - DNA, 321 bp, A.fumigatus
atcagacgaatacgtgataatcaacagattgatatgaatcacaataatggttactattatctcaaccgccccgacttttatgatgctgtgactcaaccttcggattttctccatactctgggtggatgctccccgtggatggagcacagatttcactatggggactcaagaagagcagacagttcattctgcacagcgatggcggtggtcctgtcagcctatcataccgcgtactatccgacatcggccggggagctcagcaccaactccgatcacgtgcctaccacagctctactgtcgtcctcgacaacgagcttataa

SEQ ID NO: 16378 - DNA, 732 bp, A.fumigatus
tgctgtgactcaaccttcggattttctccatactctgggtggatgctccccgtggatggagcacagatttcactatggggactcaagaagagcagacagttcattctgcacagcgatggcggtggtcctgtcagcctatcataccgcgtactatccgacatcggccggggagctcagcaccaactccgatcacgtgcctaccacagctctactgtcgtcctcgacaacgagcttataagtctcaccacgtccgtcctcaaggaaacttccctttcctcttttattattttcttgcaaagcatcaaatccttgaccaatctcctctcctcttccttcctagactcccttttcctccatcctcacatcctacgcatcacaatggcttcccgtggactcccccgtgccctccgtctggcccgtgttgccgcccctcgcacagtcatctcggccgcccttccccggcctgctctcgctaaggctgctacccgtgtggccgcttcgaccgcccccgtccgtggtgtcaagactatcgccttcgctgattccaaggagaccgtctacgagcgtgcggattggccccgtgagaagctccaggaatacttcaagaatgacactcttgctctgattggttacggctcccagggtcacggtcagggtctcaacctccgtgaccaaggtctcaatgttattgtttggggtccgcaaggatggtgcctcatggaaagggggcca

SEQ ID NO: 16379 - DNA, 2523 bp, A.fumigatus
aaacatcatttacgctcttcttaccatgtgcatacaatgagccttctctccgcattcagtgctctgcccaccgtccagacacgaaaagcccttttgctcctcgattttcaaaatgattttgttcgcccatctggtgcactgcatgttccgaatgcagctgaaatcttggaaaatatcgcgcaactagtcactgcttttcgtcgcaccggtgatgttatctgggtccgctcccactatgaatcgcatcgacccctcatcgattcagacttccaggaccggatagtgctcggtcgtgagacggatgaacaaaggaaaagagccgagcgacccagctcgaaaacaccagttgatgaagaagcatttctatcgagcgagtcgtcgcaatgttgccggccgcagtcgagcggctttcaactccccgcgcccgttttggctgctatcgatgctgagaatgacacattgatggacaagtcggattactccgctctacaagatgaaggaatgatactttctcttcgcaccagatttattacggagctatatctctgcggttcgctctctaatgtctcagtgtatgctaccgccctcgacgctgttcgtcacggcttctctgtaaccctcatcgaggactgcctggggttccgcgatttcgtacgtcatgaggaagctatgcgccgcatggccgatatatttggcgccagtgggatcacaactcaggagctattcgaagagcttgattggcaagagactgacgctattgctcgtcaaagtacacacagacccgtgcgagctgttacacccgctggaatcgaaggcgtcatggatgaactcgatgtcaaaacaatccgtgggcccacggccaatgagggaacaccggagtcgttgggcagtcggcgacggagacttgatgctctcttagcagagcagactgatggcgaggatgacgatccgttggatctgacaagcttggcccgctcccgctctcgctacggaccctccggctcaccaggaagctcgtctcaagctcatggtgcgggagaaaagaaggcacgtgtacgtgtgcgtcgcacaagacgacaagatcataaggtagacgcgtctaatcggacagaagaacgacggagtggtaagacgaaaaagtcgcgcgatatacgcgggccgggtgataagattggggagggtgattcccgcatcatttatgacttggacctacctgaggacgcctttgcgagtatccgcagcgaggtcgcttggcagaagatgtaccatatgtcggggcaagttcctcgtcttgtcgcagtccaaggacaaacaagggatgacgggtccatccctatatatcgccatcccgcggatgagtctccaccattgcgccctttcacaccgactgtgaaccagatccgcatcattgtagaacgcatccttggtcatccgctcaaccacgttctcattcagctctaccgcgacggacaggacagcatatccgagcattcagataagacgcttgatattgtccgaggttcatttatttgcaatgtgagccttggcgctcagcgagtaatgaccctccgaaacaaagtcaaagctgcagacgaagaccagagacccacgcagcgcatatccatgccacacgagtcactcttcatcctaggagagaagacgaacatgcgctggctgcatggcatacgtcccgacaagcgacaggcggcggagaaatccaccgaagagctggcttacggaggcgaacgtatatcgctcaccttccgacacatcggcactttcttgaacgaggccggtgatgcaatctggggccaaggagctgtctccaaggaccagagtcaggcgaataccgtaattcatggagaccctgcagagacagagcggctggttcgcgcgttcggccaggagaatcaggccactgagtttgattgggatgctgtgtatggcggagggttcgatgtcgtcaactttgtcaccacatcgaccgctaaattagttgaggactccgaccctgtgaccaatctccgagttcgactcgcgctcagtgagaatggtatccgatatgaagtttcggcttcttccgaggacgaaaacagcacggagggaaaggcgcggccggttttaattacagctgacggcacagaagttgctggggagctggatattatgaattttcttgcaaagcatgcgccagagctaacacgagcgggcgtggaagtgctgcgtggtggcagccagcttctcaaaatcaatgagcttttgcaggactggcgtacctcccacagcaatggtgaaaagattaacccagaatccctagatctatgggagaaggctctggacgggcagtactatcttgggggagcagcccttggacttgatgactgcttcctctggccagttctccgagatattgtacagacatgcggaccattttcgagcgatgaatatcccaatttggcgcaatactaccgacgtgtggagaagcgcggaattgtcaaagcgaccctggaggagctcaaataa

SEQ ID NO: 16380 - DNA, 471 bp, A.fumigatus
  unsure (103): Identity of nucleotide sequences at the above locations are unknown.
tttcagaatgacggtaaattcgtgctgtattactccggggaactgaagaactggaagcgccatcattgcataggggccgcagtctcagagaaagaagaccccntaggaccttaccagcccatgtcggaacctctggcttgcccccgggaacatggcggtgccattgacccgtcgccgtttcgagacacagacggaaaactgtatgtcacgtacaaaagcgatgggaatagcattggccacggtggcgactgtaacaatggcaagaaacccattgtcaaagtccccatcatgcttcaggagctccaagacgacggtatcaccccagttggggaccctattgaaattctcaagaacgaacaggaagatgggcctctggtcgaggcgcccaacatcatccggacagaccagggctattactaccttttcttctcttcccattgctttcttcacaacggcgtggaaggaccgcga

SEQ ID NO: 16381 - DNA, 204 bp, A.fumigatus
ttgaatgtacaatcgattctggcagttatgattaggttgttctttcgaaacctgcctgaaacctataccagaattcatagtctacttgaaacaggggatcgtcgtatttcaaccacagacttcaagaacttgaaggacattttcgtgttctataaagtactatgtattttgtccaatcgcctgcaaacaaatggacttaactag

SEQ ID NO: 16382 - DNA, 1260 bp, A.fumigatus
attgagttgatctgttctctcctctctaaccgaatactcagctcctgcattgatcgtttgcggagcctgtggagaatttcgtggaggagatcgagatctatcttcacaactcatctgtccaatcgactcccgccgcgctactgtgattcttctttgcgcgcaacaatgctcaccttcaggaagtcgctaattgtggccgtcgtcttgattacattcgtcgtcctccttcgatccgcacactcctcaccctccgccgaacccgccgttcttaacacggaaaccactgcgcacgacaccagtcaagcagcagatgaacatcttacggatcagaaacaggatatacaacagcagccgttgaagccaccacccactgcgcccttgcgcgaacggctccgttaccaattcccctacgatctcgaaaacagattccccgcgtacatctggcagacctggaagtacacgccagcatccatgtggttttctgaagaccttcggcccgctgaagcaagttggacagaactgcatccggggtttgtccatgaagtgattccggacgacactcagcgacatcttgtcaagtacctctacggctcggtcccggaggtgttcgaggcatacgattcgatgccactgcccgtcctgaaagctgatttctttcggtacttgattctgctggcgcgtggaggcatctacagtgacatcgatacctacgcgctcaagcccgccgtcgactggttgcctggggagctggatctcgccacggtcggtttcgtgatcggaatagaggccgaccccgaccggcctgattggcacgactggtattcgcgccggatccaattttgtcagtggaccatccaggcaaagcctgggcacccgatcctccgcgatattgtcgcatacattaccgaggaggcgctgcgaatgaagaaaaagggaatcctgaaggaaggaaagatggataagactatcgtggagttcactggacccgctgcctggacggacgcggtgtttcgatatttcaacaacccggaatacttcagcatcgaaccggggtcgactcacaacgtcacatacgaggatttcaccaaccaacggggttataaaaaggtcggtgacgtcgtggtcctgccaattaccagtttcagtcctggtgttggtcagatgggagcgggcgatctggatgaccccatggcgtttgtgaaacacgactttagtggtacgtttttttttttttttttttttttttttttttttttttaa

SEQ ID NO: 16383 - DNA, 1020 bp, A.fumigatus
gataaacgctatgaggtcacgtcgaagaccacgtttgaagagtttcagtctatcatgctttccgatcgccgcacggcgaacctcgattctgacatactccagctactctttgatcgcatcaaagagaaagctattaggagaagcgaagaagagaagcatgccgcggatcgtcatcagcggcgtgctatcgatgccttacgctcgcggatgaaacgtctggaacctcctatacgcccatccgacacttgggaccaagtgcgtccgaggatcgagaaactggaggaatacaaggcgcttgaatcggatgaacttcgtcaagtggcattcgacaagttcatgcgccggttgaaggagaatgaggaggacgtggacagggagcgggagcgcgatcgagacagacatcgtggaagtcggcgagaacattacgatcgcgatcaccgtaggggcgagaggagagggcctcccagtcgtctctctcgcacacctgagcccgacgcctacgaggcagaccgtcgtaaagctcaggccgatcgcgagcggtcttacaggaaagtcagcggcttatctccgatccgtgagaaacgtgacgatcgggaccgtgacagggatcgtgagagagagaaggaccgagaccgttaccgcgatcgggactgggatcgggagcgcagctcccggtctctgagccactatgatcgtgaacgaagggatcgggaggaagagcgtgaaagactctaccgcactcgcggtgatccccgcggaagtcgggatgagctggattacggtgcggacacacgcagcaccgttagcaatgaccggaggcgccggagagacagtgatacagaaagcgtcgccagccgctctgcgaagcgctaccggcgtgaaagtcgcgagcgagaccgtagtcgggcttccaagagggacagggagcgtcaagaaccaactcctgcagcggaggaagacaagagagaagaaaaggctgtgcactctggaagcgaagagggagaaatcgaggaggactag

SEQ ID NO: 16384 - DNA, 360 bp, A.fumigatus
gcaagggaaaccaatgggagagcttcatccatcgtctacattttccgcgcatcaggatcttcgtccattgtagagcagctttccttccttggaaatatttgctcatcaagcatcatgaatcccatgactggaccagcggctgccgcgcctctgtggcaggaggcgcgcaatgccgacggtagagtgtattattacaatgttcagaccaaagctacacagtggcagaagcccgtcgaattgatgactcctgtcgaggtttgttgctattacgagtctcgctgtactcatgtctgtgctaatactttcctcacgtttgcagcgagctctagccaatcagccatggaaagaatatactgctga

SEQ ID NO: 16385 - DNA, 1116 bp, A.fumigatus
ccagtttttgcgcgcagggccccgacatttgtcgcaggcggagtcagctcgtttccctcccttccacaacagcgtgaccgtgacgattatgaccgaggctatggcgaccggcgcggtggttacggttccatggatgtcaatggaatttcggccgctccagcactgggaactgcgcaagcagagccagagtataattccctcgaagaagctgaaaatgcttttatgaaaatgctcaagcgccacaacgttcaggctgactggtcatgggagcagacgatgcgtgcaactatcaaagatcctcaataccgtgctttgaaggaccccagagaccgaaaggctgcctttgagaagtacgcagccgagctccgcatgcaggagaaggatcgagccaaggaaagattcgctaagctcagaaccgactttaatactatgctgaaaagccatcctgagatcaagcactacagccgctggaagaccatccgcccgattatcgaaggcgagacgatcttcaggtccaccaacgatgagaacgaaaggcggcagctcttcgaggagtatgtactcgaactgaagaaggagcatgtggaacaggaggctgctcggcgcagggctgcactcgatgagctagtcaatattctgaattctttgaacctggagccttacacgcggtggtctgaagcacaggctataatccagtcgaatgacaagattcaaagtgatgataagttcaaaagcctgagcaaatctgatattttgaccgcttttgaaaaccacatcaagtcccttgagcgtgccttcaacgatgcacgtcaacagcagaaggcagcaaaggcgagaaaagaacgccacgctcgtgagaacttcatcgagctgctgaaggagctgaaagcgcaaggcaagatcaaagctggcagcaagtggatgaacatctacccgttgattcatgaggatccacggtactttgcaatactaggtaactcgggttctactcccttggatcttttttgggacatggtggaagaagaggaacgatcgctgcggggaccacggaatgacgtgttggatgttctcgatgtaaggtcccttacaccttgttttcttgaacagcttcactaa

SEQ ID NO: 16386 - DNA, 234 bp, A.fumigatus
ctcctgtcgaggtttgttgctattacgagtctcgctgtactcatgtctgtgctaatactttcctcacgtttgcagcgagctctagccaatcagccatggaaagaatatactgctgagggtggacggaaatactggtacaacacggaaactaagcaaagcacttgggagatgccagatgtttacaaaaatgctttggcgcaggttcaaacacctcagtcggcccctgtagcgtaa

SEQ ID NO: 16387 - DNA, 231 bp, A.fumigatus
agctctcccattggtttcccttgcctagtgtatacagtgggtgatcacctgacgcccggtcccacctgccgcctgatttccctcacagactttcaaaatgaccaaacttcaactgcttataactccactaatataactctaattaaagcagctttagaagtaattaaattgttggaactaggtaaattaattaattatactttctttgcaaataagtatggcgttagctag

SEQ ID NO: 16388 - DNA, 306 bp, A.fumigatus
ataggtcgatccttggtgtggagtcgcgaaaaaagctattccgtgacagctcgacagaatagatttcatattcgacgatgcttggctggcaatgaccaaggccgccttagcaaccaatcccccagtgctatggcaaatgaagaagatgggtcgtcgactcttctgagcaagaagtcagcatataattcagtctataagcacaacatgacccacagcgctaagtcgccgctggtggagttgattcagcagattatgagccagcgaggtcaagtcgtcacgaacgctgggctttccatgatcatatag

SEQ ID NO: 16389 - DNA, 258 bp, A.fumigatus
gatgtcacctgccgcagccttccacatgagtcagatgatggtcgttatatgtatgtccttctagatggtagcctcctgaatggattcatcttacgtctgttctttcaggtggatatcggtcacagcactgctactactcgagggggttctgagttatggcgcagaatatctcccaaggcgacctccgaggtcgattcactgttaggaattctgtccattcttcagatgtcgagtaagcccaaaatgccgttaaactga

SEQ ID NO: 16390 - DNA, 486 bp, A.fumigatus
tcctggaactcaatgatgggagctgtggaggttgcctcatctcccgtatttccctccctggatcctattgtcgtcgatgatgagatggaaaatccctatcaagataccgatttaaactttctcgactctacgagactacagatgaacgaggccgccggccaggatttcgacgatctctttgcccgttcccactcctcccacacggtcaccgactcagaatctgtgtgtttgtctccctcagaactctccataaagagacactttcaggaacacgatgcactgaggcaacccaagattgttgcttcagactcccctgccgaatctctggataactcgagtcccagttcttcatccgattctccgcggaatcacggccgtaacacctccgtggctacgaccatttccgtcctaatagcgaccaagccaccatattgccatttgcttccgcacttgaggatgggatcacctcggacttcgattcattga

SEQ ID NO: 16391 - DNA, 897 bp, A.fumigatus
aaatgcccccggctgaaaagaaacaatcccgagggaaatataccaccaaagcctgcgaggagtgtcgtcggcggcgagcaaaggtacctatgtcatgcatgcatttactctttgtatcttgttctgacgtgcaaactgtgcaagtgcgacgggaaaaagccatcctgctcgcggtgtctgcaatggagtatctcttgccaatactcctcgacggaggacgggagacgtcctgcatccaagtcctacgttgacttgcttcgtcagcgaatacaattcctggaggacttcctggccaaacgcggactggatccagacgcggaaacgtcactcggagaggactccgcagaagtttcatatatggaggctctatgcgatcaattcaagggctgtcttgcgctggacgaatctctcaatttcgacgccgatggcgagatgcggttcttcgggcccacgagtggccgtctccagttcgctgcccaaggggtctcgccagagaaagattcaaacgcacgcgttgaacctgagcctcttgcatcaacggcatacgacgctttcgttcctacagagctggaaacccacctgatcgatctgtacttcgcctgggagcagccatggtaccagatcgtggatgaggatctcttccgcgacagcatggcaaacagaggccgctatttcactcccctgcttctgtacagcattctcgccatggggtcacggtactctgaccgcatcaaaactcgtaccgatgcaaacgatcctaacacggcgggtcgattctttctcgaacaggccaagactttactgcatcgggaaatggaacggccgagcctgacgactatccaagcattaagactgatcgggatgtttaacattgtgagttcgctatacactagatga

SEQ ID NO: 16392 - DNA, 297 bp, A.fumigatus
  unsure (250): Identity of nucleotide sequences at the above locations are unknown.
gttcgctatacactagatgaagacctactcacgattctgcaagcaaccggcgccgatgcagccgggtggctgcaccacggcatggcgaacaggctgaaccttgacatgggactcaatctggacccggctgccttcgagggagccgtgagtatgtctaccaaggaaatgcagctccgacgacagatctactggactctatactgtcacgacaagctctctgcgagctatacagggcggttttgctccatgntggttcgtcggtcatccttagttcttttgaataccacagcccactga

SEQ ID NO: 16393 - DNA, 600 bp, A.fumigatus
ggggcgagggggactgcaataatcaacgtagaatggtctaaacaacacaccatgaagtccatcttcgccctcaccggtctcctctctctcgtcctctctgccagtgcagcagacccccgtctctgccccaaaggcaatgaccccctgccggcttcggcctttaccctccaacaaagcaaggacaacagccatctagcctccctctcgcacatcttctccgtggccggcaaaaatgtcagcatcgctcgcgtgcttgactcggccaaccgtgacctcgccaaggggaagccgccggtcgggacgacccccgtcgaagcctggaaatggaaccccggcgacatggccacgaagaaatgggtgccgcaggggatcaccggttccgcggatgcctccgcctcgggcaaatgggacggccgcgagatgtggctggtcagctggcaccgcgatgacgataaaagcgtgcgcgtgagctttgtcgaccgcaaagaacgcaccaagtacccggccatgtgcctcctggggggagccccactggcgggacgaaccaactttgcctgccggggccccgtgccatgccgggggggacatagggcagggtaa

SEQ ID NO: 16394 - DNA, 531 bp, A.fumigatus
cagcttgctcaagacggcaacgtctttgctgccgacccctacaaatccgaggtcatcgcctttgccacgaagcaacaactcaccccggacttccatcagattttcatccgcgggatcggctgcaactggctggtctgtctggcttgcttcctcggcgtccagggccgcgatctcgcctccaaggtggtaggcatctggttcccgacctttgccttcgtgtcgctgggctttgaccacgtcgtcgccaatatgaccttcatccccctggcgatctggctgggggcgcccaagatcacggtagcgctgtacatctggaaggggatcattcccacgctgctggggaatatcattggaggtggattgtttgtcggtaggtgtacctcttgcgagttggcgaccgtggctaaccaaactagcgacatactactggtacatgtacctcgtgagcggagagatggccactctcacggggatgcgccagtcaggcacgacgacgcctcgttcactggatatcgaggccatggctgctga

SEQ ID NO: 16395 - DNA, 1056 bp, A.fumigatus
gaacgtgaaatcgctcaactacggaagacgctagaagaagaacgacttgcgcgtagacggcgacagtcgatctcgaccaaggttcaaagtacagacgagaccgcaaactctacccgacaaagtgtatcaaactcagctgcgcctcgcaaatcctcgatgaaggacagtaaagccccgataacaagaccagcttcggcaatgggtgatctgacggccacatcgaaagtcagcatggctgaggcagacagcaatctttccgtgcccattgagcgcccaagacggcattcggatcactccatcatccccaccactcagcggagacgtcgccctgttactgacgacatgacttctgctttcatcctgccagatattactattcgtcacgctgagttggcagctgaggacccaagccggttgccccaggctgcgcaaaaggccttggacagtgctacacagcatgatggcaaaaactgcacggtttgcaagcgctgcattcctggtaactcgcaatgcgaccatactcatgagactgtaaagatcccgaaacctgtacccgtttcggagcgcatgcctgagcattctgtttacaatgaggagcctacgttgcgccctgcacaatctcccggtgctgctctcgcgacggtgcttaaggcgttggaggatgaactgtcccatttgaaaatgcagcttgtaacgtatcaaggggcgtataacaagctggatgcctcgttgagcaaacgccagaggaagtcgctggccgccaagattgaaaagcttcttaaggacattgacttgaaagctgatcaaatatatgcgctctacgatgttctcgaaggccaaaaacagaacggacacgagatgactgagcaagagatggaagtcacacttcaatccattgggatcgacaccgccgccaccacgagggccacggatgtgaccgctaccacagacaaatcttcccacaaaaacaacgatactgacttagacgacgatgaggagctaccatgggagggcattgagagcacaatggatgttacaggcagaattggaaactag

SEQ ID NO: 16396 - DNA, 1332 bp, A.fumigatus
gacgcgccatacgtttggactatgtcgcaggagaacaccagacgctccgaagccacgacaaatagcttcgcgtcgtttggctccgattttgacccggagcacgaagccctcgcgtctacgaaacactttgagaacagccccaaattgcccgagatgaaaggcagtgccaggaaacaaatcaacaactttgcagacgaggagcccgactacgccatcgacacctctgcattggaacgcgccttccctgaattgtcccccgtgggcacctccgaagatgacaccgaggaaagtatatcggttgaagctggacggggcattaacaagcccacgcgtcggctcgatgactcgcggaactccttgatgagtattgaaaatagtgtgcggtcttcctcgcctgccgtcagactcgactatcccacctcgcatacgcctcaaaagtcagccatgcgcgtatcctcgagaaggaccgccagcgagagtctacgaagggatgctcagttgagacaagccagtcttgcccacaaggagaatcgcgaccctctttcatccaaaacagcccgcaaggatcagcgacggacattgtctgaaatgcacgcgaaggtccgcgattcttacgatggttccttcatcgccgatgagagacctcagcctgtggcaaccagtacgcgtgcgacgcgcttcggaaacgtcaacctttctcatcagatagcagacgcggtggaaagagcgtcacaggaggcttatgctaaggaaatgcgccgggggaagttatccagcaacctgcgcaacgggtccggcaatggtgctggcgacacgggcactatgcagtcttttcttcttcccgatcttcccaatctgtcggagttggtgtcgggtgtctacgaagacggtacaccggtttatacccgccagagccgagctagggcgacacgatttgtttctcctccgaatgacggtgctgatgtgtccatgactcgtgaacatatccccctcgacgcgattcccattccagaagatgaaaaggctctctttgtttctctgagactgctgcaggacaaagtttcggagcttgaaagggcgaagtcggatgcggagagaaaaattgatgaaatgcgacaggaaaatgcggccttgaaggctggccggtctaaccgcaaagacaaacacggccgttctcgcgtgtatgaatccgaagacgatgaccataggagagacgccgggtctcactatcagagtcagtttccttttgcagttcgagaacctcatgctaaccattgctctagagctcgaagcttcgaatctagctttgcaaaaccagttggatatggctga

SEQ ID NO: 16397 - DNA, 456 bp, A.fumigatus
cggcgcccatgtcgaattcttccgcggcatcgccaaccccatcggcatcaagatcggccccagcatgacccccgacgagctcgtccgccttctcgacatcgtcaaccccaaccgcgaaatcggcaaggtaaccctgatctcccgctacggcgccagcaagatcagccagcaccttcccgcccacatagccgccgtccaacgctccggccacctccccgtctggcaatgcgaccccatgcatggcaacacgcagactaccccttcaggcgtgaaaacacgacacttcagcgacatcctctccgagctgcggcaggcgctcgagatccaccgcgccgcgcagtccttcctcggcggcgtgcacctcgaactcaccggcgaggccgtcacggagtgtgtcggcggtgcgggcgggctgaccgaggaggggctgagcgagcggtacacgacgttctgtga

SEQ ID NO: 16398 - DNA, 615 bp, A.fumigatus
caagctactaaggcacctccggcacaattcttttggatgggggaccgcaggcgccaacttgacggcgcccatgtcgaattcttccgcggcatcgccaaccccatcggcatcaagatcggccccagcatgacccccgacgagctcgtccgccttctcgacatcgtcaaccccaaccgcgaaatcggcaaggtaaccctgatctcccgctacggcgccagcaagatcagccagcaccttcccgcccacatagccgccgtccaacgctccggccacctccccgtctggcaatgcgaccccatgcatggcaacacgcagactaccccttcaggcgtgaaaacacgacacttcagcgacatcctctccgagctgcggcaggcgctcgagatccaccgcgccgcgcagtccttcctcggcggcgtgcacctcgaactcaccggcgaggccgtcacggagtgtgtcggcggtgcgggcgggctgaccgaggaggggctgagcgagcggtacacgacgttctgtgacccgcgcctgaacgagaagcaggcgttggagcttgcctttttggttgccggcttctaccgcgacatggatgatgtggaagggatgaactcgatctaa

SEQ ID NO: 16399 - DNA, 213 bp, A.fumigatus
agatcttatttatgtagttttaaatatatatatgctaattattttatctttattaaatatagtattaatatactactctatatagataatatccttatactttctaattttaataatcttattaacaacttccttaagcagctaggaaagttatttaaatatactaataatagtaaggtttctgtctacctagggattaatatattatattaa

SEQ ID NO: 16400 - DNA, 189 bp, A.fumigatus
cttatactaggaacctatctagatattacttttactatatctaagcttacttactttactaggaatctcagccctaattactttattatagtaaagtatatattctactatctagtagggatgctcttactcttattattttatccttctatacttagtaatcttaatagttttattaatactaattag

SEQ ID NO: 16401 - DNA, 1134 bp, A.fumigatus
ctgatcctgacaatgtccaatgttgatataaccaacgatggcttcatcgggcttgactacgactcgaggagttacatccaggctcagtcatggcctgtggcggtggaccatcagagctcccagcgaacagagggatcgcgagacatctctagcggtcacgcatatgaacagtcggtagctcaggatcccaacctgatggtcgactggcacttccaacagctgcaaccccaccttcagtacactcaggaggatcattcgtcggctcagcaatatacaacttcaagctatggaatgcccatccattcgtctcctgtggatgtcatggctccgccccagggccagatgagctccggtcttttggaaagttcttatatgccactacctgcgccagtcgacatggtaccatttggctaccaggatctccaaactgagctgatgtctttcccggacggcctgccagatttgtcatcctacgctgcaccacgtaacttgattggcagcagttcccccacggacacttacttggaagtacggtcattgtcgagtagcgataacggctggagcgccatcgagccccgtcactctcacgaatttatgttccccgatcagggcatctttatcaatcccacgcaaacgttgcacgaccggagcctttctgaatcatcctactcaacttcctatggcagtttcgttgatatctccaatccaatcaactcgcccacttctgatcttaacttcgagtctgccttcagcatgccgagacgggtctcttacgatcacacttcccgcggctcccgatcccctaccgcagtcagccccgtagcaattgtgcgacctattcctgttccctccaagaagtccacttcgcccaccaggtctgctggatcacaggcgtcatcttcatcgccgcccagtagaaaaccctcgcgcaaaagcccaatcgctgcgaagactgcggagacaaagatccgcaagcaatcgcaagctggaaagccggaaggcgaaaaacgtgttggcaagcgaaagggcccgctcaagccggatcagagaaagcaagccagtgaaattcgcaagttgagggcatgcctgcgttgcaagttcttgaaaaagactgtaagttcttccgatccgtga

SEQ ID NO: 16402 - DNA, 249 bp, A.fumigatus
aatagtgtagtatctctaaggttagggataggggtggtagtggtaataacctatattatggcattaatgatatgctcttgcctggtgattatctactataatacctctaactttaccttaagttccctaatctattactttaatataataacttccttaacttttgcctgtatagcctatttatatttctacttaacctttattacctcttctctgtataaggagttactattatatattatctcttag

SEQ ID NO: 16403 - DNA, 888 bp, A.fumigatus
  unsure (498),(499),(510): Identity of nucleotide sequences at the above locations are unknown.
ctgacagggcaaccttcacagtgtgataaaggcgagccctgtgccggttgtcaaccctcgcatgctagattatggcaagtaccttgtacaagaattgacatcaaggaaatcgggtacttcatgaaagattggaaagcggactacgagcgtcatattactctcggattttccgtcggaaacatcaagggtttctcggagcacgagaggaccttgttcatcacccatggttatggtcagattcttcccattaacgcccgggaggtttacgtccgggatgatcaatgcttcagtgtcgactgggtcgaatcgatgcaccgagaacccacccagtacgaggtcgagacagccaaactgtctgctggtatggagggtatctcacatgcaatgttgtctgattatctcgaccgccacattgatggcaatggtacttttgagaagtttgtggacgactacttcgagggcacaccattcctcacgcagatgctcaagactgccttnncgtattacttncgcaccaagctacctgtgatccgtaaagcgttggaactcatcattgcctacaccctgactctccatgtcacaatggtggagggtataggtgaagaagatggctttcttggcaagattgaggacccgtcatcgaagtttaaaggcaagatcatggcgcctgtcatgatcaatttccaggtcaagtgcgccatggccaatatgtggcgcgagctgcagaaggatgtcctcgaagagctgtcgagtctctattccagcgtgtatagtggagagaaactgaagaattggcctacaattttcattttagcctgcatcctattggcagtgtgggaagaaatgcagttcgactgccattaccgcacaccggtgagtggcaattaa

SEQ ID NO: 16404 - DNA, 252 bp, A.fumigatus
aaggttgaaatactgacatctcggaaggatcctgctgctgtggagaagttctgcaatgacatggagaatatccctgtcggagtcatcgttggtttgttccaggcaatttcgcagaaactccccgctttcaccgattgggaaacacaaaagcaccaccacttgctgttttcgaatccagatgtttgcaacaccatgaccgaggttcgcgagcatgtaaggcaatatggtaagcggccatctgtttcgccctaa

SEQ ID NO: 16405 - DNA, 1164 bp, A.fumigatus
gcttttgcgatgaccgtgaaggtgagcaacccatccatccgatggaagaaggatccaacaactgacagcctagacctctactctcttgctctgaccgctgtatcctcccttctgcgcaagtacgcaatcgaccccaacaccatcggccgtctcgaagtcggaaccgagactctgctggacaaagccaagtcctgcaagacggtgctgatgcagctcttcggcgacaacactgacatcgagggtgtcgacacatataacgcctgttacggcgggaccaacgcgctgttcaacgcagtcaactggatcgagtcgtcatcgtgggacggacgcgacgccatcgtcgtagcgggtgatattgccctgtatgaaacgccagcggcgcgtcccaccggtggtgcaggatgcgtggccatgctcatcggtccggatgccccgctggtgctggagccggtccggggttcttgcatgaagcacgtctatgacttctacaaggcgtatttcaaatccgagtacccgctggtcgacgggcagttttccaacacctgctacctgggggccctggatgcatgctaccagcgctaccaggccaagcagcgcgcgcggcaagcggccaagacgaatgggacggccatcagcaatggtcaccaggggagtttcctggacacgtttgactatttcgctttccatgcgcccaactgcaagctggtggccaaggggtatggccggttgctgttcaacgacttcaaattagagtccggatcgtttgacgaggtgccggcacaagtccgcgaggccgacttcgccgcgtcgctgacggacaaagccctggagaagctgtgtgtcagcctcaccaaggagagattcgtccagcgcgtcgagccgtccttgaccgccccgacgaactgcggcaacatgtacaccgccagcgtgtatgcgggcctcatcagcctgatcagcaatgtccccagcgaccgactgcaggacaagcgcatcgggatgttcagctacggcagcggtctggctagcacattgttcagcttccgggtcaagggcgacacgaccgaaatggctcggaagattggcttgcaggatcggctgagtgctcgaacggcagtgtcgcctgaattctatgatcaggtgagtcgtttgatatggatgttctga

SEQ ID NO: 16406 - DNA, 204 bp, A.fumigatus
gttcgccagtgcttctcctgtggcagtgaccaagaaccttggctaagagaactgcagtatgtcccacagaccgagctcgagacatttcttggagccagtgccggaaaatacaccattggcctcggtcaacagaacatgagcttttgcgatgaccgtgaaggtgagcaacccatccatccgatggaagaaggatccaacaactga

SEQ ID NO: 16407 - DNA, 795 bp, A.fumigatus
tcatcttcatcgacctgcttccttctcttctcttccctctatcttactgagacatacagcaaaatgtcttcctggacaggcgcggctgccatgatctcatctccatcctcattccatgcgcttccattagagtgccgacaacagattctatgcgaccttccagacattcaatcgctcaaatccgccatactaagccattctgcgttgtacgcggccttttataattaccagtcgccgatcatattgcaagtcattcaacgtcagattcctgcagacctactcgcatatgctgtcctgtgttcccatgcacgcaacatcgaaccatggacgaggacaaaggttctagatatactggacctgtacttcaaccgccgcctggttgagtcattccaatggactattcgagcagctctggatctggtgaaattccacgaaagcgtgacctttttcgcaaatgactacatcgacaacgcactgggcctcgtggcacccttgaactttccaatccacgcaccctccgagactgaatggtgccgggtcgctcgggcattctacctacaggagacgatcggccatttcttttgctttcgaaacggaggagagcgctggatcactggcggcatcagatatgcacgtccatgcccgtccgaattccatcatcgggagaagtttgatatattcttcggcaagcacgcgccctgggagatggagcaagtcggtgcggttaatgagtacttgtactggagaatctcaccaggtatgtctatcccctgctacatttctgtgtttgtttag

SEQ ID NO: 16408 - DNA, 1344 bp, A.fumigatus
  unsure (952): Identity of nucleotide sequences at the above locations are unknown.
gacctgaaaattgatcgtgagaagggagctcagaaaaaagtttgttatctggtggagtatatatggaatagtcagggcttgatgctaacatacctcatgctgttcaggcgaacaacggtaatgaagagactgaggaaatggtatgtcatcttaattgcaacatcgcgtgcaataatcagagttcatgctaatatacctcatgttgatcagacgaacaatcagaataacgtgaccaacactactcagctcagtaaagggaacaaacgcctgctgcacctcggagacaacgagacacgtcccagcaagcaaactaagactggcgatgttgcagcaaacagtgacaatgacccagacttcgatcctagcgaggatagtgattctgacgggggtgacattagccctgcaggtaacattggccgctctcccactgctcggcagcttcgtaatgcgcctcgcaagcagctgaatgatactgtcgtgggttcagcttctggcctgaagcgtccttccaagagtacaaagcttcaattcactggtcaacctggtgcacgcaattcgtttagcacaacgcctgctagccctgaccctcgcacactgcagaacgcaaaaaaatctatcaaaactactgaacttgcacccaactcatctcagccaacacttccaaattctcgcactcctgacaacgctgcagacacgaacaaatctgacgcaacctctgaaatcgtgtccacggtgcagagagctcctccaaactcgtctcctgcaaacactcatcgttctctgccgaatcaagaatctactaccgacgaacatttgccatcaaagcctgaagacaaaatggctcctcgtcctcacactcccccttttcccgctaccactggttttaccgaatctggaaacaacggatacccactcatgcagcacggcgcactcctgtttgtgcaggccggtntcgccatgagagaattgccgagagagcgcgcccgcaacgcccagttggacgagagatatgagaatctcgtgatggaaggtactgaactgaaggagaaggaagccgaatggagacgggagattgaagagctccagctccataacaagaacctcgaaggcgaccttaagaagcagattgatcagaacaagaagctcgaggctggactgaaggagttgagcgagaagaagaaccagggtgctctcgattctgccaatggagccaccaatgccaaatgcgagcactgccttgagcatctcactcgcatcaacgctctgaccgaagaaaataagaagatgaagcagagatgcaaggttttggctgaagcatttgcggctggcaatgatcaagcctga

SEQ ID NO: 16409 - DNA, 243 bp, A.fumigatus
aaattttcatcaagacagttgcctttcccatttctctctcaggagaaacatccgttggatgttctcataaaagcacatgttacgaagcgaaacctttggcatcgccgtcctctgacttgcttctcttttagtctcgagcgtgaaccgacagtcaatatgtctggctggaactccggtgaggcagatgcctggaataccaatgaatcaagcggctggaataacaacaatggcaccggtacgtag

SEQ ID NO: 16410 - DNA, 186 bp, A.fumigatus
catataaagagactgtatactcattttagcttggcagattttgctgacgagaatgtcaacccaatcagctccgcccctgctggagacttcagagagggcaaatggggcggtgatcaaattggtggtcagttcgagcccaccttcagcgctggcgaagagggcaatgacaataaatgtcgcaagtaa

SEQ ID NO: 16411 - DNA, 261 bp, A.fumigatus
ctgacaagaggtgtaccaggtcacaagactatcgagtgcaccgagaatcgcaaattcgatctgaacgatatccctgacaagcttcccgaggaagcttgggctgccctcaagaaggctagcaacgagagagatctggaagacttccgtgaggtaggcaatggaattgacctatacgcatttgaaagacaacagttgatggctgacagccctctagggcctcaaggtctattccaaggcggttcctcaggccacctttgttga

SEQ ID NO: 16412 - DNA, 390 bp, A.fumigatus
tgtgaagaaggtaagataccatttgcaggaatggccggccattctttgtacccaagattaatggatgatgttctagtcggacactttagccgtgactgccctcaaaagaaggactggtctaaggtcaagtgcaacaattgtggtgaaagtgagcaatctgccaaggatgcccgacataagggtcaaatgttgaccaatgtaacagtgggccacaccatcaagcgctgccttcaggctgccagtgagggtttcggtcagggcaacaacgacatccaaactaatggcgcgggtgatgattggaataccaataccgctgcccccctcagcaatgaaaacactgacggagatgctgaaaagggcggttggtccgccggcggtggtggatggtaa

SEQ ID NO: 16413 - DNA, 318 bp, A.fumigatus
agagactgtatactcattttagcttggcagattttgctgacgagaatgtcaacccaatcagctccgcccctgctggagacttcagagagggcaaatggggcggtgatcaaattggtggtcagttcgagcccaccttcagcgctggcgaagagggcaatgacaataaatgtcgcaagtaagtgtcttcctcccctgggaaggtctacgaaggtcctgttgctgacgagacccagttgtggaggtgatggtcattttgcgcgtgaatgtcctgcacctcgtaagggtatggcttgcttcaattgtggcgaggaggggtaa

SEQ ID NO: 16414 - DNA, 273 bp, A.fumigatus
ctctcactgcaggagaaaccagtcgaagacagcatcagcttgatcaatctccagggcaagttgaactgcaagtatgtcgttgcattctacttcagccctaagccgcagcgcgcgaacctcaaggaacgctggcctgccgaccctgaagagaaccttgagcgccttgaggtcgctggcttcccttacgataaacaaatccccaagtgcggtaattgcggtggtaagcaaaaactttctctgggtggatatcgctactctcaaaaagaatgctaa

SEQ ID NO: 16415 - DNA, 201 bp, A.fumigatus
agtatcatagaaatgggtcacactgctcgtggttgcaaggaggagcgggctttggtggaccgggtcgaggtcaaatgtgtcaactgtaacgccagtggacatcgtgcccgtgactgcactgaacctcgcgtcgacaggtttgcctgtcgtaactgcgggtatattgtttttcctctcttcatcttccgagtcttgcgttga

SEQ ID NO: 16416 - DNA, 597 bp, A.fumigatus
ttggtccttcggcatttcggccattccgatctccgtccacaacgatcattcgagggtctcgaaagctcatcttccattcttcttctcggctttgtacatacagggagttcagcactgactccccctgctattggcatcaccatggcttctttaggaggctcggtgcctatgttccggagcctcgcgccccggttctccaaggatttcttcacttgccgacaatgcctcggacggacccagacatatgcaaccaaatccctatttcgcaagcagtttgctggactttccttcggccaaaagtcctctaatgcaactccgaaggcattcagcgtgacagccacaaagtttttctcacctatcttacggaggtccgtcgccggatcagccgtggccggtgcgctggagcacggagcttctcaagccaagtccagctttcccaaagtgtctgacaagattgtggcttactggctgctggggagtgcggccagcgtattcggtattgttgtctttggtggactcacaaggttaacagaatcagggtacgttctgccttatgcatcccaatttgagcgacacttgctgaccttatctgaatag

SEQ ID NO: 16417 - DNA, 1128 bp, A.fumigatus
ccttatctgaatagtttgagtattacagaatggcgtcccgtcacgggatccctccctcccatgaatgcagaagactgggagtctgagtttgcaaagtaccgtgcctcccccgaatatcagcagttgaacccgaatatgaatctctccgagttcaagtcaatctactatatggaatggattcaccggctctggggtcgttttgttggcctgtcatttgtgcttccggctatctatttcgtcgcaaagaagaaggtcagcaagcccatgtcgctacgcttagcaggcatcgcgggtcttatcggcttccaaggcttcatcggttggtggatggttaagtccggactcaaggaagacctttttgcgcaaggcagccacccccgcgtgagtcagtatcggttgactgctcatcttggggctgcgttcatctgctacacggccatgctctggaacggtcttgctatcctgcggtctcatcggctcctggctgacccagaagctggaataaagctcctggactcgctgcgtgaccccaaactgaagatcttccgccgatctgttgccggtctggccctgctggtctttgcccctgccatgtccggtgccctagttgccggcctggatgctggtctgatctacaatgagttcccgttcatgggcaatggtctggctcctcccaaatccgagttgcttgatgagcgttattcacggcacgaagaccggtctgacctctggtggcgcaacatgctggagaacccttctcttgtgcaactggaccatcgtatcatggctatgaccacgtttaccagtattatggctctatgggcttattctcgccgctctccaaccatgaagcggttgcttccacctgccgccaggaagggccttcacggtgtggttgcatttgcctgggtccaagtcggtctaggcatttccaccctcctctaccttgtccctactcctcttgcctctgctcatcaagcaggcagtctcttccttttgacctgggtgctggtcttgggcagccgtatctggcacccgtctaggacggctaagttgcttcagatggccgcaaaggctcgtggccaagcggtacgcaatgctactgcacaagccgcccacaagctatga

SEQ ID NO: 16418 - DNA, 213 bp, A.fumigatus
aaggtaaaactgcttcagggaatctgggatatgtccaaggactactcctaccgtggcgaaatgcagtttgtcatcatttactatctggcatctcgccatggggaggagcaaggcactgtatccagtgttttagcgtacttccttgctctgtacagtaggatgagaggcgacatggacaaaaagagcaaaatctatagtacgatgcgtgcatag

SEQ ID NO: 16419 - DNA, 183 bp, A.fumigatus
gtttggcatctatgtctagattctatagtagttaattcgagcacattcaatgatgttgatgccaaaattcttcattctgccacgagaccctttgagtccatgtatgatatcattgtatatgctatggagcttgtgaagttctgctacttccagtatgttgctgggcgtcgtaaccaggattga

SEQ ID NO: 16420 - DNA, 813 bp, A.fumigatus
ttcctaatttgcactggacttcccgtcatacaacgaactaacatccattcacaacagtcgcatgaactgtggtttggctcctctcaattccaccgcacctcatatcaacaccttcagttgcccggggacgcgccaccgcacggccacccacgtcgcaatggacacaatgccttgaatggacgagcagcaactactcccggcaacagcctatcgtcattgcagctcgaggagcgcgctctccacgcacgcaagaacaacatcgcttcgttcggatactcgtggatcaagccggccggatgctccaagaccatgctgggtatgaaggaggaggaggccgagcgggaggaggccctcgcggcggcggcggctgagatggctgcggcggcggcggctgcggccgatcccgggttggatgagtttgggaatccgatgcatgaccagacggatgatacgggtatggagagggatttggatgacgatattcccgatgccgatgcggacggactcgtggaggaaggagaggaaggactggaagaggacgaagacgtggatgaggagggatacatggagcgggatctagacgatgacattcccgaagcgttcgctgatgatgacgacgaacgtgatgatgaagatggcgaggaaaatgtggaagatactgtggacttcgacaaccaagccgacctggacgatgagatccccagcgcagcagatgattacgagggcgaagatatgagcgacgtagtcgagaacggcgacgaagatgcattcgggatggtctcaccacgggctggaaggatccgcgcatgcgtt

SEQ ID NO: 16421 - DNA, 528 bp, A.fumigatus
cgcatgcgcggatccttccagcccgtggtgagaccatcccgaatgcatcttcgtcgccgttctcgactacgtcgctcatatcttcgccctcgtaatcatctgctgcgctggggatctcatcgtccaggtcggcttggttgtcgaagtccacagtatcttccacattttcctcgccatcttcatcatcacgttcgtcgtcatcatcagcgaacgcttcgggaatgtcatcgtctagatcccgctccatgtatccctcctcatccacgtcttcgtcctcttccagtccttcctctccttcctccacgagtccgtccgcatcggcatcgggaatatcgtcatccaaatccctctccatacccgtatcatccgtctggtcatgcatcggattcccaaactcatccaacccgggatcggccgcagccgccgccgccgcagccatctcagccgccgccgccgcgagggcctcctcccgctcggcctcctcctccttcatacccagcatggtcttggagcatccggccggcttga

SEQ ID NO: 16422 - DNA, 603 bp, A.fumigatus
tcatctgctgcgctggggatctcatcgtccaggtcggcttggttgtcgaagtccacagtatcttccacattttcctcgccatcttcatcatcacgttcgtcgtcatcatcagcgaacgcttcgggaatgtcatcgtctagatcccgctccatgtatccctcctcatccacgtcttcgtcctcttccagtccttcctctccttcctccacgagtccgtccgcatcggcatcgggaatatcgtcatccaaatccctctccatacccgtatcatccgtctggtcatgcatcggattcccaaactcatccaacccgggatcggccgcagccgccgccgccgcagccatctcagccgccgccgccgcgagggcctcctcccgctcggcctcctcctccttcatacccagcatggtcttggagcatccggccggcttgatccacgagtatccgaacgaagcgatgttgttcttgcgtgcgtggagagcgcgctcctcgagctgcaatgacgataggctgttgccgggagtagttgctgctcgtccattcaaggcattgtgtccattgcgacgtgggtggccgtgcggtggcgcgtccccgggcaactga

SEQ ID NO: 16423 - DNA, 402 bp, A.fumigatus
gtgatcttccaatcagatgccaaagacggatcaattctaattttcttgcagccaagcctgctgttgctgagcccgtcaagaaacccgttgaggccaaggaggaggccaagaaggaagaggctgctcctgttgaggaaaccaaggattctaaggaaaccaccgaggttaaggataaggccaagagccgatctcagtctcgcaagagggccagcatcttcggctccttcctcggtaagaaggaggagactgaggagaagaaggaagagaagaccgaggacgccaagcccgtcgaagccgccgctgaacctgtcgccgcgacctccgctactgctgaagctactgagggtgagtttcatcaatattcagaatctgcctcggagccaaaaagctgattgtcattaa

SEQ ID NO: 16424 - DNA, 663 bp, A.fumigatus
gctgccgctcctgcctctgccgaggagaagaaggaggagaccgaggcaaagaaggaggagaagaaggccgagagccctgctcctaagtccaagcgtacctctctgttcggtaacttcttccagaaagttaccagcccctcccacgagaagtctgagaaggaggctgcggctcatgctgagacttccgctgtctccagcactgctccccagctcgagaaccccgtcgaggaggctgccgtgaagcccatcgagcctgagaacgtgaccgccgcctctgccactgaggccgaggcccccaaggaggctgccgctcagtcccccgctgccgagactcctgccggcaaggacaagcgccgcacctctttcttcggtaacttcggtaagaagaagggcgactctgacaatgagggcaccgacggcgatgccaaggccaagggcaacaagctcggcggtcttttccgcaagcccagcaaggccgtgaagctcgacaacaaggaagccgctgccaaggaggaggacaaggccgagcccaccgctcaggagacttccgccgaggctgctcccgctgaggatgccagcaagcccgctgaagctcccgccaccgaggaggccaagcctgcgactgtcgctgctaccacgactcccgtccaggctgcagcatga

SEQ ID NO: 16425 - DNA, 405 bp, A.fumigatus
cttttccacagccttcgactcggccgccttggatgctgcaatcgctctgtcccagcccgagactatacccgcaaaggagatctctgttcctccgtctcctgctgttggcaagtccgcttcgcccgctcccttccccctgcgccaagcaagtccggtgttaagcactccaccgtcgccggtgtcaatgctcgtcaacgcaagccattgccccctatcaaggttgaccccaacgaccctgtcgcgttgaagcgtgctcgcaatactgaggctgctcgtaaatctcgtgctcgcaagcttgaacgccaggatgagatggagcgacgcatccgtgagctcgagaagtctctggaagaagctcagcagcgtgaacagtactggaaggcccttgcccagaacaggggttga

SEQ ID NO: 16426 - DNA, 1491 bp, A.fumigatus
aaccatcctcacctatatttttttaacatcttcaccatacacccacacaattatcaggaatatcagtctcagtatccattgcaaaatggctgccttctaagctcctccccccgaacgagctcgtctttctctcgtgagacagacaccatagatcctttacggtcttcgtcactttccaccatctcctctcaaccttcttcagagtctcctgtcccaggacctctgaacttaagcatcgcttcgcgtagctcaagttcttctttgaacaacattctcccgttcgacgtcacgtcgttcaccacggataaccatcagcaaacatggctccccacgcccccgccccagcagccttcggctcagaatctgaattcgaattccaacaacgacaacaacagttccccgcaggaggacttcgtgctctatcccgccccgtgtccgcagcctcgtttgagagactcgcgtgcgccagtacttccgagtacagcccctagatctgtttcataccatcctttcctggtccggcctcagtaccagcagcccagacggcactcgctcagtctgtatcagcaacttcagcaacagaaactttcgggttcacctggccaggttcctcgtgcgaccaggcttcactcacagtctaccgggtatcctctgtcctcatctcttcggtctagtccctccagccggacgcattttcaccgtgtccacgccgcgtctgcgccttcgaattcaccaaatcccaatcgtccccctgttccattgttttcagcagccaacggaactcaattcactcaaaaacagctacagcaattacaacagttgtatcaccgccgcatcatgtcgacccccaacatcgctcaaggtgagctgatagaaattatgtccgcttcaacttggtctaattccgcagcagatatgcctgacttcttcggtctcccctcgaatgactttggggatgatttcgaattgagcactgaacccaccatgctttctcccaatcagatccccactggcctcatggccgtcaaggactctgtggcaggtgccccttcgggcaccatctcgcccaaggacttgttcatggatgcgtcggcgcccccgtcgacctcgttcactgacctcagcactccttcctttgagtctcctggctacttcagccaagacacttcgccaatgttccccaccgatctggagctgggccctggctccgaggagtggggtccactcttccctgctcaagatgacttttccacagccttcgactcggccgccttggatgctgcaatcgctctgtcccagcccgagactatacccgcaaaggagatctctgttcctccgtctcctgctgttggcaagtccgcttcgcccgctcccttccccctgcgccaagcaagtccggtgttaagcactccaccgtcgccggtgtcaatgctcgtcaacgcaagccattgccccctatcaaggttgaccccaacgaccctgtcgcgttga

SEQ ID NO: 16427 - DNA, 396 bp, A.fumigatus
gtaagtgatcttccaatcagatgccaaagacggatcaattctaattttcttgcagccaagcctgctgttgctgagcccgtcaagaaacccgttgaggccaaggaggaggccaagaaggaagaggctgctcctgttgaggaaaccaaggattctaaggaaaccaccgaggttaaggataaggccaagagccgatctcagtctcgcaagagggccagcatcttcggctccttcctcggtaagaaggaggagactgaggagaagaaggaagagaagaccgaggacgccaagcccgtcgaagccgccgctgaacctgtcgccgcgacctccgctactgctgaagctactgagggtgagtttcatcaatattcagaatctgcctcggagccaaaaagctga

SEQ ID NO: 16428 - DNA, 879 bp, A.fumigatus
atattttctcatagttttttctctcaacactttttggttttcgttttcggtcatggtaatgattcaacagcatgcaaaggcgttgggagacgtataacgttgatcccaccatttctcaaactcgacggcacgcctctgaggatgagcacttcatgctgcagcctggacgggagtcgtggtagcagcgacagtcgcaggcttggcctcctcggtggcgggagcttcagcgggcttgctggcatcctcagcgggagcagcctcggcggaagtctcctgagcggtgggctcggccttgtcctcctccttggcagcggcttccttgttgtcgagcttcacggccttgctgggcttgcggaaaagaccgccgagcttgttgcccttggccttggcatcgccgtcggtgccctcattgtcagagtcgcccttcttcttaccgaagttaccgaagaaagaggtgcggcgcttgtccttgccggcaggagtctcggcagcgggggactgagcggcagcctccttgggggcctcggcctcagtggcagaggcggcggtcacgttctcaggctcgatgggcttcacggcagcctcctcgacggggttctcgagctggggagcagtgctggagacagcggaagtctcagcatgagccgcagcctccttctcagacttctcgtgggaggggctggtaactttctggaagaagttaccgaacagagaggtacgcttggacttaggagcagggctctcggccttcttctcctccttctttgcctcggtctcctccttcttctcctcggcagaggcaggagcggcagcttaatgacaatcagctttttggctccgaggcagattctgaatattgatgaaactcaccctcagtag

SEQ ID NO: 16429 - DNA, 504 bp, A.fumigatus
cagcgacagtcgcaggcttggcctcctcggtggcgggagcttcagcgggcttgctggcatcctcagcgggagcagcctcggcggaagtctcctgagcggtgggctcggccttgtcctcctccttggcagcggcttccttgttgtcgagcttcacggccttgctgggcttgcggaaaagaccgccgagcttgttgcccttggccttggcatcgccgtcggtgccctcattgtcagagtcgcccttcttcttaccgaagttaccgaagaaagaggtgcggcgcttgtccttgccggcaggagtctcggcagcgggggactgagcggcagcctccttgggggcctcggcctcagtggcagaggcggcggtcacgttctcaggctcgatgggcttcacggcagcctcctcgacggggttctcgagctggggagcagtgctggagacagcggaagtctcagcatgagccgcagcctccttctcagacttctcgtgggaggggctggtaa

SEQ ID NO: 16430 - DNA, 363 bp, A.fumigatus
atctcgcagcacggcctcaactccctctgggccctgctggaaatcatcctccccaccacgaacccgcattcgcttctggcgtttccggtcctggtgctgattctcctgctgtatgtcgcgctcgcgtacttgacctaccacactgaggggttctacacctactcgttcttggatccgggtccggacggcgagcatagtggtcgcgtgacgggttactgctttgggatctttgcagccatcctggtcattttcattctctcgtgggctgccatttggttgaggcggaggctcacccatggaaagatcaagaggtcggtctacgacaaggaggacgttccggagatgcggcatgttggagtttag

SEQ ID NO: 16431 - DNA, 249 bp, A.fumigatus
cacctgttccttttccaaccccaatccttcgtgttgcgtgcatatatcaacaccgcaatggctgcgtctcctgctgctatagcgccgaccgcccctgagagcaaggtcgagggccttggcctttactcgcggttcgcttttgctggtgccgtctgctgttctgttactcatggtgccttcactccggttgacgtgtatgctgtccatttaggttcagctccaaaattcaataagtgcatgacttgctaa

SEQ ID NO: 16432 - DNA, 453 bp, A.fumigatus
ccctcctacagtgtcaaaaccaggatccaactcgacccgaagacctacaaccgtggtatgattggtggtttccgtcaggttatccaaaatgagggcgctggtgctctcttgacgggtattggcccgacgtttgctggttactttatgcagggcgcctttaaatttggtggttatgagtttttcaagcagcaatccatcaacgtccttgggcttgaaacggcgcgtcagaaccgtaccgctgtttattctgtctcggctgcttgtgctgagttctttgcctcgatcgctctctgccctctggaggctacacgtatccgtcttgtctctgagcccggttttgccaatggcctatttagcggtttcggcaagatcctcaagcacgagggcgttggtgctttctaccgtggttttggtcctattctcctgaagcagtacgttggttcaactacttag

SEQ ID NO: 16433 - DNA, 444 bp, A.fumigatus
tatagggtgccctacacagtgactaaatttgtggtctatgaaaaggttgctgaggctgtttttgctcgccttgacaagtctaagctgtcaaatagcgcccagactggtgttaacttgggatctggtctcattgctggttttgctgctgccatcatctctcagccagctgatactatgctctccaagatcaacaagaccaaaggtctccctggggagagcaccgtctcccgtctcatcaagattgcgggtgagcttggttttcgtggttcctttgctggtcttccgactcgtctcttcatgattggtggtcttactgctgggcagtttgccatctatggtgacattaagaaggctcttggtaagtctgattactttcttggtggatcacaaaggctgacatttgtacccctaggtgcgactaatggtgtggagatcgccaagtaa

SEQ ID NO: 16434 - DNA, 336 bp, A.fumigatus
tctgggccgttctattgctcgcttcatggtcgagcgcggtgcacgccatgtggtgaggcgaagtttattgatccgtgcacgccgcgggcaggatcgccttatgatatcaccttggagatgagccataaccctaacaagaaccctttgatcacggtcaagttgcagaaaaagcggtatggaccaaaggatgccgaggcggtcacggacgcgcacctgttgattgtgagcatcttttcaaggaacccggtgctaagagtggaggatgagatgttggatcaggggccaaatcgagggcttgatgtacctacagtccagggtatttatttcttcagttga

SEQ ID NO: 16435 - DNA, 615 bp, A.fumigatus
ataaactcttcgtccactcctttcccacctctcccccccggcgcaacatcccatccccatgcgcgcaccactgctactgccgccgccgtcgccaacatgaagctatccaaaccctccttcggcgtcgactcctccctcgactcccgccactgctacgaaacctcctggctcctccctcctctccccttcgctctcctccgcgccctcatcgccctctacatcttcgtcaccatctttttcatctggggctggaacggcacccacggcgactccgacgcgattggccagagcttcagctacttcacctggctcacgtactggggtctgggcttctattatctcgtcgcggcgatccataccgcatgttacgcacgcacagggcgctccgtgctcttcgacagactgcctcgtgcgctgcgcgccctgcatgccattttctacaccaccatcaccaccttcccgtttctcgtgacgatcgtattctgggcgattctgtttgagccgccgtggtatacgcggacttttcaggcttggtcgaatgtatgctgtccatgtttgaagactcaaaaaaaaaaagtgtcgcaaagtgagtgtccagtgtcgctaacgctatga

SEQ ID NO: 16436 - DNA, 189 bp, A.fumigatus
caagttgttcaaggatcatgccatgtcatttaccctgtgaagcttcctcaatcttgggatctgcagttctgtttccaacaacgcactaagttatttcaaacgcagtactgtattgactgtggaccaaggtatgaaatccgtccgtacctcacagatgctaaattctccggcggctctacaactcattga

SEQ ID NO: 16437 - DNA, 1959 bp, A.fumigatus
tcggcgataaaacacgtttggtctgtggcttctacttcttcttcttcttcttcttcttcttcttctgctgctgctgctgcgtcttcctcgattggcctgtcctccaccatgtctctcagcctcagttcgagcgccatcccctcggtgaccccctcggcgactcccgtcagccacggctcggtcttgtccaacatcctggtgatcgccaaggactcgtcggcggccagttcggcgacctcggggctcaatgcgtacggcatcccgtacaccaccttgctggtcccccaggcgggtgtgggcctcccggctctcaactccagcaatgtcggcaactacggcgggattgtcgtggcggccgaggtcagctacgactacgggggcacgaccggctaccagagcgccttgaccaccgaccagtggaaccagctgtatgcctaccagctcgagtacggcgtgcgcatggtgcagttcgacgtctaccccggccccaagtttggcgccagtgcggtcaacggcggttgctgcaacaccggcgtggagcagctgctctcgttcaccgacaccagtgacttccccacggccggcttgaagacgggcgcgacggtcagcaccgagggcctctggcactacccggccacgatcagcaactcgagcaacaccaaggagatcgcccagttcgctcccaacgcggtcacctcgaccgcgagcactgcggcggtcatcaacaactttgacggccgcgagcagatggcgttcttcattggctttgccaccgactggagcgcgacctccaactacctgcagcacgcctggatcacctggctcacccgcgggctgtacgcgggccaccgccgcgtcaacctgaacacgcagatcgacgacatgttcctcgtcaccgacatctactacccgaacggatccaccttccgcatcaccgtcgaggacatgaacggcatctcggcctgggtcccgaccatcaacgccaagatgaaccccggcagctcgtactttgtcgaggtgggccacaacggcaacggcaacatcgagcagtcgtcttccaccgacgcgggggcggccgcctgcaacgggggcggcatcgaatacgactcgcccccggacactcccctggaattcaagaagcccctgggcacggggaccgacctctggccctcgacgccgacgacctacgactggacggtcgcctgcacccagctcgatgacttgctgcggtggtggaccacgccggccaaccgcgacgcgttcggccacatctcgcacaccttcacccacgaggagcagaacaacgcgacctacgcggacgtcttcaaggagatttccttcaaccaggcctggttgaagcaggtcggcttggaccaggccaagtggttcacctccaatggcatcatccccccggccatcaccggtctgcacaacggcgatgcgctgcaggcctggtgggacaatggcatccgcaactgcgtgggcgacaacacccgcccggtgctgatgaaccagcagaacgccatgtggccgtatttcaccacggtggagtcggacgggttcgccggcatgcaggtcaacccccgctgggccacgcgcatctactacaactgcgacacgccggcctgcaccgtgcaggagtggatcgacacctccgccggcgccggcagcttcgacgacctgctggccgtggagaaggccgacaccatgcgccatctcctcggcctgcggcatgacgggtacatgttccaccaggccaacctgcgcaacgcggacgtgaccccgatcacggtcaacggcgtgacggccaagtactcgattttccaggcgtgggttgagacgattgtgcaggaattcgtccgcctggtcgactggccgttggtcaccatcacccaccaagaggtatgtccctatcctttttcttacgatgtctacctgtacaaactacagcctggctaa

SEQ ID NO: 16438 - DNA, 267 bp, A.fumigatus
atgtccgagaacttccttgcgcggtaccagcgcgaccagtgtggctacggcctgtcgtacgccgtcgccgacaagaaaatcaccgccgtgacggtgacggccacgggcaacacctgcagccgtccgatcccagtgaccttcccggtggctcccaccagcacgcagggctatgccaccgagcagctgggaagtgatcccttgacggtgtgggtgcagctgtcgggatcgcctgtgacctttacgctttccactcctattgctttgtag

SEQ ID NO: 16439 - DNA, 270 bp, A.fumigatus
accagcagaacgccatgtggccgtatttcaccacggtggagtcggacgggttcgccggcatgcaggtcaacccccgctgggccacgcgcatctactacaactgcgacacgccggcctgcaccgtgcaggagtggatcgacacctccgccggcgccggcagcttcgacgacctgctggccgtggagaaggccgacaccatgcgccatctcctcggcctgcggcatgacgggtacatgttccaccaggccaacctgcgcaacgcggacgtga

SEQ ID NO: 16440 - DNA, 1944 bp, A.fumigatus
tttgtacaggtagacatcgtaagaaaaaggatagggacatacctcttggtgggtgatggtgaccaacggccagtcgaccaggcggacgaattcctgcacaatcgtctcaacccacgcctggaaaatcgagtacttggccgtcacgccgttgaccgtgatcggggtcacgtccgcgttgcgcaggttggcctggtggaacatgtacccgtcatgccgcaggccgaggagatggcgcatggtgtcggccttctccacggccagcaggtcgtcgaagctgccggcgccggcggaggtgtcgatccactcctgcacggtgcaggccggcgtgtcgcagttgtagtagatgcgcgtggcccagcgggggttgacctgcatgccggcgaacccgtccgactccaccgtggtgaaatacggccacatggcgttctgctggttcatcagcaccgggcgggtgttgtcgcccacgcagttgcggatgccattgtcccaccaggcctgcagcgcatcgccgttgtgcagaccggtgatggccggggggatgatgccattggaggtgaaccacttggcctggtccaagccgacctgcttcaaccaggcctggttgaaggaaatctccttgaagacgtccgcgtaggtcgcgttgttctgctcctcgtgggtgaaggtgtgcgagatgtggccgaacgcgtcgcggttggccggcgtggtccaccaccgcagcaagtcatcgagctgggtgcaggcgaccgtccagtcgtaggtcgtcggcgtcgagggccagaggtcggtccccgtgcccaggggcttcttgaattccaggggagtgtccgggggcgagtcgtattcgatgccgcccccgttgcaggcggccgcccccgcgtcggtggaagacgactgctcgatgttgccgttgccgttgtggcccacctcgacaaagtacgagctgccggggttcatcttggcgttgatggtcgggacccaggccgagatgccgttcatgtcctcgacggtgatgcggaaggtggatccgttcgggtagtagatgtcggtgacgaggaacatgtcgtcgatctgcgtgttcaggttgacgcggcggtggcccgcgtacagcccgcgggtgagccaggtgatccaggcgtgctgcaggtagttggaggtcgcgctccagtcggtggcaaagccaatgaagaacgccatctgctcgcggccgtcaaagttgttgatgaccgccgcagtgctcgcggtcgaggtgaccgcgttgggagcgaactgggcgatctccttggtgttgctcgagttgctgatcgtggccgggtagtgccagaggccctcggtgctgaccgtcgcgcccgtcttcaagccggccgtggggaagtcactggtgtcggtgaacgagagcagctgctccacgccggtgttgcagcaaccgccgttgaccgcactggcgccaaacttggggccggggtagacgtcgaactgcaccatgcgcacgccgtactcgagctggtaggcatacagctggttccactggtcggtggtcaaggcgctctggtagccggtcgtgcccccgtagtcgtagctgacctcggccgccacgacaatcccgccgtagttgccgacattgctggagttgagagccgggaggcccacacccgcctgggggaccagcaaggtggtgtacgggatgccgtacgcattgagccccgaggtcgccgaactggccgccgacgagtccttggcgatcaccaggatgttggacaagaccgagccgtggctgacgggagtcgccgagggggtcaccgaggggatggcgctcgaactgaggctgagagacatggtggaggacaggccaatcgaggaagacgcagcagcagcagcagaagaagaagaagaagaagaagaagaagaagtagaagccacagaccaaacgtgttttatcgccga

SEQ ID NO: 16441 - DNA, 345 bp, A.fumigatus
ccggctagttacgtatctccccgcacccgcgcccaacgtaccctcgagctcctcgaaatcggctgcaaagagagactcccatggaccgaggccagaaaatcagaagaggaggaacccatacgcacggaagccaaggtggaaatcaccgacgcgatccgggaatgggactatggcgattatgaaggattgacgagtaagcagatcagagagctgcgggagaagaatggccaggggccgtgggatatctggagggacggatgtccaggcggagagtatggtacccactctgtttcaagctgcaagcctgaatgcccgttcgtggtaggacttgcacagcgcagctga

SEQ ID NO: 16442 - DNA, 384 bp, A.fumigatus
ttatccgcttgtatgacacagttacccactaaactaaataatgtgttccctcacccgcagcgaaatcttggattcctaacttacttactttctgtcgctaccaaggttgattccattaagcgtcgcacactgaaatcagtcattgcaaatacaaggggaaaagaaatgacaccccgctgcttcattgtccgtcacggcgagacagaatggtccctaaacgggcggcacaccggctccaccgacttgccgttgacagcaagcggcgagaaacggattaaggcgacgggcaaagcgttggtcggcaatgaccggctgatcgttccaaagaagctggcacatgtgtatgtctatgtattttggaattattctagaatgaagctttga

SEQ ID NO: 16443 - DNA, 192 bp, A.fumigatus
tacgcctccccccatactcgctcagccacctcccagaatgtcttcggcacctcccccaagaaacagtcctatgcggcccccgcctggtggcaggtccggctcgggtatgatgatacctcctgggcgccgtgggtatcctatgcccggaatgtcaaggccaccaagcggacaacccgttccaccttcggctag

SEQ ID NO: 16444 - DNA, 1401 bp, A.fumigatus
agaggattgcaatcgcgacgtccaatggagatagagacatatcttgggtctccaatcaaattggcgacggagtcaggtatccgggttccacgaatcgagacactctatgctgcactccatcacatcaacacaaacaatctgaacagaccctcaaccaatgatacgcctccccccatactcgctcagccacctcccagaatgtcttcggcacctcccccaagaaacagtcctatgcggcccccgcctggtggcaggtccggctcgggtatgatgatacctcctgggcgccgtgggtatcctatgcccggaatgtcaaggccaccaagcggacaacccgttccaccttcggctaggatacctcgcgaaccttctcttgagggactggaggagttcagccatctggtcgtatatgacgagtttgcggagggaggcatgccccgccagaatgggagtaacggcatgcacgacatgccgcccggtcctccgcctgcagctgcagatctggccctgagagaacgggaattggccctccgacagcgagagttgcaactccgtgagcaagagatgcagatgcgacgcggacctcgtagtagggcagcgccgtccagagcagcagcgttcgatgaggatgacgaggatgattatttcgatcccatggacaacatccctataccacacattgacccagacagcgtcgatatgatgagcatcacatcgcgcaggacaagaaaagcccccagcgcgagtcaattccgcaagaatccagaaatcagtgttaatggcaggccccagtcatccttcagtcggtacctcccgggccgaaaacgcaccagcgagcgtattatgcaggaaatccctgggcttcatgattcccttatggacaaccccatgatggcctattcatctaaccggtacggatcggttgatcgaaatcagatacaagctgggtcccgtgcgaattccatgacggctagccgaatgggtgacttcccgccacacccctatccacagagtcgaaaaaacagccagtcccctgctaccccctatgggggacccggtccgcgaatgggacgaccttcaaccgctcaagatcaacctgttggtcctcctggtcctcacggcggtcatccgtcgccgcctggcaacatgcgggcacctgtcccgaaatatcctcctggtcatggcaatgcggtaggtccgcagcaagttgagcaacattatggggtgagcaacccgtatcccgccaagggcactcccaagcatagaagtctgactggaagtgcgagcgccagcgcggagagtggtgatagcggagccagtgcgaatctggactccgaagcttccgcccatagcagccaaatcagcctaggcgctcagcaggctgcaatgccggttcgttaa

SEQ ID NO: 16445 - DNA, 297 bp, A.fumigatus
ccgtcactgttgtacactacctgtaccggcgcatcatctttgcaagcagcttctcatgtcttctacatcattttaccatctttctccacccgctatttcttctacctgcattccctcctttctgaatttccttgcatctgttctgattttttttatagggactttgcaaaaggttcagcagcctttaacactcgcaagttcatggtctggttctggcgcatcaaaaagagcaggggttctgacttattcggtcgatcgatcgacctaatctggctgagttcgcgcctcgcaaggtag

SEQ ID NO: 16446 - DNA, 414 bp, A.fumigatus
  unsure (358),(389): Identity of nucleotide sequences at the above locations are unknown.
attgatcttcgctcgaaacttcaaatttcaacttacaaaactcccagaaacccagatccttccaccatgtctgacgtcgctgaaaccaagtctgaccccgccaccaacgcacctgaggctcagaagcctgaggagacgaccaccgccgccaacactgaagagtccaagcctgcggaagaaaagaccgtgaccgaggctgcggttgacactgtcaaggatactgccaccaagacatccgacagcgttttctccatgttcggtggtggtcccaagaaggagagaaagaagaaggctgaagatgctaaggatgagccttctggttcttctaaggttcacaagggtgaagaagaggtgagtntgctttttctacactggtgtttgtcttgctntgatgcttgttgctggttgtcttga

SEQ ID NO: 16447 - DNA, 264 bp, A.fumigatus
gatgaggcgcccgagtcccctgatgtccatttcgagcccgttattcgcctgacggagaaggtcgaggttaagaccaacgaagagcttgaggagcaggttttcaagatgcgtgccaagctattccgattcgacgctgaaagcaaggaatggaaggagcgtggtaccggtgatgttagacttttgaagcacaaggagaaccataagacccggctagtgatgcgccgagacaagactctcaaggtctgcgctaaccactacggttag

SEQ ID NO: 16448 - DNA, 339 bp, A.fumigatus
gtggattgtcttgcggctaatggttgttcagttgttcccgacatgaagctcaagcccaatgttggcagtgaccgcagctgggtttggagcgtagctgcggacgtcagtgagggtgaacctgaggcccagaccctggccattcgtttcgctaacagcgagagtaagtcctggatgatgataagcttggggtttattcaatgtttgctaatcagacattacagaggccattttttttcaaggaagccttcgagaaggcccagcaggagaacgagaagctcatcggccagcagtaagaagttgcagctccacgcttcctggagattgcggtgtcttttgtaa

SEQ ID NO: 16449 - DNA, 234 bp, A.fumigatus
aggcgaccttggccgtattcaagcactctggtggcggttaacactgcccactgctctctgcctactttccccccagacagcatcgacgagggctttcacattacgcctttactttcctctcacgtttctgtctcctccattcatccttattcgaggtatctaaaagtagagctgacttgcagctcactacagctggtcgacattgaacacttgtatttcagttcaaattactga

SEQ ID NO: 16450 - DNA, 285 bp, A.fumigatus
agctggtggtgttgccttgtgtgtttggtggtgatgctgacgcttgcccttgcttactctaggaacaaggactccggtgttgaaggattccccctgcggtcgtggtcgattgagatctaccttgtcaatgaacacggcgaacaggtgccggcgaacgtcttcgacaaagtgacatacacgttgcatcccagcttcggggaccgtgcggttcagagtacgtcgcttcctttacggccctgctatcaaattcttgtcacgccaagagggcaaagggacgaccaatga

SEQ ID NO: 16451 - DNA, 336 bp, A.fumigatus
atcgagactgacacacagcgcgtcaaacaaacagctttcaagaaccccccattcagaatctcggaggaaggatggggtgaattcgacctgcagattggtctcactgccgccgataaggaacacttcctcacgcacgacctgaatttcgcacagccgcgctacgagtccaaacatgtcattgtgagcactaccccttgtgttctcgcgcgacttatttcaccgagtggcacatgtactcattccttttatctttgcagacgttcaagaaccccaagccagcgctgttggctttactgcgcgagtcgggaccagtacccggtgacgagaacggagtga

SEQ ID NO: 16452 - DNA, 375 bp, A.fumigatus
gtctggtttctctcctcccaaccgaggaggatcctctcgggcgaagacagtacatcaactaatctaacctcctcccgcaccaggtcgacatggacaaattggcagatggcctccaaagacttggagaagacgacctcctccaggtcgtgcagatggtacacgaccacaaagcgccagactcatataccaagaacgatgtcgagcgtacgtcttgccggtcatattttttttcagattgaagttatctttgagaaacaattgctaatcggtattcactggcttgcagaaggcgaattccacgtcgacctttatacccttccggacaacctgatcaagatgctgtgggattttacacaagagaagggggctttgtag

SEQ ID NO: 16453 - DNA, 723 bp, A.fumigatus
atgcacatattcttcgctgaagtagcacgggataaattgtttgtctggaaggtgagagagacttacagggagagacttcctcttgcaatagcaatgccgtgcgaacctgtgtatccagctggaattgatgcttgcttcggagtgaggatcccgcgtggaaaagaagtaacgtgcggacctaggcatccagctggactcgatgctccctacggagtgaggaccccacgtggaacagaagctacgtgcggacctaggcatccagctggattcgatgctccctacggagtgaggaccccgcgtggaagagaagctacgtgcggacctaggcatccagctggattcgatgctccctacggagtgaggaccccgcgtggaacagatgctacgtgcggaccggtgtatccagctggagtcgatgctccctacggagtgaagaccccacgtggaactgaagctacgtgcggaccggggtgtccagctggagtcaatcatccctgggaagatacttgttattgggaggagaggctcataggtgctcgcctccagatggtccgggcccgtttgatatgggtgccacgccattttcggcgcgcctttcgcagccgactttatcggcgtcggtggaccttcagccccaccgttatcgccctgcatttgcaaattctttccacttcattttccgaagagactcccacaaaattttttagaggctcggttaagtaa

SEQ ID NO: 16454 - DNA, 720 bp, A.fumigatus
agtggaaagaatttgcaaatgcagggcgataacggtggggctgaaggtccaccgacgccgataaagtcggctgcgaaaggcgcgccgaaaatggcgtggcacccatatcaaacgggcccggaccatctggaggcgagcacctatgagcctctcctcccaataacaagtatcttcccagggatgattgactccagctggacaccccggtccgcacgtagcttcagttccacgtggggtcttcactccgtagggagcatcgactccagctggatacaccggtccgcacgtagcatctgttccacgcggggtcctcactccgtagggagcatcgaatccagctggatgcctaggtccgcacgtagcttctcttccacgcggggtcctcactccgtagggagcatcgaatccagctggatgcctaggtccgcacgtagcttctgttccacgtggggtcctcactccgtagggagcatcgagtccagctggatgcctaggtccgcacgttacttcttttccacgcgggatcctcactccgaagcaagcatcaattccagctggatacacaggttcgcacggcattgctattgcaagaggaagtctctccctgtaagtctctctcaccttccagacaaacaatttatcccgtgctacttcagcgaagaatatgtgcattcaaatataccattcgacagtgaggattcaatggtgagcgagccctga

SEQ ID NO: 16455 - DNA, 234 bp, A.fumigatus
ggcaatacctttgattcccatatgcattctataggcgtgggggttccgaactttggcactttacataccaaatcgtctggttacgctactttctttccccttttactatgcacgatatacattcaaaacgaacacgacaagcagggttattttatggccccattgatcatcgctgagttatcaaagcatctttcattctcatttcatgtaaagcatcgaaccttagaacaatga

SEQ ID NO: 16456 - DNA, 435 bp, A.fumigatus
aagctcgatcaacctcggaagtactgcacacgcgctaatcaatttattgtcgtacagagagttttttataatgacaaggagaagaaagtcatcagtgtggtatacctcggatcgggtctggagggttggccaacggttgtccatggtggcgttctcgctactgtgcttgacgagaatctgggacgtgctgctatacgccatttcccggcacgcaccggcgtgacggccaatcttgagatcaactaccgcgctccggtatattcaggcaacttctacacatttcactcgcaggtagacccagaaagaagcactgagcgcaaggcgttcgtgactggtgaaatccgcgacccggtcgggcgagtgtgcgcgcaagcctctgcgatttttgtggtcccaaagggattcaagttgcgggagattggagaacgattctaa

SEQ ID NO: 16457 - DNA, 255 bp, A.fumigatus
ctctgcctgtactccacactaattcattttatcatgcaggtccttgcaaatctgctagctctagccggtgtatgccctttcgttggttctttgtcagatctgatcggccgtcgctatgttgccatcatcggcgcgtctctcatctgccttgggatgatcgttaccagcacagctcacacaatgaacatatttatcggtatgtccaagtgtactacctacctggccaagggtacacacgctaacaaagaagattag

SEQ ID NO: 16458 - DNA, 621 bp, A.fumigatus
cgctctgctcatcaggctgcggcgcaatggcagtcgcccgtcaagacaatctctaccagctctggggaatcctcgtcctcgctggcctgggtatcggcggcatcgtcgtccccgcttccatcatcaccacaatcatttgcccggacgtatgttccaactgcctctatctttctacttacgcggaaggctaacaggctcgtccaccaggatctcatcgcgacaatctcagcacttacgctctccattcgcgtcgtcggcggcagcatcggctacacgatctactataacattttcatttccaagttcgttcccaacgcgaaacacttcattggtggcgtgatgggcacgaagctgaacatcaccaatccggcctacatcggcgaagctatcgagctcaccggtgcttcgctgctggaagagttgaagactattccgggaatcgctggaagcgaggctgcgtacaatgccgttgtggctgcgggccagcttgcgtatgctgagagttacaagtgggtttactacgtcagtattgcgtttggtggtatttctattctcgcggcttgtttcctgggcagcatcagtcaatacatggatgaccatgttgcagtggtcatgcattaa

SEQ ID NO: 16459 - DNA, 1137 bp, A.fumigatus
acattcccaccacttatgtttctcaatgctttgagaagcgttttccctcaatttgctcagaaagacaggaatggtcatggctatgctcaacaagacgctgaagaggcttggtcgcaaattgtcactcaactgcgaagcaaactggtgatcaaagagggcgaaggagattccgctaccgaggtgtcgtttgtggataaatttcttgctggtcgattcgaatcggtcaccgaatgtgacgatccggcggccaaggcagctggcgaggaagcgaccaaaagctccgacatcttcttcaagctggattgccacatcggcaaagagacaaaccatctgcatgatggaatactggccggactcgaggagaaaattgaaaagcgatcacctacgttggaccgcgacgctgtctacactaaacgatcccgcattgcccggctacccaagtatctgactgtgcactttgtccgctttttctggaagcgtgagacccaaaagaaggccaagatcatgcgcaaagtgactttccctgccgaattggatgtggtggagttttgtacggaggagctcaagaagcagttgatccccatcagggataaggtacgagatattcggaaagaagaggtcgacattgagcgtgcccgcaagcgccagaagcttgctcatcaacgggaggaggagctgaagagagccgctgagtctgatgcgggtctggaacccctgcaaaagaaagctacggaggggcaaaaagaggctacaaagagcggcgagcaagatggggacacagccatgacagatgtcttcaagtcagacgcagagtacgaggccgagaagtatgcctcaatactcgctgcaaagaaggaattggctgcactgattgaccccaaactcgcctcagatgctggtacaaacaagtcgggcctctacgagttgcgcgcagtcattacgcatcaaggcgccagtgctgacagtggacactacacgtcatatgtgaagaagcagccagatggcaaaggggtggaggacggaaaatggtggtggttcaacgacgagaaggtcaccgaagtggacggagagaagatcgaaacccttgctggtggtggtgagtacatcgcttgtttctgtctattgctagaactttga

SEQ ID NO: 16460 - DNA, 252 bp, A.fumigatus
cttctggagtggtccactgtaacaaatgagatgaaccgatttattttcgctggcgactggctagctccaatctggtcacacatccgtttccctcctccctcccaatcgagtagcctaaactcagtcaaagtcaatatggagcttgtttcgcctcctatcgcccgcgccatgcctacaggtccaatcccccgctctctccacagctcagatgagcccagctggcccagagaacccctcgccggcaattactga

SEQ ID NO: 16461 - DNA, 462 bp, A.fumigatus
caaagaagattagctgggatggccattgccggtgctggtgctggcgtcaacgaactgacggcactggctgcaacctcggaaatggcgccaaccagccaacgaggcaaatacgtcgccatcctaatctttactatcgtgccattttgcccgtccgttttatgggcccagctcatcgcagcacatagcggctggcgctacgtcggagccttctgcggtgcctgggggggattcggcttgctagccaccgtcttcttctactttccaccaccgagagttaactcgcagggactcagcaggaaagaggtgatcaggaggatcgatttcgtcggtggactactgagtatcactggtttaatcttgttcttggcgggcatgcaatggggaggttaccaggtacgcatcgtcttctacatgcagatttcaacacctcccgaccagcagctaaatccagtcatcacatag

SEQ ID NO: 16462 - DNA, 618 bp, A.fumigatus
tacccctggacaaccgcacacgtccttgccccccttatcctcggatttgtgattctcgtcgccttcgcagcctgggaaatctacggagccaagtatcccattttcccgacacgcttgaagcaagagccccgaaccctcggtctcaccttggttatcacattcatctcgggcgcaaacttcttctcggttatcatgttctggcctacgcagtcattcaacgtgtatggccacgaccctgtccaagtcggactccgtagtctacctgtcggcttcggcatcatggccggcgcctgtatcgtcctgtggcttctcagtgtcctccgcggtcacaacaaggagttattgatcatcagcagtgtcctcatgacagcaggtcagttatgttccccaactccccaacatctcctggaaatagttgcatttctaacgctctgctcatcaggctgcggcgcaatggcagtcgcccgtcaagacaatctctaccagctctggggaatcctcgtcctcgctggcctgggtatcggcggcatcgtcgtccccgcttccatcatcaccacaatcatttgcccggacgtatgttccaactgcctctatctttctacttacgcggaaggctaa

SEQ ID NO: 16463 - DNA, 183 bp, A.fumigatus
agccgttcgaatgcttacagggactgttttctaaagtacctatggatagacaaggacagagtatggggtgtctacggcgtttacttagctggggcgtcatttaagggccaaggtgattgtacacaggcgttccgagttctttcgtttcagggtcggcgttcgttgattcagtggtcttcctga

SEQ ID NO: 16464 - DNA, 687 bp, A.fumigatus
cctgtttcaggacgttcttcctcattgtccattttatccagagaagggatcgagtggatcaagcacaagaccggtgaagtcgacttccttcgtttgctagtctcagacacaaagcacgatagtccatgggactattggcggcctgacgtgttccatgatgtatttgcttcgaaggtcttcaaacctcttccgcctcgagcggaggtattctccttgctgggcgattattttcgaaccatcaatcgcttgttcccactttaccatgaagcctatttcatggaaatggtggaatggcagtacacacagcagacgtgcgatgacgctgctcggtgggccagcatcaatatcattctcgccttggcctatgaatatagatactcaaacagtctcaagccagaaaaggacaaggaaagagcatggctctattataagaacgccatatcggttctcactgagctgacgctgcgccgaactgacatgctgagtgtacaagctctccttggcatggcgcttttccttcgcggtaattcaggcactcagtcagcaatgcctttaataacggcagccatcagaacgtgccaccgactgggtctccatcgtgacaccccacggcctcaccttgccccagcagagcaggagcagaggaaaagagtcttctggatcgcctttattctagaccaaaggtaa

SEQ ID NO: 16465 - DNA, 561 bp, A.fumigatus
tgcagtacatgtatacgaactggaaatgcgccaactcaacatcctgacgatttcgacgttgagatccctgctgttgatcccgaaaatgatctcctgctaagcgacgacaagccatttttccagcaactttgtagaatcaccattatcaagagtcgtatatacacggagctctattctgaaaaagccttgcagaataagaccgcagctgaagttatcaagattgtgaagaaacttcacgctgagctcggtgaatggagggcggcgaacacgtttgatgatcaattgaaacagggagcggcaggcgaagattttctgcgaggatttgcgtccgccggcatgcagttcgtctacttcaattcattgatcttgatccatcggatggttctagtcattgcctttatctaccgacaacgtctcgcaaatggaggtcctgcacctgacgatgccaatttgatccttcgagaatcgtcctcctccattgctttttgttcagaggctgctcgagatacattgaggctcgttaataatctcccatggggtgatatagcatggatatggtaa

SEQ ID NO: 16466 - DNA, 948 bp, A.fumigatus
ggcaacgatagcatcaggcacagatttaccttttatttcgatgctcactattctcacaggtcccttctttattacgtgtttctggccgttatgacaattttcattaacattctgcgagactcgcggtaccctaacgtcagggaagatattcaatcgcttaacatggcctcgacattcttcgccacgctgatcccaagtgacgggccctccaactacgccaggttcatgacgcaaatgagcgcaaactttgaacgaatagccagatctgtcgtagagcgagatcaaaaggcaaccaaactcagccagagagcaacttctcgtacatcaatgaccagagcagaaggccacgatctcgcatcagaagaacaacgaagccaacgtagccaaccggcagaagcgccaaaatcatccccttcatcttctcctgtccactcgccctcgatcatcgatattccccatctccctggtcttccccgcatcaactcttccggctacgtggtacccgatagcagcccttcggcgtccgatgacctccaaccttcaaattcttatcctccaattgaaaacgcctgtcaaaacggcgcagcgtcatctgaatcatccgcttctccccaagttttcaataatcccacctatccctttgatgcattcttcccaatgccgatagccaatcacatccctcaaagcgaattctggcaaaccatcccgatagcggactggggacccccgggttcgaatcagttcagtgacgatccctatatgcaaggtttctttcaaggaagggcaccgtccttcgcagcaccaaccaccacagcgacgccgagcaatatgccttcggttccccctgacttgggattttctactgaaaacccgggccaatttgttgacgatcaggggccaagtcagagcatctggccgggcggagggtttggaaacccattctcttaa

SEQ ID NO: 16467 - DNA, 504 bp, A.fumigatus
gaatggggtatcctgattatgtacctggtctcctacggttgctccgagggcgtacactctcctgctgctttccgtattgcctggggtgtccaagccgttcccggtctcatcctggcggttgccctgctcttctttcccgagtcccctcgctggctggctagcaaggagcgatgggaggaaagtctggatacgctggccctgatacatgggcacggcgaccgcaaccaccccgaggtgcaggtcgaatgggaggaagtccaggaacccgtgcggatcgcacgggaggcgaaagatgtttccctcttcgcactgttaggtccacgggtgtggaagcggacgatgtgcggtgttagtgtccaggtgtggcagcagctactcggtgggaatgtggccatgtactatgtggtctatatcttccagatggccaatatggtaaatttatttctgctgctccccgacgtttatttaggggacaggttggctgacatgtttctagcccggtga

SEQ ID NO: 16468 - DNA, 384 bp, A.fumigatus
gcccccgctgcctggatctacgcctccgaagtcttccctctcaaataccgcgcaaagggcgtcggtctctccgcagccggcaactggatcttcaactttgcgctcgcctatttcgtggcgcccgccttcaccaacatcaagtggaagacgtacatcatctttggggttttctgcacggtcatgaccttccatgtgttcttcatgtaccccgagaccgccaggagatccctggaggagattgatatgatgtttgattcgaaagtcaaagcgtggcagtcgcacaaggttcatgataagtttggcgaggagatcgagaagcatcgccagcagagcgtggttgaggctgagaagcctgtggaatctgtgcatgctgaggttgtttaa

SEQ ID NO: 16469 - DNA, 510 bp, A.fumigatus
acccagcacgtcgaaaggaaacatcatgatcccctggtatatgtacccagcgggtggagcctggacatctatggaaaaattgtacgttctgtcgttcttcgagtcagagccaaacctctaacctgtattgccaataggatcagctccaaccccgacgtccagttcaccatcatcatcaatcctgacaacggttccggccctaccgccctgccggacgagaacttcttggccgccgtccccaggctcacagcatacagcaacgcgttggtgattggctacgttcgtactgacaaggggacccgcgatatctcggaggtcaaaaaggaaatcgacacctatgaggggtggccatccgccagcggaaacccctccttcgcagtgcacggcaccttcttggacgaggcaccctcggagtatgatgccgccgcagtcgagtatttccagcaattggcctcgtccatccgtggaagcaatggacttggtccgaacaaccatgtaagcaactgctga

SEQ ID NO: 16470 - DNA, 525 bp, A.fumigatus
cccggtgacaccgtgctctactcgtcggccattcagtatgtcatcttcctcgtcaccactggcgtcattctgccatacatcgaccgtatcggccgtcgactgctgcttctctccgggtcgatcatctgcatggccctgcactatgccattgccggtatcatggccacctacggcaacccggtcgacgagatcgacggcaacaagaacctgcgctgggagatcaagggtgcgccgggaaagggcgtcatcgcctgttcctatatctttgtgggcatatatggcctgacatgggtgagtgcctccattctctgtcccgaatgccgcactaacaaagctcctaggcccccgctgcctggatctacgcctccgaagtcttccctctcaaataccgcgcaaagggcgtcggtctctccgcagccggcaactggatcttcaactttgcgctcgcctatttcgtggcgcccgccttcaccaacatcaagtggaagacgtacatcatctttggggttttctgcacggtcatga

SEQ ID NO: 16471 - DNA, 306 bp, A.fumigatus
gtcgtgatgaatcccggcactgttcctgatgccgcctacctcgggatccccgacactaccgtcatcttcgagtcgccgtacagcgaattcgtacgagcggtttcatccgaccagtttcagggaatcaagggccaggacctcagtcgctttgcgtccatggtctacgatgttcccgacaacgtggacctcgagaacttgctgtctcagctgcgtgccatttccagccagacctatctcagcaatctcaacacctaccaggctttcgattcagtctggaccaaggtggtctctctcctgtctgcgtaa

SEQ ID NO: 16472 - DNA, 288 bp, A.fumigatus
gtgtatggctcctttcctttgctcatggtgctctccgggcttacgggcttagatattgagaagccggatgaatcgcttcgccgggttagtttgccgacgttgcatgtccatgggctcaaggatccgttcttgatgctggggaggcagcagttccaaggctattataacccgaacgcggcgacgctgtatgaggtcgactaccatcatgctatgccgtgggcgagacacgaagccaagcagctggcggatcacattcgaaccatctacaagaacagtgcgaagcaataa

SEQ ID NO: 16473 - DNA, 213 bp, A.fumigatus
ctcgctgatgtcttggaccatgttctggaatgcagcattgttcaccagaatgtcaattcctcccagacaccgaagggcgacgtcgactactttctggcagttctccctttttcggatatctactgccaagcagtgacattcttttccggtttcctgcactcttctctttgtttcctgagcatctatctcttcctctggcaagtatacaattag

SEQ ID NO: 16474 - DNA, 2106 bp, A.fumigatus
acaacagcgcgggccgatgccctctcagacatttctgcaatggaccaaacggtaatgcaagaccaatctgagacgataatccaatgcccagcatccaggtcgactcgtgacggatataatatgcctatcgaatcagcattatcgacaccgtgggtttttcttagcccgacaacctcgctgcatgcgaatacagttgattgtgcaaagtactttctggattcccttgccctgtccgtcagcaatgcacagcttgctcgtcagcgcgttatgcggaagcgcaagcgatcggattatgagcaagagactctgcatcatgtattacagttgaaggaactgtttgtgcaaggttttacttcagatcaaatatgggaacaggccacaagaatactagactctgccaagcaggaaattgagcaagattccgctttgattgcccagcatgtcgaaccagcttttctagacgcaagagcgtcaccatttctgtcgcaggaggcgaactctgaagatatctctaattttagtgatatttcagattcggccgctgatcgttcagaccgcgactctgcttctgatgatgaaagggaagatatgggatccgtaccagaatcaccgagcatggctgagggccgctctgacggagatagtaggactgatgtggaagagtcggacaatgataaccacaatagccgcggcacctacgtacaagacccattcggactgaatgatggctttttctccattgacgaattcaacaagcagtccgagtttctcgagaggcaagatgcaaagggcgaaatagatgacgatttggagagcgacgaagaggagatagactggcacgtcgaccccttagctggtggggtttctgtgccttcccaaaccacacgaccaacagcacagaggtctaaacggtctttcgagaacggaagtgagagcagtagtgacgaggaagggccgactttcgataacgttgccatcgaaaatgacatcgattcagaggatgacgacgcatatgcaattagtgcggataccactaattggatgaataccagtgatatcaagtactcagatttttttgagcctcctccacggagggcgacttcgacgaaaacccgccctcttccgaaaacacaacctcatggggctcctgtggaaactgacatcgatcgcgcgattgctgatgttaggcgcgacttgcttgaggacgatgagtcgctggatggaaacgattcttccgataatgagctagctggttctaaacaacagcattcggctcatgagaaacaacgcgcgcggattgccgacgagatacgtcgcttagaggctgctaatgtggcgaagaaagattggatgcttgctggtgaagctcgaggcgctgaaagacctatgaattccttgattgaagaagacttggatttcgagagggttggaaagccggtaccagttgttacgacggaactttctgggtacattgaggagctggttaagcgtcgaatattggcgaaggagttcgatgaagtaatacgccgtcgtcctggaattccggaagcgcagactgcaaagaaagtgagatttgagctggaagacaccaaacctcaacagagcctggccgagctctttgaatctgatcatctcagggctactgatccgaactatgtcgaccccaagaatcataaacttctacgagaacatactgagatttcaaacctttggagagagattagcgaccgtctggatacgctgtcgaactggcattacagaccaaaggctcctcaagcaaatatcaatgtgatcacggatgtccctaccattatgatggaggatgcgcagcctgcggctagcagcgctgttggtgggtcagcaacccttgctcctcaggaaatttacgctccgggtgataacggcaaggttgctggagaagtaacactgaagagtggagaatctatcgccaaggatgaaatgacgcgcgatgagaagtccaagctaaggaggaggcagaaaaagcagagaaagtctgactctgaccctgcaaaacaacaatcagggacagccgctgaaaaacaacaaattgttctcaaacgtggaagaagggcggtgtcaaggtga

SEQ ID NO: 16475 - DNA, 570 bp, A.fumigatus
ctgcatctggaaaggttcgaaaggaggtgcccttgccgagccaggaaaagaaagagggtgcaatgcaatatgtcctgttcgtgtcccgcatcttttacgtgcatgcatactaaatgcctggtcgtcctgacactgtcgtgtagtaccacacttgaccaagtcgccaattgggcccgccaaagctccttgtggccgatgaccttcggtctcgcctgttgtgctgtcgagatgatgcatctgtcgacacctagatacgaccaagatcgcctgggaattatttttagagcttcacctcgccagtcagatgtgatgattgtggctggtacattgactaacaaaatggcaccagcccttcgacaagtttacgatcagatgcctgatccacgctgggtcatcagcatgggaagttgtgcgaatggcggcggctactatcattacagttactcggttgtacgaggatgtgataggattgttcctgtcgatgtttatgttcctggatgttcgtcgatcttccctcttgactcgcagttgagatttttttggtgtgagagctatgctgacgggatatag

SEQ ID NO: 16476 - DNA, 579 bp, A.fumigatus
gtccccatcttcgaatcaaatttggccatactcatcagtactgcaggtcaccggatcccaatccaacatcagaaaaagcctgggctacaggcggaactcgaggatcccaagcctgcgtcaactcgcataccgaccgacgactatggatatcagacatataaagcagccgggaaactcgctggaaagagagccatcattacgggtggcgactctgggatcggtcgcgccgttgccatattgtttgcaatggaaggggcatctagcctaattgtatacttgccagaggaagagatagatgctcaggaaacaaagagaagagtgcaggaaaccggaaaagaatgtcactgcttggcagtagatatccgaaaaagggagaactgccagaaagtagtcgacgtcgcccttcggtgtctgggaggaattgacattctggtgaacaatgctgcattccagaacatggtccaagacatcagcgagctagatgagtatgctctgatttcccaacagagtcttttgagcccctcttcactaccagcgcccccacaacacacgagaagggagagctctcccattagctga

SEQ ID NO: 16477 - DNA, 519 bp, A.fumigatus
gattatactaatgcggtgttacctagagttgaactaggagctggcgggggccttgtgggcctcgcggttgcacgagggtgcgatgttggtccttgtcccatctacatcacagaccaagagccaatgttacacttgatgaaaacgaacattgagctgaacaatctctcaactgctgtggcggccacagtattaaattggggagagcgtctcccggactgtataccgacacatcctgagatcgtcctcgctgcggactgcgtctatttcgagccggcattcccccttctcatttcaaccttgcaagatctgctgggacccgaatctgtttgctacttctgtttcaagaggcgtaggcgagcagatctccgttttatgaaagcagctaagagggtttttgatatcaaggaggttcgtgacgaccctgaggcggatacatacaggagggagaatatctttctctattcactccggttgagatttagaccagagaacggcagtcttagagcaataaaagaatga

SEQ ID NO: 16478 - DNA, 510 bp, A.fumigatus
gcccctcttcactaccagcgcccccacaacacacgagaagggagagctctcccattagctgatcaagttgaccctctccttagggaccaatggcatcgcacctttgacacaaacatccatccttactattacttgtcgaagtacagcctaccacatatgcgatctggcgccacgatcatcaattgttcatctgttaaccattatattggccgaggtgacctccttgactatacatctacgaagggcgcaattattgcgttcactcgaggattgtccaaccaacaaattgggaaaggaattcgagtcaactgtgtgtgccctggtccaagtatgtatcgataccggataattgcaaaggttgtctcttacataggttctagtctggactcctttgatcccatccaccatggatacttctgcaatggaacaattcagctccgtgcccatggggtcgcccgggccaacctaagggaggttgcaacatgcttagttttccttgccagttcatga

SEQ ID NO: 16479 - DNA, 321 bp, A.fumigatus
tgcggacgaggagccagcgtcgaagggcggaaagccggcagccatagggtcattggacaatggctggaaatcttgatcggaaaagggtggatcactgatgccaatgctaggtctcctacggcgtgcggcagcccagcgtttttcctcctcttccttctccgcgcggagccgttctttctcttcgcgtgcctctttttccttgttacgctttcttcttcttccggtctcagcgctgaagcgctccaatatttctgggacgaccacatctctccaatcgcattcgagaaagtttacctcacatccttgtggaagatggcctaa

SEQ ID NO: 16480 - DNA, 240 bp, A.fumigatus
agctcgctatgtgcacgcaaattaccgctttattgtgaatcccactcgaagttatcatgcgcaggcggcgaatgccgatgttcatctggattgggattcggtcttacaggtcttggtctcggcacaaacccaatccacaagctgtcctatctgtttatctacgcccgtagctcctcggatggctcggtgtggtcacatattctgcctaccgtgtctgattcgctatatgcactctactga

SEQ ID NO: 16481 - DNA, 1980 bp, A.fumigatus
cgagtacagcgaaactgtatgtgcttcaaaaccaatcattctttctttaagatctttggtcagaaaactaagattcgatattctggtgctcaggccgtcatgagatcgacaacgagtcgtaaaggacaaacgtccatcacgcatttgatgaacttttccctacctccacgtccgcaataccagccgccaccacgcaatagccgtcgatatgcttcgtgggggttaggctcgggttatcatgctatggataaagctcgctatgtgcacgcaaattaccgctttattgtgaatcccactcgaagttatcatgcgcaggcggcgaatgccgatgttcatctggattgggattcggtcttacaggtcttggtctcggcacaaacccaatccacaagctgtcctatctgtttatctacgcccgtagctcctcggatggctcggtgtggtcacatattctgcctaccgtgtctgattcgctatatgcactctactgacgatgacgctcccgttcctgagaagaaggctcgctggaagaagtgcccactttgttgggattcaatttatatttcagagactcgacctgtacgatggtttcgtgggcaggaaggagatatccctgtcgaaggcggtgatgtggtactgcgactggtgaagcgagatccaggcagcacccttgctctacctcgcgatggcgcagagagtctcaaccctggcgaggatgttccgtggtaccacgcagcggaggtagctgactacgcccgaatcatgaaaggtggcgaagattacatgatcgctcaatatgacgcagaagtggaagatcttcgaaggcaggaagctgaggatgagcttttatttggtgatgataatacgtggaccaaaaaggctattgccgccatcaatgatgccaaaacgaaaataaaagggattggaaatccgcccaatgttcagcgacaacctgctacggacaagtcgctcaaggatgccgtctcagcgcagtcatcgcagtcatcgcctaatgctacacaaacggaggagatattggcagctgagtccgtctcttcgtcaggcgtgggtgctggcgctgccactattccggtcacgaacggcgaagtagaacgcgtggcagaggctgtggccaatgttcatttaaagtcgactccggaagcgaagttgaaacagaaagatgccgggcatagccgaagccctcataaaggcgatcgcactcgggaaggcaatggacctcacccgcccgaccatcccttctacttctatcaggctcttcctcaattctacctgtctcccttggatattcgcatactgaaggctgcttttggagattacgctacatttccagcgacgattcttcctcgcgtggagcgtatctcaagtggacatatcgtcgacgatgagctccgaaaacgtgtcaagtatttaggccatcttccacaaggatgtgaggtaaactttctcgaatgcgattggagagatgtggtcgtcccagaaatattggagcgcttcagcgctgagaccggaagaagaagaaagcgtaacaaggaaaaagaggcacgcgaagagaaagaacggctccgcgcggagaaggaagaggaggaaaaacgctgggctgccgcacgccgtaggagacctagcattggcatcagtgatccacccttttccgatcaagatttccagccattgtccaatgaccctatggctgccggctttccgcccttcgacgctggctcctcgtccgcatcaccacctcggccgtcctcgcagtttggcgccctagcttcaccgtcgactactcctcccggagttcgtactgtttggggaactaccgtcgcaccattcatcgcagagtcgtcagaagtttccccaaggcccgctcgccacgacggctggcgcgaggactgggaagaagaattactagctcaccaggaaaggcagttgttggcccagacgagtctggaaggaaaccaataa

SEQ ID NO: 16482 - DNA, 585 bp, A.fumigatus
tcgctcgctgagtctgtttttcctcctttacacaatacatattggcgcgagtcatcagtgcgactaatattttttcggagtaggaagttggaacgccctggttacgttgaaacccctggccgacgagtcactcgcagccgcgtcgtggtagcatcagagaccagtgcagacgacgtgtccgattcagcgaccgaaatccgcgggagatccaagtctactacacggagacgtcaagtgaagaccgaggaagcgtcagaaggcgaagagaagggacgcgccaatggacacatcaatggaaacaccaatggacacaccaatggacacaccaatggacacaccaatggttcgacaaagaagccacgagtcattgacggctgggttgagggcagtgatcctaagattgactatagcggagaattcgagtttggagggtcctggggagtgctgtccatgatgatcgggttccctctgttgatgtactacatgtggattggtgccgtctattatgatggcaaatttccccgtcccttcggaaggccagagcatgtcggaatttctcgcgcacatgggccatttagtctgtga

SEQ ID NO: 16483 - DNA, 480 bp, A.fumigatus
  unsure (308): Identity of nucleotide sequences at the above locations are unknown.
tgtactacatgtggattggtgccgtctattatgatggcaaatttccccgtcccttcggaaggccagagcatgtcggaatttctcgcgcacatgggccatttagtctgtgaaggcgcttacccttcgctcagagcttggatcatttactgggtattcttcatcttcgaaggcctatgctacgttcttctccctggtgtgactgtcatgggcccgtgctctgcccccctcccgggggaaacaactgccctactactgttccggtgtctggtctttctaccccaacattgctcttgctgggggtcctcctntttaccgggattttccggcggtacaccatcctccaatgaattccgggccccttctgaacgttggcatcctctctgggcttcccgggtggtccctccgtcccatactcctccgcgtttggctccttgggtgccccaccttcccctgaacggggttaccaatcctaagaattcc

SEQ ID NO: 16484 - DNA, 219 bp, A.fumigatus
ccccaacggggcttcattcctggactcatcgtcatcggagtgaacaccggccaagcaagtaaatccggggtgtttgcccgacatggcatccatacttgtggctctactgctaaaaaagaacataatcacacgactcattcgtcaactgtcagaaaggataataagtacagtggtatgatgtatcaaacagttataacctgcatgggttactgtaaataa

SEQ ID NO: 16485 - DNA, 339 bp, A.fumigatus
ttgaaatctctgaaaattagtatggagaatttcatcactggttacccaggtcatgagtcgcaacatcgtgctgctatgcggagagtcttagggccagagaagtacgaattctttttcgacagatggctcgagtatttcttcactgaggcggacgccaagttctttgctgggctgggactgaattgcatacggatcccgttcaattatcgccactttgaggatgatatgaacccacgggtactgaaggaatctggtttcaaacatttggatcgggtgatagaattggtaagagtcctccagcgcgacgaccgcatgatgctgatgtgttattccccatga

SEQ ID NO: 16486 - DNA, 660 bp, A.fumigatus
tgcgcaaaagagaagatatacaccattctggatatgcacaccgctcctggtggacagaacggggactggcattctgataacccgaccagctacgctgctttctgggatttcaaggatcatcaagaccggacagtatggctgtgggagcagattgcagcacgatacaaggacaatccatgggttgctggatataaccctctgaatgagccgtgcgatccggagcacgtccgtcttccggctttctatgagcgcgttgagaaagccatccgagctattgacccagatcatatcctgtggctggatggaaacacgttcgccatggagtggaaaggcttcgataaggttcttccgaactgcgtttatgctatgcatgactattctgtaggccatttcccatccgagcaaagagtacacatgctaatttttcccccatcagtcaatgggttttcctaccggagagcgatacaagggaaccccagagcaaaaggaacacctagaacggcagtaccttcgcaaagccgaattcatgaacaaaaacgggacagtaatctggaacggcgagtttggccccgtctacgccaatccccgtacggaagcagaggcagaaaccatcaaccaagaacgttacagccttctgggagagcagcttcgtatctatga

SEQ ID NO: 16487 - DNA, 1497 bp, A.fumigatus
  unsure (1301): Identity of nucleotide sequences at the above locations are unknown.
gagaagttctccaagatgtctgaagcatcgagtgcttcttacccatcgtccttggacgttctgtttgatgggacgtcgccgttgagggaacagtatgacccggtcaaactagcacatgcggagattgtccccatcctccaacttccactggctagggaattgttgggacacaaccctacagatgcgagtgctatcagccgtgtctccaacggcgagatatgctataccacttttctggctgagaaggcgaaggctacggctcagatgccactggatgggcttactgctgggcagcaacggtcacagatcctccatattggtctggcggctctgtttagctttatgcagtccaatattacaggtcctccgttggattttaattctgcggatgtgatattccctaaggctctccactcagatgccaccaagctccgggctgctcgcaatcacatcattcgtgaactgtctgtagacggagaagctgcctacaagctgacaccaaatgttgagctctttgccgttgcgatggctcttcttgttgatgctgacatcctcgtcgctgacggaccattggtggcgaggacagcaagactgcgtgtcaatttccttcatcagaagatgctgtctgaagctactagcacattgcaggatgccatatatagcgacttggaagagttgaacagaattctacttggtgaaaagtctgtgttctctaccgctcaagaaaaaggacgcttccttgtggagagggcgacaatccacagccaccatggctttgacgccaaggctcgggcagatcttgagcaggctgctgcagtcaggaaatttgaatttgcattgactggaagactggggaaaaggacgaagtttcaagagcatgatatcagccagctggtcgtcttggcgaagagtgctgaagaactgacgaccactggaaactctgctctcccagaagacaagggggatactttccaagcgggacctaagaacctagaccttaacgatgatacacttctcgaaagcatatccttcaccaaggacactcagacatcaaaagacaagtcgacgacagtccaggaagaatccacacttcccccagctttacagtctcttgaccccggcaaccaaccactgctggaccctgttgactctgccattttgctgggcttggcttccacaatcacgaacacgtcgccggacaacggtctgactcgagaagagacccatccttacgctatccgtgtccttgaagggggcagctcgaactggcaggtatacactcaagctttgttggtccgaanccgtgtggaaggataccgagctcgaactgtagaaagatctgttctgcagatgcaagcgcttgttgaccaagtcattgcagacacagcaactcttgatactcaaactacggaaaatggtaaccaggctaccacgttcctcccaagacccgaaaaatccgagtctgcttcggctgcggaaagactagagtacatctgg

SEQ ID NO: 16488 - DNA, 1305 bp, A.fumigatus
cttccgattgtaccgcttggcgcggttccttcggcccctgtggtgaagattgtcttttgcgagaacagccgaattctagcgaccggtgacctttccggctgtatcgatacctggctcctgaaagatgtcaaggactcgtctgcagtagcttccaacaagcgcaacggcgctgcagattctgacgatgaatcttcggacgacgaggatgaacgaccggtgatagacggagagcgctggcagtacgccaatgctgactcacccatacccagactcaaatctggcgtgcttttgctctctttccgcccccaaagcccggcagaagcaaagcttctcacaaacggtgctgatcagtcttcccagatatctctgaggggcgagagtcgattgatggctcttacgagcgaacaccagcttgtggaattcgacactcttgaaggaaagctatcggactggtcaaggaggaaccccaaggcttatcttccggagcaattcaaaggggtcaaggaccgcgcaatggggtgcttgtgggacctttccgagtcgcgtgaccgcctgtggttgtacgggacatcttggttgtggatgtttgacctgaatcaggattttccctcctcggaagagatgaaggaagccgcagatggccacgaaggagactcttcgacacagctcgttaagacatcttcggctcacaagagaaaacgtgaacaaatggaggaagaagagaaaagaggaaaagcgaacagtggtgctggtgatcggatgtcattggctcaatcggatgttcacttaggctccaaatatcgcaagatcgaaggacacgatgactccaagggagagtgggtctctctagacaaggaacgcccacaagcagcaggagatgaagaggccttcgaatatgacgaaaattctgcagcagttcatgacacagccctggcgcgacttagaagaggaaagcttgaggaagacggaattagcactccgcgaaagcgagtctctcttggacctcgtgataatcttctctcgctcaatggatccaatgatacaccatctcggaagccaaatgaccatgacatgcctgacacgcctcagacacgattggtgcagccgaatggaactcaaccggcacgtcggtggtggtacacgtacaagtaccgtgatctactcggcattgtgcctctgagcccgccatcggtcgaggatggcgtcgaagatgatactgcgggcaataccctggaggttgccattgtcgagagacctatgtgggacgttgagttaccaggtcgctacgtcagagattacgcatag

SEQ ID NO: 16489 - DNA, 213 bp, A.fumigatus
acatcatactctgcacatcctttcatctggagctttgtatattttttctcatcttcctgccctttccaacttttgtactcacttggcgagctggataggtctatttataaatggataaaagtttattcttggaatgaacctttgccctctgcctataccagtgtctatgaggctgcaggcagtgacattagctcttttagcattagacactga

SEQ ID NO: 16490 - DNA, 222 bp, A.fumigatus
ataatattatcatatcaatcaatcaatctttcaatctttatcgatcagtcactagacggtgatattatccacaactcccccgactccgaaacctcccaatccctcccccccccctctcttcttctcatggtcaagtctcggttacagaatcttttgtcgtctccctcgcgactcacaagatggcaaaagacgtatttgctgttccaagtatgggttttttga

SEQ ID NO: 16491 - DNA, 486 bp, A.fumigatus
gtgtggtggggggttgccattgggttgttcatcagtgtttgcatcggagctggcatgatcggagcgttctatggatatggtaaggatcacttcgctagcacggaggacctgtgggagggcatcttctccctgatcgccagtgtcatcatcaccattatgggtgctgccctgcttcgtgtcaccaagttgcaggagaagtggcgcgtcaagctagctcaagccctggaagcaaagccgttgactggcggcacattcaaaaacaacctcaaactttgggcggagaaatacgccatgtttctcctccccttcatcaccgttctccgagaaggcctggaagcagtggtgttcattggaggcgtcagtctcagttttcctgcaactgccttccctctacctgtttttactggcattctcgcaggagtggccattgggtacctactgtatcggtatgttgaaacccctgaatcagctgtctttctcaaatag

SEQ ID NO: 16492 - DNA, 537 bp, A.fumigatus
accaccatgctgatggtctgcagaggaggaaaccaagcctccctccagatcttcctgatcatctccacttgcatcctctacctggttgctgccggcctcttctcccgaggcgtctggtatctggagaacaatacttggaaccacgtaattggtggtgatgctgccgagacaggtgccggtccgggatcgtatgacatccgacagagcgtctggcatgtcaactgctgtagtcctctcgttaatggtggcgggggatggggtatcttcaacgccatccttggctggacaaactcggcaacctatggctccgttctttcatacaacctttactggattgcggtgatcgtctggtttgtggctatgcgtcacaaggaacgccatggacgattgcctgtggtcgaccctctgctgaatcggctgcgaggccgaaagtctgccgaacctgggaatggagagcaagatgtcgaggtcagcacgataccatctgatttgcagacggagtccaaaataccgaaaagcggagcatcccttgtctga

SEQ ID NO: 16493 - DNA, 189 bp, A.fumigatus
gtgctattcaggatcttggggacacgcagcctgcagtctgcactctatgtctcccccctctacattccgatcctatttgtctccgcgttgacgcgcctgcaagagatcggttactgctcttcttttattactcttcagttctttcttttaccttgcaatttgacacctctctatgcaatatgtccatag

SEQ ID NO: 16494 - DNA, 258 bp, A.fumigatus
ctggcggcacattcaaaaacaacctcaaactttgggcggagaaatacgccatgtttctcctccccttcatcaccgttctccgagaaggcctggaagcagtggtgttcattggaggcgtcagtctcagttttcctgcaactgccttccctctacctgtttttactggcattctcgcaggagtggccattgggtacctactgtatcggtatgttgaaacccctgaatcagctgtctttctcaaatagaccaccatgctga

SEQ ID NO: 16495 - DNA, 306 bp, A.fumigatus
ctaacctttcttcacctgccgtcagtcttttttatctgtttccgagaatgtgtcgagaccagcatcattgtctctgtgttactctcatttatcaagcagaccttgggacaagagcaagatgctaccactcgtaagaggctgatcagacaggtaggccgattttattcgttggccctctcattctccgaactccaggctgattcggtggattctgttcttctaggtgtggtggggggttgccattgggttgttcatcagtgtttgcatcggagctggcatgatcggagcgttctatggatatggtaa

SEQ ID NO: 16496 - DNA, 606 bp, A.fumigatus
tttctttcctcttctcaatttctaactacattcctagtattgaaaatgcctccgcacgaaagattggttcatctgaaagagtacgacatccaagacagcaatgtggaactgatcggttcagacattgaccaccgcgtcaaatacaagtcagccgcatccgaaccagcctggaacaacgaactggtaggccgagaatgcggctcttcatctggcgcattgagaacttcgaggtcatcccctggcccaaggaacgaacgggtgagttttacgacggcgacagctatatcgtcatgcactcctacaaggccgaggagaagctgtgccacgatatcttcttctggctggggagcaagaccacgcaggacgaggcgggcacggccgcgtacaagaccgtcgagctcgatgagttcctgcgcggaactgcgacacagcatcgcgaggtgcaggcgcacccctcgccggagttcgtggcgcttttccgccggctctgtgttcggtctgggggcgtgcgatcgggcttcaaccacgtcgagacagaggagacgtcgtccacggaggccatcaccctgcttcggatcttcatgcaccctggtgctgcgcgagtag

SEQ ID NO: 16497 - DNA, 264 bp, A.fumigatus
tggacctgtagagcacctttcagccccgtggtgaagacctatatctactccctctacatctcctctctgcctcactgccactttacaactattcaattgatccctttcggctcgtcccccattctggtcagcgctagcgtgattgaaacgaccttcctctcgtccgcccaccatggccgctcttcgttcgacctcgcgcctcgtcgcatccacacggcctctgttccgtcctgccgtctttgctcgctcgtatgccactgttga

SEQ ID NO: 16498 - DNA, 264 bp, A.fumigatus
cggagtcaacactttggcttgcttgtgtatgtttggcccatttggaacggattcaggacatcgaccgtggttgctaacaccccgttaggccgtattcccaccgacaccaagcaggagtcgcgtatctacccgttgcctcacacctatgtcgtcaaggacttggtcccggatctgacctacttctacaagcaatacaagtccatcaagccttacctgcagcgtgacaccaagaccgaggatgtgagtacttctcggattctgtga

SEQ ID NO: 16499 - DNA, 324 bp, A.fumigatus
ggtcttgagaaccgccaaagccccgaggaccgcaagaagctcgacggtctttacgaatgcatcttgtgcgcctgctgctcgacctcttgcccttcgtactggtggaacagcgaggagtacctgggtcctgccatcctgcttcagtcttaccgttggctggccgattctcgtgacgagaagaccgccgagcgtaagcacgctctcgataacagcatgagcgtctaccgttgccacaccatcctcaactgctcgcggacttgccccaagggcctgaaccccgctcgggctattgctgagatcaagaagatgcttgctacccattag

SEQ ID NO: 16500 - DNA, 516 bp, A.fumigatus
ttgaaacgaccttcctctcgtccgcccaccatggccgctcttcgttcgacctcgcgcctcgtcgcatccacacggcctctgttccgtcctgccgtctttgctcgctcgtatgccactgttgatcccgctactggtgtcggtcgcactggcagtgcggaggccaaggttacccccgagaccaggacttccaatgttcaagatcccagcccgtcccaggctccgagaatcaagaagttccatgtctatcgctggaaccccgacaagcccaccgagaagcccaagatgcagacctacagcctggatctgaacaagaccggccctatgatgctggatgcgctcatcagaatcaagaacgagatcgaccccaccttgaccttccggagaagttgcagagagggtatctgcggtagctgcgccatgaacattgacggagtcaacactttggcttgcttgtgtatgtttggcccatttggaacggattcaggacatcgaccgtggttgctaacaccccgttag

SEQ ID NO: 16501 - DNA, 264 bp, A.fumigatus
tatctgagttgcctggggtgcaatatcttcaagccatctacacctatatatactagccaggctaacaaagggtcccttacgtgtctgtactggattaaaaactctcagccccataaggatttgatttactgcatgatgactgtccttgaagctgatctcaatgactatgggcatagtcatagatatacatcatgcatcaacctttcatgtcttgtctggtatatgtacagtgcagcacagtcttattcccctttattaatttaa

SEQ ID NO: 16502 - DNA, 207 bp, A.fumigatus
tggagatctccactatcactgcagatcatcctctccctcgctcactcctcggccctaacccaaccacccgtccacatagtttctttcctcttctcaatttctaactacattcctagtattgaaaatgcctccgcacgaaagattggttcatctgaaagagtacgacatccaagacagcaatgtggaactgatcggttcagacattga

SEQ ID NO: 16503 - DNA, 1116 bp, A.fumigatus
ccaccgcgtcaaatacaagtcagccgcatccgaaccagcctggaacaacgaactggtaggccgagaatgcggctcttcatctggcgcattgagaacttcgaggtcatcccctggcccaaggaacgaacgggtgagttttacgacggcgacagctatatcgtcatgcactcctacaaggccgaggagaagctgtgccacgatatcttcttctggctggggagcaagaccacgcaggacgaggcgggcacggccgcgtacaagaccgtcgagctcgatgagttcctgcgcggaactgcgacacagcatcgcgaggtgcaggcgcacccctcgccggagttcgtggcgcttttccgccggctctgtgttcggtctgggggcgtgcgatcgggcttcaaccacgtcgagacagaggagacgtcgtccacggaggccatcaccctgcttcggatcttcatgcaccctggtgctgcgcgagtagattcagtcatcgtgcacgaggtggagccgacctgggggagtctcgacgaccatgacgtgtttgtcttggatcagggccagaaaatctgggtctggcagggcaagagctgcagcccgatggagaaggcaaaagccgctcaggtggtcaatgatatgactcttgctaaacatctcgacgtcgaggttctgtcccagctggagtcgcgatccagaatcatcgtggacctcctcggcggcaaggatatccagcagtcgtctttcaaggcaccgcggcctgtttcgttccctgcaggaggcgatcgggatagcgatgagtctcaatcactcaagttattccgcctcagtgacgctacaggggcgatttcgttcgacctcgtcaaagacgggcagcggatctccccgtcagatttggatgagaatgatgtctttgtctgcgacactggtagcagactatgggtctggcagggctcgcgggcgagtaaactggagaaggcgctgtggctcaacgttgcccaatcctatgcccgacagatccaagaggctcggactaacctagctgctcatctgactccgatctcaaatgtggtgcaaggtcatgaaagtccggcattttggaaagctatccgagtccgagattag

SEQ ID NO: 16504 - DNA, 201 bp, A.fumigatus
agcagtgatctaaatgagccatcaccggcgcaagtcattcaagacattatgacccctcctgcttcgaggggttccggtttcccccagaacccgctgtctcatcatggactgatcctgatgacttcggatggagatgagtacgagcgtaccaaggtgatttgcgctccatcgagttggggccagaagcttagcagaaagtga

SEQ ID NO: 16505 - DNA, 387 bp, A.fumigatus
agccacgggctagaaaccgacaatgaaccacagggaaaaggctatccggacctcagcacgcgagcctttgttcgaagactgcttgatgagactagacatctccccgcagaggagtccccgcgcttttacgctctcgtcgacagtgatcctgatggcatggcaatcatgtcaacatataaatatggctcgatggcgcatgcgcacgacaacgagaagctcaacgtttctaagctttgctggctgggactccgaacatctgatgtcattggaggtgcagactcattcggggatgaggctttcattcgcctgagcctgagagacagaaagaaggctgttgcgatgctgtcgaacaatcgtcttaccacggggctcgaaggatccgcgcta

SEQ ID NO: 16506 - DNA, 249 bp, A.fumigatus
cccgtggctctagcattgggaacttactgttaccaatacaccttttcctgcggctgctctagtgtgatagctgcttctcgagagtcgacggtagactgcctgagaatgagatgttaccgcactgtacgcagcggatggtacgtgggtgatatatcctctcctacttctttttccaagatcaagacccatttcacctcggaggcatcaattgcttcaatgtcttccgttttcggtatcaggacgtcctag

SEQ ID NO: 16507 - DNA, 564 bp, A.fumigatus
cacctctcgcccctgccgccacgaaccgcatgtttgccattcacgtacctgactattatacaacaggaacttccagagctgccgaaagcaaaaactccactgcaatgtgccgagaatggcctagagtttttctccaaattgcaacttcctccaggcaattgggcctgtgagtatggaggcccaatgttcttgctcccaggccttattatcacgtactacgtgaccaacactccgattccgccggagtatgcgactgagattaaaaggtatctctttgctcgtcagcacccggaggacggcggctggggcttgcacattgaggcacatagctctgtctttggaacttgcatgaactacgtcgcgctgcgcttgatcggtgtcagcgaagacgaccctcgtatgatcaaagcccgtgggctcttacataagtttggcggtgccatatatggccctcactgggcgaaattctggctcagtgtcctcggtgtcatggaatgggagtgtgtcaaccccgttccgcctgagctttggtacgttccattacatctgcacattctcttgtaa

SEQ ID NO: 16508 - DNA, 1461 bp, A.fumigatus
caacggtctaggctgcttccggattgggttccctttacaccttggcggtggtggatccatatacgtcaagtgttcttgcccatgtcgtacctatggtccaagaagttcacccatccgctggatccgctcacgaaacagttgcgtcaggagctgtacactcagccttacgactctatcagctttgcaaaccaccggaactcgattcatgcagccgataattactatcccaagacttggcttttgaacctgatcaaccaacttctcgtctctgtgtggaacccctatttccgaattcctgcgttggtaaaacgcgcagaggaatggacctgggagttgattagaatggaagacgagaatacggactatgcaggcttgggccctgtgagcaacccgatgaacatggtagcttgttatctccatgatgggccagacagctattcagttcgtcgccatcgtgagcgtctgaatgattacatgtggatgaagaatgaaggcatgttgatgaatggaaccaacggggttcaagtgtgggataccgctttcataacgcaagcaattgtcgttgccgggttcgcagatgaccccaagtggcgaccaatgctcaccaaagcattggagttccttgaagaccatcaacttcgggagaacgtcccagatcaagaaaagtgttaccgccaacaccgaaaaggcgcgtggccgttcagtaacaagacacaaggctatacagttagtgattgcacagcggagggcttgcgatccacaatccaactacaggagatgcacaactatccaaggctgatctccgtggaacgactaaaagacagtgttgactgcttacttctgatgcaaaatccctctggcgggttcaccgagtacgaaaccactcgtggctccgagaagctggagtggctcaatgctgcggaagtgtttggcggaatcatgatcggttatgattatcccgaatgtaccactgcttctgtcaccgcgctttcgcttttcagcagattttaccctgactaccgggccgacgagatcaaggctgcgaaagacaaagccgtgaaatatatcaaacgcgtgcagagaccggatgggagctggtacggatcttggggaatctgcttcacctatgcggccatgtttgccctggaaagcctggccagtgtcggggaaacctacgagaccagcgagtatgcgcggcgtggctgcgagttcctcctctccaagcaaaaggaggatggaggatggggtgaatcctatctcagcagtgaaaagcatgtgtacgttcaacatgaaaagtcccaagtagtgcaaactgcttgggcttgtcttgcactaatggaggcggaatatccacacaaggagccactgcagaaagccatgaagctgctcatgtcacggcagcaaccaaacggggagtggttgcaagaatccattgagggcgttttcaaccaatcttggtaa

SEQ ID NO: 16509 - DNA, 822 bp, A.fumigatus
ctttcagggttgtctccggaaccgccaccctcgctctgtcaactgactgtggctgccatgatgaacggatgtcgcacccatggtgagggagatcaagtgactcctgactcaaatgcgcaaacggactcgaatttgtcgaagggagaaggtgaaatggggttcagtcatgttagcgaagtcttcgacatcttgccggctaccgctctcgagctattgtgtgtcaatgtcgaatttctggccagacccagtgttggcaaagtggtcgagcctgttctggctgcgggctccacgccggccaccatggctcgtagcgacagcttatctagcggagaagccacgcctaccaggatcatcgaactacactgctctccaatcagtcatgaagagggtgctcgggatggcattcagcagctcatgttgtccaagaggttcctctcgaagagagaaccacctatcagcctacgggactacttgctgagactccatcggtattgcccgatgtctacagctgtgtaccttgctacaagtatctacatcacaagattagccacagtggacagagttatatctgtgaatggcaagaatatgcaccgtctggtgctggctggccttcgagtggccatgaaagcgctcgaagacctcagctatccccacagccgtgttgccaaggttgggggagtgagcgagcgggagctctccaggctggaaatcagcttttgttttctgacggacttcgagctacgggttgatgctcagatgttggctgaccaagcacaatctcgtcgaagcagcatggatctggttctctcagagatggcttag

SEQ ID NO: 16510 - DNA, 1296 bp, A.fumigatus
attcgcggatccttccggccccgtggtgaaaaccacagtcaggccacgctggacgggatcatgggggtcaatgctgctgagtctagtgacccattgcatcaggaaccacacaggctgtctttattctctctcccgactggtcaagtctttttgaaattagaattgaaccacgcgctttccgatggtgtctcgacggcactcatctttcgagacctttccctggcgtacagcaaggctctcccgtcaagtcccgcgccaagtttcggaggttttattagacgcctgaatctcggagaagcagaagcctcgtcaacagcgctcaagtactggacagatcgcttgaccggtatggtgccgtgtttgtttcctgtactgcgcgaggccgcgtggacaggtccgtccaccgtgcaacacgttgagattcctatccatgggagccaaggggcattgcgtagattctgtactcagcacgggacgaccattgccaatgtttttcaaactgcgtgggcgctggtactaagcatttataccgggaccaacgacgtttcgttttgctaccttgtttcgggtcgagatgcctcggtggacaatgttgatgagattgtcggccctctaattagtatcatggttcatcgtctgacacttagccgatctctggcactcctccaagtcctacgacaggttcaatcggactttacggtggcactgggccaccagcattgctccctggcacagatcgcacactctttgaatctgcgtggacagccgatgtccaatacggtcgtgaatgttcagcgccgcttcagccaaggtggaccagacggcgtagccgatgtctacatccgtgggatagattgctgtaatccgacggagttcgcaatagccgtcgatgttgaggattgggagacttatatgaccgcacgtctcagctactgggagtcatgtatatcccagacccaagcggaagggatagctgagacactcgccgaggtaattcgaaacatccagaccaatccactgcagacagttggtgaagtggcccttgttggagatgcggtactcgccaagttatcgacctggaatgcagtcctccctgaggccaacgaagcttgtctgccggagcttgtagaacgacaggtgatttctcaaccatctgctgtcgccatcgatacggacgcagaacagatcacgtatatcagcttatggaacctttcgggcctgcttgcaggacgactgatcgactctggagtccaaccaagggacctcgtggcggtgtgcgttccccagtcgagttag

SEQ ID NO: 16511 - DNA, 216 bp, A.fumigatus
gctgtgattgcaatgctggcaattcagagggcgggaggagcctgtgtcccccttgacccaaaagcgcctgctcagcggtggtgggaaataatatcccggaccggtatatctactgtggtcacaagcgaaacgaagaaacacatcatgtccagtcagttaccaggcttgcaggtcgtctctgctgatggcactgaaatcgatcaacatcacctttaa

SEQ ID NO: 16512 - DNA, 597 bp, A.fumigatus
ggatctggccgggttcttcccgtcctctctgtggatagcaccgcctacgtgctgtttacgtccgggtcgacgggatccccgaaaggaattgacgtccctcatcgggctatctgtacgagcctgtgcgcccactgtccagttctaggcatcaccaatgagacgagatccctgcaatttgctgcgtataccttcgatgcttcgattgaagagaccttcggcgtacttgttcacggtggctgtgtgtgcataccttcagaggacaccaagatgaacggtaggctatcagctgggccttcttcacaccatcgttggtccggcttatcgaccctgatctcgtaccgtctcttcaaacgattgtcctgggaggtgaagccgttgggaacgacatcttcaatacgtggagtcacagagtggacctcatcaatggttatggccccgcagaagcatccatctgttgcgccgccgcccatctatctctacggcagacgcagtcaccatccacaattggccgtgcggtgggatgtcggatctgggtcgtcgacccccagaatatcaaccggttattgcccccagactgcgttggagagctccttatag

SEQ ID NO: 16513 - DNA, 3684 bp, A.fumigatus
  unsure (1165): Identity of nucleotide sequences at the above locations are unknown.
gctatcagctgggccttcttcacaccatcgttggtccggcttatcgaccctgatctcgtaccgtctcttcaaacgattgtcctgggaggtgaagccgttgggaacgacatcttcaatacgtggagtcacagagtggacctcatcaatggttatggccccgcagaagcatccatctgttgcgccgccgcccatctatctctacggcagacgcagtcaccatccacaattggccgtgcggtgggatgtcggatctgggtcgtcgacccccagaatatcaaccggttattgcccccagactgcgttggagagctccttatagagggacacatcgtggcaaatggctactggggtgatgaagaaaggactgccagctctttcttgtcccctcccgaattcttgcagtccctttccctcgaatatccggcggacaactttcgccggtgtttttaccgcacgggagatcttgtccgtcagcgccatgacggatcgctcatctacgtcggccgcagcgattggcagaccaaagtgaacggacagcgagtggaaattggcgaggttgaagcgcagctttccttccatatggcgaaaaatcactcaaaccacctttcgatggtttgtgttcccaagtccggcccgtggatgaagcgtctggttgccattttatccctggaccccgaggagtgcactgttggcaatcgcagtaacgtcgttttctgcttagataaaccggagactgcggccatgattcgcacaatctcaaaaggaattgagtcctccttgccacctttcatgattcccactgtctggatccccgtcaaacagctaccaactttggcgtccggcaagataaatcgaagatgtgtgcaggaatgggtggaaacatccaatgagggtatcttcctttccgtttcccgcattaatagcgaggcattcgggaccagctcgacagagactacaagagggctcacgcccacagagaccgtgatccgcgccatctggagtcgagtgctgaatattccactacactcgatcgggctcgacaacactttcttttccttcgggggcgattcattttcggccatgcaggtggtgtatcaggcccaccgtgagggcttgacgatcagcgtccaagacatatttcattgcaaaaccgtggctaagttgngacgtcatgccgatcactcgtccaaaaataccagcagctccaatcttctcgcgcccccggtggatgaagtggaagttccttttgccctctcccccatccagcaatggttttttgagtctgttccacacaagccagcgatcttgaaccactacaaccagagcgcccacttcagagtcatgaaagagatagaccactcccagctgtttaaggcactgcagcatgttgtccagagacatgcgatgctccggtcacgtttcatactagatagttggtcctggcagcagaaaattactaccgacatcgagggatcgtttcgacttgaagttgaaagcattgacgccattactgctttccggtcttgttgtgagcgagcccaaaagatgatcgatatcattcacggtcccctgctggttgctattctagtgaaggttgctgagcctgcacagcactttttggtattgatcggccaccatctcagcatggacgtcgtctcatggtcaatcattcatcgtgaactggaggctttcctcgccggaagccaggtgatagcgccgctatcgtccacgtcctttcaacaatgggcccgacttcactatgaacctaacattgttcccgctgagccccgagaagttttaccgtttagcgtgctcgaagctgacttggactactggggcatgcgggataccgcaaacgagtaccgccacggagagtatatcaccaccagcgtcgatgaagagacaactgcgtcgatcttcaaggaggcgaacattgcaataggtacggaaccggtggagttgattatggctgccgttctctactcctttggcaggatatttcatgatcgatcactgcctgcactctacatggaggctcacggtcgcgagggcgatgaattcggtctggatctatcggggactgtgggatggttcacaaccatatgccccctccagctacatcgggagtctctccacacttgggctcgcgccgtagctcaagtcaaagatcgtcgccgttccattccggccaagggttgggcgtattttgcctgccgtaccgtcagtcccaaggggcaagcatcgttcaaccaccaccagcagatggaaattctattcaacttcactggctccaccggcgatattaatgatgagcatgaccgttttctcagcccagtaaggttaatggaagactcgcggtcagatttcgatcccaaaacaccacgagtagctttgttcgcgatcgaagcgtcggtagagaaccgccagctgcggttttctgtgagctatcatcgatcgatgcggcacgttccgcgtgtgaaacaatggattcatagccttccttcgactctgcaggagggggttcagatgttgagtacaataggtagacaacccaccttgtacgattgtccccttgcggctttgaattatagcgatctcgactccatcctagcacgcatccagcagagtcaagcggacatggtggtggaggagatttacccttgctcccatattcaagagggcatcttgctgagcagtatgagaaaccctggccattatcaagtcaggtggcttgttaaagtagaggcgcgtcgtgggctgccagtttccacccaaaggctggcgaaggcgtggcagtcggttgtgcggaaacattccatcctgcgtactatctttgtcgatgatccctctggcacgagctcatttctccaagttgtggtggaggaccctcgctatccagcctccatcgtggaggtgcaacacagagattctgtcgccagcctggatgaggatattgacttcactgtcggggaattgccatatcgggccaccatctatcagctccacgatggcaatgttttcttcctgctggacatctcacacgcaatcttagacggcacttccatgggtattctcgctcatgaactagtcagaggttacgatggtagtctgactggggatgaggcacctcactaccgtgactatattagacttctgcaaactatgccgcggaatgagaccctggctcactggaaagcatatttgcaagacatcgagccgtgcaaaatgatcagtcgcaacaattgcgtagagaaagtcattaccccagaagtccggaaagtggctgtacagcttccctccacggagtcactacagcagttctgcaagacttatgaggttacgtttgcgaatatcttgcaggctgtttgggccgtggttctgatgcattactccggcagtgaaacagtgtgcttcgggtacttgagctcagggcgagatctgcccattccccatgtggatcgcgctgttgggccttacatcaacatcctaccctgtgcggtacgcctacagcaatcctcctcccggctcgatgttgtgaaggcgatacaggcggatctctatcagaatcttgcccacgagcattgttcgttatggcaaattcacaaggaattaggcttaaagggcactattctgtcttctaccacagggcgtcggacaatccgcagaagagatttaccccagggg

SEQ ID NO: 16514 - DNA, 189 bp, A.fumigatus
tcgttgattaatcaaacggaaggtgtgggatatgtgactcatggcttgcaggataccctctttcctggtgacgaggtcgttaagacacagtatggaggttgccacggcgcaatgaaagcctgccgaggagaagttagcctgagttcttaccatatggtgtcactcgaccttctgaactcacaagcttga

SEQ ID NO: 16515 - DNA, 882 bp, A.fumigatus
ggcgccagaaatgggcacatcgccaagaccttcccgattaggaagccagtctcctattggttggattgccaattaaggtcatgtcaattcaacatgacaattgactcggatttagatcagaactccgctcatagcatcgtcgttgagtccgtaaaccccgatggcatgagtttagataagtcaggaacagagctatataatgcagccgttgccttctgcagatatgagagcgaacaacaacttcatttgcatactgcccatcatcgcttatcaataccagacctacatatcatggcttctgcagctcaaactcaatgcgggaatcgccctcttctagctaccaccgaaatctgcgcgggtggtacctacatcgtgactggagccaacacgggcctaggcttcgaggcagccaagcaccttgtcgggctcgaggctgcaaaggtcatcgtcgccgtacgtaacatcagcgcaggtgaaaaggctaagaaggatatcgaagagtcaacaggaaggattggtgttgctgaggtctggccgctcgatctggcaagctatgactctgtcaagacatttgcacagaaggcgactacagagctcgataggattgatgctgtgattgggaatgcggctgttgcagtctcagagcgcgtcttcgctgagggtcacagcatgtctgtcactgtcaatgtgctcagcacgttccttcttgcggtgcttatcttgcccaagatgagggaaactgcggagcgatatggaattgtaccccatcttacgctcgtgaccagtctggttggattcgatgctaaggatctctgggataaaatcaaggatgatccggtgaacaaggtggatggggatgacattccaccaatgcgcacgtaa

SEQ ID NO: 16516 - DNA, 306 bp, A.fumigatus
  unsure (287): Identity of nucleotide sequences at the above locations are unknown.
gaactaagaagtctcttaggcggggttgtcgtcacagaggacttcctagtcgttcatgacctcgtcgggccaaccaagacgaaagcgctatcgactgtcacagccatctacgacgtcggctgctttctcggctcgattctagctttcatcgtgtctgaaaggctcggtcggaagaagtccatcctcctgggaaacaacatcatggcagtccggaacatccttcaagccagttcctacagcttggcgcaaatgtttgtcggccggggttattctggggtgggtaaatntttctcgaacttcatataa

SEQ ID NO: 16517 - DNA, 351 bp, A.fumigatus
gctctattgagacagagaaacaagatgactgtaccgtcgtcatccgcgtcatgccccttctgccgcatcgcagcagcatatcctcccatccctccatcgatattccgtcctcagcacaaacaggatagcgcacaagaattagctatcatccccacagatacgacgcaagaaacgcatgcgcaccttgtactctcgaccccatatgtcctggcctttttggacatcatgccattgacaaggggccatgttctcgtcgtcacgagagatcaccacgagaagctgaaagacatggacgtggaagtcagcagagaggtcagtatatcttctaacctttgcctccgggttacatga

SEQ ID NO: 16518 - DNA, 1050 bp, A.fumigatus
gtgttcttttcaggttttccccaggctgcggttcccttccatgttcggagtgtaacgatcttggagggtattcagattggaatttttgttccccgcgcctacatcattcggcagagatatcacattatatgcatagctgaccgaaaagagcagtcaccatattgcattgtcaaattggcaaatgaggaagcggcacgaggactcattgctcgtagcatcctagcgaaggatatcttcgagctctgggctcaaggcactaactatgaagaagttcatagcgacgttcgcaggcggactcagcatcgctggaacaactacaaggaggtctcattccgtttcaccatcgagagctttgccggaaagcgaagtaatgaagagaaacgagaaattatccagtcgttcgcctatcttgacttccagggtcccattcggatgaaaaacccagatgaggatttctgggtgctagaggagtatatcccagacgttgcaatttcaaagaggacgacctcaccaagtaaaacacggccggctgaattacaaactccgcagaagatctatttcggacgctgggttgctaacagtagccgggaggccatcaacaagtacgaccttaagaagcgccggtatatcagcaccacatcgatggacgctgaattgagcctagtgacggctaatatggcccatgcagcgccagggaagctgttctttgatccgtttgtcggaacaggaagcttctgcgttgctgctgcacactttggcgccctgactctcggctcagacattgacggacgcagctttcgcggcaaagagatggggaagggtaagccgatgggagtactgtcgaattttcagcaatatggcactcaaagcaaattcgtggacgtctttacttccgatctgacaaatacgcctcttcgctccagtcagttcctagatggcatcacttgtgatcctccttacggtgtccgtgaaggacttcgagtcttgggaactcgcgacgggcgtgggaaggaagaggtcttgatcgatggggttccagctcatttgtaa

SEQ ID NO: 16519 - DNA, 471 bp, A.fumigatus
acaacttggagcggcaccttccagccccgtggtgaagacacggagaagaaattttcacccactcatgccttcatcaagctcctgcaggatcaagggaagctgttgactaattatactcaaaacatcgacaacattgaggccaacgcaggtattctgccggagaaaatcctgcaatgtcacggctcttttgcgacggctacatgcgtcaagtgtcatcacaaagtgaaaggcgaagagatttttgacgacatcaaaaaaggcattgttcccgaatgcgtggcttgcaaagagagtctcgaagacgattctttgaagccgcaagggctcaaacggaaacggatgtccaacggaacgcagaagagcaggaagaaggacggtgaggacagttcggaggaggaagattacgagattcccactcctggcgttatgaaggtgagtaggaagtatcatgaaggtgctaaaagcaactga

SEQ ID NO: 16520 - DNA, 267 bp, A.fumigatus
cctgacattacattctttggcgaggacttgcccgacgagttcggccgtcgtctgcttcatcacgaccgtgataaagtggacttggtcatcgtaattggtacatcgttgaaagtagcacctgtggctgaagttccgggtgttctcccacgcaatgtccctcagatctatatttctcgtactgtacgttacgcttcaatcccttgggcaattctggccttggagctgacccatttcttagcctgtgacgcatacgtgcttcgatattga

SEQ ID NO: 16521 - DNA, 252 bp, A.fumigatus
acctctggcacgtcaatcctgggagaccacccctactctgggacgccgcagaatcagaaagtctggtcggacgagaaggacgacgtttacgcaatggagaagaaccaccccgagcgctacggacaacgggttaccgatgtcacggtggtggagacgggattaagcctgggtgtcaagacgtatatcgtcgtcccccctactatctgtatgctcttcatcccggtgaaacagtaccaaggcggattgaactga

SEQ ID NO: 16522 - DNA, 318 bp, A.fumigatus
atctggaaccatgtccatatcctggacctggcaaacttctatctccttctcttccgggccgtgcgagagcaaccagactggcttccatcgggtcccaaggccatcttcttcgtggagagtggagagcatacatggttacaggtcagccagggtattgctgatgccctgcacaagcagggactcttagacagtaacaaagtcgagtcgatcagtatgaaggacgcagcagccgaaatcactaggggcaatgagagtctcgtggaaatcactcttgcatccaagtatgtacgagatctccttggcacataccgatactaa

SEQ ID NO: 16523 - DNA, 438 bp, A.fumigatus
cgcaagggtataaaggggcagagacatctctcgagtgcagcagaatccatcaagtactccatcggacaatcacattctacagtcaacaacccgtcctcttcgaacatcatggtttctttctcctacctgctgctggcgtgctccgccattggagctctggctgcccccgtcgaacccgagaccacctcgttcaatgagactgctcttcatgagttcgctgagcgcgccggcaccccaagctccaccggctggaacaacggctactactactccttctggactgatggcggcggcgacgtgacctacaccaatggcgccggtggctcgtactccgtcaactggaggaacgtgggcaactttgtcggtggaaagggctggaaccctggaagcgctaggtaccgagctttgtcaacgtcggatgtgcagacctgtggctga

SEQ ID NO: 16524 - DNA, 567 bp, A.fumigatus
cttcttctccggcaattacagccaatggctggtaggtcgcaaccatctgtcgggtctgcctctgctaacctctcccagggtaacgatgatcagatgttctggggtctcgcctccatcacggcttcggagacgggattcccggaaatctcaggcaaacccacctggacctctctagctcgcgtcgtcttcaacatgcaagtggcccggtgggataaggtggcctgcgatggcggcatgcgatggcagatctggccctaccaggctggctacactatgaaaaatgccatttccaatggcggcctctttgaactgtcggcccgactcgcgcgctttaccaagaatgagacctatgcagaatgggcgaacaagatctgggactggtcggccagcacgccgctgctgcagacagatcgatggtacattgctgattccacctccaatgaagccaactgcaaggatgccggaaacactcagtggtcatataactatggcacctacctgtcgggggcctcattcatgtataactacgtaagtcgttctagtacacttgcgcgactggtaagctga

SEQ ID NO: 16525 - DNA, 591 bp, A.fumigatus
tgttctatggcgggaaagaccaatggtgaggacaagtggctgaaaagagtcaacggcctgctggactccctgatcggcaccttctgccccaaggacaagggcggcaacgtcttgtctgaggttgcctgtgaaccaatcatgacctgcgatcgcaatcaaattggttttaaaggatacacggccatgtggctggctcataccgctatcctggtcccatcgaccgcggcccggatcttccccgtcctgcagggatccgccctcgccctctcgaagcagtgctccaaggcacccgacaatacctgcggcgtccgctggtggcagcccacctgggacggcttcactcctggtctggaaacccagatggcggcgctagcgggcatcacagccaatctgatgtactacaagtcgagcgccccgaagaccattcagtcgaacccggacggcaaggagcatcagattgacacccatgaggatgaggcgccagatgcactcgcccccatcaacacaggcgatcgcgcaggggcctggatcctcactgtgatcatcgtggttgccgtcggaggatccgttgggtggttgattaagacttga

SEQ ID NO: 16526 - DNA, 546 bp, A.fumigatus
cctacaccaatggcgccggtggctcgtactccgtcaactggaggaacgtgggcaactttgtcggtggaaagggctggaaccctggaagcgctaggtaccgagctttgtcaacgtcggatgtgcagacctgtggctgacagaagtagaaccatcaactacggaggcagcttcaaccccagcggcaatggctacctggctgtctacggctggaccaccaaccccttgattgagtactacgttgttgagtcgtatggtacatacaaccccggcagcggcggtaccttcaggggcactgtcaacaccgacggtggcacttacaacatctacacggccgttcgctacaatgctccctccatcgaaggcaccaagaccttcacccagtactggtctgtgcgcacctccaagcgtaccggcggcactgtcaccatggccaaccacttcaacgcctggagcagactgggcatgaacctgggaactcacaactaccagattgtcgccactgagggttaccagagcagcggatctgcttccatcactgtctactag

SEQ ID NO: 16527 - DNA, 399 bp, A.fumigatus
tggtcagattcactcaagtcggcggccaagaccgtcgctgctcccatgatggatttctatgataagaaccagaccgagggcattccaggcaagctgaccggcacctggtatgtggccggcgccatgttcatgaccctcatccagtactggcagtcttcgggcgacgacacttacaattctattgtgtcacatgacctgatgtttcagtccggtgagaattatgacttcttctccggcaattacagccaatggctggtaggtcgcaaccatctgtcgggtctgcctctgctaacctctcccagggtaacgatgatcagatgttctggggtctcgcctccatcacggcttcggagacgggattcccggaaatctcaggcaaacccacctggacctctctag

SEQ ID NO: 16528 - DNA, 306 bp, A.fumigatus
tcagtcgagcaacccattcacgtcctgatcgcatctacccaatatggtgtatactatcgtcgtccgtatgtaacactctccacaaccgattctgcccagcttaaactcatcgttgcagatctccgcgcaaagccggaccccgagtgcatctcgaagcttcatgcaaaactcctcgaggcctcagccgtctactccaaggacaaggagaccctgtcctggttcgtgatgcagtcggtccatgacaagcaggacttttgcattgtggagcgttatttgaacgagggctcccagaagtaccacctggag

SEQ ID NO: 16529 - DNA, 261 bp, A.fumigatus
tttggagagttcaactgccaccttggttgcgcgcttcacgttggcctcgaccagcgccctgttggcaatcacactctttccgccactaagttcctttatttttgcaagtacgaaaggcgtgttgtcgcttcctcggtgaccctcgacttcggccaaacggatcgcctcttctattattatgtccatttcgcctttggggatcgactgttccgctggcactggattggcaaaatggataccagagcttacaggaagctttga

SEQ ID NO: 16530 - DNA, 426 bp, A.fumigatus
atgttggcaggaagggatgagcagtcgatttcagctttttacgcggaaacgttcttccataccggccccccatcactgcacatccgcttgctctcgcgcaccgtcgggccggaccgcatcgtcgacgagatcctgctggtgtttcggcataccgaggagataccctggttgctgccgcgggtaccgcccacggaccgcgacgtgaagattgtgcttgtgatgacggccagtttccgcgcgggcaagctctcccggcagaatatatactgggatcaggcgagtgtgctggtgcagattgggttgttggatccggcgctcgtgccagggagtttccgcgcgacgggcaagacgagggaggggaggcaggatgtggaaatgttgccagtggttggcgccgaagcggtagagagggtcctgaatgggtag

SEQ ID NO: 16531 - DNA, 411 bp, A.fumigatus
attgtgtacagcggcgcggtctgttcgaaaagaccgcccatcgtcacaatgaggccatctaccgtagtcgctgcgctctgcgggctgctgttctcaagcagcttagtatgcgccgactcctcgaccagctcgcgagtcgctttacccgcagactttaagccccagcaggtgttcaagaatgtgaacctggtccggaataccaatttggagaagggatacgttcgagaaaccgtcaatgtcatcgttgagaatgtcgataagcaaccgcagagcgactactacataccgtttccatcggacgtctttggcaaggtcggggggttggaagtgagggacaagaagaccccagggaagggcagatttgccgttgaagctttggaagtcgaatcaccaaggtatgtatgcaattga

SEQ ID NO: 16532 - DNA, 1311 bp, A.fumigatus
tctccgaggaacgcaagagctgaccaagcaacttcagaaaccggggtgggtcataaacccttaactaagagtagcattgaacagctgggtaaggctgatgtccttgttgctggctctcttgcgatcgacctgtcctgcgattataccccatttgctatcgagagtgacaagatcacacccgttcctcaaacatcgaaccccgcggtcatcgggcagagcctgggcggagtaggccacaacgttgccattgcgtcacattatcttggaagctctgttctgttctgcagtgtagtcggggatgacttgagtggccgcgctgcgctctcgactctccaggaagaaggactccccaccgccggcgtacagatcctgcctgcgtcgtccggagcgcgcacggcacaatatgtcgccatcaacgacgcaaagcgcgacctcgtagtggctatggctgacatgggcatcatggagctgccggagcacgtgcttgattttgacgggttctgggatcccctgatccgccacacccagccgcagtgggtggttgtggatgcgaattggagcccagcggttctagccagatggattgccgttgctaaacagcacggtgcgcgggtggcctttgagccggtctcgacggccaagtctcgccgtcttttctccaagacctccgaggcggatgcagtaattcaaccggccaaggcagtccccaacaacgccatcagtctggccgctcccaaccagtacgagctctcagccatgtacacgacagcccgcgaatcagggctcttcgaggagtccgaaggctggtggcgcatcatcgacgccatgggcatgtccgcgactggctcgcgagatcgtctcgttgcaatgaccacggccgagctggtggaccagggaatcccacagcagagcatccaactaattccctttattccgtgcatcatcacgaaattgggcgctcagggggttctggtgacccaactgctccgtccgggagatgctcgtctcacatctcctgattcggcgccttacatcctctcgcgcgcctcgcctacagatgagctaatcgggggggtgtatatgcgtcttttcccgtcagccggggtcctggcggatcgggagattgtgagcgtcaacggtgcgggggacacgttactgggcgcggttgttgcggggcttgcaaaatggtcagggaaatcggtcgaggaggtcattcctctggcgcaggaggctagtctgaggacgttgaagagtccaggtggtgtgagcagggatcttgttactctgcgatcattgatggctgccttataa

SEQ ID NO: 16533 - DNA, 501 bp, A.fumigatus
cagttatgcacagatactcgatgtagaatgatccatacaatcggtactacagcactactctctacccattcaggaccctctctaccgcttcggcgccaaccactggcaacatttccacatcctgcctcccctccctcgtcttgcccgtcgcgcggaaactccctggcacgagcgccggatccaacaacccaatctgcaccagcacactcgcctgatcccagtatatattctgccgggagagcttgcccgcgcggaaactggccgtcatcacaagcacaatcttcacgtcgcggtccgtgggcggtacccgcggcagcaaccagggtatctcctcggtatgccgaaacaccagcaggatctcgtcgacgatgcggtccggcccgacggtgcgcgagagcaagcggatgtgcagtgatggggggccggtatggaagaacgtttccgcgtaaaaagctgaaatcgactgctcatcccttcctgccaacattcagcaaaagataa

SEQ ID NO: 16534 - DNA, 243 bp, A.fumigatus
tattgctctgcactgagaactgcccttgtcatgctttcacaagccgctacccgactctgctgcagagttcggggaccggcaataagagctcctcgggcaattcgaagctatcacgatgtcgcacaaagcaaattcttgaaagtatcagaggaaattcgtgatgcggtggccacaggaaagccagtagtagcactggagtctacaatctatacccacggtatgtctgggtcaatacagatatga

SEQ ID NO: 16535 - DNA, 183 bp, A.fumigatus
agatctcggttatatatgcggcctggtacgatgacttcgaagtatgggagtctcatttacttgactgacctttttcagggaatggctgggagacgactccatggaggaacaactgtttcaggaacaatggtgcttgctcacttggctggtattaaggtgttcgggacaggtggtctcggttag

SEQ ID NO: 16536 - DNA, 291 bp, A.fumigatus
cctgagcgcgatgcagccgatttgactgagctgggacggacacctgttgctgtcgtcagttccggatgcaagagcttcctggatatcccgcggacacttgaatttctagaaaccgagggagtctgtgtcgggacatttgccgatggccgtgaaggctcagtggatttccctgcctttttctcgcgcgacagtggcatcaagagccccagagtaatccgagatgaagcggaagcagctgcgatcatatgtaaggagccagggctctcttcctcagttggcctatcgtactga

SEQ ID NO: 16537 - DNA, 243 bp, A.fumigatus
caagcaaggctaatatcactggtaggctttccatatcccgagaatgtcgctctcgcctctttgcttgaatctgttgttcgggtcaatggtggaattcccgccacaatcggcattctcaatggggttgctagggttggcctcagtgctgaggagctcactgagctagcatcgaccgcggagaaaaaggatgccttgaaggtttcccgtagagatctcggttatatatgcggcctggtacgatga

SEQ ID NO: 16538 - DNA, 393 bp, A.fumigatus
tccgagatgaagcggaagcagctgcgatcatatgtaaggagccagggctctcttcctcagttggcctatcgtactgacaccaaaacagacgcgcagtcaaagcttcctgtaagctctggtatccattttgccaatccagtgccagcggaacagtcgatccccaaaggcgaaatggacataataatagaagaggcgatccgtttggccgaagtcgagggtcaccgaggaagcgacaacacgcctttcgtacttgcaaaaataaaggaacttagtggcggaaagagtgtgattgccaacagggcgctggtcgaggccaacgtgaagcgcgcaaccaaggtggcagttgaactctccaaactagaacaggctgatagggggactggaggccggtga

SEQ ID NO: 16539 - DNA, 600 bp, A.fumigatus
gtttaccatcacgcgtctacaagtcatgagctatctctgataaacacaagatggaagaaagagtggtggtcccaaccggataatcgagccgaccaacacattaaaatcaaatatggctggagcgaagactggggctactggattaaggtgatggacgatcgtcttgaaatggccgatgactggcatagccggtacaacacactcgccgaactagaccggttcagagcatccgtgctggacggcggtcgcgagggatgctatctgagtgtctacacgggccctcgaggtcggggaaagagagtcgactttgaggtcatgatggatctgtgggaactatataaagtggccaactcccatatcctctctgagtttcgcaacttgtcgaaacgcgagatcgacgaggtcagcgatactgtcgaggccaagatcattgacgaatgggtcaacccctgggcgagaaaatgcgaatgccaggattgcgaggcatttgatgcattggttgcagcaaacaacaaaaagaatgagagcgatgaaaatgacaatgacgaagaggaagacgaagacgaagacgaggacgaggacgaggacgaggacgactag

SEQ ID NO: 16540 - DNA, 702 bp, A.fumigatus
gaaccaatgatggttggcacggggttatctctaacaaaggcccttttcctcccgtcgcaggacgttaccatctctacattggtctgccgcccatttcaatcacgaagtttgactaatgaggcgacaggtctcttctgcccctttgctcaccggcccaatctagtgcgtcatgtcagtgtcttgaccgacatcatctctctatccgtggtcaggccataccccaacatcaaaggggaggggttacgattccccaagaccaatgatgaatatcccggagcaaccgtcgaccatctctatggtagtgaattcctgcgcgagatctacctcagagccgataaggactacaaaggaccctactccgtccctgtactctgggacaaggagacggaaacaatcgtgagcaacgactctgccgagatgctccgctggctacccaatgccttcgaccccattctgccggtagttcacaaacgggtgcatctgtaccccgaagccctgcgatcgcaaattgatgagatcaccgcctggatgcaacccgatctcaacgcccggcgtttaaaaggccggaagcgcggccactctagcagactacgaacaatcggttccgccggtctttcgaacgctcaaccgactccagcaactcatccacgacaatgggggtccgtccattctaggttagcatattcaccgaagtcgatttga

SEQ ID NO: 16541 - DNA, 876 bp, A.fumigatus
atagcttttcagaatgccgagtccaggggtcagatatataagtatctgcgctcttcttgtgatcggcggtattgtatctatcctgggaatcagaatatatcaagaaaccacggaggagactcgaccctgctcgttacaactgtgctcagaaagatgggccgcccctctggacttctgctgagcatatcggctttacttgccgctgttctcagtcccgccgcagctgcaaaaaatgggtccacgctcttcaaaggaggaacgatcatcgcgttcaatgaaaagaagcaggacctggacatcattcggggtggatcgctgctgatctctgacggcatcgtcagtgcaattacggagggcgcctatgataagcctctgccacctggtacagagatagtggatgccactggggacatcctgactccgggcttcatcgacacgcaccgccacggctggcagacagcataccggaccatcggctccaacaccacgcttgccgaatacttcaatcgttacggggagtttgctgctgacggtatttggtctgccgatgatgtctatgttagccagttgactgggttgtacgaggcgctcaatgcgggagtcaccacaactttggaccacgcccacaacacctggtctaaggccaccactgatgctggtgtccaagcctccatcgacagtggtgcacgtgtgttctggtgctttggcttccataacgtgtccaactttcctttcgagcagcaattggcaaagttccaagaacttgcagatagtcgtcggttcagcggccaggcgagctcccttggtattgcttatgacgctttcaatcctggaagcgctcaacagacggaaagcatcattcagcttgccatgtaa

SEQ ID NO: 16542 - DNA, 513 bp, A.fumigatus
tctctgacaatgtgcgcagtcatcaactcgcctgaggatcttcatgcattgggatttcttaacagttctgttccaattgttttctcccatgcgagcttcttaacgccgacgggggcaagactgcttagggagacaaaccagtacatatcgatcactgccgaatcggagatgcactacggccatgaccacccctacaaccacatgatccaggatcaggcctctctgggggtcgatactcacttcacattctctacggacattctcacccaggcacgcatttggttgcagtacgtgcgtctgactctttaccgatggcttgctcagaactatgaggtggcgacaaagaacccgatgtctgttgaccaggccttcttgctggccactcggagcggaggactggcccttcaccgacccgacttagtgtcctctcggttggtgccgctgctgatgtggtcatctgggatggttcgagtccgggaatgcttgggtggcacgatccagttgccgcggtga

SEQ ID NO: 16543 - DNA, 402 bp, A.fumigatus
ccaggccttcttgctggccactcggagcggaggactggcccttcaccgacccgacttagtgtcctctcggttggtgccgctgctgatgtggtcatctgggatggttcgagtccgggaatgcttgggtggcacgatccagttgccgcggtgatgctacatgccggtgtaggcgacgtcaagcacgtcatggttgacgggaagatgaacaagaaggacggcaaacttctcgtccccaagtaccaagacttgcaacgcaaattcgtggacgttgcggagcgaatccagtcaacctggctggctatgccgcctactgttcttgagggagatttcgccatgtcgggttatccgctcgcggttcctcctctagccgatgtcgttcgaggagatgagtctgggtactga

SEQ ID NO: 16544 - DNA, 303 bp, A.fumigatus
gtctactcccggttaacggctaatatgcctacactactagtcgatcagacagatcatttttggaggatcatccagatgctgcttgcggaggcaacctttccgggtcacgccaggttgctttctgatctctactccttgcacaacgtcgagcagcgtgaaccgacgggtcccgacatcctggtaaaaggctctcaacgacggctgatcgtcatttatgtggcgtacatccatatggaaaggtacatatgcgtactcggccatgtgtcgccaatcaattgcatttggacaagccatgtctactag

SEQ ID NO: 16545 - DNA, 207 bp, A.fumigatus
tggcatcacggactgaatgagtcatgtgtccctctgcgatgtgcttgttcagtgcgcaaatacacaaaggagagcaaaactgtcagcatggtcatcacgtgtaaccaatggatctactgtttctatggaagtaagctagaaaaggactgtcttggagagcatcattcatcactcatgatcgttcatgcacttataagtggattgtag

SEQ ID NO: 16546 - DNA, 492 bp, A.fumigatus
gtttgcgtggcggttttcttgtctgttcaggaggtggctaggatgacttccaacaaaaaatcaaggcttcccccatatcaaccgggcgagcatgttggcccttcggtgcatttgaactgtgttctgctgacaaccacagtggtcaacttcttggatctctttcaactttcctcggtactctttgcccttccgaatatccagcaggctcttggattcgcgagtgaagatatcaattgggttttgattgtatacaacatcacttttgcagcgttccttctgattgctggacaactgggacagaggttcgggctggaaaagatattcattgccggcacagctactctcaccatatccaacgttatcaacacgaccgcaccaaacaaaggtgccttgctggccggtcgtgccatttccggagtcggtgctgggttgactgtaagtgaattccagcagggccgaacggatatgattctgatacctcatcgttcttga

SEQ ID NO: 16547 - DNA, 507 bp, A.fumigatus
  unsure (295): Identity of nucleotide sequences at the above locations are unknown.
ctctttatagcttcagcagcaggctggagatcaatcttctggctgtgtctgatcctcacaggcctttcaacaatactggcctgtttatttctgccacggtttgcaaagagaaaggacatacctattgatatacccggtaccgttgtctttaccgctggtgtagcattactggtctacggcctcaatgacagctcgcgcagcggttggacatccgctgcagtgctgacggggattatcctgggagtttgtctcctttttgtcttcctctgggtggaagccaaggtttccaacccanctatccccggttacctgtggaagtctggcccctttctcgtgatgctggttgccattttcgcctttggagggagctttagtacgtggttcttcatctccacccaactctgtgtcaatctccttggttactctacaatcctaaccgccgtgtattttctggtatgtctgcctccattccattctctctctctcagatttggtgctcgtgcctga

SEQ ID NO: 16548 - DNA, 207 bp, A.fumigatus
  unsure (88): Identity of nucleotide sequences at the above locations are unknown.
cccgctgcctttgccgctatcgcaagcggagtttttgctacccccctcatacgactcgcaggggagaagaacatcctcgtggccgggntagccatcaccgccgctggtgctgtcgcctgggcatttgctggaccccggatcgggccggcggtacccaccacggggagggatactggtattccatcgttgcagccatcatctttgtga

SEQ ID NO: 16549 - DNA, 1725 bp, A.fumigatus
ctctacggtggtagcccggtggtggaggtagccctcagcggatatgctatgctggatcagattggcacaggtctgcgacagagaatctattcccgctccttcattttcgcaaatccaaatcaaccagacgatacctttatttacatcgtcatcgacgcggtgacgggcgacacagccgtccgacatggagtcctccaggcgctcgcgagtttgggaggtgattatgcgcgctatggcgagcgcaatgttgcgttgactgggacgcactcgcattcaggacctggggcttggaacaactatctacttccacaaatccctagcaaggggttcgataagcagagctatcaggctatcgttgacggcgtggtcctctccatcaaacgcgctcacgaaagcttggccctcggtcgcttgagcttcggctccatcgatgtcgagaatgcaaacatcaaccgaagtccttattcatacgacgccaatccggaggaagagaaagcacgctactcggccaacgtagacaaaacaatgaccctcctacgattcgacagggagtcggacaacagaaccactgccatcctgaccttcttcccggtacacggcacttctctctataacaacaacactctcactaccggtgacaacaaaggtgtcgctgcttggctctttgagcggagcgtccaggacgatgcgaatttcgccgacgactttgtagccggattctctcaatccaatgttggtgatacaagcccaaatgtgctgggcgcatggtgtgaggatggatcggggcagatgtgccgctacagcgacagcacctgtggtggcaagaccgaggactgtcatggtcgcgggcccttcttccgggaaaaggacaacggtgcgaagagctgtttcgagatcggacgacttcagtacgccgcggccaagcagttatatagccagatggatacgagtaatactcggatcactgggaactctaatgttcgctcctttcacgcttaccgcgatcttgctggctacacattccagtcgccgttcaattctagtatgctgacgacatgctcggcggcactgggcttctctttcgcagccggtaccactgacgggcctggcctgtttgatttcacacagaatagctcgggacctgcagagtccaatccgctgtggtacgtcgctcgagcgtttgttcatcagccttcagcaaaacaaaaggcttgccaggcgcccaaggatattctcctggatgtgggagccaacacgcagccgtatgcgtgggagccgaacattgtggacatccaggtcctccgagtaggtcagctgttcctcatcatctctacgagtgaggcgacaaccatggctggacggcgttggaaagaggccattgcaaagtcagccaaagacgttctctctattgacagtcccttggtcgtgctgggggctccttcaaacagctacgctcattacgttacgacagaggaagagtacagtaggcaacggtacgagggtgcttccaccctttacggccctcacactctcgcggcgtacatcaatctcacccttacctacctcccttatctaggcgattcgcctaatcccgccacgctaccggagatgcccacgggagtgcagccgcccatcaacaccgacaaatcactgagcttcatcccgggtgtcgtgtacgacagtgctcccagtcttcaccacggggcggaaggggcgcgcaatcat

SEQ ID NO: 16550 - DNA, 225 bp, A.fumigatus
ccgtgcaacaatgtagtggatatagcggggtatggtcgcggaccgcggcgagataaccagctcgatgactttaatatcggttcgttgcgcttagacaacaccaacacagacaagcgaggcgcattggcagcttctatatcacctcgtgtccaagctgataaatcggcctaccatctaagaatgagctgtgtttggtcattggtgtttttcgataaccaagaatga

SEQ ID NO: 16551 - DNA, 618 bp, A.fumigatus
  unsure (204): Identity of nucleotide sequences at the above locations are unknown.
ccagacatcgacgctgagccgtctgctcaagcacgcgccgctgcacagcaactcatcgcagcggagttatcccccaaccatgcctcaactcttcaccccgccattcccgagctccccgaacggggattctccccccttatacagcaggagatcgaccgcaagcccgccgggttgcccttgaccgggggaatcgacctttcccgntacgaagcaccggagccgcctgcacgctcgacagacggagaagttcctgatctggatgcgtggcgccgcattctgcagagagcgtacatggccagctcccatctctccatgcgacacgagaacctggcgttgctggaggagtacggcaagaatgcgtggctcattggcaactcccagctggaggatattctccggggtttggagaaggagttggccgagaccaaggaggcggcggaggcggtgaacaagcagaggaagcttgcccaggaggccagccagggtgagatggtgagtctggaggagacttggaagcggggcgtcagtgccatcctcgacgtggaactggcctcggagggtctgcgactgcagattctggagcagaggcgccggcttgcccagcagcaggcgcggtag

SEQ ID NO: 16552 - DNA, 1419 bp, A.fumigatus
ctaacctctgtagaaccgaacacacttctgaccctagaagacaaaagcaattcgatcctcccgcaaggtcagagactcatcctgcgcgaattgggccaccgctcgggtccaaaggtatatctcttgcccgtccctccgcaaggagtatcgggcaaaaaattcactcttctcaccgaccaaagatttgataagactggggagcatggcaatctggaagttctcttctgcagcgttttccctctccagaatggcaaattcgcaactgtcttctcgatgaatatggacttttctggaggcaacacaggttcgacacgtctcgcttgcaagaatgcggctgaggatggtattcacctgccggcatcgacaccagtttccaagtatccctttgaccgggtccagcctttctcatacctgcagtatgagttggaggatctttcagaacaccagttcgttgctattgtggacaaagccgatagtcccaccaaaggttgggttctggcggaattttcggacagttccgatgctgtgatcagggtccgtggcggccttggtggtttgctgagtgccgggctcaagatgagactgcccgcaaatcgtccaatgctcaccgagattaagattccagctctgcattccagtttgctggattacaaactccaaatcgtgagacacaatcatgacaagcggcaggagctcttcgctcctctactgcgacagtcgatctccgacccgcacgagtcgaaattcttcgtcaatgtggacaaggtcgatgtgaacctgcacggtgtagcgcctttcatgcctccaccccttcgcgaacaggcaactctcggcggtgtttcatttcagctgtggacagatcccagctgtggttccactgtcgacgtttcgctcaaagtggacattgctggcagcctgggagagcttgtgatgcgctatcggactgtctttgctgcctttcccctgcttgttgtcgctcttgtcctccgtaaacaatttcagatgtatgatgagactggctatttcatcacattcgccgaaggtctggacactgctctgcggtcatcgttcccaattctactgcttgccatgtccttgctggcatcttctttagccacatcggcgcaaattccacctatcgacgaaccgttccagtggccagttaatgccaccgagacgccgattgattttacaaaaaacgatctgctcttgggatcgcaggatgcattcttctggtttttggtacctgtctttggcctgatcagtgtcggtgtctgtgttattctcaactatatcgcactcatcctattgtctgtgctttcttttatctacgggtgcctgataaccagatcaggctacattaaacgcaacgagaaggggtatgtcaatgacactcttgctttctacgaaactcgctga

SEQ ID NO: 16553 - DNA, 366 bp, A.fumigatus
tgtcttgtccatcatgcctttcatcctccttgtggaaaccatgaccagcggggccatgatccccagagtcaccacaaggtatgcgccatcatttcctcgcttcagtgtcagtcgactaatcaccgcaggttaaaacatgtcacatctatgatcctctttgccattgccgtctattcagcagtctacggcgtgtcatacgcctaccttctccatcacctcgctaatatccttgccgcctggtttgtcgtcatctacttcttcagcagcggcttctccctccgacgactttggctcatcctcgaaggcgacgatgccacacagggcaagtctgagccaggcggaagccaccagaaaaagaagccatga

SEQ ID NO: 16554 - DNA, 771 bp, A.fumigatus
acccacccaacccaaggtcttagactaagatccgcctttccgccccagaaagcttcgatccgtgcctgcgtgctgaatgagttacgaatatctccacctcctccaatgcacagacgctcgtctggctctcctgtcgaggacgacgctgaagactcgcctctggtttcgcgatcccctacagaatcaacagcacatggccctaacaataatgccttcgagacggccgagaagtcgcgctctcagatagcgaaaagaggtacgagtttcgatctccggcgagataacggcgcctcgactcctcgctcccggaactcaggtctgtggaggacgccctcgtcctcgtcgacctcgtcgacgacggccatggccaccgcgtctacggaaacaaaatcctcctcggcatccttcctgatgccattggcctcccagcgacttcccatgggaacttctcctgagagttcacggtttcgatcctcgcggcttcgcagcccgtggacttgctcgatattgacggccctcacaactcttgtcgcatccgtgttcctcttctttattgtccgctcattttcggcccgtcaggccggcgaagatggatgtgggatacccgtgatgagcccgacgtttctccatatggtgggcttcgataccgagcatacgcgcttcgcgagcaaatacaatctctatctttaccgggaggaaggtgtcgatttctacaatcaagaaaacctaggagtatgttgtccgcctctgatccttcagctgcagtgctaa

SEQ ID NO: 16555 - DNA, 204 bp, A.fumigatus
acgggggctcccgtcttgttcttaccgggaaatgccggtagctacagacaagtccgatcacttgctgccgaagcatcgaggcactttcacgatgtcgtccgtcacgaccaagagcgcatcaaggccggtaccgcggagcttggatttcttcatgatcgacttcaacgaggatatggctgcgttccacggccaaaccctccttga

SEQ ID NO: 16556 - DNA, 282 bp, A.fumigatus
aggtctactgcgcattacaacttctctaattacgcccactcgattttcattctcatgctctggatcttaccgatcaacattctcgtccttttggtctgggcccacaatcttgttgtccactggttcatgccattctcgtcacaccataatgtcttgtccatcatgcctttcatcctccttgtggaaaccatgaccagcggggccatgatccccagagtcaccacaaggtatgcgccatcatttcctcgcttcagtgtcagtcgactaatcaccgcaggttaa

SEQ ID NO: 16557 - DNA, 900 bp, A.fumigatus
tccttcagctgcagtgctaacgagcccaaagttgaacgggggctcccgtcttgttcttaccgggaaatgccggtagctacagacaagtccgatcacttgctgccgaagcatcgaggcactttcacgatgtcgtccgtcacgaccaagagcgcatcaaggccggtaccgcggagcttggatttcttcatgatcgacttcaacgaggatatggctgcgttccacggccaaaccctccttgaccaggcggagtacgtgaacgaggcaatcgcttacattctctccctctaccacgaccccaagcgatcccgaagggaccccgaactccccgatcccagctcggtgattctcatcggacactcgatgggtggcatcgtcgcccgtaccgcattgaccatgtccaactaccaggccaattcggtcaataccatcgtcaccatgtccgcgccccacgccaaaccgcccgtctccttcgattcggacatcgttcacacctacaagcagatcaatgactactggcgagaagcatactcgcagacgtgggccaacaacaaccctctgtggcatgtgaccctcatctccattgctggtggttcacgcgacaccgttgtcccttccgactacgctagtatctcatcgctggtccccgaaactcacggcttcactgtcttcacgtctagcattccagatgtttggatcggcgtagaccatctatctattacatggtgcgaccagttccgcaaggcgatcatcaagtcactttttgatattatagacgttcggcgtgcaagccagactaagccgagagctgagagaatgcggatattcaagaaatggtacctcactggcttagagccggtcgccgagagaaccctatctcagaagggttggtgcccttgttaa

SEQ ID NO: 16558 - DNA, 282 bp, A.fumigatus
gaatggaggcatcaactgaggtcttccatccatcctctcctcttcgccgctgtctactccgccgccgatgtcgtcgcccagcttctccgcctctccctcgcatcgcgtgcggatcttctcgtcgccgctcccaagactgcgcaggcggtaatcgcggggctcggggacttttatacttggaagttggctcgctatgtctatggcgctcgaagttacgaggcttgggctactgtatgttcatctcattgtctgcctaattatcgatacgaggaccgaggttga

SEQ ID NO: 16559 - DNA, 414 bp, A.fumigatus
ctgtcaaagcttgccttgacagtcgttagcccatggcaatggttttgttcgaccaggacattgtcgaattgcctggagaccacgattaccattgtcgctctctacttgtggccctggagttggtcatttgagacaccggttcgcaagaaggctactcgcgcggccagcagggagcgtgctcagaggggtccagaggggtcagactcgctacaaaggtatggtggacgtccatttgatcatacatatctgacgcggcagcgtaggctacgtcaatgcctatccctagcagctgtcgcctgtattctacgaccgacaaatattctcatctggatgggtttggcaagtgtcgcatggtttcgaacttcttgggacaggagggcgattctggtacgcgaagtattgctttgcgggtga

SEQ ID NO: 16560 - DNA, 1440 bp, A.fumigatus
attcataggtgtgccgttcttggtctatcgtgcgtggtggatcggctcttctacggaagctggacctttcctcctttgagattcctgtactttaacattgcacagtctcttgcggtcttctatgggagaaatgactggcattattatatctcgcaagggtttccccttttacttaccaccgcactgccgttcgctctcgttggcctgtaccgcgctctggcccaagttcgaacgttcggattggggcacttgcagtctctcgtgcaggcgcagcttgcgctgatatgcgtaattatgccttttgtcctgtccctggtttctcacaaggaagtgcgattcatctatccgcttctaccatctctccacatccttagcgcaccacctctggtggactacttcctccctgcagtcatccgctcgtcccgatcatatacgcccaggcggctcaccctcatcttcctattgctggtcaatatcgttattgccctctacacgaccatctaccacgcatccggaccgtccaatatcctttcatacctccggcaacagcacgagctacatgctccggctgctcaaactccttcgaacctcaggccctcagtcaaagacccctctccgcacggaatcacagccggcttcctcatgccctgccacagcaccccctggcgctcccacctcatctaccccacaatccacgcctgggctctaacctgtgagccccccgttgaccaaaccgccgcccaaaaagccacctacatagacgaagcagaccaattctacgccaaccccgcccggttcctccgcgagcacatggccggcggcctccgccacatctcccggaaaccatcctatctctccgcgcaaccacgcccccagcacccgtcgacgacaagcaccaacgacgccagccacgaatggcctgactacctcatcttcttcgcgcaactcgagccaaccctgcagtccctcctccgcgccagctcctacgccgaatgctaccgcaccttcaacacagcctggcacgacgactggcgccgcaaaggcgacatcgtagcctggtgcctcgaccccgccgaacaacaggcttggcgatccgccacccgccaacgcgacctcgagaaccgcgagagacaattcgaccggatcatcgagagtttccggaaagaagcgagcgggaagcgcgatggcaagctctcgccgttccgtcggtggttttcgtcttcgtcttctgttgccccgtcgtcttcgctctctctgtcgtggccgacgtcgtggcgctggccgtggggccagcgaaagcggaccgcctggttaggcgtgcagattccgcagtggacaaggacacggccgtcgtggacggcttggggaggggactggttcgggggttggaggcagaagaaaaagacgaagaaacttcttgagcgggatctgtggtcgtaa

SEQ ID NO: 16561 - DNA, 513 bp, A.fumigatus
agggttaccgccgtaggtggaaccgtgggtaccaggctcaatggtgagcatgacgtctttgcgacccaagacacacgacacagggtacatgccaccggaaatagccttgcccagcagaaccagatcgggcttgattccgctccactcatggcagagcaatttgcctgtacgggcaatacccgtctgaatctcatcacagatgagcaggacattgtgcttatcacacagagctctcgcctcccgcagatagtcatcgtcgggaacgacaatgcctgcttcgccctgaataggctctaccaggaaggcggcaaggttgggtcccgcgttctcaaaggcctcccgcaaggctgccttgtcattatacttgaggggcttatcggttccagggattgtgcatccgatacctggcagatacggaccgtagttttcgcgcgactcgggatcgcaagacagagaaatagcggcgaactagatgaagaaggctggtcaatacaccatgatcgggtcgattga

SEQ ID NO: 16562 - DNA, 414 bp, A.fumigatus
aatttgcctacgaccatgtcctcgtcgcgtcgaaggaagtccttcacgtcatcgtcctcttcgtcgtctccgtcgtttcactccccaccgccgatttcgcgcctgaggccgcggtctcctccatcaagtaataccaaaacatcaccgacatcaacaacgccgttggcaaccaatatccttctgtccttaatcgcttttcggctggtcaacgcattcactgttcgcaccttcttccaacccgatgaattttttcagtcccttgaacctgcctggcaaatcgcgtttggagaaaaccagggggcatggataacctgggttagtggagtcgcatccccccagcattatcgtgtgcagccttgccttgcattcgaatttgttgcaaacagtcacatcattccagctactaacttatga

SEQ ID NO: 16563 - DNA, 606 bp, A.fumigatus
ccaggcggtccgctttcgctggccccacggccagcgccacgacgtcggccacgacagagagagcgaagacgacggggcaacagaagacgaagacgaaaaccaccgacggaacggcgagagcttgccatcgcgcttcccgctcgcttctttccggaaactctcgatgatccggtcgaattgtctctcgcggttctcgaggtcgcgttggcgggtggcggatcgccaagcctgttgttcggcggggtcgaggcaccaggctacgatgtcgcctttgcggcgccagtcgtcgtgccaggctgtgttgaaggtgcggtagcattcggcgtaggagctggcgcggaggagggactgcagggttggctcgagttgcgcgaagaagatgaggtagtcaggccattcgtggctggcgtcgttggtgcttgtcgtcgacgggtgctgggggcgtggttgcgcggagagataggatggtttccgggagatgtggcggaggccgccggccatgtgctcgcggaggaaccgggcggggttggcgtagaattggtctgcttcgtctatgtaggtggctttttgggcggcggtttggtcaacggggggctcacaggttag

SEQ ID NO: 16564 - DNA, 939 bp, A.fumigatus
aaaccttcggttcaccttaaattcagttcacaagggaacaaaattttattcccaaaaagggtttggagggaaagccaagacccatttttccagttcggggggcccaccggcaaacgccctttcacaagcaaaccggttaacccagagccctgggttggcccagacaaacccttttttcagccagttgggaggggggggggaattcaaggcagtaacaacctcagtcagtcttttggaagtgcagtgcccaatccgccccagcatgcgaacattatgccagcgttgtcctccacatcgccctttagccaggttttttaccagcagcaacagcagccgcagccgcagcagcagcagcagcagcagcagcaacaacaacaacaacaattcatgcagaatcaaccacatttgcagggccagggctttgcatcccagaatccattccagtcaatggcagcaccaaatacaccaccgaatgcgatctatcaaaaccagtatcaaccacaagtacaggcgggaatgcagcagcccacccagtacatggctcctcagcccacaggccgtgtggataaggataccattctttctctgtacaatacatcctccccacaagcatccgggatgcagcagccctctcaaatgcaagcttcgatgggaatgtcgctgaaccaagcggcccaaaaccagccaatgccaagtatcagcgagcaccagaacaacggcccacaggcctccgctggcccccagttagccgggtctcggaatcctttcatgggtggacaaggcaatcccggtgctgggacggacctaaccccaaaagcctctcagccgaatggcaatttccccagacacatgagccagcagagtgtagatatcaatggcttccagagcggacggcacagccctgatgcctttgccgatccgagcgcccgttaccagtag

SEQ ID NO: 16565 - DNA, 657 bp, A.fumigatus
ttcgccgctatttctctgtcttgcgatcccgagtcgcgcgaaaactacggtccgtatctgccaggtatcggatgcacaatccctggaaccgataagcccctcaagtataatgacaaggcagccttgcgggaggcctttgagaacgcgggacccaaccttgccgccttcctggtagagcctattcagggcgaagcaggcattgtcgttcccgacgatgactatctgcgggaggcgagagctctgtgtgataagcacaatgtcctgctcatctgtgatgagattcagacgggtattgcccgtacaggcaaattgctctgccatgagtggagcggaatcaagcccgatctggttctgctgggcaaggctatttccggtggcatgtaccctgtgtcgtgtgtcttgggtcgcaaagacgtcatgctcaccattgagcctggtacccacggttccacctacggcggtaaccctttaggctgtgctgtggctatccgagccttggaggtcattcaggaggaacacatggttgaaagagctgagaaagtcggtcacgtcctccgcaagggcctggaggctattcggagtccaatcatccaaactgttcgtggcaagggattactcgtcttcaccacgggggtcgaaggatccgcgctaagcgtg

SEQ ID NO: 16566 - DNA, 750 bp, A.fumigatus
tcaagaacaatctctttcaagctcacctcctcgcttcgttccgccagcatgtctgccaacggaaccagtttttaccatgcgtcctccacgcaggaggccatccaggcggagaaggagttcgcagcccacaactatcaccctctccctgttgtcttcgctcgtgcccagggcacctccgtttgggatcctgaaggccgccactacctcgacttcctgtcagcgtactctgccgtcaaccaaggccattgccatcccaagttggtggctgcacttgtcgaccaagcctcacgcttgaccttgagttctcgtgccttctacaatgatgtattcccccggtttgccgagtttgtcaccaagtactttggtttcgacatggttctgcccatgaacacaggagcagaagccgtggaaacgggaatcaagattgctcgtaagtggggctataaggttaagggcattccggagaaccaagccgttgttctgagcgcggagaataactttcacggacgtactgtaagtgcacgcgagaatcaatcgacccgatcatggtgtattgaccagccttcttcatctagttcgccgctatttctctgtcttgcgatcccgagtcgcgcgaaaactacggtccgtatctgccaggtatcggatgcacaatccctggaaccgataagcccctcaagtataatgacaaggcagccttgcgggaggcctttgagaacgcgggacccaaccttgccgccttcctggtag

SEQ ID NO: 16567 - DNA, 378 bp, A.fumigatus
gttctcaagcagtgtctccttcacgtcctgctttttcgatctcatcctcagatcctcttcaactcgactcggtttgttcaaggcttcaagatgcgcgaactaaatccgctggtgtctgaggtacaacatgacaaacaccgtcccagagaagcagaggctttgctgatgctccggaaaattgcttccctagttaaaccgattatgcgtcagagggcttggagagtagggacactgtgtgaattctacccacagcaacgaaatctcttgggcttgaatatcaatgcaggccagaaaatatgtctccgtttacggtacccctccgacgagcgtcaattcctacctttggagcaggtagttgatacgatgctgcatgagtaa

SEQ ID NO: 16568 - DNA, 225 bp, A.fumigatus
catacattccctcattacacaaccgcaatggccgatgcccggcgtacctccccatacctgccagctaagcggtcttatcctgattccgtctcccatttatacaacgggcccggttgccactattccaccgtcaacctgggccgataccatcaatactcgactcctttctcctatactgaccactcagatcttcctgcctcttcttacacttcgcaacaccaatag

SEQ ID NO: 16569 - DNA, 855 bp, A.fumigatus
gacacatcactcattcctggtactaacactactaacaccatgattctattacaactccttctctttccgagcttgctttcccattccctcgcggccgtcctcccgcgacacagtcaacgcatcctcaacccagcggccgacgaccttaccaagatctttactttctccaacgatttccccgcgccgaacagtggcaacctacaggtgcacgaccccaacatcatcgaggaacaagacacgctctacctattcagaggaggcctccacatcccctactggaaggcttctagcatctcgggaccatggacaaaagtgggtactgtactgagtaaagccagcgtgattagcaaaaagaacaacaatcatccctgggctcccaccgtcaccaaatacaaagggagattctactgcttatacgccatcagccagaccggtagccaggatagcgccattggatatgcctccacgtcggacctcgaaaaggagtggacagaccacggcgcgttgatcaacaccggttccggcgaacgttcccagattgcaccgggcaagaacaccaacgccattgatcctgcgttccaggttgaccagaagaccggaaaaccgtatctcatctacgggagctactgggatgatatctacagcctgccgctgcaggtgaaccaggacggcacgttggcgatcaagaacgagaacaaacccgatgcaacgcacctgagctaccagcctgggaactggcgcccgcaggagggagcgtacatgtcgtaccacgagccgtattactatctctggttcagccaggggatctgttgccagatggttcagaaagggtttccgctcaaaggggaggagtaa

SEQ ID NO: 16570 - DNA, 261 bp, A.fumigatus
catttgacttcccgcgggactgacgcgcccttcagatatcggattcgcgtcggtcggtcgaagagcattaccggtccgtttgtggataggtccggcaagaagcttctcgagggacatggagagacggtttacgggtcgaacaacgggaatgtctacgccccgggtggtgagggtgtattgccgggcaatggcaagcgaggtgatatcctctactatcacttttgtgagtcttttccgatcccgatgggcctcagtggctga

SEQ ID NO: 16571 - DNA, 2691 bp, A.fumigatus
ggactgacagagtacccagaccttgcttacggacgtgaagccaaacttttgtgcaagaaaattgtcgctttcttcgctttgctatccaagacccaggaagctggggtacggaaactaggtgtcacgcaagaactcctatcattagtcactggtcttgcccactaccttaagctcctcatccgcatcgggcttcaaggcgctctgaagctggagagggagaaggagagtcccgaaggcttgtatcatttcctcaatcacttggcagatattgagacactccggcctccggagcaagaagaatcacctgcagatctcatggctggagtagcgagtcttgctgatcagctttctgattgctgcgcagcttgtaaagaaccaattgacgatgagtgtgtcatgctgggtgaatccaggtggcacatcaagccacctcatcttacgtgtgcagcatgtcaaacggaccttaccgatacttgtcaagaggccctctggagtcctaggattaaaaaggttttctgcaataattgcgcctcgcagcaaggtcttgcgaacgagactcaaggtggctttactcgtgtgagcaaattaaagcagtttgtcttcctgttacgggttgcactcgcgcgccttcttgctgttttgcacgctggaggaaccttgcaacccacttcaggtatgttattccgtcgcaatgctaatactggtcagttatgggttaacacttttcttcctctagatgacccgagcttcgctgggagtgagactcaagatggtaaccaaactcaatctggcggtaatattcacaggtccacgacaaggtcgaagtatgcgggcagagatggtgctgctgaatcatcgcttgagcagactgtgggcgagatgcgacgcttgcggtccattcgaaacgagcgtactctgtcgactacatacaagcgagctagggcatcaagaattatcgacggtcccgaaggtcgaagtgttaggcccggctcttccggcggtgaaggttccgatgctcgtggccatggctttcaaattgtagaggaaagagatgcaaatggcgagactgtcaccgacctgacattcggtaaccaggacgctttgacattggacgatattcccaggatcgtggccgccgagcaagcaaaagaacaacgtcccaacgcttacagacatgccggcactaaactcgtaggtacgactgagccgcttcctaggtacaatcaaggccatcaacgtggtgtatctagcggcaacttggaatctcacctcgcagagagaaccaccaagactaagaagtacttctctgaactctcagctctcgaatattttatcgtacggcatgtcgctgtcttgtccatggagcctttgctggagggctacttcacgttggatgagttactctccttgattgagtctcgcaagccaacgatttggaacatattcggtcgcgccttcaacaaagatgcaaagaaggctggcaagaagaagggtgtgttcggcgtgagcctcgacttcctggtcgaaaaggagggcacagaatccactcatggcgtcggacccggcgctcttcgcgttcctgctctggttgatgatgcagtatcggcgatgcggcaaatggatatgtctgtggaaggtgtttttcgaaagaatggtaatattcgacggctgaaggagatctccgagctgatcgacaataagtacgatcaggttgatctcacaaaggagactcctgtgcagattgcggctttgttgaagaagttcctccgcgagatgcctgacccgcttttgactttcaaactccataacctatttgttatctctcagagtaagttgagctcccgcatcccagattcaaagcctctgctaacgtcaccatttacagaaatacctgaccccgaaaagcaaaagcggttactgcacctcacgtgctgtctgctgcccaaggctcatcgggatactatggaagtcctcttcgcctttctaaattggacgtcgtctttctcgcatgtggacgaggatacgggtagcaagatggatatccacaaccttgcaactgtcataacacctaacatcctctatccaaataccaaaaatagcacagttgacgaaagtttcttagcaatcgaggctgtcaatgctcttatcacttacaacgacactatgtgcgaggtaaatccttccacaacccaatgcccagtggaccaactcgctgactgtctcattaagataccggaagatcttcaggctgttctcagcgacaccacattcttcaaggataacaacgaagtcagcacaaaggaaattctgaagagatatggtgacattgcgcgaggaagcttctctccaaaacccaataacggcggagaaactgtgacaatcacaaatcctcataaccgaggagccaatactcctacgtctgcgcgcattgagacagaccagtctcaggacggaccatggcaggcgcaaaaccctgtacgccacgtgcaaaacacaggtggtcacaaccacgcaagcagtgcatcggcgccttacaatggaatggaacttgcgcctggacagtccgccagctaccgtgaacgaagcaccagcaacggcagccaacaaaatcccattccacaggagggacaaccccaacagatgccttacaggtctcgtccaggagcgggacccatgggagttgctggttga

SEQ ID NO: 16572 - DNA, 582 bp, A.fumigatus
tggaacgtggatgccccagcgcctggtgaagacccgacagtttgtggcgcccaagactcctattatgaacatgaaggcagggtttactgtcatttccactattccacccagtttgcccagagatgccacgggtgtcatacagctattctgaagcagtttgtggagattttccgcaatggtcaaaatcagcattggcacccagagtgctatatgattcataaattctggaatgtgcgcctagctccaaatggccagcccctggagcatcctgaggctggtctcgatgccactgacgaggaacgcaatagagtgcgagaagaggaagatatgatggaggagaaggtttacaagatctggagcattctttctggtttcgaagagtcttcagctgcctgcatctcggatatgctactacacgtcagcaatggctcctatctggatggagtcttagtcgctaaaagattcattggtcacgtcgaagttcttttccgagccatcgatgaacttgccggatacatcaaggcgcaagagatgaagggtaagtaccgccttgccaggacagaaaatgaagttgaggactga

SEQ ID NO: 16573 - DNA, 891 bp, A.fumigatus
agactcttccagtggttcctctccccgcggtatgcggcttcgaagaccagcatgggagccgattcgaaaacccgcaagcaggaaattgaggactggtctaatgacatctatcggcctggccctcgccttgctgaccaacacttgcctgaccgtcctaataagcgagccagtttcttaccaaccacatcacgattctccagtccctatactgtgagcaacggaggcaagcaaaagcctcagtatattacaatggccagtcagaactcaacctcccggctactcccaagcactgccggttccatgtacaaacagagccacaacagtagtggtggctcattgcatctcgagccatcgcgtctgaaccccgctgcgagtggtaccagcctcgccgtcggggcggagtccgatgtccttgggtcatctgcttacattcacgaagcggttgtcccgcaacctccccctgaatggcagccgtacggatttcctcttgctcatgccctgtgcttggtcacttgctactctgaaggcgaagagggtatccgcaccacgctggactctattgccatgaccgattaccccaacagtcacaagactatcatcgttatttgtgatggtattatcaagggcaagggtgaagaatactccacgccggacattgtccttcgcatgatgcgagatcccgtcattcccacggatgaggttgaggcattctcctatgtggctgttgccaccggttccaagcgtcacaacatggcgaaagtgtattctgggttctacgactacggcgagacctccgtcattcccccggagaagcagcagcgtgtacccatgatgatcgtcgtgaagtgcggtacaccagctgaggcaactcaggccaaagcctggaaatag

SEQ ID NO: 16574 - DNA, 186 bp, A.fumigatus
ccagaacgaggcataacagccgttgtctcattatttatccaccggttgccttcggcttccgtgtcttatgacattgctcgtgcttacgggctgagcgaaactattgcctttttacgtacatacccacatacaaactgcgacaccgcccctcaccattttgagatcaatcatctccctcgttactag

SEQ ID NO: 16575 - DNA, 1260 bp, A.fumigatus
agtgcggtacaccagctgaggcaactcaggccaaagcctggaaataggggcaagagagacagtcaaatcattctcatgtctttcctgcaaaaagtcatgttcgacgagagaatgacagaattggagtatgaaatgttcaacgggctctggaatgtgaccgggataccgccagacttctatgaagtcgtcctcatggttgacgcagacactaaagttttccccgacagtttgactcatatgatttctgccatggtgaaggatccagatgtcatgggcttgtgcggtgagaccaagatcgccaacaagacagacagctgggtgacgatgattcaggtcttcgagtatgtgtttcccttcttgttacatttgtcgtcctttggtttatccctttcttttatttccctctctaataaaacttgcagatacttcatttcgcatcatcagtccaaggctttcgagtcggtttttggtggtgtgacctgtctgcctggctgtttctgtatgtaccgcatcaaggcgcccaagggaggccagaattattgggttcccattcttgccaatcccgatgtggtggaacactactctgaaaacgttgtggacactttgcacagaaagaacctgcttcttctgggtgaagatcgttacctgtcaactttgatgctacggactttccccaagcggaagcagatttttgtgccccaggctgtgtgtaagactgtggtgccagacaagttcatggtgcttctctctcaacggcgtcgctggattaacagtactgtccacaacctcatggaactcgtgctcgtccgggatctttgcggtacattttgcttcagtatgcagttcgtcgtcttcatcgagttggtcggcaccctcgtccttccagcggccatcgcatttacattctatgtcgtcatcatttccatcatcaagaaaccggttcaaattatccctctggtactactcgcgctcatcctgggtctgccgggtgtgctcatcgtcgtgactgcgcatcgcctggtttacgtgttgtggatgtttatctatctcctttcactacccatctggaactttgtccttccaacgtatgcctactggaagtttgacgacttcagctggggagatactcgtaagacggcgggagaacaggacaagggccatgaagccggggagggagagttcgatagcagcaaaatcacgatgaagcgttggcgagactttgaaagaggtatgatgctttcgactccctatgaacgatga

SEQ ID NO: 16576 - DNA, 1197 bp, A.fumigatus
  unsure (1178): Identity of nucleotide sequences at the above locations are unknown.
tccccaacaaggaacaacgtggtcggttatctctccgtttgtacaacgcttggtgcggtttggtgcctatcaatctcaacttggaataatactctctgcgatctcttggctttatcggctgcgacctggctcgattatccctcggtggcttgcgccagcctgcgtctcgggaagaagcaatctgtgtacaaccaagggatgcccggtccaagtgactttgcatttacaacgtcagcatcgtcatcgccgtcttattttttcacgtcgccttccgaacatcctacgcatccccgttatcgtaatcggacatctcacgcctcgtcatgtgatgcgcctgggccatcacgactgcgacctgtggatatgtcgttcggacaggcctccttttatgatgaccaggactccgacgagatgtctagggaaggggatgagcatgctgctttgcgcacggatattgacgagtttccaatagtagcaacaatatcagaatctcaccaggtcggcttgactccaacaaatgacctgggatcgagcgacgcgggtatttccgccttcaccgctgtatctcaatacccgaacgctttcgacaatgactcgaatgctttcgccgtcacagaagtcgttaacgccgtcatcggacgggaagagtatctccgaggagagggaaggcacgttcgagcagcgtcagtcggccgctcgtcgtctccgccagcggatctgtatatgtctgattcagaaacaactgatgttctgggtcatcaaggtggagtgcccatcggaccatacatggccgatggcggaatgaccatggataatatcctggccgacgatccaaccctcgaacaccacttttctaccattcccgaagaaagcgacgaggacgatgtgggcgatttgatcatggactacgagtcaccgatgacgcgagacgggtttagcgtctccgaccatgaagaggaccccgacgatacgcaaaagttttatgtggatcatgacgatgactattacgaagagcacatcgatcgtccacgaacgcgtgaagctaccgcacagctcacggatgtcgacttcaacgatttctaccgggcgttcgactatgatccgtttctggtgatggaagcagcccctaccggtaaccacggcgatcacaacaagtcttcaccacggggctggaagcnaccgcggtcttttctataa

SEQ ID NO: 16577 - DNA, 597 bp, A.fumigatus
tgtctgatgtctagagatgtcgacgtgcgacaggagatcctgcataagacgctccaagaagtagcgcaagaggacaatggcgatgagctggctaacccgtgcgtcatctgcctagaggcaatcacagaaccagctgtcacggtgccttgcgcgcatgcgaatttcgactttttatgtatcgtgagctggctggaacagcgccgtaactgtccgttatgtatgcctccctatctctgcaatcgaccctcgctttcggttcactttgtactaacattcctaggcaagagtgatgttcacactgtcaagtacgagcttgagaacccccaaggtccgaagctttacaaactacctgctgttcctccatccgctgcaaatgcgcctgactctacatctcaacaccgagggctgttatcccgtggtcctcgccaccgacgtcagcccgcagaaagcccacgaccccgagagccggacgatcccattatacggcggcaatatgtctaccgtcatcagctttactcactaagagtcggctcgaacagactctcccagtaccgcgaactatcaccagaatcgttcaatcgtgacgaggagctggtc

SEQ ID NO: 16578 - DNA, 243 bp, A.fumigatus
gcaagagtgatgttcacactgtcaagtacgagcttgagaacccccaaggtccgaagctttacaaactacctgctgttcctccatccgctgcaaatgcgcctgactctacatctcaacaccgagggctgttatcccgtggtcctcgccaccgacgtcagcccgcagaaagcccacgaccccgagagccggacgatcccattatacggcggcaatatgtctaccgtcatcagctttactcactaa

SEQ ID NO: 16579 - DNA, 207 bp, A.fumigatus
accttttttgtccgtacaatctcaactcgtttcattcccccgatttgtggattcccctatattagtgccatgtggctaactagacccctcttgactcttaaccagaaccaatttacgggtaggggaaatgagttcatctcgttaaggaacgagtataaccccaaactttggctaaagtctcaggccgcactcaattactcgaactag

SEQ ID NO: 16580 - DNA, 333 bp, A.fumigatus
acagattgtgtgactcgaaatgtcttgtatggtttggtatggttcgctgactggccgcaggttcggctggtcgagctgagtatggagcagaaggacgccctcacagtacttctgacgggccgaagtgagaatggcttcgcggatattattcggcgcatggtgggcagcaaaaagctggagtttgacctcatctgtctcaagcctgaagtggggcccaacagcgaacgcttttcaaccaccatggagttcaagcagaccttccttcaagacctcgttctcacttatgagcaggccgacgagattagggtctatgaagatcgagtgaaacagtaa

SEQ ID NO: 16581 - DNA, 246 bp, A.fumigatus
gagacaaatacgatctatttcttcaatgcgctcggctttaatacaggctcttcgccttcgggtcatattctcgtcgattttagccccagacggcctaatcagcatgcttccggactgaggtccccttccttaccggctgatttccgtctccaagggactccacgatttgtgggcgattcctctagttctacttggcgatttatccagaatctgcggggacttcaaatacatggagcgtcctcgtaa

SEQ ID NO: 16582 - DNA, 1134 bp, A.fumigatus
aacagtaagccttctgtcagacgtccttgcctcagagattactcattcggcgctagtgtcaagggctttcgagacttcttcgaggatttgaacaggtcgctgcaggttgtaccagcaccgcggaagccgatcaatgcagaggtgattcaggtcgcggaaggatgtaccttcctatcccctgtagttgaaactgccgaggtacagcgtatgatcaattctcacaataagtcaatccgccaagctacatcgaatgcaacccaatcgccatatggtcgtctgcgcatcaagcgcaccatcttttacactggatatttaatatctaacgcagactcgaatcagttgatcagccagctactgaccccgcttctgccctctgggcttgctgaatccaatgatctgaaatacatggctaacagtatcctcattaccccgcgccctgccccccgatctattttgaacaaggtcggcggcattggcaagaagctcacatggcaggtcactgggactgctgtctttgagaacaaggtgtgggctgctcgagtggcccctgttcccgcgacggagaagtactacacagagaacccactgcccgtgatagttctagctgtgcgcaaaggcgcgcgtcctatcgatgcaggcaagatccagaactggcatcctgtaccagcagaaaaagctctgacttttgaaactgttgtcggtgaaaaagttgttttgcgtgtggaagaagagaatccccatgagggcgaatgggagagtcagtttttgaacaagaaccgcaagagacgccatcagcaagaacgtgatcaggacatcctgtatccgcaatcctgtcagaatgatgagccgctatcccagacaaggccacagccatactataattcccgtcatggtgggagcagccgccatcatgatgacggactgcgacgtggtggctcgcaccgcagtggtcgcggccggggaggagcgccacgtggtaagggccactcaagccgaggaggcacgcgtggtcgggcccgtggacgcgatggcggtcctgctggctatcgatccttggacgatcacgttggatatgatggcggttacgaagacaagcctggaccgggtggtgctggacccgtcatgaactactaa

SEQ ID NO: 16583 - DNA, 1146 bp, A.fumigatus
  unsure (1036): Identity of nucleotide sequences at the above locations are unknown.
aggttcattggtgaggtgtcactttactgtcgaacaatacttctcccgaatagggaactgtcaatccgacgcctttccttttgcttcaatacaagacgatggtatgagaatccatcaattaacataatagagatgatgatgcgatccttcgtccttgggagtattgtccctactgtgctcggactcgtgccgcatcatgtttctgtggccaatgaaaagacttctctcacgctcctctatcagaacaatctgaatgcatcggacgcctcaaaccacatcagtgcaatcctacttgacccaatgcaccagcatgatgtgcgtgaagcatgtcagcaatttggagagacgctgatctcccaaacaagccttcgtgaccacaaagaagatttcaaaaatctgtttacatggcttgcacacacagggaaaacgaagtcggacgcacacttttatattcgtgaaggcgtgctttctgttcccaaagactcggatgattttgctgtctccagctttccacgtcagaatgcaaggcttcccgttttgtgcacccagaccggcaacgactccgtgattgaggacgcagatagtcgcccgaagcagctgcgagtaatatccgaaggcaactcgtatattggtttccgtgatcaaaagtcgtttcgcttcttaggtattccatatgctgaccctcctgggcgcttcaagcacgcaataccctattcgcatagagaccaaaccatccacgcgaccaagtacggttctgcatgtgctcagagcggtggcggcagtgaagactgtctgtacctgaacattcagaccccatacataccgaagaagggttcgcaagagggcctgaagcctgtcatgttctggattcatggtggtggctttactggaggaaccggtgcagatccgcttacggacggtggtaacctggcatcacgcgaggatcttgtggttgtcacattcaactatcggctgtcgacactgggatttctggctattcctgggactgatattaccggaaactatgggatctcanaccagattcttgcccttgaggtactattcccacttctccatatagatgcctctgagactaacataacagtgacaggggactataaaagatatcgcgccaattcgaagtga

SEQ ID NO: 16584 - DNA, 1458 bp, A.fumigatus
ttgcatccattgcttcagcatctggatattcatctttccctcttcccgaaaaagaaggccttttttctaccgatatttattcctgctcccttatcctgcttcagacagtcctcaacctgccatcgtaagatgtctatcctgtccgatgcaattgtcgtggtcgccgtcgtcagccctatgttcatatcagccgtcaaatcgatcttagaatatcttgcttgcgccaatatctatatttcgaaggcttttagatggatgtctgctttcaagcttgacggtatcttgaaaaagcttgatctgtggcgggaactgcacacatcaaacgtgaaaccattctctgcttctacgccggtgcctgagttcgataatgcgtgcttagggaccgataatctccaccacaaaaaccacacattctttgatctggatttgggtgatctgggctcactatggctcggtcgaatcagtcagaatctggttcccacctcgggccatcttaacaatggaccaactttcgggagccttcacagtgaagttttgctgctcaactggcaagttttgcttttcatgatgatttttctgttgatcataccagcagtaacatcaatatgcacttggtattctcgcaggcactgcttccaagtagcgaacattgagattctagatttcattaacgaagtgcgttcctggagagagtttctatttaaaagaatgagcgctgctgtttcaatactgaacggcaaaattgacagcatgataaagcagatcgtgatggaacatgagcgagtttcagctgaactacccaccttccttgatgctgaagtcagagaactacgagatgctctcgacacccaattccagaacgaagatgaccaccatatcctgggagtgaagaattctgcggacaacttggaacgtgcacgacgaagatttccagatcctggaggcattgaagcagaatgcaagggtttgcagtctgtcttccaacgctggagacagcgaatgggcaactttctcgagcacgccagttccgaggctgaaaggagtgataatatacagatccctgtcaagcgtatcatggagctcccagagaaagcaccgaccactcaggctactcagactaaatatgaggccatgcaagacaaagtggacaaaaacgaacctgcaagccttactgtgagcgaaaagcaatgctcagaagctgaggagccaatctcgacaatggggctgtgggcaacagcgtctgggtaccctgcacccacaccagcggaaatcgaagaaggacggagaattcggcgtgagagagtcgcaaaacgtttgacagagaacaatggtcagcgatatgtgagaagcgagtctgggcccagaaagcacagatgcttgttccgaaacaggcttcatgggttgcacaagcaagaccacgcagcggctcgccagtccctcaaccttaccttgcactag

SEQ ID NO: 16585 - DNA, 201 bp, A.fumigatus
cagattataaagtgcatcattaattgctggacaggcaatatgactgatcctcgcccctaccatcttcttaggtacagaatccctggttatcaggatgtgaacatgtcgctgacttcgggcgcaagctacggtaccctattgggtgtgcaagtgtcccaggtgaacttcattctgccagctagatatccactacgctgttaa

SEQ ID NO: 16586 - DNA, 300 bp, A.fumigatus
tggcaagaagagctacgaccctgcaccccactcaaaggagatgatggctctgaacaagaaattcggcagacttcatggtctgtcaagtctgatcaacatggtcagccttattgctacagtctattacggtgtagttctcagcaagcgcttgtcttgaagggctctctgaatggaacatttctgttgatcgctaatctcaggattgcttaccagtctatcaagctcttcctttatgtccttaacgctctgtatatatcgttccaacaaggtgaccatacatcaacccgtctgcaagtataa

SEQ ID NO: 16587 - DNA, 192 bp, A.fumigatus
agcatcttgatcatggctgaaaaggaagcaaccgtctatatcgtggatgtagggaaatccatgggagagaagcgcaatggccgatcaatgacggatctagagtgggccatgcagtatgtttgggattgcatcacagcaactgtgagcatagcattgagcatgagaggctatggtcgtgaggctaattgttga

SEQ ID NO: 16588 - DNA, 450 bp, A.fumigatus
gacaaggacacagagcaccccggctttgtccccagaactcgacttgttttgttcgtgtcgcgcagatggggatgcctacgtcatgtgatcgaatctgcttacgtaatgcatcgtcctggacggtccacggcggctttgaattgcatcaccaaagacaaaagctgcagaggatcagttgtaggatcagaccaaaaaatgccgtcaacaagggtcagacctattgagaagtttgcgaaagctgcttctaagtgctctgcagaggtatgttcatgttctccgtgttgcttgtactgtcggtgtctaatcagtcctcaggcagccacatatggcaaatgcattgttgctgactacaatgcagtgcacaaggacatgtgtgctaaggagtttatgaagctaaaagattgctttttggtatgctgtttggaacctatggttgatgcagcctactga

SEQ ID NO: 16589 - DNA, 741 bp, A.fumigatus
actttggcagctggccaggatccagcggtccatcacgttagtattggtagcttcagccttggggtcgaagacaaagtcaatgctattgttcttcttgaacagagcggcctgaccctcgaagaacttgtagctgttccacaaagggaggagaaccttggcaacgatctccttcacaccagactccttgaatctgagcggctccgcacgcacaacgggagagttgatcaaatagagtcgaagggcatcggaaccgtagcgctgcatgatcaacgtcggatcagggtagttcttcaatcttttcgacatcttctttccatcttcagcaagaacaattccgttcacaacgcagttcttgaagggcaaagtgccgaagagatgtgttcccaggacagtcaaagtgtagaaccaaccacgcgtctgatcgagaccctcggcaatgaaatcaccggggaagctcttctcaaattgctccttgttctcaaagggataatgctgggatgcgtatggcatgctacccgattcgaaccagcagtcaaacacctcgctgacacgtcggaggacacccttgccttgcttacttgggatagtgatcttgtccaccttgtcacgatgaaggtcagtgatttctccttcgtagccactcagctgcttgagctcctcgacacttcctacagccacgacttccttgaagtcgtcgctgacccacaacggaagtggtgttccccagaagcggtttcttga

SEQ ID NO: 16590 - DNA, 204 bp, A.fumigatus
gtacgaaatcgacaagaaactcggcatgtgggcttggaggctgtcgaaaaactcggcatcgaaaagtacaatgaggagtgcagagctattgtcatgagattcgcatctgaatggcgcgagactattgagagactcggccgctggattgactttgacaatgactataaggcacgttaccctccgtgcgaatatatatcggtttga

SEQ ID NO: 16591 - DNA, 471 bp, A.fumigatus
agaagtttgttgctaaaaagaagatgcttgttgacggcatcgagctcgtcgaagggtgaccttgtcgtaaagcgtggtctcaaagaagatgttgcatctgagggaatggaacctaacgctgatgctgatgtgctaaccatccttgacgccaacctataccccgaattggctcaacaaggattaggtcgagagatcatcaaccgtcttcagcgtctgcgtaagaaggccggtttggtccctactgatgacgtgagaatggaatatgccgttctctcggatcccgacagtgttggtatcgacgaggctttcaagacacaagccaaggccattgaaaaggctgtccgcaggcccctggaacaggttgccgtggttgatggcaaggtccccagcggagacaaggaagctcttatcatggaggaggagcaggaagttcaaaaggcaactttcctgttgcggttgctgaagctgtag

SEQ ID NO: 16592 - DNA, 471 bp, A.fumigatus
gtcattgccgccctacatttatcgtctttttttatctaccccgcgacccatccctcgctcccggccacagatcgcaccgacagccattatctgacgactgtcccctcgcccgtcatgtccattgattttccggctgaggaagagatcaccctcaagaggtggagggagatcaatgcctttggcaggcaagtcgagctatctcgtggtcgcaagccatacactttctacgatggccctccattcgcaacgggtcttcctcactatggtcacttgctcgcctcgactatcaaggatattattcctcgatactggtcgatgaagggttactatgtcgagagacggttcggttgggatacacacggtgtccccattgagtacgaaatcgacaagaaactcggcatgtgggcttggaggctgtcgaaaaactcggcatcgaaaagtacaatgaggagtgcagagctattgtcatga

SEQ ID NO: 16593 - DNA, 2328 bp, A.fumigatus
accatgaactccagtttcatggaatctgtatggtgggttttcaagcagctgttcgacaagggacttgtctaccgtggctaccgtgtcatgccttactcgaccgcactcaatacccccttgagtaacttcgaagcgcaacaaaactacaaagatgtgcaggaccctgcagtagttgtatcattccctctggtagatgaccctgagacctgccttctcgcatggacgaccacgccctggactctgccttctaacgtcgccctcgccgtcaaccctggtttcgagtacatcaagattctcgatgaagcctccaagaagcactacatcctcctcgaatcactccttcgcacactctacaaggaccctaagaaggccaagtttaagatcgtggatcgcttcaagggtgtggacatgaaggactggaaataccagccactcttcgattacttctacgaggagttcaaggaccacggtttccgtgtgataaatggggattatgtctccgctgaggatggtaccggtatcgtccaccagtcgccggctttcggtgaggaggattacaacgttgctatggcaagcggtgttatcagtgaaacacgtctgccacccaatcctgtcgatgagaagggctgcttcaccgcggaagttcctgattttgttggtcagcatgtcaaggctgccgataaggccatcatcaagcatctcaagggcaccggccgtctgattgtcgacagccagattactcacagctatccgttctgctggcgttctgatactcctcttatctaccgcgctgtgccctcttggtttgttaagattggccccatcattccccaaatgcttcagggtattgaagagtcgcactgggtgccttctttcgtcaaagagaggcgtttcgccagctggattcagaatgctcgggattggaacatctcaagaaaccgcttctggggaacaccacttccgttgtgggtcagcgacgacttcaaggaagtcgtggctgtaggaagtgtcgaggagctcaagcagctgagtggctacgaaggagaaatcactgaccttcatcgtgacaaggtggacaagatcactatcccaagtaagcaaggcaagggtgtcctccgacgtgtcagcgaggtgtttgactgctggttcgaatcgggtagcatgccatacgcatcccagcattatccctttgagaacaaggagcaatttgagaagagcttccccggtgatttcattgccgagggtctcgatcagacgcgtggttggttctacactttgactgtcctgggaacacatctcttcggcactttgcccttcaagaactgcgttgtgaacggaattgttcttgctgaagatggaaagaagatgtcgaaaagattgaagaactaccctgatccgacgttgatcatgcagcgctacggttccgatgcccttcgactctatttgatcaactctcccgttgtgcgtgcggagccgctcagattcaaggagtctggtgtgaaggagatcgttgccaaggttctcctccctttgtggaacagctacaagttcttcgagggtcaggccgctctgttcaagaagaacaatagcattgactttgtcttcgaccccaaggctgaagctaccaatactaacgtgatggaccgctggatcctggccagctgccaaagtttattgaagttcgtgaacgaggagatggctggataccgtttgtacacagtagttcctcggttgctcgagttgattgacaacacaaccaactggtacatcagattcaaccgcaagcgtctcaagggcgagaacggcattgatgatactctgcatgcgctgaacaccctcttcgaggttctctataccctagtcagaggtctcgctcccttcacaccattcatcaccgacaccatctatcagaagctgcttccccacatcccccaggcactccgtggcgaagacagccggagtgtgcacttcctttccttccccgaggtgcgcgaggaactgttcgatgaggttgttgaacgacgggtggcacggatgcagaaggtcatcgagatggcccgtgtctcccgtgagcgtcgctccatcggcttgaaatcgcctctgaagacgttggttgtgattcaccaggatcagcaatacttggacgatgtgaagtctttggaaggctacatcctggaggagttgaacatacttgagcttgttttgtcgtccgatgaggccaagtacaatgttcagtacagcgttagtgcggattggcctaccctgggaaagaagctgaagaaggacgcccagaaggtgaagaaggccattgccatccctcacgagtga

SEQ ID NO: 16594 - DNA, 333 bp, A.fumigatus
gcattcgtctcgtcctgtttcagactcttgctaattgcttgttctgttgtttcatacaagactcccatcatggacccctcacaagtcaagatcccccccatgaaagacctcacggtcgacaatatcactgaaaacgtcatccggatcaattccctctgcgaagatgaacgcatgaaatacgtcctcgagcgtctcgtcacgcatctccacgacttcgcccgggagactcgactcagctcccaggaatggatggcgggacttaccttcttgaaggaggtgggccagatctcttctgatgtgcgacaggtacgtatctccccagcactcttgtaa

SEQ ID NO: 16595 - DNA, 612 bp, A.fumigatus
tatgaacacatggggaaccaaccgcaagggtggaaaacaaaggaattcatcctcctctccgacgtcctcggcctctccatcctcgtcgactcgatcgaccaccccaaaccccccggctcaaccgaaggcaccgtcctcggccccttccacactcacgaagccgaagagatcacccagggcggcctgatgtcgcacgatcccaagggcgagccgctccttgtcgtctgcaccatcaaggacacaaacggcaagcccatcgagggcgtcaagatcgatatctgggagaccgactcgacgggccactacgacgtgcagtatcccggccgcgacgggcccgacgggcgctgcatcatgcgcagcgacaaggacggcgtcttctggtttaatgcgatcacgcccgtgccgtatccgatcccgcacgatgggccggtgggtaagcttttgaagaagctgcatcggcatccgtatcgcccctcgcatatgcatttcatgttcgagaaggaggggtatgatcatttgattacgtacgtttgcgctcttcttcccgcttctctatccgcagagcgaaacggggctaacgaaatgaggcagagctctttacctccgaaatga

SEQ ID NO: 16596 - DNA, 276 bp, A.fumigatus
ggcagagctctttacctccgaaatgacccctacgagacctccgacgctgtcttcggcgtcaaggactccctcgtcgtggacctcggcaaggcgggccccgaatacgcaaagaagtataacgtgcccgaggaccgcgccctgctcacttacgatttcgtcctcgtcaccgatcaggaaaccgctgatctgcgcgcaaagaactccaaggaggcgctggataaattgggccggaaggttcgcatcgtcaatgggttaccggtgccggacctggattga

SEQ ID NO: 16597 - DNA, 705 bp, A.fumigatus
ttcactggaccacacacgttgcacagcttcatggagtccagaaccccagcggcggcagagccgtccaacaaacggcccaggtcgccgtccggcgactaccatccgattgcttccaaagtccccaagagccattcgaaccatctccagattaactacctcgctcgtcagtacccggacaatctgcctctagtctctctcgatgatactatgccagcgattctacatctagtcggcgaatatgacggcgtacttcatcgccacgaaagtatcgcgggtaacctcggcgcatgtcctctgggacccatcttgatcaagcgtttcgagcgcctgtttgacggccctcctcgtgtactcaagtcgcatggtaaagaaccgcctaacatcacctggttggatgtcgtcgaatttgccaagagcaagccggaacagtttaatctggagaagtcgcgcaatggagtgcgcgtctgccagttctataccaagcagtgtcgagttgaaatcagcgaggaagattatgtgcttattgcatccgggatgccacaaaagatgatccccccgcagccaatcatcgaggacgaggagaaagaattgggcgcactggagatcttggagaagaatttgcaacagattattcaagttgccgatcaaggtcggtccatgagttccttcaaatgcggtcatatgttctccttcagtggcatctga

SEQ ID NO: 16598 - DNA, 924 bp, A.fumigatus
tacacgcaatatgcggatgaccttctcagttactacctggatactgtcctatcagtcctcgagtcctctcctaccgctcgggagtctcttgcagaatcctactcgacctaccgtgccctgcggccccctaagccgtcgtacatgaatttcataatggaaaatactccagccgaaccctggtggcagtcgcggcttcggctgctgcaattgctcggcggagggagcagtagccagttctcatcgatgccatcaccatctaaactgacatattcaatccctgcggtgctcgcccggatcgaaccttttcagaatgaactcgtctctgagtcggtgatcctggatggcttgcagggccgccaccgggaggcactccgccttctcactcatgggcttggcgactatgactctgccgttcggtactgtctctttggcggaccgcgcagcaccagctcagcggggacggtcgaactccctgacaggtcacaccagtcggagctgtttcggtatcttctagacgaatttcttcagatccaggacgtgtccgaacggatagagcggaccagtgatctcctggcacggttcgctgcttggttcgacatcaaagatgtcctgcagctgatccccgatgattggagcgtggatatcctcagcggattcttggcgcatgtcttccgggtcctggtatcgcagacgcgagaagcgcggattgagcgggcgctcagcgcgagtttgaacttgcgtattggggcggagtatattgacggaatggagaaagtcggtggctgggtggaggacgactcgggggtgagaaggttgaaagatgcagcagctggtgatgccagcagcaatacagcagcggtgcaagtggccggcggcggaagtgacttcggggatatggtggaagcttcacaatccgggccgtga

SEQ ID NO: 16599 - DNA, 3249 bp, A.fumigatus
  unsure (1599): Identity of nucleotide sequences at the above locations are unknown.
aaccacgacctagtttggccgccggacagaacggcttatatggtaggtggcttatttcctttttgtttcgccttgcgcatcgcggcttaccatatctcaacagcggaggtctttgggaaaaaccagactggcgacactgttgctgccgaatggcttacccagtatcagaaggatgccaaggctgcgatgcatgccatgatcaactttatactcaagtgtgcagggaccgatttggaagtgagcgatgcggatattgatgatccagaccacgcaccagagcgcatcaatgacttgtcgaccgagtaccatgcgctagggatcttcgaatatcctctcatttccaaggcgcggacattcaaagcctttcaacccattctagaagacttctttgccgcgctcgtgcaaactctccaccattcttcagttctctataagcagcaggagctttacgaaaaccttcaaatatggttagctgccctgtccacttcgggttgtcggccattcagacatacctcgaccgtcatctccctcacgatcatgaacgccttgtgtgatgttgcacgagaagtgatgactactgtctctgcttcccgtaaacagctcgaggcggagaagaaaaagaagacggttaatcagggaagagtcaatgcgatcacttcgacagtcgaagaaggtgaaagcaagttggaagcaattgatgagtacctcaaagacggtgtcaatatcgtttttgtccaccgctaccgagatatcgaccccaaaattcgcagcgagtgcattgcagctctcgggcgctggatgcacacttatcgagaatactttttcgaaggccaattccttcgctattttggctggattctctccgacccgtctgctgagacacgctcaattgtcgtgacgcagctccagcgtctgtactctaacaaagataacattgctggtttaagatcgttcactgagcgctttcgccagcgcatggtggaaatggcagcccacgatgcggacgtcggcgtgcgcgcctcgtcgattgaactactcgatctcattcgggaggctggtctacttgagccagccgatattgacaccgttggtagactcgtattcgacgtggaaccccgtgtccgcagagctgccggtccgtttttcgtggccaatgtggaagatgttttcgagtccacaaccgaggaggtcggagacgagatgaatgagatgtttggcgacgaggatgaggatgactatgagtcgcccaagcgatcctggatcaagttcaagtgcctggttgatatccttcaagcctatgatgaacaggaaaacgagctggctcctgagcggaagtcgtccacggcgcgggatgcacttttcggcgcctccttagactcgcggtttgtacttgctacggaggccatctacccgcactttgcagagctctctcaatggcaatctctggccggcttcctcctctacgaccattctcagattcccgacgatcctactggggatagtgctactggcatggttaaaaaactatataagatgcaggaagggcaggaggttatccttcttgaagtcctctgttgtgcggttaaattacgcatcttngacgtcgccaagtcagacattgacaaaagaggtcgtaaagtgaaggctttgacagacaagattcccgagcttcaagaagagatcgcacatagtcttgcacagatcattcctcaattgttgaacaagtatggatcggttccggaagcggcgtctgctgttctccgacttgagcatctggtcgacttggacaagatccaggatctgcaaaaggatgccaccgcatacacttcattgctgaacgatattaacaagcagttcctcacgcactctgaccaggatgtgttggcagaggccggtgtagcctttttacacgcaaagagctctgatgacatgcgagaagctcttgagagtaaggtacaggagctatgggatgatataatagatgcccttgaggctctgtcacaaaagaaaggagtcgttgagggtagctctataccgatgccaaccctgaatgatcttgccaacacagcaatgagaattttgaacctggccagcgtgaccgactgcacacacgtacttgagaagaagccggcttctaaatccaagggcaggaagaaggaaaatcctgaagctcccttcaatgtgctcattcatttggtcaaacgtggtctgcgcgaggaagaggaagacgacgagtcagccaaggcggaaaccgagttggtgaccagcagtatacggacgctgctcttctacttcatgtggaaggtacaggccttaaccacggccttgagcgcaggaaaggcagctttcactacggcgtactttgaaactctgactaagagccgtgaggtgtttgttgctagtctagtagctgtcatgagacagcgcagtggtttggatgacattcgcttcacggcgactacaacactgctcgatctgcaaaccttgtttggcacacttcgtcacgctgggttgaacacagggaacgatgaggaggttattatgcaaacccagagcttggttcacgaaatcgattcaaatacacaggcactgattgctaagatacatggcatcgcggaacgcacatatgccaggaagttacgacagcctctcgagcctgcagaagacgacgagcctgcctctgagtcggacgttgagcgggagccttcagatgaggaggacgaaacaggagctgagggcgaatcgatagcgaacgagcgtctgcgcgccactattctagcggagcaacggctgtgcgagctgacgggtaaaatcgtgcttgccatcatagggcgcatcattgacgcctcgggctcggagcgcggacagttgaagcagcggctcgtccggcacaagtcacgcttaggccagaactaccgcgaggtgttgtctttccttgatgaacgcaaacctaaagttattgggccccggccgtctcgatcgaaaggcaaaccaccccccctgggaggcgcgcaacaggaccgggcgagtgctaccaagcttccaaaagtttccaaatcagctgagcgcatggacgacgacgatgaggaggaggatcacgaacctgacgtcgacgctgagcaagacgatgaagacgatcttcgcgcaagaggacttgtcgaggaggacaatgtcgacgaagaccatgaggaggaagacgataatcccacggcgccagatcccgatgaggatgaagtgatgggagattaa

SEQ ID NO: 16600 - DNA, 747 bp, A.fumigatus
tttatcctacagcgcgctatattatcacctataagaatggaaaatgagtcgcctctttcgagtcccgaacccgggctgaccgacctcgattcgccccaggcatcaattagaagaaagtccggacgtgtgtcgcgcaaacccgaatttctttctcaaagctacagtgattcaaacccaggcgcagccaagcgcaagcgtgacattacccgcgatgaagacgaggaggatgatgctgatgaggatgacgcgtcggaatcagaagaaatcagtgatggcgagccagacgaagaagaattgagggaaaagagacgcgcagcgcgcaaggcttccgcaaagaaagccacatccggtgtcaaaagcaagacgacaaagtctcaagcgacacatggtgcaaagaggcctagagtcgcgggcaatgggattccgaaccagctggcgattcgcccagctgtcaatggcaagaaaacagtgtcgcgccccaggaaggtgaaaccacgacctagtttggccgccggacagaacggcttatatggtaggtggcttatttcctttttgtttcgccttgcgcatcgcggcttaccatatctcaacagcggaggtctttgggaaaaaccagactggcgacactgttgctgccgaatggcttacccagtatcagaaggatgccaaggctgcgatgcatgccatgatcaactttatactcaagtgtgcagggaccgatttggaagtgagcgatgcggatattga

SEQ ID NO: 16601 - DNA, 189 bp, A.fumigatus
tcatttctataccattcactcacctctttaagatctcatagtggtgcctacttgagcacttcactattagagatcagttcaattgccccttctgacatccccatcctgcttctttcttccttcttcacctccctggtcatcatcaattctatcgtctcgcaagcttcgaacttgaatcgagcacactga

SEQ ID NO: 16602 - DNA, 462 bp, A.fumigatus
tacaatgacatcagacaagaagatggcttcaaaaacattatctttgctaaccgcatgatcgcagaaagtcaacgagccaggggcatacatatgatccatgaatcagagcgcaaagtattccaggagcaccgctttacagcatactacatttgggtagttctccatgagatcctggggcatggcacgagcaagctccttcaagaggactcccaggggcatttcaactttgacagagagcacccgccgttgaacccactcactggaaagccaattgacagttggtatggcccaggggaaacctggacaggggttttcacagatttatcaacaactgtggatgagtgtcgcgctgaactggctggtgcttatctgatcgacgttgctgagatcctgcagcttttcggatgcactgtagacagcaagatcaaacctgctgacggtaagagccccatgggtgcatag

SEQ ID NO: 16603 - DNA, 1086 bp, A.fumigatus
tacaacccgtggtggtgcattcagggaacaatgtcagctagctccgacgtgatgcccacggatggtggtcattcacagcaaaccgctccgccgcagcaattgaatcgttcctgcgaatcatgcagaggcctcaaagtgcgttgtatacctgacccaaccacagcgaaccaatgccagcgatgcacaaagaccggaagggtctgtatctttgtcgcaccccaaaggcggcggccacgaaagcgaactgattccagagttgctcaattggagagggaaatgcggcagatgcgttcactattgaaagaccgtctacatgcagacgacagcagtggagaaagcgtggatagcgaccacgacgaatcgccggaacatgattcgggcgtcgaatccaaagatcacctatcttcaatccctgaggcacccagcagtgtctcaacatcaaccaggcatacagaccagtcgtatggtggtgtcccactgtcgtcatatcccactgttgtcgagagcagctcggtctccattccctccttcacccctgggttcagcgataactcccctgaaatgccaataggagatgacgttatcgaccggggcgtgattcccttggaatacgccaatgagctggtggcattcttcatcagagatttgatggccttcgctcccgttgtcgtgctgcctcccgagactactgcctcgcacctgcgtcattctaagcctgtactctttctttccatcattgccgctgccgctatcgccgtagatgcgaccgtcgcagccgttcttaatcgagagctcgttcggctctatgctgaacgattcttcattcagggcgagaaatccttagaattagtccaggcattggtgctcatgacggtcttctactatccgcccgactctccaatgaaattgcagcactttcagtacacgcacattgcagctaccatggctttggaaattggtttggcctctaagcgtagagtatctccaaaagcaggcgggaagaaagacaagcggaatgcgtatgacgaacagatggcagaacaagccagagcgatattggagtgttaccatctggcttctacgtaa

SEQ ID NO: 16604 - DNA, 195 bp, A.fumigatus
gcggtctcgtccccagaggctctcctagacaaagccagacgccagaacgatagcatcaacgaggctctcaatgaccccgagcagaacacgaccggtgcacagtttgacaagagcaaatatccctctgaggcggtgtttgataagggtagcacgaccaaagtagcggttgatgttcctcctacgggaaggatgtga

SEQ ID NO: 16605 - DNA, 249 bp, A.fumigatus
aatagtatagtatctctaaggttagggataggggtagtagtagtagtaccctatattatagtattaataatatgctcttacctagtaattatctactataatatctctaactttactttaagttccctaatctgttactttaatataataactttcttaacttttacctatatagcctatttatatttctacttaacctttattacctcttctctgtataaggagttgctattatatattatcttttag

SEQ ID NO: 16606 - DNA, 216 bp, A.fumigatus
tactgtaatcctcgttcatccggtaaaacaacatccatcgctctctgttcttctgcccctgaccttgctttcttccaggattttaacttcctccgatggcacgtgtttctcatctatgtcggcttcaacttgatagcttttctggtcaacgccttctggaacagcattttatccgcgctgaatcgcgccacctgtaaagcttttctgtccaaatga

SEQ ID NO: 16607 - DNA, 441 bp, A.fumigatus
tctacgctcttgctaggtacggacaagtcaccagaatcagcctatcagcaactcttgcgagttaaatcttgtactaattgttcatgtagagactcaggactaccattctcccctatttggacgactgttcatgcccggctcaaaacgcccgtgaatgccctggttcttaatgcagcggcggttttctgctgcgggtgcatattccttggctcctccaggtacagtctactgctgcttgagccttgtcttagcaacctaaattttgtcgagcggccaacttattgtatcttccttctagtgcattcaacgcactcagcgctgcggccgtcatatgctttgatatatcgtattgccttccgattctcatccattgcctacgtggccgcaaactgctccctgcacgcccatggatcctccatcccgccattggatggattgtaa

SEQ ID NO: 16608 - DNA, 924 bp, A.fumigatus
tgcccgcgagaccattggtcagtttcgagcaacaccccccgaacaaatgaatcgcttgttgctaactacctcatcttttcaggccgtgtcgccgcaggagccattgcggagaagtacctacgcctgtcgcatggtgtcgaaattgtcgcctttgtgtcctccgttggtaacgaacaccttttcccgccgacccccgagcacccttctccatcgaccaaccctgagttcctgaagctcatcgagaccatcgaccgtaagactgtcgatgccttcgtccccactcgctgcccgaacgaggaggcggcggcacgcatgacaaaagtgatcgagactttccgggacaaccaagatagcatcggcggcaccgtcacctgcgtgatccgcaacgtccccgtcggcctgggcgagccttgcttcgacaagctcgaggccaagctggcgcacgccatgctcagcatccccgccaccaagggctttgagatcggctcgggcttcggtggctgcgaggtccccggctccatccacaacgaccccttcaccgtctccgaggtccagacccgcaccggcagcacacagcgcctgaccaccaagaccaacaactccggcggcatccagggcgggatctccaacggcgctcccatctatttccgcgttgccttcaagccccccgccaccatcggccaggctcagaccaccgcctcttacagcttcgaggagggcatcctcgaggccaagggccgccacgacccctgcgttacccctcgtgctgtccccatcgtcgaggccatgtccgccctcgtcgtcatggatgcgctcatggcccagtatgcccgcgaaagtgcaaagaatttactgcccccgctgcccagcaccctccctaccaaaccgactctcggctccagcggtgctcccgcctcttcatag

SEQ ID NO: 16609 - DNA, 594 bp, A.fumigatus
ccagtcttcgcttgcagctatggtgaatcccattgccgctctgtcggctgcatcgtcgatggctgccctccaggcatggagcttacagaggaagacatccaaccccagatgactcgaagacgtcccgggcagagtgctctaacgacgcctcgaaatgaaaaagaccgagtagagatccagtctggaacggagttcggcatcaccctgggtaccccgattggaatgatggtgcgcaacgaggatcagagacccaaggactacggtggcagcacaatggatctctaccctcgtcccagtcacgctgattatacttacctggagaaatacggtgtcaaggcgagcagcggtggtggccggagtagtgcccgcgagaccattggtcagtttcgagcaacaccccccgaacaaatgaatcgcttgttgctaactacctcatcttttcaggccgtgtcgccgcaggagccattgcggagaagtacctacgcctgtcgcatggtgtcgaaattgtcgcctttgtgtcctccgttggtaacgaacaccttttcccgccgacccccgagcacccttctccatcgaccaaccctgagttcctga

SEQ ID NO: 16610 - DNA, 732 bp, A.fumigatus
attctttgcactttcgcgggcatactgggccatgagcgcatccatgacgacgagggcggacatggcctcgacgatggggacagcacgaggggtaacgcaggggtcgtggcggcccttggcctcgaggatgccctcctcgaagctgtaagaggcggtggtctgagcctggccgatggtggcggggggcttgaaggcaacgcggaaatagatgggagcgccgttggagatcccgccctggatgccgccggagttgttggtcttggtggtcaggcgctgtgtgctgccggtgcgggtctggacctcggagacggtgaaggggtcgttgtggatggagccggggacctcgcagccaccgaagcccgagccgatctcaaagcccttggtggcggggatgctgagcatggcgtgcgccagcttggcctcgagcttgtcgaagcaaggctcgcccaggccgacggggacgttgcggatcacgcaggtgacggtgccgccgatgctatcttggttgtcccggaaagtctcgatcacttttgtcatgcgtgccgccgcctcctcgttcgggcagcgagtggggacgaaggcatcgacagtcttacggtcgatggtctcgatgagcttcaggaactcagggttggtcgatggagaagggtgctcgggggtcggcgggaaaaggtgttcgttaccaacggaggacacaaaggcgacaatttcgacaccatgcgacaggcgtag

SEQ ID NO: 16611 - DNA, 576 bp, A.fumigatus
atgggagcgccgttggagatcccgccctggatgccgccggagttgttggtcttggtggtcaggcgctgtgtgctgccggtgcgggtctggacctcggagacggtgaaggggtcgttgtggatggagccggggacctcgcagccaccgaagcccgagccgatctcaaagcccttggtggcggggatgctgagcatggcgtgcgccagcttggcctcgagcttgtcgaagcaaggctcgcccaggccgacggggacgttgcggatcacgcaggtgacggtgccgccgatgctatcttggttgtcccggaaagtctcgatcacttttgtcatgcgtgccgccgcctcctcgttcgggcagcgagtggggacgaaggcatcgacagtcttacggtcgatggtctcgatgagcttcaggaactcagggttggtcgatggagaagggtgctcgggggtcggcgggaaaaggtgttcgttaccaacggaggacacaaaggcgacaatttcgacaccatgcgacaggcgtaggtacttctccgcaatggctcctgcggcgacacggcctgaaaagatgaggtag

SEQ ID NO: 16612 - DNA, 1317 bp, A.fumigatus
ggtcgcaaaagagatgaagtgggactttttaacaacagtcatcgatgttgcttatctgggtttagtgcgccggcgatcggagatatctttcatcaacaagatcttacattacagtacccagcatctatttttcacctgaggctcggagaccgccagtttaccatacgttacatagtctccccatctgatctccgccacggagtccgaatttcgaacagcttcaaccatgctcaccctgtgcctgaacctcgtcgttcctcaatgcgtcgtctgctgcggggacaatgcctgctgacgtcggctttggctcctagacggagcggtagcagcccatatgaaggtgccgtacgatataactcagcattatccaccgaccattttgcacacctagcgagccgtcagtcctcccggcaccagatttaccagtcgctatcatccgatccttatgtgaatctgtccatcgagcatttcttgctggagcatgcgccggtcgacagcagcattctctttttgtacgtcaatcggccatgcgttgtcatcggacgcaatcagaacccttggctcgagaccaatctcgaagcactttataatgaccgcgttgaaacccaaaagggggacgatgagagtgaagacgtactactggttcgacgcagatccggcggaggagctgtatttcatgactttgggaatttgaattacagtgtgatttcaccgcggaccacttttactcgcaacaaacatgcggagatggttgtacaggccctccacaatatcggggcgaccaacaccagtgttaatgaccgacacgacatcgtcatgacctccgggacaagcgagcacggagggtctggcgcatctatgcctcggaaaatctatggttcagcattcaaattaacaaggcaccgagctctgcatcatggaacttgcttgttagattcccctaatatcaacgatctgggtttctttctacgttcgcctgcccgtgactatataaaggccaaaggcgtggacagtgtgcgatccccagtgaccaatgtctcgaccgcctttgaggatgcgtttgctcccttctcgatacaagcggtgatggaaggcattatggagcaatttgctcagctgtatcaagtcagtcctgacgctgtccgccgggcgcaacgtgctcacgccaacgaacctgagctgtacgctggatccgactgggtggccggtgttgtaggagcgcaggaaggatatggagagctggagattagaaagggcattgatgagcttcgggtaagacgaatgcatatagtgtatgagacccttactcacgtatga

SEQ ID NO: 16613 - DNA, 453 bp, A.fumigatus
tggatgttgcttgcgccaggatggaccaacctctggcggatgtatcacgtccggaagggaaaggtgcatatcttgaccactgaattgcacaaaaagtacggtccggtggttcggatcgcgcccaatgtggtcgacctggatatgcccgagatgatccgcaccatctacagcacccgcggcgactaccgcaaaaccgagttctatcacggaagtagtgcaaagaacaacggtaaaatcatttacaatctcttcagcgaatgtgacccgcaggtgcatgcgctgcagaagcggcccattgcaaagtattactccatgtcgggggtgctgccgctggagcctcatatcgatgagaccattggcttcttgtgtcggagactggaggaggagtttattgatggaccgaaggctggacgtccttgtgatctcggccagtggctgctctactgtaagtga

SEQ ID NO: 16614 - DNA, 2304 bp, A.fumigatus
  unsure (159),(176),(183),(206),(2029): Identity of nucleotide sequences at the above locations are unknown.
gtgcaattacggaaaagtcccccaccactgggcaggaaaattccaaaggtcaataagtcgtcagaagattatccaaagtcggaaggggtttcaacgtggcatgtacccccagttctcgcggagtcaaaaaatcgggttgcccataagatatcggtgttncaggagctttctcagcntggaacnacagaacctgccaaagatatctntcgaaagctccggccgcaggttatggtttataagatgtctcgccctgtggcgaccagtaccttatggcctgacatccgctccggtccgttctgtaacgataacgggtccactgatcctgatcgtcttattgtgatagtcgatgcggaagacctccgccgagaaggaatagagttgagtcgccatctctcttgggaaaagacctgcgaagattttgttcgggagcttgcctgcaacggacaggtcgtgtctctgctcgaatgcgcccatcttattgtgtgcttcgattctgatggagtcatccaccatgatcgaattaaggggaaggatactctttacttcagtggctcgtacgcagagggagattacatcaaatcttgcgctgaaaattcgggagatatgcccgggttaatcaccacctttacggccgggtttgtctcgaaaatagcggagtttgatctctcagagactgacgctatggacaactgtctccaagagggaatcctaaacgggctgcgatgtgcccggcggttgtgctggcacggtttccgaagcaatcttgatggccaaccagatatgtcctgggagtacatcatgactggtttggaacaatacagcaatatttttaccaacgcttctgtagacaatcctgaaaatgacctaaggttcgaggcgattacgatcccaacagaccgtatcattcagggtctccattggacaacacttgaaagcatagccggggacccggccgaagtggcctaccgcattgtgaaagatggacctgacattcttagtcgggttccaattgcacggtttgggaagatagtaactgctgacagaggggagattgaaagttaccgggcaatcaccaatttaatcgaggagtacgcaacagcaaatccgcgtcggatgacaccactctgtattggaggctttggccctcctggttcggggaagtcctttgcattgaaacgagtggcagaaacggcactgcccgacgacgatctcccgacgctagagttcaatctctcccagttcagagattattcagaattggtagtggcattccagttaattcgggacacggctttgtccgagagactccctattgtgttgtttgatgaatttgacgccaacttcggtgggaaattgggttggctgaaatacttcctcactcccatgaatgacgggaagttcttggatcatggtacaacgcacccgatcggtagagcaatttttttcttcattggaggcacttcctcaacgctcgaagatttcaaaagcgacacaaactctaaggaaggcgtcactgctaagggtccggactttattagtcgcctaagtggttacgtcaatgtccgcggcgttgaccctattcccgatgagaagagagatcaaaaatacgcaatccggcgagctctgattctcagggaattactcagaacttatcatctggaaggcgcaattgatgatgcagttctgaacggaatattgagggtctcaaggttcaagcatggtgcgcggtcactaagggccatactgcagatgagcagaatctcaggaagggagaagtttgaacgggcagcacttccttcagatgcccaacttaggctgcatgttgaccctggagatttcctgcagtggattagggacccacgattgcaatgggacttacctatttacacttgcccatctgctgatcacttggctgctcctaactcatcgccccttcgggaggctattgcaatcaggctgcacagacgatattgtgatggtatcaaaagaatccaaaaacaagacccgtgcctgctagaaaggggaatanacatcacaataaaagagtggcacgagcttgaagatatgcacaggaagaacagtcgtgcgcaggccgacgacatcgcatccaagctacggctgataaaatgctatttctccagaaaagacattgagagaccggcaagctttgaatttactacacatcaaaatgaaattcttgcccaacgtgatcatgaacgcccttgttactctgagattggaaaatggttggaaatatgggaaatcgagggcgatagtgagcaaagtatcccccaacttggttga

SEQ ID NO: 16615 - DNA, 267 bp, A.fumigatus
ttagtcaaattactaataaccagtatagttgtcaacacaccctatgatttaggtaattataagcctatttatagtctcctcttagaatatttactagataagactgagagcttagaagaattgcttcaagttagggttgttattctcacaggttgggctgggttctctcatctttccaacccaacccaaacccggcgggttctaagaaaggcaaacctgttaggttctattctgccaaaaaatcaactctctacctacttaatctag

SEQ ID NO: 16616 - DNA, 381 bp, A.fumigatus
tgccaggtcttcctgcttctgtacactgtgtttctcactctctccagccagcacggttttggacaacccatcatgaccttgtcgatggacgaagcagtgcatgcgatttacttggagatggtcgggcaaacgtttgccgtcctgggaatggccatcgccaagctgtctctgggtattttcctcctccgcattgtggtcaagacgtggcaccgggtgtcgatttgggcgtcaatggtgagcctgtccattgtctcggtcatgacggccgtgctcttctggacccagcggctaccatcaagatccatttatgatccgcgtgtccccgggcggactgtcgtcaacattgttcccttttcggtactacttggctgtaagagttga

SEQ ID NO: 16617 - DNA, 198 bp, A.fumigatus
caggaatgcgccacgagactcgagctgaccgatctagcatggtgtgccgcggtggatttctactttgccatcctgccttggatcttcatctggaagctgaacatgaagcagaaggagaagctggtcatcgccattagtttgagtctaggctttatgtccgttgccatccttccgtgtctcgccgtagacgctcactga

SEQ ID NO: 16618 - DNA, 429 bp, A.fumigatus
catacctggtacatcccagaggacacaattgatctgattatctggtcagctgtcgagctcgcggcgacaatcatctgcgtcggcatccccaccatccgccccctgtaccgccacatcgtccatgggtcgcggttcaaagaatccaatgagggttataagaagcatgacgagagtggtgagtcgaacccaggattccgcatgaagcccctgggtagaaaggctcgcaagggtgatctcgagaccacgatatcaaccgttgtgggtgatactgtatttgatatgcctggcggcgagacatcctcgcatgttcaaactgcgagggaaacggacgaagagaggctcgtcagtcctcccagagcgccgcatgtcaactccattcaagtgcatgaggaggtgaccgttgaaaggagcacaatgttgtctcgctaa

SEQ ID NO: 16619 - DNA, 345 bp, A.fumigatus
cccgggcatatctcccgaattttcagcgcaagatttgatgtaatctccctctgcgtacgagccactgaagtaaagagtatccttccccttaattcgatcatggtggatgactccatcagaatcgaagcacacaataagatgggcgcattcgagcagagacacgacctgtccgttgcaggcaagctcccgaacaaaatcttcgcaggtcttttcccaagagagatggcgactcaactctattccttctcggcggaggtcttccgcatcgactatcacaataagacgatcaggatcagtggacccgttatcgttacagaacggaccggagcggatgtcaggccataa

SEQ ID NO: 16620 - DNA, 195 bp, A.fumigatus
aatcttgcagtctactgcgattcgaattcacagcaaagaactggcgaagtcaagtggacagacattgactccatccggctgcaacaccccgagtggaacgatgacgcctccagttgcaggaaatctgactccaacgggcatccaaactcctcctttgatgcattcacgggaaccaagtgtttcgaacgccagtag

SEQ ID NO: 16621 - DNA, 3876 bp, A.fumigatus
ctaaaagatggtccaaagaaacttggcttgaatggctcctcagacaccaatggctgcttcgccagtttgattcttaagccctttgaattccgggcttatgtcccaaagaatagattcattgctccccgtcccatgatcactcagatcacgcctggccacgataccccattactctcaaaggtcgcgcctgaccaggctgaagagatagatgtcagcatctatttctcagcagaaatggactgtgactctgttacgaaatcaatcacactgaactccacaacagaatccggaaaaacgccatctgtcgacagcaaaagtgcgagctgcagaaagattcccgccactgacacgcaatggaccggtcagcttccaaatgtttgggtttggaccggaaagttgactggtgtgtataacgggattcaccggttgacagtcacaaacgcaagtgactccgctgggacgagcgcaaccaatgccattgaccattttttgtttcgtgttggccaaagtgacaatcccatggtattcacctcggccaattattccagtagtctgttgcacgagcatgagaacggcacacttttcattcaacatcatgctgctggtgccgacaagtatcgctattctaccaactggggcagttcattctctgattggatggactacaaaggtggcaacgagacaattgaggagcttccctggtccggaaccgagaagcagaagtggcagggaaagcatgtgcgcgttgagtattggagcaagttgactgggagcagcgactatgtccaagaaggagactctggttgggattccaaccgcccacggcgcttccctcacctcttctttaatgggccgtataatcaatacggctatgatgctggactggacaatgcggttcagctaggagatgatggactctggcggtttagatttgtggctgagtggccagcgcagggccagttcaatgtctggggcatcaatcctgacggtcaacctgaccagagtttcgtttttggtgatgcagatatggacggcgtcctagatcgcatgcctccctcttccctcagtaccacactgattaacatcactgaccacccgccagcgccccatctggcatgggtccttcacctggatgattcgactctgcaattccaactcgagccaacaggctccagggcagctcagatggccgctttcttcctgctttggctcataccagttttgacggctgctgcatgtgtatatggcttcaagaaatcgttctaccaagtgaaattcaaccaagtcggcgtcagcgagaagaagaagctattaccattatggcttcggaggaagatcaagcgtgcagatcttgaagatggcgagcccatgaatcctcttgtccgctttgcaaacagatcaagctttgtccaaagcaggtcagcattcaatgaagggacattaaagcggagaacggtcctgattgccacaatggagtacgatattgaagattgggcaatcaagattaaaattggcggtctaggcgtcatggcacagcttatgggcaagaatctagggcaccagaacctgatatgggttgtcccttgtgttggtggtgttgattaccctgaggatcaaagggctgacccgatgtttgtcaccgtactcgggaactcttatgaggtcaatgtccagtatcatgttatcaagaacatcacttatgttctcttggatgcacctgtcttccgccagcagaccaagacagagccgtatcctgctcggatggacgatctggatagtgccatctactactctgcctggaatcagtgtatcgcacaggcaattaggagattttctgtcgaactgtatcatgtcaatgactatcatggatcaattgctccactatatctgctaccacagactatccctatttgcttgtcccttcacaacgctgaattccaaggactatggccaatgcgaacacagaaggagaaagatgaggtctgttcggtgttcaaccttgaccttgatgtggcaagtcgttacgtccaatttggtgaggtcttcaacatgcttcatgcaggtgcaagctaccttcggttgcatcagcaaggcttcggtgccgtaggtgtctcaaagaagtatgggaagcgctcttatgcccggtatccgatcttctggggcctgaagaaagttggaaacctaccgaatcctgatcctacagacacaggtgaatggaacggagagccaactaggcaatctgacatcaaggtagatgcagcttatgaggccagtcgcggagaattcaagcgtcaggcacaagagtgggcaggactggaacagaatcccaatgcagatcttttggtgttcgtcggaagatggtccatgcaaaagggtatcgacctcattgcagatgttatgcctgccgtcctggaatctcggtctaacgttcagttaatctgtgtcggtccggtaattgacctctatggcaaattcgcggcgttaaagctcgatcgtatgatggaattgtaccccggccgtgtgttctcaaggcctgagttcactgcacttccgccattcattttctctggtgctgactttgctttgattccatcgcgcgatgagccttttggccttgttgcagtggagtttggacgcaagggtgctcttggtattggtgcgcgtgttggcggcctgggtcaaatgcctggttggtggtacaatgttgaatctacaacaacatcgcatcttctccatcagttcaaactcgctattggtagtgcattggactcgaaacccaaagttcgagccataatgagggcacggtccgcgaagcaacgctttcctgttgctcagtgggtggaagaccttgaaatcttgcagtctactgcgattcgaattcacagcaaagaactggcgaagtcaagtggacagacattgactccatccggctgcaacaccccgagtggaacgatgacgcctccagttgcaggaaatctgactccaacgggcatccaaactcctcctttgatgcattcacgggaaccaagtgtttcgaacgccagtaggctcagcgtccttggcccccagcaacgaaacacaattgtatacagccgcgatccaagtcctggaatgattgaaaagcccaagtcaggtcttagccggcagctatcccttggagtaagagctggacctgggcatctggaacgccgcggccgtcgtaagctcaagaagatgaatcaagcgggcagtgatgacaatcagaactcaacgactgacgtcgagtcaagcagcgatgacgatattatccccagctactacggcgacgatgaatacactctcacgcctgaacaagcggaagcagggcgacaaacagaaatttcccagcaacaagggcatcattccgtgtggacccctcgggacttcttcagtcaaagacattcaagtcaaacgtctatctcattcaacactcccctgtcccccaccagcactggtgtcactgaagccgacgacgctatattccctcctgctcggcggatgctggaacctgctaacccaagtcaccgccttagcagcgcctctgtgctctcagtggattcgattgtcggcgccaagagagactatagactccaaagagttgatcctttcttcacagacagtaccggcgaattctacagaatctttgaaaagaagttggagacgttgaatggtttgaacagtgaatcacagctctgcatcgaggagtaccttgtcaagagcgagaagaagtggttcaatagattcagggatgctagactaggtcgtaatcagtctcctgcttcttctgtgttccggatcaagcgagattattcgccgtcttcaccacggggctggaagggtccgagcgtagtgtattca

SEQ ID NO: 16622 - DNA, 522 bp, A.fumigatus
gcaccgatccttcttcgtcttcaatctcatcctgctcctcttcctcctcgtcatcctcctcctcctcctcctcatcctcttcttcgcccaatacctccgcccgcccatctccaccctcgatgccctcatcatcgaacgtgccttcgtcttcaaagtcaccttcgtgttcgtcttcgcccctctcctcttctaaattatggaaatgacccctttcctcagcagcctgtcgttctgcagctgaataggcctcggatctggcatcagacagatcatcgtcttccagtgctctattggtaccaattgaaatttcctcgacctcggagtcttcatgacgcctcgtatcatcttggtgaaagtcattgtctccgaaggcatcgggtggtcgttgacttcgttgttcttgaacatctccatatccatgctcttcgactaagtcgtcatcttcctcctcggctgactcctcttcaactgactcttctgttagctccatttctgactgctcttccaactcatcttcgctag

SEQ ID NO: 16623 - DNA, 498 bp, A.fumigatus
actagatatctcctcgccgagaagtgctttgacaagatagacgtctttgaacagagaggctcagttggcggagtctggaactatactcctgctgcattaaaagcaagcctggtgacccaggtgccacaattgaatccagatggaccaattgaagagccaatatggtatcgatttggggagacagaagagacacggcagctcaccttcacttctcctatatatagcaccctggataccaatatcccgaaagaactcatggcatattctgacaaaccattccctgccgattgccaagccttaccaaggcattcgacagtaaagaaatacttggaagaatatgcagaggatgttaaagacctcattcagtttgaaactcaagtacttgatgtcagaccagaggggcagaccaacaaggcttgggcgctgacaacaagaaatctccgtaccggggctaaggagacccaaagtcgtcacacagggctagaatatcggggttaa

SEQ ID NO: 16624 - DNA, 630 bp, A.fumigatus
  unsure (115),(120),(125),(156): Identity of nucleotide sequences at the above locations are unknown.
gcgtataccctacgctttccgtcaaatcggggacgaaacgggccttcccgccgacggatgttgctctcgcagaacaaggaaaggggcgacttgagtgcaacactcgcacaacgtngtcanacctntccttccccccgcactgacccgacaatcatngtcgccgtcctctcggccgacgcgaagcggattctcttcggccgctccaagcgcttcccgccgaactggtactcaacactggctggttttattgagcccgcagaatcggtagaggacgctgttcggagagaagtgtgggaggaagctggcgtcacactttcgcgtgtcgtaattcactcatctcagccatggccgtatccggctaatcttatgatcggtgcgattgctcaggtcagcgatccagagcatgagaagattagtctgttgcatgaccctgagctggaagatgcaaagtggttcgaaatccaggaggtcgaggaagccttaagggttgggacaagtgcgttgggagagacgcctgggcccgaatacaagggtggattgagacttcctcctcctaccgccatagctcaccagctcataagggcagccatcacgggagactacatcatttcgaaagaatcaaagatgtag

SEQ ID NO: 16625 - DNA, 252 bp, A.fumigatus
ctcggattcagaatccgaacggtcatagtcatcctcgtacgcctcttgctcgtccttaagcaccgatccttcttcgtcttcaatctcatcctgctcctcttcctcctcgtcatcctcctcctcctcctcctcatcctcttcttcgcccaatacctccgcccgcccatctccaccctcgatgccctcatcatcgaacgtgccttcgtcttcaaagtcaccttcgtgttcgtcttcgcccctctcctcttctaa

SEQ ID NO: 16626 - DNA, 405 bp, A.fumigatus
aagaggagaggggcgaagacgaacacgaaggtgactttgaagacgaaggcacgttcgatgatgagggcatcgagggtggagatgggcgggcggaggtattgggcgaagaagaggatgaggaggaggaggaggaggatgacgaggaggaagaggagcaggatgagattgaagacgaagaaggatcggtgcttaaggacgagcaagaggcgtacgaggatgactatgaccgttcggattctgaatccgagtcatatacaggtgaagattccccagctaggcccgagaaagttgttcatccggaggtcatcgtcttggacagcgacagcgaagacgaggctgttgtcagtcctccgacaaacactcatatgtcatcggccaaatatgctgctacagttgatgatgtag

SEQ ID NO: 16627 - DNA, 3765 bp, A.fumigatus
  unsure (2717),(3176): Identity of nucleotide sequences at the above locations are unknown.
atttggcgttcgtctcaacacttctcgactgtgaaacttgacccttctacagtttcaactcaagatacagaaaacgtgtttgcgccgccagctacaccaatcactaatggatgtgttgagcgcgatgaggcgacttctgctgctagattcgaatctgggagatctcccgccttcgtggagcgaacacgtacatcgtttggtggtctcgtggattcagcttatgacccattcgctgaagcagatgggtttgtacctggcaaaggccggaaacgacctcgttttagctttaaaggcgccaattggcgtcttgttgatgaacccgccagtcctggagaaacagaggcaccggccgattggacgtggatgtttgaagaagctgagactcacgagtccgatattggtggagaagatcatatagacagcgccacagtccctcaagaggtttccgcagtaaccgctacggtgccaaatactccagaagccgccgatactgtcgcagacgtcgacaatgaatcacttgatgttggtttaatgagcacagaacgaatggccgaacagccaaccaggccaagttttgaattttctcagccactacgtgcgcctggatttccccaacactttgccaggcagcaattagcagattccgatttcccttatccaacagacacgccacgcctgtatcctattccttctcctgggcttccgattccatcaccactggtcactaggtcgagtagtgcgcatgactactttccaactgttgcttccaatgtgcaaacaccatccgctgcagatggagaaaatgtggagatgaccgaaaaagaaaacatcgtcgtatataaggtccagcctgatgttcctacgagcaaagagctccaaccgcttgttacgactcctcagccggccattgcaaggaatacattggatttaacgtctcaaaatgcgtctatcgatttggaagctgatcgtcaaggggacatgaagagtacttcaacagccgacaccatgcccatcgagtatagagcacccgcgcaacacccggaagatgttgagaaacaaatatccaatgccccgctagtctctttggatcagtcctatgcggggaagcccgccgagtttgcgaacagcgatattaggaacgtcgttgaggaggaactagaacaaagtgacatcaatcaagaaaatggagaaatccaggtcgaagagagcaatggaactagcgaagatgagttggaagagcagtcagaaatggagctaacagaagagtcagttgaagaggagtcagccgaggaggaagatgacgacttagtcgaagagcatggatatggagatgttcaagaacaacgaagtcaacgaccacccgatgccttcggagacaatgactttcaccaagatgatacgaggcgtcatgaagactccgaggtcgaggaaatttcaattggtaccaatagagcactggaagacgatgatctgtctgatgccagatccgaggcctattcagctgcagaacgacaggctgctgaggaaaggggtcatttccataatttagaagaggagaggggcgaagacgaacacgaaggtgactttgaagacgaaggcacgttcgatgatgagggcatcgagggtggagatgggcgggcggaggtattgggcgaagaagaggatgaggaggaggaggaggaggatgacgaggaggaagaggagcaggatgagattgaagacgaagaaggatcggtgcttaaggacgagcaagaggcgtacgaggatgactatgaccgttcggattctgaatccgagtcatatacaggtgaagattccccagctaggcccgagaaagttgttcatccggaggtcatcgtcttggacagcgacagcgaagacgaggctgttgtcagtcctccgacaaacactcatatgtcatcggccaaatatgctgctacagttgatgatgtagattcatctgcaacatctgctggagagaatgatgggtatgacagaggctccgtcggttcggaagcagaagaagggcccgaagatgagctggctgaagatgaccaaacaggggatgacaaaacggaagaagagtccacgcaggacgaagtagacgtgcgcgataatgctgaagatgaactcatggaggatgctccttcggatgaggattttgtctcagaagagccaattgaagtgcaggcggatgccgaagaaaattcagcttcggcggatccagtacaatgcgaagttcagcaggaagctgatattgaaaacgaattgatctccgagacacttaacgtgctgcaagcaacttcaggtgcaccgcaaagcatagagggtcagagcatggccagtcttggtgtctctgtcgtgcaatctacgcaaggaccttacaccgattctgtatatggtccgcagcctcgggatttagcaattgatcccgagttgtatcgattaggaggtaccggcgaggatgaaacgcgcaggccggagaccgatgctcgcgctgagtcagggccggacaagtccggcttggaggatgagggtatcagagagccattcttccaatgtgctgtttctccacaacctgttgacagttctgcagaacttgcatctccagtccaggagccttcaacccaagctccacaattagtcactccagatgcttcacagttggctacgcatagtcgtcgtcttcctaccgccattccagtcgctgaatttcntccgacacccgaacagacgcaggaggtaccccaaggtctcagtacccagtacgatggtcataccgatgctccggaacgaacgttgctgcacatatccaccacgtccgtagagactgatgtatcgtcaacaaacgagtataatgtgcaaatgagttcggctctggccgaacagcaacggcagatgcagaccgacggggtatctgttcatgatgaagagtatgcgatatcttccgttgcagacgaaatcgcaagtggagtccacgattgggaagtttcagcactacattcggaaagactatcctcggttgtaaatcgtgatcatcccggtttgcgaagcaaatattcttacttcgctcctcttgctatgcttatcgaccattacaattcactgatagatacgatctctgttgtgtccgatgcttctccaatcagccgagcccctacatgcaaggaggatgngacatggtcactcctgttcaccgacccatcgatggcaggcactatcgttcatgtagaaatatttcgccctcacaaatatgcgcttccttcggtcacagaaggcgacgccatattacttcgcaacttccaggtcaaaagcttcaatcgctctatgatgctggtcagcgtcgacactagcgcatgggctgtattccacaacgccagcaaagaagcgcaaattgccggccctccggtcgaacacggagatgaggaaacagcatacgctaccgacttacggcaatggtaccatgaagttggggtcgccatggtagcggattaccagcttcaggcttcggtattgaccgctagcagagaggcaacgcctgtcagtagtgctgcgcacagtgacgcaggtagcgttgactcggcatctcgagaagtacgcggggaatcatcggtctctaaccggggctcgaaacgaaggaaatcccatcggaggataacaattcacgaattaagggatggaagaaggtataccgaggtcggatcgccgtccgacaaagaaagtatacatgaactcagggatgggacactatatgcgaatctctga

SEQ ID NO: 16628 - DNA, 306 bp, A.fumigatus
ttcggatgtcgtcttggtaatcctgtgatgtattttgttcgtggccaggccctctatgtctatcagttgcgggaatttttttttttttttctttcggataaatggttcagatatgatcgtactgggagctggcttcttggagatggcgatcaaatcgcaggcgctcatcataggctgaaggtaagagattattatgatcaaaagaattttgttcacaagttacggacgtcattaagcccccggtctatggctcggtgctcgtataatatgatctatggaagtaatacggtctacacaagacactga

SEQ ID NO: 16629 - DNA, 219 bp, A.fumigatus
ggctgcgacgcaacatgcgacctgagaggcgagtacttttttagtgccattctcaggggtgttcacttaagcgtcacggcgatctccaccatgttgacccatcgcgttcgtgtctccggcaactcctcactggaggctgaggccagaacattcgcagcgcgtttcctcttcttcgtttctgatttcgatacaggctgcgcgggagcgtcgacagactga

SEQ ID NO: 16630 - DNA, 240 bp, A.fumigatus
tcatatctctctgataagatagttcacaacgttgacgtaactctagctctaattgccggatcaagatgtagtgcctatggggacaatatggcatattctcttgatttgaagcagcatcactcatcacggctacgtagatatcggccgactgcgactgaatcggccactatcaagtctgtcaaccagaatggtagcggaggcaatgaggttgtgggcatgcgtgtcggatcgttgcagtag

SEQ ID NO: 16631 - DNA, 189 bp, A.fumigatus
  unsure (24),(166): Identity of nucleotide sequences at the above locations are unknown.
atattgagtgaagaaacggcttgnggaaatcacgttacttccaaatcaggcaagcggttatataattcaatagtagataagcgcgggtccgcagcagaatggctggtgtcagacaactactctggactagaccagcttgacagagattgtgatatgggagatgcanagctctctttgttcgggatttga

SEQ ID NO: 16632 - DNA, 225 bp, A.fumigatus
gaacttttgatgatagcatcattcggagcaccaccattagaccagttgcacacaacaagagatacagtcactagagcaaaccctgaccaaatcaccagaactcccatcaccaccatggccaaacaacctctcgtcaaaaccctccagttcgagaaaaagaacaaagacatgctcaagctcccaaaatgtactgtactgtcctgtcctacccaactcgacgcctga

SEQ ID NO: 16633 - DNA, 990 bp, A.fumigatus
agtgggggctcccgtcgaggaagtgaaagaaccttctacaaaaggtcggcgctccttatttctctttcggtatctcgttcggaaactgaccaacctgcagagatcgacgaggcttttgagaaagccttcctctattctctgtacaaactgaagcaggacaaccccaccgcaccgaatcatggcctgtcccttcccgtgcaaccatccgcccttgtctcgaacatgcttactccttacctcccgatttactcttcacagcaggctcaatactatcagatcaaaaagacaagctggaagaacgtcaaaaaattcatcaaatatcttgacaagcagcgtctcgtcaaatccaaagaccgcagtggacaagaaactgtcatcatcgatgttgacttcaacgaccctcgcgtcgagcagtttgttccttacaagcttccatcaaagaatgccgttgagaatgcgggcaagtccgtccccggaaacaagacgcctgcaacttcggagggagacccttccgtcggacagacaataaccgttcagactctttatcggccaacaggaaagcttaccccgacaatcttcccagctctttccagcggtgaccccaggaactactacaagtattctgaggtgtccaaccgtttggacgaatatattcagtctcaaaatccgcctattgtctccagtgagaaccgccggatcatctcgctcaatcctttccttgcaaacacaatcttcacatcttcatcagccgaggacaagaccaccattgcacgtggcatgacgacccgagatggcctcttgaagcggatcgtggaagactcggcgttcctaactccacactatgtaatcctcaggcaaggccaggccccatccgatgtgaaaccgaaagcaggtgcaactcccaagatcaacctcgttcttgaaaagcggacaggttcgaaaactgtcaccaaagtttcgaatctggagatcttcggtatagtcccgtct

SEQ ID NO: 16634 - DNA, 816 bp, A.fumigatus
ggtattaacttcgtaaaggtcattacctacatggccaactgcaatggtgattgcgcctcagttgacaagactactctggagttcttcaagattgatgagagtggtctgatcagtgactccaatgttcctggcacctgggcctctgacaacctgatcgccaacaacaacagctggaccgtgactgttcccagctccatcgccgctggtaactatgtcatgcgtcacgaaattattgccctccactccgctggcaaccagaatggtgcccagaactaccctcagtgcatcaaccttaaggtcaccggtggtggcagcgacaagcctgcaggtaccctcggcactgcgctctacaagaacactgatgctggcatcctggtcaacatctaccagagcctgagctcctatgaaattcctggtcccgctctctactctggcgcttcttctggcagctccaacaacggtggttccgcctcgtccagcgccactgctccttctgccaccatcactcagccctctactgcagtcccgactagctctgcgactgcttaccagccctccactaccaccgaggctgtcacagtcaccagcattcctgcccagcagagctacgtccaggctcctaccgccacccctagctccactgccggcagctccggctccggctccggttctagctccagtggcactcttcccagcagcagcaacctcactgagtacttcaactccctcagcgccgaagagttcctgaaggtcctaaagcagaccttctcttggctggttacggagaaggtgcacgctcgtgatctctctgcttag

SEQ ID NO: 16635 - DNA, 963 bp, A.fumigatus
atcaagaatcttgcgcccttacgatcctcggaccgccgtaaaattgcagaccaaatcatcagcgactacaacatcagtattccgtcagctgcaccagccgaggatgactccaatactcctaccacgtcgaaccaaacctcgcccagcatcactgcgatccgaaactcccttcttccagaaaactcgctctctgctcgcttcaccaccactgcaggtccccagctccgagaagtccaaggcacagtctacgtaggaacgcatcccgagggcgaggaacgcattttgtggtttaaggtggaacatgggcccggagccgatggacgattctatcccacggtctacacattatggcacaatcccaaactagtgcccttgcttcacacgccggaaatggtcatgcagaagcttcgtggtggcgcagacctgatgacccccggcctcgcggatgaacctccatttcctgagagcgcggtcaagggagctgttgtcgctgtagctggtttggaccgacacactgtcccgttatttgtgggcgtctgcgagattgatattgcaggacttggagaggttcagggcacgaaaggacatgccgtccgaggcgtacactgggaaggtgatgagctgtgggcctggagttcgtcttcccgtccgggacagcctgctcctgaatatctggctgggtgggatttggaagcgggcgaggaagacgtcgcggaaattgaggagcgagccactgagctttccttggaccaaggtcagcagacgcaatctgcggaggaggtgcctccagtcgactctgccgagcagcatgaagtgggggctcccgtcgaggaagtgaaagaaccttctacaaaaggtcggcgctccttatttctctttcggtatctcgttcggaaactgaccaacctgcagagatcgacgaggcttttgagaaagccttcctctattctctgtacaaactga

SEQ ID NO: 16636 - DNA, 621 bp, A.fumigatus
cttcttcaacctttctggagatataagaactgtcttcgtcacgatggaggacagctttcttctgttcttcccatcagcattcctttctcacggtctcagcaccttccattctctcattctgttctatcggcttcattgactgaagtcctattttcgtcactctttctctcgtctctcgttcgattcgaacctaagattacgctgtgcgttgatcgtttggacaatccaacaaaagcctacaacatgtctgtccctaagattgcagctgctcttctcagctcggccgctctggtcgctggtcacggttttgtgacgggtgccgttgttgatggcaaatactacactggataccttgtcaaccaatacccttacatgagcagccctcctgacagcatcggttggtctgaaaccgctaccgatttgggtttcgtcgacggcagcggctactctagcggcgacatcatctgccacaaggatgctaagaatggtgccatctctgccgagatcaaggccggtggaaaggttgaattccaatggactgaatggcctgaatctcaccacggaccggtatgtcttcgtaagacatccatggaacaattggttagggtattaacttcgtaa

SEQ ID NO: 16637 - DNA, 696 bp, A.fumigatus
gaccttcaggaactcttcggcgctgagggagttgaagtactcagtgaggttgctgctgctgggaagagtgccactggagctagaaccggagccggagccggagctgccggcagtggagctaggggtggcggtaggagcctggacgtagctctgctgggcaggaatgctggtgactgtgacagcctcggtggtagtggagggctggtaagcagtcgcagagctagtcgggactgcagtagagggctgagtgatggtggcagaaggagcagtggcgctggacgaggcggaaccaccgttgttggagctgccagaagaagcgccagagtagagagcgggaccaggaatttcataggagctcaggctctggtagatgttgaccaggatgccagcatcagtgttcttgtagagcgcagtgccgagggtacctgcaggcttgtcgctgccaccaccggtgaccttaaggttgatgcactgagggtagttctgggcaccattctggttgccagcggagtggagggcaataatttcgtgacgcatgacatagttaccagcggcgatggagctgggaacagtcacggtccagctgttgttgttggcgatcaggttgtcagaggcccaggtgccaggaacattggagtcactgatcagaccactctcatcaatcttgaagaactccagagtagtcttgtcaactga

SEQ ID NO: 16638 - DNA, 213 bp, A.fumigatus
agaacaaagtttcatcttgaaatgtccccttcaatactctacatgttcccaagaattattatacctaataaatctccctcaataaaggttcaaaacttcactcgttccaatgttacctttactttctccctttctttgaccaccaacgccttgggtgatactacgctgaggttgaccttcgacttcaaagcttatatgtgcaattcaatatga

SEQ ID NO: 16639 - DNA, 249 bp, A.fumigatus
attgtgaggcatcccggccatcactcaaagttcgacgttaaccctctcgtttttcgcagatctggctcagtgtgtcttgatgtcatcaaccaaacctggtcgccaatgtacgatatgattaatattttcgaggttttcctccctcagctgctgcggtacccaaacccttcagacccgctcaacggcgaggctgctgcgatgttaatgagggaacccaagagctacgaggccaaagtaaaaggtgagtga

SEQ ID NO: 16640 - DNA, 192 bp, A.fumigatus
aaggtgagtgatacagcgatcggttcaggacagcacttactgattggatcgacagaatacgtggccaagtatgctagcaaagaggcagttgatgaagcgggagaggatacagagtcggaagatgaactgagctcggcgggaagttacgaatctggtggtgaggagccggccggtacgatggacgacgtgtag

SEQ ID NO: 16641 - DNA, 759 bp, A.fumigatus
tctagactctgtacggaaaggcgctacaaccccgtcccctctgttgttgtgtctcctcttgttatggcggaccccgcatcatattgcccctccacaaacggctcagattcgttcacatataattatcctagtctccttcaagcgtgttcatatatagtcaccacaccacccactcatctatcaatcatgcctggacggcttgaagaaaaggttgccattgtgacaggcgccgggtcaggttttggctacggcatcgccaagaagtttgtcgaggaaggcgccaatgtcatcattgcagagctgtcgcagcaaagcggagagaaagcggcagccgagctgaactgcaagttcgtcctcaccgatgtgacgaggcgggagtcctggcaggcactgctgcaggcaacactggatgcatacgggaagctcgacattgtcgtcaataatgctggtgcgacctatagcaataagcccaccgtcgaagtcaccgatgcagattttgatctgtgcatgaatgtcaatatcaaatcaatctatctgtccacaagtgtcatagtgccgtacttccttcagaataaccggcccggatcgtttatccagatctcatcgacggctgcactgcgtcctcgccctggcttgacgtggtataatgcttcaaaggcagctgtaagcaatgcgaccaagacgatggccgtcgaatatggacccaagcagattcgtttcaattgtgtatgtcccgtcgttggtagtacagggatgtaa

SEQ ID NO: 16642 - DNA, 375 bp, A.fumigatus
agctgcacaccgttgatgcgcagacttgaaagtgactcaccttgctatgtttttaggacacatttatttcttggtaagccggatacagaagaaaatcgcgctgctttcgtttcaactgtgccgctgggtcggcccagcactcctcgggatgttgcgaatacatgttgcttcctggcaagcgatgaagcggaattcatcacgggcgtgaatttggaggtaggtaccgacctcatttgttctatatcagcactaactaatggctattgggattcaggtggacggtggacgttgtgtttagccaatatctatgatgtggcaatctatcgcgcctacgtggaaggcatagaatgttcaactgggcagctcgcgatctag

SEQ ID NO: 16643 - DNA, 771 bp, A.fumigatus
tgtgcaatttcccgctttgcaggtccccacggcaatttctctgctgctttcacccaacctcctgttccagccactcttagccagttcgtgccgcatcagggcaccccgacttcgaacatgtccccgagtgcggcgcaaaacctgacacagaacatggcttcggtcgctgcgaacagcatgcttccagcacaacagcaacaacagcaacatcatcaacaacaacaacaacaacaacaacgcccttcccagcagccaaatcaacagcaaggatccgtcccaacagcagcacagagtccggcggcagcagcgcgagagaaggctcgtgtctcaaccctcctggatatcaactccatcttgctgcaagaggtcatcaatctgcaggcggctggtaaggctggaggacctcccagccaacaagcatcgcaagagaacaatccatcaccaacgtccgaccaggcggccgacgcagccaagggcccgacacaaaagcccagtctcgagtatgttgagtgtatgcgccgtctccaggccaatttggcgtacctggcgactattgccgatcgagcgaagaagtcgggtggtgtggctcccgctgcccctgccatcatgaccccgcctcccaatttgccagcggtcaacgagctctaccacaagttgaatgagctgttccggccattgaaaggcgccgtgggtacaccccaacctagcccgcaaggtatgcctggcaacaccaaacccagcccgtcgcccgcggccgagtcagcggtttga

SEQ ID NO: 16644 - DNA, 273 bp, A.fumigatus
tcgctcggccgtgtgttaaccggaggacagaaacccaggattctcttcatagccatcacccgactcttctattcttcggtttccaccaagaagcagtacaaggggtctctttcatctaaccttcttatctacaacaaactggctccagccggccaccgcgttgaacctgcagtgtttaacaccaagcgctggaagggcctcagggatctctttggcgctatcggcactgtcctttccctgtcctgtgtatgtgggagcgggacctgggattga

SEQ ID NO: 16645 - DNA, 801 bp, A.fumigatus
atgtcttgcgtcttgtttcttttctacagaaggagcccgccggtcgctactactatcgctgatattactgctacttccgcctccgcgccgccctcatcgctatactcctctgcacctcgaatttctacgcagtctgttcgattctcctggagtggttcacaatcgcctagtgtctatagtgttacgtctgtatcgccacataagcagtttgctcgtcgccggccgcatccacatcttctctggcggtggactagcgtcgcaacacctgtcatacacagcaatcctggggcaaacaaccgattactttcctctctcgcacctttcgctcgctctcgtccgtccctgtctcagcctgcttctcgaaagagcatggatctgaatggcgaaaccagcacaaagcgcaagcgcagctccgtcgccgcccccgccgagcgcccagccaaacacttgaaacccgggaactcgacattaacgcctggggacgcgacgcccgcgaacggcaccgtatacaatgtcgaggatgaggaggatacaggccgggtgatgcctatcggccccgcacaggcggattcgcccgagtggcaggctactatcgagaaggtggtcaagagcgtggtgtcgatccatttctgccagacttgttcgtttgatacggacttgtcgatgagtagtcaggcaacggggtttgtggtcgatgctgagcgcgggtatatcctgacgaatcgccatgtggtttgcgccgggccgttctggggttattgtatatttgataatcatgaggaggtgagtagggtcttatag

SEQ ID NO: 16646 - DNA, 288 bp, A.fumigatus
ggaaaaatggatcccaacgctaccggctacccttctctgcagcaacaacagcagcaacagcagcacaacgcgggctatcctgtcacctcacagagcccacacgcacagcagttccctttctatccaaatgctatgcccacctcctcatttccccaatccaagacgccggtccaacaaccacatcagcagcattctttcggtcccgtccctctgcaacctggcggtcccggtggagctatgatgccgtctggtacgttgacttgtgatccccttggccgttttttctag

SEQ ID NO: 16647 - DNA, 465 bp, A.fumigatus
cacagaacatggcttcggtcgctgcgaacagcatgcttccagcacaacagcaacaacagcaacatcatcaacaacaacaacaacaacaacaacgcccttcccagcagccaaatcaacagcaaggatccgtcccaacagcagcacagagtccggcggcagcagcgcgagagaaggctcgtgtctcaaccctcctggatatcaactccatcttgctgcaagaggtcatcaatctgcaggcggctggtaaggctggaggacctcccagccaacaagcatcgcaagagaacaatccatcaccaacgtccgaccaggcggccgacgcagccaagggcccgacacaaaagcccagtctcgagtatgttgagtgtatgcgccgtctccaggccaatttggcgtacctggcgactattgccgatcgagcgaagaagtcgggtggtgtggctcccgctgcccctgccatcatga

SEQ ID NO: 16648 - DNA, 801 bp, A.fumigatus
  unsure (775): Identity of nucleotide sequences at the above locations are unknown.
tgcgacgtgcatccggtttatcgagatcccgtgcacgactttggtattctgaagttcaatcccaaggccattcggtacatggaattgactgagctcaagcttcggccggaggcggcccgtgtgggttgtgagattcgagttgtgggcaacgatgctggggagaagctgagcattctgtctggtgtcatcagccggctcgacagaaatgcgccggagtatggtgacggttactgtgattttaatacgaactacattcaggccgcagcagccgccagtggtggcagttccggcagtcctgtcgttaacatcgacggtcatgcaattgctttacaggctggaggtcgcgcggatggtgcggccacggactatttccttcccctagaccgccccctccgcgcgctggagtgcatccgacgcggtgagcctgtcacccggggtacgattcagacacagtggatcctcaaaccttttgacgagtgtcgtcgcttaggattgacacccgagtgggatgctgctgtccgcaaagcctcgccgcatgagaccagtatgttggtggctgagatcatattacccgaagggcctgcagatggaaagctcgaagaaagatatgtcctactgcaggttaacggggaactccttacgcagttcatccgattggacgatatccctgattccagtgtccgggaagacggtacgtttgctggttcaaataggcggtccacaatgttgaaggtacaatgtgaaggtgggccgatctgccttgccatcacaccanaaccgttttgttcacggtatcccggt

SEQ ID NO: 16649 - DNA, 192 bp, A.fumigatus
ctcaaggtagattttgaagagagagccaccgggacatatcgattgcaattagagcggatcgtcgtccgaattgaattgttgttctaccctggtcttctacatgtgaagcagcacaaatcccacgattactgtcatggcaacgtcacatccggaacagaccccaagcagccaggccctcttgtggagcattaa

SEQ ID NO: 16650 - DNA, 204 bp, A.fumigatus
aagtcgaagtatcgtctcgatccaaccaaggcacagtactgcatggactgggaaatactgtcgaacgcgcctccatttgtgcggggactgtccaaccaggcaacaggcaacctaccacacggtttcagttacctgcagctagaagagcaagttggacacaaccgttttcttctcaagtcgcgctgggaagatattggtcgatga

SEQ ID NO: 16651 - DNA, 186 bp, A.fumigatus
ttgaatctcgtcctaacaatcaaatggccactgacagtggctttcgagaacatctcaggttcgcccatggctaatgtacagggtgaagattactcgaacttacgcaaattttatttcctccttgaagctgccatcacccctgatttataccacactcaaatccataccgccacgtgtagcagatga

SEQ ID NO: 16652 - DNA, 198 bp, A.fumigatus
tctctaaatcatgccggcagcacctcaacgatcgacctcgccgtaaccaactgcgcgacaaagctcattaagtgccacctctaccatgagaactatggctcggaccatcgcgctgcttactccgagtggtctctccagccgtcgaactataatggtaaagagggtagcggtaatttcttctatacggtcaatagataa

SEQ ID NO: 16653 - DNA, 186 bp, A.fumigatus
tacaacaccagtaaggaaactaccctactgctagccggcaatttcaaccgccaccacccagcatgggagacaaactccgtcacaccaagatctatgctctgtgcagaagaactggtcaatttcttcttccagcagctggcctccaatggtgccttccactggggctaccaacatactagtctctaa

SEQ ID NO: 16654 - DNA, 1845 bp, A.fumigatus
gactactgcaccttcactcacgttacttgtcttggctctgacaatagggctacgatagatccgttagctcgcagtcgcaatatggctgcgacatcgcccctgtcacccgtactcgacttcaatcgcccgggtcacaccgagacatacgatctcttttcatcacatctgccgacgcccggtctgaaccagacgatgtatgcaccttacgctccatacgagatcgatgtcaagacagaacgacagacttttatcaatgatgtccctttgcgccatgattcctcgatctcaacctttagcacctttaccgccccgcagttaagcgcgccccttcccacattccccagcgaggactggttacaagatgaatatttctcccaagcaccgaatttgtcaggtattgacccggcgatttgtgagcaaaattttggtcagacgtatactacattgcagtcaaatattccagtcagtgaccatgatcgtccgctactcgaccactttatccacaatgtcttgcgcatcatctttccggttctagaggcgcatcaacggggccacacacgggcccaggcaatcctgcaggccttggaaaccaacaagtgctaccttcactgctgtctcagcgttgctgccatccacctcaagaccactgagggattcgtcggagaacagattgatcatgatatcatgcgccaccggtttgaggccgtctctcacctatgtcaggctctcagtgaggacatcaaccatgaggaaatcctagatgccacgcttgcgatgatcttcttccactgttccgtcggtcccgcggacgattatcttcccgacatcccttggttcgaccactttcaagccgcgtcgaatctggtcaacaggctcggtctcccgacggcagtccctgaaggaaacccgtacgtactgccacctttcagcatgaccctcacatcgtggatcgacatcctgggttccactatgcaagggaggacccctcaattcgcccacacctatcgtgctaagcaccttagcggctcgtcatcaggtctgcgggagctcatgggctgcgacgaccgtgtcatgtaccttatctcggagatcacctgtctggacgcgttgaagaccgaaggccgcatagacgcaatggccgtgtgttcgcatgtgtccgctcttggacgacaactggagtttaccgaacctgtggatcaaaccctggagcatccgttctcgcccactacaggagccattcgtcccgagattctaacgaagaacatgacgacggtgttccgcattgcggccagaatctatctctgcagtctagtgcccggctttgaccgcaaccagccaagtaacctcaacctggtcgcagcagttgcaaatactttgaactatattccctccggtcccaatggtttcgaccgctccctcgtctggcccttattgatcacgggcgccttctctgcaccgaccagccagttcagggctgtgctggccgaacgcgcctctctgctaggcgatcacgccgacttgggcagctttgggcgcatgtatcgattgctacaggaggtctggcgacttaccgacgaccccgcagacagctactacacacccggaggaaacggcgccattttagcatcggcgggcagtcccgggcccaagaacgagagggtcggaatttccgagaggaaccggaccggggccaggcttagaaaaaacaagaaacaacgggccacttggcgggacctaaggcacccggaaggcttgccaataaattgttggatcaaaatgggaaaaggggggatccttggggttcctttctggtcctcccccgagaatgaaacttcaggagggcct

SEQ ID NO: 16655 - DNA, 378 bp, A.fumigatus
ggacacaagagaaggccccgaagctgcacaagcgttctcgatctggttggttactccgttggcatcatctttctcccgtttctattcggtcgaatcgtcctattaacaggtctaggttgttttacatgtcgcctgcgaaggaagaagtgtgatgagaagcacccggcctgcggtgcctgcagcaatctctgcgtgaaatgtgaatataagcgcccgatctggtggggcaatgccgaacagcgaaggattcaaaaggagcgtatcaagaataagatcaagcagacgaagatgaatgagcgcaacgggtccgcgactggtaggactactgcaccttcactcacgttacttgtcttggctctgacaatagggctacgatag

SEQ ID NO: 16656 - DNA, 228 bp, A.fumigatus
agttttattatcggcaaggtcacgagcagtttgcataccttttctacagagtacaggacgataactcaaccctttttttttttttttttttgctgggtcatagctttagcgaagtacttactatttgctagtatcaaccaggaggagcctacactagaatgtcaacatacgatctgctttgattctgccatccttcgctatacgaagtcatctctcacccaaaaataa

SEQ ID NO: 16657 - DNA, 957 bp, A.fumigatus
cactgtcctggacccgagtcggagcaagcaagaaaaggcgatgcctgcgctggctgtcccaatcaagcgatctgtgcctcctgccccgaaggggcccgatcccgacatccccatcatcaccgaacgtctctctcaaatccgacacaagatccttgtactatccgggcaaaggcggtgtcggcaaatccacattctcctcgctcccttgcgcatgcattcgcatcaaatcctgagtttaccgtcggcctctgcgatactgacatttgcgggccctcgatcccgaagatgatgggtgttgaatcggaaacgattcatgttagcaatgcgggctggagtcccgtatgggtgaccgataatttgagtgtaatgagtatccaattcatgctgcccaatcgagacgacgcaattatttggaggggcccaaagaagaatggaatgattaagcagttcctgaaggatgtggactggggcgacttggactatctgattgtagacacgccgcctgggacttcagacgagcacttatctgtgaactcacttctgaaagagtctggtgtggacggagcggtgatcgttacgacccctcaagaagtatcacttcttgacgtcagaaaggagatcgatttctgccgcaaggctggcattcgtatccttggcctagtcgagaacatgcggggatttgtctgcccaggatgctccaatacatcggaaatctttcgtgctacgacaggaggtggcaaacgactggcgaaaaagatgggtattccattcctgggttcagttcctcttgaccctagagttggaatggcttgcgactacggcgaaagctttgtggacaacttcccggacagcccagcgtcaaaggcaatcaagcaggttgtacggtcggttggcgaaatgcttggcgaggatccaaatacagtgctcccacctgacgagaatgatatggtggagtga

SEQ ID NO: 16658 - DNA, 435 bp, A.fumigatus
gttgaagactggaaatacaggcagtatcgggccaatatgcattcactacagtcttttctcttcctgctgctccttggctacggcgtgttcgcggcaccaacgtcgccacaagctcaatctcagggcaggtccttcaaggttgagcggatcaagcgtggaaactccattcacggtccgactgctctacgcagagcctatcggaagtttggtatagttcctacgacctttggcgtcgatctgtcggactttgtgcctttcaacacgacatctatctcaggcacagctgccaatctcgtaaccgatgtccaggagccagagcagaccggtgcagtcagtgcgcaatctgtccagaacgatgcggctttcgtcagccctgtgacgatcggtgggcagaaaatagtgatgaacttcgacaccggctcagcagacttgtaa

SEQ ID NO: 16659 - DNA, 186 bp, A.fumigatus
ttgatctatcttatcgcggggcgctccgacaccgcagtgactgttcctgagaacatcaccccgcgcccaatcgccaccaagagtttgtcatccgatattggattatcaagcagcgatccgccacttttcatcaaaacttcctttgtccaaatcaattcaacacacctactggacctgggaatctaa

SEQ ID NO: 16660 - DNA, 651 bp, A.fumigatus
gcggatcaagcgtggaaactccattcacggtccgactgctctacgcagagcctatcggaagtttggtatagttcctacgacctttggcgtcgatctgtcggactttgtgcctttcaacacgacatctatctcaggcacagctgccaatctcgtaaccgatgtccaggagccagagcagaccggtgcagtcagtgcgcaatctgtccagaacgatgcggctttcgtcagccctgtgacgatcggtgggcagaaaatagtgatgaacttcgacaccggctcagcagacttgtaagttcgagtgagttactttaccaacatagcttactgactggggacttcgctagctgggtgatgaacacagagcttccggcgagtgcccaggtcggccacactgtcttcgatccttccaagtcgtccactttcaagaagatggaaggagctacttttgagatcaaatacggcgattcgtctttcgccaatggtggcgtcggaactgataccgttgatattggtggcgcaaccgttaccggtcaagcgatcggtatcccgacgagcgtctccaattcctttgtggcagatacgtactcaaacggtctcgtaggcctgggcgtctttcacacggaggctggacggatccgcgctagacacccc

SEQ ID NO: 16661 - DNA, 582 bp, A.fumigatus
ccgccgaaaatgggacgaacatcctggccaagattccctgtcggaatatcgtccctcgatggtacgggaccgcgtccgaggtggccgtcttggacttcggtaggtatctcgtcttgtctccgtgaggccgggcgatggctgaccccgagcgcagtcaaatcgcactcgaccacgcctgtgtcggacgtcctcgcctggtgcgcagacgactccaaccccgtccgttccgaatacatcgtcctggagccgagcgtcggtgagctgctcaccaaggcgtgggacacccttgccgaacacgagcgcgtgaagctgatccgcaactttgcctcgctcgaaagtaagctggcagccacgcagtttccgggctacggtgccttgtatctgcgaaacgccctccccccggcgctgcaacaacccggccgcaccatcgacgtggatgacacgtactgcctcgggccgatgtaccacggctcctggccaggtggattcgcggcaaatgcagacgactatgcaaagtactcggggccctgtccgtcctcctccgcgatctgctttggctggagttctactgaacagcgatag

SEQ ID NO: 16662 - DNA, 462 bp, A.fumigatus
tgccgatcctcacagaagccgtcccgattcgccggcacactgagcccgtccttcgccaccccgactttcacccaggcaacatcttcgtctccgccgacgaccccaccgtcatcgtcggcgtcatcgactggcaattcacctgcatccttccacgcttcacgcaggttcgctggccgctgttcctcgctccgccggaaggctaccaacccggcacgcccaacccggaacgcccgcccaccgacaacgacaacacgcaacaagcgcaggacgcggcccttcgcgccaagtgctacgaggccgcgctcctcaagtcccatctggaatcgtacctggctctcaccgaacccgacgccgccatcagccgcctcttcatctcttgccccttcacctaccgcgacgggattctgcccgtacgcgactgcctgctcaagctctcgcagcactgggcgcgtttacaggtga

SEQ ID NO: 16663 - DNA, 336 bp, A.fumigatus
atgccaggcaaaccagcgacggaaaaagatctgttcgggtacagcaagggccgcttcctcgtgaacgaaggatacgagcgggcgaaacggtactcgccctttgacatccgcgaactctgccgcatggtctccgcgttgcctcgcgtggccggctcgcccattacccgcatcgagaagaaggagggcgggtacaacaaggcgctgttgatgaccgccgaaaatgggacgaacatcctggccaagattccctgtcggaatatcgtccctcgatggtacgggaccgcgtccgaggtggccgtcttggacttcggtaggtatctcgtcttgtctccgtga

SEQ ID NO: 16664 - DNA, 885 bp, A.fumigatus
acagcgatagggagaaccctcgccgagctcggccgcgatctcgcccaccaaggcatctgccaagtccgcaactacaagacctcctacgctggccggggcccgcactacggcactcccgaggagcacatccgcgtcctcgagactgtcatgcaagtgatgccgatcctcacagaagccgtcccgattcgccggcacactgagcccgtccttcgccaccccgactttcacccaggcaacatcttcgtctccgccgacgaccccaccgtcatcgtcggcgtcatcgactggcaattcacctgcatccttccacgcttcacgcaggttcgctggccgctgttcctcgctccgccggaaggctaccaacccggcacgcccaacccggaacgcccgcccaccgacaacgacaacacgcaacaagcgcaggacgcggcccttcgcgccaagtgctacgaggccgcgctcctcaagtcccatctggaatcgtacctggctctcaccgaacccgacgccgccatcagccgcctcttcatctcttgccccttcacctaccgcgacgggattctgcccgtacgcgactgcctgctcaagctctcgcagcactgggcgcgtttacaggtgagtcaggagtgtccgtaccggttcaccgcggcggaggtggcagagcacgagcaccagatggccgagtacgagggctggctaaaactgcgggagcatacgcagcagcttctccggtcgaatgatggcgggtgggtgccgtctggcgtggactttgaggagatccaggcgaggcatgataaactgtatcgccggtttgtgaagacgaagatggagcatatgtctgaggaggatgcgaagcggcagtggttcttccgtgagagaggatag

SEQ ID NO: 16665 - DNA, 1419 bp, A.fumigatus
  unsure (973),(974): Identity of nucleotide sequences at the above locations are unknown.
ggatcgacacctgagcccacaatgtctcaccttaccattgcgaactgctatgagattttgggcatcaattctgatgcaaccatcaaggaaatcaatacagcttacaagaaacttgctctcaagcatcacccagacaagacaggtggtgaggagagctctcatatcgaattccagaaggtacaagccccggagcaagataccgaggactcgaaaccaatcatgctaaccaaatccgaccatcagattcagcaggctgtggaaatacttcgcgacccggtccgccgcaagaaccatgatctggaactcttcaagctgggaaggatatccgtgcatggaactaattccccgcatgcaggtggctcccactggtcggcttccgcgttcaagagatacgatgagaacagtcgctacatgtacagctacgagcaaagtgtacatgtgagccctcagaagcaggaatctaaagaggatatggaatgggttgagcagatgctcaaggcggaagaggaattcagacggaaccttgccaggcagcaggaagtggaacagatgcgtgctcagatggaagccgagagggtaggacaagaggaggactgcaagcttcaaagtacttgggaagaccatccgtctgaacgcctcgaacaggatgctcataccgaggatgttctcgaagaagaatctgactatttcgagtcctacaccgagagtattacccggaaggagcaagacatctgggataaatgtgcacaaagggctccccggtccacggactatacggaggaagaatattaccaggacatgtaccagaagggtgagaaacagccagagctttatgacgaggatgaggaccccgagatcgacgacgacgacgacgaagagcctccacacctccatggggaggaagtcgaggaccaaccagagctctatgaaggcgtcgatggccacgaaaacgtgttccccagacgatcttgtnnatctcccccagctctacgaaaaagaggccatgacttcgacgattattccctgtgccctgacaatcagctctccgagtatattccgtctgtctgtgggtccgacttggataacgctactgcacgaagcagcggctctgaattcaatcctcgctttcatatggagagcatccgcgcggcttgtgccgacctgtacgacaataagtcgactagtgtggaagaggcccagaaaacagacgacgatacagccacattatatgacgtcagcgaggcagactcatcccacaaattctacagtaccaatccctacctatccgagactgagagtgtgaacgaagctgtgcacaacgacgtggacgaacaagtgtctgagggagtcgacaacgacgacagtgtcaatcggtcaagcctccatgatctcctatctcccttcgttccatacctgtga

SEQ ID NO: 16666 - DNA, 618 bp, A.fumigatus
aatcggtggatacgagatgctgatctttttggaagcactgcgccccccaacgccgccaacttcgcgactctgcgtgaaatcgagggccgtttgaagtccatcaagaacatcgagaagatcaccaacacgatgaagatcgttgcgtctactcgtcttacccgcgcccagaaggctatggacgactcccgtgtctacggtcagacctccaacaaggtcttcgagaacgccgaaaccaagcccctcgaggacaagaagaccctgctcgtcgttgctagctccgacaagggtctttgcggcggtatccactccggtctcagcaaggctacacgtcgtatactccaggaaaaccccaacgctgacgtggtcatcctcggagagaaggccaaggctcagctgtccagatccaacgccgacgccatcgtcatgagcttcgccaacgtctgcaaggacatccctacttttgctgatgctcaggtcattgccgaccagatcgctcagttgcccaccgactatgctagtgttaagattatctacaacaagttcatcaacgctcagagttacgaacccagcaccgttgaggcctactccgaggaggctatcaccaagtccggtcagtaa

SEQ ID NO: 16667 - DNA, 402 bp, A.fumigatus
aaaggggaaagcactcacccgtcacagatcccggctgtgatttggatcgatagactcggacgcaagcccgtcctggtcgtcggcgccatcggaatggcagcctgccacttcgtcatcgcggctatattcggccagaacgaaaaccaatgggacacgcacaaagctgctggatgggccgcagtctctatggtctggctgtttgtcatccatttcggttactcatggggtaagcggcttcccacctccgaggaagattcaactactaaccataaacccaaggaccatgcgcctggatcatcattgctgagatttggccgctcagtgttcgggcaaagggcaccgcgctgggtgcttcggcgagtaagtgctttatttctccttggcatcatatctcgactctga

SEQ ID NO: 16668 - DNA, 255 bp, A.fumigatus
gtgctttatttctccttggcatcatatctcgactctgacacagacttttttttcgcgccagactggatgaacaacttcatcgtcggtcaggtcacgcccgatatgctccagaacatcagatacgggacgtacatcttcttcggcataatcaccttccttggggctggtttcattgccttcatggtccctgagacaaagcagttgtctcttggtaagcttcttgatcctgtaatcgtcgaatttcgggtcttctaa

SEQ ID NO: 16669 - DNA, 192 bp, A.fumigatus
tcgtcgaatttcgggtcttctaacgagattacagaggaaatggatgttatcttcggctctgaaggcacagctatctccgactatgagcgtcaggcggagatctcccgggagattggtctcgatgaggctctggcgcggttgaccaatactgcgccggtggaggttcatgatgttgaagcgaaacagacttga

SEQ ID NO: 16670 - DNA, 267 bp, A.fumigatus
tcacaaccgaaccgtcacgccaaagagaaacaggaaactactaagcagcaacagattatcaaatttgcccagattacgaacatgttcaagagagattatgttgactgtccacaacatatctactattcaatcacgccatgtaagtgctggagtcgacaccgccctcgggatattcactatgcaattgtcagtcactgcatagcatcaagcctggggaaaattgtacatacggaagagcgacttcgaatcgcttctcaatttccttga

SEQ ID NO: 16671 - DNA, 585 bp, A.fumigatus
  unsure (9): Identity of nucleotide sequences at the above locations are unknown.
cctgtacgntacaagatggccaagccgaaagataaaaagggctcctcaggcggagtgaacagtcatttgcgcgcccggctggagtaccttcataacgccgcaagccttatacaatccgtggcggtttcctcgaagaaactagatggccagcgagccgataatggaaacccagagatatcggattcaaagaggattgtaccacatgttgtaaggcctgacattgcagctcagaaacagtcgtttgctactggcccgtcaaatgacacagatcgcctttcgcaactcgcccgagtttatgtatcacatttgcggggtgtgtccctaaaatctcagctgcggctcccagtggaagtcaagcattcattctgcaagcgctgcgacacacttctagttcccaatgtcaactgcacgcacgagattaggaatgacagccatggtcgcagaaaaccttgggcagatgtgctggtcattcgttgcactacatgtgggacggaaaagcgctttccacaaacagaaaagcgcagcaagaaacttgcggaacgtcggaaggaaaaagcacaagcggagaagccagatgttaagtga

SEQ ID NO: 16672 - DNA, 288 bp, A.fumigatus
tcaacgccaccttatctcgccgtcctaccgacaatgtctcacgaggaggatctcatcgactactccgacgaggagcttcttaccactgacgcagcagccaccacctctgcccccgccgcgaatggggcccaagacaataaaggtgacttgacagtttccggcggccgccccgataaaaaaggaagttatgtcggtattcactcgaccggttttcgcgatttcttgcttaagggagagcttttacgtgccatcaccgattgcggtttccaacatccatcggagggttag

SEQ ID NO: 16673 - DNA, 534 bp, A.fumigatus
cataccgctccgccttttacagtccagcaagtctgcattcctactgcaatcctgaacgtcgatgttctctgccaggccaagtctggtcttggaaagactgcagtgttcgttcttactacactccaccaactcgaacccgtacctggagaatgctcggttcttgtcatgtgtcacactcgtgagttggcgtaccagatcaagaatgaatacgccagattcagcaaatacctgccggatgtgaagactgctgtcttctacggtggtacgccgatccagaaagatatcgaggttttgtcgaacaaagagtcatatccgaacattgttgtcggtacacctggtcgtcttaatgctctggttcgcgagaagaagctttctctgcgcaacgtaaaggcgttcgtgttggatgaatgtgataagatgcttgatcagatcggtaagcaagcgcaaatcgctcgtacggaagtcccttacttacgtctcgccagacatgcgccgggatgtccaggagattttccgtgccacccccgccgataa

SEQ ID NO: 16674 - DNA, 327 bp, A.fumigatus
  unsure (29): Identity of nucleotide sequences at the above locations are unknown.
aaaatgggaaaaggatctgagacatccgngcagaaaaatgtattgagttgtaggtcccttgaatggagctcccattggttcgctggcttgtcctcggggtctaaaattaagcttgtggtttggaactgccgatcctcgtttgctttcagcacttttgtgtacagaattgactatgatttgggcacaactcgtctgattgctaattgctatttgaacataatcaaagatcatttgaatacgtacaaagttggctcaaacctggaatactcctgtaacatctaccaatcttcttgggtaatttcactggctagaatcatcagtacctaa

SEQ ID NO: 16675 - DNA, 288 bp, A.fumigatus
agtcgacgagtcttgccacctatgactgggcaattctcgtccttgtgccgagcgaaaagtgtttctgtttgggatacgatcgcacgaccaacctgtgttctggctaagcctgtcgtggacgcaggtagtaatgcactgtatgccccgttttcgaatgactcgggaatggacggacaatgcgacacggatgcttttttcgtttttcaagtcttatggatcgaatacaagtctaacataccgctccgccttttacagtccagcaagtctgcattcctactgcaatcctga

SEQ ID NO: 16676 - DNA, 462 bp, A.fumigatus
aggcgttcgtgttggatgaatgtgataagatgcttgatcagatcggtaagcaagcgcaaatcgctcgtacggaagtcccttacttacgtctcgccagacatgcgccgggatgtccaggagattttccgtgccacccccgccgataagcaagtcatgatgttcagtgcaaccctctcccaagagatccgacccatctgcaagaagttcatgaggaacccacttgaagtttacgtcgatgacgacaccaagctcacactccacggtctccaacaatactacatcaaactcagtgaatcggagaagaaccgtaaactcaacgaacttctggacagccttgagttcaaccaagtcattatcttcgttaagagcacactgcgtgcgaacgagttagacaagctgttgcgcgaatgtaactttcccagtattgcggtgcactctggtgtcagtcaggaggagcggtga

SEQ ID NO: 16677 - DNA, 312 bp, A.fumigatus
ttcatgtttagtatcaaacgttacaaggagttcaaggagttcaacaagcgtatctgtgtcgccaccgatgttttcggtcgtggtattgatattgagcgtatcaaccttgctatcaactacgatttgcctgctgatgccgattcatatctgcaccgtgttggccgtgctggtcgttttggaaccaagggtctatccatctcgtttgtcagcagcgaggaggatgagaaagtgctcaaggaaattgagaagcgattcgaagtcgctcttccgtatgtacaattttccccaggcttgatgctatgcagtgactga

SEQ ID NO: 16678 - DNA, 579 bp, A.fumigatus
gtcttcttgcgaacgcagtgtttgcgaggctctatctcatgtatttctatttccagtggttccatcgccgcgaccccctttagtgccgttatttccgacaggctcggtcgccgcaagtgtatgttcgtaggcgcctggatcattatcgcgggttccatcattatcgcgaccgcgaaccatctcccccagttctacgtcggccgcgtggttcttggtttcggtatccaggtgatggtcgtgtctgcccccgcgtatgctgttgagattgctcctccccactggcgtgggcgtgccgtcggtaagtcacctcacaactttagaaatgtgccagcaattgctgaactgggtaggtttctacaactgcggctggttcggtggttctatccccgctgcggctgtcacctacggctgcaacaacatcgacaacgactactcgtggcgtattcctttcatcctgcagtgctttgcctgtattattgtcgtctgttccatctggttcattcccgagtccccccgttggcagatcgcccatggccaggaggagaaggccatcgctttcctgaccaagtaccacggtaa

SEQ ID NO: 16679 - DNA, 933 bp, A.fumigatus
gtactttccatccgacaaacccttcatttgcaggagctgattgatcggctagaccgcccattcttcttcacccacagcggtcgctggcgtttcctccaggtcatgatgatctccgtcttcggtcagtggtctggtaacggtctgggttactttaacgccaccatctacaacaccctgggctacacctccagctccatgcagctgctgatgaacttggtcaactccatcgtttcggccatcggggctctgtccgccgtcgcccttaccgatcgcatgccccgtcggaaggttttggtctggggtacttttggtacgttcttctcccattcccctccccgaatcgccgctgactctttagcttgtgccatcaccatggccgtcaacgccggtgtctccgagcccctgatcaagcagactgccaccggtaacatcaacaaaacctacggccaaaccgccgtcgccttctactacctcttcaacttcgtcttctccttcacctatacccccctgcagggcgtcattccggccgaggccctcgaaaccaccacccgtgccaagggtctcgccctctccggcttcatggtcagctgcatcagtttcgtcagccagtacgccagcccgatcggtctacagaacatctccacccactacttttggatcttcgtcggctgggacttgttcgagtctctctgctggtatctgtttgggtatgtgctctttcccgtcttccgaggagctattctgactcgaatagtgtcgaatcccagggtcgtacgctggaggaactcgagtgggtttaccagcagcccaagcccgtcaaggcctcgctccaggtcgacaaggttgttgtccagcccgatggacacgtcgtcgagaagatcaccgacgaggcttaattgtcccgtgggtttatctctggtaaatgggaggtga

SEQ ID NO: 16680 - DNA, 483 bp, A.fumigatus
tggtcgtgtctgcccccgcgtatgctgttgagattgctcctccccactggcgtgggcgtgccgtcggtaagtcacctcacaactttagaaatgtgccagcaattgctgaactgggtaggtttctacaactgcggctggttcggtggttctatccccgctgcggctgtcacctacggctgcaacaacatcgacaacgactactcgtggcgtattcctttcatcctgcagtgctttgcctgtattattgtcgtctgttccatctggttcattcccgagtccccccgttggcagatcgcccatggccaggaggagaaggccatcgctttcctgaccaagtaccacggtaatggcaaccggaatgcccgcctcgtcctcctggaggtcgaggaaatgagagagggtattcgtttggatggtatcgacaagagatggtgggattgtgagtactttccatccgacaaacccttcatttgcaggagctga

SEQ ID NO: 16681 - DNA, 1785 bp, A.fumigatus
gatgaagattttccgcgcttcgtctgggatactgcctccaccatgatgagtcccaggtccaccaaatttttatggatacttcagctcctcgttatcggaaatgtacctttggtgttttcttctgtgaagccctaccctttatcatggaacaccacccacgactttggctacgatggaccctggcatgcaataccactgagaatcggtcgaccagagcagacaatcaatctttatcctggtggaagctgggcgtctgtcgttttaggtactcatatccaggacgcctggggcaatgactatcccaatcaggactggttgaaggggtctgaggtttgggatgcatcattaagtgcgccacagcgcagtggatcctcacagaacaacaatatcgcgcaggcaaaccgtgggggtgtttctggaagcattgacggcaattggggagggcaagttgcaatgaatatgaccggtctcggggtccagatcacggaccgggtgtatttctatacaccggataatggaatcgcaatacccaacggtactctgtcggtccttgcctcggccaacatgacttatcccgacggtaaagtagtacctctggacatggggttcttatctctcggtgcccgcgaggcgcagcgttgggatccctatgtcggaaatgtcattcccgactatctctcgattaacggttacacaccatcgagctcgtggtccctacatattggatccgccgtgatgggcataccaggctccttgatctttggtggatatgattcaactcgggtaattggcgatatcgggacgtatgataccactgacggttttggcggaatgttcacagagctggtcgatgttcaattaggggtggcgagcggcagtggctctccatggtcctttcagaacaagactaatctcctgcaagacgccggaagcaaaacacaggttattaccactcgcatgaacccgaccgttccatacattttccttccgaacagaacctgccagctgctagctgaaaatctccctgtcacctggcgatgggatctgggactgtacacatggaacacagaggatcctcaatatgagcggatcctcaactctccggcttatataaagtttgtgtttaacaggccagccggggcatcacccatcgagatccgagttccattcgccctgtttaatctcaccttgacccagccgatcgttgatcggccgacgcaatattttccttgtcggccgttccagaacaatggcgcagaataccaccttgggcgcgcatttctacaggcagcctttctaggtatgaactgggtgacctcaaagtggtggcttgcccaggctccaggtcctctcgggttggcttcctccattgtggttatctcaaacagcacagagaccatcaccaccagtgctccaagcagcttctggactgattcgtggaaaggtattctcaccagtcttcctatcgatgggaatcccagctcctcgggttcttccttccagccttcttccgccggaaatggaacagaaagcaaaggtgcactttccagcggtgcaatcgccggtatcgccgtcggtgcgtcggtgggaggcgtcctcattctagggatgctcttcttcttctggcggacacgccgcacgaggttcaccaagcagatccctagcccaacagtatcgcaagcccagccaaccacaccagcaaatacatcaaccgatgctcagaaatacgaactgccagacagacagccagtcgcttacgaactgatgtctcgcgaacagtactag

SEQ ID NO: 16682 - DNA, 900 bp, A.fumigatus
atatcctacgtcgctcaacgtgctcggtctctggtctgcgatgtcgaccccttcgatcaactggactctcccgttctggatgatcgtgctgtcgataatcatggtcaatctctctgctgtgatatcggcgctgtggactggtgctctcacgccggccaactctgtcgctttcaacagcaccacgctcatggtccccgactggtccaacaccacgctgatcaaagaatatccatcggagatcgaccagaccggcccaaccatccgcaacaccaaaggctacttcacctactccgtcggcgtgggcctcctgacccccctcgtcgcctcggccagcacagccaccaccgtcgacggcagcatccgcaaccacaacaagctcgacaactcgggctacgcctaccacggtcgatcgtacggcgttggcgctcctgtcggccttgtcgacgatatcctgcaccgcgagaacccccgcgcaacaaactacacgtacgaggaaaccggtctcgccgccgacgtcgcttgcatctacaaccgcacctcacaattcaccatccacgaactcggcagcgtcctgcacgctctgaaggggcctctcccggacagcaacctgagcgccccagagtactccgtctatatcggccgcggcgaccgcaccatcgtcggcatcggcgtctccagccagcccacaactttcacagcgagacgctacctcgccattgccgcgggggattattacgccccactgaacgcaacacagtgcaccgtgacgtacatccccgcgcgcttcaacgtctcggtcgacatcccctcgcggaacatcaccgtcgcaaagctggacggcccggcggcgtcaatcgaccccacgcatcgcatcgcccacgtcgtcacccgccagcttga

SEQ ID NO: 16683 - DNA, 1917 bp, A.fumigatus
gatattcgtgtgggattgacttcaatagcaaaaatgcgtatgatatacaggaagaacgacgagaaacaacgactcgtctcccaacgcagagtctcggaagattctgtccagaagccatcgcggcaatcgcatgctacctgggagcagctgctattctgcctcctgctgattcctgccgtcttgagcattctgctcgtcctcagcgatgttcgcaactggcatatgccttcagggctcaacgccctggtcgacgagtaccggacctcgatccagacggccgttcaaattgtagcgactattctgagcactatccagatattcgcgctctgtcggcttatcaactgggccacgcgcattctgtttggtaaatatcctacgtcgctcaacgtgctcggtctctggtctgcgatgtcgaccccttcgatcaactggactctcccgttctggatgatcgtgctgtcgataatcatggtcaatctctctgctgtgatatcggcgctgtggactggtgctctcacgccggccaactctgtcgctttcaacagcaccacgctcatggtccccgactggtccaacaccacgctgatcaaagaatatccatcggagatcgaccagaccggcccaaccatccgcaacaccaaaggctacttcacctactccgtcggcgtgggcctcctgacccccctcgtcgcctcggccagcacagccaccaccgtcgacggcagcatccgcaaccacaacaagctcgacaactcgggctacgcctaccacggtcgatcgtacggcgttggcgctcctgtcggccttgtcgacgatatcctgcaccgcgagaacccccgcgcaacaaactacacgtacgaggaaaccggtctcgccgccgacgtcgcttgcatctacaaccgcacctcacaattcaccatccacgaactcggcagcgtcctgcacgctctgaaggggcctctcccggacagcaacctgagcgccccagagtactccgtctatatcggccgcggcgaccgcaccatcgtcggcatcggcgtctccagccagcccacaactttcacagcgagacgctacctcgccattgccgcgggggattattacgccccactgaacgcaacacagtgcaccgtgacgtacatccccgcgcgcttcaacgtctcggtcgacatcccctcgcggaacatcaccgtcgcaaagctggacggcccggcggcgtcaatcgaccccacgcatcgcatcgcccacgtcgtcacccgccagcttgaactcatctcaaacgacctcaccagcttctatcgatccacgctgggtgatgccctcaacgccagtatcagcgactaccgcaccgcggtagcagccaccagcccgaatgcgtctctgtcagaagagcagatcgcgctcaccggcctcgaaaacgcaatcgtcgcattcgtggacgatatgctcgtcgcgtatgcctcggcgcagctggtcgtcggcgggttcgccaccccggccagtgcggcggtgcatgtctctgcgctgcggcttgggtcgcgggcgtacatttgtgccaccgcggtgatcacgggggtgattgtgctgctggtggttgcggagatggtccggacgaaggggtggagggggctgcccaagtttgactatttggataatcggatgctggtgctgggggctagtgctgggggaggggagattgcggagtatgcggcggagcggcggtggaaggccacggggaggattccggttgtgttgaggacggaaggggatcatgaggtgattgcgttaggggtggagagaggtagtgacaggcagcaatcggagagtacgttggctgaggagactgagcagtcaactgccgtcagtgagacgaggcaggcggggagtaggagggttgctgaggcggggtggatctga

SEQ ID NO: 16684 - DNA, 411 bp, A.fumigatus
cccggcagacatggtttatcatacacaaccttccatgtctctcctgaggcgacggtctctccaattgtcttctcgtcggacagtccgcccactgccacagtcctagtcaagaatactggtcccatggcaggagcgcagaccctacagctttatattgccgcgcccaattcaacaactccacgccctgtcaaggagctacacggattcaccaaagtgttcctacagtctggagaagagcgatcagtttctatccacatcgaccgatacgcgaccagcttctgggatgagatcgaggatatgtggaagagcgaagagggcgtgtatcaggtgctgattgggacttcgagtcaggagattgtgtctcgaggagagtttagggtggagcagacaagatactggcgtggtgtatag

SEQ ID NO: 16685 - DNA, 255 bp, A.fumigatus
caatattcaaggggaacaattcaatgtttttcagccaattggaagtgggagagccccgaagcctgggttcttaagcggtggccggtggccgccatcctttttgcatctaagatgggatatttgttcgatatcatcactggacatgattttcaactgtggaggtttggcagaagcatgggcagtcccggaagggctttgagaggtctggaaaagtcaggggcattccgatcaatccacgaaaacggctggacttag

SEQ ID NO: 16686 - DNA, 2028 bp, A.fumigatus
agtctcatagggagtgacttttggcacactcatgcaatccccaaattcaatgtgcctccgattcgtaccactgacgggccaaatgggatccgcggcaccaagttctttgccggggtgcccgctgcatgcctcccatgtggcacagccctaggcgccacctgggatcgtgatctgctgcaccaagccggtgtcctgcttggcaaagaatgtctcgccaagggggcacattgctggctgggtcctacgatcaacatgcagcggtcgcccctaggaggacgcgggtttgaatcgttcgcggaagacccccatctctcggggatcatggccaagtcaatcatcctgggctgcgagagcactggggttatctccactgtcaagcactacgtaggaaatgaccaggaacatgagcgccgcgctgtcgatgtgctggttaccccgcgcgcacttcgggagatctatctccgtccctttcagattgtagctcgggatgcccatccgggggcattgatgacctcgtacaacaaaatcaacggcaagcatgtcgttgagaatcctgccatgctggatattgtccgcaaagactggcactgggatccattgatcatgagcgattggctaggaacatacaccaccatcgactcgctgaatgcgggcctagatctcgagatgccgggtccgacgcgctatcgcggaaagtacatcgaatcagccatgcaggcaagactgatcaaacagtcgacgatcagcaagcgtgctcggaaggtcctggagtttgttgaacgcgccagccgcgctcctgtgtcggccgatgagactggccgtgacttcccagaagaccgggcgttgaaccggaccctgtgtgcaaacagtatcgttctgctgaagaatgatggcaatctgctgccgattcccaagacagtcaagaaaattgcactgatcgggtctcatgtgaagactccggctatttcaggcggcggcagtgcttctcttgagccgtactatgcagtctctttatacgatgctgtcgtcgaagcacttcctgatgccgaaatcctctatgaagcgggcgcgtatgctcacaggatgcttcctgtcattgatcgaatgcttagcaatgctgtcatccacttctacaatgaacctcctgaaaaggaacgcacactactggcgacagaaccggtcgttaacactgcgttccagttgatggactacaacgctcccggtctcaacagagccttgttctgggctactctaatcggggagtttacaccagatgtctctgggctgtgggactttggtctcaccgtattcggaactgccacgcttttcattgacgatgaaatggtcattgataacgccacgcgccaaacccgcggaacagcctttttcggcaagggaacggtgcaggaggttgggcagaagcagctcactgctggacaaacgtacaagattcgaatcgagtttggatctgccaacaccagtcctatgaaagctatcggtgtggttcactttggtggtggggccgcgcatctcggtgcatgtctacacatggatccagagcagatggttgccaatgcggttagagtcgctgcagaggcggattatacgattgtgtgcacaggactcaacagagactgggagtcggaagggttcgaccgtcccgatatggatctgccccccggcatcgacgcgctgatttcgtccgtgcttgacgtggcggctgacaggactgtcattgttaaccaatccgggactcctgttacgatgccgtgggcgcatcgagccaggggaattgttcaggcatggtatggaggcaatgaaaccggccacggcattgccgatgtcctgtttggagatgtcaacccgagtggaaaactgcctctttcctggccggcggatgtgaggcacaatcccacgtatctgaacaatatgagcgtggggggtagaatgctctacggtgaggatgtgtatatagggtatcgattctacgagaaggtcggccgcgaggtcttgtttccatttgggtag

SEQ ID NO: 16687 - DNA, 423 bp, A.fumigatus
gtcctctgcagtgtcttgaaatggtgctggagcagactccccggaggagttgtcacctgggacgcgtatgaacttttcaaagtcggcgaacaaggtatgggtttacactacatagcggcggccggcaggttgcataaggctgatcggatcgcagattctcaactcgcccgcgacgcattctccacgttcatcccaatcagtgtcgactcggatgctcgaaccaagattattttcgactttttcgacctgctagctgccattgcagcacacggcaagtccaacggtctcggaggccgaaagctctcgaggtatgctgggtggtgggcttttgagcattcggatgcgggcaatggctttgaagctgcctacaaaaactgggccgcgtacgttttccttcaatcgaatatacctggactgagttag

SEQ ID NO: 16688 - DNA, 1089 bp, A.fumigatus
  unsure (698): Identity of nucleotide sequences at the above locations are unknown.
caaggaacgagtttgcggggcggtcttcggtccgctcctcattccgtcgcgggggatcttggtcgccctacaactccatcctgggcagatttcatgtcctccggcttcaatgacagcaacgacttcaagccgcaagttgctcctttgctccttccaccacacaaggtcctgcctccaattgctacggtgcgaggccaaagctctcagtctcacaagcgtaccctggactcggaagttcctgccgaacctgccgagcttgccagcatcaccacactggatctggacgactccttctggtgggtctggatcagcagtctgacactagaggagcctgcttcgcggaaggcggtatttggtaggtgcgcattgatcgaaacgatcattaaggacacaaagtggttagttctggaggaacaggttaaaggcgcagcgccggagcctgaaccaggtgcgtacattgtcgagaagaagaggttttttaccttctcttctcgcaagggaatgatcggtcggcgcaaatcgtcggccaaaaaagtgtctgccgttgaagagtcctacaatcgcgccaacaatctcgctccccatagtaagactagcattgcacctgatcagcatgctcgcattcaggctgctgccgcggctttgcagaagaagcatcgggaacaggagcaggaggccgttaacagatcgaaggctancgtgccgaacgactcacggtactcaaaggcaacctccgttatgtctttgcaaccaggaatcatgagtgaggcttctcaagcgatgaagtgggccaggaattatgacaagaatgcctatcgcgccgcctatctcaaggacagccgggccgggacaggtgcgctgaccgacgaaaatgaggcggctgtgaacggcaaggtgtcagagccgccagcttctccggcactgagctcatcaacccaccaggcgccacctccggtgcccaaggacagcgtgccaagctctcccacgccgattgagcatatgcaaagaagcagtgtggacgaaaatgccgccagcagacaggacaatatcagtgcagctgctgaatctctgccccaagcagtcaactga

SEQ ID NO: 16689 - DNA, 747 bp, A.fumigatus
aacctactgggggctcagccgtcggctgttgctgctgctcgtgcggctttagaaggcaaggccaaggaagcccaggagacagttcgccccaatggcgcttcgactttgaggaaacccgttccagctccggcggcggctccccccgctgctccagctgaagtcgcaagcccacctgcacgcgtggagaaaccagtccctgagccgcagaccgtcactactgacgaacagcatgatgggcccccgatgacccgtcgtgatgctgaatacgatgcactttcccgcgtagacactaatgagcgaacggcagcggatcgtgaattctctcgatttgatcagggccccttggtggaacagccagcgttcgctcctgaggattctcctgtctctgaagcattcgctgacaagtctgcgcctgctgccactgttagcgaataccccaataggaccggagtttctgaacgttcaacgagccctacggcagccccggccaattcatcttatgaccgctgggcacagattcgcaagaatgccgcggaaagggccgctagactcgaacagtccggttcctaccgatatagccaagatgaaggtaatacaagcgaagaagagagtaagtggaggcggccccttgaactggcaataacgatgctgattctgtccaggcttcgagtctcgtgctgctcgtatcaaggcgagagtggccgaattgactggaaatatgcaggccgcaagctaaaagacgtctaa

SEQ ID NO: 16690 - DNA, 300 bp, A.fumigatus
aatggcaaagccggcgccattcccgccgcatcctcctcttccctcgagaaacccgtcacccctgctccagcaagcaaagatacccccgagggtgccgtcgcattcagcagcgccgcaggcccatggctgaccgcggcgataggctttcccgccgctgcgacattctgtatcagggcaagcgaggccgcgtcccttacgaggtcaaacatcgctaccatcaacatcaacatcaacatcataatgtcaacctcagattgtagatcgttagacatagacatacccccccgcccacccacatag

SEQ ID NO: 16691 - DNA, 786 bp, A.fumigatus
  unsure (27): Identity of nucleotide sequences at the above locations are unknown.
ttactcgttactcgccgctggctgatnacccatttcaccacgcacagctcacaacaaggaaaacacccgcagtccgaactcgcccacccatactctatcctcgaacccaaggtcaccctcaccatggcctcccctcagggcggcgaagcgcccttcgacccagcctctgcctcagcctccgcgagaccagaatccgatacaaccgacatcaccgctctagcgcggcactgggaggcttggacgcacacgtataagatcagggagttggttgcccgtgcgggagcgggggaattcgacgcggtgttctatgtgggtgggcgggggggtatgtctatgtctaacgatctacaatctgaggttgacattatgatgttgatgttgatgttgatggtagcgatgtttgacctcgtaagggacgcggcctcgcttgccctgatacagaatgtcgcagcggcgggaaagcctatcgccgcggtcagccatgggcctgcggcgctgctgaatgcgacggcaccctcgggggtatctttgcttgctggagcaggggtgacgggtttctcgagggaagaggaggatgcggcgggaatggcgccggctttgccatttcagttggagacggagctggagcgcgtatctgggggtggatatgtcaaagcggaccgatctgggaccaaggttgttgtatctacgacggccgggctgtgctcgccgctgattacagggcagaatccggctagtgcggctggcgtggctcgggagattttgagggtattggggtgcgattga

SEQ ID NO: 16692 - DNA, 546 bp, A.fumigatus
caattttgtgcgtatctggtgaatagtgtccatcctacactaagcctgcacatattcaagatgggagctgtgagaaagatcaagacaaagcgcagaacaaggtacgatatacaggaatgcactcatcgcgccattggtgcacttgaaggtccgatagctctaacattgcttgtctcttgtagggactacgatcaagtccgagcggacatcgactctcccaagcaccttacgcagtacaaagcgaccaaggatgcggaggatctcccaggtctaggaaagcattattgcgtcgaatgttcgaaatggtttgagagcgaatacaacctggtcgcccataccaagggcaaaaaccacaaaagaaggtcggtgataatggacagtgcgaacgtctttttggaccgatcacgtctaactcagggatgcttgaataggttgcgattgctgcgcgaggagcctcattcacagaaaatcgccgaggctgctgtcggtctgagtaccgacaatggattgcgacaacaggaaacggtcgttgacatggaggattag

SEQ ID NO: 16693 - DNA, 1092 bp, A.fumigatus
gcagtgaaatggctgggaaaggatgcaattacgccgttcgcgatagacggcaaagcctcgaaggcggagctcacctcccaaataaagcaatgggccatcgcatccgggcgggccgtagtccggcctgttctcatagtttcatatgaaactcttcgaatgtatgtcgatgcattaaaagacagtccgattgggcttcttttgtgcgatgaaggccatcgtctcaagaacaaagacagtttaacgtggactgctttgaacagtctgaatgtgactcgtcgtgtgattttgtcgggtacccccatccagaatgatctctctgaatatttcgctcttctccattttgccaacccaaatctgcttggctcgcaaaatgagttccgaaagagattcgaaatacctattctgaaaggacgagatgccgcaggcacagaggaagatcggaagaagggcgacgagcgattggcagagttatctggtattgtgaataaattcatcattcgccggacgaacgatattttgtcgaagtatctgccgatcaaatatgagcatgttgtcttctgcaacctttcccagttccagcttgatctctacaaccatttcatccagagccccgagatcaagagcctgcttaggggaaagggaagtcagccactgaaggccattgggatattgaaaaaactatgcaatcatccggatttactcgatctcacgagagatcttcctggctgcgaacatacgtttcccgaggactatgttccacctgaagctagagggcgagacagagatatcaaatcatggtactctgggaagatgatggttctcgatcgtatgctagctcgtatccgtcaagatacgaatgacaagattgtcctcatcagcaattacacccaaactctcgacttgttcgaaaagctctgccgatcgagaggctatggctcgttgaggctggacggtactatgaacatcaacaagcggcaaaagctcgtcgacaaattcaacaatccagatggtgaggaatttgtgttccttctaagcagtaaggccggcggttgcggattaaacttgatcggcgcaaaccgccttgtgttgttc

SEQ ID NO: 16694 - DNA, 879 bp, A.fumigatus
attgacaaaaataggtatcgcccgcgcccagctgtaggaactgaaggtggaaacaccccgttatccaagccactacagagaaacatatcatccaactcgatagaccgtctttcaaagcctttcaaatgtcccgggtctgccatccctacccgaacatcagataagcctgcgagaaagcgaagaaaagtcaactacgcaggagcagatggagaggtggaggacaacagcgtcaagccatggaccaacgaagaacgtcttgctcttgcgacaagagatgccaataaatttcccgtctttaaagtcaaggacaaggaaaccacgtttaagcaaagatttcggatacctttgatcaacaagtcctctaatgattacaatccttcgagaccagctcccactttgggaatgaggcaaggcgccacttttgttgtgaaaccactacacgatcctagtggagaatttgcgatagttctatatgatcccaccgtcgacgatattggcgaggctccagaatcgatgcctgaagacaagggcatcgaggaaactaaagccaagctggacgagccgctggtgcacaagagcctagcagatatactcggactgaagaagaaggtggagtctcgtcctaaggttccagtggtcatagatcccagattggcgaaagttctgcggccgcatcaagtggaaggtgtaaaggtagtgactcccttgacatccacacgaacacgaatccagaaactaacctgtctcctccgcaagtttctttatcgctgtacaacaggtctgatagataaaaatgcgaatggttgcattatggccgatggtatgggattgggaaagactgtatgtggcagcttctttcgagatattgatcaagcctaa

SEQ ID NO: 16695 - DNA, 519 bp, A.fumigatus
ttacttgcgccagagactcgattggctatggattttagtatgcacaatgctttccctgggtctttccgcgacaggtttctagtcggacgtttatttacctatggcacccacagtttctgttcttacgagtaccgcagacctcttatgtcttccgaaattgataacgcgcatgagattgctctgaaagtacttttctgtggaggcattgctggagtgaccacatgggcttctgtttacccgctggacatgatcaagacgagactgcaagcgcagacaattgcaatagctcccgagtcccgcccactgatacctatacagagcaagccccagacattgaattcctaccagattactaaagccgcgtatcagtccgaagggctgaaagctttctaccgaggactcgggatttgtagcttgagagctttcatagtaaacgctgttcaggtatgtgattccaacaccacggaatggcatttgctaatcatgcgcaacagtgggcagcatacgaatggcttatga

SEQ ID NO: 16696 - DNA, 186 bp, A.fumigatus
cggggtgtttccaccttcagttcctacagctgggcgcgggcgatacctatttttgtcaattcagctcattggaacgcagagagcctagagtggactcacattgatagcttcttctatgcaggcatagcttctcaagtagctggctggattgccttgtcgctatccgtagtaatcaatcaaggttga

SEQ ID NO: 16697 - DNA, 228 bp, A.fumigatus
gcagccactgctcaagctctcgaccttgggaaattgttctcaatgtcgtcagacttttgggcgggatacctcagtggagccattggaatcataatcggcaaccctctggatgttgtcaaggttcgattacaagctggcggggttaatgtagctggatcaacgagccggaacataggctccttcgagaatgtgagctcccttgtgcgaggtcggttggctctctcatga

SEQ ID NO: 16698 - DNA, 360 bp, A.fumigatus
acactgacgtgggtacgaggtgctgctgctcccatactgggatatggagcgtttaatgcgctgctgtttgtcgcttataatcgttcgttgatgttcatggatgattcgataaaggatcctacaaaccccttgggcgtttcgctctacaaaatttggcatgttggtgctgctgggggagcggccagctggacgctctcatctcccacagagttcatcaaatgccgagcgcaaattgactctcgccttggggtctcttcgtggactgtcgccaaggacatctttcggacccgaggattgacgggtctttacttcggaggcatgattacttgcgccagagactcgattggctatggattttag

SEQ ID NO: 16699 - DNA, 1125 bp, A.fumigatus
gtcgaaccacagtcgcagcgagacccaatcggtctcctcgcagggtggtctcccgacaggtgggtgttctatatgatccttctggctggatttgaaatgcaggagataaccattcccccactgacaacaggcactattcctgagaacgagaagttatccacccgggatgatgagaaggggacgcaggacgatcatgtttacatcgcggataccctcccccttcgacgccagattcccttcatcctgacgatctgctcggccatgtacacgaaccagctcgggctgggccaaaccatggacatcgttcgtatcattggggactggtacggaatcaccaatagcaacgaactgtcgtggttggtggccggctacagcttgaccattggcacctttgtcctgattgccggccggctaggggacgactttggacataagaggatgttcgtcatcggcatgggctggtatgcgctgtggacgctggtctgtggtctggccgtctattccacgcaggtgctcttcatcttcgcccgggtcttccagggaatgggccccgcggtgacactgcccaacgcaatcgccattctgggccagtcatacgcccccgggccgcgcaagaacatggcatttgcctttttcggcggcagcgcaccctttggcgccatctccggctttgccactggcggcctttttgcgctggcctggtggccgtgggcgtactggagcgcagccatcgcactcaccggtctggcggtgtttgcggtatggtcgatcccacctcaaccggtgagcgcgacggccacgactcggacggtgggccagaagatcgcacacctggaccttgccggctgcgtcaccggcgtggcctcgctggtcctgatcaatttcgcgtggaatcaagccgccggggtcggttggcaagagccatacgtgtatgtctgcctcatcctggggttcctcgcggcggcagccttcttctgggtggaactgcactggtcggaagatcccatcctgcccctggcggccttcaactccgacattgccttcgtgctgggctgcaccgcctgtggctgggccaccgctcgaatctgggtgtttttacagccgccggctggaaggacaacgctc

SEQ ID NO: 16700 - DNA, 930 bp, A.fumigatus
gccccggtgtcccgaaagaaagtgccgggccttcaccaaattgttttttttggagctactccccccatgttgggaccgttcttcatggaaccggaagttagaccgccccaaacatgtccacattcccggccggatccccccattgaacggccccccaccgcgggtttataccccggccgggtgattttaataaatgcgtggcccggcagcaccaaccacaacaagcagcggcccggctttgtcacccttgatccatgggagaagaagtcatccaccctgctgaacaactactatggcctgaccttcacggactgtgacgatgtcatcgtcgaccccgtcacgggcttcgtctggttcaccgtcccctattactcctggtggctggaggtggccgacacgccgccccagctcaagtccgccacctatcgcttcgatccggccacggggtccacggtcgtcgtcaatgacgagatgcgctcgccgaacggcatcgccctgagtcccgaccggcgacacctctacatcagcgacaccgaggccgcgggtcagtcggcgccgatctccctcgatctgcccagccccggcgtggccggtctgctgttcaacaccaccggcaaacgcaccatctacaagttcgatctcatcgaccagggacacgccattgccaacaagcgtcccatccactacgacgcaatcggcacggtgcccgacggactcaaggtggcccggaacggatgggtggtgacggcgagcgggaatggattgagcgtgatggacgagtatggggagatgatcgcgcgcgtgcaggtcaatttcaccgtcaacaactttgtctgggccgatgtggacgactatcgggaggtgtggatggtgggacagggaggcgtgggacgcgtgcgatgggagctccaggggcaaaaagccgtttga

SEQ ID NO: 16701 - DNA, 1002 bp, A.fumigatus
tatgagccaccgactgaacggtcgagtactcgaccatctagggagataaatctcgatgagccactccatcgcaacgtgctcaaggcgctccggaaatccctggaactgcaatatcgaaacgagaacgccggattgtggtacttcgtcgatccgccgcccccctacccaccgtacggcaatctctcgtacagcgacggcatgtacggcttcgcgcccttcgccgccttgtacggcatgacctacggcgacccaggggtcaacctcgacgccgcgctgcttcagctggatcttctctacacgcagagcatcgagccatccacggggttgatcaagcacggctacgatgcatcgcgagacgctccctgggcgcacccgatcactggcgccagtcccattgtgtggggccggagtctcgcatggtacctgatcggcacggtggacaccctggagatcatcgcatccaggtctggagaccactcggaggatgcaaggcgcacggacaagaccgtccagcgcatccgtgagatctttcagcgtctcgcccgagcgacggtggacgccatcgaggactcggccggaaagacggggcgctatgccgtctggcaggtgatggatcggccgggagagcctgggaatttcgtcgaagccagtgccagtgccatgattgcgtatgtgctggccaagggggtccgtctaggctatctgcccggacgttcgccaagttcagagactgatggaaaacaccgtgcggcttcgtctctttgggtccagggcccgaggccgggtttccgtgatccggtgcaatctcaggatgttctggccgtggcacgcgctctctaccaagatgtggttgcgcaatttgtcgttcgcaggcacgaggacgacactctggatttcctggggacgagcatcatcgccagcttgcatgaagagaagccgtattacgaggtctgtttttccccgttttcgaggtccgatgtctttgtcttcgggctaacgtaa

SEQ ID NO: 16702 - DNA, 1110 bp, A.fumigatus
actctacgatttagcggaatatcgtctggcaccgcagtttccctttccttgtgccctacaggactgtttggcggcttatctgttccttctcaacgaacacgatccgaccgagatcatatttgccggagactccgcagggggtggaatggtcctttcgtaagtgccataccgactactcttggaaatgcaactaatcatggcaggatgttggtcaccattcgtgaccaaggactacctttgccggccggagctatcctgatatcgccctgggtggatctgacccattcttttcccagtgtgctatcggacagtccaggtgattacatcccaccgagtggattccgatataggccctccgcagcctggccgcctccaaacgccgatgaactccgctcgatcaaggatgcaaaacaagagtcaccagaaagcgctgtggaaaaagccgtgccaggagaggacacaccggctcaggagacagcagtgcaggggtacacagtcgagaaggatggatcagatcggacagaaccgactccagcagctcttcagcattccgaagacgacgagaccaagctcgtcgaaattcctattgacggtcatacagtcgtagtgaaagaccagatccaaatgtatacaccgaatcacctcatctcccacccactcgtctccccggtactccaaccgtcgcttggcggtctacccccgctgcagatcctcgtcggaggaggcgagcggttacgggacgagcagttttacattgctcacaaggccgcaaacccaacagcatatcctcccagcgacaagactctggacgagtatgatcccaaacgagaaatcctacacaaatatcctggcacctatgtccaattgcaggtatgggacgatctctgccacgttgccccgacccttagttttacgcgcccggccaaatacatgtaccgatcgattgctcaattcggtgcctgggctcttgcatgctcccacccttcggagattgccatcctcgacgacaacgacatctcctccatctcctcctccagtgaaacagaccctcgcgacgcagaaacccatggcgaggtcttcaccacggggctggaaggtgccgcgccataa

SEQ ID NO: 16703 - DNA, 219 bp, A.fumigatus
ccacatgctaattgcgcagtgagttacgcccgggccacagaatacagaatgactgctaaactctacgatttagcggaatatcgtctggcaccgcagtttccctttccttgtgccctacaggactgtttggcggcttatctgttccttctcaacgaacacgatccgaccgagatcatatttgccggagactccgcagggggtggaatggtcctttcgtaa

SEQ ID NO: 16704 - DNA, 408 bp, A.fumigatus
gttccattacagcaagcactgctggacgtctttaagcccgtatcataccgtaatatgtctggtcatccatctggaacactccacactgtgtgtcaggttgagtgcatccgttgcaatgacctgcccgacgccatgacagatcttctggactcggccatgcagattatctcggcagtcatggactttgtaaagtactgtgatcaagaagacagcatccgccagcagtacacatggattgtaagcccctgtaacctgtctctgatccagcttcagatgcctaacctgtcaggatcaacttttctcttctatactctccagcagcaggtgttgttgcaactccaccccatcactgtacagtgtttagcttgccactaccatgttccatcccgcggtcgaatttatccgtga

SEQ ID NO: 16705 - DNA, 483 bp, A.fumigatus
tatctgcatcggaaatcccatcgcacgaaacccacggtccacatctcctatgacgaggcaatccagattattcgtcaattccttaactatgctgccaaacacaccgtggaggatatccagtcgttcacggctcaacgagttcccgccccgcattgggtgaagacaaccaaggtcgtcattccggagaattacctctcttctgcggcgactgctcttatcaagcaacttgggcccaaaggtatagcgcgtgtggggggtgacaaatggtggcaatggcgtggaccggccgaggatctcagaggagagtggatcgagatgaagtcggactaccacgagaggagacgcaccaacaatcatccgagcgggaagcgcatcatgttgtatcttcacggcggtgcctacttttttggcagcgtcgagactcatcgatatcaattgcagcgtcatgcgcgaaaactcaagggacgagtatttgcacggtaa

SEQ ID NO: 16706 - DNA, 1173 bp, A.fumigatus
tgcttcctgacagtcgcgccacgaagaaacccaagaacactgaatcaagtcccgcccgagatcctggatgaccctgaaatccaggccgcgattgaacttctgcccaagaattactcatttgagattcccaagacgatctatcggatacggacttcgggcgccaaacgtgttgctctacagtttccagagggcttactcatattcgctaccacgatatccgatatcctaacccagttttgcccggggacagagactttgataatgggcgatgtcacctacggcgcctgctgtattgacgactataccgctcgtgctctaggatgcgatctgctggtccactatgcgcacagctgcctcatccccgttgatgtgacccatatcaaaacgctgtatatcttcgtcgacatcagcatcgacacctctcatttgattgctacgttagaacgcaacttccagccaggaaagaccatcgcaaccgtcggcacgatccaattcaacgcaacacttcacggcctcaaacccgtgcttgaacgcgccggattcaaagtcgtcatcccgcaaatcgcaccgctgtccaaaggcgagatcctaggctgtacctcaccgcaactctcccccaccgagatcgatatcctcctctacctcggtgatggccgcttccacctcgaatccgccatgattcacaaccctaccatccctgcataccgctacgacccgtactcccgcactctctcccgcgagacctactcccacgacgagatgcatgccctccgccgagacgccatcaacactgccaaatcagccaaaaaatggggcatcatcctaggctcgctcggccggcaaggaaacccgaacaccatggccatgatcgagaaccacctcaacgagcgtggtatccccttcgtcaacttgcttcttagcgagatctttcccggaaagttggcgtccatgtcggatgtcgaatgctgggtgcagatcgcttgccccaggttgagtatcgattggggctatgcattcccgcgaccgcttctgacgccctatgaggcgttgattgcgttgggtgtgagggagcactgggatagcgcgaacagcggtgtatatccaatggatttctatgctaaagagggactagggagaacaaagcctcagcaagctttacagggggctgcttga

SEQ ID NO: 16707 - DNA, 549 bp, A.fumigatus
ctcgatgccatctccgccactccgcatttccacttgttccatacatccttgacgtctcgtctgacacaactttgcatctcttcaatagacaacatcatggcttttttcttcgtacctcgccgggtattcgtacgctccagctctggtctccgtatatcctcccggtcgttctcatgtttctccgttcttcggaacgacaagccggctttcgccttcggccgcggcccggctcctccaaggctaccgaaggaagagcaagagctctttgaagaacttcaaagacgatcgactggcgcatttagtacgcctcgcgcccctcccaaagtctaccagtcaccacattcgcaacctgccgctgaaagagagcctgagtttaaagccatgggcaaaggagaggaacttcatccggatctgcggggaggtctcaagcctgaatttgagggtgagaagaatcccaagactggagaagtggggggacccaagaacgagccactgcgatggggggcggatggcgactggagctacggtggtcgtgtcacagatttctaa

SEQ ID NO: 16708 - DNA, 564 bp, A.fumigatus
cgttcactgttcctgaattctcgcaagaattgcctttcccgcccggctctcattgaaccggcccagctcgctgctaatccaggagccaatcttggacatctcttccaagttgattccagtatgcatgccaagtccatgcagcgtgtggataagatcttcggtcgatacattgccagtagcacccttagaataagggcagccaccgagacctccgacactgctgtcgaatatccgaatgccgtgctccaggcccactatggtattcacgagggcttggccgtacgtatcgtgaaaatgaagtgccagatctgtgtttgcgataccggcagccttgagtgcttgcaggagctcaagtgtccgtggagccgttcccataccagtggtgtcggcaaccgacacttcatcagcgcccatttcaagaagtgtagccgtgatgtccgcgactttggaggggggaacatctggaccttcatatgggcagcccaacgccacagaaacatatcctctgaccctgatatctttcgtcttggccaacgctacgatggggcggatccgctcgagtga

SEQ ID NO: 16709 - DNA, 612 bp, A.fumigatus
attatgaatgatgtgaccatgcataagcatgcctcaatatttgcaaagccgctggcagaacgagatgcacctgggtatagagatctcatatatcgaccgcaagacttgaaatccattaagtcgtccatccatcaaggcagtagagctgtggctgcagctacggaagctgccagcacgcccgctgcagatggagagtccccggctcccaatgcaggcacgacgtccaagaacgctgttctagtgcttccaaagactgaagacgtgattcctcctaaggccatagtcaactcggcacagttggagaaagaattgattcgcatgttcgctaacgccgtcatgttcaatcccattccgcaacgtgggttcggacctgccttccccatgatcagcgatggtgggtcgcgagagagcacgcaagttcccgaaccggatgaaggaggcatcatcaaagacactctggagatgttcgaagatgtcgagcaagcggtaacgagatggcgggcggcggaacgcactgctgacgaactagcgagcaagagcatcttatcccttcgaagaggtagcacgagcgatttgaacacggatagcgcagatgaagtcaaggggccatga

SEQ ID NO: 16710 - DNA, 339 bp, A.fumigatus
ctggcgttgtcttttggccatactgcatttccttggatcatggctttccgaccgagattgaatctcttctctacctttcgagctgctccacctgctcgactcttcgcgacagaggcgcggctaacctcggaccatgttcgcattgttgaagtaggtccacgagatggtctacagaacgaaaagaaatctataccgcttgagacgaagctgcagctcatcgagaagttggcgaagacgggagtgacgaccattgaggcgggatctttcgtacctgcaaaatgggttccacaggtatacacctcatgtttatccgcagttctctttgaaagtagcgcatga

SEQ ID NO: 16711 - DNA, 846 bp, A.fumigatus
agttttctgtctgacaggtctgggtcccatcagatggctagcactgcagaaatctgtgagcatctgctccgatcaccgccccagtcgcagcatgctattgcttataattacctggtaccgaacgtcaaggggcttgagtctctcatcaaggttatggatgcgacgtgttctacagcagagacaccaggctcagctaccaagcctccaacaactactgaaatctcactcttcgctgcagcaactgaagcattttccaaagccaacaccaattgtaccattgcagagtcactcgagcggatccgccccatcgtagcgttggccaagacgaaagatatcagggtcagaggatatgtttctgtggcgttgggctgcccatatgaaggtccagatgttcccccctccaaagtcgcggacatcacggctacacttcttgaaatgggcgctgatgaagtgtcggttgccgacaccactggtatgggaacggctccacggacacttgagctcctgcaagcactcaaggctgccggtatcgcaaacacagatctggcacttcattttcacgatacgtacggccaagccctcgtgaataccatagtgggcctggagcacggcattcggatattcgacagcagtgtcggaggtctcggtggctgcccttattctaagggtgctactggcaatgtatcgaccgaagatcttatccacacgctgcatggacttggcatgcatactggaatcaacttggaagagatgtccaagattggctcctggattagcagcgagctgggccggttcaatgagagccgggcgggaaaggcaattcttgcgagaattcaggaacagtga

SEQ ID NO: 16712 - DNA, 285 bp, A.fumigatus
aaagaggcagttttgcctaacccagaccctgccgcggaatctgccacggcggctttcatcagggagcgcaccccgtatatggtgcctacatacgtgcggccaactcccgtaatgattaagggacaaggatgttatgtctgggatatggagaacaggcggtatcttgatcttaccgctggaattgccgtcaactccctcggccattgtgacccggaaatcgcaaagattatcgcggaacaggtgcgtatacttgggttgattgaccacaccaccaggggtttgtag

SEQ ID NO: 16713 - DNA, 549 bp, A.fumigatus
ggactggaagcagactgggttctgcggttttggaggtatgtatctctttttcttccttttctcactagagcagctcttactaaccgtcgcgcagattcctgcaaatttcttcacgctcgagaggactacaaacagggctgggagctggaccgagaatgggagattggcaccaaaggcaagcaattgagtggtcgggttgtctcgaaacgaagcggcgacgcgaagactgcggaagacgatgaggacgatgatgacgaagagcttctcgagagcattccgtttgcatgcatcatctgcaagagctcctataaaagtcctatcgtcacgaaatgcggccattacttttgcgagtcatgcgccctgcagcggtatcggaagaacccctcgtgtgctgcgtgcggggcaggcactggtggtgtcttcaacgtcgcgaaaaagctgaatcacctgctggacaagaagagagaacgtgcgcgaaaactacgagagcaagcaatcgcagagggtgaggaggttagcagcgatgaggagggtgatgaggagtcctaa

SEQ ID NO: 16714 - DNA, 810 bp, A.fumigatus
atgatgtgctttcttcttgcgtcaatacacggcagctattgtccgcgccatagcacgatagtcctgtccaagaagttatttgtccaaataaagatggcggaggaaactcaaggtgcagacgctgttcctcaaatttccttcaagaaacgcaccaacaaggccaaagccaacttccgcaagaagcccgatacgccgccacctgcttcagattccgactcggatttcacatcgtccgatgatgaggaaggtcgccggatcaagcgacgacgcaagaacgctgcagtgactgcttcttcgactacagcgggtccgcgcagaaatgtcgtcgaagaccagcccgccaccgagaccgccgctattcccttgacctcgagtaacgatgcgaccaagcactccaactggtatgacgaggagttgagtgagaagaacctgttagggacgacaagagctcggccagcatcgaacactcaatctgcgcccgacggtacctacaagggcgccgcgaactattcatcattcatccagaagaaccccaatgcgcctaccaagcagtttggtcctatcaaagcgcctaccaacgtccgtacggtgacagtcatggattttgcgcctgatgtatgtaaggactggaagcagactgggttctgcggttttggaggtatgtatctctttttcttccttttctcactagagcagctcttactaaccgtcgcgcagattcctgcaaatttcttcacgctcgagaggactacaaacagggctgggagctggaccgagaatgggagattggcaccaaaggcaagcaattga

SEQ ID NO: 16715 - DNA, 1155 bp, A.fumigatus
gaagaagaggaatgtcctcaggaaaaatccgtcagtttggagaggcccctatggcttacagcagccggccttcgagtgcacgagattggcatgggacaggattcgcccaagattcgggctcccacagaaggacacagtcttttcgaggaacttgcagaactcgaaggcggcgaggatgaggacggaacatttggtgctaactcccagacgtctactccccgtatgcgtcttacggctgattcgcgacgaccctcggaggccattctggacgtgccggccaagcccgcgatggtcgattcaggcgtgatgaccgatccctggcaacctacggagtctgctaatcctgtaaatgccggggttgaagaggctctgcctgttgcaccagtcacgccaacaaaggcaaccgtaccagttgctgaagctggcatggccatcaaggagccaccgaagctggttaattccgcaacgcaatggacacctctcaggtcaggcgccgagtcaaatggtgatcaagtatctagcgtgccaaccccaccgaagatggcctgggatgatgcatcaggcgcagagggagagacaacccgtgttcctacacctccagtcgctaagccagacttctcgccgatttcataccaggagacctcaccagtggcccctgtattaccgcagttgactacatcatacttcatcggcggggtaaccgaaccggttgcacttccttcttcgctgccacgggagctgtctttgtcctccatatcctctcagtctacagagcctctcatggcacaacttccagaacctgagcaggtatactctccccagatggtcatttcagctgtcttctcggaacatacagttcccattgccgttactctacccgagccagaaccgttgcctgttctgtcttttgcggaacaagctacgaacacggagactccacatctaaaagtctcaactatcttctcggaacataccctgcccgttgctgcatcactccctgagcccgaacctgtaccaattatctctgtggcagaccactcaacaagcaccgagaactccggacctagagatatcttccatactcccttgagcagaccgaaactatcgcagctcttccaccccaatcacttttccggaaccagaaaccctttttga

SEQ ID NO: 16716 - DNA, 1767 bp, A.fumigatus
tcttctgaactacagtcaccgctcagtcccgtcctattcgccagtcaagcgaccaactctcccagcaaagtgagcgttccgtcacggaaacaacggaaccaaccgtccagccgggtccatgacattgaattcgcgaccgagatttccacttctctcttggcccaggttcgtcaattgcaggccatgctcgctgagcgcgaggaggcgttgaagaatgccaaccttgagaaatcacgactggagctggaggcagaagggtacgcacagcgaattagggcgctggatgagagcgaggagcgttacaaggatgagaattggaacctcgagactcgaactcacgagcttatgaccgcgatgaaggaggctgccgatcgcgaaaacagactaaatagcgccctcggtaccgtcacgtcagagaagaatgctattgaacgggagctggaggaagtgaaacaggccaatgctcggttgatcgaggaacaggccgctgctcagaaagccaacgatgctgagattcacctcctgcgcaggaacctcaatgcacaagatgccgagaagcttgcccttcacaagaagcttgaggagttaaactcccagaacgaagagcttgccaaagtggttacgatgcggcttcgtcagcaggaagcgcaagccactctcgaagtgccacgagaccatcattcttcggatgacgaccagggtacaccagagaactcaccaccaccgtctccgaacaagttcacaccgcgtcacaatcacttagagactgaaacattgcgcagttctctcggccacgctcatcgtatgatccaaaatctcaagagtacaatccatcgcgagaagaccgaaaagatcgaattgaagcgtatgctgcaagaggcgcgggacgagatcgaacaacgtcgccgtgaagctgttgccccggcaggtccgtccaccaaacgccaaaagaccaggccagatgcctccagaaaacctgcgcgaccggatctgctcggagctggccgcaaggggaagactgagatcgagattcaggacgcagagtgggaggacaacgttgtagatgccaccccgacacgtcacgcttcaacctccctgactcgcgaccgttccggtgaagagtcctctgcctaccccagcgacgcttaccagactgccaccgaggccgatgatgcatttgagactgccaacgagcgggaaactgcaacagaaagcgaagccttccagacgggcatagagagcatggctgatgggagttctgatactgatgagctgactgagactgaggagactgttcagaggacccctcgcctacgtgtttcttcatccttgatcatggccaaggctcgtgaccgttcttcatatcacagcaccgcatccacttccgcagatgaagatgaaggtgtcgatgaagttctcgcctctcccagtcaagcacacgctcccagatacagggttaggaagaagaggaatgtcctcaggaaaaatccgtcagtttggagaggcccctatggcttacagcagccggccttcgagtgcacgagattggcatgggacaggattcgcccaagattcgggctcccacagaaggacacagtcttttcgaggaacttgcagaactcgaaggcggcgaggatgaggacggaacatttggtgctaactcccagacgtctactccccgtatgcgtcttacggctgattcgcgacgaccctcggaggccattctggacgtgccggccaagcccgcgatggtcgattcaggcgtga

SEQ ID NO: 16717 - DNA, 636 bp, A.fumigatus
gacggctgtttccctcattcggtcaagttcgataggaaccaccccgtggtgcacaggaccccagcaggcaacaaaatcacggacgcggatcgccaggatcttacttccagaatggcttcgatggatgacccgttcgtatcaaaaacggaggagcgtgttcctcgtgatgcgcataggtactcctctttcgacacgcagctgttcagtcttaatgcaccttctccagcacaggcgaaacgagctcttgaagctcacctggcggagacagagcgcagactcgaggaggcttcgaagctcggcaccgcgctcattgaacagcagagagagctcgaggagaagttgaaagaggtagaacagcagcaggatgagaaccagatcggaccggatctgcgccagaagcttgtggaactggaaagggagtacaatgagattggtcgtgagaccgctagagccttactggctccgaaacgcctggcaggtggcgatgatggccatctgggtacgccctcgctcgatcaaaaggtaaaaccgcaacgcttcctgtaccgccgtcaggatactgatcttctgaactacagtcaccgctcagtcccgtcctattcgccagtcaagcgaccaactctcccagcaaagtga

SEQ ID NO: 16718 - DNA, 306 bp, A.fumigatus
tcatggccaaggctcgtgaccgttcttcatatcacagcaccgcatccacttccgcagatgaagatgaaggtgtcgatgaagttctcgcctctcccagtcaagcacacgctcccagatacagggttaggaagaagaggaatgtcctcaggaaaaatccgtcagtttggagaggcccctatggcttacagcagccggccttcgagtgcacgagattggcatgggacaggattcgcccaagattcgggctcccacagaaggacacagtcttttcgaggaacttgcagaactcgaaggcggcgaggatga

SEQ ID NO: 16719 - DNA, 1098 bp, A.fumigatus
acctcaatacgtcccccatttcctctctcaatggcctctgccgacggcgcgtctccccatgtgaaatccccgaccgagcgaaacctgaaacaggttgtactaggtgacctattattcaaaacttggtatcaatcgatctatcccgaagacctcgtgagcaaggacacagaccgtttgtatgtctgttgctggtgtttctgttattcgtgcgacgtcaacagccatgtgaagcatatgcgactttgcgaacaccggacaacacctcccggcgcccaggtctacgaacatggcggatattcagtatgggaggtggatggagacgaacacaagctctatgcacaaaacctctcgctcttcgcgaagctgtttctcgaccacaagtccgtattcttcgacgtcgcgacttttctgtactacatcctcacgttcaccgatccagggaaccccgaaaaataccatattctagggtttttctccaaggagaaactgtcctgggacgcaaacaaccttgcctgcattttggtcttcccaccttaccaacacaagcagctgggaaagttattgatgggtgttagttataaaatcagtgcctgggaagaagatgctggtttcataggcggtcccgagaaaccgctgagtgatatgggtgcgcgcagctattctcgcttctggcaagaacggatcggaaggcgtttgttgttggacgatacagatgcttccggacaagagacacagccagccagagagactcggaaacggcattcagcaactttcatgacggttagggatataggggaggccactgggatgctgacggaggacgtgattacggccctcagaggaatgggcgttgttcaacctgagacgccttccaaaaggcgtaaggcaaaacaggctgccgatgtgcccgatcactatgccactatccgcaagtcagatctactgcggtggatggaaaatcgtaaagtctcactacgagatccggtcagggatgaaagatttgtcggcagatgggcccttagaggcactcctgatgagaatgatagtatcgcgggtgaaggggaggaagaagaagaggaggattcacatactgcataa

SEQ ID NO: 16720 - DNA, 336 bp, A.fumigatus
tcccaacatagagtgttgcccttagaccttatttttcttcttggacggctcggcatcgctgtcgtgcttgcgcttctttttctcggattcgccttcgccaacgtcggacttccgcttcttcttctactcttccttctcgctcttgtccttcttgtccttcttctccttcttctccttcttttctttcttttccttcttctcccaacttctctgtcttctcagccttgtcatcgacgtcctgcatctccttgtcgctgtcatcagcgtcgatgtccatatcggctagaacggcatccatggcagatttctgtgatggttagtgacttggccatataa

SEQ ID NO: 16721 - DNA, 270 bp, A.fumigatus
cttttctttcgtgtaattttgaggaaattaagacgatttgccatggccgactaccttttgttcgagggccctatgggttactcaatcttcaaagtcactcaccagggagacagcgttggaaatcgcttgaaggaagttcaagatggtgtgaatgatcttgcaaagttcggcaaaatggtcgagctcgccagtttcctgccgtttgagtatgtttctgaccatctattcaattttttctccttcaaatgcgtatatgctgacaaattctag

SEQ ID NO: 16722 - DNA, 1320 bp, A.fumigatus
atgatcttgcaaagttcggcaaaatggtcgagctcgccagtttcctgccgtttgagtatgtttctgaccatctattcaattttttctccttcaaatgcgtatatgctgacaaattctagaaacaacaagcaggctctcagcgaaatcaacgatgtttcggaaggtgtcgcttctgacactttaatcaactttctcgaattgaaccttccaaaggccagcaaaaagaagaagatcgttctcgggcttgctgacaaggcgctggcttcaagtatcaaatcagcgttccccttcgtcgactgcgagactggagacaccagtgaagttgtgcaagatatgcttcgtggtatcaggctgcatgccactaagttgctaaagcagctccgtgagggtgatatggatactgcccagcttggtctcggtcacgcctactcccgtgctaaggtcaagttctccgttcagcgcgacgacaaccatattattcaggctattgcaatcttggaccaactcgacaaggccatcaacactttctctatgagagtgagagagtggtactcgtggcacttccccgaacttgtcaagatcgtttcggataaccagcgctacgctcagattgcactctttgtcaaggataaaaagactctgactgatgagagcttgcacgatctagctgctcttgtggatgatgatgaaggtgttgcacagagcattattgatgctgccaagcacagcatgggccaggaaatatctgagtcggacatggaaaatgtcattgcgttcgcgcaaagagttgtcagcctttccaagtaccgcaagtcgctgcacgcttacttggtttccaagatgagcgtcgttgctcctaaccttgctgcgttgatcggagagatcgttggcgctcgtctgatttcgcatgccggaagcttgaccaacttgtccaagtatccagcttccaccgtgcagattctcggcgcggagaaggctcttttcagagctctgaagaccaaaggaaatacccccaagtatggactgctgtaccactcttctttcattggccgagctggccccaaaaacaagggcaggatctcgcgattccttgcgaacaagtgctctatcgcttccagaatcgataatttctccgagcagccctcgaccaagtttggtgaagtcctgaagaagcaggttgaagaacgcttggagttctatgcttctggcgcaccccctactaagaacgaagttgccatggtatgctggatttcctcgatgaagatcttatatggccaagtcactaaccatcacagaaatctgccatggatgccgttctag

SEQ ID NO: 16723 - DNA, 246 bp, A.fumigatus
agccgattacgcgtaggtcaactcatctgttatcactctatgaaagagttgcattctatactcaaaactagggctgattcaacaatttatagtgggcgggaattgcgagaaataaatttcaataccgggctatatatcggcggcttccctgctatggatttctttggagatggcagcttctacttgttggatgcccccggtgtcagtattatttcattcctagtacaatccggctcaaagtactga

SEQ ID NO: 16724 - DNA, 237 bp, A.fumigatus
atgttaaaggctccacatgatgcagatgcaatgcatgataggttgtatattcagaagcccctcgggttctcatatttcccaaacgagatcattccggctcccaaggcctgggtgagcactacggggaacctagtcttctggaggcaacatgacaaggtacgtcttaatatcaagggccttctagtcatatgttatagggtgggcatttcgccgcacttgaaagaccccacgacctga

SEQ ID NO: 16725 - DNA, 282 bp, A.fumigatus
accaaacaagggcacgcacaaatagcacggtcagcagaaagagagttactcccagttgaaacgaaggataaactaagcaacggaaacattggtaatagcatctttgaagtcctccaaaaatctccaacggccagtgtccttccaacccttcgttttccactcattcgctttattcgggaaaaagtctataacttccaacagacttttgtcatgcgccaaaattataaatatgtcatcacttgcgtcaaacgagatcattttgctgatagtcgcctccgctaa

SEQ ID NO: 16726 - DNA, 774 bp, A.fumigatus
acttcccatagcccaaagttactccactgcctccgggtatcgatcttcgtggcaaaacagctttggttactggagccagtgcaggcaggtattgggttgaaaacagcccgacaactccttaaactccatctttctcatcttattctcaccgtgagaaatgtatcgaaaggagaagcttgcaagcaggagatccagcaacttaaccgccaagcacaaatcacagtgcttgagctcgatatgaacaattacaatagcgttctgagctttgcgaaaactctggaggaagaggtccctacagtcaacattctgctactcaacgcgggaatcggacttctgaagctggagcggagccccagtggacatgattgtgtcacccaagtgaactacctgtccaacgcccttttgattgctgcactgttgccgtacctcaaggcatccgcagaaacctctggcgttccttctcgtattacttgggtagggagtcgaatgtactttaccacgagtctggaggagaaagcgcctataaaaactggtgaatcggtgcttgagcacatggattcaaaggaatttttttttcctaaagagagatacaacgataccaagcttctgtgcgccatgttcatgtacagtctcgctcagcgtctcgacaaatccaaggttatcctgaacatggtctgtccaggtctgatcaacaccaatatgaccaatgtgttacccttccatatgcgcatggtcatgggtgtcatgaagttttttcctagcgcgcccggttga

SEQ ID NO: 16727 - DNA, 261 bp, A.fumigatus
tattcctaccgctgcgtccctgttctgtctttgagctctggcaaattcatcaagactcttgatcttatcacagatgcagcatttgagttcaacagtttgatttcccgaacagatgcggcattttgcgttgttcttcgtcaaagcgacattcacaccgtgactcaagatggcatgacgaagggcttcgagttgcctattggagtagttactcgaggaacggatcttgctacaggttccacatttgatcctattctatgttaa

SEQ ID NO: 16728 - DNA, 624 bp, A.fumigatus
atttgccagagctcaaagacagaacagggacgcagcggtaggaatactatctcatgtctctcttatcggctaaggatacagctaacatctggttcttcccagagatgcatgaattgtgtgcagagtcacaccgatgccgagccagttctcgaggagcctaaactcttgactgagagtgagctttccactgcccctgatacgtacacagctgtcagtcacgccgatccgtcctcaaaatgcttcacaaatgcgtacatcctggtgctaacacagtttcagggccaaattgactctctttccttgattgcatcaacccaaagactcacagtgaaggcggctcctactgcccaacatattgacagcagtggtgcgcacgacatggaccgcgtgtcgctcattgaagatcacaatgggaaagcgaactcggtgcgcggaggacaaccctttacagctttcaattctaaaggagtggtccaccgccgctctggttccccccctggtaccgcacggtccgttcacggcggttgggcgacctggggagtggacttcaactatactgtcaccaaacccatcaagaagggccgcagctccaagtttgccaaggttccggtaagccccttatga

SEQ ID NO: 16729 - DNA, 201 bp, A.fumigatus
gcagtaatcataccacaactgcattttctcgatgtctcttcgcttgagctgcttgcctcggtctctactatcgtcgaaacactgactctttgcgattctcatccccgagtttcctctttgaacccctctcaagacaagatgcctccatcctttcgaagtgcgtatgctggaggttacagcgatgagattaagaaacggtag

SEQ ID NO: 16730 - DNA, 768 bp, A.fumigatus
  unsure (71): Identity of nucleotide sequences at the above locations are unknown.
acatgccgcagccccaagtgcctccggcggctccgtcgccaactcaaggccaatatgcggagtcacctcancaatactcatggtatcagcagccatccattggaactatcaatgaaggccgtcagctcagcttttcataaagctgagacacccacctatctatcgccagaagtcctgtcccaaatcactgcaaccgtgattcaacagctcaaagcaactggtctggataacttccaagctcagcatgcacctcagtcgccgcaaccatcgccgcagccaccatccggtccgacaccgtcacagtgggtgcctccgcctcccagctctgctccccaatacagttataacgagtatgaatcgccacctcctgtaccaccaaagccgtcctcgccgcaaccggttgcagtctccgatactcccgactaccagcagtattcccaaactagtccatatccaagcagcgttgagcccagtgcacgaccttccccggtacctcctgtcgagagaagggggtcgccgtatagccaggcaagcgaccaaggccagaaaatggaagcacgcccaaaaccaccgtcaagggaaacaaccgtgacagagatgacaacattggaaaagatatggggcaagctctttgaggaaggcaggccaaccaagagactaggccagctcttgcgtggcatagcagttcatctggtaagcatggatgtcgatgattggaggatttttgcgtctgacagtgtgcaagatcgaggactaccctccaggtaa

SEQ ID NO: 16731 - DNA, 726 bp, A.fumigatus
  unsure (303): Identity of nucleotide sequences at the above locations are unknown.
gctggaggaagaacacacggagtgggtcgaggaagaactgccagagtacgttgcgaaatccccgcaccaacagcgtctatgttactaacaacccccgacagctggcagcgcgcaatctacaccgtcaacccctccaaagcaaccgtcgcagacaccaagaagctcaccaccccgctgaacaaaggccacgagtccatggcctacctcacctacctgatcgaccattacgactccctcccctccaccatcgccttcttccattcccaccgcgcgggcttcttcatggcctggcacgtcgacgcnccgctccacgataacgtagcagccatgcgcgctctccagctcgatttcgttcagcgcaacggctacgtcaaccttcgctgcaactggaaccctggctgcagggccgccgaccgtctcaaccgccacgtcactgagcaggtctgggcggagatcttcgacgggacgagtactccgccgctgaacgcgacgacttcccctgcccgggcagcagtgccccagcagaagtttctggcgaaaccgaaagaaatcggcgccgcgtgctgtgctcaattcgccgtgtcgcgcgagcaggtcctccagcggccgcgcgaggactatatcagattccggcagtgggttatcgataccgacaaggacgatgcgtcgagtgggcgcgtgatggagttcctgtggcatgtgattttcggccaagaggctgtatag

SEQ ID NO: 16732 - DNA, 192 bp, A.fumigatus
gttgctccactgattttgcattccttcgaggtcaataagccacacatacagcaatgtctatctaccagatggttagttggtaggcaaggatcaaagtcaatgcgagatgccacagctactatcagtttcctatgtttagattcacagaacaacaaggaggaagaaagtggcctgaaagttcacacttgttaa

SEQ ID NO: 16733 - DNA, 456 bp, A.fumigatus
  unsure (442): Identity of nucleotide sequences at the above locations are unknown.
aggtgcacctggaagatttctgcgaccagtaccgtgcaggcacatatctggtcgactggaccaaatcgcgatatttcccgcagactgtccccaccctccctaatggacaaacaggcgacaaaatcatcgtcatggctaagctggaggaagaacacacggagtgggtcgaggaagaactgccagagtacgttgcgaaatccccgcaccaacagcgtctatgttactaacaacccccgacagctggcagcgcgcaatctacaccgtcaacccctccaaagcaaccgtcgcagacaccaagaagctcaccaccccgctgaacaaaggccacgagtccatggcctacctcacctacctgatcgaccattacgactccctcccctccaccatcgccttcttccattcccaccgcgcgggcttcttcatggcctggcacgtcgacgcnccgctccacgataa

SEQ ID NO: 16734 - DNA, 726 bp, A.fumigatus
gcgtcatcactaagatatctctcgcagggatacaaagcagtaagggacgctgtcctcttcgccatcgaagtcagcgattcaatgttgactccgcgtccatcatctgatcctaagaagagagtggaagaatcaccaaccaccgcggcgctgaaatgtgcatactacctcatgcaacagcgcatcatatccaatcctcgtgacatgattggcgtattattgtacgggacgcaggcgtccagattctacgacgaggatgagaacagccggggcgatctatcgtatcctcactgctacctttttacggatctagatgtcccttcagcacgagaggtgaaagaactccgtgctctggcggaggacgaaggcaaagcaagagatgtgcttgtgccatcgaaagagcgggtctccatggccaatgtacttttctgtgcgaatcagatcttcacatccaaagcccccaactttctgtctcggcgattgttcatcgtcacagacaatgataaccctcacggcgatagtaggagtcagcgatcggctgccaccgttcgcgcgaaagatctttacgatctgggggtgaccattgagctgtttccgatctctcagcctgagcatgagtttgacagctccaagttctatgacgtaagaccagccaccgttgactgtcagtggaggcaacttcgtggctcacatcgtataggatatcatctacaaaacctcaccaactga

SEQ ID NO: 16735 - DNA, 1014 bp, A.fumigatus
gatatcatctacaaaacctcaccaactgatgcggaggctcctgtgtacctgaaagatgattcaaaggtgtcgactgcctccggagatgggatctcgctgctgaacggcctcctatccagcataaattctcggtcggtcccgcgcagagcgcattttttgaacatgcctctggagcttgggccgaatttcaagatctccgtgacaggatatctcttgttcaaacgccaggcacctgcacgcagctgttatgtctggcttggcggggagaagcctcagatcgtcaaaggagtaactacccagatcgcagacgatactgctcgcaccgttgaaaagtcagagatacggaaagcatataagtttggtaacgatcaggtgtcattcactcccgaggagcaaaaggccctgagacacttcggtgacccagtgatccgtatcattggattcaagccactctccgctctccctttctgggccaacgtcaagcacccatttttcatctacccttctgaggaggattacgtgggctcaacgcgcgtattctccgctttgcaccagaagcttttgaaggatcacaagatggctcttgtctggttcatcccgcgcaaaaacgcagctccagtgctcggtgcaatgatagcgggtgaagagaaggtcgacgaaaatggcgttcagaaatttccccctggaatgtggattataaccctaccatacgcggacgatgttagacagaatcccgaaacgaccctcaatgtagcgccagagccactgatcgaccaaatgcgaacgatcgtgcagcagctgcagcttcccaaggcgtcatacgaaccgcagaaatatccaaatccatgtaagctgggcaagttcaatttattgacaagtaacgctgatttgctccctgcagcgctgcaatggcattatcgcattctacaggccctcgcattagatgaagaccttcctgaaaagcccgaagacaaaacaatccctaaataccgccagatcgacaaggtaggttga

SEQ ID NO: 16736 - DNA, 420 bp, A.fumigatus
ggcaggaaactgtgttttcaggtaagtctggtatctgctcatgcgtcagtcaacttgctgaacaatggaacttcctccaggtatacaacgaaagcattcggcccggtcatggcgaaagctgccactcttaccatagtggaggcggaaaatatcgttcccgtcggttccattgaccctaacgatgtcgatctgccgggcatctttgtggatcgagttgttcctgctacggcagagaagcacatcgaaatcagaaaattgcggactccagaaaatgaggatgtgactaagaccttaagtgaccctgccatggctcagagaaaccgcattgcccggagagcagcgaaagaactaaagcaaggatattatgttaatctgggtgttggtgagtacgctagtcttctaaagctcctcaagcgctga

SEQ ID NO: 16737 - DNA, 447 bp, A.fumigatus
ctagcttgcagggacatcatcaatgctgggaaagagacggtcaccctcatgccaggcgcggctactttcgatagcactgaatcgttcggcatgattcggggcggacatgttgatgtgtccatccttggggtgagtgaagcagattatgcttgtgaacggatagagtaccgggttaatgataagcaggccgtgcaagtgagcgccaaaggcgacctagcgaactacatgattcccggaaaggtcttcaagggaatgggaggagctatggacttgatctctaatccagaccaaaccaagatcgttgtcgctaccagtcatacagccaaggacggatctcccaaggtcgtcgcggaatgtagcctgcctttgacaggcgcaaactgcgtcagtacgatcatcacggaacttgtaagtctattaactcgcgtgcaacctcagactctatag

SEQ ID NO: 16738 - DNA, 438 bp, A.fumigatus
agtcacggccctgcttttctatcctgggtggcatacttctcttcttgctgccaaggaatggcgactttgcggggttcagcaatcgtatctcctatgtggagaacacatactgtcacccgtccacggttacacttagggacatgttataaagcgtgtgcgcgacctggtcttctaacaacaaccattcgctatgtacgatattcaactgccactccgccgcaacagacacttgcacccaagattgagcgtggcgtttcaaaactattcagagatgcagatgaggctgtcagtgacctcaagagcggatctacaatcctgagctctggttttggcctttgcggcgtcgcaggtaaatttcttcccaacaagaagggttcaacagacaaattgacattactcagatacacttctatcagcgatcaatcgcagaggagttga

SEQ ID NO: 16739 - DNA, 228 bp, A.fumigatus
  unsure (31): Identity of nucleotide sequences at the above locations are unknown.
attgcacttacagttctgattttactttatntcgcagacacgttactccaagcaggagaaattcccgtccggctagatgagtctggaaaagtattggagcgtggcacaccacgagagacgaggatattcaatggcaaaacttacttgatggagacagccctcacgggtgatgtggctatccttcgtgcctggaaagcagatgaggcaggaaactgtgttttcaggtaa

SEQ ID NO: 16740 - DNA, 228 bp, A.fumigatus
  unsure (117): Identity of nucleotide sequences at the above locations are unknown.
agctcctcaagcgctgacactcgctcaggaattcccacactggctccgtcattcttaccagaaggcacgaaagtttgggtgcaatcagaaaatggtattctgggcatggtggggtancctgcgaatttggccaaacaacatcaactaacggatataactagggaccgtatcccactgaggacgaagttgacccgtaagttctatccattgaacttggtatacgcatga

SEQ ID NO: 16741 - DNA, 234 bp, A.fumigatus
cattactcagatacacttctatcagcgatcaatcgcagaggagttgaaaatctgcattccctgacagccgtttcaaacaacgctggcgctcctggaagaggagggctttctacacttactcaagccggacaagtagatcggttgatcctatcctatctagggaacaacaaggctttggagaagaagtatttgactgggaagattgtaattgagctatgtccccaaggaacataa

SEQ ID NO: 16742 - DNA, 231 bp, A.fumigatus
agtcgtcttccttgcagagaccatatacaaaagggaacagctcaattccttcgaatcgacgttgtatatcccatgcagagcacgtcactctgtcaagtctcactggaggatggaaatggtgctaacctccgcttccccctcaaaattccgaaggatggttggattgaggttctatacatgatgtctacacgaaatgttatctacatgacagccagcattgatcaggtctga

SEQ ID NO: 16743 - DNA, 192 bp, A.fumigatus
tgccttggtcgcatcatgatgctgatgcattctggttactttcctggtgaagtaactgttggttggactgccattgccagcacagaacagaacagaacagagaacaatctgattctgaaatccgacatgactaatctgcggagtacaattgagtacaatgcccaaaatgacgcgcttaaacctcgaaactaa

SEQ ID NO: 16744 - DNA, 639 bp, A.fumigatus
ggcacttcatctttactctcctcgccttggccaccacctcagccttggctcaggatcccggcccatcgcctacagcctctgtcggctgcaagccacatggcgaccactggtaggacacgcacgaaagccatcgacccagtaaaactcacaacatataggcattgtgatggtccagcaacaggagccgctactgctgccaccgagctgtccctcgttccgagtcccactgagtctgtgggatgcgaaccccacggagaccattggcactgcgacgggcccgcgtccgccacggctgtgccaacggcgacttctgatgaccacgaccacgaccacgaccatgatcacgatgacgaccatgatgaccacggcaccgcgacaccgactgtccctagtcccacggcgtcggttggatgcaaaccgcacaacgaccattggcactgcgatgggccccgggagactggcagcccttctgcgagcgtgaacgaggcgtccgcttccactttagtctcgactacttcatctactacagcgtctgcgactggggcacaacagtcgggtggagcaggctctttgggcgtggaattgacgggggcggttggtttggctttggctgttgccgctgcggcgtttcatgtgtga

SEQ ID NO: 16745 - DNA, 948 bp, A.fumigatus
gccaggactaaggtattcaccatggactcgctcaattcgtcctatccgcagtccgccatggcgacctattccgatcttctcgacctcgccgctcagcagcaacctcatctctctggtctcgagagactttggtgggcgcattatgcctactgggacaataacattgtcgcaactggtaagtggcacaaacctaacggaccaccctcgtcaatcctaatagctacaggaatcatcaccttcctcgcccacgaaatcatctacttcagccgctgtctcccctggatcatcgccgactccctccccagcatcttcctgaaatacaagatccaagaccagaaacctcctccatccgcagcagagcaatgggcttgcacaaagtacatcctcctcatccactttgtcgtcgaactccccctcatcgtcctcttccacccaatgatggaactctgcggcctgagcttcaccatccccttcccagatctccgcactctcaccgcccaaataattatcttcttcctcctcgaagacacataccactactggctgcatcgcgccatgcactggggcccgctctaccgctccatccaccgcatccaccaccaatacgccgcgccctttggactaacagccgagtacgcgagtccctgggagactctcctgctgggcttgggtaccatcggccctccattgctcctggcactgatggactgcaacgtgcacttggtgacggtgctggcgtgggtgacgctgcgacagttccaggctatcgattcacattcggggtacgattttccctggagtctcaggcggattttgccgttctggggtggagcggattggcacgatgatcaccatcgatacttctgggggaattattccagttcgtttaggcactgggatggtaagtgcttcctgttatccttcgggatatccgctaacggggtctag

SEQ ID NO: 16746 - DNA, 264 bp, A.fumigatus
gtgcacctcatccttatcctgagcggtaataatactttttacaagccagaagtactacctcagatcttgactttttctcaaggtaagcaattgttgattaaggagctacgcagtccgcgtggtcacaaaagccagccatcgaaccctcctcctcagcaacccctcatttctttcctcccggaggagtatagcttgcgtttccctttccatcattgtagtatgtgctaccattgggattggagtagtagtatgatccatcgctga

SEQ ID NO: 16747 - DNA, 243 bp, A.fumigatus
acgaagctttgccttgtccctcccacctatttatcgacgcgcttcccccattccgcctttcccccacttcagctctttccaccctcctctttctcttcatccactccaacttctcacaaccgactaatctacaacactgaaagttaccagcccaccatgcctcagaaccaggactacacctacaagagctccggcaccaacagccaagtgaaccctccctgtctctctccattcacaatataa

SEQ ID NO: 16748 - DNA, 222 bp, A.fumigatus
ttgcgctatttgcatgttggaagcagagcacttccgataccaactaagctattacattacaataagactatcgatactcacgatgataataatacgttcgtgccagccctgaaaatcaagcctgccgcttctcccgctcggcgcgtctcttctccctcgcttccggaccagcaaccgtacccatcaacactagaccccgttagcggatatcccgaaggataa

SEQ ID NO: 16749 - DNA, 507 bp, A.fumigatus
tcggtcgttggtatgctagacaataaccgttgcagggcgaatatcttctttgtcatctatgcgtcaacccaggtagctgagattgtcgcgagccctctgagtgcctggctcatgtccaggacaccctggctgccgtacttcctgggagtactgttcatgctttgtggcctatgtgcttccataactgtaccggagacgctgcccaagtcgaccaaattgagcgagcccgacactgaagacgacgaggctgatgatgacgcaccacggacggtccgttatcgtctaaaggccgtcttgcatcatgccaggcatcagatcatgcatcacagccggttcatcttcgccgatcgcaacattggttgtatctccatcgcccttctggcggcaaacgtggctatccagtcccttgtgatcacgctacaatacgtctcaaaacgcttctcatggtcgatggcagaggtacagtcctacagtttcactctccactacttgtctttcctgacttga

SEQ ID NO: 16750 - DNA, 813 bp, A.fumigatus
tgttcttcgctgacccaaggcaggattgatactccgggagtcattcagcgcgtctccaccctttttaatgggcatcccgctttgatccaaggattcaacacgtttttgccgccaggctaccgcatagagtgtggaacagaagacaatccagatgcgatccgggtgaccaccccttcaggcacgaatactttgaatatgccccgcccccgcccttcaatggacccggcgggagacatgggacccgctggtggcatgggctcacatggacgtactgactactacgagcaagcacgacctggttggcaacagcagccgcagggtcagcaacaacaaggaaatcttccagcctcgtactccccagggtctcgaatgatgggccctggcatgttcggacaaggcgcacaaggtcaacctcaagatcatcactttgactacccaacccaacaagagcagcaagctgcagcgggtgccgcagcaatggctcaccagcaagaccaacgtggtgtctcacaacttcagggcgccgcagccgcgtccgctgcgatgggccgagctggaatgatgcaggtgtctcctgcttctgcgcaagcctccggtatgaaccagcccatgaacagtctggctggcattggttcaggtatgttgcagggcagccaggcggacttgaacaagcgcgggccagtggagttcaaccatgcaatcagctatgtgaacaagatcaaggttggttgttcctttcaagtggcgtcaaatggcaacagaaatcccactaaagcaatctctttggcagaatcgcttcgccagtgcacctga

SEQ ID NO: 16751 - DNA, 1011 bp, A.fumigatus
ctccctctggccctttacttttgcatcgtcgctccttcaaatttcctttgcacgttgtatcacccctcctctcggctttccctctgttacatattccatgcacctgaacgtgacaactcacgaaacatgcagagagcgaaagtgcaccataccaaaccatcccaagcagacgttcctgctgtttctccgacgctcatacccgctcttcctgagcccatacagcccacccagacgatgacgcccagccaagaagagtttgccttttttgatcgagtcaaaaagtacattgggaacaagtcaatgttcaacgagttcctcaaactgtgtaacttgtactctaccgacctcattgacaggaatgtcctgatcaagaaagccgctgggtatattggctcgaatccggagctaatggcctggtttaagcgtttcatgcacattgatgaacccgaagacaaggtcattgagacaaagcccaaacaggagtctggtgttgtgaacctgtcgcactgccgttcccttggacccagttaccgtctccttccgaagcgtgagcgccagaagccctgcagtggtcgcgaccaactgtgctacagtgttctcaatgacgaatgggcgtcccatcccacttgggagtctgaagactctggcttcgtggctcaccgcaagaatcagtttgaagatgccctgcaccgtattgaagaggaccggcatgattacgaccaccatatcgaggcttgtactcgcacaattcagctcattgaaccgattgttcaacagttcctggtcatgagcgaggcggaacgagcagccttcaaactcccaccaggtcttggcggacagagtgaagctatctaccagcgtgtgatcaagaaagtatacgaccgacaacgcggagcgcgaatcatccgtgaaatgttcgagagaccatgccacgtccttccgattgtgctcttccgcttgaagcagaaatgcgaagagtggaaagccagtcaggtaagttatgtcggataa

SEQ ID NO: 16752 - DNA, 447 bp, A.fumigatus
acatttactgctccaggtccgtatcaccccgcgaaccagaaccccggtcattcccttcccgggctagcggagttgagtcagggtcacggtggccctcatcaacccgcatatggccaacaccctggagctccgtcgcacgctacaggacactcgttaccgggtatcggtcagacaatgcaacacccttctccccagtccctcaaccgagagcgcgagcgagattcaagagaacgcgagttgatcgaaagacagcgacaacaggaggaaatggtccatagagaacgtgaacagcgtgagcgtgaacgtgagcagttggaacgccagcaactcgagcgtcaacgtgagcagcagcatcatcctgtacagagtcatactggttcgattcccctacatcaaccagtggcgtcgaaagtgccaaattccattcacgggcccaatgggctttag

SEQ ID NO: 16753 - DNA, 189 bp, A.fumigatus
tgggccctggcatgttcggacaaggcgcacaaggtcaacctcaagatcatcactttgactacccaacccaacaagagcagcaagctgcagcgggtgccgcagcaatggctcaccagcaagaccaacgtggtgtctcacaacttcagggcgccgcagccgcgtccgctgcgatgggccgagctggaatga

SEQ ID NO: 16754 - DNA, 603 bp, A.fumigatus
acaagatcaaggttggttgttcctttcaagtggcgtcaaatggcaacagaaatcccactaaagcaatctctttggcagaatcgcttcgccagtgcacctgagatctacaagcagtttcttgaaatcttgcagacatatcaacgcgaatcgaaaccgattcaggatgtctacgctcaggtaacccagttgttcaataccgcgccagatttgctggaagacttcaaacagttccttcccgaatctgctgcacacgccaagcagcaagccgctgctcgtcaagctgaagaatcgattcctatcagcaatgtgcgaggagaacccggctatccaagcgcgggcggcctaccgtcacagacgcccaatcgggatatgaaaatgccgcccttgggtcagttcaatgtcaaggactctgccaaggacggaaagaaacgcaggggtggtcctggcgctccttcgacgatgacctcttcgatttctggcccctccgcgggcgctgaggccgctagggtggcagatgcccaggctggtcgtccttcagcccttcagaccagcaacgccaacaaggtgagcgaaaatctagttccgcgccattcacatgcttga

SEQ ID NO: 16755 - DNA, 339 bp, A.fumigatus
aatgttcgagagaccatgccacgtccttccgattgtgctcttccgcttgaagcagaaatgcgaagagtggaaagccagtcaggtaagttatgtcggataacctacgttgagaaatcgcccactaacatattggcgcagcgtgagtgggataaagtatggcgggagcaaacgcaaaaggcgtactggcgcagtctggatcatcaagcgattgccagcaaagcgaccgacaagaagctattcgtggcaaagcatatccagaatgaaattcagagcaaatttgaggacgccacggggttacgtcttcaccacaggagacgacggacccgcgcaaggatccac

SEQ ID NO: 16756 - DNA, 369 bp, A.fumigatus
gtctgtatagatgaatgtgtcttcagcaaaatgctctgtcgctcgttcaacttttcgcagttggcgattccgttcgtctccgtgttaatcagttttcttgcgtacacgtcccagttatttttctactattttgaggaggcgcccctaagatcggaagagttctggcggctgaacatctttgctgtgtgtatttgggtgtgctattaccgcgcatgcactgtagatcctggccggatacccaaggattggacgccgcccaacctgaagcaattggaaaaggattgcgctgggggtaggcagcgctggtgtcgacgatgcgaggcgttcaagccaccgcgagcgcaccattgcaagacctgtcagaggtga

SEQ ID NO: 16757 - DNA, 306 bp, A.fumigatus
atattttcctacttcgtcagcgacactgcgcaaaatgcgaaagagaaaggatacctctccatcgcatacgccgtccaccacaccctattcctcgtctccatcatcgccgcactaaaggttttccccacgcatcgccgatgcatgccgttctgcatcgccagccgaatcgtcagattgatatacacgtaccccaaccccgccgcatcaatcggcaacgcatacgccgccaagagcaaacaagcctgcacgctctccaacgaggacagctcgataatctccggtaggagacggattgcttcctggtag

SEQ ID NO: 16758 - DNA, 264 bp, A.fumigatus
agcaattggaaaaggattgcgctgggggtaggcagcgctggtgtcgacgatgcgaggcgttcaagccaccgcgagcgcaccattgcaagacctgtcagaggtgagattctgtggctcgaaagcggttcccgactgacgatttgcaggtgcattccaaagatggaccaccactgtccgtggacatcgaattgcgtttcgcactttacctatcctcatttcatgaggtttctgttcgtatgctgtagtaggcatgggttatcttga

SEQ ID NO: 16759 - DNA, 213 bp, A.fumigatus
tctcgggtgctgaaagaggaattatatcggatatgcaccaactgccaactggttaactgtacgatctactgcttggtagcaggaaacgaccccgtcccaaggatatctcccgcctcttcttttcccgtctgcgccctctcgatcctcgcctttgtcgtgctgcacagccttggctatgtcttacacgacggcggctggaagattattcgctgg

SEQ ID NO: 16760 - DNA, 501 bp, A.fumigatus
ccatacagctgcgatcaatgccgccgatggaaagaaaaatgcgagggaggaatcccatgcaggaaatgttcgcatctgggccgtccgtgtcgcgtgcgcggtatgcctgtgtcgcaggatatcgggtacgtcgttaaagtcactcatcagtactttgttcaggctgacgctgctagcactcgtgatgcatttctcgagctgcaggagcggggcatgtacatggagcgaatcctgaaacatgcgttcaaggggatcgcgctggatacgaagagtctcggccagatggcgttgtcgattgaagagacggagaaggggccgcagacagagactgacgaggctgaattggctgtggaggaggagtgcacgatcgatccggtcgaggataccgttactcgtgagctttttctattccacagtgtacatggcggcgctgactgtcgacagacttctccggggaattctcctactggaacttttccatgcgcgtcaagcgccagatag

SEQ ID NO: 16761 - DNA, 666 bp, A.fumigatus
cttctccagacccctccaaaccaaatatcaaactacccccgagcaaaacagctccgatccagctcgcgaactctcgcagcagccatctcctgcatcccccctcgccacatcgccgagtttctcgtcaacatcttcttcaaacacgccgtaactcactacttctacgtcgatagatcatggctccgcaccagactagccgctctctacaccaacccgggatccctcaccagcaaagaggccccagtcctcggcattatcctgactatctttgccatcggcacgcaatatgcctacctcgaagcaaagcccgctcctgcctcgtccggccaaacccaggacttctccgaggacgagctgggaaccatgttctaccaggaagcaatccgtctcctaccggagattatcgagctgtcctcgttggagagcgtgcaggcttgtttgctcttggcggcgtatgcgttgccgattgatgcggcggggttggggtacgtgtatatcaatctgacgattcggctggcgatgcagaacggcatgcatcggcgatgcgtggggaaaacctttagtgcggcgatgatggagacgaggaatagggtgtggtggacggcgtatgcgatggagaggtatcctttctctttcgcattttgcgcagtgtcgctgacgaagtag

SEQ ID NO: 16762 - DNA, 933 bp, A.fumigatus
cagcccagatccctcctccgcaccacccccaaacaggacttcccactcttgctctcacggctcgccgacagaaaaaccgacctggaaaaatggtggtcgtcgcttcaattaaccatcccaaagaacgacgcccagaccccagtcgatcgatcaacagcccacatcaaactcgaacactgcctcctccgtatgttcatcggccgcccgtttctcttctcgcgaggctcgccctcaaacccaacctcgccagctactcccccctcaggcaccgggcaacagctcacgccccgccaggaactggtgacatgctgcatcacagccgccgccgacgcaatctccatctgcagcaccctccgcgacagtgatagtggtcctggcctggcgcgcgcctcgtatatagaatatagctcgtgccgggcggcgctgctagtgctaattgcgtactcgatccaggatcgttctgaccactttcgcaaggcgctgcgggtcgggttagacatgattcgggagatggcggcgactggggagtccgcaagatcggaggtggagctgattgaggtgttggagagggcgcttgtgagactaaggtcgtttgatgaggtgggcaaggtagcctcggactacgaggagtttaaacagtgggagtctatgtggaagcggcagaatgatgggaattgcaattccttcgaaacggttgcgggatcgattcacgagcaaggttggccgacaggcgagatggatccctccggtatggcagagagcaatgagaatctgggctctttgaggttattcgatggcgcggctgaatgggctttgttcggtgggggaagtgcattgccacgggagctgcagcatccggaaacgcagatgttgggggattttctggctctccatgatccgagattcgacgctgatttgagtcagtcgttgtga

SEQ ID NO: 16763 - DNA, 219 bp, A.fumigatus
gatggccgcttccacttccgctcccctgagccaggtatgtctctgccagagctcaccgaactgactaacttctccagacccctccaaaccaaatatcaaactacccccgagcaaaacagctccgatccagctcgcgaactctcgcagcagccatctcctgcatcccccctcgccacatcgccgagtttctcgtcaacatcttcttcaaacacgccgtaa

SEQ ID NO: 16764 - DNA, 513 bp, A.fumigatus
agcggaccctgttggcttctgcatcaaatatgggcgaaatggggagctcatcaggtacgttacccggtgggaggcttcagaactccgtatgctgacgattggagtactcaacgtgcctcgcacccagtcggtacaacggtgcgagttacggatctcttcaagagcataccagtccgcaggcaaacagtattgaaaagcaccgcaaagacagtagccaagattaaaaagatcgtacagtcatatgctatcgctcggcccactattaggctctccctgaaggttcttaaagctgctaacgaaaaggccaactgggtcttcgcccctggaaaaaatgcctcgcttacggacgcagcactcaaagttgccggcactgaggtcgcttctgcttgcgtaaccaagccgtggccgtgcgcaaacgagtccggtgaggaatctagagttgtcaatggctcttcttttcagctgatggccctactcgcggatcctggatcaggtatttactctgtccattga

SEQ ID NO: 16765 - DNA, 600 bp, A.fumigatus
aagggatcaatacgtctagaggatgatccgagaatcccgtcatcgccgttgaggatgccgatcaaggcccttccccagaccactgttcgagcaattggctcaacttcagtcatttcagacccctgctccattgtcaaggagttgctggacaattcgcttgatgcacacgccactgcaatttctgtagaaatctcccagaacacagtcgatgtgatccaggtgaaggacaatggacatgggattccagccgaagatcatcctttcgtctgtagacgtgcctttactagcaagatcgcgactgtcgaggatctgaggaaactcggcggaaaatcgctaggctttagaggtgaagcgttagcaagtgctgccgaagtttgcggaggagtgacagttaccaccagagttgaagcggaccctgttggcttctgcatcaaatatgggcgaaatggggagctcatcaggtacgttacccggtgggaggcttcagaactccgtatgctgacgattggagtactcaacgtgcctcgcacccagtcggtacaacggtgcgagttacggatctcttcaagagcataccagtccgcaggcaaacagtattga

SEQ ID NO: 16766 - DNA, 744 bp, A.fumigatus
tggccctactcgcggatcctggatcaggtatttactctgtccattgaaccgagaacttggctgatgagcgcagatttctccaaagtgaacaatgcaggacagtttttcagtgtggacggcagacctctctcagcatcccgaggcattggacaggagatctcaaaactgtacaagacctatctgcgagccgctgcttcccgtagcggcgggttcccatacatatcagattcattcctttgcttgcagatccgctgcccagaagccagctacgatgtgaatgttgaaccggccaaggacgatgttttattcgagaatcagcaagaccttctctcgcttgcagaagaactcttcaaggacgtttacggtgaaaccctggacaggcacgagaagcacaaaagctcctccaaagggaaagaaaggatggtaaatagtgatgccttcgaactacttttagctcgtaaagacagcactgaatgttctgccgagactgtgagtgagggcaacaagccaccaagcttcgtcacggctagttcgcttttccacatgaggagcagtccgaagcatggccgacacgaacagcgattattctccgatggaagtccaggagcgtccggatacacgcgaaccagagatctagagggtctcaacccatggtcagtgacgcgactgtatgctccttctggagctctatctcataaaactccggcgagggttgtcttcaccgcgggctcaggagctctcagg

SEQ ID NO: 16767 - DNA, 219 bp, A.fumigatus
gaagccacaaagtcttcgattacggccgaggttgagggcgtcgttgatcgactgagatcctctttcgcctgtttgtccatcctgcaaacaattggagagttggatatggccgcaattgacttgaccactgtctcgctactgggacgtgcgggaacagaaaagaagctgcggcacaatagaaccactgccggatttattacgcgtcctgtacttccttga

SEQ ID NO: 16768 - DNA, 372 bp, A.fumigatus
cgaacttacggtcgtggaagaaaagaccatcaaccgcatgggcatggacgaggctctccacggcggctacgatcgatggttcccgggctactgcgcacagcactatcgagtgcacctgaagagcggaccagtcaatcaggaaggcgtcccgacccacaacaccaaagtcgagatccaggtcgtctctgtgctgcggcatgtgtgggccgaagtcgagcacgacgtggtctacaaggggaagcgcagggcaagcggagacgaccaccgcatcctggacgggttaagcggggccgtctttctgggcgaatgcttcctcgatcaattgtatcaaacccaggtgtccagggctaccaccgacgaccggggctttga

SEQ ID NO: 16769 - DNA, 534 bp, A.fumigatus
tctaggaaatccaccctggtggtaatagccgccttcgtgagcatcttcaccggctgcggcctcaacttcgcgttcggcgtgtatcaagagctctacgaatccatggcccagctgccccggcgcaccccattcaccggcgtcacgcccgcccagatcgacctgatcgggacgctggccgtctccatgatgtccctcggagcgcccttcgcgtcgggctggtgcaaatcttactccccgcgccggatcaccctcgccgggacgatcatcttcgccacggccaacgtcctcgcctcgttcagccagcacctctggcaggtcgttctcacccagggcgtgctcctaggctgcggcacctgtctcacgtacatcaccgccgtcaccgtcgccccgggatggttcaccacgcaccgcggcctcgccatcggggtcatctcctccggcaccggcgtcggcggcgtcgtatgggcccctgcgctgcgcgccctgaacgcccggatcgggtttctccacaccgtccgacccacgggcggctgt

SEQ ID NO: 16770 - DNA, 1239 bp, A.fumigatus
gacctgcatgagctggagctatctcctcttcattttgagtcagtaagtcaaggaagtacaggacgcgtaataaatccggcagtggttctattgtgccgcagcttcttttctgttcccgcacgtcccagtagcgagacagtggtcaagtcaattgcggccatatccaactctccaattgtttgcaggatggacaaacaggcgaaagaggatctcagtcgatcaacgacgccctcaacctcggccgtaatcgaagactttgtggcttcctacgagaagcaccgcgacttctactgccacacagcaattgcggtgcgaaggctctgcgaggccgccctggaagaccatcatataccctgtctggtcagccatcgagcaaaagaagcggcaagtctacgcaaaaagctgtatgcgcgacaacttctccgcggccatgcctacgcaagcagagaagagatcaaaaacgacatatctgacctcgcgggcgtccgcattgccctctactatcctcggcacggagaggaggtcaagcgcatactcgatgacgaacttacggtcgtggaagaaaagaccatcaaccgcatgggcatggacgaggctctccacggcggctacgatcgatggttcccgggctactgcgcacagcactatcgagtgcacctgaagagcggaccagtcaatcaggaaggcgtcccgacccacaacaccaaagtcgagatccaggtcgtctctgtgctgcggcatgtgtgggccgaagtcgagcacgacgtggtctacaaggggaagcgcagggcaagcggagacgaccaccgcatcctggacgggttaagcggggccgtctttctgggcgaatgcttcctcgatcaattgtatcaaacccaggtgtccagggctaccaccgacgaccggggctttgagaacgtctacgcgctcggatcgtttctgtggaattggaccgcctccctcgggcattgtcaggtggaataccctgtagaggtcgagtttctgaaagacctgctggggattctgggactcaaccacccaaggacgctgcgcgatattctcagccagatcgacctgtccactcgcgacgagagcgagtggcacgcgttccgggcggcgtttcaccccgctcggtccagtcttacgatgttccttatgcaccggatcctgacaacgccggccggcgccaaccggcttgcgactacgccagcggacgatcctgggatcgaccgcgcctaa

SEQ ID NO: 16771 - DNA, 357 bp, A.fumigatus
cacgagttgggccttatttccagttccctgatctggctcgatcgggtgtatccgctctcgtctcaattgttcggcgccctcttcgcaagtgactcatgggaccgttatctgcctggaatcgagtggcttgattcgcaaaaagcccaggattattggaggggtaaggcagtgctcacggacgaggaaaggcagaagatcaacgtggttttccagtgttttacacggaacagggcacagcctattcaacttgcgtttgcgctggcccggttgggcgttctgagaagatacgctgctgactggttggcgctgcatcgcgtcatctccccgttgctgattgtaatacaggctcgctgttag

SEQ ID NO: 16772 - DNA, 528 bp, A.fumigatus
gaaatccaccctggtggtaatagccgccttcgtgagcatcttcaccggctgcggcctcaacttcgcgttcggcgtgtatcaagagctctacgaatccatggcccagctgccccggcgcaccccattcaccggcgtcacgcccgcccagatcgacctgatcgggacgctggccgtctccatgatgtccctcggagcgcccttcgcgtcgggctggtgcaaatcttactccccgcgccggatcaccctcgccgggacgatcatcttcgccacggccaacgtcctcgcctcgttcagccagcacctctggcaggtcgttctcacccagggcgtgctcctaggctgcggcacctgtctcacgtacatcaccgccgtcaccgtcgccccgggatggttcaccacgcaccgcggcctcgccatcggggtcatctcctccggcaccggcgtcggcggcgtcgtatgggcccctgcgctgcgcgccctgaacgcccggatcgggtttctccacaccgtccgacccacgggcggctg

SEQ ID NO: 16773 - DNA, 744 bp, A.fumigatus
tacaaaatgtctaagaccaagtccgtgaccaagaagggcgccgacaagcccgtcgacaaggccttgagcaaggtcaaggatgctggcgtcaccaaggcttcccagtctcccaaggctaagagcaagcagatcgctcgcgaggtcgctgccaaggagaactccaagcgcaagaagaaggagcctactcctagcagcagctccgagtccgacagcgatgaggagatggagtctaccacttccagcagtgagagcgagagcgaggaggagaagcctgccaagaaggaggtgaagaaggagtccaagaaggctgagtcctcttccgaatccgagcctgagtccgacagcgacgaggagatggacgacgcttccagcagcgagagtgagagtgagagtgagagtgaggatgagaagcctgtcaagaaggacatcaagaaggagtccaagaaggctgagtcctctgattccgagtcggagtctgactctgagtccgagtccgagtcggagtctgaagatgagaaggccgtcaagaaggaggtgaaggccaaggctgacacttccgagtcctctgagtccgagtccgactctgacgaagaagaggaggctcctaagaaggccgctaagaaggagtctagcgacagcgaggattccgaatccgagtctgagtctgagtccgagtccgagtctgagagcgaggacgaggctccgtcttcacccggggcggaaaggccgctgccatgcaaacga

SEQ ID NO: 16774 - DNA, 294 bp, A.fumigatus
tactgctacaccatggctcccacgaccccttcatctcatcggccacggaagaggagaaagtatcccactggctcgaacaactccctcattcttgaagctgagggcggaaaatcatcccctgcgttccctctcgtctcgtttctgtgggctgcccgagctggtgtatctcaatggctggtgctacctctgatcctcatggtggtagggctcttccgctgggctgtcagtctgtggggctactctggtttgtgcagtgcctgggtgttgggaatatgtgtccaaacgtgcagctga

SEQ ID NO: 16775 - DNA, 204 bp, A.fumigatus
cgtatagatgcaggtttccaggtgcctccgatgcatggtgatttcgaagcgcaaaggcactggatggagctcaccattcacctgcccatgtcgaaatggtatctctatgacttgcaatactggggacttgattacccacctctgacggcatatcatagctggctgctggggaagatgtacgtggctttctgggacatattataa

SEQ ID NO: 16776 - DNA, 1413 bp, A.fumigatus
ggaaggcgttcgttgctgacaatcagtagtggaagcgtccttgacccctcttggtttgccctggacgattcgcgcggctttgaggatccaaaattgaaagtattcatgcggggaaccgtgatcgcctccgagtaccttgtctacatccccgccgtcgtcaacttccttcgtcgttatactcggatgcaaggtgttccagcctggtctgcctcaattgctctcgtcgcgatcctattgcaaccggcaaccattctcatcgatcatggccatttccagtataataccgtgatgctggggcttgtggtcgcaagtttggatgctatattggccgggcggatgctgtgggcttgtctcttcttcgtgggcgccttgggcttcaagcagatggccctttattacgccccggccatgttcgcctttcttttaggcgtttgcatcttccccagggtacgcattcttcgtcttctgaacatagccattatcaccatcctcgcatttgcgctattgtttactccgctgcttgttgccgcaaccaatgccgatgctcgggactatctgagtgcttctgcagaacctcctttgctccaggctctacccattaagctgtcaaaggactcttttctgtacgcacccgtctttcagctgatgcaaattatccaccgtgtgttccccttcgcacgtggtttgtttgaggacaaggtcgccaacgcctggtgcgccatccacacgttctacaagcttcatcgcttcgaagcgagccttctccagcgcgtctcactcggcgccacactggcatccatccttattccttgtggaatcattttccgtcacccgcgagcatcgctactgctccccactttggccagcgtcgcctggggcttcttccttttctccttccaggttcatgaaaagagtgtgttgttgcccttacttcccatgacactccttcttgcaaatgatggcggcctgagcaaagacaccagggcctgggttggatgggccaacgtcctcggctcctggaccatgtatcctctcctcaagcgcgacgaactccgggtcccgtactttgtcatgacgggtctctgggcctatctgatgggtctaccaccaacttccttggagacatatcgcagccgaacccctgggggcgaatcacgtcctgtctccgagcctcgcatcctcacgaaacttctgcatttctgcttctacctggcaatgatcgtttggcatgtcctcgacgcatttgtgcctccaccggagggcaagcccgatttatgggtggtgctcaacgtcttgattggcgcgggaggatttggcattgcttacctgtggtgtatgtggagactgatcacgcaatgctggcagattgatcgcaaggcggcagaagaggagagccggaaaaagaagcagtga

SEQ ID NO: 16777 - DNA, 747 bp, A.fumigatus
cgtttgcatggcagcggcctttccgccccgggtgaagacggagcctcgtcctcgctctcagactcggactcggactcagactcagactcggattcggaatcctcgctgtcgctagactccttcttagcggccttcttaggagcctcctcttcttcgtcagagtcggactcggactcagaggactcggaagtgtcagccttggccttcacctccttcttgacggccttctcatcttcagactccgactcggactcggactcagagtcagactccgactcggaatcagaggactcagccttcttggactccttcttgatgtccttcttgacaggcttctcatcctcactctcactctcactctcactctcgctgctggaagcgtcgtccatctcctcgtcgctgtcggactcaggctcggattcggaagaggactcagccttcttggactccttcttcacctccttcttggcaggcttctcctcctcgctctcgctctcactgctggaagtggtagactccatctcctcatcgctgtcggactcggagctgctgctaggagtaggctccttcttcttgcgcttggagttctccttggcagcgacctcgcgagcgatctgcttgctcttagccttgggagactgggaagccttggtgacgccagcatccttgaccttgctcaaggccttgtcgacgggcttgtcggcgcccttcttggtcacggacttggtcttagacattttgtactag

SEQ ID NO: 16778 - DNA, 207 bp, A.fumigatus
cttaagaaaaagtgggtacctggcaggaactcggtgagcacacggccgtcgctggaaccacagtgtcagttgctggtactagcttcaagttccacctccacagactactacagcatttctctactccaagcagtttatttgattaccacgggcattcctcacgctcctactaccggattcttcttcttcggcgacgcactatattga

SEQ ID NO: 16779 - DNA, 558 bp, A.fumigatus
ccaggctacaggctcgaagaaaactcgcatctccttcagccaccggtgaataattactgcgtctatcacccctcctcccccgcgacagccggatacacggtcatgatcgttgggggaccaaatgcccgcacggactatcatatcaacacgaccccagaattcttctatcagtatcgaggctctatgcttctaaagacagttgatacgtcagtctctcctcctgtcttccaggatatccccatccatgaaggatcgatcttcctcctgcccgccaacaccccgcactgccctgtccggttcaaggacactgttggtgtggtgatggaacagcctcggcccaaagatgcggttgatacgatgctgtggttctgcaagaagtgcggggaggttgtctgggagaagcggtttgtgtgtacggatttggggacacaggtgaaggaggtggtggaggaatttgctgctgatcaggagaagcggacttgcaaggcatgtgggaccattgctgaaacgagatatcaggaaggcgaggttgtacagccgcctaggtttctggagtga

SEQ ID NO: 16780 - DNA, 657 bp, A.fumigatus
ggtggattttcctacgtttaccttgtccaagataaggcgacatcggagctcttcgccttgaagaaaatccggtgtccattcggccaagaatctgtatcacaagctttgaaagaggtcgaagcctacagcctattcacatcacaaccgaacatcatccattcgatagaccattgcgtatctacggactcgggctcaaagtttcgttccgatggcggcgaaccaggatcgaaaaccgtctacatcctgctcccctactaccaacgcgggaatcttcaagatgcaatcaatgcaaatctcgtgaatcatactcggtttcccgaaaagaggctaatggtgcttatgctcggtgtcgccaacgcgctaaaagccatgcaccagtatcgggtaaagagtggcgctgggtctacgcgcagagccaaagcggtcagacgcgagggcgaggcggcagatgcacaattgtcaatgcaaatgggcaagccgaagcgtcgagcaagccagagagtagacgaagaagattcagaaaacgagccgttgatggatgacgaggttactataagccaggagggagttcaggagggagaccttcgcccttatgcgcatagggacatcaaacctggtgagctggtgcgtctgcaattttatgcgctgggagactga

SEQ ID NO: 16781 - DNA, 357 bp, A.fumigatus
gagaatcagcttctgatatcgacgacaggatatcggaagatctccaatccagcaatcatggcgacaacatctcagcctccccttcggtttaccggccacaagaatttcgtaaaccgattggtcttttcaaccttgaccggtcgcgcagtccatatctcccaaatccgtccttcgtctcccacgaatcccggtcttgctccccacgaaatctcgtttctgcgtctcttggaagctgtcacaaatggctctcagatagaaatttcatacacgggaaccatcgttgtttacaagcctggtctggtcactggaggcattgcaggcaacggtcttcaccacgggcctggaagatccggatcc

SEQ ID NO: 16782 - DNA, 2148 bp, A.fumigatus
cttgtgttccttctggatttctggaccccttcagttttccgctctggtcgcgttcgtcaattcgagcactttgaggccgctctctctcaaatctcgaactccatcgccatggcgcctctcgacgatatccaggttggcgacgttgtgaacgttcccgggggcatgtatgggacggtccgctacctgggcagcgttgccggaaaacaaggcaggttcgctgggatcgaactggctccggagcacgccaagagaggcaagaacaatggagatgtggaaggaagaaagtatttcaagaccactgtccctggttccggcatctttgttcccatgaacaacaatcgctatgtcacgaagcgatcctccacatccgcccctactgtgaccaccgcccctccgacgccttcgcgaccgatcaatttcagcaaatctgtcggtcccagtcctgcagtacctcgtccacgagtaagacgaccctctttacctcgccctgagtcgccgcgtggtccgcctccctccaagcttagccttgccggtcttcgtactccatccaccgcttctcgagcagggccgagtcccaatggctatcctcgaagtccggttaaagctccgtctcgcgcatccgataggactccctcccgcatgagcatggacgatgacttgtcctcagtcaggacttccgacttccatcgcagctcgatggcgtcggaggtgcaggaattgaaagatcagatcaagagcctggaaaagcaactactggatcgcgataagcaactagaggaacaggcaaatacacttgcagaattccaaaggacaattgaggacctagaaggctcggatgctctgtccatcagggcccagctgcgggagaagaatgagaggattgctcagttgacagcagaattcgatctacatcgagccgacttcagaagcacccttgatacgctagagatagccgcgtccgagaccgagcgggtctacgagcagcgcctggacgaactcatgcagcagaataaagagctacaagaccgaggggaggatgtcgaggccgttgccaggcagctgaagcagttggaagagctggtttcggagctagaagagggcctggaagacgcaagacgtggcgaggcggaagcgcgggctgaggtcgagtttctacgaggagaggtggaaagaacaaagcttgagctgaaaaaagagcgcgaacattccagcgccatgttgagggaagcccattcaggcggagacggaggccggcagtactcgaaggaactagaccagaaagacgacgagatccgcggcctcaaagccatcatccattcattgagcaggggcgacccgaacttccctggccttcagaatgggcttgcaagttctcgacaggaccatgattccgaacacatcgctcgtctggaacagcgtattcaggaatttgagcatgcaaccgagagcaagaactatcgcattgaggagcttgagcgcgagttacagcagttgcggcttagcaacgaaagccgtactcgcagctccacgatcagcgctccagcgcctccccataaaccatcgaactctgctggatatgtcgggaccgcgaacactatcaaccatgctcatcgactgtctgaccgcacagtggtccctaatgactggcaagagcaacctcatggtgaaaatcagtatcagccgtttggctcgcaccaccgaggagcttcgaactcctcgcgccaccgtttggagaccatgcatgagtccgatggccgctctgatgatggcaattccttgtggtgtgagatttgcgaaaccggcggtcacgatattctgagctgcacgaacatccttggtgccgaaaccaagaacgagcatgtacgccccgttgagcagtcacaccacgaggcttctgtggacagcaagtcgacccccgggacttccatcgccggagaatcctctccgttaaaggacgaggttagcgccacccctcaaaagacaggacgagacgccgtcctggaggggctgaagggtatcagtggaggtctcaccgcttctatggctcctgttgcagggaaggctagtggagtgattgatgaaacgaagtggtgtgccctctgtgagagggacggtcatgaaagcattgattgcccttttgatgagtga

SEQ ID NO: 16783 - DNA, 207 bp, A.fumigatus
ggagccgagatccatgaggatcggagtctgaccgtcatcgtcgatcatgatattacctgtcacaagtcagtctcccagcgcataaaattgcagacgcaccagctcaccaggtttgatgtccctatgcgcataagggcgaaggtctccctcctgaactccctcctggcttatagtaacctcgtcatccatcaacggctcgttttctga

SEQ ID NO: 16784 - DNA, 234 bp, A.fumigatus
gatcaatttgatgactaccgagagtcgacgatcggcgctgccttcctaacacagaccatttcgctggacgaaagcacaacggtcaaattcgagatatgggataccgctggtcaggaacgatacaagtccttggctccaatgtactacaggaatgcgaactgtgctgttgttgtctacgatatcactcaggctgtacgcgccccgatcaccttctctaatatcaggctactttga

SEQ ID NO: 16785 - DNA, 1680 bp, A.fumigatus
tggttccaggtgctaattagtgcagctgctgaggctcctctccctcccccgcctccccctgcgcctgcgcgtaagaccgggcgatttcgaaaattccttctctacttgattctgacgtctggattcgcctacggtggcggcatctttctggcgctcaagtctgacaacttccacgatttcttcacggaatacgttccttatggcgaggactgtgttttgtactttgaggaacgtgacttctatcgccgcttccccaacacgttgagaaaccagaaccgggcccccaaggatgagggccacacggttacgattccgagcaagagcgggctctcctggaaggttgcagaggaggaatctggagctgatgtgtcgcagaagggtcctcatatgagcgcactcgacaatggcgacaaagcgcaactcaagcctggcgcagctaagcctgaggagaaggtcgccactgtcgagaaagttaaggccgagtctgctgccaaggaacagaccgctgaggataagaaaaaggtgaaggaggaacccaagaaacccgcggctccagcagtgacgcccattgaatttgcaactgtcagtgaaggcgatgaagaggtcgtgcaggaactggtcaagactttcaacgacattatcactgtcattggcgctgatgagaacgcgcacaagttctctggtgccgtcaataaggcaaaggaggagcttcgaactattggcgagaagatcatcgccatccgcaatgaagcgcgaaaagctgcccaggaggagatcaagcaagcccatgcaactttcgatgagtctgcacgagagctgattcgtcgttttgaggaggcacgtgctcatgacgctgctcagtatcgggaggagtttgaggcagagcgcgagagactcgcccgtgcttaccaggagaaggtcaacacggagctgcagagggctcaagaagtagctgagcagcgactcaagaatgagctggttgaacaggccatcgagcttaaccgcaagtaccttcacgaggtgaaggatctcgttgagcgtgaacgtgaaggtcgtctaagcaagttgaacgagttgaccgccaatgtcaacctgctcgaaaagcttactaccgactggaaggaagtgatcgataccaacctcaagacccagcaactccaggttgctgtggatgccgtccgctccgtccttgagcgctccaccgttcccaggccttttgtccgtgaacttgttgcagtgaaagagctggctgctggtgacccggtcgttgaggctgctattgcatcgatcaacccaactgcttatcagcgtggtattccttcgacgtctcagattattgagcgcttccgtcgggtggccgatgaagtccgcaaggcgagccttctgcccgaagatgctggcatcgccagtcacgcggccagtcttgtcctgagcaaggtcatgttcaagaaagacgccgtcgcgggcagcgacgacgtcgaaagtgtgcttcttcgtaccgagcatttgttagaggaaggcaacctcgatgacgctgctcgtgagatgaacaccctcaagggatgggccaagattttgagcaaggactggttgagtgacgtgcgtcgggtgttggaggtaaaacaggctcttgaggtaagactaggaccttttacttcattgtttcatttatatagatag

SEQ ID NO: 16786 - DNA, 561 bp, A.fumigatus
cacagaccatttcgctggacgaaagcacaacggtcaaattcgagatatgggataccgctggtcaggaacgatacaagtccttggctccaatgtactacaggaatgcgaactgtgctgttgttgtctacgatatcactcaggctgtacgcgccccgatcaccttctctaatatcaggctactttgaaagactaactcgggcaattggcaaacagtcgtcgctggacaaggcaaagtcatgggtgaaggagttgcagcgacaggcgaacgagaatattgtcattgccctcgctggcaataagctggatttagttacggaacatccggacaagagagccattccgactgctgatgccgaagcctatgcgcgcgaagccggactccttttcttcgaaacatctgcgaagacttcgacaaatgtgaaggaactattcgccgcaatcgccaagaaactccctctcgatcaggcgggcccgcgcaatctgcgcaccactcctcgtcccggtgtggacttgcgaccggaagcacctggcacgcagggcgccggagcttgcaattgctaa

SEQ ID NO: 16787 - DNA, 462 bp, A.fumigatus
gcacgtgcctcctcaaaacgacgaatcagctctcgtgcagactcatcgaaagttgcatgggcttgcttgatctcctcctgggcagcttttcgcgcttcattgcggatggcgatgatcttctcgccaatagttcgaagctcctcctttgccttattgacggcaccagagaacttgtgcgcgttctcatcagcgccaatgacagtgataatgtcgttgaaagtcttgaccagttcctgcacgacctcttcatcgccttcactgacagttgcaaattcaatgggcgtcactgctggagccgcgggtttcttgggttcctccttcacctttttcttatcctcagcggtctgttccttggcagcagactcggccttaactttctcgacagtggcgaccttctcctcaggcttagctgcgccaggcttgagttgcgctttgtcgccattgtcgagtgcgctcatatga

SEQ ID NO: 16788 - DNA, 459 bp, A.fumigatus
tacagtcaaaggaaaaatgacccaagaccaagacaaccttcgcgcccgcttctgtcatgccctctcggaaatgtacaaagccgaagtgcccctgtacggggacctcgtcgacctcgtctggcaagccgacgcagaagccctccagaccagccagcggcagcacggcaacaccaccccaatcatcaacccagacgacatcctccccgcccgaaaccgcgtcgaacggcacggcgccatccgcctcggcaccgcgcgcgaactctccaccatccgccgcatgttcgccgtcatgggcatgctccccgtggggtactacgatctgagcgtcgcgggtttccccatgcacgcgactgcgttccggccgcgcacacgcgaggcgctagcccgacatccattccgggtattcacgactgtgctccggatggagttgctgagcgagaggacgagggcgctggctga

SEQ ID NO: 16789 - DNA, 1431 bp, A.fumigatus
acagttgatacagtcaaaggaaaaatgacccaagaccaagacaaccttcgcgcccgcttctgtcatgccctctcggaaatgtacaaagccgaagtgcccctgtacggggacctcgtcgacctcgtctggcaagccgacgcagaagccctccagaccagccagcggcagcacggcaacaccaccccaatcatcaacccagacgacatcctccccgcccgaaaccgcgtcgaacggcacggcgccatccgcctcggcaccgcgcgcgaactctccaccatccgccgcatgttcgccgtcatgggcatgctccccgtggggtactacgatctgagcgtcgcgggtttccccatgcacgcgactgcgttccggccgcgcacacgcgaggcgctagcccgacatccattccgggtattcacgactgtgctccggatggagttgctgagcgagaggacgagggcgctggctgagcgggcgctcgcgcagcgggagatcttcaccccccggctactggagctcctcgagctagcggagacaaacgggtcgctgagctgcaaagaatgcgacgagttcatcgctgaggggctagagaccttccggtggcattcgcgggcggcggtcacgctggaggagtaccgcattctcaaggcagagcatcccctggtggctgatatcgtctccttccccagctgccacatcaaccatttgaccccgcggacgatcgacattgatctcgtgcagaggatgatgcgtgagcgggggatgccagttaaagaacgcatcgagggtccaccgtgccgtgtgaaccccattctcctgcgtcagacgagcttcaaggcgctggaggagacggtctactttcgtgatgcggggggtgagtacgtgaggggctcgcatacggcgcggtttggggaggtcgagcagcgggggtatgcgctgacgcggaaagggcgccggttgtacgatcagattcttgcgagggtgaatcgcgaggcggctggcttggagccggtggagtatgagaggatcttgaggaaatgtttcgaggagtttcctgatgatctggtgcagctgcagacgcagaaactggctttcttctgttatcgggtggcaccgtatgccttgcagaggaaatatcagggcgtggaatctgtttcgctggcgcagttgttgaaggataatgtgctcgactacgagcccatcacgtacgaggacttcttgcctttatccgctggaggcattttcaattcgaacttggccaacatgtcgcagtccaagcaaccgatcatggaggctgatgctgatgctgatctggatggattccaacggatgctgggggctcctgtgctggacgaattctatctgtacgagcagatccagcaggagagtttggagacttgttgccagcagttgggaattggatcgattgactga

SEQ ID NO: 16790 - DNA, 930 bp, A.fumigatus
atttgccagctccccaataaggacgccttccgtcagcgactcggtaccgcaaaaatgcgtaccttttatctgctctccctcagccttgttgcggcagcagagcggccctcgaagcctaacctcctctcacatggacaaaaagaccctctgctaggaaccttctttgggactccaggcgccgacgcaacttttgactatgtggttgtcggcggtgggaacgccggcctgaccgtcgccagcagactcgcccagaaccgatcagcgagtgtcgcggtcatcgaggccggaagcttctacgagatcgacaatgggaataagtcgatcgttcccggctacgcgccgtactttgccgggacagacccggaggactaccagccacttatcgactgggggttcgtaacaacgccccagcctggtgcaggcaatcgcaccgcgcattatgcccggggaaagacactgggagggagctctgcgcgaaatttcatgctctatcatcggcccacggcagacagcatgcagagatgggcggatgaggcgagtgacgagagctatactttcgacaggatgcttccgtactttaagaagtcatgccactatacgcctccggaccagagtctgtacgtcaatagtacaaatacgcagactccagacgcgtttgagccttcggggggtcctctgcaggtttcttttggcaatagtgtcgatgtgtttggaacttgggcacagaaggccttcactgccgtgggcttggaggagatcgatgggctgaacagtggcaggctgctaggagctgcatacggaacctccacgatcaacccgaagaacgcacagcgttcgtcgtccgaggcgagtttcctccaggaggccatggcgggggttcgcctcctccgatctacatcaagcgccatgggcgcagaaaatcctgtttga

SEQ ID NO: 16791 - DNA, 210 bp, A.fumigatus
atccaaaaaattccaacaaatactcgatgttggccccctcccttttccctaattgtcccgttaattattaaccaactcgaacacaatggcgggaatctgtgtcctaccacattcccaactaaggttgttttgtttaaaaaatcccttgtttcaaacttctcaaacatctattacctaatctcttttaacactaagttatttgttcaccac

SEQ ID NO: 16792 - DNA, 1158 bp, A.fumigatus
gagctgcatacggaacctccacgatcaacccgaagaacgcacagcgttcgtcgtccgaggcgagtttcctccaggaggccatggcgggggttcgcctcctccgatctacatcaagcgccatgggcgcagaaaatcctgtttgacgagaacaaggccgcaacgggcgtccaggtctcaacagcggggacattcggcacgccaccggtcagttacaaattgaacgctcgcaaggaggtcatcatctccgccggcgcgttccagtctccccagctgctcatggtctcaggcgttggagcatgcgaccagctctcaaagttcggcattgactgcatccacgacctgccgggcgttggccaaaacctacaagaccacgtttacttcggctccgtccgtcgagttaacgtcctcacagcgtctgcatccgccaacgatccatccctggctaccagggaggtagagcagtacctcgccaacgccaccgggccgctttctatctttggcgccggatattacggctttgagaagctccctgaaccgtatcgctcgcagctctccgagacctccatccaggcgttgtccagcgtcccaagagactggccagagatcgaatggctgccggtgaattcctggatcggggacgggtccaactacatgaccggcgatccgagcgacgggcacaactacgccaccatcgcgacggcgctcgttgccccgttctctcgggggtccgtgacgctggctgatgcgagtatgaatacgccgcctgtcatcgacccgcagtggcttgttgatcccacagacgtcgacctggcgattcagtcattcaagcgccagcgtcaagtctgggaggtgcttgttagaatggggattgctgatgcgcgtgaagcgtatcccggagagcatgtccagacggactcacagatccgtgagtatctggccaaaagtgtgattcctgtgtttcacgtggctggcagctgtaagatggggcggaaagatgacccactggcggtcctggataatacggctcgggtctttggagtacagaacttgcgtgttgttgacgccagtagttttccgttcataacgccaggacacccgcaggcggtggtgtatgcactcgcggagaagattgcagatgttatactggctgggagatag

SEQ ID NO: 16793 - DNA, 1002 bp, A.fumigatus
  unsure (218): Identity of nucleotide sequences at the above locations are unknown.
atgtttgagaagtttgaaacaagggattttttaaacaaaacaaccttagttgggaatgtggtaggacacagattcccgccattgtgttcgagttggttaataattaacgggacaattagggaaaagggagggggccaacatcgagtatttgttggaattttttggatttatttttgcgaacacggacgcccattaacaacaagtccaacccagattcnagggtccattggttttgttcttcgctgggggggacgcagagacctaccaagagatctgagtgatttaattcaagcggaggaccaaacaaattcaccatgttctcccgaacaacgatggcaagagcgttcgccctacccttgggagcagcagcacaacgcaatcttgcgccccagcttccgcgcatgcgttcaccaagccacgaacacaagcagcagcagcagcacatcacacctcgagaaccctctcagcgccacaccacaggcccaatcctccacgcctaccgctcaaactccacccagaccctcacaggatcaagcgtcacccctacgccttaccaaatccctcctcgagaaactcccctaccttacctcccaaaaaccacactacataaccgcgcacctccacgcaagaccctacctcctgaccgcaggcgaccatctccgcctgccgttctttatgcggggcgtgaaaccgggagacatcctccgcttcaaccgggcgtctgtgctcggttcgcgcgacttcacgctcaagggagcaccttatattgatgagcggctgtttgagtgccgggtgagggttatgggcgtggatgcggagccaatgcgggtgaaggagaagacgaagcggagacagcggcatgtgcggaaggttaagagcaaacataagtatacccttctacgggtgatggatgtcaaggtcaagacggcggaggagctacttgaacaaggggcggtggttgttgaagagggggatgtgccgaagttggaggctaatacttaa

SEQ ID NO: 16794 - DNA, 369 bp, A.fumigatus
tgggctcgtagtcgagcacattatccttcaacaactgcgccagcgaaacagattccacgccctgatatttcctctgcaaggcatacggtgccacccgataacagaagaaagccagtttctgcgtctgcagctgcaccagatcatcaggaaactcctcgaaacatttcctcaagatcctctcatactccaccggctccaagccagccgcctcgcgattcaccctcgcaagaatctgatcgtacaaccggcgccctttccgcgtcagcgcatacccccgctgctcgacctccccaaaccgcgccgtatgcgagcccctcacgtactcaccccccgcatcacgaaagtagaccgtctcctccagcgccttga

SEQ ID NO: 16795 - DNA, 639 bp, A.fumigatus
aggcaagaagtcctcgtacgtgatgggctcgtagtcgagcacattatccttcaacaactgcgccagcgaaacagattccacgccctgatatttcctctgcaaggcatacggtgccacccgataacagaagaaagccagtttctgcgtctgcagctgcaccagatcatcaggaaactcctcgaaacatttcctcaagatcctctcatactccaccggctccaagccagccgcctcgcgattcaccctcgcaagaatctgatcgtacaaccggcgccctttccgcgtcagcgcatacccccgctgctcgacctccccaaaccgcgccgtatgcgagcccctcacgtactcaccccccgcatcacgaaagtagaccgtctcctccagcgccttgaagctcgtctgacgcaggagaatggggttcacacggcacggtggaccctcgatgcgttctttaactggcatcccccgctcacgcatcatcctctgcacgagatcaatgtcgatcgtccgcggggtcaaatggttgatgtggcagctggggaaggagacgatatcagccaccaggggatgctctgccttgagaatgcggtactcctccagcgtgaccgccgcccgcgaatgccaccggaaggtctctag

SEQ ID NO: 16796 - DNA, 1113 bp, A.fumigatus
gctgaggggctacaagaacaatttgatcaaggagagcatacgggtaagtggtatattgctgaaaatagcagcgatgctaactttgcatgttcacagatgggcaacgaggatctcggacttcactaccatcaaatcggcaacttggttgccgcttccaaggcctactcgcgcatgagggactactgcacgacacccagccatatcgcgtctatgttgttcaagattatcaatgtggcaatcgaacggggagactggttgagcgtacaatccaacgtgcaccggctgcgcaacctccaatcgaaaccggaagagcaggcgaagaatcaacctaagatatcagccgccttgggcttgtcccagctgcactccgggtcatacttagatgctgccaacagtttcttgaccactgatccatcacttggggattcctacaacgaagtcgtcacatcgaacgacgtggcggtctatggtgggctctgtgctcttgcgtcgatggattgtaacgagctccagcgacgcgtacttgacaacaactcgttccgcaatttcctcgaactcgaaccgcatattcgccgggcaatctcgtttttctgcaattcgaagttccgaccttgtttggagattcttgagtcctacaaagccgactatctacttgacatccaccttcagcgtcatgtcagcacccttttcacccgcatccgcacgaaggctatccagcagtatctcgttcctttcagccgcgtgacgctcgattccatgttgaagatctttgctccaggggtcgctgccggccaggcgcacccgaccgacttcaactcccccttcgtgcaagagttaatcaccttgatccaggatggaacgctggatgctcgaattgacttggaaaagggggttctcgtatctaagcagactgatctacggacagacgtgcagcgagcagcgctggaaagccttgtcaacttcaggaaagaggcacatctccggctgttgcggactaacatccttcgtgccgggctagaggtgcgggcgccgggggacgacagaaagctgagaccagcggaccgaggcgttggaaaggggttggctgggctagggggcaagtactctcggtga

SEQ ID NO: 16797 - DNA, 378 bp, A.fumigatus
ccaaactctctagtaatccaccccgccgaatcccacccgttagttatcctccatgccatcgcctcgcgcaatctctcaacatcccagaagcaccagcggaactaccgttttaccaaagcctacggctcgtatcaggatctcctggacgatccggacgtcgatatcgtgtacatttccacgccgaacagcctgcactacgagtgggcggcgaaggcgctccaggccgggaagcatgtgctctgcgagaaaccgttcacggcgaatgcggacgaggcgaagaagttggtggagctggcgagggagaaggggttgattgttgaggaggctgtaagtctcttttctttttctgtttgcgcggcaggtgcagcggggtggtga

SEQ ID NO: 16798 - DNA, 654 bp, A.fumigatus
gttttggtatttttgtgtgctaatgcaagtgcagtggttgacaaggggataggcggctcggcaatggacatgacctatgctttgtcgtttactcgctatgcactgcatgcgcagctcccgcaggagatcatctccgtcagcgtgcggccgtccaaggatgacccgcgcgttgacgaagccatgtacgcgcatatcgacttccaaggcccggacggcaaccccgtgcacagccgcgtgtatacggacatggcgcgcgagaaagtcgcgggcgtgatcccgcgggtctgggagttaccgtccatcgaggtcgagacggagaaggcgatcatctactactataacgcgatgatgccgcatctgtaccactacatctccatccaggataagacgacgggcaaggtgagctataagaagcagtactctggtggtcccttgtggggcaatgttgtgaccagcacgggggagaagggcggaaatccgcactggagtacatatcggtggcaactggaggcgtttgtggatgcggttaagggcaaaacgccggcgtattgggtcagcggggaggagagtatctggcagatggagtcgattgattccctgtacaaggcggccaatttaccaatgcggccgtcccaagggaccaagctggggtag

SEQ ID NO: 16799 - DNA, 258 bp, A.fumigatus
atgggctcaatcttacctacagtaaccagaggattcggccaattctcaacttcaaacaatcgtcattgtatttgttgtgtcattgtatttgttgtgatcatggcgctcgtcgaccaagccgctacattcctacaccaatacgtctactcgtggctccatagcatccccagtaaaacccccgacgcattgaaactcggcgtcatctcaaccgcccagatcaaccctgcagccagtaaagcttactttgtttcgttttga

SEQ ID NO: 16800 - DNA, 759 bp, A.fumigatus
ctcccagacccgcgggatcacgcccgcgactttctcgcgcgccatgtccgtatacacgcggctgtgcacggggttgccgtccgggccttggaagtcgatatgcgcgtacatggcttcgtcaacgcgcgggtcatccttggacggccgcacgctgacggagatgatctcctgcgggagctgcgcatgcagtgcatagcgagtaaacgacaaagcataggtcatgtccattgccgagccgcctatccccttgtcaaccactgcacttgcattagcacacaaaaataccaaaactcactcacctgccaggtcaaacttccaccggatatcacccctggggataccaggactagccgtcatagcggccttcgtacagattatcttcccgtattctctcgaatccaggatctggcgccatgcatgcgcggccggatggaactgccaatggaactacatctgtcaccaccccgctgcacctgccgcgcaaacagaaaaagaaaagagacttacagcctcctcaacaatcaaccccttctccctcgccagctccaccaacttcttcgcctcgtccgcattcgccgtgaacggtttctcgcagagcacatgcttcccggcctggagcgccttcgccgcccactcgtagtgcaggctgttcggcgtggaaatgtacacgatatcgacgtccggatcgtccaggagatcctgatacgagccgtaggctttggtaaaacggtagttccgctggtgcttctgggatgttga

SEQ ID NO: 16801 - DNA, 240 bp, A.fumigatus
gccccaaggcaccgtcgtcgaggattgaccgccgaattcaccgcctcctttcttctccacaacaaaacagtaatttggtggttcttgtacggcattcagaccatctctagcgcaagtatgagaaagcaagtcatcagttcatcagatactgtcaaagatcccgtcaccatggtccccgactacatctcctacggctcttgtcatcacggtatcaacctgtgctgtcggatcccagtgtga

SEQ ID NO: 16802 - DNA, 2076 bp, A.fumigatus
acgaagcttcattcacactctccctccaatcatcctggcattagtcgtccttgcttcctttctcttcaattcctcctcctttccctcttgaaaagaatcaccattgtacacagctacaccttgcaatcattctggtgcatctctatagtgaacaatttcaatatggttcaacaggatcctcaggaagttgcgcatctggtcggagccctggaggcctccagtaagaagaatagaagcgaaggaaagagaacatttacttgcaagaaatctactttcgccgtggcaggctcagataatatctcagttgactcgtggaggtttatggactgggactacaaacggagcaatcttccgacctatgcccggggtctgttcacgagcaagaggaaagacggcactcccgagattgtagtgcgcggttacgacaagttcttcaatgtcgatgaagtacctactaccaagtggcaaaatatcgagacaaacacaagaggcccctatgagctcagtgtgaaggagaacggatgtattatcttcatctccggcctggaggacggctccttgctcgtttgtagcaagcattcgactggcgttcgacaggacaccaacctgagccacgcccaagccggagaaaagtgggtcgagcgtcatgttgcttccacagggaaatccgtcaaggatttggccagagagttgcgcaggctgaaccttaccgctgttggagagctctgcgacgacagctttgaggagcatgttcttgcctacgatccggcagctgcaggaatatatcttcatgggctcaatttcaacgtgccacagttcgcgacattgccgagctcagaagtacataactttgcagatacatggggtttcaaaaaggccaaatacctcgtatacgatgacatccattcggtcaagaagttcctagatcactgcgctgagaccggcacttgggatggccgtgagacggaggggtttgtcatccggtgccagctaggcgaaggcggaggcccgtacagggattggttcttcaagtataaatttgaggagccatacctgatgtatcgacagtggcgtgaatgtaccaaagcgatcattgccgggaagtttccgaacattagaaagcaccagaaaattaccgaagagtatcttcattatgctcggaggcagctgtcccagaatcccaagctgggcgatctctataaacagaatcatggaatcatctccatgcgagaaggttttctcaaggagagaggcttaaagggatcggatatcatcgcgatggaagccgggaaacctgatgaagtgacccgagacgtcattctagcacccatcgcttcgctcggctgtggaaaaacaaccttggctctcgctctaaccaagctttttggctggggccatgttcagaacgataacattcccaagcaaaagaacaaaccgaagcggttcgcattcgaaatcgccaatctcctcgcggacaaaccagttgtgatagcggaccgcaacaaccatcagaggcgagagagagagcagctcatggaagatatactccctgggattccgggcgcacggtttgtagctctccactacgttcacgaaccaaaagacgttttacttccttcgatcagagaggttacacgcaaacgcgtcttagagcgaggagataatcatcagaccatccgcgccggaacgaagaactcggatgagattgtcggcattatggaaggtttcctgaagcgatttgaaggtattaacagggagcgtgaacccgacagcggatttgaccatgtgatcgacttggatgttgccgcatcttcacgagagaatctcgaaactgtggtgaacgcgctgcattcattctacccggaccttctgcggcgggttcccacgtcgcaggaactcgacgatgctgttacctgggcgatgacggaataccatgtccaacttgacctcagctacagctacggttcatcgaagccgagacagaatttgaataagaacaagggtcagaatgacggtgcgtcgaccgcagcacacgcccagccccaggaatcttcaccacggggctggaaggctccg

SEQ ID NO: 16803 - DNA, 690 bp, A.fumigatus
gcccagatctgttgcttttgtacagccacgatgactcaaccgaatccctacattctggccgccgaaaacccttccgccctattgactcttttgcgctcgaatccagccatcgcatcctgtcaagatgaacacggatactctctcttgcacgccgcagcttcgtatggccatgctgacctcctacgcgcacttgtcggggagttcaatgtggacgtcaaccttctcgatgaggatggcgagacgtgccttttcgtgacggagaatgctgacatcgccaagtgtctcgttgaggagctaggtgtggattataataaacggaacgatgaagggttaacggcgcaggagaccattgagagcgacggcgcatttcccgatgtcgcagcatacctcgcaaaagttatgggcatatctccatcagcacctgcaggctcgtcattagatgccttgaatgctcctcctccgttgccgccgaatatcagagtcaacctaggaacagtatcggaggaggaagcgagcgcagggacggaccaggttgacccagagttcaaacgccggattgacgagctcgccgcgcgagaagacttccacagtgaagctacgcaaaaccaactacgacagctggttatggatgcccttagtggctccaatattgagacacaggacagagatgttcggcggagaacggaataa

SEQ ID NO: 16804 - DNA, 2172 bp, A.fumigatus
ttgccgccatcttgcagccgatcgaaaagccgtcccaattgcactgcactttcgattccaccacttcagtctaggaatcgaacttccccgcttcgctacggttacactccaacgcggagttccgcaatcggtcgcagagtatcaggggcatgttcattgacccttgaccagtcattggatgggttgttcggcctgcgcaacaggctcatcttgcgtcatgaaagcggcggggatcgagtggtcctaataccggaaggacgcgttacctggcttaaagatcatggccacattgccgtggagatcggctggcaggcgagaagtaccttccacctttatacagtggacgatcagttcggccgcctgaccgacaatggtagcttgcacagtagatcacttctgtgctatttacatgccctaacgtcatactgccttccagacccgcttactgggagaacagggaccgagcaggctctcaccatccttcggtccgcatcaatgcgctcattcgaccggcttcacccgaaagcaagtataattctcgccaaaattgcagagctgacaccggagaggcattattatccatccaatgagcgagttatgcagaccgttcgctgggacaagcacctcgggttcctcgcccagcatgatagtttctaccgagaggtcacggcaatttttgatcacgacaaccggatgaagatgtttcatccgaatgagcaggtgaaccaacccccgttgcctcatatagttcccgatttgctgagacggaacgaaattcggtcgtcctcctttcgtgttgctggctttggggcggaggctcacacggttgaatatgaccggccctacaaaggtcttgatcagaatcgtcactcggccggattctaccgtgcctaccgcctgtgcaaaatcctctatgaggggatcccctcagccctggagacctcacatgtggacttgctttcagaactctggcagtttctctctcaaacccacgttgtccacgcagccagttccccagtcgacagtagcaggatacagtacgatgcaggatggatactggagccgatgacctttgtagctagtcactggtgtagccttcatcaactgctctgctcaagggacactggcatgagtaagttccaagtcatggtatggttggcaaccttggcattctccgagagctccaatatggtcgtccttgaagttcttgcttcactctacgtgatcccagagatggcgaaccccacgccagcttctcgcggacagtttcagctttggcacggatatgaggtgaatgaggcaatgttgggctctcggatccatcagtcagctgctctctcgcacaccccagaatccaatctacatccccgacacaatgagaatatgcgggtgttcagatcccgaaagaaaagaatcgcaaaaatgaaccggacattggctcttcagacattcatacggggcttaaaagcgcgatggccgatccgatctcctgcaacacctcccgaggaagcgggcccaaggtttggagactactacgcaacacccgaagccatgactcaggctggtcagctttttcaaatatggtttgataatctcgagtttcgagaatatctctcagatctctcgtctctcttcgtcagccaaacagtccatcatgtccagatgccccctgtctgcctcccaggtgaagtgaaacagacaaccacacgccggggatacatctgcatagacgacctgctaggttttgagccaatgctggacatggagcgtccacgcttaagtagtctcctgagtagccaccccgagtgtgaggacccagcacctcgcctcatggcccttgtcgattctttagaacgacagtcaaagtcccaatatgagcgccgatatgtcgagcatctccggggcagtattggttccctacagcagaagaaaagaagggattatattacaataaactctagccaactggaggcagctcttctcgactaccttcatcattgtgaaacgtactgtgagcgcctgtacgacgccatgaggatgcgtttgacgcattttgacggaacgcttgatagcacccaaaatagtctaccgttggaaacgttggccggcatcggtaattggccgagaatctcaccatatcttctggttgagcaactgacgcaccaacgatag

SEQ ID NO: 16805 - DNA, 3504 bp, A.fumigatus
  unsure (23): Identity of nucleotide sequences at the above locations are unknown.
tatcttctgcccgagcgatgganagccaacatcgtcgaatatgggtgtgcaatcacagcacttcagcgagcaagacggttaaccaccctagttcattcccctgacgatttgattcgggaactacagaacccgggccataccaactgggatccgtaccagtaccccgagtccctgctgttggaaattgaaaatagcatgttgataagagaggtccaggaacagattgctcggagaatgagagacatcagtcccggcacgaacgcagtcatgcagctgaatatgggggagggaaaatcatcggtgattgtgccgatggtggttgcccaccttgcagacggatcacgtctggtgcgcgtagtcgttgcgaaaccccaatcccggcagatgctgcagatgctggtctcaaaattagggggattgttgggtcgaccagtctaccttctgccagtctcgcgctccctgaggttaacggtggcggacgccgatgccatattccacctgtgccagaaatgcatgaaggagggaggcgttctgctagtccaacccgagcacctattatcgttgaaactgatgtgcctcgagagctttgtcacggggagaggggcagttgggggttccctgcttcagactctcgagtttttcacccaatacgcacaggatgtggtcgatgagagtgacgagaacttcagcgccaggttcgagctcatctataccatggggactcagcgccagttggagctcaccccgcaaagatggatgatcgtgcaggagctgctcaatatcatgaggatgatagcgccgagtgtcaagaaggactatcccaggtcactagaggtggaagagtgttcggtggggggctttcctcggataagactgctgcaaaaagacgcggagctagaactgttgcaacgggtcgctacgcacatatgcgaacacggcattgattctctgccgatttctcgacagtcaaaaacagcgagacaggctgtacgtgcgtacattctgaagcaggagttaagctcggaagagatctcgtccgtcgaggacacaggcccagcagggttctggaccgaaacaacaaagaatccgctacttctgttacgcggcctttttgccggaggaatcctatccttttgtttcggccagaaacgatggcgggtgaactatgggcctgatcactcacgaaatcccccaacgagactttcagtcccttatcgagccaaggactgcccggcgccccggtctgaattcagccaccccgacgtggtcatcctgctgacatgtctgaattactactatgccggcctcagcgatgaggagctgtttctggccttggatcatcttgtcaagtccgatcaagccgagatcgagtaccaggcatgggtggtcgattgtccgtccctcccggacacttaccgtcaattgggcggggtcaaccttgaagatcgacagcactgcgtgaaacagatattcccctggtttcgctctgcgaaaggtgcaattgattattttctggcccacgttgtttttccaagggaattgcgagagtttccagacaagctctctgcatcgggatgggatatcggtgaactcagaacccagccaacagttggattcagcggaacgaacgattcgcggcagacccttcccctgagcgtagagcagttggatctcccggagcaaaatcatacgaacgcgttggttctggattaccttttgaggcccgagaactcggtagcgctctctcccgcacggccgcaagcctcgacgttggacgccaaggggttgctggacatggttatgggattagagccaccagtccaggtgatcctcgatgtcggcgcgcagatactggaactcagcagtttggaggttgcagagtactggttaaatctgataccagacaacactcagactcaggcggtgattttcgtcaatgagaatgatgagatatgtgttcttgaccggaacagacgggtagagctgctgcaggtctcgccctttgcaaagcagcttggtgcatgtttggtcttccttgatgaggcgcacacgagagggattgacttgaagctgcccgcgacgtatcgagcagctgttactttaggcgcaggcattacgaaggacaaattggtccaaggtaagacggctggaaaccgagggatgaatcggaatgcaaagctaacggcgcattcagcgtgcatgagaatgaggaagctagggaaaggccagtccgttgttttctgcattccagatgagatcaggttcaagatcctggccctcccccataagtgcagccggtcagatattgatgtcgccgacgttctctgctgggcggtgtcggagacctgggttgatatacggcgaagtatgcccctgtgggcggcacagggtaaacgatatatacaacaatgcagactatgggaggccgctagtcaaggcggtaaagcccagctttcacttagccgggcttccgactttctcgaaccagaagctcaatctctagatgatcggtatcggccacgtcgcggggatgccccgtttctgcaccatcagcccgatgagagtacaccaatgtgtcttatttctgagcgatgccgggagtttgatgagttgaagtttgcgtcggcacagctacaagaagaacaggagcgtgagcttgccccggaaattgaacaggaacgccagattgagcggcctcctccagccaagcctaaccaacattgtcttcatgcggacctccttacgtttgtgtccacaggcatactcaaggagcactccagcgcttttaggcctgcctttgaggccctcaaaaatacgtctgcagcccgttatctgggcgtgtctcagtttccttcgggattacgagtcacaaccgacttcgccactaccattcaattacgagaggggtcttcttgtttgtctgatacataccagcgccctgtccaatgggtcctaacacactccatctatgattctacttctggaaaacgaaacgcaagtcaagtcataattataagcccctacgaggccatgcatctgcttccagaagtccgacgatcgacaggtgccacaattcatttgtacgcgccgcgtcagaacctgagcttcgtatccctagatcgcttggacctgtacaatattccaagccgtcctgactctatcgatataccagacgacttaaagatacagttgaatctattcgcgggtcaactgtatattgcctcataccccgagtacctcagactgtgtgacactcttggggtagcctctgctgcaacaccagataatttcactgttgccgctgacgggttcattctgcagggcaatgtgacttcaaagtcgaccttcagtcagagcccccttaaattcttgcaagtcctcctgtcgcaaatcaggaaagacggccaagacatcagcaagactcacattggcagactcttggacggccgacttcttgaactacgcgattttgaccccgcgatcgaagagtttacgcccacaagt

SEQ ID NO: 16806 - DNA, 2106 bp, A.fumigatus
  unsure (1949): Identity of nucleotide sequences at the above locations are unknown.
cgcatggagcgcactttccatccacgtgctgaagacatggattgcacttacgaagaagtcatcgttgacaggcgcttcaacttccgggagactcgacatagtggctcctgccaacgatgcgcgtatcagcgccaagcggactcgatgaaggtgagcgtccacgaatggccacttcccagtaatcgtttgcaagcaaagtccacggtgttcgagctgaacgtacctcgcccctttggatgttggcgggatatcaccatgttctttctcgttgatgtcctgcacattcaatatatctccagagacgaaccgagggccgaacacacgctccagaattacggcggcctgtcgcctttttatactgctgttcaaggcgtcgggcgagtcggccttctatcacagaataaaccgcacgaacggacacatcggctgaaaaagaaaatcatcaacgtgacagaagatgacgtctgcgtcaacaacggcctgcttctccggtatttcgatttctcgatgcggacgttcgtcgggggctttaagatgtcggacgaaattgcaaacttatgcatgtataagttaccaaaaagaagtacggacctacagcagtttctatttcggccattgggcaatccagatgggccatcgcccaatacagttatcgcatcgcaggattgctgcccggtggggatgtcgcttgaggagtacagatccctgtgtaccatgccactcggagtcgagatccagtggcaaaatatccttcgccagctggccatgccgtcgatcgatctcaagaaggcagagacttgcatctttatcctgcagatcatcaaccaagctggcccatcaaccgcgagccgggttacgaggacggcacatgacatcttaaacgacaccgcgtttacgaccgcgttgttaggacgagtttacgacatcgcggcgagactagaggagaattgggaaatggcacaagggctcagcgctctgagtgccttggtactcagaattttggctctatcgccctccgcagacgtgcgggagatatgcctcactacgcttcagcatctccgcaaagtcgcctttgcctgggtcaagatcgttaccgagaaagccagctctacgactgacgacagacgcagaagcgacctgctgatgcggagcggtcaactagcgttaatatgcgccacaacgttcgatgccgaagacatcgtcttggttcgaatgctggagaatccatccgatactgcagttttacttcaatgttgtatgctcataaacgacacacggcgtttcctgtgcgagggatccggctcctcccctttaatcccgatcctttttcgtcgctggcaagtcctgtgttatcgctgtttgccggtcctgaggcaaaatatcctccagcgcgcggactcgtcgctggatatcgctatcggacagatatgggtgacgtatcgcgctgggtcctcttggaaggcatccccagaggcgccaatctgttggcttgtcactagtctcccaagccagtccgagcatggggtcgatctgcccgttcattataacctgctaactggggatcttctcgtcaacggccttcccttggctcgactgccctcggaatatgagagacatgacacctacagaacccttttcggacaatcctcactggaggtgatgccgagtgtgatcccggggatggatttcacctgtcgaaagaaatacatgggacacactgtgagcttctcgaggagaaaggtgacgggctgtgaggactttgatttgtgcattcaagcgacagaagcgggctgcacctgggaatttatacctcccagacttctgatgggttccttccctgacgcttttctgacgggctgcgtgcactggtacaacgttcacaatgactatgtggaattccggcccatagacaagccttggatatcatccactttcaattggaggcttcngaagaccagcgcgcacgacctctggcggctagcccaagacactttattcttggtcagcgtgaaaagtcgaaccgcagaagtgattgccgccatcttgcagccgatcgaaaagccgtcccaattgcactgcactttcgattccaccacttcagtctag

SEQ ID NO: 16807 - DNA, 213 bp, A.fumigatus
agtaacagctgctcgatacgtcgcgggcagcttcaagtcaatccctctcgtgtgcgcctcatcaaggaagaccaaacatgcaccaagctgctttgcaaagggcgagacctgcagcagctctacccgtctgttccggtcaagaacacatatctcatcattctcattgacgaaaatcaccgcctgagtctgagtgttgtctggtatcagatttaa

SEQ ID NO: 16808 - DNA, 198 bp, A.fumigatus
ctagtaatggttaggatggtcgtggtagggtatagctatacctccacaccacttcttgtcataacgttatatagtaagcagtcaaatgagccattcctggaagatcaaccctcttacacctccgttagtgaggtctttcccgctacttgtttgtacagagcctataaattagaatcctataacatactcagctactag

SEQ ID NO: 16809 - DNA, 1122 bp, A.fumigatus
  unsure (790),(821),(1015): Identity of nucleotide sequences at the above locations are unknown.
gcacctagaatccgtgccatgtcaacagcagcatccaccatgaacggcacagtcgaaaaggttttgtatctctcttcccttgccgtgggatcctgggtagccaagagactcctggacgaatatgccgacctcccactgcatctcctctgctccagcatcgaggtccactcctatgatgaggcctacaattatctcctctactggcttatgaagcaaacattcgacgcaaacaaaaaccgcttgctggctttaacgtcgctgacgagcggccaggggggtttcttcggcgaagacaccaacaaggacaatgatgcggccgaggaggacgaactggaggtccacgcggatgcagaatacaaggcctccctggcgaatacccgtcccttgctctggactccctcggcgggaacacactggttccgatatcgcggtcggtttctggcgctcacgcgggaggtagaggaaaatcggcaaacagtgtacacgcgcacagagaagctgcgggtctcttgtttgggatgggatccagccattctgaaagagttgatgcaggatgctcgggtggcgttctcgcaaaaggagaaggggaggacagtgatctaccgcgccatgaagtcgatttacgatggcgagttggcttggaaaaggttgacttcgcgtcctgctcgaccactgtccacagtcattctggacgaggcagtcaagcacgcgtttctcgaagacattcagcactatctgcaccccagtacgatgcgctggtacagcgaccgtggcattccctatcggcggngatacctgttttatgggccgactggcacggngaagtccagtctcgcgttcgccccaacaagggtttctcggcttgaatgtgtacatggtcaacctgaactcgcaacaacttacggaggatgccttgacgcagttgtttctgacgcttccggagacggtgtctggtgctgctgggaagatatcgacgccaaggaagtaactggtcgttcgcaacccaactgcacgncgccgaaaggggaagaacgggatctcgctctcggccttgttgaatatcatcgacggcgtcgcggctcaggaggcccgggtgctgattatgacgacgaatcaccatga

SEQ ID NO: 16810 - DNA, 597 bp, A.fumigatus
  unsure (27): Identity of nucleotide sequences at the above locations are unknown.
ctggtcgttcgcaacccaactgcacgncgccgaaaggggaagaacgggatctcgctctcggccttgttgaatatcatcgacggcgtcgcggctcaggaggcccgggtgctgattatgacgacgaatcaccatgagcacctagatccggcgctcattcgacctggccgggtcgactacaagctcgagtttcagctcgccagtcgagatctctgtgcgaccatgtttcggaatatcttccaggtctacacaccgtctgaagtgggcagtgcacaggttgccgcctcttccactcagggtggcctatcggaaaaagacgggtctacagcgattgatctccaagatgtcgccaaagtatttgcggggaagattccgcccggtaccttttctcctgctgaggttcagggatatttgctgcggtatcgagattcaccagaggatgctgtagcgggtgtcgaatcatgggttgaagcatcgcaggccgagaaagcagctaatgaccaagtgcttgaagacaaagcagcccaaagtagtgagagtgaatctgaggacgattctgaggatgacaatgaggagcagccagatgaagacgcatcttga

SEQ ID NO: 16811 - DNA, 789 bp, A.fumigatus
ttgcaatccacgcctcgagcccttcaccttcggaagccggccttctcacataccttcaatctcagccgtcttcgcctcctccctacgatgccgactttgcgctgcggttatgcattcaaccacgaacgtgttcaatcatgcatccatatatatagtgcgatggggcagtatcttcaggccgttgagctggctctgcagcatgaagatattgaactagccgcgatcgtcgcggacagaccagaagggaatgacaagctccgcaagaaattgtggctgcttgtagcggagaagaagatccggcagccaggcaccggaatcaaagacgccatcgagtttctgcgccgatgcgagctgttgcgtattgaggatctgattccgttctttcccgactttgtcgtcattgacgacttcaaagacgagatttgcagtgctctggaggactactcgcggcacatcgacgcattgcgccaggagatggacaattcggcccagactgcacgacaaattcgatccgagattgcggcattggatatgcgttatgccattgtggagccgggggagaaatgctggacttgctctttaccgttgcttagccgccagttctttgtctttccgtgccaacatgcattccacagcgactgtttgggcaaggaggtacttgaaggtgcaggcgggaagaagaagtacattcgtgatctgcaggcgcaactgaataaagccgatgtatcagcttctcggagggaggagatcgtgaaggaattagacggtctggttgctgaggcgtggtaa

SEQ ID NO: 16812 - DNA, 2013 bp, A.fumigatus
gctcacgcgctccgtcccgctatcctcgtggcaatgctaaggtgttttgaactagatattgatcttccaaagaaatcctcggaagtcggagtgattcgtcgaatgtttcttgaccccactgcatcacatttgatcattactacgacccttggcgagaactactaccttcatactcagtctaggcatcccaagtcgctgtcgcgtttaaagggcgtttcgatcgagagtgttgcctggagcccgtcactaccaacggcttcgacaagggagatcctcttaggcgctacagatggtcagatttgggagacctacatcgaaccgtccacggagttctttcggcgcgaggaaaagtacgcccactcagtctacaaagctttggagggatcacctgtgactgggatttggacggaactcgtgcctacgacgcccgagcagagacgggtgctgatcgcgacacatgacaagctaatatgttttcaggggcgggcagggagacaaggaagccaaggtatatatgccgaactttttcaacgggaggcgccagtgctgtatgagattcagaaaccatctggcgccgcaccgtcgacgctggtgatctccgccaccgcggttgatggacacaatgtggatagttacgctgagaaagagttcgcctggctcagttcgcaaggtatctaccatggccaattgccatttgcttcagggaaagagaaagggccctttgaaggcgccaggatgctaccgcgttccatgttccccccaacagagtcagctcggggaggcaagaagctaatccaagatcctatcactgctatgacactgtcacagtggcacattctagcccttgtcgaagggaaaatcgttgctgtcaaccgcatgagcgatgagatcatctatgagcaagcagtgctcgagcctggacagagtacgttagggcttctgacagactcgatgcagcacacgtattggctgtttaccagccaagaaattttcgaaattgtcgccgaggacgaggaccgggatgtgtggaaagtcttcctgcagaagcagatgtttgaccaggcactcgaatatgcccgcggtagcgcgcagaaggatgctgtggctactgcttctggtgacttcctagccagcaagggccgttacctagaagcggccaaggtttggggtaaaagtagcaaggggtttgaggaggtctgtctgactctgatcaatcgtaacgagcatgacgctttgcggaagtatctccttacccagctatcgacatacaagaagtcatctactatgcaaagaattttggttgcgagctggctggtagaggtcttcatgtcgaagttgaacgctctggatgataacattgccaccaaggctgagttagcggagggagccagcactgaggatatcaaagatgagctgagcaatgttcgggccgagttccaagagtttgtgaacaagtacaaaaccgacttggacaagaagacagcgtacgacattatcagtagccatggccgagaagaggagctgctcttttttgcgacggcgactaatgactacaattacgtcctgtcgtattggatacaacgagaaaagtggtcagaagcactcaatgtcctacaaaaacagacggaccccgatgttttctacaagtatagcagcgtgctgatgacccatgccgcgaccgggttagtggatatcctgatgcggcagacaaacctggagcccgagagacttattcctgcgcttctcaattataataagactgtgaatatccctctcagccagaatcaggctgtgcgatacctcaactttatcgttgtcaatcacccgaagccatcggctgcagtacataacacactaattgcaatccacgcctcgagcccttcaccttcggaagccggccttctcacataccttcaatctcagccgtcttcgcctcctccctacgatgccgactttgcgctgcggttatgcattcaaccacgaacgtgttcaatcatgcatccatatatatag

SEQ ID NO: 16813 - DNA, 195 bp, A.fumigatus
tacaccgtcaacagattcttcggccaagtccttctcttctactgtatctcccaccaccccgatcctcgcctccgcaagaccctccccgtcggctgggaacgctggaccgacgagatactgcggtttttggaggactgcgcgccctttagtcctgccgtctcgaaggatctggaactcctgcaattgttacgatga

SEQ ID NO: 16814 - DNA, 834 bp, A.fumigatus
gtgtttgacttgccttccgggcatgcaattctttcagccactaacaatcgaagtcatgatgtcaatttcgatgagtgggaaggagacatgaaatcgcgggtctactggaacactctcatgaacgaaactatccttgtacaggagctgcatcttccacccagtggcctttcacgtctcgaggaactcgtccctattcctaaatttattggcttcgaatctgtcgacttcgtgccagctcgcttctcttcctcttcggacgaaatcgacgaatccttcttccagtaccatttcctcgcgcaggtcgcccaccgtatcatcctcacccgcatccgccgttcactgtacttctactgtgagtcttcgcctctggccccgttcctcctgcgctgcctaagacctctaacattagcctcagccgattcgggaaccttccccctcccggccgtcaacgccgaacttcgccaccaactcgagcaatggcgcatcaatctccctcccgcgctgcaattctccgactctcaacccagtaccccgatggacccaaacccttccccggctccggtgtcccctctccccattgatccgaaccggcccctctctcccgccatagcagtcacagaggcaatgctacgcggccgctacatgatcgccaatttccacatcggccggccatacctgtacaaagcgctccggatcccgcaacgcgtaacggaccacgatcttgagcaaatgcgcaacggcctccgccacgcaatggactggcccccggttggcggcatcttccgcaaaatgaaaagctgcatcccgatcaagttcgctttctgctcccagtaa

SEQ ID NO: 16815 - DNA, 270 bp, A.fumigatus
cctctatctcttttgttgaaggcatgccccctagttgatgagcttgctctctacgatgttgtcaacacacccggcgtcgctgcggatctgtctcacatctcttctgtcgcggtatgtgacatcatcctagacccatctactcaagtgattaatcctcgttctgactcgcactttcagaaagtatccggctaccttcccaaagacgatggtctgaagaatgcattgactggcactgatattgtcgtcattcctgctggaatccctcgttag

SEQ ID NO: 16816 - DNA, 291 bp, A.fumigatus
ggtacgatcctgaagactaattatgatttcaatggcactagaaacgctgacttaatcctctgtatagtatgctggctatgccaacaccaaggtacctcatacatcatcaacttgcagactttcgataataaagaggaattgtatctaagctattgtgaacaggctgtcggtgtgcaggctactgagaacggcggtgtcgttgtcatcaccaagaagcctggcaaccctcagcagcccgcgaagaacctggtcagcgtcagctggggccctaacgctgccacccgcaagtaa

SEQ ID NO: 16817 - DNA, 240 bp, A.fumigatus
tttgccgggtggcattgtctcaggctggttttgctaatcagcggcattgttctatggcacaggatctacaaggctgtagcaagcaagaccgccaagaacggctaccgcgccgacctccgtgaagacgccgttgctcgtgtgagcgccatccgtcgctcccagaagcccaagaaggacgctgcccctaagaagctcagaggcgctcaagccagaaaggctgcggagcagaagtcggagtaa

SEQ ID NO: 16818 - DNA, 564 bp, A.fumigatus
ctcaaaatcttcccaacaggcaagcctggtatgactcgtgacgatctgttcaaggtgaatgctggtatcgtccgtgacttggtgacgggaatcgcgcagtactgccccaaggcttttgtactcatcatctcgaatcctgtaaactccacagtcccaatcgccgctgaggtgcttaagaaacagggtgtcttcgaccccaagcgcttctttggtgtcaccaccctggatattgtctgtgcagagaccttcactcaagaatattccggacagaaggatccatccaaggtccagattcctgttgttggcgggcactatggcgagaccatcgttcccctcttcagcaaggattcccctgccttggatattcctgcagacaagtatgacgctcttgtgaaccgtgagtgtctgctctatatctacagttatttgcagctagcgactaactcgtccgtaggtgtccagtttggtggagatgaggtcgtcaaggctaaagatggcgccggctccgccactttgtccatggcttatgctggcttcaggtctgccaccttttccggagcttaa

SEQ ID NO: 16819 - DNA, 324 bp, A.fumigatus
gtgtccagtttggtggagatgaggtcgtcaaggctaaagatggcgccggctccgccactttgtccatggcttatgctggcttcaggtctgccaccttttccggagcttaaatccgcctacctgctaattcaaggtagatttgccgaaaaggttatcagggcttcgcagggccagtcaggcattgtcgaacctacttacatttacttgcgaggtgtcactggtggtgaggaaattgccaacgagactggtgttgagttcttctcgacccttgtcgaactcggggtaagtgtttccacgtcttcagcacagacaattctcatatag

SEQ ID NO: 16820 - DNA, 447 bp, A.fumigatus
ctgcaaataactgtagatatagagcagacactcacggttcacaagagcgtcatacttgtctgcaggaatatccaaggcaggggaatccttgctgaagaggggaacgatggtctcgccatagtgcccgccaacaacaggaatctggaccttggatggatccttctgtccggaatattcttgagtgaaggtctctgcacagacaatatccagggtggtgacaccaaagaagcgcttggggtcgaagacaccctgtttcttaagcacctcagcggcgattgggactgtggagtttacaggattcgagatgatgagtacaaaagccttggggcagtactgcgcgattcccgtcaccaagtcacggacgataccagcattcaccttgaacagatcgtcacgagtcataccaggcttgcctgttgggaagattttgagtcagaagaagagtag

SEQ ID NO: 16821 - DNA, 333 bp, A.fumigatus
tgcccgttggcagcgctctatctcacccgatcccggtggttgcccttaatcccagttcccgatcatctttatgctcgccttccctccagctttgcgggggacctggaggcgggcctctcctcatcacagttcgatatatcctccaacatcgcagatggcgacacaagagctggcttagacaacaaagcaaaacgcgaggtgcagaagatcatgaagacgcagaatgttaatttcgatgaagctcgacgcatctacaccgaacgacggtttgctacccacaatatcggtcctgacggtcggccaagggacccgaagttcgtgtcattctcttaa

SEQ ID NO: 16822 - DNA, 1146 bp, A.fumigatus
  unsure (377): Identity of nucleotide sequences at the above locations are unknown.
gatcggatccttccggtctccgtggtaagacacgctatcagtgagatggatcgcctgcccccgcggtgggtcgacgttcaggacgaggtgactgagttgctcgcagacattgcgcaaaagtcagcacagctggacaagctacaccagaagcatctgctacctggattcggcgacgaggaagtaaggaagcaggacgagcgaatgatcgaacgactcacgcaggatataactcgcggattccatgagtgtcagacggcggtccagaggattgaagcgatggtgcgcgaggccaagcaacagggcggagtgagtgccggggacgagaccatggcgaagaatatccagatatccctggcttccagggtacaagaggctantgctcggttcaggaagaagcagagcacctatctgaagagtatgcactgttaccatggccattgggaaaatattgtaacctgcgatttgacagaattacgaggactcgagggtgctgcggcgccttttgaccgcgccccaacgccacagaatccctacatggatccttcattaatggagtccgacgcggacaagtcattctctcaatcgactctcatgcaaacgtcacaacgactgaccggtcaacatgacgaagccattgagcaacgtgagagggagatcaacgacatcgcgaagagcatcattgagttgtcggatatatttcgcgaactacaagcgatggtcatcgatcagggaaccatgcttgatcggattgactataatatcgaacggatgggtactgaggtcaaggcagcggagaaggaactgaaagtggtatgtgcatcgctcataagagatcgaggctgccaaaggactgacaaattttgcttgaaggcgaccaactatcaacggcgaacgacaaaacgcaaaattctccttctacttatcatcctggttgcagggatgatcatcctactaatagtcaaaccaaaaaggcatagctcaccagctcctacaccgtcccctccccggcctgtcgaacagccaccatctgagcagcctccgagtcttttccctcgatcatccacatttgtctatcgccgaaagaggcgtccgtttccgattcagtcgtcagatgacaagttgttcgagccgggtataaatgggtag

SEQ ID NO: 16823 - DNA, 291 bp, A.fumigatus
tacctgattatgatgctaatctggattcacccaggccagactgaggttgtcgaaaccaacggcgcatcggatgaaaacgatttcctagcccgggagcgcgctattcttggagatgatgccgaccaatttgctactgctcaagaccacgttgctacagatattggtgatgatttactgggaggtgcggaaggagccgtagttggtgaaacagcccctgaggaaatctcgggatttgagtcttcatttcctgctattgagacacagaatgaggtatcatttcgctcgccctag

SEQ ID NO: 16824 - DNA, 354 bp, A.fumigatus
agggaatggcgtgagagacgagacgcagaaatcgcccgccgtgcagagctttcgaacgagaagaaggaggcgactatcaagaaggctcgagaggacatcgacgatttctacgtatcttacaacaacaagacggacaagctccgggctcaaacccgcgctgatgccgaacagttccttgccaacagagaagacacgtctgccggtggcaccagctgggagcgcatcgcgaagctcgtcgacatctcaggaaagggcgcaaaaggtggtgccagtggatcaggcaaggagcgtttccgtgagttgctactggatctgaagaaggatcagaatgcgcctggtgccagtgggatctag

SEQ ID NO: 16825 - DNA, 867 bp, A.fumigatus
gctatagagattgataagtcacggtcgaccggtaaaaagccattgctgggcggatcccttttctcgagcccgtctgggtcggttccatccgaactccagccgctggtccctctgcaagcagctttgtctaaagcgacaatggcttccggtgcgtctgctactgcagcaaatggagagtacgacaaaatgaatgatcccgccgtacccttaccaactcctccagtgcacgctgcacgtctaagccaactactgaaagcgcttgcaaatgctgaaagttctgtgtccgaggtcatcaaatcgcgcttagcacttatcgatggtcttgagaagcttcttgaaaccaatcgtgcagccttatcaaaagagcagtctgttctttcgcagctgactgaaaggaaggcggagactgaagcgaagaagcgggacgtggaagatagcatcatgagaggactttctatcgacaatccatccctgcctcagcctagcgacgcgggcgctgaagcaccagccgtggctcgtccggaggtcgaagctttgactcccccgccagtggaagcaatcaccccagttgggtccccaacgcaagccccccaggagaaaatccaagagtcggtggaggagggtcaggtcgatggtttttcgcttccaggcatcggacagcctaccaataatgtgccatctgacacaggtctaccaggtctgtcgagtctttccggcatgctacagcagggcagccctaacggagtcaactcgaagaagcgtaaggttacccacggagaggaggactatgcgcaatacgctagcggcgacctggacgctgatgtcgccgagttactgaatcaggagggctatccgcaggagaggtaa

SEQ ID NO: 16826 - DNA, 198 bp, A.fumigatus
gttcacagtatccttccacatccatatcaaactggactggccaatttcgacgacctgtatacttccgctacgcctaagaccttcgactcataccatctctttctcacacccaaccatctattgcatacatacggggcgccccttccgcctgatcgccgtggtcgcagactgttgtcactgacccctttcagcacttga

SEQ ID NO: 16827 - DNA, 273 bp, A.fumigatus
tcaagtcagggcgcgttgatgtacctcgtcgcaatcacgaacatcctgaccgacatggctgtcctcacgcttcccttcttcatgatgcacaaggtccagatgtcccacgggaaaagagtaaagattctgtgcgcattttgcacaagagcgctgttggtcactcgacattgtacgagttattccacgctaatggagacacagcaccgtcttactcacaactgggcaactagcgacactaccacgatccttaacatcatcagatactacatgtaa

SEQ ID NO: 16828 - DNA, 348 bp, A.fumigatus
ccttcccagagtgtgatcaacgcctcccgtaaacgcattcctgggctggaggatgtcgagccaatccagggcaccacagcgacaacgacctatgtctatataaccaaccaatccgcaggccctaggccagatgaatccagcccgagtgctcgcgtgaacactttccccagcatggagcccgagaagacttgccagctgctcgaagctcatttacagctgtatcataatcagatcaaaaacatctcgagcagggatattgacattcagatggcgtctttacctcccagcctctgtcagttctcatcacacaggcctctgcagatcggggagagaacgctttcgggttag

SEQ ID NO: 16829 - DNA, 192 bp, A.fumigatus
atcagcatcaccatagatggtctttcaacagtgaagtttcaggtatataaggacgtggaggattggcttaacatattcccgtccttctacaggggcatgtgcaactggatttatgacatagccacaaccatctcatgcttaagctatgctgaccttcaagagcatctccaaactccacttcgcaagctgtag

SEQ ID NO: 16830 - DNA, 198 bp, A.fumigatus
gcttcatctttcaagttgcaacagaaagaagctcctgatgaacaattgagcaacgacggtagactgaatcctctgtttatgaatcaggtagccgatgatcaggtctattccagctacggagcgcagaacaaagctccactacaacagatcgcacaggcatacgatcctgcaagattcatgaagagacatggtagatga

SEQ ID NO: 16831 - DNA, 372 bp, A.fumigatus
agctcctcgtgtctcagaaagattacgaaccaatcggaagttggtgaagttgaaagacttctggaatctgctctggtagagagattcccccgtcattataattctcctatcatgctgtctgaaacagctaagagacgtactaaccgcaaaggaactgagagcaagtctatagagcatagttattatttcctacggaatatacgctccattgtggatcagtacgcgcggcgcaccaccatcactagtacatatccctgcaatgatcccggcaagcgccatgcaggctatattaacgacgcattacagtacgtacccagatggcctgttctatttacaaaattacatcctgccgaggtcggccttgttgtctaa

SEQ ID NO: 16832 - DNA, 228 bp, A.fumigatus
atttatatcaatgctcctgtttgtctgtcctctagaggggccgtgtgtgtaaaattgccccccatgtctagtatactttttaagaattcaccactgctcgctaagaggaggaacaagagcaatattaacaatattaataatgtctcggtcgtcgactggaggtcggttcagctttcttatgatgcccttatccccttgatttcgttcaaattcatccgtcgtcaacca

SEQ ID NO: 16833 - DNA, 261 bp, A.fumigatus
ggcagcagaaacataaatatcgccgtcttccttccctgtccatcagttccccgcctttgtatacctccactacacctctctcttatatttctcgttaagtcacttacagcaatgccgtgctggagttcattggcgttggaggtgcatatgaccttctatcacggtgagctaaatctcacctaccagcacccaggtatcccagagacggttattgtctgctatatacagtacgctttcttcacccaagctgtatatttatag

SEQ ID NO: 16834 - DNA, 1422 bp, A.fumigatus
tgcagcgaactggacaattcgacggtgagcacctaccgtaactttgcagcgtccgagtatggccagctttcgatgttggcgacattgaacaccgtcaccagtgtcgttgccgctgtcagcaaaccgccgatttccaaactctcagacgttctaggaagagccgaaacgtacatcatcacgattacctgctatgtactctcgtatgtgctatgtgcttcagctaggtccctcgatacctacgccggcgggtgtgtcctttacgcccttggccagtctggaacttcgatactaaacgcgattgtcatctctgatatctcttctatgcggtggagagggtttgtctacaatataatataccttccattcctcgtcaccccctgggtctcagcattcatcgttgaaaatgtcgtcaatggcattggatggcgctggggaatcggcatgtttgccattttgatgccatcttgcgccagtatcataatcatcagtttgcttgtctttcaacatcgtgcaaagaagaccagttctgttgtctaccatcgtccgagcgtgcatggtttctgctcgggaatcgacttaggaggtattgcgatcctgacttgcggattctcctcgctgttgattcctacaaccttagcggccacaacaacaagtcgatggaagacgccatggatcgatgcccttattgtcttgggtgctgtcttgctagcttgcctctatccttacgagaaatacatagctgggaatccggtattcccggtacgctacttccacacgctgtctgtgctcgtgccagtggcacttgcttgcattgacaatatagggttcggcacaacccacacctacctttatgcctggtcaatggtctcacataacttttcccctcgaaatgcccagtttctatcctggacaagtggcgtcatacaggcgctcgctgggatgtgtatcggtctgcttatgtaccgcctgcgaaggtacaaatggatcgctgtagccggtgctatcgttcggctgattggttatgggctgatgattcgccttcgtacaaacacaagctctttggcggaactcttcatcacccaactgatacaggggctaggaagcggggtcatcgagacagtagcgatagttgcagcccaggtctccgtaccgcattcggagctcgctcaggtgacgtcactggttatgctgggcgcattcgtgggtaatgcggttggatctgccatcgctggcgggatctatactgggaaactccgcgagcgactgcaggtacgcttaggtagtgccattggcgaggccaggctggatcagttgtataattccatcacgggaactttacccatgtggggaacatggcagcgagtggcagtaaatcaagcagtaagtattacacgtcttttgctgctttatatcacctgctga

SEQ ID NO: 16835 - DNA, 498 bp, A.fumigatus
  unsure (484): Identity of nucleotide sequences at the above locations are unknown.
cgtggtgaagatacctctcagaacctaaaaaaacgcgaccgacaccaactgagcgactttatcaaacagttacaatatacattatacgatgcgatttctcatcttggtaatgcagatgtttccattgtaacagcaaccaccattcgcactatccatactctcctgcatgaagccatatcaggcccatctcacgtttatgagagaacaactaacacaattagatatgttattaagtctttgcaaaaacagaacatcaggttactgagcgacaagtcacgccaggatagcaccctaagggtggtgtctatccttgtggcacagcaagacgcagccagtaatatactgcttgccactagtatgaagcaggatagtactaggatgaatgcgattgctgctctaacaatggtttctccccaagacatttacagcagtgagtatcagacaatccggtttctcccctccctgcggaactgtcacgacttanggagcctttgctga

SEQ ID NO: 16836 - DNA, 789 bp, A.fumigatus
ggtgcccatggactatcatcgggagaacggccggggccgccagatggctattgccattgtgcgcttaccagcaaagatcccggtgacggactcccggtatggtggtgcagttttaatcaatcccggtattctcaaccttccctttccctatcatatcaggctctgatgaacgcagggggccctggtggttccggagtcgaacaggctctgttgtttggtcgggacatgcagacgattattgatggggaaactgatcctgcattgccgacgggtcctgcgaacttgtcagctcgatactttgatatcatcggctttgatccacgtggcgttaacaacacaactcccgggttcagctgtttcccagattcattttcgcagaggaactgggagctccaggtggaggcggatggcatgctgggtagctctgacgattccctcatgcgcaattggcagcgtgccgttgctcttggaggtgcttgctccaaggcactacagtacgcgccggagggaactgatgaagctcttggagatcatctcaatacaccgccagtcgcaagggatatgctcgaaatcattgagcgacacggtgaatggcgcgaaaggcaaggtcagactgaacaaaggatgtacgatcgcatgtacggctatgaccagcaacagagcatcgtggcacgaaccaagtggaagagagggcatgaaaagctcctgtactggggccgttcgtacggaactgtgctcggaagcacttttgcaacgatgtttcctgatcgggtcgagcgtcttttattg

SEQ ID NO: 16837 - DNA, 201 bp, A.fumigatus
tttctgacaggccaagcaggccaaatcgaaaatttacctaaaaacgatacggaaatcaacagtatgcgcgttatcacaaacaagcagccagtcagtgaggaggaatccagaatgctaattcgttcatggaaacgcaatttcaacctgaatggatattatatttggttccagtgggacagagtgatctcttcgccagcctga

SEQ ID NO: 16838 - DNA, 321 bp, A.fumigatus
tcgtctctgatcaggtacataatggaggatcgacagcgccactgttgggaatgtctccggcggtctttggtctgtgactttatccggccccaatgtaagcggtgctctacctccgggatcgtttgccctggatacgaagataaggcgcctttcaggttaaagtggcttcctcctggaagggtaaagtttcggaatcgaaaacaggtgaagcatcagaaaatgaacagggcgagggtcgcagcagagcactccgtcgttccgcgcttcgacaccatctatgatgccccagtcttggcccaggcagccgaatactgcaagtga

SEQ ID NO: 16839 - DNA, 747 bp, A.fumigatus
ctgaaagcctggccctatagtccgctcctcgagctcgccaactaccacgtgctcggccgtctgttctactacgtcccaaacctcgcaccccttccccccggcaaagtcctggccattttcggcgccctaatggcactcgtggaggcactgaatgctctgggggtagccctcaacgctaacccaactggcagccagcaaggattgggaaaagctttgatcctcgtttccctcgcccttcaactgtgcgtggttctcgcgttcgttttaacagcggcctctttccagtggcgatgcgccaaaagccaatattcgttcgcaggttccctggccacccttttgttcacggtcgacatcagcatggggttaatcctggtccgttgcatctaccgcctaattgaacatgtcgacaacacgtcggtggacctcgtgattccagagggacttagatccctgagcccgcttttgcgatacgagtggttcttctatgtctgggaggcgtcactcatgctcctcaactctttcttatggaatgtgttcaatccgggccgatatctgcccagataccccacggtttatttggcagcggatggcacgacggaaatcgaagaggaggaagtccgcaatgaccagcattttctggttaaatctgcgtatgcggccgtcaatgcgctgacatttgggctgtttcgcctcttcgtccgccagaaggatgaagagaaccatccgctaacagagcgaactaaatag

SEQ ID NO: 16840 - DNA, 474 bp, A.fumigatus
agaccaccatgttcctcgtcacgcctgagaagctggagctgctgcaacaagacgtcatcgccgaccccgccaccaacggcatcactccatccatcagcgacatcgtgcaagccttcttctggcgcgccgccatcaaggcacgataccgcgtcgccacggagatccgcaagcagaagttcagcccggacgccgtctccatcctcgagctccccaccgacacccggccgcattttttgtcccgcttcccaccaacctacatgggcagcatgctcatcttcaaccgcaccagcatgcccatcgagaccttttgctccgccgagaccagcatcgccaaagtcgcgctgctcctccgccaatccgccgcgcgcatcaccccgtcgctcgtgcacgacgccttctcactcctgcagtccctccccggccaccgccggttctccaccgccaacatgggcctcgagcacatgcacgccatga

SEQ ID NO: 16841 - DNA, 2775 bp, A.fumigatus
ggtgccgggattattatgaatattctgatgcccgccctttttaacctgcactgcgtcttcggaccagcgggagtcctgcccaatatcaatctggtggacgctctcgcagtgagcactagaatcgatatctggagcatggtaccgtcccttgtcgatgagttgggagaaactcccgcagtattgtccaagctcaaatcgtccaagttcatctgtgcctctggcggtcccgtcagtcccgtcagcgctggcaaggtcaacgaggtaatacgagtcctgaacttgactgggacaaccgagggtctgtttatgggtaacctcataccaccaagagaggattggttctggttttgcttccatccgtattccggctttgagttcaagcaagtcgagccggacacatacgagcactgggtgcatcgcaacgagcactggcccctgttccagggcatcttccacactttccccgagaagcagtcgattaacttcaaggacctgtacgtgagacaccccaccaagcccaatctgtgggccttcaaggggagaagcgacgatctcgttgtactgtcgaatgggtacaagatatcgcctctgcagacggaagccttcatcacgacccatcccgccatcaaaggatgccttgttttcggaactgggaagccccaggcaggtctactgattgagctgaaagacccgttgcagaagaccgacgagctcctcgacagcatttgggaaacagtccaacaggccaactccatgtctcggcacaaaaaccagctgctgagggactttgtggcttttgcaacgccagacaagccattttgccgcaccgacaagggcacagtgaaacgatccgccacactgaagctttatgccgactacattgagcgtttctaccgctcacgcaacgacgatctcggcggcactttcgacttcgacatgagctcggcccactcaatcgaggacaatgtccgcaagatcctcgccgcttcgctccctgatgtccaggaggcctctgcagacacggacctgtttgcgcttgggcttgactcgctcggtgtctttgcggccatcaagaccatccgggcagctacggggctaggtgaccagattggccctcggcatatctacgccaatccaaccatagcccgcctttctgcgattatcgcacttctggcgagtgccagcgacactaccttatgtgaaagaccagtggacgatgtcggggcccagatcgcgcggatgattgcccagcacaaggcgcggcaatcgttcagcttgaacgcgttcgactatgtcaacccgaaccacggcatgggcttggtcttgtacttcccaatacgcgacggggtcagttacgagcaagtatttgcgaacctgcaggccggtctcaaccgcacgtttgatctgattcccgccctcagcggcaagatgacggactgctcggagcaagggatcggctacaccaaaggagacctctgcgtcaccattcccccccttgccaaggccgattcggcacgcaatcgtctggtctacaaggacctctctgctgttcttccgtcattcgacgacttgcgcaaaggaggcttcgcgccgtccgccttcagcgacactcttgtcttacgggacgatcctttcccccagatgcccgccgatatcttcgtaggacaggccaattttgtttccggggggtgtattcttgccgtcgaccttaaccattgctgcctcgacggtctcggcgccatggtcgctctcaaggcctgggccgagaactgcagatatttgcagggcgatcagtcggcaacctgcggctggtatgaccccgagagcttcaaccacagcttgccggaaattctccatcggcaggaaggctgggcccggccgcttcatgagatcgaccctggtacatggggcttcctgccattctttcccccggaggatgaggagacgaaccccagatgcgagaaggcaacggaaggatctcttcctgcccgacctatcttccctctccatcccgtctggccgctgccgcgcgccgagcgatgcctaaagaccaccatgttcctcgtcacgcctgagaagctggagctgctgcaacaagacgtcatcgccgaccccgccaccaacggcatcactccatccatcagcgacatcgtgcaagccttcttctggcgcgccgccatcaaggcacgataccgcgtcgccacggagatccgcaagcagaagttcagcccggacgccgtctccatcctcgagctccccaccgacacccggccgcattttttgtcccgcttcccaccaacctacatgggcagcatgctcatcttcaaccgcaccagcatgcccatcgagaccttttgctccgccgagaccagcatcgccaaagtcgcgctgctcctccgccaatccgccgcgcgcatcaccccgtcgctcgtgcacgacgccttctcactcctgcagtccctccccggccaccgccggttctccaccgccaacatgggcctcgagcacatgcacgccatgatctccaatatgctgctcttcccgaccagcgagatcggctttggagacgccttcttcgcgaacgggggcgtgccggagacaatgcggccgcagctggagcgcggcaacgggcggtttcgattcttggctgtcttccctctgaggaaggatggaggggtggagctggtcctgggcacgcaccgggaggagttggagatgctcgtgacggacgaggagtttacgaggtatgcgcgtatggtcgatacctgctgttga

SEQ ID NO: 16842 - DNA, 405 bp, A.fumigatus
ggaagacgcccttttctccacctgttcgtgcggattgatcccaaggataccgtcgcagcggatttgctcgatcctgccacggtcacggggctagggatagctgggacaatgggttacgtgcccgatggacgagtcctggggctgtcgaagctcgcccggattgccgaggtctactcgcgccggctccaggtccaagagcgattgacgcaggagattgccgatgccatcaaccgcgtcctggctccgacgggggtggtggttctgatcgaatcgacgcacctgtgcatgtccatgcgaggcgttcagaaatcgggggccaccaccatcacctcgtgtatgaccggtgtcctggagcatgatccaaagcttcgaaaccacgcggagttcctcctgagaatcagatag

SEQ ID NO: 16843 - DNA, 1314 bp, A.fumigatus
atctcctttacattcatccttccactctttccatctctgcttacgttctatcgttctcaagacccctctcccacctctctcctaaaccaggtcttccactatctcaacgcgtataagaattcattcgcaaagccgatcgactcgcgatatgatatagtgctccttggaggagcgctaggatcgctcttttctcttctacaagccattgctgcccctttcatcggccgactatccgacagatatggacgacggacggcactgctctgctccatggtcgggaacactctgagtgtcgcactatgggtcgccgcgacggattttcgtaccttcttggccagccgaattgttggtggtctaagcgagggcaatgtgcagctggcgcatgcaattgctacggatatcagtgacgaaagtaaacggggctcgaccatggcgctggtgggtgcctgctttagcattgcgttcacctgcgggccggctcttggagccgccttgtcgaatatcaccacagtggccgcaaatccgttcgcgaccgctgcaggggtctcgcttgtccttattgtcaccgagacactgtacctgtatcgctgtctgccggaaacacacccccgattgactaagctcagtcttggtcctcacagagctgaggacaccgcctccccaacgcaaaagaatggcaagcaagctgacgcctcgaaccccgactcgaccatgcctcgcaaacgcacgaataatcccgcactcctcaacctgcttcactttctcttccttcttcctttctccgggctggaattctctcttcccttccttaccgcaactttttacgcgggaagcactgcatctccatccgccctgaacggtcgtcttctttccttgatgggactcatcgcctctttgctccaagggaccgtcgtgcgacgtctaccaccactcatgacccttcgcgccggggtggtagcttgcaccatctctttcttcctcctggctcgagtctcttcgctcgtcgggctctactcggccggtgctctgttggctgtgaccagtgctacggttgtgaccggcctgaatagtctcggtagccttgaagcgcgggaaggagagcgcggccttgtgctgggtcgactgcgaagctggggccaggtaggccgagctgcgggccccctgctcttctgctcgcttttctggtgggtcggacgcgaaattgcctacaccactggtgggttcgcaatgttggcggtctgtgtgggcgtgtttacgatgttgaggtcgcctcctatcgaatctgtggcgatggccggcaaggtgaaggcctag

SEQ ID NO: 16844 - DNA, 657 bp, A.fumigatus
tatttccaggatccttgcatttacgattccgaaggtgtcctcctcatcttgcagcactggcgtactcatggccaggctcgctgggttccgttactcgatacgaaacagcttgacagattggcaggcgggcgaaaagaggaaacttactggcctgtgccagtcgcacaagagaaatttcactgcattatcttgaaaggaggagatagatatccttactttcctcgcccactgctcagtgagttcgacttcaggatcccgatatccgacaggccgcaaaaagcatccgacgacgagggcgatgaatctcgcaacgacgcttcagcacggtttgaggagtcttttgtccggggcaacgttctcctctccctgttccaggatctcctgtcctccaccaacgcgacgcctagtcaacgggtcgagctggccaggaaagagatcgaactggataagatccttctgcagatgctcgcagttgagtgccgagaaggcgaggagcgaggcatgaaggccttggagttagttcgtatgatgaaggatcgcaatggaaagatgattgaagccgcagcgaagattgcggaacgatatgggcgaggcgtgctggaagacaagatccgggatctggccgaacgggcgatacatggagacaggcgacgatga

SEQ ID NO: 16845 - DNA, 753 bp, A.fumigatus
cggtgccctttcgcagcgctacgcactctctctcctctactaccgactctactcatcaatcctttacctccgagcatactttcgccgaacatcacacttcacttatttccctcgacgcatccgcacctccccacagtgaaaggtcgcacattgtatcgagccgcgctctggaccgtccctgtggcgtggagcagcttgccgctagtcggtaacgtgaagttgctgatcctcagcgagcggatcgttcgtgcaggcacggtcttagatccggacggatgcagcgagagcgaaagcggagatgagcggctagtcgtccgatggaggacagagcccaggagagagggtcataaaggtggctctgccggtgctgcgagcaagtccaacaaggccttgtcgtcatcgtcatcgtcggaaaagctcagccatacttctgcgaagaatggcgtcaacaagggtctcagtgtgcttctgggcggggatgcacccatcttcaaactgtcgaatgaggagcagtttactgggctgttcattttctcctttgacgaagaaggccggatttcttcgcatacgatcgagcatgctgacgacgcgggcggatgggatcggactgccaagtttgtcacgttgactgactggctgattgggaaggcgcgaggttctctcgaccctccgcctgggctggcgatccagggctgtcagacctgtagctttccctcgcctcgcacgcatcgtggctctgaccgatcaacatag

SEQ ID NO: 16846 - DNA, 222 bp, A.fumigatus
tgcctcgaagctacaataaagagtcgaaacgactgctgttggcgagatgaatgccattcatttcatctgctgtacaaaccaatctacgccaagattgacccattctcccacagaccagccatgtccttgcgacgccgtcatagcaacctccctatcaccatcaccatctccccccactccatggcccaaatccggcatgctgggcctcgaggggaattgtaa

SEQ ID NO: 16847 - DNA, 195 bp, A.fumigatus
ggggtaaaacaccaacgggagaacttgaccaaggagatgtacatcagctactcattcccagtcttcgtcactgtcatcgtccttagctgccgtcgttgggctcttctccttggggctgccaggcgcacgactggtgttgccactgacaagatcatagctcgattcactgtctggctgagactgttggtcgtttga

SEQ ID NO: 16848 - DNA, 417 bp, A.fumigatus
tataagattgatgcctctgatgacaaattggtttcggattgtaaaagcccaggctcatcttccaagccaggatgtgatataggcggagggagatcttcggagtcactgagaggtgatctgtctccgtcctcgtcgtctcgatcctcaaatagcatcacattcggctcttcattcggaccagacactattggttcatcatcactgaagtctgtttcggcgtccgtctcatatacaactgtcctctccgtactcggtggaggtttgtcaggatgcggtttcttatccaactcgggcgcggaatcggatggtccctttgctggatccgactgtgtttcttcaacagggaaatttgtttccttatcaacacccagctcggacggcgattcaaagtcgggcatcatgatctgcggcaattga

SEQ ID NO: 16849 - DNA, 243 bp, A.fumigatus
gatgaaggtatttcggatttcaatggtttccgtggcgtcctcgggctttcttttaagactttcttttccagggtcgaagtcctaggcaagatctctttcgcatcctcctctgcctccagcttcctcttcttgctcgagcttaaggactcttgggcggtggctaccacagtgggggcggacttgagcgcacgaggcagttttccttcgtatccctggctatcactcttcttcggagtgatatag

SEQ ID NO: 16850 - DNA, 246 bp, A.fumigatus
cttctcctgggactcagtttgccttctttcgtcttcaagataatccaggacctcttcaaccgcctcctggcactcgctggcaacaacaatcccttgaaaaacagcagttccatgtcgccctttgaagtcaaagcctgtaactgcgtctgcataatcaataccaaggaccctggctgcatgggcggcctgaggatgctttatgtgaacacctccaggaggaaccatactcggcacatagacatctag

SEQ ID NO: 16851 - DNA, 1983 bp, A.fumigatus
atacttcgatttgcaatgagacaaggtgacagaccaagtacaaacgcaaaatctgcccaggaacaatttcgaacaccgaacaagcctcctatatcaagcgcttccaccacctccagggcacgaaaggggacggcaacatcgaaaaagcaaagtggaactccaacatcctcagccacagcggctaagccttggaaaggcagtttgctctccggagatcaacctacacttacacagattgactttgtgacgccgaggacacagaacgccgaatccgatgatgatgacgatcttgattacatcgataaagccgctcaagataatgaaccggatagtcgcgaggtgatcgagatagacgacagttccgatgacgatgctagttatcaacaaacttcatatatacgggcacggcgtaccggagatgccgaacgaaaacccaatgctgcgcgcaatgcatcgaggaggatgaggagtacaggtcaagctggttccgctgaaaagccacctggacggaagagcatcgaaggtgtcaagggcagcaagaagaagacaaagaagcagcaaaaggacaagacactcactcagatggattacgtacggcgttacctgaagatcgagcctgatgaagccaagctggagtacacctatatcactccgaagaagagtgatagccagggatacgaaggaaaactgcctcgtgcgctcaagtccgcccccactgtggtagccaccgcccaagagtccttaagctcgagcaagaagaggaagctggaggcagaggaggatgcgaaagagatcttgcctaggacttcgaccctggaaaagaaagtcttaaaagaaagcccgaggacgccacggaaaccattgaaatccgaaataccttcatctcagtcacccgaaagtcctggagttgcgataatttcatcatcacagtttcgaaacgctactcgatcacctcccaaccttgatttttcgaccaagcccacctctaccatcaaagaagaatctcctgatttaaaccagacaaatgcaattgccgcacaagtatcaatatctgaagatcaattgccgcagatcatgatgcccgactttgaatcgccgtccgagctgggtgttgataaggaaacaaatttccctgttgaagaaacacagtcggatccagcaaagggaccatccgattccgcgcccgagttggataagaaaccgcatcctgacaaacctccaccgagtacggagaggacagttgtatatgagacggacgccgaaacagacttcagtgatgatgaaccaatagtgtctggtccgaatgaagagccgaatgtgatgctatttgaggatcgagacgacgaggacggagacagatcacctctcagtgactccgaagatctccctccgcctatatcacatcctggcttggaagatgagcctgggcttttacaatccgaaaccaatttgtcatcagaggcatcaatcttatatcaaagacggcagcctgccactcagttcccactagaacccatacctacgctgagcacccagaagctggcggagcttttcccacgtgaatccagcactcagcaaaccacgaccgagccatcgtgtaccaagtcatccgctcacaaggttcaggcattatctgatccctcctttcagacgcagactcaaagccaaactcaagaccaggacaaatattcaacggagatgattcccgaatcctcgcccatcacatggcacgcgggttacgcgagtacaggtaatgctacactccctcaaaaccgtgctcagagcgtggtgcaggtagagtcttcacaaagagtggaccgcctaaaagggcgggttgatccagatgaagattcttgtcctaggggaattctgtcccgcagccaacttctcacctcgagtgttatggagagtgttcccttaccgggtttctggataggcagccaggacagtgtcggagaaccctacagcttaacagatccatag

SEQ ID NO: 16852 - DNA, 315 bp, A.fumigatus
caagatatcatggcaggcgccaacgtagatgaagaggaagaggttgcttgggatgacgactccgacgacgacaccgactctccctctactcctcaggttaagaccaataataccacccagattcccacggtcgacaagaataagctgctcaagcctgatgaaccccggcgttcaaacgaccaacagtctcagccagacagtgaatcgagctatgatcttgtcagtggcaacaccagtcgtgcgcctggcagccccaaggagaagagcccaacgacggcagctaaggacgatgacagtgacgaagactgggaatga

SEQ ID NO: 16853 - DNA, 1026 bp, A.fumigatus
ttgcgatatcaactcgccaagaaaaccatggatatcgcatacgatcatattccagaggagatcttctcctctaatgagtcgtcgaaaaaaaaagcttcacaagacgactccaaaaccatccgctccatcgtcgacctcaacaccgaactgcaagagacattccgcgccttttccgcgagcccctggggtataaagattggtgggctgtgggataatgtccgcaaacaaggcgagagttactatgaaggagctaggcaagagtatgctgcggccagcgaggagtccgccaagggcctttcggacttgaaagagactatcgtaggacgcacacgaggcctgtcgctaagtacagctttcacttctgcgccatccgcgagaagtaaggatgagacgccgactcctactgcgtctcgagcaggagaaagtcaggaagaagggaccagcgacgcgggcgcaagcgagggtttcctgacccgaatcaaagcagaggctgcgagacgactgaaggagattgagaaggctgaggaagctgcggatgaagcgatcctgcgctttggtatgaccattggccaaaagctgcgggaggcggtcagcattgtgccgccggacgcggagtcgtcaaatatgatcctttttgagagtaaggatgccgaggggaagagagtgattcatgcgacgcgatttgaggcgcagctgcatgtgatccattccaaccttgagagcttcaccaaggacccagtcagtgacaaatgggccgcgttcaaggaggagtttaatgtagacaacaagaccgacgccattgccgtagatttggagaagtaccccgagctgcgatcagccatggagaagcttgtccctgagcaggtcggctatgcaaccttctggtctcggtactatttcctccgcctcgtgattgagaccgaagagcagaagcgcaaggagcttcttaaaggtttgttactggtcagcccaccttgcctctttaccggaaaatctgacaagatatcatggcaggcgccaacgtag

SEQ ID NO: 16854 - DNA, 1464 bp, A.fumigatus
ttcttggaggacagagatgagattgaaattagcgagctgacagcgagaactgctgatgagcatatgccgcgaaatgtgcaagactttaaagatcacccgatatacgcgattgagaggcaacttcgacgtaacgaagtcgttttcccaaagcgcgtcattggccaagtcagtcttggaaagtcgggatcgaaagatcaggtgttggtgcctgtttaccgccgtagcgatgttcatgttgtccgcagcgcggacaaatggtatcgcttgggacgagacatcaagataggcgaacagccattgaaacgtattcgcgtcaatagaaacaaggatgccggtttcagcgaagacgagcacgacaatgaaagcggcatggagattcctctgtatgcatactttcaaacggaggtctacacaccaccgcctgttgtgcagggaaaggtacctaaaaattcttatgggaacctagatgtctatgtgccgagtatggttcctcctggaggtgttcacataaagcatcctcaggccgcccatgcagccagggtccttggtattgattatgcagacgcagttacaggctttgacttcaaagggcgacatggaactgctgtttttcaagggattgttgttgccagcgagtgccaggaggcggttgaagaggtcctggattatcttgaagacgaaagaaggcaaactgagtcccaggagaagtcaagagagactttacggttgtggaagcattttctgctgaaactgcgaattgcagaaagggtcaaaagctacaccattgaaggagaagagagcgctgatgaaattcttgaaaaatatgaggacccaggggaagccggtggcggctttatccccaaaccagagcaagaaatggctgacggaggacaatttgcgacttgtcaacgatcaatgcaattagagggtcgaggacacacttatcatatagtgtcgacaaataacggaggcccaggaattggagcgcacggtgatggacttcaatctgacgagagcgccagccacatagaagcaatatctgtgaatccttctgaaacccacattcctaaggcctcaagacgtcctcgttatagccttatcgtcgttcccaataagaaagcaaacaataatgaagacggcacttcccagcggcaaccacaaccgcagtccgaaccaactcctgagattgtggagcttgagccagcggcagaagctcagagtgtgcagaggtctggggagactggtcatctaggctcttccgaaattcccataatggtcgactcttcaacaacaggcggctccaggtcagcgagtgttgaggtactgtcgcggacagcatcgcaaacacagccacaaactcccacaccagaggaaatggacgagtcatcaggagttgatgacaatgggtcattgttgtcgcatgatcccgaagatgaggatgcgattccagagtggctagtatga

SEQ ID NO: 16855 - DNA, 456 bp, A.fumigatus
cctgttggtttttcttgctggtatgtctcacaccggcctggatatcgcgatcaacccatcgcgcgagacgaacaagagtccaatgctgatcgcaaccgcgtgcaggtcccccaactcattgagaactactgtaatggcaatgctgaagccatctcgctcctctttctcttcgtctggttcattggcgatatcaccaacctgatcggaggcgcttgggccggtctcgtacccgtcattgtggccattgcggtctatttctgtattgcggatggtgtgctcatcgcgcagtgtctatactacaaaagccgccatgctcgtcgcgagagtctgcgtcgtcgtcggcgctcctccaccgtcacccctgatccgacaacccctttgctcggcccgtcgattcagcgataccctggaacggggtccggcttcgcgacgccgatctataacgtcgcagcgtag

SEQ ID NO: 16856 - DNA, 1134 bp, A.fumigatus
catagagtctcatcgtcctccgcaactcgatcctggatgtcctcccgagcgattcgcaagctgcagaagcttcgcgaacaagaattgcaacaagcccacctacaagcggagcaagataacgatgagtctgacgagtacgagccggtaatccggccctcaaggccgaagctgaatgcctttgatctcctcaatactggtgacgatggggatgaggaacacgagtctgaccacgatatcgaagagacggtgactcacctggcggaagatgtccctgcccgcgtgaaatccgcggattctagtaagaagaagaaaaagaagaacaagaagaagaaggcggcagtggcaaaggttacggccacaggaggagctccttgtgcccagtcagatgacgagctggacgagatcgatcgagctctgaaggaactagctgttgaatccaagggtaccgacagtcaaaaagctgcagctgttccccccgagaatgtccgcggcgcatcgttccccaggacaccagaggagctgctctctattgagcctaaattcctcaacgccatgaatgagatgcggagattgttcgggaacgtcgtgttggagagtttcgacgaagaaactgggacaggtcgcaggagagacaggaatagggaaatggttgatatgggtcgcgctttgactggtaggtatagtcctgccagtaaaggtctaagtttagcagggactacccagcggcggaatgttctcatgcaggggaaagacgagtggccgcgcgctcccagtggtggattggggatggagctggtagaaaagctgcccagtggagctacgaaataccagattgtccacaactctgcgtatacagacgtgcaaagacaatttgatatgtgcgtcgagtccatggatccacaacgaatgatccacctcttgcaatataacccgtaccacatctctactctccttcaagtgtccgagatagcaaaacatcagggtgatcatgccgtttccgccgatctcctcgagcgagccctgttcaatatcgggcgctcagctcactcgtcgttcggcaatcgcttaaaggaaagtcaggcaaaactcgactttgtccacatggcaaatcgtgagctgtggcttgtgggttga

SEQ ID NO: 16857 - DNA, 1128 bp, A.fumigatus
  unsure (36),(40),(95): Identity of nucleotide sequences at the above locations are unknown.
aggtatattgcgatttgggaaatgaaaggaacgtgnaganccgcatatgaatgggccaagctactgttgagcctgaatgatgacgacccatatgncatcaggcttttgatcgaccatctggcgctacggggcagagaatacgcgcacttcgtcgatttgtgcgcacaaactagactgagtgaggactgggcgccgttgcccaatatccaatgctcactcgcactggcatatcttcggttgaataaaccaaaggaatgccgccagcagctgcgccgtgccatgtcgagatatccgtgggtattctgtaagcttgcgcaggagttggatattcaacccatgcccaagcgcatatggggcaagatgcctccaacagacgcccacgagttgcttactgagctctacattgccagagccaaggacctctggaacactcctgaagtggtctccctgattgtggaaatcgccgacactcttccagaggaagaagagcccatcgaacctccggaaattactctggacattgcacgccatgttgtcctctctgatattccccgcgtgacaacacatttgcccggacgatttgtttcggggcgaatctcagcctctgatcctctcccgccttacgactctgaggctcatcggcagcaatcggacccaacgccgtcctacttggcgcagatgccagaagtaggccgaccacaatggcttcgcgatctgctcgaccagctgaacaacggagcgcttcattttcctcgattccgcgggggcgacaatgaagagatccgcgatgatgatttatccgattacgatcagggagaagctggtggcgagcgccgacgtcctgtggccgaccagggagcatcactggagcagtggcttctgggagatggtatgcagagcctgcaagccttcttgaatcagtacggagttgatcgtggtaactggggtgatgtggtcgattactctcccttaacggagtatctcgacggtctcgatgccgtgcagccggacgaggcacgacaagagttacttcatgggcgaatcagagaggtcatgggtgatatggttgttgatatgctcgagaatgaacttgagcttcagcagtatgacgacgaggacgaagtctga

SEQ ID NO: 16858 - DNA, 504 bp, A.fumigatus
tgcgcggacccttccagccccgcggtgaagaccgaacaacgacacctgccactctcggcaggtgtcgttgttcgccgtctctcgcggcgctctgaaaggatcggcttctgcaggttggaaacaaattctgatgtttcatctatgaccaagccaggctcttcagcctcttcattctctgcgtccattggcgtctgcgattcctctctgagttgtcgtgcgatatcctcgggtcgcactttctgccgctttttgaaagcggctcttctctggcgtgtaagagaggcttgtagatcgtcatcatcgacaaaggatacgttctcactgctctcccattttcgaggagctgacgcgggcacgccgttgctggcatcgacttccatagccccattctgcgccgactcagttgtagaaaatatatcatcttcgtcaaccggtctctgtctggttgccttgaccttctttttcttcggctttttgattttgatctcgctcacatccatgtaa

SEQ ID NO: 16859 - DNA, 876 bp, A.fumigatus
gtggcttatccatacagatcagacaaatttccaatgatttctgaagctcacgaacatactcaagcaactgtgactcttttgaacgaggctccttcacaagagttacgcaacaacacagatatctcgtcgttctcaggcgacttccctatctgtaccgatcttaatggtccaatagctcctttttgtctacctaaggatggagcagacgttacagccgacgcgacgtactatgtcacatggaatgcagacttctaccctctgaacgcgacgatcacaatcgaattgagatacgcgaattcctctcagggagactcggcattcacgtctgaaaagactgataacagttacggttatatttcgcttcctatgcagaaggaatggctccaaggaaagccatacaatgctctgaccctttatatcatcgagctggatcctacgtcgggcagccgagctagtgcccggcaaggcccaactgtcatactccatcctaaaccagttgaacactacaagccttcccctcggacaccatttaacaggacggctcttcttatcggacttcctgtcagccttggtgttgtcattgctgctgttgcgggtctagcttttggcatgcgtaaaagcaggaagaccgggctgagagacgtcgtgagtgcccgaggaagaagctacggaattggaaaatccaagaacaaacgtcttgggaccaaaagggagattaatgggccagattcttttgcagccttgaataaatacagagaggactctggtgaaggcttctccgaatttgagggttcagagaagtctcacggactcgagcgcagcgggagctttgcgtgtagacaagaggtatcaaggctgaagacatggagcggttaa

SEQ ID NO: 16860 - DNA, 450 bp, A.fumigatus
aagatgcgagtacaccgagaccttattgctaattatctcacttcgaaggaatctcttctcctgttctccacagaccctaactcccctaatcttggttatctgaactgcgaatcggaccagcttctgtgttccacatggtctgcaggcgctccctccgtttggtactttgaggttccccaagctcaacttggcgagagtcaagctgcgacacctctccacgtcgtttatctaaactcgacaactgtgacatcccaggacatctacaagattcattccgagaagacctacaagaaggagcccgcttacgaaggtgccctccacccaacggatggctggctagcccagaacaaccttcttgttcccctgggctatatcatccacggtttcagcgttatccccagttggctctttatgatcttcatcagctttgctagccgatctctgatgtaa

SEQ ID NO: 16861 - DNA, 324 bp, A.fumigatus
cacgatacgcttaacataggcaaaatcgccgcccagtgctcgcatgcaacgctcgcctgctacaagtacctcattgcgcataacccgcagtcacctatcctgcggaggtgggaacaacaggggcaagcaaagatcgccttgcagacaaagtcggaggaggaattacagttgctgcatgcacaggcgatgagcctgggtctctgcgctcgagtgatccaggatgctggacggacacagatcgctagcggaagcaggacggtgcttggagttttggggccaaagagtgtggtggatcaagtgacagggcatctgaagctattgtaa

SEQ ID NO: 16862 - DNA, 1368 bp, A.fumigatus
tacaggttgatttgtaattcgcccaacatggcggacgctctctctattgagcagaataacaaaatacgagtcgcccttgggctcaaacccctgcccgtccctggtgctgacgccacctccggtcgggtgtttaaagaaacaagagagggctctgcgtccgaagaagacgcaggaagcaccctcgagtcgcggcaagcgcttgcctcggagaattggaagaaacttcaagaggaggccgaagcgaagcggagacgagaggctaaaaatgccgcgatcaagaaggcccgtgatgctgctcagcgcgctcggattctagaaggccctacgctaggagagtctggtgatgcggatatggacacgaagacctggttgctgcaggcgaagaagcgacagaagaagatcgaaaaggaacgtgccctcaaactcgcccaagaactagaggaacgtgaacgtgctgcggaatactccacagcggatctggctgggctaaaagttgggcatgaaattggcgaattcgaagcaggagaagaacacgttcttacactcaaagatacgactatagatgagaacgaggaggagggtgatgagctggaggacgtcaatctgagggaaaaggagaaggtggcggaaaggctggagttgaaaaagcggaagcctgtctacgatcccaccgaagaaaataccggcatactcgcgcaatatgacgaagagattgaaggcaagaagcggaaacgcttcacgcttgatgctcaagggtctacagtcgaagaacgagaggctaagcgacaagaggtatcggacagactcaagcagaatcttgtcagcctcgaccttggcgcaattgagacaaccccagtttctgattacatggatgtgagcgagatcaaaatcaaaaagccgaagaaaaagaaggtcaaggcaaccagacagagaccggttgacgaagatgatatattttctacaactgagtcggcgcagaatggggctatggaagtcgatgccagcaacggcgtgcccgcgtcagctcctcgaaaatgggagagcagtgagaacgtatcctttgtcgatgatgacgatctacaagcctctcttacacgccagagaagagccgctttcaaaaagcggcagaaagtgcgacccgaggatatcgcacgacaactcagagaggaatcgcagacgccaatggacgcagagaatgaagaggctgaagagcctggcttggtcatagatgaaacatcagaatttgtttccaacctgcagaagccgatcctttcagagcgccgcgagagacggcgaacaacgacacctgccgagagtggcaggtgtcgttgttcggtcttcaccgcggggctggaagggtccgcgcac

SEQ ID NO: 16863 - DNA, 474 bp, A.fumigatus
ctgactcgcgtcatgactgctagctccatcatgcgattcattcaagctctcgttatcctcccagcccttgctgcagcgcaaaatcaggttccccttgcggatcgagttcagggatggttcaacaaggccaagtcttacctgccaaccgcgactcctgtcgttcctacggttgagaaggtcgtcgaacagaaggtccaacagaaggctgtcacagtcacccctttcaacatgagcaactggcagtctctcttggagccatcttccgagccccaagactggctgctgtacattactggtggtaacaagacatgtttcggtcgttgcggaaacgcggacaaagctttcaatgtaaggactcagatgggtagtagaagatgcgagtacaccgagaccttattgctaattatctcacttcgaaggaatctcttctcctgttctccacagaccctaactcccctaatcttggttatctga

SEQ ID NO: 16864 - DNA, 477 bp, A.fumigatus
ctgattgacaagcagctgtggcggctacccgagctcagatcggatcttagtctaccactaggacaggctagaacactgatggaaaatacccaaacagcttctcccacccttgcacttccaaaaataacaaagatggccgagttagatcgggtccctccttccaccacagcatacgtgatagctacagctattctcgctggcatcactggttacttcattggacagggagcctcattgggactattttcctgggccaaagagaaggaaggctggcccaacagctacaatgtgaagatccctcagcattcctccgacgaagagggcgaaaactacgaaggtgatagcgaggaggaaggcgatggtggcgagctagccaattttgacgccagcaacgaggaagtgaagcttgtgctggttgtgaggacggatctgggcatgaccaagggtaaaatgattcccttgtgcttccccgcctaa

SEQ ID NO: 16865 - DNA, 198 bp, A.fumigatus
catctctccaaccagtctgctcagaagcttcccatggtttacagccccgaacatggaacttgcatccactaccatatgcaaccctcctattggaacggattgaaattaatctccgaccaggcagtagccggcaaaattattaccgtaactagccgttttattccacgtcaagatcacagcatcggcggtctgggatag

SEQ ID NO: 16866 - DNA, 297 bp, A.fumigatus
atagtcatttgttggctgcggatccatcagtgcccatactctgaggccatgacgcgcaccacttctgttgaagatgtcaaatttgagatccccacgtgggacaactcgaatgttgatgtcgctgacggcagcggccgaccagaatccagtaccagcggcgacacaatacgtccaaaaggtcgcatacgacgatcaatgacggcttgtaatacttgtcgcaagctgaagacccggtgcgatttagatccacgcggtcatgcttgccgccgctgtctctccttgaggttcgtaccatag

SEQ ID NO: 16867 - DNA, 441 bp, A.fumigatus
acatgctttcctcgcaggatagagtgcaagctgcctgagacagctgagcgctttcaagataatgcttcaatgtggtcggatgccacagcagctattccgtccattgaagagcgcctcatctcgctggaacgaagtatgacagaaatgaccagcatgatgcgacggatgatggaccggtcacccagtatatctggcagctcggtatccatgctgacaaggagtggtatcactgatgagaccgcttcgatcgaagggagtcaatcgtcctccttcgctcctagacctatccgtctccttcaggacctgcagtccgacttcacgggtgaggcaaatgtcctacctgcggattcaaggtcactcggtgaacttttcaccaagggaattatcgaccctaaattatctcagaaattaattcagttgtatgcaacctttctcgtctga

SEQ ID NO: 16868 - DNA, 1434 bp, A.fumigatus
acttatactgagacattctctttgattacgcactttttatttttttcatctcgcgcacctgataacactaaaccgtgttccttaacaggtgaaagcgagtcacgtcccagggccattgaactagaagatacagaggatatgagatcccagggtaatatgtctgatcgcctgggcgttgaagtcgactgccactcactcggctccaacgaatgtccgtctatgggctccagcttctcgcctttggaatcgcccacacctacccctacgagcatctacagtcaaggttcacttgcttccccaagctggccagaaaacgggtcatacccgggccacgcttacgacagaggtaccggatcgacacccatacgcggccacttccgtctcgccagtatgccctcgcacgagaacatgggtctgccaccatacagcagcctggatgggcaggatcgcatggcggttacagacttcctgccttcgtatgacgagaacgcggatcagttctggctcccctcggatgttcccaagacctacgatcaccatgtccatggactgccatgcccgccgtccatgcaccaatatccgccaatgcttcgcagcaactaccgccaccaccccgctccgtatttccctgaatcggccaccaacccgtgcctgtcgcgccctatcttccatcatcaacccgagcgcctgccaccatcgttatccatgagccatatgatgccctggatgggccatacggagtcgattgcaccggagaccattgctccgtcccaagttgcaccggtaacccctcctccttcctacacggatttctccaactctatcaacaccttcaagacgcactcgccggacacccccatccgctcgtgctctctaggcactgtctctggagcggacacacctttgagccgtctctctggcggcgctggtgagtacatagatgaatgccaccagtcgcctatctaccgagatgcgtcaggcgttcgtctgcagcggcagccatcccgcaagatggcgcggaagcagccttccaagcagagcttgtcactagagaacctgccatccatcatcaagcaggtgcagttcaagtgcaaagaacctggctgcaagggtcgcttcaagcgacaggaacacctcaagcgccacatgaagagccactccaaggaaaagcctcatgtctgctgggttcctggctgccatcgagccttttcacgcagtgacaacctcaatgcccattacaccaagacccacagcaaacgcggaggccgcaaccgctatgtggccaccttggatgagacgagtcccgactacaacccggactatcgggggccacttactgctgacggtcgccccatgcccggtgggacgctggacgagtccatgccttcccgcgagatttttcaccacggggtccgaagcatccgcgcatgcgta

SEQ ID NO: 16869 - DNA, 189 bp, A.fumigatus
agacgtaggcctctatctagcttctttataaagagtactagtgctgctactaggctagataattccctaatccaccccttcttaagtattttattaaggtatttacacagagcctccagctctagctgtaatatagtaaataaggggctatatagtaacaacttcccattaagtagctatatcttataa

SEQ ID NO: 16870 - DNA, 201 bp, A.fumigatus
cctacctataggttaataatcccacccttctatattaaggtctcttctagtttaataggtatggcttctagtggattctattaccccctagcttcctttattaaatatttaacttcttattatctatctaggagttattactacagctcttttacttcctctatagcattactagatctagtaataaagtatttaagatag

SEQ ID NO: 16871 - DNA, 684 bp, A.fumigatus
cacggtctgcttcaggtcttgattcagcatcgtgcctcagacgagagtttgcggttcgtcgaagaagtattctcgtcgttcggttcaaaatatgtttacctcacaggcgagatgcatgaccggatcactgcagatacccaagcggttacacatgcagcttttttaagcatgggaacggcttggcaagcaaacaatcagttcccctgggaaatgtcgcgctgggttggcggaattgaaaacgtcaagatcaacattacattgcgcatctactctaacaaatggcatgtctatgctggcctagccatcctcaaccccgctgcaaaagaacagatccgcacctacgcccaatccgtgacggagctgtataagctgatgatcggtggacagcgagaggagctgaaacgtcgagtcaaggcggccggcgcggctgtcttcaaggacggtactgaggggcaggaattgctactcaaagatgaggttctagatcgcttctccctctcgaaccggcctcgggagtatcacccgccgaacaatcacctgagtcttcttgcaattgttgattgttggtcgaaattgggcatcgtcccttatgatcatatgatctgctcgacacctgtgagtgacgctaataccgcagctgcattgcttacatcgttacatgttgagttgctaattgctctatga

SEQ ID NO: 16872 - DNA, 1194 bp, A.fumigatus
gtgatacgcactctaccacttgcgactagatggagacctatggcgtccggatataattcaggtttctccggaacgtcgatccagcaccgtgacctgggtgatggacggtcgtatgccagccaggaagatggatccgcaaatggcagctgggccgagaccgcgtcaagacctgggaggaatggtcgctcacagtctggaaacagtgcaaatatccgccctcggggaggctctggaggctctctagcgccttccatcgggggtcctggtagcttcagctcagagcttaagagcatgactacgtcgcggagtgtgacaccccgaccagatggtgcctacagacgacgaggaagcagcaatgttgagttggacgaattgtcgagcaccgaggagcgccaggctgcgattcgcgacaagattgccaaagagatgaagatcaaaacgggaaccgagaacatgcttgaggcacttctagccaaggacccgaaacataccaaagatcagcggctgagggtggaatccgaactgagttcgtccaatcgcaagcttgcggaactacaccatgagctcgaggaggaattactacgtgcgcaggcgccgtcaactcctccgcggaatcgcttttcgatgtccttttttcggggtagtcccaggcggtcgccctcccggaacaacgatctcacacttgacgatgatcgattggaagaagccgaggcggagatggagtcgcctacttacgtccttggggaaacattacaggcgcttgagatcgaagggatggcgccagattactatgtcgaacgtgccaacagtctggtcgaactctttagacgtcacccaaccctaaaatacgaccttgcatggtccgttttcggcttgcgcgttcaagtcatgctcttaagtgacagcaaagaagtcgtagcggctggctaccgcttgactcgatatgccatagctgatagaaagtcacttcaaatcatccggtccctgcacactgatgagctggtgatactatctctagtcaaggagagcaaagctagcattgagcgcgaacaggcattgaagttcgtccgagcttttctagatgtgaaagacggcgtacacgaaatctcgcgagctgttgtgcgaacaatcgtctccatacctggaactcctgaagaccgccttcgaaacctttcaaccatgactcttcgctga

SEQ ID NO: 16873 - DNA, 459 bp, A.fumigatus
tatcctgccagggtccccccgaacctctccttcgaggtggacgattttgagtctgactgggaatactccaagccattcgatttcatccacgcccgcgacctgcaaggatcggtgtccgactacaatcgcctcgtcgcgcaagccttcgcgaacctggcgcccggtggatggtttgaattcgcagatgccgacttgcttgtctgctgcgacgacgagaccatcaaagaggcaaagaacatgctggaggtgaaccggctggtctgcgacgcaagcgcaaggttcggcaagctgatgggaacggccaaacagcacaagcagcgccttgaggatgcgggacttgtcaatgtccgcgaggagatttacaaggtgggcagcagtgactatagttgtagtttcaaagtggttactaaccggagacacagatcccattctcaccctgggcaaaggaccccaagctga

SEQ ID NO: 16874 - DNA, 405 bp, A.fumigatus
agatccgcggtcatcttcaaagggagcgagtcggcgctgacgcgggaccggccactgaaggcgaagacgggggagtcggtgcgcatcttctttgggaatgcggggcctaatctgacgagctcgttccatgtcatcgggagccatttccagcacgtctttcgggatggaggggtggttgacccgccagcgagggtgttgtcgacggtgggtgtgccaccgggcggtgcggcaatcgtcgatctgaagatgatcgtcccggggacgtatacacttgtcgaccatgcgatattccgcatggataagggggctgttgggtatctgaatgtggcgggggctcctcgtccggacatcctctatagtcagatgccgccggagccttgtgtggggtgcaagctgcatccgtag

SEQ ID NO: 16875 - DNA, 501 bp, A.fumigatus
cccctgcgcggatccttggcgcctccgtggatgaagaccaggctcggccccaaccaccacaaaattcccgttaatcaatgcccaatgactttcaacccaactcttcgtgacggtacgggcacttttgacgccaactatggatctttgcctggctacgtgtccgaatcgcagggcgtgaattttgcacgtccccaggagcacgacccccagttcaacgcatgggtgtcgcagctctcatccaggccctggatgcagaccaacgagaacgactataagtttccgcgggacttttacaacgcgctgcctgagttccggagccaggagtttcaagataaaatggtggaaaatatcattgcgtcggtggcccaaactcgcaaggagattcgcgagaaagtctaccacaccttccatctggttgatccggagctgtctgcacgggtgaagcgaggggtggagaagatggatgcgtctttcaaacaagtctctctttccaggctctga

SEQ ID NO: 16876 - DNA, 441 bp, A.fumigatus
ctgcggtcactagtactcatgagaagatacgcaatggatgacttgacccttgctgatggcaacaaaatccctaaagggactgtcctgggaataccaatcttcgggatgcgagatccaaagatatacgttgacccggacatgtatgatggatatcgatttcaaaagatgcgtgacaagcctggatttgaaaacaagtgccagcttgtctctacgagcccatggcatctcggatttggccatggtattcatgcatgccctggtcgatttcttgcagccgttcaagtcaagatcatcctctgctatattgtcgcaaaatatgatttcaaactggcaggtggcgcgcctcccaaggtacaatctgtcgggatagagttgatatcggataccgaggcaaggctcgccgtgagaagaaggcaagagatggtgattggattggagtaa

SEQ ID NO: 16877 - DNA, 228 bp, A.fumigatus
ctgagtcaatataactccgttcctttagtcaactatgctagttttgtaaatatcatcctctctacagaattcttcgcgcaattattgccgaacgaagctatcgggtcgacgggtaaagtctcacaagcttactgccccttgcactctgatgtctcatcagcagtaggggagaaatgtgtgaaagtcttacaaatatggcagaatccctacaacgcaactcatgtctga

SEQ ID NO: 16878 - DNA, 699 bp, A.fumigatus
ctgatgagatcagaatggcacgaggtgacggcaaaatcctctgtccatgatatcattgcccacctatcggccttgcttttctatgggccagaactgtgcagccataaagaatggctggaagttacggatgagtatgcatccgtcgggtttctagcggctcgacagctccgtctttggcctcccatattacggcccatcgcccagtggtttctcccagcttgtcggcgactgcggtatctagcaagcagaactcgtggcctcatcgagcctgtcattgccgctcgacagaaagagaaggctatatgttattcgcatgggcgtcaaccgcctgtttacgatgacgcgatagaatggacggagcgagctgccaaagggcgcccctacgacgccgctatgagtcctctacttttctcgatcaatgcgcttcacacgaccactgacctgttaactcaagtcattctcgatctcagtacgcagccggacctgattgttgccctgcgtcaagaaattctctcagtcaaacctcaacagaatgggtggaagaacgccagcctaaaccaacttctgctcatggatagtgctatcaaggaaagccaacgactgaaaccaaccgagtcaagtatgcatgtcgtgatctataacttctccttttcccttccgaataccgtattgaggtaccacactaactgcggtcactag

SEQ ID NO: 16879 - DNA, 924 bp, A.fumigatus
gtcatatccgaaccacacatggcccggcagctagtacttcagagagatggaggaatacggccttactcgatcagtcatatcgtccactccctgatttcattccgccggtcgaaacctcgacccgtgctccgcttccaggccaatttcctggcggatggactcatgctctgtatgggttacaatcactctgtgtttgacggtactggagctggtaatatcctcgaaatgctggctgactgttgccgtgccaatccaaatagcattctcgctctacccaccaatggcgacatcgagtccgaactgcgcgggctgttgtccagtcctggtgttgctgttgcaaatgcgtcccaggaagcgtatgccatcaactgtgcacacacggaggtagaacccgaaccttcctccgctatgctgtactgttggcccttcctgttgtcttccgagaagattgaatgcctgcaagaagcatgtaacagccttttaccacatattgtacgcttgtacagtgggacccaaagttctttgatcaaccaggacacaaactggccacatattctctctagcaacgacgtgttgaccgcgttgcttgccgtaagtattgagaaagccagggaagcgacaggggccctgggacatatgagcagaagccttgcgatggctgtgaatctccgagaacgattaaagccgatgccgaggcattatcttggaaatttagtgaccactgtatgggtgtctcatcatcgacctgcggtgaaggacctggagacgatggttttacctgtcccagcctgtaatcgtcatgaaattgacagagatgatctgctttggattacccacgttgcgttccgtatccgtcttggactgaacgccatcaacgaagagcatattcgcggggctcattcattatctgcacagtcaggatga

SEQ ID NO: 16880 - DNA, 375 bp, A.fumigatus
acgcagatcggaaagacttcatcccttgtcatgaccctctgtggtgtactgaaagatatccttcttgtcgctgcatcgatgatgatctggcagactcctgttacccctctccaattcttcggttactcgattgctctgatcggcctggtctactacaagcttggtggtgataagattagggagtacgctggccaggccaaccggtcctgggctgagtacggtgccaaccaccccgctcagcgcaaatctatcatcatcggtgccgttgttctcatcttcttcctgctgatcggctccatggcgcccagctacgctcccgagtctgtggacaaggtcaagggcatgcttggcggcgcaactgctgggaatgcgtaa

SEQ ID NO: 16881 - DNA, 285 bp, A.fumigatus
tctcactcgttagacctctgtttctatttttcttcttctttcacagcttcacccctggcctccgcgcgctttggtcagagcagccttctacggccgcgccctttcgattttaagcaattcctatccgaccagagtcaactcttcacaatgagtaacgaaggagaaaaagccagagtctccggcgaggtctctcgcccagagcccaccctgcccaccgtcaatcccgccgttgagaagtcggagccctccaagcctacattccaccctgccgtctatgtgaggtga

SEQ ID NO: 16882 - DNA, 291 bp, A.fumigatus
cacttcccagctatcatcctgacaacatggcacttggcattcgcgactttcatgactcaggttctcgcccgcacaacaactctgctcgatggccgcaagactgtgaagatgactggaagggtctacctgcgcgctattgtaccgattggccttttcttctccctgagtttgatctgcggtaatgtgacatacctgtacctgagtgttgcctttatccagatgctgaaggtgtgtttctgctctgatcaacttgccattttgctggcgataattgctgatgacggtacatag

SEQ ID NO: 16883 - DNA, 417 bp, A.fumigatus
gcaacaactccggtcgctgtgttgctcgctacctgggctatgggaatggcccccgtcaacctgaaagtcctcttcaacgtcgctgttattgtcatcggtgtcgtcattgcctcgtttggtgagatcaagttcgtcttcatcggtttcctgttccagattggcggtattgttttcgaagccacccgtttggtcatggttcagcgccttctcagctctgctgaattcaagatggaccctctcgtttccctgtactacttcgctcctgtttgcgctgtgatgaatggtgtcactgccttgttcgttgaagtgcctaatctgactatgggccacatctacaacgttggtgtctggaccttgctggccaacgctgttgttgctttcctgctcaacgtttccgtcgttttcctggtaagatag

SEQ ID NO: 16884 - DNA, 1245 bp, A.fumigatus
cttgaattttatagctcacttaacaggacagaacgcaacagtttcggatttcggattcaccctcttaaccaccttcgcaagtctctagccatgtgcccaatgctcctcagtggtcttgcggatggacccgccatggtcctatcccctcgccaggaacacgcttttgttcagttccctcgccagtcgcagctcgactcggcctctgccgcgtctcacaattcattcttcaggaatggcgtgcactctcaggcctccaacaatgtcttttccgcacccaagctggccaacacggccgccagttcttccagaatttcgcgcaagagatcgcgagatgaagccgagtctgaggaagcactcagtgcttcgagcgcgcctgcagtggccgcgccagcgcccaaggaggagcctatctatggggagggtatgacacttatcaatcctcgcaccggcatgtcgctttctgcagagagccagacaggcacttggtacgaagaacagctcgaaaacgctgctgccacagcggctcctgtctcgtcgcggtccctggccagttcgtccgaacttcacagccgcaagtcgcaacgccttgacccatccgcctcccgtgtcgacgacatcacgctcgcccacattcaacgaagacttcacaagacaaccgccgaagacaaccaccgcctccttaacgccggagcccgcaccaaccccttaaccccgaacgaaccccaggttgacgacgcaacccacctcctcggaatcagctggcaacgaatctctaccgacgacgtcgacatggcggccgccgtgcgtggctggaaaaagtacattgacaagcaattcgccgcgtaccttctggactcgcagatcctcatgaaaaaccgcgcgctcaacgcgtacctggttacagcgcgaccaatcactcctgccggacccgccattgccccagccttctatctcttcagcgaagacctcagccaggctcagcttgtggcctcctcctgggaacaatgcgtgcacaatctccgctcggttcccgtaatctttgagcaaaaccaagtactcagcgctgcagacagacaatgcaataacaacagcagcggcccaggcgttttaggcctggacacgaccacggaaccgggcctcccgctcctgcaaatgatgtgcgcccagccagtcggcagcgacatgcgcgcggcgggactgcacaatagcgatggcatgtcttcacacgagtgccagatccgcatc

SEQ ID NO: 16885 - DNA, 273 bp, A.fumigatus
ccgactacgaaaaggctctccatgaggtcgaagccaccgaagaatccctcctggccacactctccttccccaatgacacccccaagcgaggctccgtctacacagccctcgttatcccccccgccacagcagaaaacccatcccccgtacctgttggtatggccctgttcttctacaactactcgacatggcgatcggctccgggaatctaccttgaggacctttacgtgcagcccagcgcccgaggcaagggatatgggttcaagcttttga

SEQ ID NO: 16886 - DNA, 480 bp, A.fumigatus
caggggctacaggttggcttttactttgccttcttgcagtcgtattttcggttcttgatgttccctgcggcattcgggttttcgtgttggctgctattgggctcattctccatcatctacaccgtggtcaattgtctctggtgcatcgtctttattgaatattggaagcgtcaggaggaggacctcagctgtcggtggcagaccaagggcgtgtctgcggttcacgaaaagagagcagagttcaaacccgagaaggaaattcgtgatgaaagtaccggcgaggttcgaggagtcttccccgctacaaagcggatgcatcgacagctcctccaagtcccattcgcattgcttgcagccgtcgccctaggtgccatcattgccacctgctttgcgattgagatttttatttccgaggtctacaacggtccgctcaaggggtatctggtaagtgtcgctccaagcattttgcaaaattcatag

SEQ ID NO: 16887 - DNA, 504 bp, A.fumigatus
ttaatgatccaggtgtttatccctaccatcttggtatcggcgcttataccgacaatgagtgcggtattgctgactgttgcgaccaaattgaatgactacgagaactacgagactcaggatgcctacaaggtggcattgacacaaaaaatctttgtggtcaactttatcacctcatacctccctatcatcttgacagctttcgtctatgtaccattcgccagtcgtatcgtgccttatctcgatgtattccaccttactgttcggccgttcgtgtccaaagagcatgcaaccaaggcacgaaccgaattcagcattaatccggatcggctacgaaagcaggtcatctactttaccgttactgcccagattgtcggttttgcgcttgaaaccatcgttccgtttgtcaagcaacgggtattccgcgaatataaggaatacaccaagaaacaacatgcaaaagccgagccaggttttctccacaggggccggacatccgcatattga

SEQ ID NO: 16888 - DNA, 1728 bp, A.fumigatus
acaaaaaaagttggaaaaaaaaggggccaccattttgaccgtctgagctccaagcttaaaggagaggagggcctcaaaggagaaatcgaatccttacgcgacgatttacttcaccttggtcaagatcatgttgaagcaaaggacaagatcaaggaactgaatgtagaaaagaaggcgctagaggagacggtctccaagttggaaaaggaattagccgatatacggacgagccatgcctccaagagcgcagactcagagaagatgcacagcgatctgaaggaggactacgagaacctcaaagtcaaactcaccaaccttgagacggagctctctgccgctcagcaactggccgctaccaggttcaaggatctgacggaattgcgggagactttgcagaaattacaaccagaattgaagagcctgcgggtagaatcttcagaactgaagtcgacgaaggaggccctggcgagcaaggagtctgaattgaggacactggaaggtaaacatgaggagttacgtgccgaagtgaagactctcaagtccacaatttccgagcgcgacgccgaggtgaagaccctcaaccaaaagatcagacaggagacagacagccgtctcaaggctgaggagaatctgaccgttgctcaatctgacttgcgatactcagaaagcaaaaagcaggaagccgttgagacaaaggagaagattgcagcagacttatcccgagcgcaagatgagcttaagaccgctcggtcccaactgcgggaggttgaaaacaaggtcactcaattgaacaaggagcttgatggtctgagggaggaaatccagctgaagaccgcacagcacgccagcgcgcaaagtctgatgaacagtatgcgcgaccagagtgccgagctagcgatgcaaatgaaggaggcccgggaacgttgtgagagcttggaagaagaattggctgatgctcatcgcttgctcagcgagcggacgcgcgagggtgaaaccatgcgacgcttgctcagcgatatcgagggccgtgccgaggccaaggtgcgcgatttcaaggagcggatggaggccgccattgaagagcgcgatcgggcagaagacgaggccagcgctcagggtcggcgccgggcccgagagctagaggagctcaaaaccaaggttcgggaagccgagaaagcactgagaacggcggaggaggacaaggaagagctcgagcgatcccaaaaggactggaagcgcagacgggatcaactcgaggaacagtcggagcgctcggcgcaggagctaaacgacatccgccaggccatggcacggttacgtgatgctttagatgaaagcgagaagcaagtccgtgatctggagaaagaaaaggccgagctgcgtcgttcagtggaagaaacgaacagccgactggagaagcttcgcagatcctaccggatcttgtcggacgaaactcgtgcagtccagaatcctcagtcttcgcgttcatcgattgactcaggagcgagaaaggcagttgcatctcccgtgtcgaaggaccgtagcccatcgacacggagaagcgaaacgccgacgggagcaccgattgactacatctacttgaagaacgtgctcctccagttcttggaacagaaggataagaactaccagaagcagctgatcccagtcttgggtatgctgcttcatttcgatcggtcagtaacctatttccttaactacccgaattga

SEQ ID NO: 16889 - DNA, 642 bp, A.fumigatus
aggactcttgatctcacaatgtccggggaagctaccatcagactggcaactcccgagggcaagttcaccccgcattcccttcaatgcttctccgcacgagtcggccatcgctgcgagaaggtctcacggcccttactgactccatgcgaaattgcagatgtcccttacatcctccaattcatccgagagctagccgactacgaaaaggctctccatgaggtcgaagccaccgaagaatccctcctggccacactctccttccccaatgacacccccaagcgaggctccgtctacacagccctcgttatcccccccgccacagcagaaaacccatcccccgtacctgttggtatggccctgttcttctacaactactcgacatggcgatcggctccgggaatctaccttgaggacctttacgtgcagcccagcgcccgaggcaagggatatgggttcaagcttttgaagtacttggctgcaaaggtgttggaggtgaagggccgccgtctagagtggagtgtcctcaagtggaatgagcccagcatcaagttttacaagcaggtaggggcccaggctatggaggagtggatgaaaatgatggttgaggggccggccctgaataagttggcggagggactgtag

SEQ ID NO: 16890 - DNA, 222 bp, A.fumigatus
tggagatggccaatatcaattacatcaccatctagcaatttggagataccctacaacagggtcaagcgatatgccaagaacaaacacagtctgattcctctatacgcatatatcatcgccacaacattgagttccaagatctttgagctgtctcaccgctcttgcaatatcagacccttggataggactgcggttgtcaagtgtacctttgttctggaatga

SEQ ID NO: 16891 - DNA, 1302 bp, A.fumigatus
  unsure (835),(1261): Identity of nucleotide sequences at the above locations are unknown.
agatttgagttggacgagccattaatcgagcaggagctagtggacccgccacagatcgtctcaggacctatacacacagatccttctactacgagtgcgagcgattcgattgcgccaacttatgacgtgccacgacgaacaacgcaattggttaaaataaagacttgctctgggaagacacacacagtcactcagagaacttataagccccgagtttcatacgagaggctagtggcaagtcgctcgactacgggactaggacgagcgcagaaaagctactatggcattaatatccatcaaatattggatgaggttgcaagagaaactgaacaggctaaagcttccacaaaagcactggaccgcacgatacagcattctgttgaggctccccttgagggccaaaggaataagaaaatggcagcggcgatgtggacagagaaataccgcgctcggaagttcactgagcttattggagacgagcgcatccatcgatctgttttgcgatggttgaagggctgggagccgatcgtcttccctaatcttgccaagtcgagaatcaaaaagccgggcaacaacaacgatgacggcgagcggctgcaccgtaaggttctactgttgtgtggtcctccagggctcggaaagacgacattggcacacgtgtgcgccaaacaagcgggatacgaggtactagagatcaacgccagtgatgaccgcagcaaagacgttgtcaaggggcggattcgagatgcccttggcactgaaaatgtgaaaggagtgaatgtggaggtgggagatcgcaaagtgcgaaaggctgggcgaccagtgtgcgtcgtanttgacgaagtcgatggagtcgttagcgggtctgggagcggtggaaaaggaagcttcatgaaggccttgattgacctcgttctactcgatcagaagaacatggcacgatcagccgatcagaatgccaagaacgggaaaaaacgtaaaggcgacactttccggttcttgcgcccactgatcttggtttgcaacgacgtgtatcaccctagcttacggcccctgaagacctcctctgaagttgaaatcattcatgtccgccaagcaccttttgaaaatgttgtctcacgcttgaagagcatcttagcgctggagggcattccatcagacaccaacggtgtgcggcggttatgcgaggcatcatggggtctggcgaggaagaaaagtggttggctcaaaagcagtgggaacggccgaaaggtgatatcgnaagtgtgctggtcgctgcggagtgggtggcgcataagctga

SEQ ID NO: 16892 - DNA, 183 bp, A.fumigatus
tttcgaggtcatgtccatgataccctcaatcatctggtctacggaagcactcagagaattctagttcgcaagtctgtatgcatctgctcctactccgaagacagtagagccttgttttttgatgctactattcgcttgctgaaccatttgattgctagtaatttgatcggcctccctcggtag

SEQ ID NO: 16893 - DNA, 711 bp, A.fumigatus
tatagccctgagttgtctttctgttcttcttgcgcaaactacaagatgtctttgaagcctatcgtcctttggagccacgttatgggcccgaatcctctgaaggttgttttcattctggaacaactgggtattccatacgagcagaaatatctcgcaacggaccaggtaaagaaagagccattcgtgaacattaatccgaatggccgcgttccagcgatcgaagaccccaatacgggaatcacgttatgggaatcgggtgccatactcgaatacctggtcgaaacgtacgacaagcagaataccatcagctttcctaccggctctccagagtatttccaagctaagcagtggctccatttccaaatgtccggccaggggccatactttggtcaagcagtgtggttcaccatttaccatccggaaaaggtggacagcgcgaaggagcgatactacaacgaaatccgacgtgtctgcggcgtcctaaataagtacctccaaaaccgcgagtacttggtcggggataaattcagctatgtcgatgccgcattcgttccttggttccggattattccagcaatcaccggggacgctatcgagcttgggaaggactttccaaacctcgacgcatggctgaagagacttcatgccctgcctgctatttccaaggctttcaaaatccaagaggcagccaaagccgcacaggaaaagtaa

SEQ ID NO: 16894 - DNA, 339 bp, A.fumigatus
agaccaccacaaaccgaacaaaacatcctccgaacaccagtcttcaaaattctctctgaacaccaagtcaaaatcacatcaaagacttctctaagccaccaatcatcactcaaagtcaacatgcctttcagaaccaccatgtcctccaacacctcctccagcgacgctgcctctacacgctccgtctcctccaaagcatcgaccctagagggcatccaaaacatgcacaagaagttcctcgtgacgaagcaaaaggcctacattaacgccaactcttccccatgcttcgctgctgctgagcacaacgccgccgtcgccagctatcttgctctgcggtga

SEQ ID NO: 16895 - DNA, 270 bp, A.fumigatus
atccaatggcctatgagaaacttgttcagtttggccgcacaacagaaacacatcgcgaacaagaagtgcttacggttccatacgataagcccagcccccatgcccgccaccttcactctcaattcgaactttttcaaataccacccccaagcctgtcatgactcgaactgcggcctgaacaagtgcccgttcactgtctttgcgaacactggccacactcttctgctccccactcccacgcaccacaactggtctcacatcaggcgatag

SEQ ID NO: 16896 - DNA, 228 bp, A.fumigatus
  unsure (81): Identity of nucleotide sequences at the above locations are unknown.
aacgaggtcaatcaaggccttcatgaagcttccttttccaccgctcccagacccgctaacgactccatcgacttcgtcaantacgacgcacactggtcgcccagcctttcgcactttgcgatctcccacctccacattcactcctttcacattttcagtgccaagggcatctcgaatccgccccttgacaacgtctttgctgcggtcatcactggcgttgatctctag

SEQ ID NO: 16897 - DNA, 687 bp, A.fumigatus
  unsure (663),(664),(665),(667),(670),(671): Identity of nucleotide sequences at the above locations are unknown.
gccagttcgactgcccttacgctgcccttactcgcttcaactgccgcacgtccccgatattatcctcggccacgcagcaagatgaattctttcaactcctggatcaaggcactgtcacatactagccggtcatgccagggccgagtgatctcccaacacgtgatgcatccattttctaccaccatgagccccagctcaagcgcaaaagaaaagacccgcgaaattgagagacaaattctgaatcccaattcagaacagaccactgacgataattcgccgctctctgctattactagaatgatgcagggagaaaaagctcgcgctagccaggccgtcagtcgggactactcccgcatggccgagagtttggaagcagagatgattaaatacccatatgccgatcgttctcctcctcaccatcttcacgtttacgcccacaaacacaatactctcctgacgctgacgcagccgaacgggaacccaatgctgtcgatgagctgcggacacctcggttttcggaaaggaggccgttctggatatgacccagcttatcagttgacgtcccacgtgtttggtcaaattcaggaaagaggttttctcatggacattaaacgacttgaaattgtgtcttcaccgggggtgcaagggcgctcagtggtcacnnnangcnngtccaagggtctccaa

SEQ ID NO: 16898 - DNA, 1002 bp, A.fumigatus
gctcccaccgagtctcagaagcgcctggcgcttgcaattattgactttttgaactccagcctgaaggatggcaccctgactgcggatgacgctgaatccattgagatcgctcagtcgtgtattgcagacactttcaaggtcgacccctccgatgaggccgccgtcaaagacgctcttggcggacagtctctggcgagcatcttcagcgtctacgagaagctccgtcagaagccttcgaaagaacccgccagtgctggcgcgcaggctcagagcacagaggcacagcaacccaaggctggtgcccccacacccgagtctgacaagttgaaatcggagggaaatgctgccatggcccgcaaggaatacagtaaggcgatcgatctttacacccaggccctgtccattgcccccgcgaaccctatttatctctcaaaccgagccgctgcctactctgcctcaggtcaacatgagaaagctgcggaggatgcggaactcgccactgttgtcgatcccaagtactccaaggcctggagtcgtctcggcctcgcgcggttcgatatggcagactataagggagcaaaggaagcgtacgaaaagggtattgaggcggaagggaatggaggaagcgatgcgatgaaaagaggtctggaaaccaccaagcggaagatcgaagaggccaaccgtggtgccgagcctcctgccgacgatgtcgacgatgccgctggagcatcgcgcggtgctggtggaatgcctgatctctcttctctcgctagcatgcttggtggcagaggtggcggcggtggtggtatgcccgaccttagctctatcatgagcaaccccatgttcgcgagcatggcccagaacttgatgagcaacccagacatgctgaacaacctcatgaacaaccctcaattgaggcagatggcggagaacttcggcaggggtggcggaatgcctgacatgtctagcttgatgagcgacccaagccttgcggagatgtaa

SEQ ID NO: 16899 - DNA, 879 bp, A.fumigatus
agcatgatctcggctagcaaaatgtcggctgtcgcacgggcggccactctacggtcccatgttcccggcctgaggacgacatacagcaatgccatcgcttcttcgcggactctgattcataaaagtgcttattcgacctccatccctacctcgcctacagtattacagcgccaacaaacgtccttcccgacaggcgttcaacttatttctccgtatactgctttgccattgacgcggtcattccatattgccactgcccgttggcaacaacagcaaaaagagaagcatagtgaagaaccaaaaagtgaaaagagcgaagaggcgaagagtgaagggggcaaggaagaaggacagaaggaggcgcctccaccaccgccgcctcacggagacaagactccatggcaggttttcagagagactctccaagcagagttcaaggcatcaaaggaatggaatgagtctactaaggctctcgcatcgtctgctcaagagttcgccgagaacgagaatatcaagcgcgctcgtgccgcttatgaagccgcttcgggtgcagcaacttcgaagacgtcggctgcgttgaaaaaaaccggtcaggccatcggaaaaggagctgcatggacatgggaaacccctgttgttaagggtatcaggaagggtgtcagcgccactggtgccggacttgaaaaggccacaagacccgtacgtgagacggaggcctacaagaacgtaaaggaagccatcgacgacggaagtagctcccgctatggtggctggattgagaaggaggagcgccgtagacagcggcaattgcgtgagcagaaggaaatgatgaagagcgggcgccgttcgaccgagccgctggttgaagatccaaagtaa

SEQ ID NO: 16900 - DNA, 522 bp, A.fumigatus
atagagactcggcggaaccggcgctcatgttttagctgtgatagtagcttcggcttgttgatccatttcttcaatatcttttctattccttttttttattattactacctgagtacctttgtcctctccacagatttcatggacctggtttaccagtctttcctggccttcatggtctttgctgaggcgatcgccgtcagcaaaggctcggcggatggattgttactcatagcgaggacgcctttgatcctggcatgcctgcataatggccaatatcctttttttttccctatcactatgggcgtatacggcgttgaattatatgatctgcgacaaacaactccactccgaacattttcatgtattggcatctggaatcatacccagccttctagccggttctgctgctttttggtacgagctacctggacatatattttgaacatcgacactacaatgcactggtggcttcttggtatgctctgtcagggtaaacctctatctaatcaggggcaaatataa

SEQ ID NO: 16901 - DNA, 780 bp, A.fumigatus
agagcgggcgccgttcgaccgagccgctggttgaagatccaaagtaagtgctgctttcacatggagctttttcttttcagaactctgacaattgcctggcgcagtgctggtaccaatctcactattcacaaggactctgcttggaaagagtcgtggcgcgaattcaaggagtcaaatcctatgatgcagaaactctttgctctgaaggagacatacaatgaatctgagaaccctctcatcagtacggcacgcagcatctcggatcgtgtcgccagcttcttcgccgaaaatgagactgcccaggtcatcaagaagttccgggagatggaccccaatttccagatggagtcgttcctgagggagatgcgcgaatatattctgccagaagtactggatgcgtacgtcaaaggcgatattgagacactcaagctttggctctctgatgcgcaattccatgtttacgctgctctttccaaacaatacaccactgcgggactcaagtcggatggccgcatcctcgatatccgaggtgttgacgtttctcacgcccgtatgctggagccaggcgagatccccgtcttcgttgtgacctgccgtacacaagaggtacatgtttaccgcaacgttaagacgggtgaactcgcagctggtatggaagacaaggtgcagctggttacctatgctattggtctcacgagaatacccgaggacgtcaacaatcccgagaccagaggatggaggttgattgaactgcagaaggctgcccgtgattacatctaa

SEQ ID NO: 16902 - DNA, 327 bp, A.fumigatus
  unsure (15): Identity of nucleotide sequences at the above locations are unknown.
atcggacaagagcgntacagagcccccgagatcctattcgagcccgagctcatcggcttggaataccctggtgttcatcagattgtccaagacgcgattacccgcacagatctcgatcttcgcaagtctctatatctcaacatcgtcctctcagggggctcaacgctgtgcaagaacttcccagatagactaatgcgcgagatcaagagattggccgtggaggacatgaagattcgcatctctgctccggcagaacggaaatacaccacctggatcggcggtggtatcctcgctgggctcagcacattccgaaaagtacgtctttaa

SEQ ID NO: 16903 - DNA, 255 bp, A.fumigatus
gtaaaggaagaaagtggtggtttggttatcagtcaacgcaaggtatggaacatctttatttggccgttaaatagcactggcttcttcttgatatctgacattgaatgtttgttaggttctggcattttctcgagtgttacggatgggattcccttcatcgttgtgcccaatccttctcttcaggacaaccatcaagaggaactagcgcgccagttacagaaacaaggatacgtggttgctagtcactatcagtag

SEQ ID NO: 16904 - DNA, 933 bp, A.fumigatus
  unsure (867),(908): Identity of nucleotide sequences at the above locations are unknown.
aatctttctcagccaccggtcttacgagtcacaaccagcaagaatcggccggagggccattgtcaccacaattcgtgccgcgtttcccctaccgacttcctccccaaacacaacccttctcctcacagaatggccgaggcaacgcttcacaacgcccccattgtcatcgacaatggcagcggcacaatccgcgccggtttcgccggagaagagatcccctcatgtttcttcccctcgttcgtcgggcgaccaaaacacccccgggtgatggccggcggtctacagggcgacgtgtttatcgggcaacgagcacaggaattgcgcgggctgctcaagatccgataccccctggaacacggaattgtgacggactgggatgacatggagaaaatctggcactacgtgtacgagaacgagctgaagacgctaccggaggaacatcccgtgctcctgacggagcccccgctcaacccgcgcaagaaccgcgatatcgctgcccagatcatgttcgagacgtttaatgtgccggcgctgtatacgtctatccaggcggtgctgtcgctgtacgcgtccgggcgcacgacgggcgtggtgctggactcaggggacggggtgtcccacgcggtacctgtgtttgagggtttcgcgattcccaatagtatacggcggattgatgttgcggggcgagatgttacggagcaattgcagctgctactacggaagaacgggcatgtgctgcatacgagcgcggagaaggaggtggtgcggatgatcaaggagaaggtctgctacgtgtctttggatccgaagcgggaagagaaggactggatgaacagttatcacaagtcggagaccaaagctgtcgantacgtattgcgtgatgggcacaagatcaaggtcagcctttntactttcatggggagaccaagctaa

SEQ ID NO: 16905 - DNA, 276 bp, A.fumigatus
gggggggccgaagcgcgataccttccagccgcggggcgtgaagacgggctggcctcctcgggctccttgatcgccggcatcaactatgcgaatcaggtccgcgagaatctgcacaagagcggcaatggcaccgacacgagcagccaggatacgtctatcgctagcttaggtttcggaatgattcaggtagcgatcggtatcactgtgggattattcattgcggcgctggttgtatatccgtttgggaagcgccggagtgggcttttcagtttttaa

SEQ ID NO: 16906 - DNA, 1131 bp, A.fumigatus
ccttttacggtacgcccttcttcccctgtctctcatctgtgcatccatgtctcattccctcctttcctaatagacttcctcggtgtgagtcccaatgccaaccaggacgaattgaacaaggcctaccgcaagaaatccagacttctccaccccgacaaggtcaagcgatccttcatcgccaaccgttccaaggacaagggcaaggccaaaactaccaagcagggcgtccatgtcagcaagggtccctcccagcgcgaaattgctgccgctgtcaaggaggcccatgaacgggctgctcgcttgaacaccgttgccaacatcctccgcggacccagtcgtgagcgttacgatcacttcttgaagaatggctttcccaagtggaagggcaccggttactactattctcgataccgtccgggtctaggaagcgtgcttgctgggctctttcttgttttcggtggtggtgcgcattacgccgcgctcgtcctcagttggaagcggcaacgggaattcgtcgaccggtatattcgccaagcaagaagggccgcctggggtgatgaacttggcatccgtggtattcctggcgtcgactccaccagcactgccgtccctcctccacctcccgaacaaggagaggcaactgcaatccctatgaaccggcgccagaagcgcatgatggagcgcgagaaccgcaaggaaagcaagaaaggctcaaaggcatcacctcgcggctccggcactgcaacacccaccactgagtccgtccagccgactggcgagaggaaacgggttatcgctgaaaatggcaaggtcttgatcgtcgattccgttggaaatgtcttcctcgaagaggagaccgaggacggagatcgccaggaatacctgctggacgttgatgagattcagcggccaactatccgcgacacaatgatgttccgcgtcccgatttggttgtaccagcagaccgtgggcaaactgaccggagcttcgaccacgggagagcacgaagtggacgctgaagaagaatctgcagaggccacggagcaggaggtccaggatagcagcagttctgctctcaggaccaatggcggcgcgtctagacggagagggaaacggtcacaaaggtcctaa

SEQ ID NO: 16907 - DNA, 243 bp, A.fumigatus
ggagagtcaagtctagacttctatttgattctttgttcgggccattgcggcattgaccgcttcccctctgtgcccatcatgaagcctcttactctccgcttgtttgtgtttgctgttctagtggtacttgctgctgcttggactaaagaaggtttgtcctcttattcttcccctttgtatcgccatggatttccttgggaacaaaaaaattgtcgcatcaatgctaatttgttaagattatga

SEQ ID NO: 16908 - DNA, 285 bp, A.fumigatus
ccggagcttcgaccacgggagagcacgaagtggacgctgaagaagaatctgcagaggccacggagcaggaggtccaggatagcagcagttctgctctcaggaccaatggcggcgcgtctagacggagagggaaacggtcacaaaggtcctaagtcagtctgtcctcaggatggacgcgcaattgtcaaggtcaagccttggcttatactactctttttgaagcattatcggcgagaaatcattgtatacatgtatatcaattttagacgtaaaaaaaaaaaatag

SEQ ID NO: 16909 - DNA, 1239 bp, A.fumigatus
gccaatcgagaatgctttttccgaggaggcggtctaggtggtcggccgcgagctccttacggtatgccccgatggggaagaccaccgggggcacgagtggggagatccagcgggagacaggcggctcagtggatggatattaataatgtgcggattcaggaaattgattgcggggccgaagaggaataccttctgcgacctggtcgcgctttgtatgctgctgaacaacggaggaatgggtggccgaggcgcaatgaggactacgacgcatctgctggtgatgtgcactcggtcgacggcatagacttggatctggacgacgattcggacagcacagtggcatatgcagtgcaattagcgatgaaagacgatgaagagtggctggtagacaaggccctggaacggatacggcgtgcgcagttactgggccagaagaatgtacgactttcacagcgggagttggacgccctcgaacgaaaacggatgcaaactagcggtatggaagacgtcggacagagaaacaaggttcccaaggcagcgtctgtcgccagcagacccctgaggcccgtagagagctccacaaacgggggactgggaaatctctggacaatgcggcatggatctagcgccccaaacggtagcataccgcgtacctttgtggcggacaagaaggagatgtatgaatcgagggcgcgggcctcgggagcgtcggccagggacgattctcctgtactaccacgcacgtccacagtgcctaacctgcaacctcgaatgtcggggcctccgacttactcatccgttccacgcgattctcggtcggaggttcccctcacctaccccagccctcgtccaccggcgaccttccagaaccctccatatgcacgcatccttcctcacgggccacaatgggtgccttcgtaccaggcatcgtatgctttggcaaccgtccctgcgggatctcaaagccatccgggccatatggcatacccggcaactcccgcgtctgttcttggcgatcgccatccgctgagtcgtcagcatgtgtccttgaattcgaccaggggcgatttgagcagcgcagctgacgaagaagaagacagtgaatccgacaatgacggtgataggatacacattgtggatgtggtgcgacgaaaagtgccaattggtcttcagagacggccttctgcagccggcggggccggtgccagagcagttcacccacgatctcgacgttcttga

SEQ ID NO: 16910 - DNA, 924 bp, A.fumigatus
ggaaaaccaagagtccttgatcccctcagtatcttgaatcttcagggattcagtctggtccatagcaagtcttggacggcggtgaccaaaagcgctaaggttgtaaaggctaagagccccttgtgcctgttgcagcgccggaaccaaaattacgacccaaatggggctaggctgaaggttccaatgatttttctctctccaggcttcctcatatcttccggccagatagatctgtcaactttgccttcacttaccacccctttttacgaagtacttctctgctcattgactcgattcacggctacttcttgtctcctaatccttttcaatttttcctggccgtcagttactacttcagagtttatatccatccacaaatcttcctacaaccaattcacaatgagtccaattcagttccccattgacgcgattgcctcgcgattcggtgatcgcttcaatagcgtccgcgcgcaatctcttacctcgcgtttctccaacctccgaccaatctcggagttcctcgatgtcaagcgcctctcgaagcctgccaattttggcgaggttcaaagccgtgtgaactacaacctggcctatttctcgagcaactatgccgccgtctttgtcatgctcagcatatacagcttgctgaccaatctgtcgttgcttcttgtcatcctgttggttgctggtggtctgtatggaatcggcaagctccagggccgtgatcttgacttgggctttgcacgattcaccacctctcagctgtacaccggtctgctgattgttgcggttcctctgggtctttatgcttcccccatcgccactgcgctctggctgattggagccactggcgtgactgtcttcggtcacgccgcatttatggataagccaatcgagaatgctttttccgaggaggcggtctag

SEQ ID NO: 16911 - DNA, 228 bp, A.fumigatus
ggtactgattactttagtgtcggatacctgatcagtgcggtgctcatctgcatcgagtatctgtggctggggatcttctatcgctcgcagcatcgcatcttattcgcgagctttgtgatcaaacttgcgtttgtgatcatcgaagtcgcattagccattgcatttggtatctgcactcgccgcagttctggcaagaaaaacgttggcgctatctttggaatgggttag

SEQ ID NO: 16912 - DNA, 444 bp, A.fumigatus
aaatcagttagatgggggcaaacttacatccttgatgctttgatgtcatatgtgcctcaggacacagcagaagcactcttgctcgcagagcgtgtagcgcctcgcctttcgcactccaattcctccgttgtcctcacgtcgatccgtgtcatcctctatctaatgaactacatagccgacgaaaggcacatcacttctttgtcgaagaagctctcaccacctcttgttactctgctgtcgaaacctccagaagttcagtacttggctctccgaaatgccattctcattttacaaaaaagacccgaggttctacggaacgacatccgtgtctttttctgcaactacaatgacccgatttatgtcaaagtgaccaaactcgagttaatatttatgctgaccacgaaggagaacatcggaatcgtgctagcagagttgcgagagtga

SEQ ID NO: 16913 - DNA, 246 bp, A.fumigatus
tcgtcgccgcgtggagtggtcatatcggtcatcacggtccttgtatctgctggaatgtcggtcttcgtcgcccctatccgctctgcggtctctctcactccgacgatcatccctccgatcatggcctctgtgctcatctctgcgatcatcccgtctatctctctcgtctctgtaatcgcgatcatccccccgtttcctgtcggaccggtctggcgacaagggagaccgagacctgtgccgatgtga

SEQ ID NO: 16914 - DNA, 1041 bp, A.fumigatus
agatatgcaactgagatcgacgttcatttcgtccgaaaagccgttcgtgccatcggtaaactggccatcaaaattgaatctgcagcacggcagtgcatcgacaccctcttggagttggttaacgctaagatcccttatattgtacaagaggcgactgtggtcattcggaatatctttcgcaagtatcccaaccagtacgaaagcattatcagcaatgtcattcagaatatcgacgaattggatgaaccagaggcaaaggcagccatcatctggattatcgggcaatatgcagaccgcattgagaactcggacggactgctccaggattacctggccactttccacgacgagacggttgaagtgcaactcgccctcttgacggccaccgtcaagctgttcatccaacgccctaccaagggtcaacagctcgtacctcaagtcctaaaatggtgcacagaagaaacagacgacccggatctcagggatagaggatacatgtactggcgcctgctgtcgaccgacccagctgccgcgaagcaggtcgtgatgggccagaaaccacccattagcgcggaaagcgagaagctggattcgcggaccctggaagaactctgcttgaacgtcggcacgctggcaactgtgtacctcaaacccgtccagcaagttttccgctctgcgcggacccgacgattgcagtacagccctgccctgcagaaacctcaagacgagaacggaagtggtgcttggcaattcctcacaggtacggggccggattcaggcgttgcggccaatgcatcaccgacgaacggttctggtaccggtgcaagcagcatgaatgcggctgtgagcgccgcagacatgtacttcaacaacgtcggaagccagcagatggcggcactcgacctgggtggtcgagaagatggcggttctggcggcggaggagcctcacagactcaatacgtagtgaaccagaaccagcagcaagtgtaccagcctcagctggctggcggggccgcgacaggcgagttgctattattgtaa

SEQ ID NO: 16915 - DNA, 189 bp, A.fumigatus
tccaattatggcattctcatatctgctccgctgtggctactacaacccgattggattttttccctacactttggcgtggaggaggaatcgatgcctaataatcaatgccaaaaaaaaattaccgtttctttaattttttcccagccactgcgcaacgagagcaaagctcagggtataacagctgcttga

SEQ ID NO: 16916 - DNA, 324 bp, A.fumigatus
ttcgaaatcactttcccctctatgttcatcgccgtgcttccttatgcaaccagctatggctcaccattctctcaatcttcacagggcaaagtcgcggagctgcgccaggagctcaatagcggcggcaaaaaggacaagaatttctcggccaagaaaatcgccctcaagaagatcgttgcgaatatgactatgagcaacaatgacatggtcgccttatttcccgatgtgatcggttgtatgaacttgcccagcctggagataaagaagatgtacgtccctagcgaggataatggatacaacgcgcaggcacgaacagacgactaa

SEQ ID NO: 16917 - DNA, 387 bp, A.fumigatus
gctaacattgcgtctcaggatatggacgactcgaacccgcttgtgcgcgcgttggctctgcgaactatctcgtatgtgcacgttcgcgagttcgtcgaagcaacagtccagcctcttaaacgattgatgggggacattgatccctatgttcgaaaaactgcagctttttgtgtttcgaagctgtacgagcacgataagaagatggttgagggatcggatctcatcgatcggctcaatcgaatgctcaaggatgagaatccaactgtcgtgtcgagtgttcttgcttctttgacagatatctggggacgaagtgaatcaatatcactgacgattgactatgcaagcgcctcaaagcttgtttctatcctaccagactgttcagagtaa

SEQ ID NO: 16918 - DNA, 1389 bp, A.fumigatus
agaagtaagtacctacatttccacagcctcaaccatcccttttgtatcactcttactcaccaacatatcagatcatggcatccgtcgctgctccgcaatcaggagcgcgtgtgggcggaagagaaacgagccctagaggaacgcaaacgcatcgagcaactccgtcgtgaacgggaagaagagcgccagatccaagaactacagcgcttgcaagaagcttcggggaaaggtcgccagctgaaccgggtcgattggatgtaccaggcgccatcgagcgcaacaggtcactatgctgaagagatggaaggatacctattgggcaagcgccgtattgatgggattctgctcaaaaatgatgagagcaagaagctggagaaggggactgatgtcgtgggggctaatgccgccccgccacctgtgaataacccccgggacaccatggcgaaggtcatggcggatccgttgctcgagatcaagaaacgcgagcaggctgcttatgagaatatggtgaaggagtcggtgagacggagtcagcatatccgtgacaaggatcgtgatagggatagggaacgccgtcgtgaccgtggtgaccgagatcggagtcgcgatcgggatcgcagccatagacgttcgagacatgaagatgaggatgcgcaccgttctcaccgccatcgatcacatcggcacaggtctcggtctcccttgtcgccagaccggtccgacaggaaacggggggatgatcgcgattacagagacgagagagatagacgggatgatcgcagagatgagcacagaggccatgatcggagggatgatcgtcggagtgagagagaccgcagagcggataggggcgacgaagaccgacattccagcagatacaaggaccgtgatgaccgatatgaccactccacgcggcgacgatcatatgcagatcgttcgccatctcctcgacgcggcaatcactactatgatagacgccgaacagaggacaggagcgatggatatcacagagactctcgaaaccatgatcggccagaattctaccgaggcaacgacaggaaagttaacaaggaacccagagactcgaatcttagggaacgcagctcgaatactagagatgaagttgctggtaacaaagaaaaggttctggaagaggaacgcaaaaagaagctggctgagatgatgtccaacgcagacgagttggaacaaaagcgtcttcagcgcattgccgaggtcacagctatggaagaaaaagagcgcgaagcagacgaaaagcagcgctctgaacggggccgctttgttggtcaactccatcgtcagctccaggaagatagtctggacgatcggattcgacgcagtcgaggtggcttggagaggatggaggattag

SEQ ID NO: 16919 - DNA, 561 bp, A.fumigatus
tatgacgcccgaaatccttcggatgtgtccttggagcagcggcacgaacctccaccgctgcagccgcgccaggaccagcttgagaaggcgcatgcgcaatttggtacacgtatctcggatgctgtgaacactattcagaatacaacggtctcagatggtactccgtttggcttggtccagcatctgcttagtccattgaaagatgcactcctccctgtcggtacacgcgcctatggtgctttggtttacgcgaatttggccaatgcatctgtgcaacagaacgacgagatccgagctggagatattgtcactttccgcaacgcgcggtttcaaggccaccgaggcacgatgcatcagaaatacaatgctgaagtcggtaagccggatcatgtcggtattgtcgttgactgggatggtaccaagaaaaagatccgcgcatgggaacaaggcagagaaagcaagaaggtgaaggtggagagcttcaagctcaatgatttgcgaagtggagaatgcaaggtgtggcgagttatgcctcgaagctgggtaggctgggagagttga

SEQ ID NO: 16920 - DNA, 1656 bp, A.fumigatus
  unsure (1563),(1624): Identity of nucleotide sequences at the above locations are unknown.
tggctagaatcctccattagccatataaaatgttcgtgctattctaatctggtcagtatttgccatcggtgttgtcagctgtcacccgacctcgactcaaacaaacctcaacgactctatgtccgcaacgcttctccaaacgttggcattcgtcaaaatttcccttcaaacgcagccatgggaacattccggttcggccgattgaggtcactcctccttgccacgggcgccatttttctgatctcgaccttttatctgtactggaccccagcaccagcatccgtggtccccagcagcgcatttgaagtccctctcaccgaacgtcagattgccttatggaaagccctcaagtccatcctagaaaagaatgcgccaaactgtccgtccccagttgcccgggccgatgctcatgcggtccatttcaatgccacctcaaccgatgcgcgaccggatttgaccctcctgaaagacgacgatcgaaaggcgatggaagaagcgcatgcgaattatatacgcgatatccgggtctcggaaaagttgcgctcaccacacaccgctggaacgcgtggcttggtttcgactgcggggggttcataccttccggtgtttctgtcgtcattacggatgctgcgccgtacaggatctgccttaccggtagaattattcatgaaggatgcaaccgaatatgaaaagaagatctgtgatggcgtgcttcccgacctaggtgcaaagtgtgtggtcctttcagaaatcgtcgggaaaacccctattgcgcattaccaactcaaggcctttgcgattctgttttcgtcgttcgaggagatcatctggatggatgcggactgcttcccgttgcacaaacctgaagagctgtttgactcggaacccttcaagaccaacggcttggtcacttggcccgacttctgggcgtcgactgcatctccggcatactttgaactctctcggcaaccaatcccaccggtgtctgctcgacagtcgtctgagacgggcgtttttatggtgtctaaggaagcacatttgacaacactcttattggccgcctactacaattattacgggccgtcgcattacttccggctgctgtcgcaaggagctccaggggaaggggacaaggagacatttctgcaggccgcaacggcactgggagagccgttctatgctgttagcgagagagtgcaggctctcggtcattggaagcctgacggcgaaggactctctggttcggccatggcgcaggccgacccggtggaagactatgccttgaccagtcaggacaaacggcgggtcatagatccctccgtggcaaaggcgccgcgtgtgttcttcatacatgcgcattaccccaagtttaacccggcggagaacgtcttcgggacgaagtgggacacgaccccgacgcttaaagctgatggctcggaagggcgtgcctggaccgcaccggaagatgtcgttagccgtttcggctacgatgtggagaggaactactgggaagagattaagtgggtcagttgtgatcccaagactcagttccagacatggaanaacaagaacgaggtttgccaaaaaagtcaaaagctactggcaaaaaagtgttccccggaancacacgaaggacgatccaaagtttaccgatga

SEQ ID NO: 16921 - DNA, 729 bp, A.fumigatus
cccacagtaatcgcaatgacatctgtcgacccgcgctacgaacaactgttcctagaaatagagtccaggttcagatccaccgccctccccgcagacaaatggtacattctcgcaatcgcaaccatcgtcgccagctccgaccccgagcgcgcagaccagctctacctccacctcattaaccagcctggccatgagtcccccagcgcccgacaagccctcgtcaagcgtctacgagaagccctcttcaaatccgtcatcatcgtcggcgtttgcaagcccatcgaagccatcctggccatcagcaaggtcgagcgcgacgaagacaaagagtatacctgcacgcgggagaactggcaatgcgacgcagccaaccacgagcgtgggatgaactggttcggcaagctgtacgcgcgcaacgcgtctaacacgctggacctgttcaatgggcacaaggacttcgcctggttatcgatggagatcacctacgggctgtttctgtctgatcggcaggttctggatgatgtggatacgcagatggttgtgttgccggcgatcatgagccagaatctcaggaccgagacgcattggcatattcggggcacgaggcggttggggctttccagggaggaggtacaggttgtttgggattgtgtacagctagttgcagggttcttcggcgtaactttggacaaggttcctactgttgaggaagtggaagctgacgtatga

SEQ ID NO: 16922 - DNA, 183 bp, A.fumigatus
aatcctccagcgaaaaccgaatgggagaatccccaaactcaatatcgggcgttgcgggaaccatcccactcccacagggccctaaccttccgcaagcttccaatgcaaggaattgcagtttccacccataacaatggctccacctgggcctttggtccaaattacctgcttcccactatccgt

SEQ ID NO: 16923 - DNA, 204 bp, A.fumigatus
tctcagcgactcgaccatatgacatcacaccgtccagcatctggtataaagccctatcaatctctgaccatgaccacacattcatacttcaatgagctcaaatacaatccactaattgacctcacgcaacctcttaccctctcttcaatcctcaatctcaaaagatattaccaaaatgcccacaggaacccaaaaatctggtag

SEQ ID NO: 16924 - DNA, 189 bp, A.fumigatus
ggactttctggaatagcaataatatggtccactatccctcgtggctgcccctttttcaggtttagtgctggcctagagaaaagcagccaagattttagtcaaccaaagatcgcttccataattttgtttccattcaacaataaatacactgtaatggctgtggcaagaatgaaggacctccatttctaa

SEQ ID NO: 16925 - DNA, 255 bp, A.fumigatus
gaacagttgttcgtagcgcgggtcgacagatgtcattgcgattactgtgggtcaataaatgggttgaatattgatgttagcatagagaaggatgattcaatctctgagtgggctgtggtgattatgcaagtatgcatcgctgatgcccacttaaaaccccacacccccaattcagtccttcagatgatgcatccaatgcattcttactatgataacgctttaactcagttaaaatccgaaatcctgactgtctga

SEQ ID NO: 16926 - DNA, 285 bp, A.fumigatus
ttgacctcacgcaacctcttaccctctcttcaatcctcaatctcaaaagatattaccaaaatgcccacaggaacccaaaaatctggtagctcatacgctggtggcggccagtcaagcgtcggccagccctctgtctacgaggctggcgaccagcgcaacgagccccagtctgtcattaacgaacgcgaacggtaccatgagggccagaagggaagtcacaaaaacttggattcgagtacgtctctcccatcggacaaccagcttggtttggtaccaggatcatag

SEQ ID NO: 16927 - DNA, 258 bp, A.fumigatus
ccgaggaatggcacgacaaaggaactatgtacatatgcgatcaatgtccatatcgtctatctcaaatatgggtccccgccatacatgggcgatgcacccctaatggacaagagtcgcgtatgtgcattcaattatggccgcatccctcacctcctgattgcgacgcctaagccccgaaagaccctttctccatttcataaaacaagaggtagacttctttctgcatgcccagcacgtctgaggtcttgcattccttga

SEQ ID NO: 16928 - DNA, 342 bp, A.fumigatus
tcgttcttgaaatcgcagcatcgagctaatccattgcagggtgtcagcaacgatggccagaaggcctccatcgctggttctatcgccgctgcccactacatccgcagcattgctccctcctacggcattcccgtcgtcctccacaccgaccactgcgccaagaagctgcttccttggctcgacggtatgctcgatgaggatgagcgctacttcaagcagcacggcgagcccctcttctccagccacatgattgatctgtctgaggagcccgttgactacaacattgaaaccaccgccaagtatcttcaccacgagacgccggatccgcgcattcccagaaaa

SEQ ID NO: 16929 - DNA, 702 bp, A.fumigatus
  unsure (239),(251): Identity of nucleotide sequences at the above locations are unknown.
gccagttttccttcgccaagagataggagggttctcgaccagaaaatccagttgactcgacatgccatggttactgatcttgagaatcttcccgaaggagtcagctttcttccatcggactttgcacctaagcgaaagattgctcgccatatgcgcatcactattttcccaaagattatagcaatccacttttcgcgctcgatctttgatcgcagtagttctacgaaaaatgccgccanagtatccttccntgaacgacttcctttgggaggaatattgagccagaagtggttcaagctgctggccattgtctgccacaaaggcagtcataacagcggccactacgaatctttccgacgtaacaacctctatccacctttctctactccggatacctttagttcctacgcgcaaagtcgggcaacccagcgtcaatccctctactgcaccgagtcctcgtctcgcggctcgcggggtcgccgagccagaaccctccccaatcagcctctcttcctcgacatcattaccatccctgtcgggcagttcgcttccctccccagctcgttctcagactgtgtcggtgagggactcctcacaacctgcatctcagctgaatgcgcctccctcgccgtctgctcggcccaccacatccagctcccgtgtatcctttcagagtatccgcaccaaatcgtcaggttctaa

SEQ ID NO: 16930 - DNA, 288 bp, A.fumigatus
aaagttttgttgtttcgtgatctaagtacttatctatctcttctcccgtccagatctctttcctcctcttcaatctcatcaaactcgatcccatccagacactctagtcgcatccaaaccatagtcacaatgggtatcctcgacaagctttcccgcaagtccggcgtcattgtcggcgatgacgtcctccgtctcttcgagtacgctcaggagaagaactttgcgattcccgccgttgtaagtttactgatccttctgatagcttgcgcaatacgccgtggtgcataa

SEQ ID NO: 16931 - DNA, 717 bp, A.fumigatus
gccagaagtggttcaagctgctggccattgtctgccacaaaggcagtcataacagcggccactacgaatctttccgacgtaacaacctctatccacctttctctactccggatacctttagttcctacgcgcaaagtcgggcaacccagcgtcaatccctctactgcaccgagtcctcgtctcgcggctcgcggggtcgccgagccagaaccctccccaatcagcctctcttcctcgacatcattaccatccctgtcgggcagttcgcttccctccccagctcgttctcagactgtgtcggtgagggactcctcacaacctgcatctcagctgaatgcgcctccctcgccgtctgctcggcccaccacatccagctcccgtgtatcctttcagagtatccgcaccaaatcgtcaggttctaagcagaatctctcgccgccgggatctgaaaccccgagtccagctagtgatagtggggcctggagcaagtctgggtcacggccatccttcatgagtgagcggaccacttccaagacgcccccagaagcaccagccctgtcgagttctcggctccgccgtcgcaagaagacgaatgatcgatggtggcgcatctccgacgagaagatcaaggaatgcaagacctcagacgtgctgggcatgcagaaagaagtctacctcttgttttatgaaatggagaaagggtctttcggggcttag

SEQ ID NO: 16932 - DNA, 249 bp, A.fumigatus
attcgcttgcactccgcatatcattatttccgagatgtttcgatttgcagttacagaagtccaagatgtgctcactggggtcccttcaagatgtcagatgcttctaacaatgttcgattccgattgttggacaagtctcctgagtctggtcgattcattggcaagaagtcacatgaccacgcgtcttatgtaacatacctagccactgtcagccacagaataatgagcaagcgtaaagactatcgataa

SEQ ID NO: 16933 - DNA, 1011 bp, A.fumigatus
tgcacacgtccctttaccatatttcgctggaaagcagaccgaacggcacgtaccaagcggaccaccatctgcctcacttgcgcgcgcctgaagaattgctgccaatgttgtatgcttgatctgtcgtttggtctcccgatcgttgtccgtgatgccgctttgaagatggttgctcccggcccggagagctcaatcaatcgtgaatactatgcacaggaacacgagaaagagatccaagaaggtcgcggggcggtcgaagcatacgagaagacggatgagaaggcgcgcgagctgctgcgaagactggcaaacagtgaaccgtactacaggaagcctcggcagcaactggaaggtccatccgatgattcgactgaggcacaacccaccgacgctccagtcgtacagagccgctatgggaacggacccgggcctatccggacaagcgaaagtagaagaggaacaccactacctggccgaggtcgtggcaatatgcgcggtggtcgcgcaggccgtccgtttcctggcaccgctcagatccctccatctcccgaagattacctgcctcctgcggacccgaatatcatgtccctttttgtgaccggcgtggaggacgaccttccggaacacacactccgaacattcttcacacagttcggtcaactccggtctttgatctgttcacaccgcgctcattgtgccttcatcaactttgcgactcgagagggcgcagaagcagctgcacagcattgcaagggcaaggccgttattcagggatgccccctgcgggtgcggtggggtaagcccaagcctctggacaacatggacagggaggagcggatgaagaatgctcgtgagggtcgattgacagtccaggcacaaaaggatggagagtcaggacagagagctatcacagctgcgggtgagcctgcgacagagaagccacagagctttgttgtggcaccacccccaggtagtggggatgtccaatactcgagcttgtcgggcgattga

SEQ ID NO: 16934 - DNA, 927 bp, A.fumigatus
cctctacaggcccaagatcactacgccgttcttggtctgtccaagtaccgctggcgtgctacccccgagcagatcaagcgcgcccaccgcaagaaggtcctccgccatcaccccgacaagaaggccgccctgggagaccgcgatgagaacgacaactttttcaagtgtatccagaaagcgcacgagttgctgactgaccctgtcaagcgtcgtcagttcgactccgtcgatgaggctgccgatgttgaccccccgtctaagaaggaggttgccaagcgcggtttctacaaggcctggggtcctgtatttgaggccgaagcccgtttctctaaggttcagcccgtccctcagctaggtgacgagaacagcacccaggaggaggtcgagaccttctacaacttctggtacaactttgacagctggcgttcattcgagtacctggatgaggatgttcccgatgacaacgagaaccgtgaccaaaagcgtcatattgagaagaagaacgccaacgcccgccgcaagcgcaagaccgaggatattgcccgtttacgccacctggttgacgactgccttgctcaggacgagagaatcaagaagttccgccagcaggctcgtgccggcaaggacaagaagcgtctcgagaaggaggccgaggcaaagcgtctggccgaggagaaggagaaggctcgtctcgaggaggagcagcgcaagaaggaggccgaagaggccgctaaggccgagcgtgagaagaacaagaaggccaaggaagccgccaagaatgctgctaagaagaacaagcgtattctcaagggctctgtcaaggatgtcaactactttgccgagtctggcgagccttctcccgctcaggtcgactctgtcgtcttcaccacggggctggaaggatccgcggtggcgctagggatcaat

SEQ ID NO: 16935 - DNA, 189 bp, A.fumigatus
tcaaatatgcctccgcctcagattaaacaagatctgaacaggtcaggctgggagtccactgacttcccttccgtctgcgagaactgccttcccgacaatccttacgttcagatgctcaaggaggattatggtgctgaatgtaaaattgtgggttgtacatcctgttcagtttatgtaaatatttactaa

SEQ ID NO: 16936 - DNA, 402 bp, A.fumigatus
tcgtgcaaactaacaggtgtacagaagcgccaccaccgtactttctccgaggatgaaagaattcaggctcagcagaacgtcaagaagactgaggatgatgacgacgatgagatctccgagcctgaggaccccgtgatgctgtccagagatgctaaggactggaaggtttgttcactcatagttcatctcactgttaagattgatattgacctctacaggcccaagatcactacgccgttcttggtctgtccaagtaccgctggcgtgctacccccgagcagatcaagcgcgcccaccgcaagaaggtcctccgccatcaccccgacaagaaggccgccctgggagaccgcgatgagaacgacaactttttcaagtgtatccagaaagcgcacgagttgctga

SEQ ID NO: 16937 - DNA, 564 bp, A.fumigatus
gtgacgagaacagcacccaggaggaggtcgagaccttctacaacttctggtacaactttgacagctggcgttcattcgagtacctggatgaggatgttcccgatgacaacgagaaccgtgaccaaaagcgtcatattgagaagaagaacgccaacgcccgccgcaagcgcaagaccgaggatattgcccgtttacgccacctggttgacgactgccttgctcaggacgagagaatcaagaagttccgccagcaggctcgtgccggcaaggacaagaagcgtctcgagaaggaggccgaggcaaagcgtctggccgaggagaaggagaaggctcgtctcgaggaggagcagcgcaagaaggaggccgaagaggccgctaaggccgagcgtgagaagaacaagaaggccaaggaagccgccaagaatgctgctaagaagaacaagcgtattctcaagggctctgtcaaggatgtcaactactttgccgagtctggcgagccttctcccgctcaggtcgactctgtcgtcttcaccacggggctggaaggatccgcggtggcgctag

SEQ ID NO: 16938 - DNA, 306 bp, A.fumigatus
tctgtgatccaccccttttccacccttaccacatccaaaagtccaattgctatcgccatggcccccgtagctttggaacaagagaaccacttgcgcgatgccgagttcaatcgtgcaatgcacggaaagtctgcccagtttcggggtggctttgctgctcttcgtggcaaggactcagcttctcagaaggccgctgtggacgagtacttcaagcattgggacaacaagcccgctgaagacgagacagaggagactcgcgcggtaagtaatctgtctctgctaccgtctggtattctagaactctag

SEQ ID NO: 16939 - DNA, 204 bp, A.fumigatus
ttacagagcaagaagagctccatctatcctagtccaagtacctatgcaaagcagtctgtactctgtaggcctacctacccccatactcataggtacctgtcccagcaatcatcaactgatgctgctcacgccactgagtccaccctgtccatgtgtcgatttcccgatttccccgagattgaggtgatagccacgatgcaataa

SEQ ID NO: 16940 - DNA, 234 bp, A.fumigatus
ttaatgttcaatcggtcgcttgattgtttcaactggggtatacgtaggcatcagcagctgtcagtagccgcccatctacaaacttggaaagcacagactctacctagtacgctcacgagaaagtactctgtcaaaaagtacgtttggcccgatacaacggtctatatctcccccgagcgccttgtccaaaccccttattggcctagccgaacccgtccacaagctgtggcgtag

SEQ ID NO: 16941 - DNA, 321 bp, A.fumigatus
gtgtccggtcaggtcagggctagactgactgtccaggttggttccattgacgctcttacggagcgaggcggcatctcgaagacattcgtcgggctgatcctgcttcctatcgtgggtaatgcggccgagcacgccacggcggtgacggtggcatgcaaggacaagatggatctgtcgattggagtggctgtgggatccagcatgcagatcgctctgctggtgctaccgttgattattgtgataggatggattatgggtatgtgctattcctcgaatactttgttgaccgtgactgactggcaaaaggactcgaggatatga

SEQ ID NO: 16942 - DNA, 351 bp, A.fumigatus
  unsure (289): Identity of nucleotide sequences at the above locations are unknown.
atgcatcattcgggtaggtgctcgatcgtttggaaaccagacaccaccccgactgacaataatagtaatgcggtcgaattgatcgtcgccattattgccttggtcgataaggaggtgcttatagtccaaacgtcacttataggtagtatgctgtcgaatctgctgctggtcatgggcatgtgtttctttttcggcggtgtcaaccgtcttgagcaacacttcaacccagttgtcgcgcagacagcggctagtcttttggcgctagcggtggcgagtctgatcattccanccgcgttccacgcgtggtctggtggtgcgtcaatccggccgcagattaggaagtttgactga

SEQ ID NO: 16943 - DNA, 447 bp, A.fumigatus
cttgtacagccggaaccgtgggaatcgctcccttgtcgcgaggtaagattgctggcaatgcgccgaggactgtcgctgacaaacgcaggcaccagtatcattctgctcttcgtctacggatgctacctcttcttccagctcaagtcgcacaccgagatctacaacagacccagccccaaggtcgagaagcggcgccaaaaggtgtcggagggcgatgccagtcgcggcctggcccagattggcaagatgacggccaccatgggcggccagaacgcgcagcagatgaaaatccacgaggaagacgacgaggaggaacagcctcagctcagcatctgggttgcggtcctgacgctggccatctccaccgcttttgtcgcattgtgcgctgaatttatggtaagtctgatgcatcattttgagtgtccggtcaggtcagggctagactga

SEQ ID NO: 16944 - DNA, 840 bp, A.fumigatus
ggtgtaataccgagggcattcaggatatcctcaggacgacggggaggacgacctggtttgcgcttgataggtgaaggagacgcgccactggtatggagtttgataagctccgctaacggatccttgctcgaattaatatcgataccgttcaactgcagaatctccgcaatgggcgttgacggagccggacgatctacttcctccgcgctgaaaactgcaattttggcatcgatatccaagtccgggtggaactcctcccaaccgcgctcctcgcgcggcttgtacccgtctccctgctgtagggccaaagcggcggctgtcgacgagccataccgaccacgactctgcgacttctcccttctcagacgagcagacggggaagttgtcggagcagggggcggcggcggtgggggggggaggaggacttgttgtgactcaagttcaggtttggctatgggttcaggttcaggctcaggttcaggctcaggctcaggttcaggctcaggctcaggctcggattcaggttcgggttcgggctcgggcgcaggttcgggtgcagggcgacttcgtgaagatgaggttcgtctgatgggggttcgtttgattttgggaggttcgtccacatcaatttcgacatatcttcccccacctccaggtcttccgggaatgtatcttcgtttcttcagaggggggccttcgctagcttcagagtttggccccttgagggcaactttcgggccctttcgcgaggccctgccggccgacaagcgatattttgatgaagaatatggcgccatcctaaaggaagtccgtgaaatagcagagactaatcggaaatag

SEQ ID NO: 16945 - DNA, 294 bp, A.fumigatus
taccagcccgttcagccggaacctacatttccgccacaagcagaagagccactgaccaccctgcaccagagcctaagcctttcttctaccgaccaaatggaaaagatgcaaacagcaaccgtgccagtggaccctggggcgcaaagcgtacgtcacattaccaccaatacatcggagttcagtgctgctaacgcatatgcagccaacacaatggctaacggaaaggacttctttcttgagctccgcaagcaggtgaccgcgttgcggcagggagctactgtccctggaggttga

SEQ ID NO: 16946 - DNA, 1827 bp, A.fumigatus
tttggtttctctgcaaaacaccgcacggcctggaaactttacgcttggtatttgaggctcagcggcgaacccaacggaacgccattcagggacgctttattaagctatttccgattagtctctgctatttcacggacttcctttaggatggcgccatattcttcatcaaaatatcgcttgtcggccggcagggcctcgcgaaagggcccgaaagttgccctcaaggggccaaactctgaagctagcgaaggcccccctctgaagaaacgaagatacattcccggaagacctggaggtgggggaagatatgtcgaaattgatgtggacgaacctcccaaaatcaaacgaacccccatcagacgaacctcatcttcacgaagtcgccctgcacccgaacctgcgcccgagcccgaacccgaacctgaatccgagcctgagcctgagcctgaacctgagcctgagcctgaacctgagcctgaacctgaacccatagccaaacctgaacttgagtcacaacaagtcctcctcccccccccaccgccgccgccccctgctccgacaacttccccgtctgctcgtctgagaagggagaagtcgcagagtcgtggtcggtatggctcgtcgacagccgccgctttggccctacagcagggagacgggtacaagccgcgcgaggagcgcggttgggaggagttccacccggacttggatatcgatgccaaaattgcagttttcagcgcggaggaagtagatcgtccggctccgtcaacgcccattgcggagattctgcagttgaacggtatcgatattaattcgagcaaggatccgttagcggagcttatcaaactccataccagtggcgcgtctccttcacctatcaagcgcaaaccaggtcgtcctccccgtcgtcctgaggatatcctgaatgccctcggtattacacctcagccgaaagctataccgccaccgggtccaaacccccgcgagaggctcactctcccaaaaccttcgttccggctgcgggatccttttgttttctatgaccagccaggggttggccagcggaactacgtggaccggacgatggcgagtgtgggttaccaagaaagcgatcttttcgtccgtcatgagcggcagatgattcggatgactgagggagcgcaggaagacgacctggatattatcaacccgcccactagcgagggggaagtcaatgcctctgttggcagagttgaatatgacatggacgagcaagacgaaaaatggctggaagactacaatgcgaagcgaagggaagagcagttggagcctatcaaaccggccgtctttgagattaccatgacgaaaatcgagaaagagtggcatactttggaaaagcgtataccgaagccgaacccgaagcctccacagactcaacgcccccggtcaagctccgcagcagccgtgaatggagaaacgactgccccgggcgaggaacaagacagtaaatgcgctatctgtgacgatggcgactgcgaaaactccaacgctattgtcttctgcgatggctgtgatctcgcagtacatcaagagtgttacggtgttcccttcatccctgaggggcaatggttgtgtcggaagtgccagctgattggacggggatccgtcaactgtatcttctgtccgaacacagagggtgctttcaagcagactacgagctctaagtggtctcacctactctgtgccatatggatcccagaggtctcccttggcaatccctcgctcatggagccagtgactgatgttggtcttcaccacggggctggaaggatccgcggtggcgctatg

SEQ ID NO: 16947 - DNA, 1344 bp, A.fumigatus
  unsure (10): Identity of nucleotide sequences at the above locations are unknown.
gggtggtttntcaccccgtggtcaagatctccatatagtgacgacacgtccgttgcgatcgtcgagaagaatgatcgatgccgtgatatctctacgagaattcattttctcgagaatgtgacggcagataccagggaatatcgaggcatccacccaattctagcacttgaatcgcatcaagagaatctggccaaactcgtcgataaggcgctcaagcacttaccaccagtatcggaagatggcgaggatacgtcgaaattattgaaactatcagatggctctcaacggcgcaagccggatttcgtctcggtcacccgcgggcctgggatgcgggcgaacctcttcactggactcgatacagccaaaggcctgtccgtcgcatggcagattccatttgtgggcgtccatcatatgcaagcccatctcctgactcctcgacttgtttccgccatggaccgagcgcaacaaggccccgatgtcacctctgccaacccacctctaacccccgaatttcccttcctctctatactagtctccggtggccattcaatgcttgttgagtctacctctattacagaccataccataatggcatcgactgcggatatcgcgatcggcgaagctctcgataaagctgcgcgagaaatcatcgcaccctctgtcctcaacgaagccaaaactacaatgtatggcaaactgctggaacaatttgcctttcccaacggcagcgcagattggagtaactactgtgcccccaagacccgaggcgaggagctgatcaagcagccaagcccgtggggctggaccctcacgtctcccttcgccaacacccggcagctgcagtacagcttctcatttctgccaagcatgatcaacaaattgatgggagcgaagaagacagcaggcaaggaagtctcggatgaggagcgagttgctctggcccgtgaggcgatgcgcgtctgctttgagcatctgggttcgcggacgatcatcgctcttgaggagctgcagcagaaagcgcggaacaagggtgtcccagatgtcaacacgctcgttattagcggtggagtcgcagctaataggtttctgatggctgtgctacgatcgttccttgatgtccgcgggttcggacatgttgaaattgttgcgccgccgccgtatttatgcacggacaatgcggccatgatcgggtgggctgggattgagatgttcgaggcaggcttcagcacggacctcggtggtagggctctcaggaagtgggctcttgatccgcgtgctgaggatggtggacttttgggcgctgacgggtggatgataaagaaaggcaaggacactgtatactag

SEQ ID NO: 16948 - DNA, 1494 bp, A.fumigatus
atcatggctcgggagcaagatttattacagtggtcatctcagttcttcgttgctgcaccacagcgcacaccgaagttacctggagacaagattactctgccacaatcggccctcgagcagcttctggctgctgctccgttgagcgatgtatcacctcagggttctttgcgccaatacacaagtacctttgacccgttcaatcctcacacattcgccgccgaatcgcgagctcgagcacagcagctagaccgccaaaagcagttacctcatccactcactttccgactggtgaaccccaacaatgagcgtgcaatatatgcagggatacgagagttttcagctgcggagggagaagtgggtctcagcggttttctacgacaggctcttgacatcgaggatgagccattccaattacaaaccggtgaacatgggacagagacggcgcactctccggatttgaacaaccgagaaggatcagggtctgttcgctcgacccgccattcaacccccacaattacagtccatgccaagcagttgccaaaaggcacatatgtgcgcctacgccctctcgaagctggatacgacccagaggactggaaagcattgctggagcgctatttacgtgacaatttcaccactttgactatcggggaacttctttcggtgtccgggaatcggaatgaacggtttagatttctcgtcgacaaggtggaacccgaaggcgacggcatttgcgttgtggatacagatttggaggttgatattgtggctttgactgaagaccaggcaagagagacattgcaaagacggttagagaaagcttctcgtgctcccggcaccaaagggggcagctccattggcggagttctcgccctgggagaaacagtcactggacaggtgattccaggcgaatacgtagactacgaactcagcagatgggatggcgaggagacgatcgaagttgaggttgaaggaatagatgacgcagttgtctatttgttcgcgagtccattctcctcgcatcagcgcaatcgacccaggttggacgagcatgttttcgccgacttctcaagccaaccatcgaaaaagcttcgtatccggccaaccaatattgaactagacggggctgaggcattgtatctttcggtgcatgcatattctcagaccgaggctggtgccgggatggcatcaagccagaccttaccacttcgttacagcatgcgggtcgtgcaaagctcttcagctattcaaagggaacagacggcagcccagttagatactcatgaacctggcgatgtgcagtgtaagaactgtcatcagtgggtgcctcagaggacgcttgttctgcatgagaacttttgtttgcgcaataatgtgctttgccctcagtgcggtaatgtcttccagaagcgctctccagagtgggataatcattggcactgccctcacgattcgtcccacggtaatgatattcctaaccaaagatgggcatga

SEQ ID NO: 16949 - DNA, 1230 bp, A.fumigatus
agacatgtgctgtccaatagcttgatcctcgatcacatggctccttatttgtcgatttcgggcttgctctcgttggcatcaacatgccgtgcccttcgatccgtggttatggagacaccatacgtctttcggcatcttgacctaagtcgatgtcgtggggcgcagctgcagagaagttcggcagataacggtagggctcaagccttgggtaatgaacccatggacgagtctcttaccgaggacgagttctactcagcccccttaaagaagattttcgcaaaactcgagcacaagtcgcttttacaggacgtacgcaccttgattttggacgggttacctgttccggcggacctaattgcagacattttgctgaatgaccgcttcaatgtgaacatcctgtctatcagagggtgccagcatctgaatgaacgtaaacttatgcaagtccttcaatatgccgtgcgtccgactcgccctgccggcactccccgggtgaaaggcatctattttttcacgccactgaacctggcacaagctgcagcacgaagcaggtaccgcaagtggtggagttcaaggtgtgccggtcaaacgccggtggaagcgaggccgtcatcacgtcaacatgaccagggccgtgagactgaccggcagaccgtctggtactcaccgtccggcaagttgctgaccgctagcatcgaggaaggctgggcacagacaattcagaaatgccacgggatcattgccttcgacgccgtgctgtgccgtgggccaagacacgaccccaatgcaatgttggttggccaggatgggtctcagcgtgaaggccgcttgctcggtccagcgattgctactattgcccttgggtctcgcggatgtgacggttgtcatagctcccccgagggtccagcgatctggggacagtccccagaggagaccttccctctgctcactccgccccccttccactcatcctccgttgtggcggcaaagcgcccttcgctttttccaggggcggaccaccctgccctgattgcccgctgcgcagattgccttaccgatcgctggtgccaccgttgcaacaaatggttttgcgccgattgcctgcccaatccacaacgtgtgagctcgaatctgtcgccgcatcagactgcattgagagcttctctcggcaccaatgactcgtctcaggtatgtaagcttgaatgctcatattcagagccgaggcgatag

SEQ ID NO: 16950 - DNA, 186 bp, A.fumigatus
aataaagcaagcgggtacgccaccaagcctctcataccacgcatccgggccacagcacagaacatccccgaggaactatacgtgcaccagccgaccgcggccgtcgttaacaagtacccgaacagagtatccatcgggatcagaatccccacaagactggtcaaaaccaagggcaggaaacaataa

SEQ ID NO: 16951 - DNA, 294 bp, A.fumigatus
  unsure (112),(216),(246),(294): Identity of nucleotide sequences at the above locations are unknown.
ggatcccggatttccgccttcgaacttggttggtattgcgaggtccaacgcaaaagtccttgggcgaatcatgaagaagtgttgaaggttggttggagtaagctccgctggnttagccaatccggtcatcgccatgagatcggatacaatggcttctggagacaggttactggactggctgagaacgcgtcgcccacgttccgggctgatgcaggngacagtgtgaagagcagtattttccacagntggttcgcagatcgaagagataaccttctccttccatcccgtggttan

SEQ ID NO: 16952 - DNA, 648 bp, A.fumigatus
tacgccaaagccttcaacgaattggccggatggggtcccctgaagggagatgtctcgttttggaagtcggaggtcgaagcccagggagcaattcccattccaattcccggaattgaaggtgacagtggtatcagcttcacaatcggtttccgtgcaggtcttctgtatcctttggggctggactctgattcccgacctcagctatctcgcatcaatgaccgcttcgtacttggaggcccgacagacgtccgcggcttccgcctctgtggactcggtcctcacgatggagccgatgctgtaggaggtgatgtgtatgctgcgggtagtgcaaatcttttcctgcctcttccccgagtcggtgcggacaagccgctgcggctgcaggcgttcgtgaacggtggccgcctgctacccctgcgcactttgcagaaggaggctccaacaaacagcacagaggtgaaggacgccatgactgctacgatttcagagctagggaatggactgcctagtgttgcagcaggcattgggctcgtgtacgcccaccctgttgcgcgatttgagctgaacttctcgctcccactggtgttgcggaagggtgaggagggcagaaagggactgcagctcggaattggtatcaacttcctgtag

SEQ ID NO: 16953 - DNA, 438 bp, A.fumigatus
tcgtcttcactactctacatattggccgcaatggcccaatactatccccagcaacagccctacgggtcgcaagcctctccgcagaatctccaattttatccgtcatcatacacgtcggtctcaggtcatacaacgccatcgcaagctacctatggtggatttggcggaccttcgggctccactgctcaggcatatcccgttggaggggtcgggagcggatatggtggctttgggtcccctgccgctggagtgagtgggaggatgggtgaacagggcggattaaggacaggatggctggctgcttttggcacggagggctatgaaggggagccgccgctgctggaggagctgggtgtgaattttgagcatatcaggaccaaggttggtaatggactgtcaagtggcttgataaccggaaaacgttgtgtttgtgtttaa

SEQ ID NO: 16954 - DNA, 666 bp, A.fumigatus
ccggaaaacgttgtgtttgtgtttaaacggaaaaaggctgatcattttttgcattccttacagactttgacagtgctcaacccttttgctcggatcgatcagcatctgatggacgacagcgatctgtacggggccctcctttacatcgtgctctacgggacattcctccttctctcgggcaaggtcttctatggctacatctatggtgtcgcgttttttggtaccgtcgtcctgcacctgattctcagtctaatgtcgcctgctctcgatacggcgtcggcgcccaatgccgcagacccgtccaactacgacccccatcacaaacctaccatgtccgacgcctcctccgtgggtcatttctctgccaccctgacgtttccccggtcggccagtgttcttggttattgtttcctgcccttggttttgaccagtcttgtggggattctgatcccgatggatactctgttcgggtacttgttaacgacggccgcggtcggctggtgcacgtatagttcctcggggatgttctgtgctgtggcccggatgcgtggtatgagaggcttggtggcgtacccgcttgctttattctatgttgtctttggcatcatggggatcttctcgtcccgcggcagtggtaccctggccgctaaaacgggcgccgcttga

SEQ ID NO: 16955 - DNA, 258 bp, A.fumigatus
gaagtcggcgaaaacatgctcgtccaacctgggtcgattgcgctgatgcgaggagaatggactcgcgaacaaatagacaactgcgtcatctattccttcaacctcaacttcgatcgtctcctcgccatcccatctgctgagttcgtagtctacgtattcgcctggaatcacctgtccagtgactgtttctcccagggcgagaactccgccaatggagctgccccctttggtgccgggagcacgagaagctttctctaa

SEQ ID NO: 16956 - DNA, 282 bp, A.fumigatus
tcggaagagagaaaacggccaagtaatgcactccctaatgcgggccatattcagggtctctttacccctgacggctgcctcggcgtctcggaatgtcacttaccccagaccggcgatgtcgcctatttttccaccactcgatttaccgtgagcggtttcggcaatttcagttgcagaatggaggtctacctgagtctagcaatattaggcatggctgcagaggctcactgtgccttcgaagcacggtttgcatcagccaaatatcccgcatcgaattggtag

SEQ ID NO: 16957 - DNA, 351 bp, A.fumigatus
acggccgagggagcagtgactctctccaaggcatcaacaacacacttcttttgggacgtcaccgcagtcataatgctgaaactgatgggttctcttgttctcctcgcgtctgcggccgaggtgattgcctctcccgcggctgagccagttgcgccgtccacaactctggagaagcgcgcatcttgcacgttttccgggtccaacggcgccgctgctgcgatggcttctcagaaggcttgctccactattgtcctgtcaaacgtggctgttccggctggcacgacgctggaccttagcgatctggcggatggcaccacagtacgaaccccatctccgacaccaaccccctaa

SEQ ID NO: 16958 - DNA, 684 bp, A.fumigatus
gtcaccttcgagggcgagacaacctggggttaccaggagtggtccggtccactgctgaagatttccggcaagaacatcaaggtgaagggcgcgtcgggggcgacgctgaaccccgacggcgcccgctggtgggacggccagggcggcaacggcggcaagacgaagcccaagttcttcgccgcgcacgatctcacctcgtcatcatccatcaccgatctgcacatcttgaacacccccgtccaggcggtcagcatcaacggatgcgatggcctgaccatcaccgacatgacgatcgacaattccgccggagacacccaaggcggccacaacactgacgccttcgatattggatccagctccaacattatcatttcaggcgccaaggtctacaaccaggacgactgtgtcgcggtcaactccggcacggatatcacctttaccggggggctctgctccggtggccatggcctgtcgattggtagcgttggtggccggtctgataatactgtcgagaatgtgtcctttaccaactcccaggtgaccaactccgacaatggtaccatcacctccccccgttgtcttgtcgagggtaaacttctaaccatgaagcaggtctccgcatcaaggccaccaaagggaagactggcacaatcaagggagtcacctactcaggcatcaccgtga

SEQ ID NO: 16959 - DNA, 711 bp, A.fumigatus
gcctcgacaatgcgtttcgctattcctttaggtgcggcgtgcgcctgggctggcgttgcgctggcagcgttgcagatcgccgaggatttcagcagcatcactctcaacaatgaccgtttcaaagctgtttggagcaagagcaaggggtcagttgtcgatatgttcctcgatggtcaggatcttctcggacctcaatccggctctacgggtattggaccctacctcgactgctactgcgtcccctcgggtttctacacagcaggcgccacgaacccgagaatgcagtatgtcgaaggaaccgactcgaccggaacgaaatacgccggagtcattctgaatgatacctatacccctactggacaacagttccaacaatactggtttctgcgtgatggagagacagggctgcacatgttcagtcgtctggcttattacaacgagaccacccccttccttcgcaacctccaagagttccgcacgctcttccggccaaacacgcagttgtggacacatcttacgtccagtgagctccagacggctcctttgccaagcaagaacgccgtgagcaaacaggtggtcgttcaggatgccacttggcgattcaacaacaccccagacgatgcgtactacacgcagttctcagaatatttcaccaagtacacgttttcgaaccgtaagtcgcattcgctcatgtggtgtgatttggcttaa

SEQ ID NO: 16960 - DNA, 198 bp, A.fumigatus
  unsure (37): Identity of nucleotide sequences at the above locations are unknown.
caaccactcggtttggttttcgctccgtcgggacaanactccttgggccaagtgtcggaattggcttattggatgcaagaatcatatcttaaggaatcgagtcccggtctttttttgcagcagtggacgccggaatatgacttcctgactcgcgggctaactggcgcaaccttcgataatccttttgggaccgcgtga

SEQ ID NO: 16961 - DNA, 1221 bp, A.fumigatus
ggtccgctgcactccgatctaaccgtcgatggtatcgtctacaactatattgtctccaaccaccacggtgaatgtacacccaatatcaccaatggctttgaccggacctttggccctcaattttacctcttcaacggtggcaaaggttccacctcttcactccatgatttgcggtcagaagctgcaaagctggctgatcccagttggaacgccgagttttacgactcaatcgccaagcacgtcgttggctacgtgccttcctcgaagcgtggcagcgtcgacggtcggattaaacttcctaagggcgcttccaatcctattgccatcctcactgtggacggccagtatttccaggataacagcgttgttccatcctcgtaccaatactggacggacatcgacacgagcggcagattccgtatcgatcgcgttgtcgaaggcaagtaccgactgaccgtctacgctgacggcatcttcggcgactttgtgcgcgatggtgtgaccgtcagagccggcaagactaccactgtgaaagagaaatgggacgccgagtccgccggcaaagagatctggcgccttggtacccccgacaagtcctctggcgagttccgccacggtgtcgcacgcgaccccacacacccactgcacccgccggagtatctgatctactggggcgcatacgactggcaatccgatttccccaagggcatcgactacacaatcggcagcagcgacccggcgacggacttcaacacagtgcactggtctgtctttggccccacgcctgacaacccgaatgtcgagtacaacacgacccacgactggaagatcaacttctccctgacaaagaagcagctccgcaactccaagaaggctaccctgaccatccagctggctggcgccaagacggcctcgggcaacaccgacgagtacaaggcctcagagccgtacatcaacctcatccatgagagctacatcaatgaccagaaggagcccctctcctttgtgattggcttcaaccagtcaagcagctgtattgtgcgttctgcggtgagctgctaccaggtccgctcacgaatggagttccctgcggattggctcaaggtcggcgagaataccctgacactgcatctgccgtacaatgcgacggacacggagactgccattctaccggcgaccgtgtatgtgcaatacgacgctttgagattggagctggattag

SEQ ID NO: 16962 - DNA, 282 bp, A.fumigatus
aagatgacggttatcaagctaacattgccaaggtacggtatcctcatcgagcaaaactacgacggcggcgatctcaagggcgacccgacgtccggcatccccatcaccgacctcaccatgcagaacatcagtggtaaaggcgccgtggcgtcaagcgggtacaatattgctattgtctgcggcagtggggcttgctcgaactggacctggaagagcgtcgaggttaccggcgggaagacctatggtagctgcaagaacgttcctagcgttgcccaatgctag

SEQ ID NO: 16963 - DNA, 774 bp, A.fumigatus
aatgtatgccagggccaccgcggtcacggacttgatcccgtgctctgctgcaacattggcaagcgcttcactcattctgatctcagcctcggtctggttctccgtagtatctccactgaacacgctgcggaggctttcacctttcttctttcgctcctccacttgctccctggtctggaattttccactgccgaggatattccatggcgccagagccatgccgaaatggcgagccatgggcagaatctctctctcaaagtcacgcagcatgacattccagcggccttgatagatgcaaaagggtgtcttgccaacagcggccgcgtatgcattggctgcggcaacaatccacgcaggcgtgtccgagattcccaggtacaggactttcccctgctcgacgaggatatgcaagctgttcataatctcctcaatggatgtggtgtgatcccaccagtgcagatagaggatatcaatccagtctgtttgcaactttttgagagaatcgcgaacactcatatgcaggctccgccggtgatttccacagtggttaggcgaaagaccctttttctcgaaggaatgtgccttgtaatcagaagtgtacttggttgcaaggacaatctagtcacagtttttccgagcagacatccattctccaatccatgcttccgattgctcgttctggtatgcgtttgcggtgtcgataaagttgcctccggctgcaacgtaggcgtcaaggagtgcgaatacctgctccttgttcatgcgtccccatga

SEQ ID NO: 16964 - DNA, 1257 bp, A.fumigatus
tcaaatctcacggtccacgagtcgctcattatgacgcccccatcgagtcatggatatggaagattccgtctggactcagctcggggaaaaccacgcaagacggtccagaccggacgaagatcccaccagaaatctcgcaccggctgccggacctgcaagaaggaccgattgaaatgtgacgagacccatcctacctgtccgaggtgttctcaacggaaacggatgtgtgaatacgatggaatacaccggtattattcggaatcctcgactgcatgcagcccagtggtcgcatcgcagggaggtttatcgttggagcactcgttgatggacggcctcatcaaccaaagctttacccacagtctgtcgataacaaacaccacgcatctgatgcacaatcttgttggctctgtgcacacgtcactggcaacaccaattgggaagttcttgtttgaccactacattctccctcactgcgcggcaaccccaaggctcttgcatagtctcctcgcgctctccgctcgacatctgcagcatctgcaacctcgctgcctttctcatacgacggcacactactttcacgcaagccacgctgcggagctactaaatgatgaactggggagggtcgcttcaagccctcagaatctaggcatgatctatgcaacttgtatagtccttaacatggggtgttttgcctcggatgactatcatccatctagctcgtgggtgtttcaagatacagcggagattgaccagtcgttcacctggttcacgcttcagagtgggctgggttatgtctcgtccatgttgaaaaaccaagtccatcaaacattctggcgcctcaaagcaggctccagaggatcctctatcggcaacctccttacctgggccacgaaagatccatctcataccgggagcctagaaaagattcctgactttctccttgacctgtgcgagatcacaccagacagctccccagagaataacccgtactatattcctatctgccttctgtcccacacgctcccattgaagaagccggtcgcgcaggaatttgaccatctcctcatctttggccctctcattccacattccttccgaatcctcctccgcgaccgggacgaaagagcccttgtgctcttcctgatctggctgagattacttggtcgcggtgacttttggtgggtcaatactcgagtggaggcggaatcaagagctctctcatggcatttcttcgtcacagcgaagatggagagataa

SEQ ID NO: 16965 - DNA, 294 bp, A.fumigatus
atccggttctcatactgtcctgcctcccataagtacaatcatagattccgctcttgtccaccgtttcgccacacagttcaacttccaaaggctctcaatcaatctctatactttctttgcaatatggactttcagactcctgaacctcccaccgaattgggccggtaccgcatcctctcctcaaactgcggtctccgtgtctcaccgctccagctgggcgccatgtcgattggagaggcctggtcctccttcatggggacgcatgaacaaggagcaggtattcgcactccttga

SEQ ID NO: 16966 - DNA, 246 bp, A.fumigatus
gtcaatgacattaggctatattcatgcgctctctatcagaccacagtagagctggatatgattccgtacaaaacccacagcccctcactgtgggatattgtcaaggtacatatcgcttacgccttgcatttcacaagctgtacaatcaatcaagctactgagaggcgtgagtctggacatgttatccgaacaagccaaatacaatcacaaaacatagtggcaggattagcactgatacctggataa

SEQ ID NO: 16967 - DNA, 345 bp, A.fumigatus
  unsure (116),(187),(273): Identity of nucleotide sequences at the above locations are unknown.
cgggggggggctagtccccggggaacaggatttggttgttccaagcccgcatggcccaaaaaagtccaccggaaaactgtcccacggcctggttgcgaagccggacggatgtgtcnaggccagttcagctcccccatttcgcacattcgcgtggatcggttgacttctcgatcgactctcggcgatntcgcccgcggcagtatttcgaacagcgaggattacctttgcagctccgagacgacagaagtgtcgtgcggcttcgagcccgaggcngacattggctcccgtcacaatcacagtgcggccggggaactcttgggttgggtacttaggggtgacgaataa

SEQ ID NO: 16968 - DNA, 456 bp, A.fumigatus
tatagtataacccaagtgtttgtttcctgtagttctgtaactccgtttaaatccggttctcatactgtcctgcctcccataagtacaatcatagattccgctcttgtccaccgtttcgccacacagttcaacttccaaaggctctcaatcaatctctatactttctttgcaatatggactttcagactcctgaacctcccaccgaattgggccggtaccgcatcctctcctcaaactgcggtctccgtgtctcaccgctccagctgggcgccatgtcgattggagaggcctggtcctccttcatggggacgcatgaacaaggagcaggtattcgcactccttgacgcctacgttgcagccggaggcaactttatcgacaccgcaaacgcataccagaacgagcaatcggaagcatggattggagaatggatgtctgctcggaaaaactgtgactag

SEQ ID NO: 16969 - DNA, 897 bp, A.fumigatus
attgtccttgcaaccaagtacacttctgattacaaggcacattccttcgagaaaaagggtctttcgcctaaccactgtggaaatcaccggcggagcctgcatatgagtgttcgcgattctctcaaaaagttgcaaacagactggattgatatcctctatctgcactggtgggatcacaccacatccattgaggagattatgaacagcttgcatatcctcgtcgagcaggggaaagtcctgtacctgggaatctcggacacgcctgcgtggattgttgccgcagccaatgcatacgcggccgctgttggcaagacacccttttgcatctatcaaggccgctggaatgtcatgctgcgtgactttgagagagagattctgcccatggctcgccatttcggcatggctctggcgccatggaatatcctcggcagtggaaaattccagaccagggagcaagtggaggagcgaaagaagaaaggtgaaagcctccgcagcgtgttcagtggagatactacggagaaccagaccgaggctgagatcagaatgagtgaagcgcttgccaatgttgcagcagagcacgggatcaagtccgtgaccgcggtggccctggcatacattctatgcaaggcacccaacgtctttccgattgtcggtggaaggaaagtcgagcatcttcacgataacatccaggctctcaagatcaaattgactgaagaacagatcaagtatctggaaagcgtcaaccattttgatcctggctttcctagtaattttctcggggaggatcccagagtgtctggaaaggccggcagacttttggccacttcagcccctctagcatgtgtgcgggctccaacggcgatcggatatgaggtattagctgaaataccaagttga

SEQ ID NO: 16970 - DNA, 270 bp, A.fumigatus
tgccttggatcgccgacaccggtcatctacaaagtgaaatctgagattcagcttcgggaggcgctctccggttctcccagccgctttcgctcaggatatttcacgagcattattctagcttggtcctacatcgtcttctgccgctgggtagagatcttgcaacgggcgggggaggaagtgcgctcctacacgaaaagaatggaagtattcgagaactcgttctgggatatcgtcacgcacggtggctgggaagccctcggaaaaggatga

SEQ ID NO: 16971 - DNA, 1110 bp, A.fumigatus
aaccgcctgagagagctgggctacagcatcccgttgggtaccacaccaatccacctccgacggggcggccggttcgcgtatatgcagatggggttttcgatttgtttcacgtggggtatgtctacaatactttttttttttattcttttttttttctctcagattacagctattttctacagtcatggacttgatgctcattgctggtggttttttggcagacacatgcgacagctggaacaagcaaaaaaagctttccccgacgtgtatctcattgtcggcgtgaccggagacgaagagactcacaagcgcaagggtcttactgtactcagcggtcgcgagcgtgcagagagcgtccgccattgcaaatgggtggacgaggtgatcccggactgtccctggatcgtgactccggagttcattgagaagcatcagatcgattatgttgctcatgatgacctaccttatggggctgcggaaggagacgacatttatgcaccgatcaaggctcagggcaagttcctggttacgcagaggactgagggtgtcagcacaacgggcattatcactaggtttgggtttcctcctcgtttggcggacgtggttgctgaccgtctcatttcatccagaattatccgcgactatgaccagtatattgctcgtcagttcaagcgaggtgcctcgagacaggagttgaacgtgtcatggattaagaagaatgaattggagatcaagcgacatgtcatggagcttcgagacagcattcgcaacaattggaccgccactggccaggaactgggccgagaattgcgacagttatggcagaacagccggcctggcagtcctgctccgagcgcccgaaacagcatggatttgggcagtgtgcgtggtggtaacggtgggctgaccagtcccactggtggccagaaatcacatgtgtcacgactagaggcattgggtcgtcctgacagtccagtcggaacaaatgggagaaacgaagattttgcgacgggctacagtttgggcttgatcggcggtgtgcgagcatgggtttgtattacctttcctgccacgatgatagaatcgagcgttgaccatatttgcagatga

SEQ ID NO: 16972 - DNA, 654 bp, A.fumigatus
agcagtgctcctcagtcagccaacatgtcgtctccgtccactgcggccaaacgcaagcgcagtgcttctcaacatttgacggccgacattgccaaatcatccacagtcgatctcctccaaccatcgtctcgcgatgcgtccggtgaggaaggagacgactccaccgatccaatcacccccacagcaagcaagaacaggaaacatacttcaattgaagtgacctcgaccggagcccccaatccgccttcgaaacgggctcggaaatcgtcctctggcgaggctccagccgccgcgcccaacggaaccacagaacactcctcagccatccatcaggaagatcccggcgagccatctgagaccaccgtagctagtagtgacattgagcatggggcgacgggtcgaccggggttgcacataaagaccgccggcgccgatgcagaaacgaaagagcgtctgatgaaaccgcctgagagagctgggctacagcatcccgttgggtaccacaccaatccacctccgacggggcggccggttcgcgtatatgcagatggggttttcgatttgtttcacgtggggtatgtctacaatactttttttttttattcttttttttttctctcagattacagctattttctacagtcatggacttga

SEQ ID NO: 16973 - DNA, 1209 bp, A.fumigatus
aaagatagaccatttttttttttcttagacatatacactatagaccacagatatagaaaagacatgcgacacttcgatgcctggctgcttcgtgatccctactccatctggcactactattcgaccggacgacgatggcaggagatagtccgtgatctcatccaggaacgcaagatctgcgctcctcctgtcaacttaccatcttcaacctcatttagaccagtggacccttacgatcgtcccatcaacccgcagtctgcctcgccgctcttcggcaaactgcccgcagagatccgcttgatcatctaccactacgtctttggcgacgaggcagttcatctggttcagctcaagggcaagatccgccatgtgcgctgcaagcatacctcctcctccctcgatagtcaccgactctgttgcccgattaccccagctcgctggcgagcgggagcaaggacccatgacggccattccgacagcaggctctacccgcacacccaccccgccctccccgacatgctgagcaacggctcgctcgccctcctgcgcacctgccgtgccgtctacgccgaggctgccgaccttccctacgccaccctggtcttcgatgtcgacgatctgcacaccttcgtggccttctcccagaccatcgacccgcaccgcctgtgcgccatccgtcgcctcaccgtccagtggacacccgtctggcaacccatggccggccaggagcacaaggcctccatctacgcgcacacccacaacgaccacctctgggccctcttctggtcccgcgtcgccgcctgccgcggcctcgaggagcttcatctcagcattgacctcggccgcttcaccagggccaccaacgccaccgccgggctgctcggtgggcaacgcctgcggctggacgtaagggagccatgggtcgcgccgctgctgtctgtgcggggcctgcgcgtgttcgagctgggtatcaccgcgcggtctgacgctgagcctgttgcgcggaggctcctggaggagaacctgactcgggacgcggtgacgctgagagattctctccgtgcggtcatgtgctcggcgcctggcaaagctgtcttggtttcgggagtggagctctggaagccttgtcccgtggaggaccgcgatgagcagacccagcctgcccgatggcgccgaacccggcctcgtctcgctatcactgctaagtga

SEQ ID NO: 16974 - DNA, 1074 bp, A.fumigatus
ctcatgcaaactctcctcctcgagcctggtgacctcgttcaggtcaaatcaaccgatctccctcccggccaattcattaaacttcaagcccagtcaacctctttccttgacatcagcgatccaaaagcagtgttagaaaacgcttttcggaatttctcctgtctcacgaagggcgatgtcttcacttttgcttataacgaccaggtctacgaaatggcggttcttgagaccaagccatcgaacaataccaacgccgtctctgtcctggagactgatctggaggttgattttgcaccgccggtggggtatgaagaaatccaacgcccaagtggcaccagtacacccctcagcggggtaagcggtaagctcccctctgggggtttacttcatccgcacgggacaatggctcaagcgatcaactatgcggccattgctccagagtccaccgacgccgctacaggtgcaaaagcagtatcatcaaattttcttcttggagggcagcgcttgaatgcgaagaagggtagtaaagccccgactccgaagccttcaaccccggtgccaggagctactaatcctcagcatccgccgccagctagacgcaccaatggaccgcagccactcaggcttccacccaaccagctattttttggatatgcaatcaagcctgtgaagaagcgtggggaggacggacaggccatcgaaaagccgcgcttccagggaaccggacagacattacgaggaaagaagagagagccaggaaactccgctacaccgacatcgggaagtgatgcggaaaatcacaagggcaaagaacgcaaccagaagtctcacgggagtggggcgaacccttggcggtaccaagcgctgattttcaggttgatcactctcacaaatcaatgctttaacgacttccgtattcatttcttccttcaaggcggcaagaaatttaagtcgagacggcttcacatcaagcataccaagggtggccggcgtttaatagggatcgttttctttcttcagctctgttccattgtagactatggacagccatcattactcgattttccctcgtaa

SEQ ID NO: 16975 - DNA, 330 bp, A.fumigatus
ttgtggcaggacttacgtccttgtgattcaaacaaggcccaatcccctctgcgttaccccacaaccgtaagagattcccaagattaccgagcgtctgcggttagtttgaagtcgccttcgtctaatctggcacaatcggctctagttctaatgtataataactacaccacttcgctccgaggtgacagcccattcccagtccagaaagccgatcgaaccatggcttccagcaagaaccacggatcaaaagtcgatatcaaccttcgtgtctctgcctcgctcacttttcttcacattctggtaaaacttcctattggtcaccctttatga

SEQ ID NO: 16976 - DNA, 534 bp, A.fumigatus
caacctcagtttcgccctggctactgggacgacgacccgatggacggagtcctagggtcctccatgctccgccatggagccactatacgtcgcttcgatgaatattaccgctgttaccccgtcgcaatgttgcctggtccagagcgagaaaacgtcaaccatggcggcaaggtgatcatgcctcccagtgctctagacaaattaactaggttacatatcacatatcccatgctattcgagttacataatggcgcaaaagagaggatgacgcatgctggtgttctggaattcattgctgaggaggggaaaatttatctgccattctgggttagacagtccatgtcctcttttgattatatcggtacagccatcactgacattgtctggtctctccatagctcatgcaaactctcctcctcgagcctggtgacctcgttcaggtcaaatcaaccgatctccctcccggccaattcattaaacttcaagcccagtcaacctctttccttgacatcagcgatccaaaagcagtgttag

SEQ ID NO: 16977 - DNA, 888 bp, A.fumigatus
ttttgctcctcatcatcgtttccatcaagaatgatatcctctcaaccgcgcccaaagcgggcaggtgaagacttcacacgcacacaccaccacgatgaagacgatccgaacggcccttccgaacacaagaagccacgcttcgatttgcggaatccctccaatcttgcaccggacgcgctcgacgaggacccggtattagacgcagacgagatcggtcgtcgcggacaacaagtgcgccgcaaggccgtgaacctggatggttacgattcggatagtgaaaatgaaggattcagcgcgcgcatcgaggccaaggctaagaggactcgcgcgaaacacgacgctgaagacgacgacatgttcgcagagctccaggaagatttcggcgccgaagaaatagatgctgatgaggcactgaggaagaacaagaaaacagtgcgtttcttgcgagatgatgagattgagggtcaggtagcttcatcgaaaggtggagtgacattgcgtgcggatctgaacgcaacaggggacacagtcgaggaggacgaggtggaaagcgagagcgatgttgcagacgaagatcgtgcgaggctcgatgagggcatggacgaggaattaggtgctggagctaaaaagaagcatgcgccactgctagatgcatttaatatgcgggccgagcaggaagagggtaaatttgatgatcagggaaattatatacgaaaagcggcagatcccgacgagatttacgattcttggcttgagggagtatcgaaaaaggatatacggcgcgccaaagaggcagcagagaaaagagaggctgagagaaaggagagagatcgattgaatgacatcatcttacggccgttttttaacagcggccatggaaagtataaa

SEQ ID NO: 16978 - DNA, 735 bp, A.fumigatus
tatagtggagagagcagcaatagccaggagagttcctcgaatgatccgcagtcgtcggtgacgcccaaggaggaagaaatggagcaggatgaaccgccatcatccccttcgtcgattggttcgctagatgccattgatagggtggaagaagatttgaatcggagtgagagctcgagggctacagggtactttggcaaaaattcagagctcacctggatgcagagggtacgacgggaggctgagcaacgcgttcggaatcagtcaggagcatcggatacgaagcctgagggtgactttgctctgcatgccgtgaactatcacctagacgacatggatatcaccgtcccgggccccgtacaagtgtactggatgccacctcgccatgtggcggacaaacttttcgaagattacctgaccacagttcaccctttcttccccatcatcagtcgcacgctgtttagcgcacagtacaggacctttttcgaaagcgcagggcggcctggtgacaaatggttggccattttgaacatgattttcgctattgcatccaagcatgcacatcttacacaggcaccttggcgcggagacgaacgtgatcatcttgtgtatctgacacgggctcgcatccttagcatgaatggtgatacgatcttcaatcatcctgacctgcagcaggtacaggttgaaggtcttattgcgttctatcttcttgcatcggatcagatcaaccggtga

SEQ ID NO: 16979 - DNA, 1437 bp, A.fumigatus
ctgaccctttccagagcgtggagaattgcgtccttggccgtccgatctggtatttctctcgggatcaatatgaagaacaccagcgagacgacgcccagtatatccaaagaggcacgttatagggtctggtggtgcctgtatacgttcgagcatatgcttggagtcatgacgggtaggtcaacatgtattctagatggtgtttgtacaacgcctatgcccctgcccttcgatgaggagcagctacgagagccgttcgcggccaagcttttggcggaccaagatatgcggcaagcgtatatcgaatcagcgatggcaagttcgtatgttcgtcaaatgcccttgaatccgccaggtggcagagatgctcaactcgcggacaagccacgggacgcccaatggttaaagagtcagcccgcgagccgggccttgtgctatctattctacaccgacctggctgtgatcggtcaggagattgtcaacagggtttactcgccagattgcgtcaacacaccgtggccccatattgagaatcgtattggggagcttcgagcgagaatcgaccgctggtatcacaatcttcccgaggtgtttgactttgcccacaagatgaccgaggaggaccaagaactgctccgtttgaaacttttcctcgcgttccacttctacagtgctcggatcactcttggacgaccatgtctgtgccgtcgtgacgcacttccgagagatccgagcaaaaagccgacttttagtcacggcatggctgtggtatcgctcgagtccgcgcttcggatgctcgaattgctacctgacgagcccaacgccatacagctctatcagatctgtccctggtggtgcaatttgcactacttgatgcaggccgcgactgtccttctactcgagctatcctttggcaacatccatatgcctgaggaggagccgaatttctttgcggccgccaaaaaggccgttcgctggctctatgcgatgtctgagtgcagtgccgcatcacggcgtgcatggcagctgtgtgatagcaatctccggcgaatcgcttacggcatgaattacgacgtcagcgacatgcccgagtctgcctacgagacaagaccagcccaccccctgagcatgcaaccacagcgctataatccacaaaacaccaatttgacatctacaaccatgtgttatgatgccacagacgatctcagtcttctaaatcccactgccgccggcgggtcccaggaaacctaccaatacttccaaaattcccatccgtctacggtttcgcattctgaaaagatccccagccttgatctgctgtcctcggccagcagcaatcctcccaggggcgatgcctttttcccctatgatccgatcagcagggaattcatccagtcgttcttccccgtggccgccgacgaggaaccatggacgcattga

SEQ ID NO: 16980 - DNA, 708 bp, A.fumigatus
accaacttacccggttacactcctccggatctacatcatcctccttctgcacacgagttcaatcgtcgcctccggagaggggagtccagcatggaaaatgctccctccagtatccccgagtcgggaagtgccgcgatgcggggccagatgccttcgcatccgccaccacaacaagtcgatcgcaatgaaaaagctgcgatcaactcaatgccggccgtcgagctcaaagattcatcatacatgcagcagatctcaaaaccctcgccgctaggtcccaatcgatctggagcgaatgaaagtgcaaatgcgaaagttgcgatccccagacagcgctcgactgtcgccccgcgctacagtcgccgtgtgccgcgagcgtgtgaaagctgccgagcacgaaagacgaaatgcagcggtgatactcctatatgcaggcagtgtaaagagttgagggtcacgtgtcgatatccggtgtcatggagggagaagacaaaagggtacgtcgtgggtctgtcgtgttgtgtgggcttacaactgattcgtatggttttttttttttgccacggacacaggcagttggatatattgtcagtcaaaacccaagactatgagaatcttctgcgagagatcgggagcatggtggatagtcgaacttcggaacgtatcaagagcatgctggacaaagtaagagcctccggcgatattccttga

SEQ ID NO: 16981 - DNA, 1800 bp, A.fumigatus
ttattaagggatacacgccggtgcactgggcccgtggcttacggtcactacaatgtggtgtttctgctcatgaaagtgggtgctgatatcacgccagggcagaacaccggatttagtccgctagattatgccattataacaggacatgatcgcgttgtggaggttcttttgaagcatggagctaccattacggatgtgacaattggcccatctcagagaacgactctgcatgcagctgctatcaagggatatagcaagattgcaaagatgttactgagccacggtgctcctactgatgtcaaggatgcccatggtcatacgcctctccatctggctgtttcgaaagggcatcttgagatcgttcaggcgctgctttgtgctggggccaccgtcgacattcaagacaaagtaggcgactcaccgctgcaccttgctgccggcaacggttattttgctatcgtacaggagcttctgaataagggagcagacccttctctgcaaggtcgcaaaactgctacgccattgcaccaggcatctttaatgggcttcgttgacgtggtccagcttcttctagaatctggggcaaatgtgtctgctcaacggtcagatggacaaacccctcttctccaagccagcggcgccggccaggttgccaccgtgcggctgcttttaggtgcggggagtagtccttcaattccggatgaagatgggaacacaccactccactttgctgtcctctcagagaaagctacaatcgctgaaatgctgatagaggctggagcgcatgtcgatagcgcaaatgacaagaatcagacccccttacactgggctgcaaaaggccatgaagagatggtccctactttgctgaagcacaaagctgatacccatgctcgtagccatacagggtggactccgctacattgggcagcgaacgagggccatgttggtataacgactgctttattggacgccggggctcgcgaccagattcaaaatgaacatggggaatcagcgctgcacttggccgttcagaaaggacatcaagccgtcgtccaattgcttatccaacggggcagcaagccacatctcaccgacaacaaacttcgcacagtcctgcattgtgcagctgacgtaggacatgaggatgtggtaagaatattgctgagtgtccaagccagatcggacgtcaaagatatcaatggtcggactccgctgtactatgcagcactccaaggccatgtggtgatcgcaaaactgcttcttgaatttggtaccgcccttgacgagtctgtcaaggaggcctttttagaggctgcagaagctgggcacgaattgatggttcaacttctcatcacacatggcattgatctatctttcaaagatacaagcggatctacagcgttgcacagggccgttctcgggggccaaattgaagtggtcgaacttcttctcgatacagaggctgatacctctgcccgggataacagcgggaaaacagctttgcatcttgctgcccaggagggcgaggatgagattgccaaagttctcttgagaaacagtgaaatcagagatctccaggattgtgatggctggacggctctgcattgggcggttaataacgaacatgaaaacaccgtccagtctctattggatgctggtgttgatcctggtattgcctccttcgacgcatgcacgccgcttgatttggcagaagttggggctctagaaacaattgagcagatgctacgagaggcattagcagcaaccgatagaccaaccattggtgacgcgcctccatga

SEQ ID NO: 16982 - DNA, 315 bp, A.fumigatus
gcggttataaatccattggcacgcactcggtgcatcccacaaaagcgattcgtgacaatggaaaccctcgatgcggttcagctgccctacctcggggtcgtcggcgcaagcttgatcgtcatcctgggcatcatattgttgtttcccttgggcagcgacccctttataaccatcaaccaacacccatgggacttgtttcagacaaaggccaagcaacagtttgaatataatgcagctgctctacttaacgagggcctccaaacagtaagcgcagagatccggtgtagcttccgtatcttcgccaacaggggttaa

SEQ ID NO: 16983 - DNA, 657 bp, A.fumigatus
tcacagacagagtggcatggcgtctctatcccggaaaccgtactggccttgattgcccaaatgacaacaagagcactgctgggccctgagctctgccgcaaccccgaatggctggacattgcgaaatccttcaccacaaatcgagctattgctgtcgccgccgtccagtcctggcccagctttcttcaacctgtgatccattggttcctgcccccgtgccgggctcttcgccgtcaaatccagtgcgcccgtaatatcatccttccggccctcgagcgtgaacggcgcgcgtattgcagcgatcagccaacgaagcgggaattctcgaacttggtgttcatcgatcagtatgccaagggagcccgctatgatgctaccatggcgcagctgcgaattattgccgttgcttttcagactacgagtgatttggtcgaaaaagtgatagcacgactttgcaagcaccccgagctcattgagcccttgcgcgaggaggtggtttccgtagttgggaatcatggcttgcaccgccactcattacgtaaactcacgttgatggagagtgtgatgaaggaaacccagcggcttgaacccgctgtgatcagtacgttgcctccgaatatagttatcttcctccgtatgggtctcgtgctgacttga

SEQ ID NO: 16984 - DNA, 444 bp, A.fumigatus
cgtccgatctcagtcggcatgttccgcctcgccaaagaaaaagtgacgttgaaggacggcactgtcgttcccaagggtaccaatatcgcctttgcgaatgatctccgcttcgatccggaaatgtacctggagccggaaaccttcgatggctaccggttccagcggatgagagaggatcctgcgaagattgaccttgcgccgttcaccaagaccaggatgagccatctcgcttttggccacggcaagcatgcctgcccgggccgcttcctggcctgcgatgaagcgaaactcattctgtgtcatattctcctcaattacgacattagggctgtggagggatcccctccggaattgcgtgcgcgtgggatgtttgtgcagctggatcctggggcaatgatgtcggtgagaagacggcgggggactgaaactgcaccgcatgggtag

SEQ ID NO: 16985 - DNA, 234 bp, A.fumigatus
ggccactcggcgttccggctggtgaccaacatggtcacctatttgatcttgaaagaccagtatgcggaggaaatcaagaatgatagtcggtttggcgctcatgaagcagttgatcccgtatgtcgccctcttcattgcgcagatttctcgcagaacgatctggttctcatccgtctaggtattacttgtggacctgcctggcttagagagcatgttccaaggttcgctgcataa

SEQ ID NO: 16986 - DNA, 537 bp, A.fumigatus
aacattgaacgcccgcctcgtcctgcagccagcagcgagagttgtgactccctagactgtccaggttttctccaatttcgattctctatctcactcgagcatcatccgcatccgcgtcccacaatgaccataccaactgagatttcgtgccctgaagaagacgcattccagctcctcgacaagttctcatggtttcccagcgacgaccagcgacgttggtgggaatatactggaccctatctgctcaagcttctgcgtgatgctaaatatccgcagaaggatcaggttccctgcctttatctcctgcagcaactgctggttccatacctcggcaccttcccagtcgtgggacaagcacctctgccttggtggagcaatgtgaccacctatggcgtaccgttcgagctcagctggaatcttctgcataatatcgtgcggaatggcttcgaaccactctcacacttggcagaatccggcgtccatgctttcaaccagacaccgccagaggaatgcgtctcccgcctaagcgtgtcttga

SEQ ID NO: 16987 - DNA, 771 bp, A.fumigatus
  unsure (737): Identity of nucleotide sequences at the above locations are unknown.
aaacaccatcgattaacgcggttcagacacttccaacaccaccttttggtgactcccgaggaagaaacatggttgctcaaagagaaagcccccctcgccaagtctggacgaggccagcaaaccctggccgtggaattccagaatggtggcatcagcgccaaagcctacttcttccccggcatgaagtcgctggcgactggactctcgccaggaaagctcattcttgactccatcgagaggctcgctctcccaggattgaaggaacccgtgcatcacctccgcagcaccctcggcctgcaagacgacgggcacccgacagataccgcgattgccccgttccttctcggtgtcgacctgtgcactcccgaacgaagtcgcctgaaattctatgtgaccgaccaggtggtttcatgggatcgggtagcggacatgtggactcttcgcgggaaacgtctggaagatcctcaatgtgccgatggtctggccctcctgaggaaactgtgggatctcctcgcgatccctgaagggtatcggagcaacatccggccggactttgcttttgggacgcctcctcccgaggactaccgtcccgttatgatggcgaactggaccctatctcccaagaaaaaatttccggacccccagatatacctcctgaccgttgggatgaatgacgccgtcgtcatggacgcactcgtggcgttctacgaggttctgggttggacggatctggccancacgtacaaggacaaagtggcctcatacttgtaa

SEQ ID NO: 16988 - DNA, 276 bp, A.fumigatus
agactggacggtgttttcatgttcgttattaaccgcccaatgcagagccgtccagccatcacaatcctggagatctctgatttcactgtttctcaagagaactttggcaatctcatcctcgccctcctgggcagcaagatgcaaagctgttttcccgctgttatcccgggcagaggtatcagcctctgtatcgagaagaagttcgaccacttcaatttggcccccgagaacggccctgtgcaacgctgtagatccgcttgtatctttgaaagatag

SEQ ID NO: 16989 - DNA, 297 bp, A.fumigatus
aaaggcctccttgacagactcgtcaagggcggtaccaaattcaagaagcagttttgcgatcaccacatggccttggagtgctgcatagtacagcggagtccgaccattgatatctttgacgtccgatctggcttggacactcagcaatattcttaccacatcctcatgtcctacgtcagctgcacaatgcaggactgtgcgaagtttgttgtcggtgagatgtggcttgctgccccgttggataagcaattggacgacggcttgatgtcctttctgaacggccaagtgcagcgctga

SEQ ID NO: 16990 - DNA, 261 bp, A.fumigatus
  unsure (63): Identity of nucleotide sequences at the above locations are unknown.
cgccgtcgtcatggacgcactcgtggcgttctacgaggttctgggttggacggatctggccancacgtacaaggacaaagtggcctcatacttgtaagtgatcctgtctggtgggtgcatgccacaacgggctggaatggaattaacctcgttgacagccccggccctgactttacgaaaaccaattacattcactcgggggtttccttctcgtatcgccactccaagccctacctgagtgtttattattcgcctttttga

SEQ ID NO: 16991 - DNA, 390 bp, A.fumigatus
ctctgtctggggttgggttccactgctgatctgccacagttttatggtcgaaagtggatttacatcgtgtcatttaccttctttttgatatggttgatcccgtgtgccgtggcgcagaacatccagactatgatcgtaagccgtttcttcaacggccttgctggcagtgcttttctcagcgttgcgggaggtacagtgggcgatttgtttgaccgccacgaactcagtgcccttatgaggggatacacggttctcatatcatcggtccagaagtgggcccgctgtatgttctcctcgaatttcctcggctcggacgttgaccggatcgaagctcgctcttgtgcagcagggactgacaggaagtttacccagggttggcgggttcattaa

SEQ ID NO: 16992 - DNA, 483 bp, A.fumigatus
ctcgacttgtccagactcctccggcgcaaggcgcaaaagctgcgcaaagaaacgggagacgacagatggaaggctccaatcgaacgaatgcaccgctcggtagcacggactgtcctgcgatccacctaccggccgtggcttctattggcgttggagccgatgtgtttgaacctctgtatattctctgccatccttctgggtattctctatcttttctttggtgcttttcagctcgtcttcggcaacgtatacggcttcgagctctggcaaagaggtctgtcgttcctcggcctctttgttggtatggtatttgccatcctatctgatcctttctggcgtcgagtttacgttcgtctggaaaagaagcacgaaaaagctgttgggaaaccagatgatttccagcccgagtggcggctacccccaggtgtgtatagtcctggtgttttggttatcggcatatcgaaccagaatagaccttgctaa

SEQ ID NO: 16993 - DNA, 288 bp, A.fumigatus
gctgagtatagacggtctgctaattcgatctgttgcacgaacaggacgatcctcgtatactcgggtgtattcacgtttctggttgatgcctacccaacatacgcagcgagcgctctggcagcgaacagttttgctcgttcgacctttgggggtgtctttccattgtttggtaaccaaagtaagcattctcttcctgtctatgcatctgcggtcgtccgcgaagtggagctggagcaacaggtcaggagcatggtctacgtcaatggtggtagcctcatactcagctga

SEQ ID NO: 16994 - DNA, 216 bp, A.fumigatus
tcgagaaactacctcttaggtgacgagagaccgtgtcagcgctgtatcaaacggggtcttcaggatgcatgccatgatggggtgcggaagaaggctaaatacctgcacgatgcgccggatggagcgttgatgcctggagttggggggaatttctacaacaacgcgatgcgaaataatatgcccttgtctcaccacggggctggaaggtgccgcgcc

SEQ ID NO: 16995 - DNA, 435 bp, A.fumigatus
ataaggatgtcgacaactcagcagaccgactctgttaccacaacagaaaagcctgagtcgcctgtcgatgaggattcgtcaagtgagaagagcacggaagatgctcgaggaaaagaaacacaacagggtgaagaatcggataggacttttgcacccatcaatgcgtccgtcgcaacaaacaatgagcgatcgcagaagctgcagcgcactacgtcttcgaccatcgagcgcagctggtctctgaatgatggatacagctgccatactgtcgacgaagaagcagaagatagatctaaccaaccgggtgaagcagccgacggtgatgagtttgttgtcggatgggatgacaatgaccctaagaacccccggaatatgaacaagctccggcgatggcttattgtcatcatttgctcgtcgggttctctctgtgtgtga

SEQ ID NO: 16996 - DNA, 189 bp, A.fumigatus
tatgagaaccgtgtatcccctcataagggcactgagttcgtggcggtcaaacaaatcgcccactgtacctcccgcaacgctgagaaaagcactgccagcaaggccgttgaagaaacggcttacgatcatagtctggatgttctgcgccacggcacacgggatcaaccatatcaaaaagaaggtaaatga

SEQ ID NO: 16997 - DNA, 237 bp, A.fumigatus
atctccagacctgaggctgcgggacagaaggccgctgaatctacgccgccgtccgttctggtcacctgctctgattttatccggaataacatgattatccgccagaagtcgtctttcctcttcgattgcctggtcgcgctccctccacgaaagacattccggctctcctcggtgcggaacaactgtgctatgcgatacagtagtgaaaaagctgggccgttggtaagagccaactaa

SEQ ID NO: 16998 - DNA, 366 bp, A.fumigatus
gcgataggccatctcatgactaacatcgaccggggtctgcttcaccgtgcattctcagttttccttttcgactctaacaaccgcctgctactgcaacaacgcgcttccgagaagatcaccttccccgatatgtggacgaacacctgctgctctcacccactgggtattcccggcgagaccggtgccgagctcgacgctgccgtgctgggtgtgaagcgtgccgctcagcggaaactggaccaggagcttggaatcaaggcagagcaagtacctctggaaaagtttgagttcttcaccaggattcactacaaggcgcccagtgacggaaaatggggagagcatgagagtacgtattggatatcttga

SEQ ID NO: 16999 - DNA, 519 bp, A.fumigatus
attctgcactggattcgcctcaccgctttggaattatgggcgggttttccctttacgaacacgaacaaccaagggggctacaaaaccgtacagtcgtctggttctctttcacactttctgaggcctgtcgcttttcaggcaaactatcaagtagtcttttttgtgtttttaaatattgatagacactgtcctacacgtaccaagatgacatccaccgcaacagttactgttccccccagaattacagcggagaatgtcgccacgctcttccccgaagttgatacatcgttggctcgggaggtcttcccctcaacagtagagggctccgccaaagacagcgaagagcttgctggctatgatgaggaacaggtccgtttgatggatgaagtatgcattgttctcgatgacgacgataagcccatcggcagtgccagcaaaaaggcctgtgagtatctcaatttattgtttttgtctttgggaccttcgcagaaacagtatactgaccaatgtgagcgatag

SEQ ID NO: 17000 - DNA, 840 bp, A.fumigatus
attgtcactatggttcgctctcaaggcagtcgctcgctcaacgcagatgagcaaacatatcacggtcgtcgcatgtccagctcccctctggcggaaacagcaattgctcgagatcttgaaaactatgccgataatgaagactccataaataacactgaagacgaagaacactccgaggcatcgaccgtacgtgcgatcaatagtcagcccggtacaaccccccattctttagttggctcttaccaacggcccagctttttcactactgtatcgcatagcacagttgttccgcaccgaggagagccggaatgtctttcgtggagggagcgcgaccaggcaatcgaagaggaaagacgacttctggcggataatcatgttattccggataaaatcagagcaggtgaccagaacggacggcggcgtagattcagcggccttctgtcccgcagcctcaggtctggagattcactggagtccagcagtggagtggagaggcgggagaggacggaagctgttgctgtaccaacagaaactacctctctgcttgaagctgggaatggtggctctggctatagcctgagagatgctgaagcgattgatcgaaagtgggaagaagcggtaattgccggtctgatacatacaacatggaagcgagaagctctggtgataagccgatacgctgctccgcttactgttacctttcttcttcagtattccctgacagtagcgagcatattcagtgtgggtcatcttggcaagaaggagctcggtgctgtcagcttggcaagtatgactgcaaacatcaccggctacgcaggttcgttcagttctccattctaa

SEQ ID NO: 17001 - DNA, 306 bp, A.fumigatus
gagtacgtattggatatcttgatggctttcggatttgctttcgcagccgttactgacacacaaattctagtcgactatatcctcttcattcaagcagatgtcgatctgaacgtgaaccctaacgaagtccgcgatacgaaatatgtcagcgcccaggaattgaagcagatgttcacccaacctggcctcaaattcactccctggttcaagttgatttgcaattcgatgttgttcgagtggtggagttacctcggcaccgccgacctggacaagtacaagggggagaaggagattcgccgcatgtga

SEQ ID NO: 17002 - DNA, 198 bp, A.fumigatus
ttcctcgataaggaagcaatcgatatttttgggtctacagaactggacaatgtcatcactttgaagtttcatgggaaaccattaattgtccttgcaggccataaaagctacgaaaagacgggcatcgagtcattcccccccccccatttttttccccaaaagccgactgcagctaccgtcgagtttccgctccagtga

SEQ ID NO: 17003 - DNA, 189 bp, A.fumigatus
ttgtgtcatatagtttaccaaggtttagcgactagcttggacactctctgctcgcaagcatatggatctggaaagaagaagcttgttggtctgcaaatgcagaagatggtcttcttcctttggactattaccattcctcttgcatcgattgtcttcacactcgccactagacggaccacgcataattct

SEQ ID NO: 17004 - DNA, 1008 bp, A.fumigatus
atccctaagtccgatgacccaaaatccgtctcggtatatagcgcggcagagtccctgttatgcacagtccagtaccaccaagaataccgccaagctatcgctcaccccaccgagtatacaatgcacatcttcataaccggtgcaacgggcttcatcggccgcgtcgttagtgaactcgctatccaacaaggccacactgttcacggcctctcccgcagcccccaaggcgatgagattctcacgtcgatcggggccatccccatccgaggcgacctagccacacacaacattctacgtgaacaatcggcaaaagcagacgtcgtcttccacctcgccttcgaccatgactttggcaaatcctacgaccaaatcatcaagctcgacactgaggccgtcgacgccctcgccgccccgctagtcggaacctccaagcccctcatcgccgcaagcgggatactcaccgtgcgccctgaccaaggtgactgcgtcgtcaacgaatcagcaccctataccaaaaacaccagggtcaggcggcatgtgtgcgaggagaatgcgctgtcgtgggcggagcggggggtgcgggtcaatgtggtccgcttgccgccgtatgtgtacggccgggcaaacgagacggggttcgcggcaagaatggtccgcatggcagttgataatggggtgagcgggtatattgcgtctgtcaaagacaggtgcgtgaccagtgtgtatgtggacgatgcagcggcgttgttcttgctgctggcatcagacaagacggttaaagccggagagatattccatgggacggccgactgggatacgacgtatgggatgctggccaaagctattgggcgggccagttggggtcccggtcagacaattcgagcggaagaagccgaagaaaagttggggggctttcctgtcaagcttctttgggctgataattcgggcttcgaatggaaagcctgtcgagaaactggggtggaaacccgtcaggcccaagcttggtga

SEQ ID NO: 17005 - DNA, 219 bp, A.fumigatus
gttgccaacctcgaagaagcggtgattatgttcttgtacggtacgtttcccgaatggaggtggaagaaaaaggcgagcgacaaaatctcatcaatgggtcacagagtctactatttgaacgtcactggtcaaaatatcatggtagacttgttttacttaatgcgtgatatagagatcgccgagtcctctgagcggaagaagaatctaacagtgagctag

SEQ ID NO: 17006 - DNA, 363 bp, A.fumigatus
ccgggaccccaactggcccgcccaatagctttggccagcatcccatacgtcgtatcccagtcggccgtcccatggaatatctctccggctttaaccgtcttgtctgatgccagcagcaagaacaacgccgctgcatcgtccacatacacactggtcacgcacctgtctttgacagacgcaatatacccgctcaccccattatcaactgccatgcggaccattcttgccgcgaaccccgtctcgtttgcccggccgtacacatacggcggcaagcggaccacattgacccgcaccccccgctccgcccacgacagcgcattctcctcgcacacatgccgcctgaccctggtgtttttggtatag

SEQ ID NO: 17007 - DNA, 432 bp, A.fumigatus
gttgaacggattcggtgtgttttccggacgtcagaacaagtgccaacaggccaggggcaggagttaccagcgggccaccacggtgtcggtttctattacgatatccagccgcttcttgctattcctgatgtcaaagcattcatcaacgtgcgcaagcatgccaagagtgatctggctgctgcagagacagtgattagcttcctggagcgtcacggccagggacaccacaatccacgggcttacctgaacgtcctccgggacatcgtgccggctgaggagctggagacgcgcgtgggtgcccaggccttctactcggttgcagtcaagaaggaggagctggacattaccgcgtactttattccgcaggtatatcgccgctttgcttccgtccaggtggagttgaatggacagcgacggagtagatttgagtaa

SEQ ID NO: 17008 - DNA, 222 bp, A.fumigatus
aaaatgctggacttgagccgtactacaaaccaaggcatccgcaatttcagcgcaacgcccaccgtttccgtccttaagtgtgaggccgatgaagattggctcatcgagggcacgcagaccccggcagtgggtaagggtacttctattgtggttggagccttgacagatataggcctgagctttgcatgtgctttccaagagacattagataccaaattctag

SEQ ID NO: 17009 - DNA, 183 bp, A.fumigatus
tcagtgtttgtatcattttctcccctgattaaaatgagagatcaggctaagccagcacatcaagacttagctggtaagaagattgacgtttctgccagaggactattagcctggatcaccttctatgcaatcataacggtgttgcaaatgttgttgacacactacaaggcagaaagggtttaa

SEQ ID NO: 17010 - DNA, 468 bp, A.fumigatus
ccaggttcgctatcaagtggtaaggcattcccctccttcctaagcgcaacgaccttaatttactctttctatttcagggattctgaggaggatgctccagccgaatacccacctgaccaacctgaagcggatctggaagacgacggcgctgcttacggcgctgaagaagccgaactcgaggctgcgctgatcagagagctcgaagaggctgaaagagaggccgccaagggcggtgaccacgagatggaaggggctgaggaaactgctggcaaggacgacgaggaagaagacctctccgacgcggagagtgaagatatagaggatgaaagtgacgatgaagaggatgaccttgacgaggatgagggtggagatcgtgatgaagatgtagagatgggcgatgacaccgaatcgaaagataccaacgccgccagcgggcatcatcaacagcaggacatcatggtgcactaa

SEQ ID NO: 17011 - DNA, 276 bp, A.fumigatus
cgctaccacatatcaatcaccatgtccgtggtctcccttctcggtgtcaagattgttaacaatcccgcccctttcctggctccgtatcaattcgagatcacctttgagtgtctcgaacaactccagaaaggtaacatactcaagatgttctttacagccgaggtcagattcactaacaaccgagttgccagacttggaatggaaactcacttacgtcggctctgctacatcgtaagtcaaagctgccagcatacaaatgcaggtttgctgtgctga

SEQ ID NO: 17012 - DNA, 363 bp, A.fumigatus
gtcaaagctgccagcatacaaatgcaggtttgctgtgctgacctgagtagttctgaatatgaccaagaactcgactctcttcttgtcggacccatccccgttggcgtcaacaagttccttttcgaggccgatgctccggacctgaagcgaatccctacttcggaaattctcggtgtcactgtgatccttctcacatgcagctatgacggcagagaatttgtccgtgttggatactacgtgaacaatgaatacgactcggaagagctcacccaggaccctcccgccaagcctataattgaacgaatccgccgaaatattcttgctgagaagccgagagtgaccaggttcgctatcaagtggtaa

SEQ ID NO: 17013 - DNA, 426 bp, A.fumigatus
actgcgaggtgtttagtgcaccatgatgtcctgctgttgatgatgcccgctggcggcgttggtatctttcgattcggtgtcatcgcccatctctacatcttcatcacgatctccaccctcatcctcgtcaaggtcatcctcttcatcgtcactttcatcctctatatcttcactctccgcgtcggagaggtcttcttcctcgtcgtccttgccagcagtttcctcagccccttccatctcgtggtcaccgcccttggcggcctctctttcagcctcttcgagctctctgatcagcgcagcctcgagttcggcttcttcagcgccgtaagcagcgccgtcgtcttccagatccgcttcaggttggtcaggtgggtattcggctggagcatcctcctcagaatccctgaaatagaaagagtaaattaa

SEQ ID NO: 17014 - DNA, 954 bp, A.fumigatus
cctgtcatggctgaagaagatgctgagaaagcctttttccaggctcagactatgaatgcggaatctgtggactataaagctgttgaagagcatggtgcagatagttcagattcagatgattatgatccttcaaaaacactccaagaccaatattcttcctccatgacagatctcaagcaaagtgaaaatgtttcttccagtgcctctccagagccaaaccctactgagcaaaactctgttcaaccagatcatgatcctagtcaaccggatggtgcatcctatccctctcagacacccccacgagatgagtctcggacttccactatggtaccaacgtctggtacatctgtgcagccgaagactaggacaatcggaggattcgtggttgaggatgaagacgaggacgatgcgggtgatgctgactatgagccccctgctgtacttggtgttgaggacatgaatactgttgctacgaatgtgcctcagcagtccgtttcaggaaatgaaaatgaagcttcttctacccctgatgtatccctggatgatgctgcgcaacagtccgccagcctgaacaatgtttcccataactcttactctcctgcccctgctgttgcccctaaaagcgatgtggctgttgccgctggacagagtttgtacaactcacatgctttacagtccggaaatgtgcaagacagcgcgaccgctactcctacgccagattctccttcgacctcgaaaggtcgcttgcctcacgatcgagtcggcatcttggaagaccggatccaagaggatcctcgtggcgacattcctgcctggctcgaattgatcaatgaacacagaagtcgcaatagatttgacagcgcgcgtgatgtttttgaacggtttttgaaggttttcccctttgctgtgagtacgctaaagtcacctcagcaccgatgggagaaagctgactga

SEQ ID NO: 17015 - DNA, 534 bp, A.fumigatus
agtcacctcagcaccgatgggagaaagctgactgatcctcaggccgaacaatgggtagcgtatgcgaaaatggagtccgaactcaacgatctttatcggcttgagcaaatcttcaatcgaactcttttaactatcccggatgtccagctgtggtcggtatacctggattacgtccgcaggcgcaatccattgacgacggacacaactgggcaagcgaggaggattatctcatccgcttacgagttggcgtttcagcacatcggcgtagacaaggattcgggttcaatctggtcagactacgttcagttcattaagtcggggccaggcaatgttggtgggtctggttggcaagaccaacagaagatggacctgttacggaaggcatatcagaaagctatttgcgttccaactcaagctgtcaatactctctggaaagagtatgatcagttcgagatgggtctgaataaacttacagtaagttcgagccataccgtgaaggttctccattttctgatatcttccccgccattatag

SEQ ID NO: 17016 - DNA, 738 bp, A.fumigatus
ccagagatgtggtttgatgcggccgagttctgcattctgaagaatctggaaagtgaaggaaatgaattcctcaagcagggcatggaagctaatcctgaaagttgtcttcttgcctttaagcgtgcggaccgactggaaattacatcggagtctgagcaagatcccatcaaacgaggtgcgaaggttcgggaaccctacgataaactacttgatgctttgtacgatttaattgcgaaagcacgtacgagagaagctcaagacgttgcacgccttgaagagacttttgcaaagatgaacgccgacaatccacctgccaaaactgatgacgacgatgacgatcaaagtgagtcaaaagcaagagaatcagtcaaaaacgcgcagatcgatgctgttcgcaaagcacacgccatacaaatcggcattctttctaagacaatctctttcgcctggattgccctcatgcgtgccatgcgtcgcatccagggcaaaggaaaaccaggggagacgcctggctcccgacaagtgttcgccgatgcgcgcaagagagggcgcattactagcgacgtctacattgccagcgccctcatcgagtaccactgctataaggaccccgcggccacaaagatctttgagcgtggtgctaagctcttcccggatgatgagaattttgcactcgaatatttgaagcatttgatcgatatcaacgacattatcagtaagttactgcagtgcccctaa

SEQ ID NO: 17017 - DNA, 783 bp, A.fumigatus
tggaatccgattcttaaccgtctcccagatgcgagagcagtgttcgagatgacggtcaggaagttggcgtctaaccctgataacgttcataagaccaagccaatatttgcatttcttcatgagtacgagtccagatacggcgatctggttcaggtgatcaacctcgaaaatcggatgcgtgaattgtttcctgaagatcctacattggaacaatttgctcaccgttactcggctcctactttcgacccgaccgctgttcggccgattatatcgccgtctcaaatgcggcccaaggcagttttccctacatcagagcaaccgatgtcccgccatggtacccccacgccgagatacccaggctcggtcacagactctcctaaaagaccactggaggactttgacgacgactacaaccggccccgcaagtttgtgagggctgaatcacctttaaagacctctcagcggcgacaactggaccagcagaagcgatcacaactcagcaatgtccagactggatcgcaattcagatctcaaggctcaccagctccgttacctcgcgatattgttcatctcctgagcatcatccctccagcctccgcgtacacggccggtagattctcccctgagaaattagttgatctcattcgtagaatcgagatgccgagctccatttcccagattcctcttccgcagtcggctcggggcctcgggactacacaaacaccaatgcagccattttccggtaaggcttctccttctctttccgttcgagctgtctactag

SEQ ID NO: 17018 - DNA, 612 bp, A.fumigatus
tgctgccattgctggccgtttcggcctttgcctccctcggtgccgcgcagacctacaccagctgcaaccctaccaacagtaagtccgctcgtgggagtaaacctcactggactaacaagagtagcaacgtgtgaccccgacacaggtctgaagacatggagcctatccaccgatttcacccagggcagctcggatggatggacggccatctcgggcaatgtcacctacggcagcaacggagccgaattcaccatcaacaagcggtacgatgcgccgacgcttgagaccaacttttacatcttcttcggcgaggtcgaggtcgtcatgagagcagccaatggcaccgggatcgtcagctccatcgtcatggaatcggatgatctggacgaaatcgactgggtgagtccggttctcgatgataccacagaaagaatactgatgaagataggaatgcactggaaccgacactacccagatccaaaccaactactttggcaagggcaacacgaccacctacgaccgcgcaatctgggagaccgtcagcagccctcaggacgaattccacacgtacaaagtcgtctggaccgctgcggccatcacctggtacattga

SEQ ID NO: 17019 - DNA, 1209 bp, A.fumigatus
aatttgagcatgactggcctatcttcctacgacgaaattctcaattccctagaggaggacagctactacgccgtcagcagcaacgatctctctccctctctccaagcatggtccaacaacacagacctggaggaactcgacctcagcagcctcaacctctcttctagctcagactcatcctcatggatcgaccctttagagtcggcaataacagacacccgcaacggctcctcgcccgtcctcagcaccctttcgcagttcacagccctcctcgcccaaaccggaatccacggcccccgcatcctcaaagccttcaatctctccagacgaggtacgaaaattggcgcaggcgcccagttcaccgttttcaccgaccccatctacgaaggccaggttatcaagcgcgtcaatgtcccactctccagtaaggccgagcagcgcttcgccgcgagcacggactaccgcctgcagctgcgcacgctggggctggaggttttatcgctgtgtaatccgatgctgcgcgcgcatcccaacatcaccagtctgctggcgtggggattcgatttcccctttgcggatatggcggtgccggtgctgttcatggaggctgcgatgatgcccttatccgattttctgggcgcggagactcgtgccgtggaggtgcggtatcagctctcgctcgatgtcgcgaatgggctagaggcactgcagaacttgaatatcgtgcatggggacgtgaagccggagaatgtgcttgtgtttgcgggtccgagcgatcgggtgcccttccgggcgaagttgagtgattttggggtctgcctggatctggaggcgccggatgcgaagttcatgttgagtgattaccggggcacgcaggcgtggctggcgcccgaggtggtgagtgaggatctcgataggttcggggggttttcctcagagttgatgttcaggttcgatgcgtatagctttgggctggtgctgctgtctgtctttacggggaacggcgcggccccggttctggatgagcatccagagaatgttcctgatcaggtttttgaattgctttatggtcaggaggacattccgtcgaacatccgcatcgagctgcggaaagcgatagcaaagcttctgtcagaagatccacggaaacggccacttcccagtccaggcttgatcaaaactgatagccctacgtacgcagcttggtag

SEQ ID NO: 17020 - DNA, 738 bp, A.fumigatus
gaatgcactggaaccgacactacccagatccaaaccaactactttggcaagggcaacacgaccacctacgaccgcgcaatctgggagaccgtcagcagccctcaggacgaattccacacgtacaaagtcgtctggaccgctgcggccatcacctggtacattgacgggaccgccgtgcgcacactcgagtatgccgatgcggtcgatgggaagaactacccgcaaacgccaatggtcgtgaagctgggcatctgggccggaggtgacccgtccaacagcgagggaacgatcgagtgggccgggggagagacggattacgacgaggtcccgttcacgatgtatgtgaaatcggtcaacatcatcaactacaaccctgcggcgtcgtataactacacggacaagaccggctcgtataccagtattgtggcctcgaattcgacgaccggcagtggcatccatagctcgaactcggttagtgtgttcgctccgtcctcctcgacttccaccttcacctcttctcgagcgttgattgctacggcgagtacttacccggcctctgtgcagacctcgagcagtggagtcgttagcttgtcctcttcgtctgcgtcttcttcctcggctgctgcttcatcgacctctggtagtgcgtcggccgtattcactggtgctgctgtggccaatctgccctcgttcttctttaccgttttctttgccctggctatcgcacttgcgttctaa

SEQ ID NO: 17021 - DNA, 315 bp, A.fumigatus
ctgtatgcagtatctgtagtttacatgttaatcccccccgcaagaacatccacaaccttctcctggaaatccaccgccaacgccgggccctccctccccctaaactcccccttcagacatgccaacacagccttcgtataccccacccccatctccttcggcaacccctgctgcgccagcgcaatcagatcctcaagcaccttcttcgacctcggcaggcgcccgctcgtctccgcctcccggatcctcgcctccatcagccgcgacatcgtcacccacagcccgatctccagcaggaccaccccaagcgcatag

SEQ ID NO: 17022 - DNA, 405 bp, A.fumigatus
cagacacccgcaacggctcctcgcccgtcctcagcaccctttcgcagttcacagccctcctcgcccaaaccggaatccacggcccccgcatcctcaaagccttcaatctctccagacgaggtacgaaaattggcgcaggcgcccagttcaccgttttcaccgaccccatctacgaaggccaggttatcaagcgcgtcaatgtcccactctccagtaaggccgagcagcgcttcgccgcgagcacggactaccgcctgcagctgcgcacgctggggctggaggttttatcgctgtgtaatccgatgctgcgcgcgcatcccaacatcaccagtctgctggcgtggggattcgatttcccctttgcggatatggcggtgccggtgctgttcatggaggctgcgatga

SEQ ID NO: 17023 - DNA, 765 bp, A.fumigatus
gaagattcagatccttcactagtatgttctccgtcccctctcgagaatgatctaaccgcagcagtccctttgagcttccccacgggtacacctctgcactgggcttgtttcttccgcaacctgactgcggtcgaagccctgatttctctcggtgccaatatcaacgcaagctatcatgcctcggatgcatccaccactcctcttttcttgaccgcgtactttggtgaaccctctcttgccaaatacctgatctcccacggggccgatgtccacctggtcgactccatggggcgcaacgcgctgcacggaatcaccaagtacttccccgagcgacatggctatcttccgcaccactggcactactggatccgtcatggcagctgggagcaccacctgactcaaatgacggagttagtcaagatactggtggacgcaggcgcggacctcaatgctaacgacaagggatatccaccactaacccccgtcgcggcggctgcggaccttggcgtctgggacggaggagtgatttgtgcactgttagacgcaggggcagacttaggtgaatccgtcctgtcagctggaaacacggttctacattcgtgggcatctatagtgggaccccgtctcgcttatcccgattcctacctgtcgacgatgaagaaaattgtcagcgccacgccagatattgacatcccaaacaagtttgaaaaggatactccactagtcttcacccggggctggaaggatccgcgctggtgcatcaaa

SEQ ID NO: 17024 - DNA, 189 bp, A.fumigatus
actcatacactcgtttatgttcacatctgctgccaacagccttacagtaacatgatgctgccattgctggccgtttcggcctttgcctccctcggtgccgcgcagacctacaccagctgcaaccctaccaacagtaagtccgctcgtgggagtaaacctcactggactaacaagagtagcaacgtgtga

SEQ ID NO: 17025 - DNA, 984 bp, A.fumigatus
ccctacgtacgcagcttggtaggtgatgtgttcactggattatcaggaaagctgacgattaggctctcctccatccaattgacacctacaaacacgcacgccggcatcatggatccaatttacaacaaaggtcccttgttctggtaccgactcgatgaaagcattcggacagagctggaagggcaatacgccctgatgcaagagggaaacgcaccgccattccccggtgacgtgctctttgggctggcacagacgattaccggcgccaagccgtcgtatctcgaccggctgctgacgtatctaaccgaggcagccagagcaggatactcgcctgcaaggggggtatatgcccagatcatggaggcgcatggccagaagccggagtttgcggaggatgtgctgggggagtggatgttgcaggctgtttccgaggggtatttctttgcgagtcccagttactcgaaggggaggatcgaggaagcgcgtgaacggttcagggccaatggagggttctgttcagatccatttctcgcgaagaaggatgttgtcgaggctgcgggggaccggaccaaagcgctgaggcggacgatggagaatggaagtgttgtcgatcggaagggaaacacgatcctacatgctgcggctgcattgggagctattgacgccgttcgaggactactagacgacgggcagctgcccgtcaatgtggagaatgaaaagggagaaacgccactgtacaaggcatgccaagctggccacgcaaaaatcgttgaattattgcttgaccggggggctgatgcttcgactatgactcggcaggacaagttgagtccgatgcactggctgtttatgattcctgacgcttctatccctgaaatcgcgagactaatggtcgaaggaggcgcggacatcaacgccaccattgagcctgttgtaaaggagaacagtgctggattccctgagaagattcagatccttcactag

SEQ ID NO: 17026 - DNA, 231 bp, A.fumigatus
gcgagacggggtcccactatagatgcccacgaatgtagaaccgtgtttccagctgacaggacggattcacctaagtctgcccctgcgtctaacagtgcacaaatcactcctccgtcccagacgccaaggtccgcagccgccgcgacgggggttagtggtggatatcccttgtcgttagcattgaggtccgcgcctgcgtccaccagtatcttgactaactccgtcatttga

SEQ ID NO: 17027 - DNA, 1851 bp, A.fumigatus
tctaagttgacgacgatgcctgtgtgcggaaagtcttgtataaataccggggcatctgttggcgtcatcccacgtggcgccgttagtgctgacggtcagcctcacgcttcaccaaccaacccctctcgacctcgtctgactttctcctcttgctcgggagtcgtcgatgagcaagccaaaatggacatctacggtacggccgtaaccgcaatcacccaagtctaccaggtaaccatcttcatcaaaggcgtcgtctccgacatcaaagcctttgacgacgaccgggccgagatccagctgaagctcaatctccaactcacgaccttgcttttcttcaaacgcatctgctttcatcccgagcatggcctcctcctcccgggaaagctggacccgttcatcgccgacacggtcgaagggctcctggtgcagatgcgaaagaccctggccgagtacgagctcgtggcggccaagtacggtctcatcgatgacgaactggccatcgagcccgacaagcccgccacgacgcaggagtcgctgctggagcgcgcaaagagcaaggcccgatcgctcaagctcaaggggtacgactggtcgctctttgacaagaagaggctgaaccgcattctggacgcgtataccaagtggtccgaggacctgcgcaacatcatgctgcacatgtcgcaggacacgttggccaagatggccgaaagcgaccaccagggattgcgcagcagtggtctggagccggtgatgaagcgccggacgctggccgcagccaaagcacccgccgattatcagagtttgactgggaccctcgccgaagaaggcaagacgatgggcggctttcgcctggggaagtggacggcgtcggaatccgaggcgatgccggtgattgtcgagtaccacgagtacgagagcaggcttaaacgcgacgatctcgaaccggacgagatcgaagaactcaaggaaccgatccgcaatctcgcctggctcctgcagaacacaaccttcagcggcacgtcagccaactcccttgaccagccgaagatctacgccctcgaatgtctcggcttcctcgaccaacccaccgacgagcgcaccgtctttctgtacaaactgcccccctccgaaccgactaccccagacacgaccctcacaaccctgcacgccttcatcaacgccgtcgacagccagaccaaacgcccactcaagaaaccctccctcaacgaccgcttcagcatggcccacagcctggccctgaccgtcgccaacctccacgcctccgcctggctgcacaaaaacatctggagcagaggcatcctcctcttcctcgagacacccggggggaccagcgcagccggcctctacgcgcatcgccttgccccgtccccaaaggacaacacccgaatcgtctcctacctcagcgactggggctacgcgcgctccgtgcagcaaggcaccgagatgcgctccgacttcgaggtcgagccaaacctctaccggcatccggaccggcaggggcggccgtcgcaccagtttagccgcgagcatgacatctatgcgcttggggtggtcctgctggagatcgggctgtgggtgacgatgtcgcggctgatggaggcgaggatccgggaggcggagacgagcgggcgcctgccgaggtcgaagaaggtgcttgaggatctgattgcgctggcgcagcaggggttgccgaaggagatgggggtggggtatacgaaggctgtgttggcatgtctgaagggggagtttagggggagggagggcccggcgttggcggtggatttccaggagaaggttgtggatgttcttgcgggggggattaacatgtaa

SEQ ID NO: 17028 - DNA, 339 bp, A.fumigatus
ccgtcgccaacctccacgcctccgcctggctgcacaaaaacatctggagcagaggcatcctcctcttcctcgagacacccggggggaccagcgcagccggcctctacgcgcatcgccttgccccgtccccaaaggacaacacccgaatcgtctcctacctcagcgactggggctacgcgcgctccgtgcagcaaggcaccgagatgcgctccgacttcgaggtcgagccaaacctctaccggcatccggaccggcaggggcggccgtcgcaccagtttagccgcgagcatgacatctatgcgcttggggtggtcctgctggagatcgggctgtgggtga

SEQ ID NO: 17029 - DNA, 711 bp, A.fumigatus
agcagcagccgaggaagaagacgcagacgaagaggacaagctaacgactccactgctcgaggtctgcacagaggccgggtaagtactcgccgtagcaatcaacgctcgagaagaggtgaaggtggaagtcgaggaggacggagcgaacacactaaccgagttcgagctatggatgccactgccggtcgtcgaattcgaggccacaatactggtatacgagccggtcttgtccgtgtagttatacgacgccgcagggttgtagttgatgatgttgaccgatttcacatacatcgtgaacgggacctcgtcgtaatccgtctctcccccggcccactcgatcgttccctcgctgttggacgggtcacctccggcccagatgcccagcttcacgaccattggcgtttgcgggtagttcttcccatcgaccgcatcggcatactcgagtgtgcgcacggcggtcccgtcaatgtaccaggtgatggccgcagcggtccagacgactttgtacgtgtggaattcgtcctgagggctgctgacggtctcccagattgcgcggtcgtaggtggtcgtgttgcccttgccaaagtagttggtttggatctgggtagtgtcggttccagtgcattcctatcttcatcagtattctttctgtggtatcatcgagaaccggactcacccagtcgatttcgtccagatcatccgattccatga

SEQ ID NO: 17030 - DNA, 249 bp, A.fumigatus
cggagttgtgagagcaggtctggcgtcttcggtactgcttcagttgcctgtcattctttcatgtcgttttacgtcattgcggcggtggactggcatttgagtcattgggagaacatcattgcttactgtggtggtttcgtgtacataggacacattacatacactgggcaggttacaggcctggcttatcaccttcaatcttttcattactcaatttatgattttcacacccttcagacttgctattga

SEQ ID NO: 17031 - DNA, 1386 bp, A.fumigatus
  unsure (171),(208): Identity of nucleotide sequences at the above locations are unknown.
aacagttggaatgggaaaaagttttttggggccaccaatttgttcaaaccataccggcaggggacgttcacccaagaccagtgccaaggttgttcgggaagaaagcctgtgcctttcgcagcagcttgggggagtccggagggtaccaacccccaccggggaccccagttntggatgacctgcgccatacagttggaggaagagcccntgaatcgcatcttttcccgtccactgtcattccgttggccgttcaaagaacgccaactggatgatgagagcgtctacgatgacgcttccacaacttcccctgactatgccagtacgcacgagtcggtatatagcaaacagtccgtcaagtctgtttcaaagcccagaatgggcgtcatgaagaccgtggggactgagcccaagaaagaccttgtcattggggacgcccgttatacgctcgatgagccgtcgcaaatcgatccggacattccaacggtagatttcgggccaacacttacctacctgcccaccactggacgtccgagcacgtcggacactctgaagaagtttacgcatcataagaccggctcggatgccacggaaaaacagcgctatgcggtgccaacacatcccatcaaccacactcatgcaaggtctcccagtcaagacgaacaccggcggagcattctatggcagccaggcatggcacgtccaacgacccctggtggcggtctttccccagaacaatttgtgcagcagcgagctgcccctagcccgccaatccatctacaccaccaccgggcaccttctgcgactcctccacctcggagaccgctctcgggagactggatggcccatgctcgctccaagtctcagatgactatttccagagatccccaacctcgaccccattcccgtggcgccagtagcatgatgaacttcaacgacatttcatcccacctctcggctcgggagcaggagcacgtggctcgtatgacaggatcttctttctttgatatctcgagcgacaagagcaaacaggcacctcccgttgatccaatgggccttgttggtgcgattgatgctcgagagcgcgagaagcagagtattaaagaagggatgtcgaaccagctggtgcagcacgcaatcgcgcaacggcaacaacactggcagcaccaccaacagcggcaacttgccacaacaccacctccgcagaattacgggctacaaagtggcgttcatggcaatgtttacaatctccctgctgcgagtcacacttgggatgcgctcaatcaaacttatcgtgctgatgagcctcgccgtcagtcttggtatgggccatttgcggctcagggcaccggcaaacaccgccaatgtatccccaaagccagcctctga

SEQ ID NO: 17032 - DNA, 312 bp, A.fumigatus
  unsure (7),(8): Identity of nucleotide sequences at the above locations are unknown.
gcggggnnttttttttatggcgcggctccttccagccccgtggtgaagactacgaggcttgatgctttcgccaaaacagtcgaggatgctcgcatccgtaccacctccggaggtatcatcactttggcttctttggtagtcatcctgtacctggtttggggagaatggctggattatcgacgggtagttgttcttccagaactggttgtcgacaagtcgagaggtatggaccttcgaagaacagagaacatgggtatacgggctgatgcgaacgatggcattgaacaggcgagcgaatggaaattcacatga

SEQ ID NO: 17033 - DNA, 963 bp, A.fumigatus
caattgtgtgcgtccgctagccactctaaagaggaaatcgccaaacacctcgacccaaactactgcggcgactgcggcggcgcagaccctctccccggctctatcaaagaaggctgctgcaacacttgcgacgaagtgcgcgaagcctacgcagctaagaactgggcctttggcaagggcaccaacatcgagcagtgcgaacgggagggctacgcggcgcgcatcgacgcccaacgccgcgaaggctgccgccttgagggcatcctgcgcgtcaacaaggtcgtcggcaacttccacatcgcccccggccgcagcttcaccagcggtcaggtccacgcgcacgacctgcaaaactatctcgactccgagctcccggacaacgaaaaacacactatgacacaccacatccaccagctgcgtttcggcccccagctccccgacgaggtctccgaccgctggcagtggacagaccaccaccacaccaatccgctcgacagtacaagccaggagacgaacgacccggcctacaacttcgtctactttgtgaaggtcgtctcgacgtcctacctgcctctgggctgggatccgctcttctcgtccgctgcccacaacgcccacgatcagactcccctaggctcccacggcatcgcgtatggttctggcggcagtatcgaaacgcaccagtactcggtgacctcgcacaagcggtccctgcgcggcggcgacgcctcggacgaaggacacaaggaacggctgcacgccgcgaacggcatccccggcgtcttcttcaactacgacatctcgccgatgaaggtcatcaaccgcgaggcccgccccaagagcttctccggtttcctgacgggtgtctgtgccatcatcggtggtactttgactgttgccgcggccattgaccgtgggctgtacgagggcgccctgagggtgaagaagttgcattcgagctga

SEQ ID NO: 17034 - DNA, 501 bp, A.fumigatus
caaggtgcgcctgagttctcctgccgagggaggccgtgtgctggatgttcaagctttggacctgtaagcagccaatttcttttaccgttggcgtccactgctaacaattgtgtgcgtccgctagccactctaaagaggaaatcgccaaacacctcgacccaaactactgcggcgactgcggcggcgcagaccctctccccggctctatcaaagaaggctgctgcaacacttgcgacgaagtgcgcgaagcctacgcagctaagaactgggcctttggcaagggcaccaacatcgagcagtgcgaacgggagggctacgcggcgcgcatcgacgcccaacgccgcgaaggctgccgccttgagggcatcctgcgcgtcaacaaggtcgtcggcaacttccacatcgcccccggccgcagcttcaccagcggtcaggtccacgcgcacgacctgcaaaactatctcgactccgagctcccggacaacgaaaaacacactatga

SEQ ID NO: 17035 - DNA, 189 bp, A.fumigatus
acaggcgagcgaatggaaattcacatgaacatcacctttccccgactaccatgcgagcttttgacccttgatgtgatggacgtttcgggagaacagcaagttggcgtggcacacggcgttaacaaggtgcgcctgagttctcctgccgagggaggccgtgtgctggatgttcaagctttggacctgtaa

SEQ ID NO: 17036 - DNA, 744 bp, A.fumigatus
ggaacctccccgccgctcggtttgtctccgctccactttcaccctgaacttctgggtcggtggcctcgtgggggactatcacattcggctgctattattactacttttattggtgtctccataattctagacgagtttttagtcggttccagactaaaggggagaaaggctagcttggggtgcaaaaaaaagctggaaagtcagcaggacggaccgttgggaccgcccggagaaatccatcacgtcacgttgtcttgtccgtcctcccgtctagcaatggcagctgcctttgacgacgaggacctttctgtctccctcccttcctacaattccgatcgtcatcgtgaatgtcccattggagccggtcctcctcctaacgcctcgaattatcctgccaggccaatgcctccgcccacacgcccgaccgggatggccgccgacccctccaagcagtccccggcgaccatgagggacatgcagcggctcgatcagtaccagacggttaagattctgggcgaaggctcgtttggaaaggtaaagctggcgattcatcagcctagcggccgtcaggtcgctctgaagatcatctcccgtcgcaaattgctatccagagacatggtcggtcgtgtggagcgggagattcaatatctgcaattgctacggcatcctcatattatcaaattgtatgttcaagtccgggtcttgtctgtgttcacggatagaaatagactaatgctttcttga

SEQ ID NO: 17037 - DNA, 852 bp, A.fumigatus
cttcgcaggtacactgtcattgctaccaaaaccgacatcattatggtcctcgagtatgccgaacgagaattgttcgattacctggtcaaaagaggccggtgcaacgatgcagaagctcgcaaattctttcagcagatcatctgtgccgtcgaatactgccaccggcataaaatcgtgcatcgggatttgaagccggagaacctgcttattgacaaggataagaatgtcaagattgcggattttgggctgagcaacatcatgacagatgggaatttcctcaagaccagctgcggcagtcctaactatgctgctcccgaggtcatctctgggaaactctatgctgggcctgaggtcgacgtatggagctgtggcgtgattctctatgtattgttggtgggacggctcccatttgacgacgactatattccagccttgttcaagaagatcgccgcgggaaatttccacatgcccccgtatatttcgtctggagcggctcgcctgatcagatcgatgctccaagtccaccctgtccaccgaatcactattccggagatccgccaggacccttggtttctgcaggacctacccaaatatcttcaaccccctccggaagaattcattgctaccggggtggatccgaacaaggctatagaccttaagaagattgccccggggaagcccctctcggtgcagcacaagatccaccagattgccatctccaagttggagcggagcatgggatatgcgcgggaagatatcgaggatgcactcaagagccccgagcccagcgctatcaaggatgcttttttcattatcgtagaaaacgaaatgatgcagaccaattgtgagtga

SEQ ID NO: 17038 - DNA, 648 bp, A.fumigatus
cagcgggcagctcccacagaggacaacctgatgggtggtcctgtcgcaccttcacctcccccgaaccgaactcctttgactacacctgcagttggccggcccgctgcaccccgcccccaaggattccctcattatgattcacatcgcgcgccctcacaagcaccacaacaggccgattcggatgacttcgaaagttcccgaatcagccatgttcgcattctgccgaccagcttgccctatgtgcatgatcaactcatggaacaacgggagcgggagcgggagcagcgggcacgtgacgcgggccgattacgagaagaacgtgctcaggccagtctcgacgacgatctttccggcgcacggtcccccgaggagcaggaagcaagcgctcgagcgttgaaaccgcactcccgtagtatcatagacttgaacaaactgcgcctggaaccgccagagggtcggagtgcaccccagcagcccaagaggacgcgcaagtggcagtttggtattcggtctcgcaatcaaccttacgaggcgatgctctatctatacaaagccattgccgcacagggcggcgtgtgggagatccagccctccgaagcaggttcgttttcttccacgttactgactcacgtacgtgttgtgaactaa

SEQ ID NO: 17039 - DNA, 1089 bp, A.fumigatus
ccggtatcaccatgtacaaggtacccgtcaggccacgtgggtatatccccacgaacctaccaaggttccctcccggaagatcacgtcgatcatcctcgtagggcaagaaagatggctcccaatctagctccatcgaccctggagtttatccgtgacatgattttgagcaatgaacttactcactcgcagattgccaatgcggctggctgccatccaagtactatcactaggcatgtcaccaacatgaagctgtttggaaatgtgaaggcacccccaaataagggcggacgcccacgaaaactcacaccggttatgattaaagccctctgcgatcacctactcgagaagccccatttataccttgatgagatggcgatttttttatgggacgagtttcaggtgcatgtaaccacatgcagcattggtcgtgctcttaggcgtgaaggttggtccaaaaaagctgctaaatacaaagcaagagagcgaaacgcagatctacgtgacacgtacttccattttatatcagacttttgctcataccatcttgtgtatgtggatgaatctgggtgtgacaagaggataggattcagaagaactggctggtctcctcttggtatcgccctaactcaagtcgccaaatttcatcgtgaccagcggtatcaaatcctcccagcctacgcccaagatgggatcgtcctgtccgatgtttttcaaggctccaccgatgcgtctgtcttcgaagattttatagaggagctgcttcatcattgcgggagatggccggagccaaaatctgttctcgttatggataatgcctccttccatcactctgagagattagagcaaatgtgcgcaggagcaggggtacagctggtatatttgcccccgtattcgcctgatttgaatctaattgaggagctcttctccgaactgaaagcctttgtaagacggcattggcaagtgtacgaagataaccccgaccaaggctttgattctttccttgaatggtgcattgaaaccgtgggtgcgaggaaacagagtgcaaaaggacatttccagaatgctggtctgacaatcgaagagatttag

SEQ ID NO: 17040 - DNA, 204 bp, A.fumigatus
tctttaaccaggacctttctccctctcctcgagccagagtttagtgtggctgacgaatcgccgtgcaacaccaatttttacaccctgcttaacgaagaactccgggttttccgtgcggatttgtccaaggtcaagacagttctccaacgctatatcacgcgcttttttaatattttccttatagctgtcactgttcacccgtga

SEQ ID NO: 17041 - DNA, 1110 bp, A.fumigatus
cttctggttctcatatatctttttgttgttgttggcctcgtcacccctgctcaggcctatatctcgtacactatggcgggtaagacctgtctttcacatgatgattatacagttggatggatctgcgccttaccactggaaatggccgctgcaacagttatgctcgatgagaagcacgagaaattacgcaggcaaccgaatgaccacaacgagtatgttcttggacatattggggaacataatattgtggttgcatgcctgcctagcggcgaatatggaattacatctgctactacggtagctatgcagttgctgtctagtttccactcaattcactttggtcttatggtcggaattggaggaggggtcccgaaggaggataaggatatccgacttggtgatatcgtggtcagtgagccaacttatactcatgggggagtagtgcaatacaattacggcaaagcattgagtggcggcgaatttcgacggacaggcatgctcaaccgtccgcctcagagtctcttgacggcgctttctaaactacaagcgactcattacacaaaaccaagccaagtgattaattttcttgctgagattgagcagaaactaccaacagaacaagctgcaaactttgctcgtcctacacagacagatcagctattccttgataactatgagcataccaacacccacactcaaacttgcaatggctgtgatacaacccaaaccatacggcgtcagtgtcggagccacaataatccttttatccactatggattaattgcatcggcaaatcaagtggtgaaagacagtcaactacgggataagcttggtcgcgatttgggtgttctctgcgtggagatggaagcggccggactcatgaacaactacccatgtctcgtaatacgtggaatttgtgattatgcagactcacacaaaaataaggagtggcagggatacgccgcggcagtggcagcagcatatgcgaaagaattgctactcacagtgtctgcggatcagaccagaaacacaagagctataacgaatgtgccacctccgcccacagtaagcggccacagtctcatcataatatatgtcgatcttatctaa

SEQ ID NO: 17042 - DNA, 345 bp, A.fumigatus
gatgttatgttcccgggtggccagcaaatttacgttgacccatctggtgccgtcaagttcaccaccgctcactccgccagcatgccccctggctccaccgtcgagggtttctcctacacttccggtgacccattaggccactggaacttcagcggccagggcgccaccggcttcatggcttgccctactcagggtgatgctcctgctccctaccaggtctttgctgccatcagctccgcgaccgttcccactggcaatgtcgccgactgcctcggattcgatgcggccgctattgcctggactccatctcaggggcagactgcagccgcttggcagtacacgtag

SEQ ID NO: 17043 - DNA, 312 bp, A.fumigatus
ttaattaaatcagggctatacaagcccccctatagtactaatatactaagtaatttgcctttaggggccgccgcttcgggaaactgcctccccggatgcggaaatgccggccctcaccgcctcatctctcgccgctatataggcctcccctcccgccctcgtaaccgtcacgtcctgttatccccctcaattttacgcccgtctcccccaacgctcgccgcgacatcccttgtggactcccacggcgtccagcccactattgtgtctagcgcttctcccgtgtatcgcctctatcgactaaacgaaggatag

SEQ ID NO: 17044 - DNA, 1275 bp, A.fumigatus
actgacacgcgtaggcggaaatactaccaacgcaccaatgagctcgtgtcacagtatctatacatcgatcaactgctggactcatcgctgccacaccaattgatagatgaatacagtcatgaccacgatatagtcgcccacctctggaccaggggccgagagcagaatggtgagggtccacctgcagacacctcaagccggaagatcaaaaggactccacgtaacctataccgtattccaaacgaacggtcaccgttgctacagccaacgatcgaggaggacaccccgtttcccgaaatcccttccccccatgctgctgagcatgtccacagcggcgatcgcattgtcaccgtcgccatctatatcaacttgctcgccaatgtgtttttgttgggtgccaaaatcgccgtcatgagtttgacgagttccatgtccgtgttggccagtttggtggacggcgcattagactttctgagtacggttatcgtgtggacgacaaccaagcttgcgcagcgtcaggaccggtaccgataccccatcagtcgacggcggctggagcctctcagtatcctagtgtttgcagtagtgatggcgacctcgtttgtgcaggtggccatcacctcgttggggcggctgctaggcccagaccacaaactggtgcaactctcgctaccagcaatcttcatgatggctagcactgttgtggtaaaacttctctgttggttttggtgccgattgatcaagaatactggtgttcaggccctagcgcaggacgccatgacggacgtgatcttcaactttttcagtattctcttcccattgggtgagtcgtatatctctagatgtggccgacgcgagctgacagataaatcagtgggcttttttgccaattggtggttcttggacccgcttggtggtctcctgctctccgtctacatcatctggaactggagcgggaccgccgccacgcatatccgccatctcaccggcgccgctgcctcacccactgatcacagcgtcctcctgtacatgaccatgcggttctctaaaatcatcaccaaaatccaagatttgaaggcctattacgcgggggatcacctcaatgtcgaagtggacattgttgtagatgagcggacgagcttgcgcgatgctcatgacgtcggtgagagcttacagtacatgctggaaagcgtgccgactgtcgaccgtgcgtttgtgcatctggattatgacccgtggaatatcccaagccatatgaatcaattggaagcatag

SEQ ID NO: 17045 - DNA, 186 bp, A.fumigatus
ggctgccaaggaggctgcgtaagctcccccctgtttcctttagccccagcgctcattgggaatccgctctcgctaacattctccaacagtaacgactacgccaagctcctggccacccgtgtccacgaggagaaggctaagcgtgacgagctccgcaagcggagagcttcttcgatgagaaagtaa

SEQ ID NO: 17046 - DNA, 342 bp, A.fumigatus
ttgacacttgtcattacagccatcaccaacttcgacctcgccgtccttgccctgagcatcgtcaagcagggtgagagtgagctccccggtctcaccgacaccgttgtccccaagagacttggtcccaagcgtgccaccaagatccgccgcttcttcggtctcgacaagaaggatgatgtccgcaagttcgtcatccgtcgtaccgtcacccgtgagggcaagcccgactacaccaaggcccccaagatccagcgtctggttactccccagcgtctccagcgcaagcgtcacaggattgccctcaagcgccgccgcgctgaggctgccaaggaggctgcgtaa

SEQ ID NO: 17047 - DNA, 237 bp, A.fumigatus
ccgcgcacacccgtcaagatgaagctcaacatctcctacccggccaatgggtcgcaaaaagtcatcgaggttgacgatgagcgcaagcttcgtcccttcatggagaagcgcatgggaactgaagttagcacacccccagacatattctgctttacgtatccggcacctcgaaagcacacaagagaactcttctcagccgaaagaaaattgaatatcgaatggagaacagaagactga

SEQ ID NO: 17048 - DNA, 741 bp, A.fumigatus
tactcctgtcaccatgaaaacatggcgcaaacagcaaaatctctcagaggaaattacattggctccgttgtggacaacgagaagctctcaaacaccatgctcaatatgtacaagacaccgctggcggattttaaggcgcaagtaaaacaatggacgacggcggagagagcagccctggagtccttgtccgacgagaagatcgcatcccgtcaaaataacactattgttgttgtctcgtttgggatctgggacttatggaacatgatcggaaagagctacgaagattcgatcaatgtggtcgatcatagtatccaggtgatcatggaccagctcaatgtgctctctcagctctgggtcataaataacctcaaagtcattctcacactgacaccggatgtgactttccttccagcatttaagccgacagcagccgaacagcgcgtcagtcactacaaagacacggtcaagctgacggagtattggaatcacaaattgcgtgatgctgcagaacaatgggtgcaaggcgccatctacctgttcgacaccaatgcatttgtggcggaccttatcaaagactggcagctcttcgctgccggggtggaggaatccaacgggcttggaaaaaatcaggatccgggctgggtgaacgttgaagacgcatgcgtccagagtggccagcaatgggtaatggccaccaaggagaaacaatgtgaaaatccggacaagtaccttttctggtga

SEQ ID NO: 17049 - DNA, 198 bp, A.fumigatus
ctcctctgtccacccgagacatcgtttgaggctttgatttattttctgactgtcagccagcaattcctggtgcttcgcaaggtctacgaagaaccgcttctcatctttgacccgatgtctcgcatcgtgatcagcaagcgaatcggggctgacaacaccagagtccatggtggaatcctcatcactatactccgatag

SEQ ID NO: 17050 - DNA, 1728 bp, A.fumigatus
tgggcccaagtaagggttttaaagtttcccagatttaatataatgattttaggggctcccatttcttccattcttaacaagaaccgggccaagattttaaccagcaaattcgagcgtatattgaaagaaagggctcgcctaaagaaactggacctcacgcatgacctaagaaaggccgacgagttgattgctgaattggaatcaacgagagatctgtctcagtacgtggtacatgttgactgtgatgcattcttcgcagctgttgaggagcttgaccggccagagctcaaaactgtccccatggccgtcggaaagggagtcctgacgacgtgtaactacgaggctcgaaagtacggatgccgcagtggaatggcatcctttgtggccaagaagctctgtcctcagttgatctgccttcctcagaactatgagaaatacaccgccaaagcacaggagattcgtgttattttcgcgcagtacgatcctctcttcgagagcgcgagcattgacgaggcatatctcaacattacttcttactgcaccgaaaacaatctcgatccggaagaggccgttagtcgtatgcgagcggagatcttggaaaccacgaaaatctcagtctctgcaggtatcgcggccaacgcgaaggtcgcgaagatctgttccaatcgcaacaagccgaacggacaatttcgtgtccctaatgagagagaagctattatggagttcatgagaactctcccggtccggaaagtgaacggcgtcggccgcgtgtttgaacgtgaactcgatgcaatcggcataaagacatgcggtgacatttaccctcagcgtgctcttttaactcggttgtttggggaaaaagcattccacttcctgatgcagtgctttctcggcttgggcagaacgcaaattcagcccgtggagaactatgaacgaaaaagtgtcggcacggagcgcacgttcagtgaaattggcgacaaacaattactccgagagaaactatgggatacggcgcaggaactcgagaaggacttggctcgtgcagagtgcaaaggtcgtacgttagtcctcaaggtcaagctggccacatttgaggtgctttccagacaatgtcagccacccagagcagtgtctctcgccaaagatctttacgcattctcacttcctatgctagcgaagctggaaaaggagatcccaaacatgaaactgcgacttcttggtctccgctgtaccaacttggttagcacgaagaaagtggatattaacttctttggcgcggcgtcgcagtcgaggtcagtcgctggcagaaagcccgatgcaatgacagagcagcaaatcggtgccgaggaagctttcgaggaagctgcacgccaggaaaggcaagacgacatcaacgaactggagcagctcagccaggaaatttccgacacggagcaaccgaacaaaggaggtgacacaaccatgcttcctgagtcagaaagtcaaccgcaattctgggattgcccaatctgttcacggcctcaggtcgcggaggataaagcattcaatgatcacgtcgattattgcctctcaagggaaaccatcaaggaagccgtccagtgcaccgccgatgtatctccaatagccatagagagcacgccgaaaataattggacgaaaaagaaaggcgacaaaagagccgtctcacgagtctcacgacccacggcaaaggcgtctgttctttacatga

SEQ ID NO: 17051 - DNA, 1617 bp, A.fumigatus
actcccgatgccgagaccgcctccttcctcagtgtgaacgttacccctcgatcgggttcacggaatagcagacgtgatggatttttgtctccaggcaatgcaccatccagcggacagtcatcgccacaagtacagtattcgcatgcaggtgtcggccatgttgcgagctcggggggttgcagaacggagcggagtcccgcccgctcgaacgggaagttggaaccgtccagagggaatcgagcaaagactctgacgacagagcgtccaaatactccgcggccgaattcctattccgactcttccacttcgcgaatgtttttccacgcatatgatgcgcggtctccgaattcttccgacggggacatccgatccaaacaactaagcaaaccatcctcgcctgctacgtttgtatatgccaatggagaacaagaggagcagactcaaggcgaggaggcaaatatcacagctccgacggtcaagcggcgatcgataggctcgtctcgtcttgccttggcaccaaaagctctcccagttacctcgccccggttacggccagctaagctcgctgactctgcggctagactttcggacgctacttcacaagtcagctcaccacgtgatggcatttccgaagttagctctcaagctcatagctcattctcgggcgcttttcccgcaagaacaccaattccggctgtcaggcacatcaaatcatcaagtctcgactctgccagcagcggtgtccatcccaaggaaggcctgaagccaagcccgataatagtatcaacggttggatcgccggtagaaacggaaagtgctgcatccgagtcgatgccggggctcaggcctcgaattctcagcaacggatctatgacttcggtggacacacatctttcatcagctgcacagagtccggtgaagtcggataccggacaggcaaacaacgacgtcgttctcaatgcgcgaattgagaggaagatccttgacttggaaatcagcaactcctctttacttgcgatcaaccgtaccctagagcgggagatgcgcaagcagaatgcagagttgcgaagatatcgccgcctgagtcgctccggccgtttgtccatggcgccctctacacggtccttctccggaacttcgttagggataactaacgaactggacgaggaagcaagcgagctctcgtctattcgctctccagaggaactatcggagtatagtgatgaggattccaccatggactctggtgttgtcagccccgattcgcttgctgatcacgatgcgagacatcgggtcaaagatgagaagcggttcttcgtagaccttgcgaagcaccaggaattgctggctgacagtcagaaaataaatcaaagcctcaaacgatgtctcgggtggacagaggagctaatcaaagaaggcaagaaggctctcgagtatagcgtgcatgtcaacgacgtacagcttggtggacgagtcctctcaccggaggagcttcatgaggaggcagaaagagcccgtgcactgttgagtcctgttgccgaacctcctcctgatcctccgttggcatctcaggagttggaatctctaatggagatgcttgacaatgggggctactga

SEQ ID NO: 17052 - DNA, 471 bp, A.fumigatus
cccgcatcggcacagctccacaacgctaacagttcaaaccatttacgacagattgttattatatgggattatacgttttgcagactaagtattcaagcttcagggagtagccaagcgggatcgggctcgtcatcctcgttatccgacctgaaattcggtcctggagatctttgttcctcgtccctgagtagatcagctggtggttcgggattgtccaccccaagaggatctgtcaatgaatcgcttttaccgtcaggaggacgtgcatttgttgtttctcttcctggagcgggtgatttgtcctctgtagatgctttaaatgcgtcgagcagcatctctcgtgcttcgcgcagggcttcgagctctgctccaatgcagcatatgagtagcttccaatccttcttctctgcaagattcaggtgttgttccacgcggttggtagtatgctccagatcttctacaacagattga

SEQ ID NO: 17053 - DNA, 246 bp, A.fumigatus
agaaattcctgccaaaagtttgtcgctaaccgactcttgacctttagagaggcattatacgaagatgagtcttttccggagcgggagctcgccgctttagttgcggcgaaggtttactatcaccttcaagaatataacgaaagcatggtgttcgctctcggagctgggaagctcttcaagctggagaatggcggcgagttcgaggagacaatcatcggtaaattttggcagtactcctccgattga

SEQ ID NO: 17054 - DNA, 582 bp, A.fumigatus
gttttctctcaagccaaatgtgttgatacatttatctccctgtctgctgctcaaagacccgccgcaggcgacccgtctgccaacttgaacaattcattcccgacatcaggcgaaggagccacgagcacgtccgccagcctaacatctcccattacgccattctcgcagtccacattgccgtcaaagtcattgctgtctcggcaagaggtgccgggtttggacgccgctcacccgggaggcgaagacgtgtctgtcaagcatgatgaaacaacattggtactgaaacggggagttcagggccagctgcaatctgtcattgagcgtttgttcgagcaatgttttgtccagaaacgttatcgtcaggtcatcggaattgccatcgaagcgaagaatttggacgtactccgcagggctattatccgagcaagtgaggatgggaagaaacacggtggatcccgtcgaagcgaggagctcatggagtacgtattggatatctgcatgggaatcgtgcaggagagggcttttcgcaatgaagtatgtctattttcttgttttatatgccgttgtcaggccttccgctaa

SEQ ID NO: 17055 - DNA, 2226 bp, A.fumigatus
  unsure (2180),(2204),(2216): Identity of nucleotide sequences at the above locations are unknown.
atcttgaaactcattctcgagctcctgaacgaaattccagctccggactacttctcgattgctaaatgtgttgtcttcctgaacgagcactccatggcatccgtcattcttcgacagttggtggagaagggtgatgccaggtcacttgccgttgcttaccagatctcgtttgacctttatgacaatagtactcaagaattcctcaagaaggttcgcgaagaaattgccgaacttgtacccgaagaacagcagcccgacagcagcaaaacggaaagtcaagaagagcccaaggaatctgatcctttgttgcaggatcagtctagctcggagcaatcaaggtctcttggattgaacaatacccaggcgaagttatctgatgaagcgcgtacggcattcaaaaatatactcgagattctcgatggcataaaatcaattcaactcaatctcgagttcctctaccggaacaacaaagccgatattgctattttgaacaaggtccgcgatagtctggaggctcggaactccatcttccatacagccgttactctttccaacgcgttcatgcatgctggcaccacacatgacaagttcttccgagataatctggagtggctgggcaaggctgttaactggtctaagttcacggctactgccgcgctgggtgtcattcaccgtggcaatctgagccaaggccaaaagttgctccaaccctatctcccaagggagcatattgctggcgttggcgggtcgggctctgtttacagccagggtggatcactctacgcttttggactgatttatgctaaccatggtggaatggctgttgacatgattcgggatcacttcaaaaaggctacggaggaggttgttcagcacggtggagcgttaggattgggtgttgctggcatggccactggtgatgagggtatttacgaggatcttcggaatgttctctacactgactcagcgctcaatggtgaggccgttggtctggctatgggcttggtcatgttgggaaccggaaatatgagagctcttgaggacatgatccagtatgctcacgatacgcagcacgagaagattgttcgtggtctggctatgggtatggccttgatcatgtatggccgccaagaggctgctgatgagttgatcaacggccttctgggcgaccctgacccaaccctccgttacggtggtatcatgaccattgcgcttgcttactgcggtactggcagcaacaaagccgtccgcaagttactgcacgttgccgttagcgatgtcaacgatgacgttcgtcgtgtggcagttctcagtttgggtttcatcctgttcagaaagtaccagagcgtgcctcggatggttgagctgttgtctgaatcttataatccccatgtgcgctatggtgcggcgatggcactgggtatctcgtgcgctggtaccgggctggacgaggcgatcgaccttctggagcccatgcttaaggattccaccgatttcgtcaggcagggcgccttgatcgccttggccatggttttggtccagcagaacgaggctatgaacccccgtgtcagcagtcttcgtaaagccatgatgaagatgattggagacaggcatgaagacgccatggccaagttcggctgcgctgtggctcttggcatcatcgacgccggtggtcggaactgcactatcagcgtgcagacacaaacaggcaacctcaacatgcctggaatcgtcggaacggccgttttcattcagtattggtactggttccccctcactcacttcttgtcgctcagcttcacaccaactgcagtcatcggcgtggatcagaagcttgaagttcctttcttcaagttccatagcaacacgagacctagtcttttcgactaccctccagagcagcaggtgaaggccgaggaggcgcctgagaaagtcaagactgctgtactttcgacgactgctcaagcgaagcgtcgcgctcaacgtcgtgagaaacaacaacggcgtgagagcatggatgttgatcagacgccaacaacaccaaaagtgtcggaccagctccccgagaagatggagacggacgaaggtgcggagaagcccgaggaggaggcgaaggaaggagagaagggcgctggcgacggtccgaagaagaaagcggagcgggaaaaggccggatatgnatttttatcacgcagctgcaagcngaacatgaatcngggccggaga

SEQ ID NO: 17056 - DNA, 195 bp, A.fumigatus
acggtagctctcctcattatcatggatggtcgatatggcatccttcaagccagctcgtttggtcctaaacctggcaatctgttccagagcatccgacctttcgtcaagtcggaagctgagtatttctcgttcctcctctttcagtttcagcaaatcatagatcgacttgaatatcccttcccgtgcttcacgtaa

SEQ ID NO: 17057 - DNA, 270 bp, A.fumigatus
caaagccgacccctttcacatcaaccacgaaaacccggtcttggaagcaagacttatctttcaaagatggtcggacttgcttcggccgccggtcttgttggctttctctctgaacctgatccggagttgagagtcttcgctttgaagaccctcgattctcaaatcgacctcctctggacagaagttgttgacgcagtgcctcaaatgttggtcatccatccgatttccacatcactattaaagaaattcctgccaaaagtttgtcgctaa

SEQ ID NO: 17058 - DNA, 639 bp, A.fumigatus
gctgaagatatggcaaaggcttacccaaaggcattcgctggtgcaccacgccggccaagaatcgtacctgagtcggcagtgcccatctctctggacccccctacacaggccagattgtactcggaggtggaggttatgatctgcgtgactgcaaacacattcctcgttcgacaatacgaagccggccgtatctcagaggaatcaatcaaaagagttaccaacttctggggctccaagaatagacctcaggtcgtcgagtttcagttcgatcaggccactcagcgtcgactgatcttgtctaacatccgaacgctgagcttcgacggagagagctcaaccaaccccatccttctccactccaaccttcacaactggaaagcagtggtgaaggagatgagtgtccgcaccttctgcgcccccgacagtgccattcggaaacacatgcacgacatccacaagctcctcgagatgctcggtgcgcacgatgctaccttacttgctttcgaagagcttcaaatgagcacattagccttgatgagacaacgacggcagatgaactatgatcttgagcgaagcaacagcaacttctcggctccagcaacggacccacagaaagtagtcggctcatgcactaactga

SEQ ID NO: 17059 - DNA, 1116 bp, A.fumigatus
atgcttaggtcctttcggctcgcgtccaccttctcttcaccaaaattcctgtccaaaacatctcacatgatggctggtcctcttcacacttacgggccgacttgtctactggccgacgatgatcccgaccattccacatggtattctctatctgaaccgccgaaagttcgagcacagtttttctacacctcgtctctaccgatcgatgatcccttaagcgcactgcctccgccatccagcggtcaaaatgcgaagaatgaacgggcaccaccgcagccattctctgtcaaggacaacatagcactcgaggaagcgtggcggcatcttcgacaaacaatgaaggaaaaggcggccgggtcaaaaaagtcttcaagtattctgagaaatgcaggtatagctgtacctgggaagggatcgactagtgacacggagcagagcaaacatacaggcagccgtcgagatggaagcctcactggaattgataagagtccgcctaatggccattcttcgtctaccaatgaccaacgaatacacagtagcagaggagaatccaatgacggagtcggtggtgcgggtgaccgtgtctcatggggcagatcgcaatttggctcggcacaagacgatgggtcggacaatcacaacctgaggaaaagggaactctccttaagcggtcagcctcatgctgcaaaacgcgctgcaggtacatcctcagagagcgaaaatccatcaatgaggggattcgcaagtggaattctaccgggtacatcatctcatgatgcgagcattagcggctcgccgtttgctagagctcctattgctcagtcacaaagcccgctaggtcgctcggttgagtctgtctcctcaaagggtggaagctcgaacatccaggctgaaccctatcacgttgggtcaaatcatactgcgaccaagccctcagacctgaggaacagttttgatcaagataactcgtcagaaggacctataatggaagctggggcagttgatcaggacgacacttctcagttgaaggttcccgtcggtgtttcccgacttcacctggtggaattaccgaatctaaaggtggtatttccctcgatagctgaattcaagatctag

SEQ ID NO: 17060 - DNA, 222 bp, A.fumigatus
aataatgaccatatcaatagacaatacgatgccgactaccacgaggctatatcagtcccctacaccttcttctccgctatgcatcttcttttgaaattctatcaagtcttcgcatctgtcttctcctgtgatccctctgcacgttcatcatcttgcctctgctgccgagtactactacgtcgtcagttcgatcccatcgttcataccgcttcatcaccatga

SEQ ID NO: 17061 - DNA, 696 bp, A.fumigatus
tctccatgtccattggaaaacgcatatgtgctaatcgtgcgaagtatccatctctcatatgaggatattgccaagctcaatcccttttatgaaaagtacagggaattctggaataccactcctgataccacggtcaccaccctctcttctctggatccttcgtccagatccccttctttccaatcagtgcacgctagcaccgttgcaccaccgtctcctcttgatatctcatcttctccttcactgcactgcgccgagccttctgctggtctccacttttccgcaatgctcgatgtccctcttcataaagggactcagcgcaagccatctgttagggtctatgacgaggatattcccacaagtcagcaggccacttttgtgattgaagggtacagcaaccattctctgtctcctgtgaacgaagcattggagatgtgtgatttccatccgattgatcgtcatcacttcagcgatacgacccaacaagtgagatcctcgcacaaaaagcttttcggaacaaatggctggctcggccaagccgacgactccaacactgtgccgctcaagagacaaaagtcgaagatcttccgagatcttggaaagaagatcaagcaccatgtgggagagattgtaagtgctcacagtaacttcctgatcctatcatttacagtgtcgctaatacagtctataggctga

SEQ ID NO: 17062 - DNA, 1086 bp, A.fumigatus
atgaaacccatatactggagtcctcttcatgatgaatcgaatgttctgcgtgctacttggttttacaagaacacaatgcttccagtagagacagagctcgccaacaagcttgaggatggatacatttatctaaaaccctggacagacacatggcaggatgaactcaacagctgtgttgagaacggagccgacgcggaaatgaaaatcgttcacaaactgtggccgaaacccgagacgaaatccaacagcacacctacttcacgccctggatctagtgctcagctaagaagtgcgggttcggattctgactcgccaacgtttgaggaaaatcgagctgctggtgggacgactgcacatactgaagccgccaagcccttcttgaattccagtgtcatatatgtcgatggtaggaatgctcaaattctcagacccagcttgcttccttcagtttcaagagggaggcgacctctcagttcgattcgcaagggtcgacacattggaatacccgtggttcgtggcttcagccgtcgctcatgggaacagctacatccatctaaacccagccctgtagatgtaagaaattacctccgaatccagtcgcgagcaatgtccaggacggatggtagacaagtctgctatgcctgtgcaatggaaggatcgcgacctactccgacggacttggtgttggtcatccacggcataggtcagaagctatcggagcgtatggagagcttccattttacgcatgcaatcaatgccttccgaaggaatattaacatggagctgaacaacgagccggtctggcatcatgtgcgccgggaccatggcgggatcatggccctacccgtcaattggcgatcgactctatccctggcggatggaagcctcgagtctgagatttctgatgatccaagtgcaaatcactactcgctgaacgacatcacgccagagaccattccggccgtcaggtcattgatcagtgatgtcatgctcgacattccctactacttgtcacatcacaagccgaagatgattcaagcagttgtgtcttcaccacggggctggaaggatccgcgggggcgctat

SEQ ID NO: 17063 - DNA, 216 bp, A.fumigatus
gacacggtcacccgcaccaccgactccgtcattggattctcctctgctactgtgtattcgttggtcattggtagacgaagaatggccattaggcggactcttatcaattccagtgaggcttccatctcgacggctgcctgtatgtttgctctgctccgtgtcactagtcgatcccttcccaggtacagctatacctgcatttctcagaatacttga

SEQ ID NO: 17064 - DNA, 252 bp, A.fumigatus
ttcggtaactgcctgaagtatctcgtcccgtacagcagccaggtcatcgtgacgaaggcgccgatcggcagtctgctgagtgtgttctttcagacattcgcggatggtctgggcgatttcgtctttggtaactattggaggctgctcgaaactctgaactcctgcctgaacagcggccaaaacttgatcataagtcacggcttgttcacgttgcggctggtatgccttgagcccttcgctcaagcactctag

SEQ ID NO: 17065 - DNA, 705 bp, A.fumigatus
gactcgccgaccttttcgaagaaagtctttgtgtccaagctgatgcgttcacacgtttcattaacgctatcgcccatggcgccaatgacgagctttatgtcttcggcaagggccttggtggttgtgatagcttccaggtgcgcgttgtctcgttcctcagcttcagtgaacttcgagccgattgaattgtggacttcatcatacttggccatgacttcgccgagtttctcatcaaattttgcacccagctccacaatgatggctgctcgaacctcatcatgtttgacaagggcagcggcgtcacgttcctccatttcaagcttgcccgcgtcttgttcaccacgaacacgctcaaattcccggttgatgagttctgtgagttcgtggatgctttctacggtcgtaaagctttcagcagaagcagccaagccttccaagagttgcttgagctcggaaagtccttcggaactgccgtctagcttgctctttagctcgtcgccgagtccttcgaccacggccctcgcctcgtcaattttctccgcaagcccggcgtgttcgacctttctggcttcgaacccttgcgctgttaactcgttctcggcttctactttttctctgaagtccgtcacaagcattgacaaatccttgatgtctgtctttgttggtagtgtctcaacatcaggaagcttcaattcttccacctga

SEQ ID NO: 17066 - DNA, 627 bp, A.fumigatus
gtcttcacctcgaatatcatggcttccactgtttgcaaatccgatttgacgagcttttcagtatcaggttcaccttccgaatctttgcttttgagctcatcaaaggcgatccacatatccttcagaagagtctccagggtaccaatctctgacttggttggtccttcggcttctaggcgagcagaaagtccagtgatcgcttcctttgcctcgtggacgatgacttcgagactatccagctgctccgccttcgcgatttcgtctagggctggaaatttcagctcatcaagctgggattttgtgtttcgcagtagtgtttcaatggcgtctgtatcctccttcttcgctgtcaagtcatccaccggattttcccgagctacaataccggccacggagctttggagttcgtgtaggccggcaactacctcgtccagatgctctttttttagaacatcttctgacggttccggtgcacgcggagcagactctatggcatcgaccttgatctgtagctcggtgatgagggttttgagggcttcgatgtcgctgctgatattcggctcatttgcaagcatcaattctccgcctcgggtaggttcaggctcccttgactcatcctgtgactga

SEQ ID NO: 17067 - DNA, 3942 bp, A.fumigatus
ccaatgaagttaaagcgctggtccgagaattgcgaggacatagttttgggaatgggacgagaccttgcccgaagacttgaggaaatagagcatattcgctttgcgggggacgacgaacccaaggcgcccagcaaagacgagatcgctgccatcgtcgagcaaagccttcaagagctgaagaaccaactatcacacataatgaatgagcatagacaacatgcctcagcgttgtcggagtttcgatcagcaatggatggcgccgagatctattttattgtgaagagagtcattgaagagcactccatgtcccagcctcaggaacctggttttcagagagatgagatactggaaacggtcagggaagcctgggagacgtacaagcccgaaattgaacttcaaaattttggtcttgaacgcgacgagattctagagtgcttgagcgaagggctcaaggcataccagccgcaacgtgaacaagccgtgacttatgatcaagttttggccgctgttcaggcaggagttcagagtttcgagcagcctccaatagttaccaaagacgaaatcgcccagaccatccgcgaatgtctgaaagaacacactcagcagactgccgatcggcgccttcgtcacgatgacctggctgctgtacgggacgagatacttcaggcagttaccgaatcatttgcctcccagagcgctctgatcagagaaagtttagagttgggtcttggtcgcgatgagatattgactgccctgtcggaagggctggagacctatttcaacgcagccaaagaaacagagccggtccacatcacgaaagacgatgtcatcaacgcgataaatgatgcgtttgctgcccagaactcagccattagcacgattgttgagttagatatctcgcgggaagaaattttggccgcaattgcagagggcctggagagtcaaaactcgatgattagggagattgagctcaataaggaggatttgatggaggcaatatcggccggccttcaagaagccctgagctcggtgaatctcaacgccggggagcaggctttggaacgctttcaggaactcgtccaggaaatcaaagacaatgtccaacagcaggctcttgccggcgagaaaagcagtgagcaggtgctcgaagcaatcaaggacggcctagctgctgtgaagcaagcggtcgaaggatacgctgcaactgccgtggaagcttccggcaaacatgaaatcatggacacggtcaaggaaggtttccgattgctccacgccgacatggaaaagaccatcgcggatgctgccctatctaacagccgaggggttaatccggacactccagaacttcttgatgctatggagaaggaatttgagcaccttcggcaaaccttgagctctctcctcattcgcaccaatgtctccagcgacaaagacgagattctcgacgccattcgcgatgcatcggaaagccagaaggtcccaagcgtagatgacatcgccaaagtcatcaaggaagagttcgatagtattcgtgagactatgacaacaagccttgttcccatacagcccaagtccggcaatgacgagattgtcgcggctctccgggaaagcttcgaagcgttccgtgaatcaaacaaccaaactaaagatagcggggacagtgtctcattctcaactggtgaagtcattgaggtcctcaatgatggcgtggctacaattcggggtgatctatctaaacttctcgaccggcctgagcagattgattattccgaacttctcgatactctgaaagaaggacttagcagcctgaaggcggatgtagaatcattacgtcagtcacaggatgagtcaagggagcctgaacctacccgaggcggagaattgatgcttgcaaatgagccgaatatcagcagcgacatcgaagccctcaaaaccctcatcaccgagctacagatcaaggtcgatgccatagagtctgctccgcgtgcaccggaaccgtcagaagatgttctaaaaaaagagcatctggacgaggtagttgccggcctacacgaactccaaagctccgtggccggtattgtagctcgggaaaatccggtggatgacttgacagcgaagaaggaggatacagacgccattgaaacactactgcgaaacacaaaatcccagcttgatgagctgaaatttccagccctagacgaaatcgcgaaggcggagcagctggatagtctcgaagtcatcgtccacgaggcaaaggaagcgatcactggactttctgctcgcctagaagccgaaggaccaaccaagtcagagattggtaccctggagactcttctgaaggatatgtggatcgcctttgatgagctcaaaagcaaagattcggaaggtgaacctgatactgaaaagctcgtcaaatcggatttgcaaacagtggaagccatgatattcgaggtgaagactcaggtggaagaattgaagcttcctgatgttgagacactaccaacaaagacagacatcaaggatttgtcaatgcttgtgacggacttcagagaaaaagtagaagccgagaacgagttaacagcgcaagggttcgaagccagaaaggtcgaacacgccgggcttgcggagaaaattgacgaggcgagggccgtggtcgaaggactcggcgacgagctaaagagcaagctagacggcagttccgaaggactttccgagctcaagcaactcttggaaggcttggctgcttctgctgaaagctttacgaccgtagaaagcatccacgaactcacagaactcatcaaccgggaatttgagcgtgttcgtggtgaacaagacgcgggcaagcttgaaatggaggaacgtgacgccgctgcccttgtcaaacatgatgaggttcgagcagccatcattgtggagctgggtgcaaaatttgatgagaaactcggcgaagtcatggccaagtatgatgaagtccacaattcaatcggctcgaagttcactgaagctgaggaacgagacaacgcgcacctggaagctatcacaaccaccaaggcccttgccgaagacataaagctcgtcattggcgccatgggcgatagcgttaatgaaacgtgtgaacgcatcagcttggacacaaagactttcttcgaaaaggtcggcgagtcctacaccaagatagaggagatgcacaacgaggtgaagacacaccacgagcaagctcggtccgactttgaacgagcagtcgcggccactgatcgcgtggagagccggctgcatgagttccatccgcaggtcttggagtcgatacaggaaattctctccatcgtcggaaagcactatgatcattctcaaaaggcgacggaggatatcaagatggacctttccattcttccttcgacaattccatcaatgcttccagctcttccaccacctgagccggagaagtacgatgacactcgggtccgcgagaaactagacagcctcttggaacatgcaaagaacaacaaggtgcaagaggcactcgacattcttgttgaacgtgtgaccaacaatcaagtgcatgagaagcttgatcagttgctcagtcagactacgagtaccaatgctcaagtttacgacaagctgaatgagctgctcgaccatgccacgaacacgaacgggccaattcacgaaaagctagatacacttcttgaccacgcgaaaaatactgaccagtctgttacgcacatgatgaaattagatgagatgcataaggacatcatggagacctcacgcaagatgaacgagatgtttgcagctcaatccgccctcgtggcggagaatacagagcgcagacgccgggaggccgaggaagctgcaattgcgctggagagaagaaatgcgcaaaaagagcaggtcgaagccgaaatcgtcactctcaatgaagagaagactctcttctga

SEQ ID NO: 17068 - DNA, 1200 bp, A.fumigatus
gtggtttcgctcctaaactggttgaacttccttaaagggcatgcctggagtgctgaacagtgcgttatagggctcttggaacagacactggtggttcggttcgacttccagctgcctacacgggcacagtcggctttaagccgtcttatggattggtctcgagatggggggtcgtggcatacgctaactcactggatactgtcggcatcctggccaaaaatgcctcgacggctcgcgatgtattccgtacgcttctctgcgcctccatgtctcaagatctgtgctcttgtattggaatctaactgctcggactcaggcattgtgaatcggcatgatccacgcgatccgacaaacttgtctccacgctctcggtctcgcatagcttcgcacctccagcaacctgctcttttgtctagaatgacctcgtctctgaggatcggcgttcctattgagtacaacatatcggaactctctccatcggtccgacgagcctgggctctctcgatagcttttctgagagagcagggtcatacaattcatcccgtctcactcccaacaacaaaactagctctctcggcatattacgtccttgctccagccgaggcatcctcaaacctcgccaagtatgacggcatcagatacggttcccgctgcaacagcccggattctggtgggcagcctgagagctatctatatgccaagactagaggggacgggttcggtctcgaagtgaagaggcgtatcttactcggcgccttcagtctaagcgccgatgccataaataattactttattcaagcgcagcgcgtccgcagacttgtccagcacgatttcaatgctgtcttcagagcagagcaaccgatatccccttcgcgccagaaaggagatactgagttgaaatcaaaacaggcagaggtcgatgtcctcatctgccctaccgccccttcatgtcctccgcagttggcagacctggttgaaacagattccattttctcgtccctgaacgcatacacgaatgatgtgtttacagtgcctgcaagcctggctggtttgccagctgcgtcagttccagtcagagttaactgtcgggatgaaggttctagcgatgctgatcttgctggtattcaaatcatcgggcaatacggggacgatgagcttgtccttaaagtgtcggagtcattggaaggcaaaatcttttga

SEQ ID NO: 17069 - DNA, 246 bp, A.fumigatus
acagtgcgttatagggctcttggaacagacactggtggttcggttcgacttccagctgcctacacgggcacagtcggctttaagccgtcttatggattggtctcgagatggggggtcgtggcatacgctaactcactggatactgtcggcatcctggccaaaaatgcctcgacggctcgcgatgtattccgtacgcttctctgcgcctccatgtctcaagatctgtgctcttgtattggaatctaa

SEQ ID NO: 17070 - DNA, 1875 bp, A.fumigatus
accgttattgacgtccacatgtcgtctatacagccggtagggtcgtctggcccttcgtccaacatcaattctccgactttacctccaggaaccgcacctttcttcagtggtacagtcacaggtcaaaacgcacgatcctcgcctgcccctcccagcaatgcatcggtgcaaactgatggcacaagatcgaaacgcaacaaacgcgatagccggaagaaaagagaggccaagggtctcgaccaggaatccatcgcgcctaagaagaaagccgctgttgccccgaactccgcgcttccgagctctgatatcagcattctcagacccctcttacttgccgaacccagagcttcggacctattaccgccgcagcctcgtcaactgagttttgtgagtcgcaaaacatcagacgtgctcggtcagagctgggacttctatgaggttgttgacaaactcacaaataagaatggctttcgttatagctacgctatagctgatccaggctttccacacatcaagtaccggcagaccgacgttcccccgtatcatgcccggttcagttttgaggattcgcccgcagcgatttttttcagtgaggatgcgcgcgcggtaacagccagcagcgcatggcatactgcgcgtgctaatgtatgtgctcgcgagggtgcatattattacgaggcgcgcgtgatcaacgggattcctaataattcgcaatccatctcggctaacgaatcttctcaccgcacgccaaaaggtcacgtccgtcttggatttgcacgacgggaggctgatctcgatgcgaacgtgggtgttgactgctacggatacggaatccgcgatgtaaacggcgaggtagtcaatagaatgcgctgtgagtacttttttccgaaaggcgaatcaattcgcgaaggcgatgttatcggcatgctcatcacgcttccaccactgtccctccacaagaaagtggtcgaggggacatatgaccctgctgtcgacggagatgggacttcgccgacatcagaggctcacacatcgacaaatcttattcgggatcgcattcccttccactataagtccgatttctgctggcagcagtcaaacgtattctccacaaaacacctacgcgattatgcgttcaacctcaaagagacacccacatttggtccaccatcgccgttcaacagcgaagacccttcgctacgcacgctgccaggttcgagcatcacaatattcaaaaacggggagaagatgggtactccattcaaagaattgtatgcgttccttccaccggccagccgacttgcaaatggaaccaataacttgggcattggtgagcgagagaacgccgatgatggaatgattggctactaccccgctgtcagctgctatggcggcggtgctgtggaatgtcgctttgaagggccatggtgggttggaccaccgtctcacgcagataacggcgaacctgtcaggggcattggcgaacgcttcaatgagcagattgtcgaagacgtcgtggccgatattgttgatgaggtcgaagcaatgctcatatggggcggtgttgacggtgatgttgttggcaatgcggaagttgacagtgctggcgccggtgctgttgggggctccgaagttctgaagggcggagtcggggcagcatttgatcctcggttggattcagtccctggcgcggccgaatttgctgacaccgagaatatttccaacggattggaagctggcgtcaccgacgcggacgcaggtcatttgacgaccgaggatactctgagtgtgggccatgagggctctcccaaccctgcgacaccctcagctcctttagagaacactgtcccgacagaagatgtcgagatgtcatga

SEQ ID NO: 17071 - DNA, 393 bp, A.fumigatus
gactcgtatcttccacgccggcgtgaagatctcttgcatactcgtgcagaatccaaacgagtagcagctctttttctccggccgcccctctgtcggtatccgtgtcaattgcgctgcagagttcttgtgacaccgaacagccatcttgacccgcttattggactgagagcagtgactgacctgaaaagagtgcacttttgtacagcaatacagatggcatcggtctatggagatctccggcatctgctgccgaacaactacaaacggctcatcaccgcttggttggaggaggattgccccagcttcgactatggagggtttgtcgtcggtgagtcagagggcgaggcaagattactggggaagagcaaggtatgcagatgggatgcaagttga

SEQ ID NO: 17072 - DNA, 747 bp, A.fumigatus
tggttgagtgctcgcagagttgaatggcacgtcaaggaaggtgaatccatcgacccgatcaagcattgcgccaccgtccgcggccccatccgccagatcctcctcggcgagcgcgtcgccctcaacatcctcgcccgctgctccggcatcgcaaccaagagtaccacccttgttgccgccctgcgcgcccacggctggcagggcacgctcgccggcacccgcaagaccacgcctggcttccgcgtcgtcgagaaatacggccttcttgtcggcggcgccgacccccaccgccacgacctcagctccatgaccatgctcaaggataaccatgtctgggcgtgcgccaacaaccgctccgccgcggacggaggatctggctctgctgacacccagtccatcgcggccgctatcccccgcgccgtgcaggcggccaaggcggcgggcggtttctcgaccaaagtcgaggtcgaatgccgcagtctcgaggaggccaacgcggctatcgacgccggcgccgacgtcatcatgctcgacaacttcaccccggagggagtccgtgacgcggcccgccagctcaagcaggactgggccgggaagcaaaagtcgttcctcgtcgaggtcagtggcggcctgaccgaggccaacgccgcggcctatgcctgcccggatgtggacatcctctccaccagctctatccaccaggggactcctatcgtggacttttcgctcaaggtgtcactgcggtag

SEQ ID NO: 17073 - DNA, 2535 bp, A.fumigatus
ctcctcaggcgggggaatgcagaactccggagagaagttagcgcccagacgtccatgctcacatttcgtaacaaagagaaagagcggctgtaccaagagatcgaggagctgaaactcggccagcgccgtgacggtgttcgatccgtcgccggagatagcatcttcgatcggtctgcctctcgagcccagggcagatcctcgtcgcgggcaagtgacgggacagggccatctcgaagcgatgatgcagaacgcgaggacctggaacagcggattgaccaactgcgtgaccaagtatccgcgctgaaacttgagaaccagactatcagggccgagttagaagaacgcatcgcggaatacgatgccctcgacaagcagtatcaggccgacgtagacggggctgatgagatgtttaacgcgttacaccaggaacgtgacgaagctgaacggaaaatgaatgactgcctcgtcaacatgcagattatggacgcccagtacacagaagacatagaaaacctcgaggaggaggtcaggcggaagacagaagaatgcgggcgtctggaagaggagctccggaatcaggacgagaacctccgggcattgcaagctgagatgcgctccgccagtgaaggcatcatacggcttgaggaagacgcacaaaccaacctgcagcgatatgaaaaagttcaaagagagctccaggactgtaaccgagagatggaggcattggaaaagagtctgtatgaagcgaataccaaggtgcagcgacttaccgtccaaatcgaatcgagccagaacgagattgcgttcctgcgcgaagagcaagacggtgacaagattaggattggggacctggagtctgaacttaagacatgccagatgagcctgcagagcgaaagggacaaggtaaaggatctggaatctcgtctggcggaggaacgacatcaacgcgaagtcgtgggaaccaaggagaaacaggaggttcagcgcatcatcaacgaactgaaccgggaggcttcttcagctagggaggaggcccgcaggctgaagaagagcctgtctgcgcaagaaatcgaaacggccacctggagagagcgactcatggacttggagaataacctgagggagacgctgggagatctcactggcagccgttccagcctgatttccaacatcatgaagttgcagaaggaacttgagtcgacagccttggagcttgagagcgtccggtcaaagctggacgagaaagagactctcttacggaaccgcgatgctcttcttgagagtcacggactcgagtctcgcaagctttcggagctcctcgaacgtgaacgacaagcccgtcgggcggacaaacagtcgtttgaacaggccctcaaatctcaccatcaggcgtctcgtaccatcactcagaataattctcgcattacggagttagaaaatgcccggagtcaggaccgcaagcgatttacagcgctggagcagcagttcaaagagcaactcaacgagcgaaactccatgctactgaccatgtggaagcggctgtccgcaatgtgtgggccagactgggcgcattcaaacagtctcatcaatggaaacctacccagccaagaggtgattggcaatatcctattctggcccggatttagccgcaacctcttgctcgcggtgaagacactggagaatgttatagggggattcaagaaccgcatcaagggcgtcgagcgcgatctgaccaagcagtatcagaatcttgaacatgccctgggacagcgtatcaagaagctcgaccgcttggaggagtcggtgatgaatttgcgggctcagcagcatagcagaggccagtccgggatgtcgcccgagattgccaagctacgtggagagaaccgcctgctaaaggcggagctgaatctgcttcagtctcactcgagtcgcggcccaacgtccgcagcagctgttgccgctggtatgggacaaggcatcccacgctcgcccagtcgaacactgagcacggagtctgggacagacgcagagtcggccttgacccgccaccgttccgtgatcgaaaagtctgcgacgccccacctttccaggaatgcgcaccgaagttcgacaacaggcatccctcagccatcgtcgaacgcgccagccgacgacgggggtgccattgtccccagctcgcactcacggcatgcgtcgggcgacccggtaagcaatgagcggtggatccatcgtctgagggaactcgagaagcgcttgaaggcggagcgggaggcgcgtctgctggatcgcagcggagcgcgcaagcggctcgaggagcgggatgcggaaaaccaacgacttcgtgctcagctggagagacagcgcatgcggcgaggtctgtcggcagagacctcgaccgacggcgattacgatcacggtcgagtccgcaaatcagagcattctgatccgagcaacgacggtgattatggccgtctcaggaacgaggagctgagctcgagcgaaggagaggggatatgtgtggatattgaagtttaa

SEQ ID NO: 17074 - DNA, 204 bp, A.fumigatus
aatatctactcacagactccaatgacatctagtcttatatcctccgacccatggaacgtcgcttcctatatcatgatcagtacatgggaactcttgcatgtcaccgtggagattgagttcctcttctatacttttgagcaaatcatgagaccctttagatttgtcatgtatgtactccgtagcctctcacgttataagttttaa

SEQ ID NO: 17075 - DNA, 192 bp, A.fumigatus
tattccagaagcttgtcagacacccccggttgtcgagattgtcctaccagatcgtccttgctgccaatctttttccttttcgaggctttgcccaaggacctgcatggtgacacctacggggctgacatcgactcaagcggtcaaagcgtctctgcaggagtcatgaaccactctgaaacttgcatgatatga

SEQ ID NO: 17076 - DNA, 216 bp, A.fumigatus
gggattctacatgttgtcaaatctggctctgagcgaggccctctctcactcctgatcatcaagctccccgcaaatctggttgaattaaacaccgtctccattggtcccatgctcaccgtttggtccgactatggggcctctctaaacacggaactgcttgcaccccaaccccactacctacctatcaatgacaacattagcggcaactccgtttaa

SEQ ID NO: 17077 - DNA, 267 bp, A.fumigatus
ctattactgtctgatacagcgttccgtcttcacttggggtctctgttgctgtggggcatcaattcactggagactcaaatgctcaacttgcctcttaagcatcctctacttaatcatagacttcctgtcattcaccttcttgactgttctctctctctctccggctcgccagattatctcccccgcttgtctaagccaaggggtatcattttggcaatcggactgtctcagccttcgcacaagagtcagaaaaggggaaatttctag

SEQ ID NO: 17078 - DNA, 1581 bp, A.fumigatus
  unsure (649): Identity of nucleotide sequences at the above locations are unknown.
ttgcacggccccttccagccccgcggtgaagacatggaacggttgggctctctgcaggagaagttctacgcgaatggcaagtctgtcgatggctggaagccgcaggatattgaaatttataaaacacttgtctgtggccttttgatcaagtgtgccgacatcagtaatgtggcacggccgtgggatatcgccgagaaatggaccaggattctacaggaagaatttgccaatcagggagagatggagcgcgaggtaggcatggaaactgcgttgttcggtggtccaccggagctgggaaacgtctacaagctcgccaccggtcagatcgggttcatgtctatctttgctctccctctcttcgagggcgtgtcggaccttctgcctgagctgcgattcacggtcgagcacatccggaccaaccagactcgctggcactttctggccgatatggagaaaaggaagcagtcgctgctagacccgcgttttgagggcggcctttcccctcgctcgcagagccctgccgcgagtttcaaaggtctgcgtgcaccgttgaatgagagttctgccaggtcggcgctggaccctgacgaccctgcgacgcagcgacgcgaagcaaccggcgactactttgggacggctgaatcatccncgaatgattacaatgagaacaccatcagtcctgtcgtgtcgccagacaccccaggcccatcgatggatatcacaggcagtccgataccggttcgggccttctcggaaatccttcagtgcttgtccccgacctcgctacgccatcggtatccggcacgtttcctgacgccgatggatccgaagcatgctggagatttcgaaaggcagactggtcggaactccagacgctcttcggaggacgcggttctcagtgcggtcatccttgccaacacgtccgatgacccgaatcgcgccaactcccgtcacagaagtggtgaatccactgaaagagaagcagagcgaccgagcagttctcggcagggaccgcaggggcatcgtcgccaccacgctaacacgaactcgaccggacgcggctcaggtgcaccgaactcgcagcggaacagttgcacgcgcacccacagcttgagcacatatagcaataccatgacgcccatttctccagccaccaatgccaccagtttcgtcactgtcgatgacagggacgagaaggggcattcccgcgaacacatcagagacgagcacgacgagtctgacggtgcacggcccggttcatcgaaacagtactccgtcggcgaagggcgttcggagggtgacacccatttcagcgataccaacacctctcattcacacctggatgatggaagaaagagtcccatcaccactttcgtagtggggaacgggtccaacagccccgcgcattctacaaccaccacaccgagtgtcaagaatgaggcgcatcccacttgggatgacccaactgctggtgagcagcctccacgcaggttgccgaaacggcggagtcgtctacgcttggcgttctggaagcgcaaaccgcatcattcgcatcagcatgagctgagcggggagacttga

SEQ ID NO: 17079 - DNA, 699 bp, A.fumigatus
gaatataatccttcgtctatcatatcggtagcggtagcatcactaagcctgacaatcctcacacttttccgttttcttttcttgactctgttgttgactatccccatgctccttcctcaaggcccgatctgtatggcccaaatccctctgtggatcaaccacattcctcacccgactcttgagcaccttgacctctatccagcatcagcatctcaattcccataccagacacagcccgcacacctatcctcatctcctcgaaaagaaaagagagtacatacccggaaacccaccatcaaccctccgatcccagagcacactctcccgcacctccgtctcagacaaactagtaatactcacgataaacgtgccccccgtgcacggcacaagagcaacctcgccaagactggtcgaaaacgtcgagagaagttcctgggcgaacttttttcaatccacgttagcatagcattagcaataagcatggtacttgcgcttggacctgtttgtttggtatcggggatcgtgtgcatactgaatccgggtgaaacgagaagaaagggggggggggggacatacataagcggctcggagcatccatttacattgcgtgcagtatttgattgtgattcggggcagggttgtggttgtcgttgctgttgttgtggtcgtggtgggcgggggatttgtggttgtgcttga

SEQ ID NO: 17080 - DNA, 186 bp, A.fumigatus
attaacaacgcaatccctgctagtgaaaatctagtgcagcgaaatgaccgaaccaacgccccccatcgaacaacacccaccatcctcaagcacaaccacaaatcccccgcccaccacgaccacaacaacagcaacgacaaccacaaccctgccccgaatcacaatcaaatactgcacgcaatgtaa

SEQ ID NO: 17081 - DNA, 2778 bp, A.fumigatus
  unsure (70),(109),(110): Identity of nucleotide sequences at the above locations are unknown.
gcccggaaccaaccaacacggcaaccgcaacgcaattcacaagcagcagaacaagcacagcccacaacgngacctgggtttgggcagcttgcatttgggcagtcgcctnntggcagcctttcggcaatggggtcgtcaccatttggcaagccttctgctgtcccagcgtttggcagcccctcagctctaggtagccgacaacctgcctttggaacaccatcggctcccagtggcccatcatttggatcaccatcccagattaaaccttcattcggcacgcctagtgctctggggcgcgcaacgccccaatttggccagtcgggctttggagccagtgctgcacccagctttgggcaaccgtccacaccaggtaaaccgctacctttcggtacgcccagcgcttccgcaggaggagggtttggctcgtttgcgaatgcaggaggattctccagctttgcggcatccaaaccggccacagaatctccctttgcgaaagccgctggcgaatctccttttggaaaccctgccacagaatcgccttttggcaaggtatcaaccgagagtccttttgcgaagccttcaggtccatcgattttcggcacccaagctcagagcggctcagcctttacacctcagaaggcggacgaatctaagggtgtctttggcgcctcaggcagcttcgtacttggctccacttttaagggtgatggcactgctgtcaatgatggcccaaaacctgacaaggcatctggcttattttcctttggcacgtccctggacgatatgatatccacacctgataagaccagtccgccaacagaatcgatggacgacgccgaagatcagcctgcagtcacccaatccgcgaaagcagcagccaaggaggctccaacatcagtgtttggcgcgccctctaaattggatacctcaaaaacgacatcgatattcggttctcagacgcaacctcagccagcgacgcaagccaacaagtctcccttttccttgtttggaaacgtcgctgcggagaaacaggtaaccagtcccctatctccgcagtcgggaaagacaactatcgctagcttaacgcccaaagcggagaacatctctattgccgaaccacctctccctcctgaaccaacaagcagagccgcgtatggcccaggcgatacctctgcatcttccaacgtctctaagagctcggtcgaagatgtcaaactggaagcaccgctcccacctgatttcacgagcgggatcacaggcaaagcgggaaagcctgcggcagagggggctccgttgcctccagaaccagcacctcctgagtcacctgctgcatccgacgaggaagctggtccgctgcccgaagaatcagacgtggatgagtctgaaaaagagccgagtgagggggctgatgagtctgacttcgctgatagcggagaggaaatcacccatgaaattgaagaggaagaggaagagccggaaattactggccaaacaccgaagatttcaccggagagttcatttggcactggcatctccgaacaaagtcccgccggaggattgttctctcgcatttccaggcctggacagcagcaacgaccacgtcagttgcttggggaggttgctaaacccatgttccaaccgacaactcatgtcgaccgcgaacccccgagatcgcctagtccagttcgaggcagcatcccaaaaactctggtgaagccacaaatccacaaatcgaccagtgctccgcaaatcccgggtagcacgcttgctgcccgcaaggctgctttgaccgaggcagctctgggtaatcaacgtctccgacgggaatctgaccgcacggcccgtgaacagcaggcccgcttgaagattcaagcacaaaaagaggaagaagaagcattgtccctttccgacgatgatgaagatgagagacttcgcgcggatcttgcccaaccactcgagcctgtcccaacacttgaccccttcctgccacaccaggactatatgggtcaaaccacgaaaccgggaattcccggtcaaatcgagaggttataccgtgacatcaactcaatgattgatacgctaggcatcaactctcgggctctgtcatccttccttctatatcaacaatcgccccgagactccgagagatggatacagaccttgaagactgatcattcagccgacgttctagacgaggaggtccttctcggcgaaatcgaaaaactcgacgatgctgtgcttatgcttgccaattctctccaggagcagcgagtgcaacgtgtggaggagaagcttgagacctgccgggaattactgagcaaagacattctcactcttaggggccagtgtgcaagcatccgaaagacccttgacgctcatacagatacggctgcaatcctttccgcacctctttccgcggagcaagcgaacctccagcaagacctccggtctgcattcacaaacctacaagcgagtctggcggacttggaatctgcagtgtcaattttgcgggctaagattgcagaagcccctcggccagacagcagccgccagtcaacgaagcgccccactgtagaagctgtgacatctacaatcgcaaccatgatgaacatggccgagagcaagagcagcgatattgatgttctggaaattcaattgaagaagctcgggatcgatacaacaggtcctccgactagtcgggaaggatccccgtttgccacaccgaaaaaaggggttggcaagatttcctacgacgcctggctctcgggggtctattga

SEQ ID NO: 17082 - DNA, 636 bp, A.fumigatus
cgtggtcgttgctgctgtccaggcctggaaatgcgagagaacaatcctccggcgggactttgttcggagatgccagtgccaaatgaactctccggtgaaatcttcggtgtttggccagtaatttccggctcttcctcttcctcttcaatttcatgggtgatttcctctccgctatcagcgaagtcagactcatcagccccctcactcggctctttttcagactcatccacgtctgattcttcgggcagcggaccagcttcctcgtcggatgcagcaggtgactcaggaggtgctggttctggaggcaacggagccccctctgccgcaggctttcccgctttgcctgtgatcccgctcgtgaaatcaggtgggagcggtgcttccagtttgacatcttcgaccgagctcttagagacgttggaagatgcagaggtatcgcctgggccatacgcggctctgcttgttggttcaggagggagaggtggttcggcaatagagatgttctccgctttgggcgttaagctagcgatagttgtctttcccgactgcggagataggggactggttacctgtttctccgcagcgacgtttccaaacaaggaaaagggagacttgttggcttgcgtcgctggctga

SEQ ID NO: 17083 - DNA, 1158 bp, A.fumigatus
attattgcgcagctctgtggagagaaagaagtccttgcccaagtaaaattatccttcaagagtacatctggagcgaagatggttgctacacggagcctacaacttacagtgaagaaaaccactagacaacagaaaaccctcgagggacagcttctgatggtcaaggatggtgaaaggacagctatctcatcccgagtagcagagctagaccaaatcatgcctcagtatcttggcgtttcgagagctgtcctagattccgtcattttctgccaccaggatgagagtctttggcccatgagcgagccctcggtgctcaagaaaaaatttgatgagatctttgaggctatgaaatatacgaaagccatcgacaatatcaaagccttccggaaaaagcagaatgaggagctggcaaaatacaaaatcatggaacagcatgccaaagaagacaaagaaaaagctgatcgtgcggagaaaagatccatcaagctacaggacgagattgagtccctccgcgctgaaactcatcagctctcccaagagatgcgccgtgttgcggaactcgccgacaaagcttggaaggagtctgaaagttatgctcagatcctagggactctggaaggaaagcgtatcgaggcaaagagtttacagtcaacaattgacaatctcaaaaggcaccttgttgaacttgatgatccggatgagtggctacaatcgaatttagaacagtttgagtccaaacagctccaataccaacaacaagaggaagctcaaaaggagaactacatggagatcaaggaccggattgagcaagcccgtcagaagttgggagtcaaacaagccgaatacggaaaatacgaaaatgacaaagccaacttcgagcgccaggtagaaagaagacagaggatgacaagggaaattgctcgcagtcataacatccgaggctttgacaatatccaggatcaatctgatattgacgacttcatgcgaaagattcggaagctgttgaaggaacaaaatcaagcgctggagcgcgttaagcgtgaggcgcaaacggagctacgcgaagtacagtctactctaaatgagattgggcagcgaaaatctgcattgcaggaaagtaagaatgcggccaagcgtcaaattggtgcagatgactag

SEQ ID NO: 17084 - DNA, 1044 bp, A.fumigatus
attgaggccacaaagcgagccggggattttgcccggttagatcatctcaagaaggaactcaaagagcgagaacgcagcttggaaactatgaaagccgcacatggcgaacgtcttgcaaagtacatcggtgcgaactggaaccctgccactctagagcaagagttccagcgcgtcctggaagaggagaccagaaacgtctcaaatgccgaaagtcaacgtgacggcgtcaacagggagctggagcaggtcgaattcaacctcaagacctccaagaagactctggctcagcgacagaaagagctcaatagctgcgccacagaaattcgcgaagccatcaatgaggaacccgaagagtatcccgatgcactcaaacaacgacaagcgcagctggatgtcgctagaagggacgccgagcaaagtgccggactcggcgactactttatgcgttgtcttgagactgccaagcaggtaaaagcctgtagactgtgccaacgagcgttcagggccgacgcagaattcactgtcttccagaaacgactagagggcttggtgaagaaagcacagattggtgtggaggaggaagatgttgaaagatttgaagccgaactcgacgcagcccgtgcagtaagtacagcttacgatacgtggactcgcctttccaaaaccgagattccggatctggagaaagaagaagaccagtatgctctccagcgggatgagctcctgaaccaactggagaatcatgacaagatcgtcagcgagaagattgaaaagaagagagacgttgaggctttgtcaaaaaccgtcaatactatcgtgcgatacgagagcgaaattaaaactatccggtcccagatccaggatctgtcctccaatcagcaggataatactgctacacgtactctggaagacatccaagaggagattgccggcattggcgacaagactagagctctgaaaaaaaccttgtccaagctcataaatgatagagagcaggcacgaactgaaatgaataacttagaattgcagctcccgagatgctag

SEQ ID NO: 17085 - DNA, 1362 bp, A.fumigatus
aattgcagctcccgagatgctagaagcaagttggacaatgtgaagttccaactagagagaaagtcagacttgcttgctcgaattgaggaatataaaaacttcaacaaccaacaacgggaagccatcacaaaggctgacagagatatcgaggagctgacaccggagttgctgaaataccaagctcaatacgacgatatcagccagcgggtcgaggcccgagaaagggagatgcagcaaggcatatctcaactgtcggaacgcatacgccaattggatctggcgacggaggagattgattcttacaacgaacggggtgggccgagtcagttggagcgtagtagacgcgagctccaaacgatcgaggctgaaattagccagcttgaagcggaacaggctaatattacaaaagaaatcaataagatctcggcacaactcaaagacagtgagaacacaaaacgccaatactccgacaacctgacatatcgccaggcgacccgagcactagcagaggtgtccgcagaaattgaaaacttagctgctcagaacgcagaggtggaccgaagccgcttcaaggaggaatcagagcgccgaacccgcgaacacaacgcgcttgctgccaagcaagcgagcaagatgggagagatgaagtccaaggatgatcagttgatgcagcttttggcggattggaacacagactacaaagacgccgcttcgaagtacaaggaagcgcacattaaggtagagactaccaaggctgctgttgatgatttggctcggtacggaggtgctttggacaaagccatcatgaagtaccactcgttgaagatggaggagatcaatgcgatcatcggagagctctggcaaaagacttacagaggtacggatgttgacacgatcctcatccgctccgataacgaaaatgcacaaggaaaccgatcctacaactatcgcgtctgcatggtcaaatcgggcgcagagatggatatgcgtggacgctgcagtgcaggacaaaaagtactcgcgagtataatcattcgcttggccccggcagagggtttcggcgtggattgcggcctgatggcactcgatggaccgacaaccaatcttgaccgggacaatatccgctctctcgcggagtccgtgcacgacatcattcgggcgcgtgaacagcaggcaaattttcaacttattgtgattacccacgatgaggagttccttcggcatatgcaatgcggcgacttcagtgattactattaccgggtctcccgcaatgagaaacagaacccgatcattgagagacagtccattgcagaggtgagttatgatgacctgcgttgctttcaaatcgctctcacatactga

SEQ ID NO: 17086 - DNA, 879 bp, A.fumigatus
gattttgataggatgtgcgaggaagtccgggagcctgccattcaggtgcccaaagccatggtgggcaccatcgtgctcaacttcgtggccggcttgggcttcttgctgccgctgacctttgtcctgcccgatatcacgatgctggtgaacctggcctcggggcagcccacccccgtgatcctgaaagatgcgctgggcagctcgaccggagccttcctgctgcttctccctctgctcattctcggcgtcatctgcggcgtgggatgtgtgacggccgcctcccgctgcacctgggcgtttgcgcgcgacggcggtatccccggctccaagtggtggaagaccgtcaacgcgacgctggacattcccctcaacgccatgatgctgggcatgacggtggagattgccctcggtgccatctactttggctccacggccgcgttcaacgccttctccggtgtcggtgtgattttcctgaccctcagctacgcgtgccccatcgcggtctcgttcttcttccgtcgtcgctcggagatcgccaacgccagattcaacctggggatcatcggcagtatctgcaacgtggttgctctgggtaagtctccgccccgctcgcccactccgcaactcactcctcctgggcaacctactgacgggtctacagcatggagtcttctggccatccctctgttctgtatgccgacgtacaaggtcgtcaccctggagaccatgaactacgcctgtgtcgtcttcgtcgggttcacgaccatcgccggactatggtacttggtctggggctaccgcaactacgacggtccccccaaggagggtatcgatggagtggaggccgatttccccgatctgcccgccaagtctgggtaa

SEQ ID NO: 17087 - DNA, 873 bp, A.fumigatus
caccctctgctcccactgcatcgagccagaatgaagatagcaatcacaggagcccgcggaactgtaggacgcaccacggtcaaggtgtgcgcggatgccggacacgccaccgtccaggtgaaccgaaccgagcagccccccggcgccattcccaataccgagatgcgcacagccgatgtggccatgaactaccagcaaaccgtcgaggccttccgcggctgcgacgcagtcatccacctggccgcgatccccaacccggtcggcaaggacgagtacgccgtgcataacaacaacgtcgactcggcgttcaacggcttccgagccgccgcggaggtcgggatcaagcggttctgctacgcctcgtcggtcaatgcgatcggtcttgccttttccaaccgaccgctccacttcgactacttccctatcgacgaagaagccccccagcatccgacggacgcgtacgccctggcgaaacgcgaggcggagatccaggctcaagccttcgcggagtggttccccggaatgaagatcgcgtgcctgcggatccacgaggtgtcctcgctggaacgggtacaaaaggtccacgcgaatgactgggagaatgccggggtgaagcagctctgggggtgggtgaatcccgtggcgaccgcgcgggcgtgcttgctggccgtggagaaatgtgataactgggaggggtgtgaggttttcaatatcgtggccccgacgactacgcaggatctaccgtccgaaaagctggcgcgaaagcactatcctgacgcggagatccgagctgatatgtcgggtaatcagggattctggaccacggataaggcaaagcaattgatggggtgggagcattatgagacggagtag

SEQ ID NO: 17088 - DNA, 207 bp, A.fumigatus
ttagctactctctctcctttcaccagaatatcctgtatttcattggatagaatcaactacgaggtcttccacgtcaagctaaacaccttctctccgccccgagacaaggccacctccacactcccatcctcactcttcacactctccgggataacctcccccttccgctccagcacaatcctctccgtcgcctccggcaacttgtag

SEQ ID NO: 17089 - DNA, 336 bp, A.fumigatus
cgagtgccaggcgtgacgaccaactccgcggccggcgtccgcgactatgacgaattcttccccgtcttcgcggagatggaaaagcacgacatggtgctcaacctccacggcgaggtccccggctcgcccggctcgggcatcaccgacatgaacgccgaggaaaagttcctgcccacgctgacgatgctcaatgagaagttccccaagctgcggattatcctcgagcattgcagcaccgaggcggcgctggaggctgtccgctcctgctcctcgacggttgcgggtacgcttgcttgcccttgcctttgttatatgcgttgcgggctaacgaactga

SEQ ID NO: 17090 - DNA, 411 bp, A.fumigatus
gctcatgcacattctatcccctcctccaatgcgttgctaataccatctagtggaagcgacagcgccccccacccgcgtctcgcaaagcaaggcggcgcagagggcacagccaaaccgccggcgggtgtgtttacgcagccctgtgtcgtgcagtatgtgcttctggcgctcgaggagggcgtggaacgcggcgtcatcgccaacgaggatattaccccggagaagctggcgaattttctcagtgggtatggacgtcggttctacaagttgccggaggcgacggagaggattgtgctggagcggaagggggaggttatcccggagagtgtgaagagtgaggatgggagtgtggaggtggccttgtctcggggcggagagaaggtgtttagcttgacgtggaagacctcgtag

SEQ ID NO: 17091 - DNA, 285 bp, A.fumigatus
aaacctcacacccctcccagttatcacatttctccacggccagcaagcacgcccgcgcggtcgccacgggattcacccacccccagagctgcttcaccccggcattctcccagtcattcgcgtggaccttttgtacccgttccagcgaggacacctcgtggatccgcaggcacgcgatcttcattccggggaaccactccgcgaaggcttgagcctggatctccgcctcgcgtttcgccagggcgtacgcgtccgtcggatgctggggggcttcttcgtcgatag

SEQ ID NO: 17092 - DNA, 306 bp, A.fumigatus
ggaatccagctagaagaccgcctcctgacgtcctccgcagaaatgatcctgaaagagacaacccggctggagctgccggcggcggccgacatgcacgtccaccttcgtcaaggcaagatgatggaatcggttgtgccgcagattcgcaacggaggcgtcgataccgtttttgtcatggttagtgctgctggtcaactgctgacgctgacgctgacaccgacgctgacgcgaccagcccaacctggtcccccccgtcacgagtgttgcccaggcgctggagtacaaggcccagttgcaggccattga

SEQ ID NO: 17093 - DNA, 192 bp, A.fumigatus
gccgtctgccttatcgcctacgcctgtgcatacgcccgccttctctgcatctccctcaatgtcttccgcatctccttccacgcctcctgtgccccgttccacacttacacctctcttagcgcaaaacgaacggccgctgcctacagacgcacagagttacgccaaattctttgctcggcgcgatggtggtag

SEQ ID NO: 17094 - DNA, 1662 bp, A.fumigatus
tcgtctgagtgcattcaagaactgactgatatgtggaatcacaggcatgatgccgccaaacctcatcttgctgattttgacacgacccttgccgaaattggctcgctgtctgtcgagttcactcgactggcacaattgactaagcaagacaagtactacgatgccattgcacggatcacaaacgagctcgagaaactgcaggatcacaccatggtccctggtctgtggccgcttaaaatcgatgcttccggttgtaggaccgccgcctcacagctcaataacgaggtccctcgcaatggtgtggttgatactgagccgtctgccttatcgcctacgcctgtgcatacgcccgccttctctgcatctccctcaatgtcttccgcatctccttccacgcctcctgtgccccgttccacacttacacctctcttagcgcaaaacgaacggccgctgcctacagacgcacagagttacgccaaattctttgctcggcgcgatggtggtagcttacatatcgacgcggagccggcaaactatgacgccccgaatgaaggcgagaattctgcagttactagtagctctggtgataaggcctgcacaggaggtctcaccgcgtcgctctacccgaaacagaagtttgggctcggggcccgcggtgattcaacctatgagtaccttcccaaggagtatatgctcttgggcggtctcaacgagcaataccccgcaatgtacaagaaagccttgaatgcagcgcgcgaacatctcctctttcggcccatggtcaaggacgagcgtgatatcagattcttgagcaccatgacgctgacgcgccctatagcggaacaggcccctgaaagtgtctctgcgacgtatgagggaactcatctgggctgctttgcgggtgggatgtttgctcttggtgctaaactatttggtattgaaggggatctggaccttgctgctaaactgaccaatgcatgtgtttgggcttatggggtcaccaaaacaggcatcatgcccgaacacttcttgctcgtgccctgcaaaaagggcgagccgtgtgtctggaacgagaccgactactggaacgcactcgatcctaacgaagaacagcggatcgcggaggctgaaaaagccattgagcagaaatcgaaagcgagtgactcgactaagcgatctactacaaacgggattcgtaggcgtgattcatctggaaaatggcacgtcattgccgattcggcaaagacggacgacctgatcaaccatgatgaagatgaagtcaagaagcaagatgcaaaggataaagctgtccctcatgaaatatttgtcacccagcgaatcatgaacgaacgcctaccgccaggcgttactcgcattctgaaccgtgcgtacctccttcgtccggaggccatcgagtccgttttctacatgttccgcataacaggcgacaactactggagagagaagggatgggagatgttccaagctgtgtccaagtacacccgcaccgaaatcgcacattctgcgatcaacgatgtcacccttgaaaagtccaagatgcaggacaccatggagtcattctggcttgcggagacactgaaatacttctatctgctttttgccgacccgagcgtggtcagtcttgatgactatgttctgtaa

SEQ ID NO: 17095 - DNA, 201 bp, A.fumigatus
ctggttttcaacgagcagttcatgatttcagcgcatgatcctgtggtcgataaatcgtcgactcccttgactaacaaggtcatcaaggtcttggctatgcatggaaatctctacaagacgttcggcgagaacatcattctcctcatcaacagagaaggtaccaacctccgagattcttgtttagcaaaacaaattccctaa

SEQ ID NO: 17096 - DNA, 1239 bp, A.fumigatus
  unsure (1219): Identity of nucleotide sequences at the above locations are unknown.
cgacttctagcggaaacatctcttcagcttctcacgctcaagctcctatacctcatatttacaacccctagtacttatgaatacttctacaccaatgatcttcatgtcctggttgacattcttattcggaatcttctggacttgcctgaagaagcatctgccctacgccatacctacctccgcgttctctacccattgctcgctcacacgcagctgaagtatcctccccactacaagcgcgaagaactcaagaaagtgctcaatatcttgggccggggccagctatcaagcggtgagggcgacctcgagagaatattgcactttgaggaagtcgacgaaaccacgaggagactagtcctccgatgcgcaacagtcgagtggttgcgaaacgaggaatctgaatcacatagagagagcgtcgcctcgtttgactccacgaccgatgcagtccagacggacgcggagtctggtactcccaccagcatggaaggcagctcccctggggctctatcacccacccggctttgtggatcgggctctcctaagccagacgcgcatcgcaagccaagcgcggtacagcgtctcggaatgcacgtggagccagcttcatgctcagctatcagcgtgcaggaagttgccaaccagcacgagaaacctggcgtcatcacccctagtcgcaatgacgcccatcccacagtgaattcttcaactacggacaccagtgcgaccatcaaacctaaaattaagccggagcctcccaaatcccgacgccggcgcgggagacgcatcgccgaggaggaagacaatgccgataaaacccccgagggcacagcatcagcagcatcgagtccagccacggcttccacatctgtaactcctctggtcgattgcggaaactctacaagcatgtctggtctcgctccaccagtccctgcacacttacgtcgttccgcatcgaatcctcctccagccctgccacctcctcgacgttcgagtcacccggccgtccaggctcatcctctctccggcaactgcagccctctgaatagcagtcctctgaacgtcccctccgtcggcaaacacggccagaaacctgaaccgccgaaggcacgtcgttgggcgagaggaaggcacgcacatggtgactccgcggacaggtccgggaaggatatgccgatgaatggtgcaatcttgcgcgtattagccgagacgggccggnagagaaccaagcaatgcgtt

SEQ ID NO: 17097 - DNA, 1164 bp, A.fumigatus
tcacatccttattcccgtcactcttttattcctcttgttgaggttttgatttttttgattttttttttttttaatttttttttcctcctcatcttcgttgcgtcgcctcaccgtcgctatcggttgcctgccatgtttcgagcccgtcgctatcgagtctccctggtttttgcagtcatctttgtgctgatcttcattcatttctcccgatcccgcgatacatctgcgagtactgtgagcatccccgcgccggtcgatcagcccaagacataccctcagagaccaccccctgctgcgcccgacaacaaaaaacccatcgcacccgaatctccctcctcccatgagccaacctccgaattagtctctactccggctcagcaagttgagaagcccgctgctcccgactcaaatcccccgcaggatctagcgtccggcgcgcatggacaagcgtcatccaaagatgtttcggttgccggtcagactgcaacatcatccagtgacaatgcatctgctaagggagacggttcagaagttcccccgtaccatttggactatcacggccacgcacgtcttgaggcggaccttccggaaacgaatcgacctactgtgcactggaagcaggtgcaggaacattatcctctggcgcctgaaaacctcatcaaattgccgacggggaaatccaaggcccttccgaaagtacaggctgcttttagagacgagacaacctcagacaagatacagcgggtgcagcggttgtcgaccataaaggcggcctttgaacatgcctggaatggatacaagacttccgcgatgggacatgacgagatcaaacctctgcggggcgggttcagagacccgttcatgggttgggcagccacgcttgtggattccttggatacactttggatcatggaccttaaggacgagttcgccattgccgttgatcaggtgaagaagatcgacttcacaaccagcaaaagggacgagattcctgtatttgaaacggtcatccgctatcttggaggattgcttggcgcttatgacatttccggtcacaaatacgacgtactcctcgagaaagcggttgagctggcggacatcgtgatgggtgcgtttgatacgcctaatcgcatgccgaccatgttctacaaatggaccccgtaa

SEQ ID NO: 17098 - DNA, 369 bp, A.fumigatus
tcgctctctgaaaaaatacaggattatgattgcttctatgcctcagtgttcgaggctgaacagccagtgctcaagtctttgcctctggcggttcaacaaaagcagatcgtggtcacttgtaactacgaagctcgacggcgagggctgcggaaactgcagctaatcaaggaagcgaagcagatctgtccagacgtagtcattgttttaggtgaagacctcaccagattccgcaatgcttccaaggagctctatctgtttctccaggatttcgtctggggtaagcgagtcgagaagttggggttcgatgaggtgggtgtataccctgcctgtgctttcaggatttggccccatgctaatgatcaatcatag

SEQ ID NO: 17099 - DNA, 1458 bp, A.fumigatus
gtttttctcgatgtatccgacatggttacctacaatgtcgagatgctgaatcgtaatgacctaaaaaactcattcttccaccttgaccgtcgagatcccacagtggggtttacgtacgatgcgacagactttcatggacacgcctatcaagctgttcccgacgttgcaaccgacgcggcctcggagtggcttcgcactagactgttggttgcgtcgcatttggcagcttatcttcgaaaccagctcgagtatcagaagggctacactgccactgtgggcatttccacatcgaagcttctcgcaaagctagtcggaaacacacataagcccaatagtcagacaactcttctgccgccttatactgtggcggagcatggggcgaaaagtaacgtgctacacttccttgatgctcatgagatccgaaaaatccctggaataggctcgaaaattgcacatagaatcaaatcattccttactacggctgtaaatgggcccggaacagaggttggacggactagggatacgagaccacactcagacgaccacatcgtcacaattggcgacgtgcgttgcttccctggcatgggccctttcttattagaaaaaattctagggggtccaggatctcccaggggcattggggcgcggatatgggggctgatacacggggtggataacaccgaggttctacaagctcgagatctaccgacgcaaatcagcattgaggactcatacggtcgcttagacactgtcaacgaagtcagaaaagagctggttgcactgacagtaagcttgatccggcgcatgcgggttgatctgactgagatggaccccgatgtccattccccagccggcgagcccgctgcagctgatgctcttaatacaaaacgacagctccgatgggtggctcacccaaggactcttcgtctatcgacgtgtcctcgcccagcgccaggctccgatcagtcacagcgccatggtctcaaccggatatcacgttccgcacctctcccatcctacgtcttcaacctggatgagaacgcggatgctttggcagagcgacttgtacaagacttggcgatgtcaatgttccggaagctccaccctgaaaacacgggttggaaccttcgtgttctgaatattgccgtgactaatatgatcgagagtgctggcgaccagaagaacagcagtggtcgagatattgggaagatgttccgtaaacaggaagcgacgcagcacgatgatcctacgccagagctggcgaagattaccttcagcggcatcgctcagggggacgtggattcgaagacggttgattccgccgaagccaacagcacctgggaggagagcgacgaagatggcgacacgccgtgtgtcgcctgtacaatttgtgggatgttgataccacattttgccattcttgctcacaagacgtaccacaccacactggatgattga

SEQ ID NO: 17100 - DNA, 1890 bp, A.fumigatus
gggttccgtccacttgtcgacggagatgaggtttctcaaaagtgctctgccatttgttgccagtgcactttcacttctatctgttcaggctgcaggttagtccgcattactgcttcgacaaatcttcgtcagggatggctaattatcattcaatttcgtacagcccgatcgcaagaacctagtgccatccaacatgtctcgatactcgaacatgccgtgatcaacacaccgtctcacgaggtcgaccaccttacagatttcgacgtcacattcgaacttccagataaacaccaaaccataaaattagaattagaacccaaccatgatatccttgccgatgatgcatacgtgcagtaccttgacgcggaaggaaacgttcatcgcgaggaaccgatccaacgacatgaacacaaggtcttcaaagggcgatccctgttgaggagagacaatggtctgtggaggcctgtgggatgggcacgggtatacgtccaacgggacggctccaaaccgctgttcgaaggtgttttcagtatcgacaatgacaaccatcacgttgaactcaagtcgacttacttgcagaagaagcgcgtcgaagatgccagtattcccgaccgaaaagacgaatatatggtcgtctaccgcgactcggacatgattcgacaggtccgcagtgagttgaagcgttctctgatcagctcgtcgtcctgccaggccgagaagctcggcttcaacagtgacccgcagcatccgatcttccgctctgagtttcaagacatggacttgggtatgagcagctatggttccatgtcgctgaactccttgtttggcctcagcaaacgacagtcggatattggcggcgtttcagggaatgcgggtggtgttaatctggcccaaaccatcggtagcacatccgggtgtcccaagaccaaacaggtggccttggtcggcattgcggcagattgttccttcagggcttcgttcgacaacgacgacgctgccaagcaatggatcattaacgtggtcaacagtgcctcggacgtctacgaaaaatcgtttaatatctccatcggcctgcgaaatctcaccatgaccgacaagacctgtcctgagactgcaccggcttcaacgcaatggaacatgccttgtgatcagagcaacatcactcagcgactcaaccttttctcccagtggcgtggacaacagagcgatgacaatgcctattggactctcatgagcaattgccctactggcagcgaggtgggtttggcatggcttggacaactctgcaatacagaagttaccggtgacggcagcaactcggtatctgggaccaatgttgtcgtccgcgtctcgggtggtggatggcaggtctttgcccatgagtcgggtcacaccttcggagcggtgcatgactgcgacagtatgacctgcgcgcagaatttggaggcgtcctctcaatgctgcccgtacaacagggggacctgcgatgccaatggaaagtacatcatgaacccgagtacgggagcagatatcactgcgttctcaccctgcacaatcggaaacatctgctctgcattaggtcgcaacagtgtcaagtccagctgtctgtctgataatcgcaacgttgttacctacaccggcagccaatgcggaaacggtatagttgaagccggcgaagactgtgactgcggcggcgagtcgtcctgcggcgacaatccctgctgtgacgccaaaacctgcaagttcaagagtggagccgtgtgcgatgatgccaacgacagctgctgctcgcagtgtcagttctctccagccggaaccgtctgccgagctagtctcggggaatgtgatctgcaagagacctgtacgggcaattcaagcacctgtcctgcg

SEQ ID NO: 17101 - DNA, 459 bp, A.fumigatus
agttacggggtcttcctttcttattatctctcccacgatgtcttccccaacaccagtgcattgtcgtacgccttcactggtggtctgagcatctcctgcgcgctcctcgttgcaccgctggccacacatctaatccatctcttcggaactcggttcgtcctcaacctaggcgtcttcttcgaaaccctgtccctgatcggatcctcctttgccacgcagaaatggcatatctttctcagccagggagtctgtttcggctggggaatgggtttcctgttcgttggcagcgtggggatcactccgcagtggttccaacggcgaataagtcttgcaatgggcatcaacgccgccggctccggactggggggtctcatctggtctcttgcagtcggcgctatgatcccccgggattggtctaaggttggacattcccgggtcctcggtatccttcgcctgcgt

SEQ ID NO: 17102 - DNA, 1407 bp, A.fumigatus
cacctttggaattggcaccgtgattaccgtgagctaataggcgacttatctccagcaaactatctgaaagacttgcgaacgaaccgacctgtccgcccgagcggatcacgacccattccatcaagagcaaccggatcagttgcaacccctcgtgaggctctccctcctcgcgcgtcgtcgtcaatgtcaatgtatggacagcccggcccccagcctacttcgcccgaaagagagcgacctcgagccagcagctctctgtcaacccatcgcccctttgaaccccacgtttcgctggggagctcagccgggcgaccattggtacaggaaccaagaatggtgccgatacgcaagaatgtctcaccatcgcacgttttctcacgcccgtcgcctccatctcccaatgcggtttatcgtgagagtggtcagcggcgggtagagaaggaagaagcacgctccttgcgggacgcgttgcaggaattggacttgcatgacgagatccgcctccatcaggctgcacaagacgaagccacggagctagtctggatgcatcagaaccccggtgtgccctacaaaaacccatatgcgccgtatcataaccccgacctggacagatcgtcccagacgccaaagagcgccggccgctctcaaaaccaaagtgataaaattggtgggcccatggataatcatcgatcgacctcagaaagctcttctgacagccattttgctgattctggtgggataggtttaggtgtaaagcatgacagacaaccccagcatgggctggaggactctggaagcagccctacaaagtccccgtcgccgcggaagaatgtcagagtcgactttgcgttgcccgccgaggaatcgccctcgaaatcgagaggcggtgggaactcatgtctttcgagatttggtaacgagtcatcgagggggatttttcgaaatcctcgtgactcgatttacgaggaaccgaaagacactcgtggccccgaggaggatgagcgaccggcattttccagatccgattcgtcggctctcagagcaaagccgcgcaatgccctaccacggggctctcgaccccttccgggaagactaagcagtcttccgttcgttgacaagttggcgcggttcgagctacataagcaacatccaacccaatcgagaaatccggactataggacgaacgacccgcacccgcaagcagccccggatgggaatgcggacaaagagcaggccgatcaaggcgttcgtacgaagaatggccttgaaattcgcagcgaagagatcagggcagctacaagtaagaagctcaaagaccgaagcacaaggttgcctatgcccacagccgtcagtaatcgcgttgggccggccaatcgtgagtttcgacccgtcttggaagcccactga

SEQ ID NO: 17103 - DNA, 678 bp, A.fumigatus
ttgcgtcaaggcgttgtcgctcgttctttacattctatacacaccagagctgtcactcgtttccagctccattcattctttacttcctacaggcgaaatcaaaaaagctctctcgcttatcaaaatcgatataccagcgcccaacatcgaccagcttactcccaaagctatttcccttcccagtatcgcgtttcaattgcagcctgcacatctcaaacttcagtcttatctatcaattctgcgatcaatatgcatttcaccaaagctctgctgtttaccgccgcggctgtcgcgcctttcgcgtccgctgcagcgcaagctgaaccgaccaccaccatcaccgtcaagatgatgagtgttggcgcttcttcgactcctacaccgtcccccagcagcagtagcagcagcgccgtcggcgcgactccaagcggcagcagcagcccctccattcgacccaccggtggcatctatctccccagctccggccgttggaactcaaccagctcttcgatcgtcaaggtgacagtccctgccaccgtcagtggcccctcgcagacaaacgctgctgcctccgcggcctcgtcggcaccatcccagggtggcgccgctacctcgatcaacttctctggccctctgactgctgttgccatggctctcgtgggatttgccctgttttaa

SEQ ID NO: 17104 - DNA, 216 bp, A.fumigatus
tttatgtctgtctatacccttaatttgtctttcaagaagctctggcctcttgcctcttgccttgtttcctctagatttagatactctttacatcctattccactggatttcttcgtgatgatagacggtaccgatggttctaccatgtcgccagttcctatcatccttgaagtactaaagtacccttatggtgcttaccgtggcatagcgggctaa

SEQ ID NO: 17105 - DNA, 606 bp, A.fumigatus
gcggttgtcaagctgcctgttatcttcatagacatcgagactaacagtcgttctgtacgaagttccggtgggcgtacaggaggctcatctcgccctggttccacctctagtagcaatcgcattggcggtgcctactacgctggcggcgccacatctacatacaaggccggcacgcgatctcctctgggagtcactcctttccttttgccagtcgctgcactggccatcttccctggtatctggctctacggagcatatgcatacccgtacagtcatcgttacaactatacaaatgaaacttctcgccaaaacgaatcattgccggtagtctgcttgtgtcaagaatactcagattgcggctgtgacgataacaataacagcacctactatcaatcactgttcaatggcactcaacctgtgaactcgagtatcgccaaggttgtcaacgccaacggaaccgagaccatctacattaacggaactgtgccgaacgcaacggactctacgagctcgtccacctcctcagctcccgctacagcccttcttgaggctagtggatactgggttatggtcgctctggtggctagtatggtttgggcgctatga

SEQ ID NO: 17106 - DNA, 363 bp, A.fumigatus
  unsure (28): Identity of nucleotide sequences at the above locations are unknown.
ttgatccctatgtgggactggtttgggnttttccatccgggcctggggcaccatgtgagctctcatgagtgggaagaaactctgccacaacttttggagaccaaggtcccgatcattaccactgggtacacacagtgggacatggagagggatatcaactgggttcgcgagaaatgcgctggtgaattcgacatacttcttgagccaggcgagaatattttccgtagtttgcggtgggatttgaacgacctggaccctcacgatgtttcttgcggaaattggggtctgtgggcattcagaggaaagaggtatgtgatgactgttccaatttctgaaacattggctaacttcagtccggcttga

SEQ ID NO: 17107 - DNA, 1989 bp, A.fumigatus
agctctttagcagctccatcatcgcttcaagaaacgttcatcaaaattcatttcggcaatgtatccaaaaaccctaaaaaagttccacggatctcgctgcggagtaaagctctattattcgagctagaagatgatgctttcgagtggaaactaggttgcatctatcggacaggtctacttgagcagcgacaacgtttagcgcgagaggaggcgttcgagctcaaggttcaaaagatcagggagtcaggacagcgacgggccccatccaggttgagaacaaggtccagccatcggacacttcgcagcgaacggacaagccatgacacgaagaggagcaaaagtgctgatccgaagccccgcggccatgctaccgagacaaagggtggacgagggaggagattccggtatgatacggagggctcggcttgcctgtctaccgattccaaaatctcggaggaaaaggcttggctccgtctccaagaacacaatgctcgatcgtggaaacagaagattgatgcggcttttcgctttcaaggcagctctatcaaggagattcggaacctcttctctggagccgatgagccgcctgatgatgccactgtaaccgagaaaattctcgccattccaaacaggcctggtatcatgtcagccttgataactgacctcagtctagtcatagacaaaccgtctttccctattgaagagttcccgtcgtttctccataggcttggaaagggaatccctctatccacacaatacgctttgctcattccaatgagcttccacctgaacatgggcgagtctcgagtcaacctgagagactaccccttggacttgttgcatatacctgccttacgaccgggccagtctcccagactctcaagttggtcgctacgaacggatttcgttatagccgaagaataccgcgactacaggtcgtcgagaaaggtacagctcgaactcgttccatcaaccgaactttcggatggaaccacgagtcctcccttcttgattgatgtgtggcgttctgtgtcccctgtcaagacttactccgaccctaccatcgaaatcaatactagtcttccgacaagcatctcctggggtatgtcatatcagcctgtgattcaggacatgatgaaaatcatagaaggcttcaccaagactgagatagatccctctgaaagagttgggttctgggacaagatccgattaagtttccactcgcgcatacgagttctatggaaggaggacggtgacgttcacctgcgccttaaaggctctagggatccatatgtggtaactggcttcggaggcggcttcgtcatgtgctggaagaaagacgtaaaatgggaaattcacaccagcgacgatccgaaggaattcatgagtgttacaagtggggaatatgtgctggcgatcccagactacagtaacgaggctcgatacgcacaagaggccaccgcgcacgacttggagagcacttcttcttcaagcgacttcaagaacgcaacacttttcaagaaggttgtgatgaaattgtcaggcgacgtccgattagttgctggcttggtctttgaacgtaacatagacggggacaagcggtcctttgagttcaaaccgcattacgatgtggtccttcgaaatccggagtttatcgacccagaggagagaaaggtacatacaattaatatttcggtgatttttctgtctaacctttcatcacaggactacgacgcctatcgtgggttccgcagcaaccacatccacttgtccatctcagtcgttgcccctgtgagcaggaactgggatgtcgatcatgttcagcccttaagcagctacaacgccgttcaactgagtccgcgggtcttcacgcactttttaacttggtgggctctaatcttgggtgggatgtcttttccaagccggcaggggcctctttgggcctggtttcaccaaaaccagcaggaagttcattcggcaccttggtaa

SEQ ID NO: 17108 - DNA, 2949 bp, A.fumigatus
  unsure (2768),(2777),(2887): Identity of nucleotide sequences at the above locations are unknown.
tcgcgagacgcgatgacgctctttaatccgacgaccgtcctcgtgggtttcctcctcctctacctttcctcgttccttatcttcgccatcgttcgaatcgcaacgggagtttctattcagcgaatcggctatttttccctccgccgcattgcctatgttccaagagaagggatacaagtcgaacttcgtggcttgggattatctctacatcctccgtccttcgcgcaaccgacatggctgagtcttcgcttgacggaactgaaagtgaccgtgaatccttcggctttgggcaaggggcgtaatagcgacacagcaaaggcggatgtgcctgagcctcaaagctcttcggacgtggcggatacttcgcaggatggaggggagagcagcccagcacgagctcggcggagcaagacgtggaagacactcacacggatgaaagagcaggtcaagagactacacagaaagatacattggctcaaattggtggacgtcgttgcagtgaatacaacgatcaacttcctcgaagctggccaattccagataggatcgctctcgttggcggtggacaccaggcggaagatggtggaccgggcaaaggtgtttcgccgaaaaaaggatgagtctggtgaactatgccctgccgaatggatcatgaacgtgcaaaatgtccttctcgcggtcgatggcaacgagccggctgaggttctggatcatgttcaggtcaatatccacggactcctccatagtgaccgcgacggactcagagatacctctattgcactgaaaatcggaagactccatattccatatgacgaattggcaactgtctcgcaacggattaagcagttccggcggtcgaggaaggatctggtcgtcaatgacacggacgacgagatatcgtttgccgactttgtcgaggagttggacagacccggcagtcgtgacgatgtgattgtgcaaagggtagctgattcgaaagaatttgcaagctccctgctacgtggcattcgggaaattcaactggctttgagttttttcagactgtctcgcattgtccagccgtcttctgcgggacagaaatcggtgtacttgaacgtcatatcccatgaaatcggtgttgacctgcatcgcatggaccaaaggagtcccgcacatcgcatgtattttcagcgggacgacgtcgcacatcaggctcttctggccgcgatatctctctcagtaagcttggatgacagctcgggtgagacggacaacatcgtatacatccctatggctactacaacaatcaagactacgcttccttccaaaaccgttggctctttcgataatcataatgcggaggagcgcaacacaaatatcctctttgccaattttgtcgttacctcgccctctctcgatctagaaccacaccatcttgaccgacttctcggtctggttcaaacccgagcatcctcctcgcgtggaaagaagcgcgacaatcatcgactgatttcgcggctgctcccaaaagccaatattaagctgtccgtgcatgagcctgtcgttcgactcgtcctccccatcaataaagaatcagccggctctgatgatgactataaccttctaatctcctccatctccgctatagctcttgatatagactcttcgcactcgtcagaaggtggagtacattatcttctctcgtcagtttatcgggtagcagatcacaagctgtactatcagaccccaacaggggtcaagcacattctgctgaccacagagaccctggaactcaaggtcctcctcaacgagtcgccagaggtgtgcgtgatcgctacggggacactgaacacatgttccgtccacatggtcaatggtgaggtcaatcgcggcatccgccaggtcgttgagcagttgcgagcccagatgcagaacaggaggagggcctcgatgggacaccaagaaaggaaaccgagcatactaaggcgcattccgccatggttactcaattttcagtttgaggccacgggtctcagtttagaaatcgctggagtggacagtacagtctcaaagctttcccgaggagtttcactacagctgcaatcatggactgcagaatacagagcccaaaaagccgaacccactcacatcagccttgtacggcgacgcaccccaagtcactccaccatcggtgacgaatcgccgtttcgatttcctccaacatcgccacccagacaaattcaacatggtgctgcggatgggagacggctggcttttcacgcccgtggcttcgaaggctttgtgattgaatctgaagactacttggagcctgagccgtttttctcacttccccgatttgaggttgcactgagcacccaaagtgaccgtcttggtcctatcttccatatcaactcggtcctgaagggtgtctatttgcagtattcactctatcgctattactgtcttggagtggcggtgtcggttatccaggatgcattcattcaacaccctacagaagcaccaacccagccaccgttcgaatggcaccccaaggattctgcaagctctccctctgttccacggccaccgctccaaaggagtgagctcataacggtcgatatcagagctacagtcgttcaaatcaaaactttcctacctgccgaccctccaatgctgctacagatatatggcttggcggcggggtctcaccgtctgtcatctccctacgtaaaggcgcagctgattcgcttacatgccgaagctcccaagctcaagggtgtttgggccanaattattancatgaataacgtcaaggctgacctgcgtaagttcaaactaaagcagggctctaatctatttgaagagaagtcaataaacgtctgggccgattttatccgcataggtgtcncacatcacatgataatgcaccgtgtcttcgacaactgggtcaacactgctaaagctctttag

SEQ ID NO: 17109 - DNA, 243 bp, A.fumigatus
aaaatggtcccccgaaagcgcagttatgccagatttactaccatgaagactgctaccagcgccaacgaaggcccacatttcgctgtccccagcgccgatgtagtcgaagctacaggcgcaaagaacacctcactctgcactctgcaagccacaatcaatcgccagcaggcgactgtccgttttgtgataaagtcttctccacatccctacgagctgctctcgtctgttgatgacgctgattga

SEQ ID NO: 17110 - DNA, 411 bp, A.fumigatus
ttaaaccgggacaacgattttcgttctaagatcatatctcccagctcaatctttgcgaatgcaaacttgtatcgcacaacaatgtcttgtcatcaacacattcccagagaccaagatgggatccctggctcgcctctcagcaccaaaagccgtgtcctggaaggcggcgccagcatggttcaagatttcacgcctgtcaaacaaatttgcgcccatctgaacgcattccacgtttatgcgtcagatcagacaagagccgtggaagcgaaccattattgtacacatgttacagaaggtcttgatagctcccttccttctgcaagagaaagacagctgatctcaaaacgcagatctcaggcagtgtatgatatacgaatccaccaagccgaatgcccggttgatcggcgttga

SEQ ID NO: 17111 - DNA, 549 bp, A.fumigatus
cccggcaaggtacagcaagcacaaagtggagagacgacgttcatggcagcggtaaaaagctctacgcgcaaaagggcaccggtcgggcgcgtgttggcgacaaaaagtctccaattcgacggaggaggaggtgtcgcttttggtcctcaccctcgcgactttgctacaagtcttcccaggaagatctacgaccaggcttggcggatagccctgagttaccggtacaagcgaggccagctgattatcatcgacaacgaaatttcgattcccgagggtgccacaccgcaccttatcaaggagatcttcaaggtcaactgctggggccgcgaatttggacgctcaacattaatcacagaccagctgaatgaaggcttgtttgagacggtacgtgaggtgggagagcacgcaaagatcctgaaccgcaaggacgtggacgtcaaggatctcctggagacaggaagactggtcattgaaaagcaggcgctggaccgcattctgtctcaacattcaagggacttggttaacaagcctgccacggctgtgtattaa

SEQ ID NO: 17112 - DNA, 549 bp, A.fumigatus
tctcaaaacgcagatctcaggcagtgtatgatatacgaatccaccaagccgaatgcccggttgatcggcgttgagtatatgatttcgccgcgcttattcgagaccctcccgtccgaggaacgcaaactatggcacacgcatgaattcgaggtcaaaagcggcatgttgatcatgcctgctccagctggagtgccgaagcctgcttgggaagcagcggaaacatcagagatgagggaggtcattctgctgtacggaaagacgtatcatttttggcaagcggacaggggcgatccccttcccttgggcgctccacagctcatggctagcttcacatctgaagacaaagtcaagctcgttcatccgaagggtctcgatgggttacttgcggggagggacgaggcgtttggggttgattataaggttaaggcagagaagaggaaagatattgagccgcccaacctgagtcctggtaagcattttggggcatgtttgagaagctctataattgctgacaactgtcacagatgccgacaccatggtgtagaatag

SEQ ID NO: 17113 - DNA, 396 bp, A.fumigatus
tccagatatgctctgaccataccaatggaacgattattccgctccgcgctgagaaacgcaacccccggcgccgtcttccgcctcactctcgacggcctgggcctattctgcgcatgcacgctggtctgggaacacctgctcacggtgcagctcagcgaagggacctcgatgtacccgacattcaatccgcggggcgattacctgatgatatcgcgggtgcacaagtatgggcggggaattgaagtaggggatgtggttcggttctaccatccgacgttcctgggcgtcaatggtgcgaagagagtgttggggatgccgggggattttgtctgcagggatctgccgttcagtacggaggtgggcacgagtcgggagatgatacaggtaggggtttga

SEQ ID NO: 17114 - DNA, 222 bp, A.fumigatus
atgtcgactgcccccgaactccccaaagaactccccggagacgaacccgacgatgtcctattcagctccctttacggtgtacgattgattgagctcaaccgccccaagaagctcaattcgttgaacgggtcgatggcacggaagattctccctcgattgaaggttagcgactcggatcctgcagtgtgtgataatgtcttggttgctaagccggtggaatag

SEQ ID NO: 17115 - DNA, 933 bp, A.fumigatus
gaatgggaaaaatcccagctcgcgaacattgtcatgctttccggtgctggtacaaaagctctctgcgcgggaggtgacgtcgcttctttggctctacagaacgaacaaggcccagaagggcagcaaaagtcgaccgatttcttcggcctcgaataccgtctggaccatattatcgctacttacacaaagccattcatctcggtgatggatggaatcacgatgggcggcggcgtcggtctcagtgttcatgcccccttccgcattgcgactgagcgtactgtcttcgccatgccggaaaccaccatcggattcttcccggacgttggtggctcgttcttccttccccgtctcgacggcgagattggcacgtatctggcactcacctcggagcgtctcaacggcgtgcaggcgctctacgccggtattgcgacacactacttccactccagtgttttgagcaatctgacagctcgtctggcagaactggtctttagggaccacgcgtcgcttgccgagcgcttggacctggttaacaagaccatggccgagttttccgtcggccttccgccggtggaacaggagcctatccaacttgccggtagcctgaggagcgccatcgatcgctgcttcaagcacaataccgtcgaggagatcttcagggctctcgagcaggagaccgtgcacaaggaatgggctcagaagacactagagaccctttcttctcgctcgcccacatcgctcaaggtgactctgcggcagatgcgcgtgggcaagaaatggtccatttccgagaccttccagcgggagtaccagattgcggctcagttcatgaaacaccccgactttgttgagggcgtcaaagcccgtctgatgtcgaagccccctcgccaagctacatggcagcccgctaccctggaaggaagtcaccaatga

SEQ ID NO: 17116 - DNA, 255 bp, A.fumigatus
atttcctgcctgccgctcgtggtgaaaaatggtcccccgaaagcgcagttatgccagatttactaccatgaagactgctaccagcgccaacgaaggcccacatttcgctgtccccagcgccgatgtagtcgaagctacaggcgcaaagaacacctcactctgcactctgcaagccacaatcaatcgccagcaggcgactgtccgttttgtgataaagtcttctccacatccctacgagctgctctcgtctgttga

SEQ ID NO: 17117 - DNA, 612 bp, A.fumigatus
aagcgatgcctggcaacacctctttcgagatcaatgacaacagaggcccagcatacgaccgatttcctcacaagagagtctgtgaccggtccccggcccgtatgggatacacccgccaaagccaccacctactcttttccatcaatggagcccctgcgtgtcgtcgagtatcctcgaaaccatcttttaatgcctctacgaaaagacattctccaccgagctgtcgtctatgaaggtgacatgacccggcaaggtacagcaagcacaaagtggagagacgacgttcatggcagcggtaaaaagctctacgcgcaaaagggcaccggtcgggcgcgtgttggcgacaaaaagtctccaattcgacggaggaggaggtgtcgcttttggtcctcaccctcgcgactttgctacaagtcttcccaggaagatctacgaccaggcttggcggatagccctgagttaccggtacaagcgaggccagctgattatcatcgacaacgaaatttcgattcccgagggtgccacaccgcaccttatcaaggagatcttcaaggtcaactgctggggccgcgaatttggacgctcaacattaatcacagaccagctgaatga

SEQ ID NO: 17118 - DNA, 411 bp, A.fumigatus
  unsure (263),(266),(268),(278),(280),(283),(299),(311): Identity of nucleotide sequences at the above locations are unknown.
tgtcgaagccccctcgccaagctacatggcagcccgctaccctggaaggaagtcaccaatgatgctgtggatgccttcttcaagcttcccgcggacaagtcccggctcacactcttcaacaagaccgactacaagcagtaccctcacgcctacggccttcccagcgaggcggagattgagaagtttgtccgtgacagctcagaatccgccagcaagacagtggccgatttcgtggagaaatggggtcacaaggaaggggtcanaananaaggttgcanangtnttggctcgacaaacantgcaaactccanaaggtctgcaatgggagtaaattcagaagtgcaaaaatcccaatggattaattctatgttgagcttgttgcatatgggctgtttctttcattccccgtgt

SEQ ID NO: 17119 - DNA, 735 bp, A.fumigatus
actgcatccctaggcgacatgaccaagcctatttaccgcttcctggccgatcggaagtggagagagtaccgtcgcaagatcttggtgcagagaattacccaaatgaaggtcattccggatgttctgcctcactgcgaccctgttgtggacaccaagctctactttggtagacatactatccaacccggagagttcgtcaactctagggtcagctcgacgccccccaagctcaatatacagctatttgaggctggtgagaagctcgtgacgattgccgttgtcgacccggatgtccccaatgtcgagaaggatggattcgactacaagatgcactaccttgctgtgaacgtgcctatctccgctacttccaccaaggttgatcttgccaacctgtcagcagattcgcaggtggttcttccctggcttcccccggtcgctcagaagggcagcccctaccaccgactctccatcttcatcatggagcaaaaggactcggctcctttgaacttttctctggtcaagggcatggagacgagccgtgatgtccttcttcggacactgcaggccagatatcacctcaaggccattggggcgcacctgttcagaacccaatgggacgagaacatgctggaagtcatgagagagattggcttccctgatgccgacgtagaactgcgccggaagagagttgagcctctgccttataagaggaggaatccttccaccttccggtga

SEQ ID NO: 17120 - DNA, 1386 bp, A.fumigatus
aacgatcttcgagacctccgatacggtccgagctgcggtgttgcatttgtacacagatgttgtccacttcttcactcgagcagtgaagtttctgaagagaaagcgtacgcaagtctgcgtcggagtggctgtacgatgctgactgagaatgcatcggtagcaagagatctcatctttcggacgcttgtcaaaccgtttgagcacgactatgcgcaaatccttaagcgctaccagatacaccgcaacgaactgcagatcgtggcacttgctgcgatggagaggaatgccagaaaggagcgggaactggcggagattgctcgtgacgcggccgaaaaggagagagtcgccgcggaaaatgaacgtaaagaggcagcagctgagaggcagcgcgccgagcaagcgagagaagatcttcgcgaagaaatcaaacggcaggaagcgcaccggaaggaggcgtcgcgagcacgaaaagaagtccgggaggagactaagaaccaggaggtccaccgcatggtggttcaggggcaactgaaaggtaagatcagaactcttgtccgaggcaaccctacggctgatacatctcatttggtaggcctggaatcagattcaatgatgcggtggttagatcccccggactatgaaagtatgctgagtcagatggtcaggcaacgccatgaagatactgttctctggattgagaagcatcccaagtatctctcctggagacaatatgccaactgggcgcgtgacattttatggatctatggcggtcctggtatgggaaagactattctatcggcgaccatcgttgaggaccttagacgccttcacatcacgcagagtcctcgtcagacaaccaagcgatacgccgtctgtttcttcttcttcgattcgagcaatttctttgagcagccagaagtggtaatgctccgagccctcgtggcacagctgctgcaccaagtcgacaagcccgaccccctcaaccaaatctaccttgcacgacgctcggcgcatgcgtcactgacagagctcagggaggcattctcgaccctggtgagcgactgctcgggtgtctatgttgttattgatggactagacgatgcggcgaacgccagcgatgccctgcagcttttgctcatgctcttggtccaggtttcacccgtcatgaagctgctggtcaccagccgtcctgagcccgatattcggcgcttcttccattcccacccgcagtttgagttgacagaggatatcactcaaccggatgtgcgacgagtcgtcacgactcgcgtccagtcagcgtgtgaggacaagaagatcagagtttctgaccctaaccttcggcaggagattgttgacgccctcgtctcaagtagctccggagtgtaa

SEQ ID NO: 17121 - DNA, 570 bp, A.fumigatus
ctgataatcccagacctcaaatacgacgacttcaagttcgtccccaccccctccggaaaccaaatctacggccaaccctcccaagccggccatcctggcttctgggaccgtctcgacacaaacacacatatcccgcagccaactaatctccttgaacccggtcagatccagctcaccggcctggcacaacgtactcgacacatcaccggcatcatcgccgcccccgcctcgacctcgacctctgacgggccaacgtccacattcacattcaccaagaagaccatcctccaactacccccttccacgcaccttcaccaaaacgccgtgcgagttctccagcgaacaaacgattacctcgtcatcctcctcttccaggacggccccgtccacttgaagaacactaaaacccgcgggagcgccagcacgaatgacaccgagaccgagaacctcgtaaaaccgattctaatccctgtagatgcgaaggagctcgcgtcgcggcccgtctcgccgctcaaggcaggcgacgtggatgatatccaccctctactcacgatatctcaggagagttga

SEQ ID NO: 17122 - DNA, 2511 bp, A.fumigatus
ctccggagtgtaagtggtttccagcacaacgtccattcggtcaatggagctgacgagcagctgtctgctagattcctctgggcgacaatgcaggtgaagcacctccagactcttcgcgtgcagactgatcgaactctacgcgctgctgtccgcaatctgcccagtggtgttgcggatatctatggccgcatcctagccaagataaactcctacgcggaggaagatcgcctgctggccgaggagctccttcgctgggttgtctgcgccaggcgaccgctgaacgtttccgaactgtgctgcgcgcttgcaatcgacatcggagacgaggaactaaacttggataacgtcccgactaacacgagtgagatcgtagacgcctgcagccctctcctctccatcggggacaaggggactgtcagcctagttcactcaacggtggcacagtttcttctggacccttccaacaaagcctctgtccctatgggcaccgaccgatacttcatcgagcagacagacgctcatactatgctggcagagaagtgtatatcatatctgtctttgctttcgtttcgcaatcgtatctccgggacacagacattggcgaagatcacgcacgaggaaatccacgcgtttcctttactggaatacgcggctttgacttggtggaagcatgtcgctcactccgccgtctcaaaggcctcggcaaagagacttgtggacttgatgttcaacttcgctaaatcaagtcagggtctgacttggctcgaggtgtcaatcaccttgtcgcgctccctggaacatttacacaccatatcgatgcaactgcgtgcatggtttcgccggctggagtttaagcatgcgcatatcgacgaactcaagctctggttggatggcctcgtagatctcacccgcgtctgggattccatcctaagagattccccctttgaactgaggtctaccgttaagaagtttagtaccgaggggcagttcttccagaagcattttggctccgactttataggggaaatcgggccaccccctgcctcgttgccgcggatcaataccaatcccactgtggcagagggaaacgcattcgatatcttggtcgacgacgaggaaggctatgtcctgcatccgtcgggaaagcttcgcttccagttcacctgggatatcatgcaaagcaatggaaccaactccctgagatacactatctatgccgaaagcccgatcacaaggaggcatttcaagacggttgaatttgcccacgaaataccctggaagcttccgcagggcttccacctcggactgcattcggtggcttttagtcctgattgggtttacctcgctatcgctacggttgagtccgtgagaggactgcctacgggacgccgataccagggcaagactactatccgtgttttcctctggcggatgcgagacctcgatgaagctggcgaagaattgcttttcgatcttccctggataatacctaccaggagtagtgacggaaatgtttacagcggctacgttggtcaagcccagtatgatgccttccggggctctcgatgtgcagttgccttccacagaatcaagtccactctctacctgcagacaccgttcggagcggtggatgtagaaacaggtacttccctggaacattctcggtatctccaaagtgtcgtaacccaaccgactgtgacccaatgcacattcagccccgatgggcgtcgaatcgcgatggtcaggaaccatacagatttcgaaattgccaatattgatggttccaacgtgtgcgccacgaagcttgtgggggagatatgcgagatcctgagcattagcaggacaggccgatatgtagcgatctgcctcaaccagcctgccacgtcttcgcagctaacccagtcgcgtcttgtcgttctcgacacggtcaccagtacaatccaggttctgctgacgggaactcaggaacgacggtttgacgaggtgtcttttaagctccgtggctggctatcgtggtctcaatgggccgcccagggacgatacatgaagttcatgcccaagggactggcccccgttcgaccagacaggcactgcattcaagtttattccgtcttcaactggctagttggcggagcctctagtgagctgtacatcgaacccgacattgaccatctgctggaccctcaggagcagcgttgggatctagtgcagcccgcggctgtcagaagagaactgccgctctcatccagtgcgacctatctattctcagatcggaccattcgtctctcggatagctcgtttgtgttatccgtgggcttctcgccggaggatgagcactgctgtattctcacatccaagcagacagtccttcttcccagctcgctgcagtcatcgcccctgacctcggtgccccctacggctgacaaacagcagaagaccacataccagacgtatactcgtctgtttgaccacaacagaaaacttggttgctttcaactagcctaccagtaa

SEQ ID NO: 17123 - DNA, 744 bp, A.fumigatus
gtcggcccaccctgctcgtttggcaatccacttacctgccgcagtggcacgcaagggcgctggatggactatctggactataagacgcacaatattgcccagagcatcacggcccgtgtgtacatatgggatctctgcggcactccaaggctcgtccgtgaccagcttctgcaactggatgaggttgaaatcaacctgcttcggtacgaacagtatcgccggctggatgtggctttccacccggccagtgatcgcatggcaatcttcaatgtagtatacaacctcgacctgattaccagcagcagcatggaataccagatataccatgagacgaacaagttccatccggatatcgcagccggacgtacgaacaacacctggcaagtatccttcagtccggacggcaggtacattgcgtttgccgtcacggcgagtacccgaactccaggactctttgggaaacgaggagaaatcaccaatgctgtggttctgttcgaaaccgacaagcccagtaccccgttatgctcgcagatatcgagccacaagggcgatactctcgccatgggctcgtgttctgttacatttcacccaacggataggaagctactctggacatcatcgtttgtgttcaccgacgccacgaccaagacaaccacaaagctactggacttcagtctcaagccatacgaaacgacctttatcacaggtaagttctctgcccttcaccagtcgggccctaactga

SEQ ID NO: 17124 - DNA, 261 bp, A.fumigatus
acgacggcgactctcagcatcagtatgctcccgctcgttcaggatggtttgcagattggcattgagagaatcgagcctactgcgttcattccgcagtacctcattgtcctcgatcagcctcttctcgatattcttccaaaggtccttctcagctttcaggtttgcgttctcacgctgaaggctttcgacgagacccttggtctcaaccaaatcttcagcagcctgctgggtcctcaggtcttgtcggttggcgttctctag

SEQ ID NO: 17125 - DNA, 732 bp, A.fumigatus
acaatggaccccaggactagccaggcaagacctgacacacacctcaaacccccaaatccacaccaacgcgcctccccctcatcgtcaacctctccatccccaacaccccgagctcccgttgccgcccacaatacagctacagtggccgaatccgtaacattccaagggacacaccctatctcggtcggcgcagggacagtcattcatccacgcgcacgcatctactcctatgacgggcccgtcatcatcggcgaaggctgcatcatcagcgaaaagagcacaatcggcatcccgccgagcacaccaacttcactcccgcccacgccgaaagaagtggttccaatacggatatcgaatggagtgacgatcggtccgctcgtgaccgtcttcccaggcgcgcatatccactccttcgttacggtcgagtcgctagccatcattaaccggcgtgtgtctctgggtgcgcattccaaggtctgttcgggctgtgaggttgcggcgaacacggtgataaaggattggactgtggtttggggctcgggggccgggtcctgtcaaaggaggaaacgggctacggggaagatgagctcgtctgttgtggctgggcaggacttgtcggcgccggacgccaaggtggttgaggatgcgcgcttgatagtattacagaaggagagggaggtagtggccaggctcattgggtcgtctgcatccgctgggggcaggaggaaatga

SEQ ID NO: 17126 - DNA, 4131 bp, A.fumigatus
  unsure (2562),(2632): Identity of nucleotide sequences at the above locations are unknown.
aaggagcgagataccttccgcagcatgctgacaagacgtcgtcaaacggttggagatggttctgcattctcccagtcgcttcttcttggtgcggtcccaccgaacgttgacgaccaagggagagacgtgcccgactatgcggagttattgcgcaaggtgcaagcccactttgacagcttccgggaggagtctgcaaccgaccatgccgctttgaaacagcaagtcaatgaattaacacggaaaaatagtgaattgctgagcgagattagtcgctcaagcagtcagcttggcgctgccactcagcgagccgagcttttgcagagcaatttcaatatgttgaagaatgagaatgcagagctgcagaaacgctatgctgctctgctagagaacgccaaccgacaagacctgaggacccagcaggctgctgaagatttggttgagaccaagggtctcgtcgaaagccttcagcgtgagaacgcaaacctgaaagctgagaaggacctttggaagaatatcgagaagaggctgatcgaggacaatgaggtactgcggaatgaacgcagtaggctcgattctctcaatgccaatctgcaaaccatcctgaacgagcgggagcatactgatgctgagagtcgccgtcgtttacaactcagcgtcgaatctttggagtccgagttgcagtctacgaaacgtaagcttaattccgaggttgaagagtcaaagaaggctgctctccgcagggaatatgagcatgagcagagccagaagcggatagatgaccttgtggcaagtttgagctcggttcgggaggaattggttgccaccaagacaactcgggatcatttgcagaccagagtggatgagttgacagttgagctacggagtgctgaagaacgtttacaagtcgtacaatccaggccaagcatcgcagctgccccggccgaggcggctgcggcggcagaagaaggcgtcccggatactggtttgacccgcgaacaggaactaggcattcaggtttccgaactgaagcgtgacttagaattggctaagggtgaactcgagcacgctaaggagcaggtcgaagtttacaagaccattagccaggagactgaggagcgcctgcagtcagtcaccgagacacaagaacaatatagggaagagactgagcgtcttgtggaggagaaggagaagaaaattcaggaccttgaggcacggatcgaggagatttcatcggaactttctacaacaaacaacgagctttctaagcttcgggatgaacaaggtgaagctggacgccgcttggaggaacagaaggctgctttggaggccgaaattacaagactgaaggaagaaaacgaacgtcaaattgcggcggctcagttccaccaggatgatcttaaggcccaggcagaaattgcccagcgcgcgcagcaaaattacgaaagtgaattgcttaagcatgccgaggcggcgaagaacctacaagccgttcgtgcagaggtcaatcaattgaagctggagctagttgaatctcgaactcaggccgatacctacaagaaggaccttgcacagaaagaagaaagctggagtgaactcaaagaacgctacgaaagtgagcttacagaattacagaagcgtcgtgaagaagttctgcatcaaaacaacttgctgcatactcagcttgaaggcatctccagccagatcgccgctctgcagaaggatcgcgccaatattccggagagtgagcaggatgaagggacaacagcaccaaatctggagggtcttcaggaggttatcaaattcttgcgacgcgagaaggagatcgtcgatgtgcaataccacctctccacacaggaggccaagcgtctccgccagcagctcgattacacacagtctcagctggatgaggctcgtctcaagctggagcagcaacgccgtgcagctgcggatagtgagcacactgctttgagccataataagctcatggaaacattgaacgaactcaatcttttccgtgagagcagcgttacgctgcgtaaccaagtcaaacaggccgaaactgctctcgcggagaaatctacgcgggttgatgaacttttgcggcagattgagcctttggagactcgtatcagggaactggaaaacgttgtggagacgaaggatggggaaatgaagcttctacaggctgaccgggaccgctggcagcaacgtacacagaacatcctgcagaaatacgatcgcgttgatccggccgagatggaagggctaaaggagaagctcgcctctttggagaaggaacgagacgaggctatttcagcacgcgacacgttacaggcacaagctgccactttcccagagcagctcaagcatgctgaggataggacgcaagaactgcgcacaaagctcacagaacagttcaaagccagatctaaggaactcactggccgcatcaacgctaagcaacttgaactaaatgctgtgatacaggagaaggaggtcatccaggaggagctgaacacaaccaagaacgagctgagtgagctcaagaccaagatggctganagtccatccccatcatctgcacctgcacctgcacctaccgcacccactgtggagcagacgcctggcgtcnattcgactcctgcctctcagttcccaaccccaacttctatgccaagtgatgacgaaagagtgaagacgctagaggagaaggtacggcgtctcgaggcagctcttgctgagaaggatgctgctttggctgccaaggatgccgagtacgagaccaaggccaacgaaagagtggagaagctcaaggagacgtacaataagaagatggcggaagtgagagcggctcatcggcaagaggttgaaagattgtcagccaatcaacaggttgcaccgcaagagcctggaacacctgtctcgaaacctgagcagactcccgcaaccccatcacagcaggatggtgacctaccagaactcaccgatgtccaggcgagagccctagttgcgaagaacgaaactattcaaacgatcgtccgtaacaatatccgggcaaaggtcgccaaagaaacagaaaagcttaagcaagaatgtgcagagttggagaagaagtttaatgaagagaaggaagccctcaaaaaggcgtatgaggagagtacggatgaaaaggtcaaatctgccgttgagttatctgacaagaagacccttgtccgtatcagtatgcttgatactcggttgagaactgcacaggccaaacttgatgtcatcgcgaaggcggctgccgagactccccaaaggcccgtcgttgaggtatgggaggttgcgaagaccacaaaggctccgcctgttcaggcacaaggagccaagccaacagccactgcaccatctgcaccgaccgcaccgactgctgctcccgctccagcgcaagtcgctacagtgccgccaccttcttcagtggcggcacctaccgcaaaagccgaaagccaagaccaacaagctgctgctcccgctcccgcccagcaaacgaccgctgctccccccaccagctctgtgcccgatgaagctcaacctcaagccgatgcgcaagcacaacagccgcaacaagaagccggtcctgcgcaaaagccggcatcaaatcaacccgcaaacgcagtggcccaatctcagaataaacagcagccctcatcactgccaagtaagcctcctgctgggggtgttttgagggcgcttcaatcagggcttccagtcgctagaggtggccgaggcggagcgcgcggcggctctcatcaacagaatccattcggcccacagcctactgatcaacagcaaccacagcaacagcaacaggctcaaacccagcaaagccagcgtggcactggtctccaacgtggccgtggcggtcgtggaggagctggccgaggtggtcatcagaacgtccaggccagcaatgcgcctcaagggcaaaatccgtccagtcctggaggacgcggcggactcaatgttcaagctcgccagtttgtccctcaagggagcaagcgggcaagagaagacggcggtgaggccggaaacgaagccggggccagtggagggaagagaatgagaggaggtggccatgccaggggctcttga

SEQ ID NO: 17127 - DNA, 258 bp, A.fumigatus
actcgacgccatgtccacgtcaatcggacgaaggaagcacttatcaacggaggtgcatatcatttctcgcaccaagaagatcatttcctcctgcccccagcggatgcagacgacccaatgagcctggccactacctccctctccttctgtaatactatcaagcgcgcatcctcaaccaccttggcgtccggcgccgacaagtcctgcccagccacaacagacgagctcatcttccccgtagcccgtttcctcctttga

SEQ ID NO: 17128 - DNA, 837 bp, A.fumigatus
tcccttgctagactgaaatccatcgcatacgtgcctttgcctacatgcagaccgaagatgttcctcctcaccattgtcgccgtcagcagtttcttggtgctgcttctctataaaatcctaatctccccatacttcctctcacccctttcgaaaatccccaacgcgcatttcacagcacctatctcggactattggattgaacgaaagcggcggtctggggaggaggtactgaccatctacaaccttcatcgcgagcatgggcctgtcgtgcgcctgggacccaatgagctgagcgtcaattcactcggggggctccatgtcatctataccggtgcattcgagaaacactctttctaccgcgatacatttgtcaatttccttacggataatcttgtgggcatgttacccaacgattctcatgcgcggcagaagcgaatgctgagcaagatttactccaagtcgtatctgcacgagtcggtagatcttcgcaatgcttcctcaattattctttcgcagaggcttctccctatgttgaaaaatgctgcggagaaaggcgaggcgatcaatgtcttgccgctgttccaagctgtagggatggactttacgtctgcgtttctgtttggcacggccaatagtacgacgtttcttttcgatctcccgggatggaaaaggtggctggtggagtacgaaagattcaaaaccttgagcgggaaagagcggtatttgggcttcattgaaagatggtgcctgtctctctgcagcagagtgcaaagcaatgagcatcctaacgacgtgccggtggccacaaacccggtcgtgtacagttcgctccgctag

SEQ ID NO: 17129 - DNA, 630 bp, A.fumigatus
actctggagaagcatccagatcaacgacctctagatctggcacttgcatcggaacttctcgatcatctcgttgctggacacgagacctcgggaatcactttcgtatatatgatgtgggagctctcgaagcggcctcggctccaagctgaacttcggcaagagctgctcaccttatcgccatctttgagatatccattggtggagttgggtgatggcagccttccccttctaccatcaccggccgctatcgactctctccctcttctagatgccgttgtcagagaaacgctgagagtgcactcgcccgcgcctgctccgttaccgagaatcaccccctcgtcatcagaaggtatagcaattgaaggatacgatcgcatccccggtggagtcaaggttagttcgtcctcctatactctgcaccgaatcagcgaggtctaccctcagcctttcgagtggctgccagagcgctggctagacccaggaccgggaaaaattcacgacatgcggagactcttttggccgtttggaagtggagggagaatgtgtctgggtagtaattttgctttgcaaggtacggcgcccttccgctctctccctttcctcgcagcatactcagagagtgcaagctga

SEQ ID NO: 17130 - DNA, 195 bp, A.fumigatus
aaagtggctccagttcgccttcgccagattctacaccaggctttgttcaagcgcgtcaacgagatcatcgatcgcgcaacatgcgactgcaaagagcaaaccatctttggttgtctaaaggaactgcgacgcattaacgtctcgccgctggacctgagcagcagtaaagcaagtgttgctcaaatgcttgactga

SEQ ID NO: 17131 - DNA, 375 bp, A.fumigatus
agacatggcaccatatttatgcaagacagtggccatattctcttcgacaatctgggatgcggcacgaagcgccgccaaatgctggatgagcagatcaaaaccggcgagcggtcattccgtgatgtgtctgaggagatgtggggatctctacgagtcccctttgaagacgggtttgaagttatggaaaaggaactcgagatcgatcctggattccaggagtttcacgagttctgcattgccaacggcatcgatttcaatgtgatcagcgcaggactgaagcccatcttgcgcagagtgctggagacgtttttgggagagcagacagtaagccatagccctctatccgctgcctggatgatgtcgttgatcgattag

SEQ ID NO: 17132 - DNA, 312 bp, A.fumigatus
  unsure (308): Identity of nucleotide sequences at the above locations are unknown.
ccctctatccgctgcctggatgatgtcgttgatcgattagtgaagtcgtctatccagattgttgcaaatgacgccgatatcaaatcggacggatcggaatggaaaccgatctggagacatgacaccgagctgggccatgacaaggccctttcggtccaggaaggtcgcgccgaggctgccaagtactgcattgatggccaaattcccctgatcgttttcattggcgacggtgtgtccgatcttcctgctgcccgtgaagccgatgttctcttcgcgcgcaagggccttcccctcgaagagtattggcnatga

SEQ ID NO: 17133 - DNA, 1422 bp, A.fumigatus
ttccccaactattcgccgatctgcggccccttggtaaagaccctttcgaggccagaacttgatgcctactttcctcctcccttgactagattctgttcgccaatggtgacggatcagtcaatcaagctctcctataatgacacgactgctgacatgtattcctatgctaatcacaattgtggtcccctgaattggccctcaaccaccaagctccatgagatcacctggtatgagaatacgttcctcccaaagatccgtgaatacttcaagggagatcttgtctggacaagaggaaccgttgcgaaacaggccgacgatagccagcgatactgggtcattgtgaacaaaaacatatatgacctgacagattacttttacacgttggataggatgaataaccaagatacctacaacttcctaccaaaaagtgtcacggatcttttcaagaattatccgggcactgacgtgaccgacaaatggggagattctgaggacttcaagaagtctcagatatgtctcgactatgtgttctacaaagggaaagtggatttccgtgataccccccggtgtactgtcaataactggattctgcttgccttcacgattctcatatgctccgttgtccttgttaaattccttgcggctctacaacttgggtccaaacggcgtccagccccacaagataagtttgtcatttgtctcgtgccagcatatacagaaggtgaagatgcgcttcgcaaaggtcttgactccttgacagccctacaatatgacaacaaaaggaaacttatcttcgtcatatgcgatggcatgattgtcggcggcggtaacgatcgaccaactcccaagatcgtcctggacatcctcggcgttgatcctaagatcgacccccctgcgttgccgtttaagtctctcggacaaggaagtgatcagctcaattatgggaaggtctactctggcctttacgaatacgagggcaatgtggttccatatattgtggtcgtcaaagtcggtaaggaatctgaacaaaaccggccgaagcccggtaacaggggtaagcgtgactcgcaaatccttctgctcaacttcctgaaccgtgtacatcaccgttccccgatgtcaccgctggagctagagatgttccatcagatcaacaacattatcggagtcgaccctgaactctacgagtactgtctgatggtggacgcggatacaagtgtccgggaagactcactcaatcggctggttgctgcctgcgcgaatgatgcacggattgccggtatctgcggtgagacgagtcttcagaatgaggaacgaagctggtggacaatgattcaagtctacgagtactacatttcgcatcacctggccaaggctttcgagtctttgtttggaagtgtgacatgtcttccggggtggtaa

SEQ ID NO: 17134 - DNA, 1401 bp, A.fumigatus
catgtcttccggggtggtaagtgtgaccgatccatgactttggtctcatctcaatttactgacgcgctggttagtttctgcatgtatcgtctacgaacggcggacaagggtcgacctctgattatttcagacaaagtcattgaagaatatgcggacaacgatgtagacaccttgcacaagaagaacctgttgtctctgggtgaagatcgtttcctcaccactctcatgacgaagcacttcccaactatgtcctacaagttcattccggatgcctatgccagtaccgccgccccggagacttggtctgtccttctctctcagcgacgtcggtggatcaactcgacgattcacaatttggttgagcttgcggctctgaaggacctgtgtggcttctgctgtttcagcatgcgatttgtggtactggtcgacctgattggaaccctcatccttccggcgacctgcgtctacatagggtacctgatctaccgtgtcgccagtcacactggcccatttccatatatctccctcgctatcctggcaggtgtgtacggtctccaagccatcattttcatcgtcaaacggcagtggcagcatattgggtggatgattatctacatcctggccttcccaatctacaactttatcctgcccttgtatgcattctggaaacaggacgacttcagctggggcagtacccgtattgtccttggggagaagggcacgaagcgagttgtagcagtggaggatgaagcattcgatcctcggagcattcctctccaacgctgggatgattacgccctggcgaacaaccttccaggccgtcgcggcgattatggcgtcagccaggagaagatgtacagccggtacggagacgaggcagtcatggagatggatgatcttcattccacctattcctctgtgaagccggcatctaccatccttaccggatttccccaaggccggcactcgagtccgtacatgccaccgcaatcgccagctccatttggcggaaacattccgggcaaccgcaactcgcacctttctagctttaccagatataccgacaacccacaccagcggaatatgtccatgggcaacctcagccactaccaggatagccctatgggcatgagtcggcacagcgtgggacttatgcagagtacggacaacctgctgggggtcgcgcgccagaattcacgcagtcccctcggcggtggcctgaactcgagacccgttagtgcattcgacttccggaccggcggtacaggaccggatgagggcgccattacagaagcgatccgcagctgtctggcagaggtggacctagacacggtgactaagaaacaaggtcagttcttttccccatatatcaagtggtattcatccctgatagcttcttag

SEQ ID NO: 17135 - DNA, 507 bp, A.fumigatus
ccaacaatgtccactcaaccaccaccgcctcaacaacaacaacaatcacccacctcctcaccgaccctctcccaacgcaccctcgaagccaaagcagccttcactgcctccctccgctccgtcggcgcaaactacgacgccgagctacgcgaccgcgcacgcacgctgcacgggaacgccgccgcgctagacaagcaggaggcggagctgcggcggacgacggccgagctgcgccggcagaatgagcagtgggagagggtggcggatacggcgcgtgagggcctcaaggagatcggggacgtgcagaattgggcggagttgattgagagggatttgttgattgtggaggagatgttgagggaggtggaggctagggaggaaggggtgggagaggaagcggaggaggagggcgaggagggccggatgatgatagatgggaaggggaaagggaaggggaacggcaagggagaggaagaggggaagggagggtggctgaggtggtggtga

SEQ ID NO: 17136 - DNA, 426 bp, A.fumigatus
aacaccagttcacgtacttggtatttaacccaagaagcaaaactcaagaatcaccaccacctcagccaccctcccttcccctcttcctctcccttgccgttccccttccctttccccttcccatctatcatcatccggccctcctcgccctcctcctccgcttcctctcccaccccttcctccctagcctccacctccctcaacatctcctccacaatcaacaaatccctctcaatcaactccgcccaattctgcacgtccccgatctccttgaggccctcacgcgccgtatccgccaccctctcccactgctcattctgccggcgcagctcggccgtcgtccgccgcagctccgcctcctgcttgtctagcgcggcggcgttcccgtgcagcgtgcgtgcgcggtcgcgtagctcggcgtcgtag

SEQ ID NO: 17137 - DNA, 858 bp, A.fumigatus
ccgcactcgcggtccttcggcgccctgtgtgaagacgaacggttgtcactgacggtcaccaaggatgatttcgccaggatgcgcattattgggcaattcaatcttggatttatcctagctacccggccgtcggaagatggctccgctgattccaaggatgagcttttcattattgaccagcatgcgtcggacgaaaagtttaattttgagcggcttcaagctgagacagtggtacagaatcagcgccttgttcagcccaaacgacttgacctcaccgccgtcgaggaggagatcgtcatcgaaaatcgagctgcgctggagaagaacggatttgtcgtcgaagtcgacgacagcggcaacgagccaatcggccagcgctgcaagctgatctccttgccgctgagcaaggaggttgtattcggtgtacgagatctggaagagctcattgttctgctatccgagatgccagcaaccgacagccgcgggtctgccatgcagacccatatcccgcgccctagtaaagtccgcaagatgtttgcgatgcgcgcatgtcgatccagcataatgatcggtaaatctttgacccagacacagatggtccgggttgtgagaaacatggggacaatcgacaagccatggaattgtccccatggacgacccaccatgaggcatttaatgactttgggtcaatgggatgaatgggatgaatatgggtatgacaatgaagaggaagacgaagaaagcggccggatcgaggtcgaccgcttggatgtatggaggaactactaccaagagatgggggaaatgagcgcggaggaagaagacgcagcggaggccgatgaagaggctgagatatag

SEQ ID NO: 17138 - DNA, 1068 bp, A.fumigatus
attctggcgcgcgacccccagcaggttgtccgtactctgcataagtcccacgctgtgccgactcatgcccatagggctatcctggtagtggctgaggttgcccatggacatattccgctggtgtgggttgtcggtatatctggtaaagctagaaaggtgcgagttgcggttgcccggaatgtttccgccaaatggagctggcgattgcggtggcatgtacggactcgagtgccggccttggggaaatccggtaaggatggtagatgccggcttcacagaggaataggtggaatgaagatcatccatctccatgactgcctcgtctccgtaccggctgtacatcttctcctggctgacgccataatcgccgcgacggcctggaaggttgttcgccagggcgtaatcatcccagcgttggagaggaatgctccgaggatcgaatgcttcatcctccactgctacaactcgcttcgtgcccttctccccaaggacaatacgggtactgccccagctgaagtcgtcctgtttccagaatgcatacaagggcaggataaagttgtagattgggaaggccaggatgtagataatcatccacccaatatgctgccactgccgtttgacgatgaaaatgatggcttggagaccgtacacacctgccaggatagcgagggagatatatggaaatgggccagtgtgactggcgacacggtagatcaggtaccctatgtagacgcaggtcgccggaaggatgagggttccaatcaggtcgaccagtaccacaaatcgcatgctgaaacagcagaagccacacaggtccttcagagccgcaagctcaaccaaattgtgaatcgtcgagttgatccaccgacgtcgctgagagagaaggacagaccaagtctccggggcggcggtactggcataggcatccggaatgaacttgtaggacatagttgggaagtgcttcgtcatgagagtggtgaggaaacgatcttcacccagagacaacaggttcttcttgtgcaaggtgtctacatcgttgtccgcatattcttcaatgactttgtctga

SEQ ID NO: 17139 - DNA, 4104 bp, A.fumigatus
ctaggagggttgcagtatcgatggctcttaacttctaactttctgctttgtagtaatgcaccaggcgcttttttccactcaggacactcttcaattgattcaacgaatgaatcaacacggagtaccaactctcgcgtcagtcttcgatccaccagcatggggaatctggcaaagtcggactataaccatacgcctcctgatcagacggacttccttgcccccgtcagctttgatgatttccacaacagcatcatggcagagccgagtctaaatcactttccgatgcccggcactgcggtttcaaatcacacaggaagcccgctctcaggcccatttacgcggaatccgtgggcagataacgatgaacccagctttgccagccggtcgagaagtaattccgtgcggagaaagagtgaggtttcacatttatcgagccagaattcctccgcagaatcggtagcttcgcgtcttccggcttccaacacggctgcgcggagtcgccggcagagtcttgtccaaaactccgctgcaaaagcccctgctccgcgcgctccacggaaatccataggtcctggctccattgcagctgctacatctgccagacgtcagagcgtgtctgcccggaaggcaagtgtggacacgtctccagccgaccatgcaagtctccgcccacatgcccagaatcccgattccagcggccttgacaagacgaggctcccttccaatgttcgcaacatgaaagccaagtcgctccagccaccctcccgggagcctggtgaccatctgctgacagcatctggattgactgaccactcccggtcatgttccactaatgctgttcggacgccgattaagaatcctgccggcagtgcgactacgcccgcttcatctgcgaaaagggtgtcagttatggccccacacgcgacaggcctcggggctcgaacaataagccctactgatgcacggcgtatgaagcgaatctctacagcgccgcaggcgcctccattaccatatactcctccaaccaaacaggacacgcttcctgttcgcccgcggtcctgcgcccagtctccgtctagtctgccgcggaagagcgtcacaccatcgtcgacgagaacaacgcccgacccaagtcggagatcctacagttcaggcttgtctttgtcgtccaacacgagctatagctttacgaggaactccggcagttccttgcagacaaggtttgcccagaaccaatcatcttcccggttacctaccccaaaaccgcgcgcagaacatatggggggaaacaacgaagaggtccctcctgttcccgcaatccccaaggcttacgagtctcccaagggtgacggcgattttcatacctactttgcttcgcggaagtctagtcttcccttggatatcggtcttccgaagcctaaggctgaccacgacgctgagcccaaacaagcgataaggggtaacgacaaaaagactacggatcatcctgctgagcgagcaatgaaaactcccgatgccaagactccagcgagcaattttgggaagaagaatctgcagcctttgaaattgcccccgttgaacctgttgcctctcagcactcctgtggcctctaaaatcgaagctttgaaggaccgcgaagacgatgggcaatcctacactccttcaggccaggccgtatccaagactccgagcacgccgatgacggcctccaaggcaaatttctcctttcgagatgaggatgacacaatgggttttactcacgctcgaagcagcacttcccatttcgtgctgagcacctcaacagttgctcctctgagaacagcaagtagctccagtgcattggcgtcttttgacaataatactactggtggtgcgcgaacaatctccccttatgtctcgtacacattgccaaagagtagcagcgacttcagcaacctacaacaaaaagccaacacaagtggcgattattccccacgaatctcgcaagcatacaagttgactgggcctcgacctcaaactcaatcgtccgcattctcttcgaatgctgagacaatcagtcaattgtccactccttcggatcctgacaacaacagcgttcctgggtcttcaatcttcaataaagtcaccttgaccggaaagcgtagcgactccaaatcacaacgttcgacaggtgctgatctggacccggcgaagcaaatgccgccccctagactcccagcatctgccacttggaataatctgtccacagtcaaaggctcaagtcccacactcaagcccgcgtacgttcaagcaagacgtcagtcatctatttccggcacgagtgtctcaacaatgcggaaccaaagtgtgagcagtgaacagagtctcgctttggagccaagtgtctcgaatgagtccggggaaagcaatacggcctcactacgacccggatcatccgtcttctcgcccatgcacaagatgatcaattcggcaaaatctagcacggcagccactcctcgccagcagcatgagtctaaccctgactctgacattttggcagccgatgaggagatgcgcagactcgctagcaagcgcaaggactttgagactgccgccaggaatctagacgaattacgtcgcaaggcaggcccgaaggagcgagtaagcccagcgcaggcactgaaaatggccaatctcaatatctttgaacgtggagagatcatcgacttcaaggatatctacttctgcggaacgcagaatgcgaagaaacatgttggtgatctgaatgcgcaagctgccaacttcggctacgacgatgatcgtggtgactacaacatcgtgatcggtgatcatcttgcgtatcggtatgaagtgctcgatgttctgggcaaaggtagctttggtcaggttgtgagatgcattgaccacaagacgggagctctggttgctgtgaagatcattcgcaacaagaaacggttccaccaacaagctctgatcgaggtgaacctcctccagaaactcaaggagtgggatccgcatcgccgtcacagcgtggttaatttcacacagagcttctattttaggggacatctctgtatttccacggaactgctcggaatgaacctttatgaatttatcaaggctcacgacttcaaagggttttcactcaaacttatacgccgcttcacgaagcagatcctgggcactctgacactcctgcacaccaagaaggttattcattgtgacctcaaacccgagaatatccttctcgttcatcccatgagctccgaaatccgggtcatcgattttgggtccagttgtttcgagaatgagaaagtgtatacctatatccaaagtcgtttttaccgctcgccagaggtcattcttggcatgtcttacggcatgccgattgatatgtggagtctggggtgtatcttggcggagctctacagcgggtatcccattttcccgggagaaaatgaacaggagcagcttgcttgtataatggaggtgtttggtcctcccgagaaacatttaattgagaagagcactcggaagaagttattctttgattctttgggcaagcctagactcaccgtctcttcaaagggcagaaggcgtcggccaagttcaaaggacctcaaacaggttttgaagtgtgacgatgatgcgttccttgactttatctctcgctgtcttcgatgggatcctgctcgtcggctcacccctcacgatgcgctccgacatgagtttataactggaatcaaacctgcgtcacgctctcgaagctatggtatggcgagcctctcaaacaagcgtgccactactctgtctaatccaacagcacggccgctgccggagccacctggaactagtctcaaaaacggtacatttattcgcagtcgcgacatttcaggcagctctcctgtgaaagcgacagcagttggtaaacggcactccaccgtgagcggcctgcagccgtcaactcctgccaagcgaggcacaactgtcccttctatgcctggttcagcattgccccgtgtcgcagccagaagtatcagtggaaagcccgacctcgcgactgcggcggcagcgacgagtctagtaagtaatctggccgagtaa

SEQ ID NO: 17140 - DNA, 462 bp, A.fumigatus
taccgcttcttccgctccggctcccgcaacaaccagtccccccgcacagaatccttccccgcgcagcacgttccgtgcaagtgcctcgccggccatctccagtatcatcgatccaccccagcccacatcaacccagcacatctactcgccaatcccacggccctcaccgagccatattccgtcgacactctcttcacccggaatacaccccaatgcttcacaatcagcccatccttcactggcaccctcccctttgccggcgacctccccctctcatgggtctattctcgccccgcagcatccactgccactagcctcgcagccacaacaatcgtcgccgccctattcacatcgctctccctatccgcctcagcagcaactaccacaaccgcagcctccgcgttctccgcgcaacgagcacaagcccgtcgccgcagctccagagcccgtcccatccagtga

SEQ ID NO: 17141 - DNA, 2127 bp, A.fumigatus
ttcttaggttcttcatttcttttttccttttgccttttatcaatcatgtctgccgatccgccggaaaatggctggcctagcaaagaggacgagtcgctgtcgtccatcgactccaacgcccgaccccgacgggcctccgccaccactcgacggtcgcgtcgcaagaaggacgacgacgccgatgtcactcagaaaaacctcgcgaggtcaaaaccccaaaaggacaacaacaacaacaacaattcaaaagatggcgcaaaggacgccaaggaaaaatccaaaccccggggaagtcgtcgccaacgagaaaagtccacctccaccaatcccaataacagtactgccacacccgccagcagcagcaacagcatcaacgacaacccgagtacgacggcacctcttgaccagaactcatcgaataattctcgcaagaaaccaaagctggagccaacgcctccagacgagatccccaagagtatctccgtgagctccatcacgaccccatctgctcctgctcctgcgctcgcgtcaacgacgccgacgacgtcaactggccgctctccgcacctcacagcctcatccgcattacacctccaccaacctcctcagcatgagcacccgcaccagcaacagcaccagcaccagctcaatccctcatcctctctccctccctactcgaattcgatcccgactcatgcgccgtcccccgcttatgcgatgaaccatcaatctcttcctcctccacgccctcaatcccaaccgccgccccctgctccccctcagaggaggagtggccagaactatgatcccattcgttcagcctttgataccgcttcttccgctccggctcccgcaacaaccagtccccccgcacagaatccttccccgcgcagcacgttccgtgcaagtgcctcgccggccatctccagtatcatcgatccaccccagcccacatcaacccagcacatctactcgccaatcccacggccctcaccgagccatattccgtcgacactctcttcacccggaatacaccccaatgcttcacaatcagcccatccttcactggcaccctcccctttgccggcgacctccccctctcatgggtctattctcgccccgcagcatccactgccactagcctcgcagccacaacaatcgtcgccgccctattcacatcgctctccctatccgcctcagcagcaactaccacaaccgcagcctccgcgttctccgcgcaacgagcacaagcccgtcgccgcagctccagagcccgtcccatccagtgaggcacccccgaaatcgcctccgaagcaggaggcagagccacccgttccgcctacgaaacaggccctcaccaaactcgcctctcccccagaggagccagccgcgatggatgtggatacggatgaacctgctcagcccaatgcagaagccaaggctcccaagaaagaaaaaggatcaactgccaccactgccaccgccccttcctccaacgcggcatcgccgaagcccgcgcgtcctgtcaaggaagcggccccccccttaccccagggctccgggttgatttccaacgccctatttggaacagatgacactcgctcctccggctcatctcgcacctcacccaacattattctccacattcccctgcagcgagacggcaatcaaatcatcaactttgcccggatggcggaagagcaatacggtttcgcggccttgcatccccgactggccgcgcacaaggagcgactggctcgcgtagcggcggcaggggcggcgttggagcggaatgaaaaggggggcaagggcctatctgcgggcgaaagcgcggatgaggatctcagtcttgatgtcgatcgtgatagcgaccttgacggcgacgtcgcgatgggtggtgtgggtgtaaatgccgcggcggccacaaacggtgcgacagggaccgatgcctccgatggaaagaagaaacgccgcaagaagaaaatggaagagtatgaccgggatgatccttttgtagacgacagcgagttggcttggcaggaacatgcggccgctagcaaggacggcttctttgtgtacagtggaccgctcgtcccggagggagagaaggtccaagttgaacggtga

SEQ ID NO: 17142 - DNA, 234 bp, A.fumigatus
gctccatcacgaccccatctgctcctgctcctgcgctcgcgtcaacgacgccgacgacgtcaactggccgctctccgcacctcacagcctcatccgcattacacctccaccaacctcctcagcatgagcacccgcaccagcaacagcaccagcaccagctcaatccctcatcctctctccctccctactcgaattcgatcccgactcatgcgccgtcccccgcttatgcgatga

SEQ ID NO: 17143 - DNA, 426 bp, A.fumigatus
cctcgcagccacaacaatcgtcgccgccctattcacatcgctctccctatccgcctcagcagcaactaccacaaccgcagcctccgcgttctccgcgcaacgagcacaagcccgtcgccgcagctccagagcccgtcccatccagtgaggcacccccgaaatcgcctccgaagcaggaggcagagccacccgttccgcctacgaaacaggccctcaccaaactcgcctctcccccagaggagccagccgcgatggatgtggatacggatgaacctgctcagcccaatgcagaagccaaggctcccaagaaagaaaaaggatcaactgccaccactgccaccgccccttcctccaacgcggcatcgccgaagcccgcgcgtcctgtcaaggaagcggccccccccttaccccagggctccgggttga

SEQ ID NO: 17144 - DNA, 420 bp, A.fumigatus
caattactaacgatgattgacagggcggacggaactatcaagcgtggacgtggccggggccgggggggtcgcagccgcgggggttcatcgactcatcaagtgccaattgccgccgcggttcccatttcccaggagacaggcctaccgcttcgtggtcccggatcccgtggtggtagcaccactcgccgtcttcgtccgagcaaaccccggcaacaggccgaacaggacaaacagggcgcctcttcggcaacatcgcagggacgcggtggagggcaagctggccgtggaggaggcgcggctgggacccgcggtggaaagacgccatctatgctcgagcttgctccggcgcctcgtccgagcttggcgcctgcaccgccagggcccagtccgctggctggtccagagctggtgtcgaagtga

SEQ ID NO: 17145 - DNA, 588 bp, A.fumigatus
ctccagcggatatatagatccctcgaccgcatttccaaagactttggacctgttcgagtagatgtgctcggcaagatcacggagtcggttcttgccggcctggtgtacctctatgaagctcaccgcataatgcatcgtgacatcaagccgtccaacatcctcgttaactcccgtggtaatatcaaactttgcgactttggtgtcgcgaccgagacggtcaactcgatcgccgacactttcgttgggacctcgacctacatggcaccggagcgaatccaaggcggcgcttacacggtgcgctcagacgtatggagtgtgggattgactgtcatggaattggcggtcggacgctttccctttgatacttcggactcgtctgcaggcgatcgcgccagtgctggaccaatgggaattctagatctcttgcaacagattgttcacgagcctgcacccaagctgccgaagagcgatgctttcccgcctatcttgcatgaatttgtcgccaagtgtctcctcaagaaacctgaagaacgaccaactcctcgggagctctatgtaagcccctgtcttttggcctgccgtttttag

SEQ ID NO: 17146 - DNA, 240 bp, A.fumigatus
ttgcagatcattcgcgtggatgccaaggagaatgtgagaaagcagatcttgcgtgaactgcaagttggccatgactgcaactcccctcacatcgtgaccttttacggagcattccagaatgaagcgagggacattgttctatgtatggaatacatggactgcgggtatgtatcccataaggagtcatccaagccgggcaatgcaattttctctcggacactgactccagcggatatatag

SEQ ID NO: 17147 - DNA, 507 bp, A.fumigatus
actgacaattcggctttcatcataccaattggtctgcataaccctcaaacgccaagtcacacaataatcaattacataatgcctccgtacaccagaacaatgatggggacatccctttatatcatcgaaaagcaatcattggacttcgcatcagcggaaaagcccgtaatgcggcaggaaggtcacttcgacaccagctctggaccagccagcggactgggccctggcggtgcaggcgccaagctcggacgaggcgccggagcaagctcgagcatagatggcgtctttccaccgcgggtcccagccgcgcctcctccacggccagcttgccctccaccgcgtccctgcgatgttgccgaagaggcgccctgtttgtcctgttcggcctgttgccggggtttgctcggacgaagacggcgagtggtgctaccaccacgggatccgggaccacgaagcggtaggcctgtctcctgggaaatgggaaccgcggcggcaattggcacttga

SEQ ID NO: 17148 - DNA, 243 bp, A.fumigatus
ccgtatgacctgacagatatgtcttgcgcttatttctctgcccttatgtattactactcaagctactcactctactcacgcactttcccccgatggcttctctccgctttattcatgtctaaggagttccggtgttccctttacagctatggtgttagatgggctttcggttttctactctcctatcggggctccgtcccaaagtgtcatcgtttcatgatggaattaataatatacgaatga

SEQ ID NO: 17149 - DNA, 291 bp, A.fumigatus
ttcctatgctgcgggtataagttccccaaagcacaatgggacgactcgctgcgcgccgtgcatgacggcaatctatggtgtagcgggggaatcaccaacggccatgatctcatcgctatgtatctcaggacgatcgttgccgaacctctcgtcaagactatcctcggtatgtcggatgtgcctcagcgcagtctgaaatacgacagtgcgccgacgaccgacaacctctttttcctgtggcaggtgctcagggcgctgccgtcgatgctgttccggtccatcaaggcctag

SEQ ID NO: 17150 - DNA, 186 bp, A.fumigatus
attcccacattttgtcagttccatttgaatctggcccgtgtttggacattggacgctattcactcgcgggtttcagaagaactaggagctattattgctccgcgtagtattactcctcccaaggcaatctatccatctcataaactccttttaacgccttttaggcctaagagtctgacggactaa

SEQ ID NO: 17151 - DNA, 510 bp, A.fumigatus
gggtcaagtctttgctttagatttcagggtgctgacattcttgaccccagtggccattacgacatcctataccgcctcgaacctactgtgaatatggaacccgtggttaactaccaattcggaatgaccactaactactccccctgggatcaaggtgccctatcgttcgacgtgaactctagtctgatgtcaattcccggtctcatgatggatccgtcgtttggcctcgcgcctcctgctcctgctgcaatatctcctgcaatgtctcccgctcccccaagtccttaccgggtatcccctccccatgaagtttaccagcccagtatgcccagtcctccggctgccattccagcaacgtcaccaccgcctccccgaatgtctggaccgccgccgcctatgagctcgttaccaagtcgctcatctgatggacctcaaattcggctgaatccattggttatgaaacaaaatttaagccattccttacctgtcactacaccgttcaagaagtaa

SEQ ID NO: 17152 - DNA, 2304 bp, A.fumigatus
ccgccttggacctcattcgtcctccccagagtccaggtgactcaggcacagacacgaatcaatacaagtcttctcgatctcacgctcgacaacttggcggtatattcagtagccgcaatggcttatgctactacttcgtcgcctgcggctctcaatggcgacgctgaatccagtttaaatatcaacaattctctccccaaccctccaaaattacaccatgtcatcaagtctttttcgcccgcaactcagacctcctcgacaacctcttatatatcttcgctcacaactactccctcatctctcttccccgcttccaaccattcaaatgcgtctagcccttcaggcacaccattacagattgctaccgacgcccttcaggggcgtttatctacttttcctcccgtttcgctttcctctttcgagcttggagagtcaatgatggctgtcccaggtaatccggcaacctcaaatgtggactctgtgtcccccaatccgaataaaggcgctggcctgatgcggagaatatcgagaggcgcagccagcaagctcacacgaagaagacaatctgcgactcacagtgataaacgagatcgcagctccggtccggtcattatgcggcgacgcagcgacagtaaaactgcagctcaaaccggacgtgagtgtgcccttgattctagcaacgaagaagatggcaacgacgcggtggattctctgggtgtctggtgtggctcggaagcgcccagtctctcgactgacgccagtatgatggcctcgcgcaacgtgggcgctgttgcgcccaaagtcgattcggcgattcagcgcgggacggtgttgacgaaagtgactaagaagcgcaagaagcaggtgcgcttcttcctcgaccttgatgcaggcaaggtttactgggatctgtcaaacccggcgaaacgcttttacattgacgatatcaaggaggtccgcgtcggagtggatgcgcgcaactatcgcgaggaacaccaagtccctcaggatgttgaaggccgctggttcaccattgtcattgctgatcctgaaaagtccaagggtcggtccgtcaagacgttgcacctcattgctcccaatgaccatatccttgaactttggacaacgactttggagaatatctctcagtatcgaatcaatctcatggctggcttggctggttccggtcagagtgagactgtcttgaaagtacactggcaacgtgaaatgtcaaggctgttccctcagggcttagcgcccggcgaagaagagagtcttgacttcggtgccgttgaaacagtttgtagaagcttgcatatcaattgttcaaagaacatgcttcgagctcagttttccaaggctgatcttggcaacaagggtcgactcaacttttcggaatttcagaactttgtcgctcgtctaaaagaaaggaaagatatcaatgacttgtacaaaacgtgggccacgaatgcccaggaaggtctcactgtcgacgaatttctggcttttctccgcgacgcacagcaagaagatgttgataccgatcgagcctattgggtctcagtttttgaaaaatatgtccgaaagtgcaaaccgcgagcaccaagtcttacagatggtgtggaacgtcaggctttccgaatgagcctggaagccttctctgcctttctctcgtccaactggaatggaatatacgcatctcgcccccctcaatcgcgatttgaccgaccgctcaatgagtatttcatttccagctcccataacacgtacctgttaggccgtcaagttgccggcgcttccagcacagaggcgtatatcagcgctctgtcacagggctgccgatgtgtcgagattgactgctgggacggtgccgatggccgcccgatcgtttcgcatggacggacgatgacaaccagtgttctcttcgctgattgcattactgtcatcaaccgatatgcatttatcacctgcgacttcccgctaatcctctcgctcgaggttcattgcaatcctgaacagcagctggcgatggtcaggatcatgaaagacacattcaaggaacgactcgtcctggagccgctcttgacaaatagttttgtcctcccatcaccagaagaactgaagggccggattctcgtcaaagtcaaaacatgtgacgagaccctcgatggagtgcgacaagatacctcgacctctttcgcgagcgctggtcggaagcgcagctcaagctccccatggatgcgtcctagcgtccctgagaatccttttgtgcacgaacctttccccttctctccagtcctatga

SEQ ID NO: 17153 - DNA, 1422 bp, A.fumigatus
agggccggattctcgtcaaagtcaaaacatgtgacgagaccctcgatggagtgcgacaagatacctcgacctctttcgcgagcgctggtcggaagcgcagctcaagctccccatggatgcgtcctagcgtccctgagaatccttttgtgcacgaacctttccccttctctccagtcctatgacccatgggcccaggagagtgtagggccgttcgtttcacaggatagacgttctttcaccaccacaagtatgagtagcgcgacagaagacagcgatggcgcgttggtgtcagtcaagagagaaagaagacgacgtcaaaagagcaagatcacgaagcctttatcagaccttggagtctacacccgtggctacaaatggcatagtttctcgtctcccgagagtcagcggttcaaccatgtttactccttcgcggagcgggcgttcgagagcatctgccgtgacgcggagaataaggcgctgttggaaaggcacaatcaaaaatacctcacgcgagtctatccatccgggtttcgcttgcgttcgtccaatttcgatccgctcaagttctggcgacgcggcgtgcaaatggccgccttgaattggcaaacgtacgacatcggaatgcagctgaaccaagccatgtttgcggctggaactgaccgcactggctacgtcctgaagcccgaatcacttcgtctcccaccttacgagcaagcgagcaagacgtccaccgaacggaagctggttcggttctcagtggaggtcatttctgctcaacaacttcctcgaccacgtaccatgggaccagatgacaatatcaacccatatgtggaaattgagatgttcagcgcagacgatcgcggccagagttttgtcgtcggagaaggaggcatgaatgcttccgcgcggaatggcgtgtcgggcattggctatccgcatcgtcgacgcacaaagatcgagcagagcaacggatacagcccaactttcaatgatcgtttcaagctatcgctcgagaccaagtatccagacttggtgttcgttcgttggactgtttggagctcactggatgggcgcagtgctgggaacaacaacagtgttcaattggccactttcactgcaaaactgagcagtctgtctcagggttaccgttacctgccactgtatgacctgggcggtgatcaatatctgttctccaccctattctgcagaattactaaggaggagccggtgccggttcaacgactcggagccgaggaacttcgagcggagcgtctggggatccttcgtcagattggtcaaacagtgttcaagcgtggttcatcgacagagagatctgacaagggcagcgagacgcctgcaagccaagacgataaggatacgtctccggtattgacgcctactgtttcaacgacgtccacatca

SEQ ID NO: 17154 - DNA, 792 bp, A.fumigatus
tatccgcactggacgggtcgtcgagacaagcagggatcgcccatcgtaatgcttgaaacagtccatctggaccaaaaggccattacgcactggcatcagacacgacaactgtctggccaaagcagttcaccggacatggaacagcgagctctagcctatttcgattatctcacccggtttgtctttccactgtgctccgcattgcaagacagaccgctgccatcggagccggtaacaaaggcgatctatctgatcgatggatcctctatctgtctgcgccaggcctggaatctccgagatttctcgcaggatgttagctggatcttagccacttgctatccggaaacaatcgatcggatatttgtaagtgagagagtcattggaccatgtgccttcgggctgacctgcgtacagctctgcaatcctccgtcatacttccccaagatgtggagtatgctgaagaagtttatcgacccggtgactgctgagaagattgtcatgttggacccagcggatgtctatggcaccctcaacaagtacatccatcatgacaatattcctgtccagttcgggggcgcattcgagtttacgcacgggatgctgccggacttgtgtcccgttactcgtcaaactttacgctggtcccctccgttcaatggcacgttccctccgggcccgatcaagtggacggagcatgctcgtggccagataaaagcagtggctattggaacggttgatggggtggagaggggattcgatgttgccacgttggacattgaggaagagaaatga

SEQ ID NO: 17155 - DNA, 201 bp, A.fumigatus
catattcgacggcacggtccgtatatgacgctggataccgcgcgttcttctagcttggcggccattcaccaagcagttcaagctctctgggcgggaacctctcgaatggctgttgccgctggaacatacatgtggacgcatggtgcagcaatggtccgacggtactgtacttgcctcccggagaggctcagcatcagttga

SEQ ID NO: 17156 - DNA, 387 bp, A.fumigatus
cgcggcaatacgggggttatgagattaccatcgagcgcgctttcgtttttggcaagccagggccctggtagtggcatggtcatccatcgcggagaaggcaaattcttcttgatcgggtgggggtttcaggtccgcgcaacctccttgtctctgactgctgcgtatacagggatcttccgcttcgaagagaaggtcgtggtgaacaaggggacaggggaactccggactcgacgcgtgctcaatggagacgaaacccgcagcggccagttcgctatcatgcccaacgaagacccagactacggtggattccctatcgcaatcactatccctgcaaagacaatgattgccgaattggaggtttacgcgttggatgaaagcgacgtctga

SEQ ID NO: 17157 - DNA, 960 bp, A.fumigatus
ccttccaccaccatccaatatccattcctcatgccctgtaggtcgatgaacaggctaataatcgcctcaggaatgtcaacgtacgctcccgcgtgggtcaagatgaaccccaagcgcttcccccggatgaaattgcgaaaagcaggaggggtcctacagaccaccgagatcctgtcaatattccatgaggaagctcagaagtgcgacgccagggcctttaagcagttgatgcgccacctgaaggactttgaccaaaatcactcaacggtcatcatggttcaggtcgagaacgaaactggcttactgggcgactctcgcgacggctccgctgcggcagaggagcgattctccaaaccagttccctatgatctcctcgacttcctcgccaatgactgggactctcttcaccgagatctcaaacgcaacttggttcgcttcaaagcccagaccaaccggcaagggtcgtgggcggaagtgttcggcaaagggccacacaccgacgagctcttcatggcctaccactacgccttgtacgtcaaccaggtcgccgcagccggccgagaagagtacccgcttcccttgtatacaaacgcgtggcaaaactatgctggagaagacattgataataacttgctgggtatcgttggtggcggtggtatgccaggcgactatccttccggtggctgcacaacaaacgtcctggacatctggcaacggtttgcgccatctttggactttttcactcccgatatctatctgaatgattatgaaagctgctgcgccaagtactgccatcgcggccagcccttgttcattcccgaacaacgccgagacgagtatggggcccgccgcagctgggctgcaattggctcttaccggggcccttggtgtctctccgattgccctcgataccctggaaccccgaacaaaattcatacatcaagcattatgccctactag

SEQ ID NO: 17158 - DNA, 501 bp, A.fumigatus
gcatcattgttatcccaaatttttttttctgacctaacatcctcacctgctgatcctgtcagtaatggaatacgatgctccgtctccgacctctcgtccccgaccgcgcgcatcctgccgaccgtctacatgcggcgggtcaacatctccgtctacgacgcccagtttgacgatgacagcggttgtcaaatccccatccctaagcatgttatcaaatcggtagtcggtgcgatcgttcgctttcagattacgtgtgctcagatcggtgtccccccggagaacatccgcatcattgcgaccgaagccacccgcaccgcgctcaatgcaaacgagtttgtcgatgccatccgacgcgccaccaacgtctcggtggagaccctgcccaaagaagttgaaggaataattggtgcgtgggggattgccagcagcttctccgacattgaaggactggccatcgatctggggggagggagcatgcagatgacttggatcgtctcgcat

SEQ ID NO: 17159 - DNA, 213 bp, A.fumigatus
gctaggagtactattagtttactagatttctatagaagcttaaaaactactactagtaatacactactaattagccccctattattaagacctatactactactactaaatctaccttatattcctagttaccctaaagctctagccttattactactaagtctactaagtaaccctagtgccctattatttaaaggaataagcatatgctag

SEQ ID NO: 17160 - DNA, 2040 bp, A.fumigatus
agcggcagatatgccaactgttgctttctttgccctcaccagcattttccgcaagttgattcgcacacatggcgttcgctccttcaaatgcgtgcccttggcaccgtggcttcaagtgccgacatggaaaagctctctccaacaatggcacagtccattgtcgagctcactgacaagcttgagcacgagctggctttgcggttggtcaaccggctggtgcgtgctcttaccgcgcgcttggcattttacgagatatcgaaagcgcgtcatccttgcctccaagatttctccaagaagcgacaagacagtgctctggatcttctgatgaacaatctgggcgaccattacagccttgttagggctgcaacagacgagtcagatggagccgaacccccaccatctgcggccgtgattatcgccgaatggcttcggactctcttcctgaaagaatgggacggtaatcctgagatttcacggagcagctccgctggaggcgtcgtggagattctgtcacggatgtacaagcagcgcaaccgcctaggcctggtcccggaagattttcacaccccgttcctctgcgagcggttggagcctctggacatgcctgtggaatggatcggaaggttgaccaataacaaaacgttacatctgctttcctattcattccttttccctccttcggcactcgtcatttatttccgcgccctaaactacgctgccatgtccaagtactacgaagctgccatgactacctcgaggcacgtgaaccagactgcatttggaccgattcccatacaggatgatgtcatgctgttgtcgcaaatgaagacatcgatgtctacgtatctggttctcatggtccgccgcgataacgttctcaccgatgctcttaaccaactctggcggcgggagagaagagagctgatgcgtccactgaaagtgcagatgggaatggacgaaggtgaggaaggcctcgatcacggcggagtacagcaagaatttttccgagtcctcatggcagaagctcttaatccatcgtacggtatgttcacaatggacgcgcgaacccgtatctcgtggtttcagccttgttcattggaacctctctacaaattcgagctcttaggcttgctcatgtcgctcgcaatctataacggtttgacattgccggttaactttccggtcgccttctaccgcaaactactcggactcaaagtaaaacacttggagcatatccgagatggctggccggagcttacgaaaggactcgagttattattgtcgtggcaggacggcgacgtgggagatgtcttcatgcgaacatatgaattcaccttcgaagtctttggtgccgtcgaaacggtcgacatggaaaaagttggcagagacgctgtatggcccttgcgagcaagggatcgcagcaagtcgtcggaacttgcaacgaactggtcagagctgtctcagcatgctgatcccgcagatctgagtcctccctgctccatgtctgcggatcatgtcgatttcctcgaatgcgggtcgtcgcatcggagcaaatcagagcgtcttgattattgcgtcccgacgcctccagttgaggaggcctcccttgttacgaatgacaaccgtgctcagttcgtcaaggattacatattttggcttactgataagtcgatcagaccccagttcgaggcgtttgcgcgaggattctatacatgcttagaccgagcggccctgtcaatctttacgccagaagctttcaagacggtcgtcgaaggaattcaggagattgacctgggagaactggaacgccatgcccgatacgaaggcggcttcggtccccatcaccgagtcatccaagatttttggagcattgtgaagagcttttctcaagagaagaaggcgcagctcttggagtttgtcacagccagtgatcgtgttcctgtgaacggtattgcgagcatcatgtttgtcattcagagaaacggtgtgggtgatgctgtaggtgtccttgctcgcttttctgctgcattatcagactga

SEQ ID NO: 17161 - DNA, 396 bp, A.fumigatus
caacaccatcagggcgtccacaacctaagcaccgcgaaccacgtcatccacgatccctccctgaccgatctcggaaacgaacaatgccgcatccttcgcgacaacttccccttccatgatcggatcgagctgatcaccgcgtcgcctctccgacggaccatctacactgcataccagagcttccagcccgtgctcgagaaacacaaggatatgaagatcgtgctgcttccggatgtgcaagagaccagcgacgttccttgcgacacggggagtgacccggaggttctgcggaaggagatggaggagcagggaattcctgtggatatgagcttagtgcaggaaggatggaacagcaaggtttgtttccttcgtttcgggagggagaggggaggctga

SEQ ID NO: 17162 - DNA, 444 bp, A.fumigatus
cggacgcaacaaaggcaagtttcacatccaataccccgacagggaacaaggttcgagatcgcatcgatgattggactcgatgcgcttcttcaaggaagatttccctggattggagacatacttgcaacactcgaacaatacccattatgtgctcagagacaaaagtacaaagctcgccgagtcgaccagaatagaacaaccgagacccaacaacaagacagcgacaaagacggcgttaagtcaagtacttcattgtgcgccgtcgtctataagagtattgactgctgcatgtcatttgcaatcagccagtggccttctcgcatcatctcagagacggacttggtcagctttactctactagagcagtatcggacaggtgagtctgccctgaaaggcaagcaaatactaatgcccggttctcaggatcctcatacctatgattaa

SEQ ID NO: 17163 - DNA, 270 bp, A.fumigatus
tgcaggaaggatggaacagcaaggtttgtttccttcgtttcgggagggagaggggaggctgacggcattcagacgggtcgctatgcgccgaccaacgaggcgatcaagaaccgagcgcgtgcggcacggcgctggctgaaggagaggccggagaaggagatcgttgtcgtcacgcacggtggttttctgcattacttcacggaggactgggaggatagcagtctttaccagggtatgtctcgttttgtcatttttttacaatcgatgtga

SEQ ID NO: 17164 - DNA, 195 bp, A.fumigatus
atctctgcacgtgtggattttttttgggtgtacccttccttcgcccgtgtcaagtcactcattgctcttagcttagcccttcttttctggaaggtctgcgcaccggaattcattcaccccgtatacaacaaacggaggtgtgcattttccttctatattctctctggttgcttattccagacgcacacactctag

SEQ ID NO: 17165 - DNA, 2574 bp, A.fumigatus
ctatttgtttttaatcctgcatggtcctgtggtgtgggctttagcatgtatgcgttggtcgatccgatctgtcaagtcaaggaatctaggagcctcattactgatatcttgaagcaaaagcagcgggaatcctggcatgttccttcgaacgcaagcgcaagaattgctcctgatcaacatcggcagtataggatagaagggaccgactcagaaccataccacaatggccagtacaacagtcagtcttctcaccaccatacgaggggaagccctgatctaggcgatttggatatcgccaaagcatgtggtgaggtgtctggagaccaccaactgcggtttagccgccagaaatcttcaacaggagtagaacacgcagtaaagaatgcccaaggcctttctggcaggcccgaaaatgctgttcgctctactgaaaaatctacttctcagaatgagaccaacaccttctcacacaagaaggacaaacgagtcacgcgacgcctggaagcagagaggatagagcttgagaaacgactcttgaagctcgaacagacacaattggcagggaaccataactcaccgaaaagggagtctcgtcgcctaacaaagaagcagcccctcggtagctctagcaggggctctagcgtgagtgctgatgaatctcgaccttcctcgaggcgtctttctggcttgttctcaatccctaggcgtgcatcaacgtcacgatcaagctctgtaaatggcaggaatggcgaagaatcaacggatagtgcacctgttccagcgaaaacactaccggacgatgtttcaacctcacgggttgctaaaccctctttatccacaagtttgccggagcgatttagtgcagtaatatcaaaagagttaattgtcaggagcaatgctctgcttcaagaccaaacgtcaccagcgcagtcaccgtcgtcaccagcgaccacagctgcaatgaaccaatcggagacactagagtcgaacgaagaacgccccttgcagaagcctgagccaaccttagactatgcaaagcagcagattgacgatcatggcgaatcgccaaagtcacgtagcttacagacgtcgcctgatttggacccattatcgttcgcagcgactctgcacctcgcaaaaagggctcgaggtaacaatcacttcaaggaccagtctccagacaaggttcagcacccgtcgtttgtccagagggatgtaacacagaatggaaagctctacgacccgcaacctctcgggtcatcgaagatgggcgccgtttcccaaccgaacccaaagacaattgacaactcaagcagcttgccaactaaggtatcagtcaagtctgttcccaggaggactttcaaaccatccccccttgcaggtgactcgacaagcggtgggagttctcggtcactcgccggaaacgccagcgtttggcgctcgcgcaactcgggaggatccagtggcgcgagacggactccatcctcctcaatggtaacggtagcaacgcgcatatcttctgctgtggaatctttgcaagtctcacaaccttcaaccaatagccaatcggagacagagagggaagggagggcacaagatagtgcttctgagcgtacgcccaagtcgaacaatttggcaaacactcgtgtctcgaaagaacaagaagctcttgattacgcttcttcgcaacatccacggattcgtcatttgactcgaacatcagcaccggtttcaaatcccccacagctgtctgtgaaatcgcgaatccagacttcagaaaatgacaagaatattaatcacctgagcgtgaaacataatcgccaagaagctcaagccatacatggtgcccaaaccgcgagggtcaaccaggatgtgcctcccatgacagagcacaaatcaggtagaagacttgatgcccggggatttgcaacaccaggcagcgcatcttcacgaagctcatctccagagccttgttcggaagactacaatactgccgatgaagctggatcgataggatctgtaccccgagccaataatgactgcttggatggtaagtctgcagcagcatctggcccctgttttgtgcagaatacgatcgaatcgaacgactctacctgtgtgggcaaattcacggatgtcgcggtatccaaggcgggcgaccctcaaggtgacaggccagccacggagacaggagtctgtcagagaaagcagtcgaccacgaagacttttgtgatatgttgttcatgtaaatactggcatgatatgccgcctgagagttattcgaaggtcgctagtccagatacttgctcagtccctaccagaaaaggcccgactcttcttggtcgcagttcctctttcgcacaaaaatcgagccggaaattgactcgcagtacccagattaagtctgccttactgaatgagcgatctgtcagcgagagggccactataggatcggcaacaaggtctcgatttgcggacgcccctttacggtgctgttggtgcgaccatccgatgaacaggcattgttgtgagggatggactactacggtctacaagcatgagaggcaattttga

SEQ ID NO: 17166 - DNA, 933 bp, A.fumigatus
tcctatcccttgctccccctgagctggatagccggctcgctaatacaccattcgactgtagggagagtgttgtcatcacaaacgatcggggtcgaattctcctcaaaaataatcaggctcggatccggtccccgaaaaacaaggatcaaactgcagctttgggacaccgcgggcacagagagatttcgttccgtctcaagatcgtactatcgcggagctgcaggcgctatcctgatctacgatatatcgtcacaagcttcattcgcagcgcttcccacctttttgatggatgcacgtgctcttgcatctcctaacctcactgttttcctggctggaaataaggcagaccttgcgtccgactccgtgacccatggcgatctcgcggatgacagcatgagagcaccccctactccctccagcactagcagcaagcagtcatcattcccaatcgactcggtccctggttccgttcgatctacaagcattctgggtactggaacaaggctcacggcgacatatgcctttgaaggtcgtcaagtgagtgccgaagagtcagcgcactgggctgccaaggcgaatattcctgttgctgtcgaggtgtcggctcttaccggagagggcgtggaagaattgttcaaccggttggcacgaattattcttaccaagattgagctaggggagatcgatcccgacgatcctcaaagtggcattcagtatggagatggcggactgtatggccagggcactagcgatgggtcgagtattcgaagtcggatgacagtcgatgataattccgtgcaactgcatcgcaggaatccaaaaaggcggggtggcactaggggagtgaataactggagaagcaacatgggagaatgggaagaggtctttcaactcagcggctcgcaccaaaagaagggtaccggatgctgttga

SEQ ID NO: 17167 - DNA, 438 bp, A.fumigatus
caagatgcggagaacgggaagggttgcgagtccccgcaagctcctgataaagcggttctagtgcgggacagctttttttgcccgccagcaaatcaagaccccgacaagtcgctgctcggcatccctgcgattaaatatcccgagttgctccacgggcgtttgccgagtataaagcaatattcaccaatgggtccaaagaagaagcccgacgcccgtggagtccccaagcctgggactaagcaagccaaagccgccgcagagcgattagctgaaaacgcaaagaaagcgcaggccgccacagaggaaccgaagaaaccatctgtgaaggaggtgatcgggggcgcatcatggactggaaagctgccggtcaatatgctcgcggagcattgtcagaagcagaagtgggagaagcctgaatatacaatggtgagtgaatga

SEQ ID NO: 17168 - DNA, 2787 bp, A.fumigatus
atgagaacttcagatggctatatctcttcagtcatattgaaacggattgatccaaagactcgagaactgaccgtacttcctcccatgaagccgccatcatcacacaagcatttggcggctcagccgacggcgctggaagctcgccatttcgctgctgcctacgccttgtttcgagtctgcaacatgagaaacctacatatgatgctcccgcctacctataagaagctgtggaaagaggactttaccgacttaaagaacgcagataccaaggaagggaaagggtggatgtacgaagccgatccattcctagcgaaacaagaacgagaaactgctgctgcagagcaagaaaagaaacgaaaagagagagaaaaggcgcaggcgaaagagaaggagaccgctgtcgacttgggtgtaggctcaagtggcgagaacagaggaaaaaggatctggtcgcaagctccaaaggttgatctgggaaatagaattcgccgtgaactcgaggagctgttgcgacagcatacaatctggaatccgtacaacatacagatttcggaggctgagcgcaaagctattgttgaagagttcctcggtttgggcttccgacgcagtcatgttgaagaggctaccgccgcctgtagagaccgggaagaggttcttgagtggcttctcgtctacgtcccggaggatgacctcccgcggtggtgtctgcccgagagatataccgccggtgtgactctcgccagcgatgaccttggaagggaggccaaaatcaaacggcttgcctcttttggatattcagctgatctgtgcgctcaaaccctggataacaagcgcggtgatgagcttgcagctgcagaatttttacaaaggactttagtgcacggtgaaaatcattccctggactcattgtccgtgggggacgaagattcttgggtggaggagcaggatacactcgaagcaatcttcggagaacgctacaaacgtttatcatccaaagtctgcgagatcaaaagcgaggcgccaaatattcctggatccctatcttttcgatttcaaaagccctctgcaggttatccatcgtctgtgcctgtgatcgccattcagggaactggtattccggcttatatacggctcagcgcgatacggcaagctgtacaatttgcagaggaaaacttcctgggagagtcaatgattttcaatataatggactggctggaaacacatctaccagggatcatagaaaatccaggcaaactacgagatatttcaacggtaacgggctcttcttcatctgcagttggctcattcccaaggcttcccgttcgtcagtcacggaagcaaagcagaaagatcgattggaatccgggttcaccactaggcgtttctattcgagaagcttggaaggccaggcagtccacaacggcacagcaagaaatgactcggaaacgcgagtctctgcctgcttggaaaatccaagatgctattatacaagccgtgaatacgcatcaagtgacgattatttcaggtgaaacaggaagcgggaagagtactcagtcagtgcaatttatactagatgatatgattaaacgtggcttaggcggcgttgcgaatatcatctgcacgcagccacgccgaatttcagcactaggtctagctgatcgagttagcgacgagcgatgcacctcggtggggaaagaagttggatatatcattcgtggagactccagaatgaggccaggcgagacgaagatcacctttgtcactactggtgtcctgcttcgtcgcctgcagtccggcagtgggccggatggcaacgtcgcaggttctctggcggatgtcacacatgtcgtagtagatgaagttcacgaacgaagtcttgacaccgacttcctcctggctctcttgagggacgtgctcccataccgaccagatatcaaagtcatcctgatgagtgctacgctggacgcagagatcttcatggactatttcgggggtcgtgagaaagttggtctggtgaacattccgggtcgaacattcccggttagcgattattacttggatgatattgtccggtacaccggttttgcacccgaactggccgagcgaggtcttgacgaagacgtcatgtctcctcctcaaggcgatgaatcgttaggcaagctccttcgcggcctcggtatgggcatcaattacgaattgattgcttccactgtccgatatatcgactctcagttgggagatcagccaggaggaatactgatattcctgcccggaacgatggaaatcgaaaggtgcttgaatgcggtgcggaaaatacccaatgttcatccgctcccgttacatgcgtccctgctcccggcagagcaaaagcgtgtcttcctcagccctcccaaaggaaagagaaaggtcattgctgccactaacgttgctgagacctcgattaccattgaagatgtggtcgcggtcatcgacactggccgcgttaaagagactagctacgacccgaaggacaacatggtgcgcctccaggaagtctgggcttcccaagcagcatgcaagcaacgacgaggccgtgccggtcgtgtgagggctggttcctgctacaagctgtacacacgcaaagccgaatcgagtatgccgcagcgaccagaacccgaaatccggcgagtcccattggagcagctgtgcctgtcagtcaaagccatgaaaaggataggacgatgttgctaccttttttggcgagcaccatctcgccgcctgaaagcgtcgctgtcgagggtgccatag

SEQ ID NO: 17169 - DNA, 357 bp, A.fumigatus
aaagcccattcatatcaccccgcgacaagcgcgacgaagccgacgccgccaaagcgtccttctccaaatgcgacggggatctcctcaccgacctcgccgcataccagcagtggtctgagcgaaccaaagcacagggctactggcagacccagtcctggtgctccgccaacttcctctcgcaccagaccctccgcgacatttcgtccaaccgagcccagttcatcagttctctcaaggacgccggcatcctcccagtcgactactcagactccgaacccagttccgcctggaaccgcaacaacgggaacagaagcctcctccgcgccatcatcgcaggtgccttccagccgcaggtag

SEQ ID NO: 17170 - DNA, 489 bp, A.fumigatus
gcgaaccaaagcacagggctactggcagacccagtcctggtgctccgccaacttcctctcgcaccagaccctccgcgacatttcgtccaaccgagcccagttcatcagttctctcaaggacgccggcatcctcccagtcgactactcagactccgaacccagttccgcctggaaccgcaacaacgggaacagaagcctcctccgcgccatcatcgcaggtgccttccagccgcaggtagcccagatctccttcccggacaagaaattcgccagctccgtgacaggcaccgtcgaaatcgacccggacgcccgaacaatcaagtacttcaaccaggaaaacggccgtgtcttcatccacccaagctccctcctcttctccgcgcagagctactccggtgccgccgcgtacctcagctacttcaccaagatggcgacaagctaagtcttcatccgggatctaacccgtatgcattcccatccccatcccca

SEQ ID NO: 17171 - DNA, 1017 bp, A.fumigatus
ctacgacccgaaggacaacatggtgcgcctccaggaagtctgggcttcccaagcagcatgcaagcaacgacgaggccgtgccggtcgtgtgagggctggttcctgctacaagctgtacacacgcaaagccgaatcgagtatgccgcagcgaccagaacccgaaatccggcgagtcccattggagcagctgtgcctgtcagtcaaagccatgaaaaggataggacgatgttgctaccttttttggcgagcaccatctcgccgcctgaaagcgtcgctgtcgagggtgccatagatttcttgcatcgcgtgggcgcccttgatcaagacaggctgacggcacttggacgatacttatcaatgattccggccgacctacgctgcgccaaacttatggtctacggctccattttcggctgcatagatgcctgcgtcaccatatcagctatcctaacggtgaaaagcccattcatatcaccccgcgacaagcgcgacgaagccgacgccgccaaagcgtccttctccaaatgcgacggggatctcctcaccgacctcgccgcataccagcagtggtctgagcgaaccaaagcacagggctactggcagacccagtcctggtgctccgccaacttcctctcgcaccagaccctccgcgacatttcgtccaaccgagcccagttcatcagttctctcaaggacgccggcatcctcccagtcgactactcagactccgaacccagttccgcctggaaccgcaacaacgggaacagaagcctcctccgcgccatcatcgcaggtgccttccagccgcaggtagcccagatctccttcccggacaagaaattcgccagctccgtgacaggcaccgtcgaaatcgacccggacgcccgaacaatcaagtacttcaaccaggaaaacggccgtgtcttcatccacccaagctccctcctcttctccgcgcagagctactccggtgccgccgcgtacctcagctacttcaccaagatggcgacaagctaa

SEQ ID NO: 17172 - DNA, 378 bp, A.fumigatus
atatccaaaagaggcaagccgtttgattttggcctcccttccaaggtcatcgctggcgagagtcacaccggcggtatatctctcgggcagacaccaccgcgggaggtcatcctccgggacgtagacgagaagccactcaagaacctcttcccggtctctacaggcggcggtagcctcttcaacatgactgcgtcggaagcccaaaccgaggaactcttcaacaatagctttgcgctcagcctccgaaatctgtatgttgtacggattccagattgtatgctgtcgcaacagctcctcgagttcacggcgaattctatttcccagatcaacctttggagcttgcgaccagatcctttttcctctgttctcgccacttga

SEQ ID NO: 17173 - DNA, 750 bp, A.fumigatus
atatcagtctcagagcttctatcacctaagaacaagcaacagaaacaaaccagccatcccccctcaaaaacggacatcaagaacaggtttggcgcgcgggacggtctgggcgcttacatcgaaaagccagagtcatacccgtccagcgtcgtggtacactacgacgatgattttgttgtaattcatgacatgttccccaagtctaccctacatttgctattgcttccccgtgacccaactaaaacgcggctccatccatttgaggccttcgaagatgcagagttcctgagtaaagtcaaggccgaaacgagaaagcttcgcactttggccgcagccgagctgagacgcaagtacgggagatattcagcccaggataaagagaggcaggatgccttgaatgcagacccgccgcctgatgtgctaccgcaggggagagactgggagaaagaggtcatgtgtggcatccacgcgcacccgtcgatgaaccatctacacatacatatcatttccgtggacaggtatagcgatcgcttaaagcacaggaagcattataatagcttttcgacacctttctttatcgatatcgaggattttcccctcgccaaagatgatccgagacggcatccggacagagaagggtatctacggagagacttcaaatgttggcgatgtgggaaggaattcggcaataggtttgctgaattgaaaagccaccttgaagcagagttcaacgaatggagaaaactctga

SEQ ID NO: 17174 - DNA, 462 bp, A.fumigatus
ccatttgattttggtaggaacgctccgttcattcttggagttcgtgctgtcgcgcttccgctagctgccggtaacaccgccatcctcaaaggctcagagctggctcccaaatgtttctgggcaattggtgacatttttcgggaagctggtcttcccgccggatgcttgaatgtcctgtaccacaaaactgctgatgcggctgaggtgaccactgctctaattgcccatcctgccgtgcgcaaggtgaacttcaccggaagcactcaagttggttctatcatcgctgcgacggccgggaagtataccaagcctgtgctcctcgagttgggaggcaaggcgtcagctattgttttggacgacgcgaacctggagaaggctgcgttctgctgcgctcttggatcgtttatgcatgtgagtattggttcgttgacgccctgggatgcgttcagaaggctgacttaa

SEQ ID NO: 17175 - DNA, 453 bp, A.fumigatus
aaccagtccggccagatctgcatgtccacggagcgcattgtcgtacagcgcgcaatcgcagacaaattccgtcagctgctggctgagaatgcagaaaagctcttcggaaaagctgcgccagcaccggtgctggtaacctcggcagctgtcaagaagaataagacgctcgttgctgatgcgctctccaagggcgccagcgtcctcttcggcgatgcaaacgccacagagtcatctgatcacagcctacggcccgtgattgtggacaacgtcaccaaggatatggacctctactccacagaatcattcggtccaacagtatctctcattgtagtggatactgaggaagacgctattgcgctggccaacgacacagaatacggccttacatcggcagtcttcactgacaacttgttccgaggtcttcgtgtggccaagcagatcgaggccgggtaa

SEQ ID NO: 17176 - DNA, 657 bp, A.fumigatus
tcctcaaggaagacaaaaatgcgtttcgtcaccgttgctatctctgcccttgtggccatggcttccgcctacactcagcccgactactctaagcctcctcagggcaatgccatcctgaagcccggtctgaacgagcaggttcctgtcggcaagccctacaccattacgtgggatcccaccactgagggccccgtctctctggtcctcctgcgcggccccagcaccaatgtcgttcccctctccaccatcgttgagtcgatccccaacacgggctcatactcctggactcccagcaccgacctcgagaacgacgtcacccactatggtctcctgcttgtcgttgagggtactggtcagtaccagtggtcaactcagttcggcatctccaaccccgggaaggctgccgacactcctgctgccagcgtgaccgcgaccacctccgccacttccgaggttgagacccccgctgcttcttctcccgctgactccaatgtcaccctcgtcaccaccgagacgactacttggtgcccagagtccactgccaagcccacctcgatccccgtcatcgttcccaccggcgctccttccatcccctctggctcgcctactccttctgcctaccccagcagcactttggatcagggccccaaaaaaagg

SEQ ID NO: 17177 - DNA, 525 bp, A.fumigatus
ttctctcttgttataatttcagcgttggatacccctgccgaagagatcgtcaatatggccgcaaacggtgctaaagctgattctggcgtcatccccctcatcatcaataacgagtcgatcgtgacggagaatgttttcgatatccatgcgcccgctaccgggcaagtgttgcatcaatgcgccgccgcctcggtcgaccatgccaaccgtgccgtagcagccgcgaaggctgctttccctgcgtggagcaggatgaagccctacgaccgcagagacgtccttatgaaagccgccgatatcatgttcgctagaagtgaagagttgattaaatatcagatggaggagacgggcgccgggaggatgttcgcggagaagacgtgtcttttgggagctggattcctcaaggactttgctgctagaatcccgtcgattgaaggctccgtaccttctgtcactcaggacggtgagtgcgcaatggtattcaaggagccgtatggggtggtcttgggaattgcaccttggtaa

SEQ ID NO: 17178 - DNA, 309 bp, A.fumigatus
gtgcttccggtgaagttcaccttgcgcacggcaggatgggcaattagagcagtggtcacctcagccgcatcagcagttttgtggtacaggacattcaagcatccggcgggaagaccagcttcccgaaaaatgtcaccaattgcccagaaacatttgggagccagctctgagcctttgaggatggcggtgttaccggcagctagcggaagcgcgacagcacgaactccaagaatgaacggagcgttcctaccaaaatcaaatggtcaatttctatgcgaagacgacgtcgcaaaagcagactcgaaatag

SEQ ID NO: 17179 - DNA, 204 bp, A.fumigatus
gttataacaagccccagtcacatcaactcagctcggcggggcgcgaaaatacgcatatcagcaaacaaacaattaacttattaccaagtccgatcatttaagtcaataaacggagtgcaacctctgtcgtttatcatttcggtggaacctcagtttgtgtctcaaaagtactatgagcattccagccttcaatctccaggttaa

SEQ ID NO: 17180 - DNA, 204 bp, A.fumigatus
cgacgggtcgcggggattgagatatgttggtggcccggaggtataatctacaacgaagggtgggaggctctttataccgctgttgttatgcgctctggcaacatctttattgatcttgttctgtactgggatagctgccgtgtaagcttgcactgtagcacccagccgaacaattgcaacaggaagattgttttgctgtggtaa

SEQ ID NO: 17181 - DNA, 510 bp, A.fumigatus
ggttggatgccaaagacaatagaactgacaaacatagacgtccaaatggtggaacaaaagccccttcgagttctcgtcatcatctcagacaccaatgcctactgggaaaagtcttggtctgcttcagaggacttactccccgtggcttttgagatcctccaagagaattgcttagtggagaacacatataaacactggcctaaaatgagactgctggcaaaggagaagtgggcgacccgcgtgttccttatatttgacatttcaaatacttcctatgaccctgaagtgggacatttaccacagcaaaacaatcttcctgttgcaattgttcggctgggtgctacagtgcaagcttacacggcagctatcccagtacagaacaagatcaataaagatgttgccagagcgcataacaacagcggtataaagagcctcccacccttcgttgtagattatacctccgggccaccaacatatctcaatccccgcgacccgtcgttacttcggtga

SEQ ID NO: 17182 - DNA, 204 bp, A.fumigatus
tctttaaccagaactgttctccctctcctcaagccagagtttagtatggctgatgaatctgtgtgcaacactaatttttacaccctgcttgacgaagaagtctgggttttccgcatggatttgtccaaggtcaaggcagttctccaatgctatatcacgcgctctcgtaatattttccttatagctgtcactgtttacctgtga

SEQ ID NO: 17183 - DNA, 309 bp, A.fumigatus
aggtttacaaaagcccctgttaccaatttctgtattaaatggtactggtcattccatgacgcaaaatattttatattacctgtatcgccatctacaaggtacccatcaggccacgtggatatatccccacgaatgtaccaaggattcctcctggaagatcacatcaatcatcctcatatggcaagaaagatggcccctaatctagctctgtcgaccctggagtttatccatgatatgattttgagtaataaacttacttactcgcagattgctaatgcggctggctgctacctaagtactattacttag

SEQ ID NO: 17184 - DNA, 228 bp, A.fumigatus
ccagagctaaaatctatccttgttataggggatgcgtccttccatcactctaagagattagagcaaatgtgcgcagaagccggggtaaagctggtatatttgcccccatattcacctgatttaaatctaattaaggagctcttctctaaattaaaagcctttataagacggcattggcaagtctacgaagataaccccgaccaaggctttgattctttccttaaatag

SEQ ID NO: 17185 - DNA, 378 bp, A.fumigatus
ctcttcatccgcggatcgccggcccccgtggagaaaactgcaggggatgtgtccggtgccccgaaggttcgagcgatgcagttgatcgctgagctggagggcgagaagcgcggggtctacgcgggcgcggtgggttacttcggattcgatagctcgagcgctgacggggcgaacctggtgcctggtgcaatggacacgtgcatcgcactccggacgatgcttctcaaggacggagttgcctatttgcaagctggcggtggcatcgtctttgactcggatccgtacgatgagtacgtcgagacgctgaacaagctaggtgccaacatccagtgcatcaaaggtgccgaggacaaatatctgagcatggagcagttgtag

SEQ ID NO: 17186 - DNA, 1380 bp, A.fumigatus
gtgtttgaacgaccgggtagacccttggctaacgagcggtatctcttgtgtcgtacagttcgtgttgcggcagaggaacttaccaccctcattctcgttgaggaccgttgccgcattgaacgatccgaccgtaagctctggaaatcacgggtgaatggactggacgagtaccagagccatgggcccgagccttcgcgccgatccgaccgacgggagcgtcgtcgaccggccgatgacgaagacatagagtatcgcctggctatcgaggcgagcaaggcagaagccgaggaagagcggaaacgacgcgaaaagcaatccatgatgggagaagaagatgaggatctggccaaggcgattaagttgagcaaggaagaagaggaactgcggaagcgggagctggaagagagcaatgcccaatcgctctttgacgatactcctgtggcccaatcccagcccaccgggtataaccagggataccagcagcaaggcgctgtcgattggtttggcaaccccattaacgcccaacagcctctgtctaccggttacttgaacaaccaatacgcacaaccaactggatttcaaaaccaagtcactggaatacccaatgggtacgccaatggatttcaaaatcagccaactgcattcgaccagaacccatacggccagcttcagaacaacttcttgcagccacaagcgccactccagcctcaacaaacggcttttacgacgaacaatccatatggcaccgacatattctcccagcagcagcaacagcaacagtaccagcagtatcagcagcaacagcaagcacaggagaatgtttcgccggcaggtagcaacaacccgtgggcccagagcggtaaccagacagcgaatgccttgcaacccatgcctaccgggtccaacaacccgtttgctgcccgcactcaattccagactcggccccatacgtcgacgggacctccatctcttaacacactcgcggaagaaagagcgaccaatcagtttacttcctctcctaaccccatcgccaatttccaggccccagcacctcccaagagcactccgccacaaacgagcaatcctcaccacgcccgtctcaatgctcttctcgcgaccggcgagggtcaggacacattcggcaacgtcggcgatctacgtatcccagcccagcatactgctccaggcaccttcgtcaactctgccggtcagggtttggatcgtctgcgagccactcacacaggcaacaaccccttctataaccagcagcaatttgtcccacagtcgacaggctttgctcaatcttcgaacaacccttgggcgactcagcgcccataccagcagcagcctcaggctggtggcagcctgatcgatttgtga

SEQ ID NO: 17187 - DNA, 237 bp, A.fumigatus
atatcaattgttgaatataaaaaactgcaaagtccaatggaacgacgagaactgaaacaccgatcctacctgatccatgcctcaagcatcgagattaccaagttgaaccatgtacgccagggttacttgaaaatcatttcaggaaagcaccgctcctccggtaccaccaataccatgtatgtacctattcaccaggaagcctttcaaatcgaaccagccgaacaaccaaccatatag

SEQ ID NO: 17188 - DNA, 315 bp, A.fumigatus
ataaatcagccgccccgttcgccgaattttctggcccactcctcgtattcgcgtagtccgtcgcgactgacgctgggcctgatggatttgagactggcttcgaagtcgtggaagcggatgggacggatttggtccatgggggtgtggaggagggcttcgccgaggttgcggagaggacccattgcggcgtctttggcgagggcggtgatgtcggagccggagaagcctgtgattgttgatgatcacgtgagtattgtagataaggaaatagagtggggaataatgatgatgatagaattaccctctgtgacatga

SEQ ID NO: 17189 - DNA, 549 bp, A.fumigatus
ttctatcatcatcattattccccactctatttccttatctacaatactcacgtgatcatcaacaatcacaggcttctccggctccgacatcaccgccctcgccaaagacgccgcaatgggtcctctccgcaacctcggcgaagccctcctccacacccccatggaccaaatccgtcccatccgcttccacgacttcgaagccagtctcaaatccatcaggcccagcgtcagtcgcgacggactacgcgaatacgaggagtgggccagaaaattcggcgaacggggcggctgatttatctattgtgcgcttcattcagcgtccatcttccctttggaggtctccgtaggcacattcgatgcctcgattccatcgtacatggtcctcggtccttggtgtttttcgcacagcttgtttcggcgcggtcttactcgggtggtctacatgtcatgctatatggttggttgttcggctggttcgatttgaaaggcttcctggtgaataggtacatacatggtattggtggtaccggaggagcggtgctttcctga

SEQ ID NO: 17190 - DNA, 840 bp, A.fumigatus
  unsure (1): Identity of nucleotide sequences at the above locations are unknown.
ngtggagcgcattttcagcccctggtgaagacttccattacgagtatcatgaacaaactgcccaagggcatagaccctaatgcggcccggcagatcctcaatgatatcgttgttcgaggtgacgaggtccattgggatgatattgccggactggatgctgccaagaaagcgctcaaagaagccgttgtctacccgttccttcgtccggatctcttctctgggcttcgtgaacccgctcgagggatgctcttgttcggcccaccgggaacaggtaagacgatgctcgctcgggcggtagccacggagtcgaagtcgaccttcttctctgtttctgcctcgacattaacgtccaagtggcacggcgagagcgagaagctcgttcgagcgctgtttgggctcgcgaaagcattggctccatccataatcttcgttgacgagatcgactcgctcctttcgtcgcgctcctccggaacagaaaacgaagcatcgcggcgatcgaagacggagtttctgatccagtggtcggaccttcaacgagcagcagctggccgtgagccatcaacaaaaagaggcaggggagaccctagtcaggtcctcgtcctcgcagcgaccaacatgccttgggatatcgacgaagcggctcgtcgacggttcgtccgcagacagtacatccccctgcccgagcaccatgtccgcgaccaacagctccgcaagctcctgagccatcaggtgcacgaactagatgacgaggatattgaagtcctcgttcatgtcacagagggtaattctatcatcatcattattccccactctatttccttatctacaatactcacgtga

SEQ ID NO: 17191 - DNA, 237 bp, A.fumigatus
tcatcaacaatcacaggcttctccggctccgacatcaccgccctcgccaaagacgccgcaatgggtcctctccgcaacctcggcgaagccctcctccacacccccatggaccaaatccgtcccatccgcttccacgacttcgaagccagtctcaaatccatcaggcccagcgtcagtcgcgacggactacgcgaatacgaggagtgggccagaaaattcggcgaacggggcggctga

SEQ ID NO: 17192 - DNA, 621 bp, A.fumigatus
ccggtagacagaggctgttgggcgttaatggggttgccaaaccaatcgacagcgccttgctgctggtatccctggttatacccggtgggctgggattgggccacaggagtatcgtcaaagagcgattgggcattgctctcttccagctcccgcttccgcagttcctcttcttccttgctcaacttaatcgccttggccagatcctcatcttcttctcccatcatggattgcttttcgcgtcgtttccgctcttcctcggcttctgccttgctcgcctcgatagccaggcgatactctatgtcttcgtcatcggccggtcgacgacgctcccgtcggtcggatcggcgcgaaggctcgggcccatggctctggtactcgtccagtccattcacccgtgatttccagagcttacggtcggatcgttcaatgcggcaacggtcctcaacgagaatgagggtggtaagttcctctgccgcaacacgaactgtacgacacaagagataccgctcgttagccaagggtctacccggtcgttcaaacactcatcgcgagaccacctatcgatctggccaaggtctctcccgtcctcatccacgtattggaactcgcgcagtgtcttga

SEQ ID NO: 17193 - DNA, 282 bp, A.fumigatus
cactgccgtcgttccccccctgtcaccgcagcccgtgacccggcaaccaactccgtcgacatctgcattgaccatgtcaatgcgcaatacatccgaacgcttccagtttccgcacaccgaaggccggtcctcgtcggttgccgtctctacaggatcgaacagcccgatggaatgtcctactccccggtcgcacagaagtaccgcgggattattaggcacatctcagccttctcgtcgggggctctcgatggtggatctcgatgcgggagaaatgagcgatag

SEQ ID NO: 17194 - DNA, 4200 bp, A.fumigatus
cttcagactatgtggatgctacggcctttcaatcaaccccgagaagtgactattgatcttccccccctgttggtggagtcgttgggtgtcggtgctgaagtgctggcgaactatttgacaactctcgctgaggctgcggcgaatgaacccgatccctcgaagtacccggcgcccaatccggtcctctgtcgcatttgtgagcgtcagatcaccccttggtggttcgagaaacactccgatctctgccttcaagaacatcgggcagagatggacgtccagatcgctcaggaaaaccttaatgagcatcgccacgcgatcgtgaaggttctagatgcattggaggctcgacaaagcaggcctctggcgggcgaaacgccttctccgatgccgcagccggagtataaaggattagcgattgggccatctcccgctgtttccgcaccttcgtctggaaatgtctcgagttctagctcggctccatgcactcccccccggtctcgtgaacattcggcttcggatggcggccatgcacgcggccggtcatttgcagttcggcgaccgttgacacggattgttgagctgattctcgatctgtgcgatacagctctcgaaattaacatgcccgtgatcaaagagcctcgtggggacagcttggacgatttccggactctctcgccgcaatccgaatctcgaatctcccaagtcatgcagtggcaatctcccagttccaacactttggaacaggagcagggtctcgctgcgttgagcgctgacacagagcaggtctgcaaagcaaaagttgacgctgttattcgccatcgcaagatcgtcgaatacgcagagcggattcgtatcgaatatacggtgatggtggaagactgtattgcagctgcccttagtaaggctgaacgtattgctgctggccagttgagcgattccacttgctcatcggaagatgaacttccacctgaaagcgtcactgcttcctctgcgacggctaatggcagtagcactgccgtcgttccccccctgtcaccgcagcccgtgacccggcaaccaactccgtcgacatctgcattgaccatgtcaatgcgcaatacatccgaacgcttccagtttccgcacaccgaaggccggtcctcgtcggttgccgtctctacaggatcgaacagcccgatggaatgtcctactccccggtcgcacagaagtaccgcgggattattaggcacatctcagccttctcgtcgggggctctcgatggtggatctcgatgcgggagaaatgagcgatagcagtgtgctttcttctgcttttaccggagccgtacggactgagtctccagcatccgaccggagcttggagagaaaacgcagaagcttggtgctcccggggttgtccagctcccctcgccgccagccctcacccgccagaatgtcgacccctcactcgcccttgcgcatgcccaaacctcggctctccagcggcgctgaaagcctgccgtcgcccatagtttcaccttccactcacgcaagtgaactagcgcattatcactaccgccatcatcgacgtcagtcatcagcaacttcgtcggatgcgacgaagcccccggtttctcctcacctgacatcagccagtcagcctcaaccccgcccagcgccgtcgtcgatcaaagatttcgagatcatcaaacctattagcaaaggcgcctttggcagcgtctatctgtccaagaaaaagtcgacgggagaatacttcgcgatcaaagttctcaaaaaggccgacttggttgccataaatcaggtaactaatgtcaaggctgaacgtgccatcatgatgtggcagggggaaagcgacttcgttgccaaactctattggacgttctcgagcaaagactatctctatctggtcatggagtatctgaatggcggtgactgtgcttcccttgtcaaagtcctgggcgggctcccagaagactgggctaagaagtatatagccgaggtggtcctcggagtagaacacctgcatagcaggggcattgttcatcgtgatctgaagccggacaatctgctgatcgatcaaaggggccacctcaaactgaccgattttggcctgtcccgtatgggcttggttggacgtcagaagcgcgtcctcaagagtttgaatgagccagcacccgatcttttgaagcagggtccctttcctcgcgccacgtctattgcgtcctctcggtcagcgtcgttcgatttccaggcccctggttcaccagggtcaacaccgctcatgacccccgacctctctggcagtctgaaccagccatcgtacttcagccttaatcagagcggtctcagccgccaaccctcgcgccgggcatccggctaccgcagtgacagtggtggcagcgagaatctgagcgccatgttccgaaatttctctcttaccgagggaaacgagactgcttcttctttaccgccatcttccttacctgtgccggtaccatcgtccagtaacgtagccgaagaagagagtcaaagtgaagccggcgagtctcctcgcttgtatccgcttctgccgaccttaagcaactcggtgccattaagcactccgcctcagcagtcgatgatgccacccctcatggcactctttgaccccgaagatcataacagaagattcgttggcactccggactatctcgcacctgagactattaatggactaggccaagatgaaatgagcgattggtggtccttaggctgtatcatgttcgagtttctcttcggttaccccccgttcaatgcccccactccagacgaagtgttcgagaacatcctacaccagagaattaactggccgcatgaggcagaagagctagcatcccaggaagccattgatctcatgaaaagacttatgactctggatcctcgcgaacgcatcggagccaatgttggcgacaaattcccgaacggaggggcggaaattcgcagtcatccttggttctcagatatcaactgggagactctgctggaggataaagcacagttcgtgcccaaccttgagaatcccgaggacactgagtacttcgacgcccgtggcgccaccctacagccttttgccgaagagttagaggaaggaatttcttcgcaacatgtcacagcagcagaccgccctcacgacgcgctgtttaaggttcgctcgcaggtcaattcgatgaagcggcccttgatgcctcttcacattccgccgcatgtccgtgactcgcgtagcaggagactgagtgagccagccttggccgacgactttggcagcttttccttcaagaatctccccatgctggaaaaggccaacaaggacgttatccagaagctgcgccaggaagctttgcaggcccaacaacgccaatacagctcttccattcctcaagcaattccaccaacgcagggttctgcagccacgtccggccctttgttggaaggtagcccgttgccaatgccactacagcgaaccttgtctcataataaaggcaacaaccgaccgtcgtcgccttccagcttgagccaagctaactcctctccgagccgtccttcccagccttcatccccgcttcttgtgcaattcagtaccggcaacaaccatgagcgcagaaagacgtcaggatcatcctcgacgaattctcatcagtctagcgggtcttttgcgaccggcagtactgatcagggccgcatggcaaatatcaaactaggctcatcagcatcatctcccattaaaatcggtcgaggaggtacacactcgccggataaaacaccttcgggccatcgacagggcagtatcccaacgacccgagcgagatctcagacgatcggatctcaagatggagaattttcgtcctctctcgcaaaggaatcgtatgtcgcaggtcattacaagcgccgcagtcagttgtttgatatatcaccttcctcgtcagacaatgaggaccctcgtacgaaagctttgcttaaagtccagcgccgtcggcagagctcgagacgcctgtcccagatcaacatcctcgatggtccattcttccggcctttggacgtgcttatatgtgaagatcatccggtttccaggatggtgatggagcgcttgtttgagaaactacgctgtcgcacaatcaccgcagtggtgttcaccacgggactggcaggatccgcgcttacgtat

SEQ ID NO: 17195 - DNA, 195 bp, A.fumigatus
cgcgttatgtcggaatgggtggaaacctacatggcccgtcccatctggcgtccgctcaaataccataatgccctgcccttccatgctcaagacatcatggcagttgtctacttccttcgacggttgagagccctcactgctttcttctgtcaccgtgtcgactggtcggggttcaggcgagtacttcagtattga

SEQ ID NO: 17196 - DNA, 411 bp, A.fumigatus
catcaggtatttccccggtcctttccctttctggggttcctgccaggccacacagtgaaatatagatcgcttgaggcgcctcttgttgaccgcattcagatttcttctactctgttcagtcgactgttgttttctttattcctcttctctccctcccaccatctgatctgcactctcctctcccaaacatttgcttacattaacacttcgctgagtgttagccttattcctctcaccaaaccactttctacctcgcgagataaagcttctatctcactgttttcctcttccttccccctcttcagtgtttactctgcttataataccttctatctgcatctactgcttgtgatagccttgctaagtcaaagatctcttgcatatcaaagtaagtttacattgtttccctaa

SEQ ID NO: 17197 - DNA, 678 bp, A.fumigatus
ctaaattataccttgagcatggacgcagcgcggggagttctgcaacgccgggtgcgggcttgcatctctcgtcccggtgttttgtctggtagagtcatttatccatcattgtggctgtcttcgtcgttgtcgtcattgtcatcatccgttcgggcgcggagttctccccgcacgacggtctctccgctccgcggcggtgcgctccgtgaggggagggggttgcttacacctgtgatggcgggtgcgggtgtgggttactcgactactactggtgcttctggggagcaggagcaagagcaggagaaggcgcaagaacaggagcaggaacaggagccagagaaggcgcaggaacaggagctggagcaggggcaggagccggagaagccgcaggtgcagatctcgcagggtgaggatgcagaacaggttcaggggggattggaacgcttgcttgagaacgggtgggtgttggacggggagagaatgggaatcaaaaagacgttttattttcggtcttattttaaggctgtggtgggttttgtcctgactgttgttcttcgcgagagatctagggaggctgattggttggtgcagagctttttgaatgtggttgcgtcgcagagcgcgacaaagaagcatcatccgaccatgactgttgtaagttttttattaacctgctga

SEQ ID NO: 17198 - DNA, 1596 bp, A.fumigatus
tacgcaagatacagagcaggctatctcaaaatggcagtgcctccttctgaaggggtcatagagataggagactcgcatcatcatgagtctgaggcctcgtcctccactcacgcggaccatggcattgacccgtttgaaaagacggagccaaccacagatgtggaaaatgtcgagaccgtagaagctgccgaagacaagcctttgccttccagggcggacaaggtgataaaagaagctgattgctatgacgagctgggttactcctggccagcatggaaaaagtggacgatcattagtgtgatcttcctagtccagacttccatgaacttcaacaccagtctgtattccaatgctctgactggcatctctgaagagtatggagtcagtatgcaggctgctcgttgcggtgccatgattttcctcgttacttatgcctttggctgcgaactctgggctccctggagcgaggaactgggacgcaagccaattctccaggctagtctgttcctcgtcaatgccttccaacttcctgtggctcttgctcctaactttgcctccatcatggttggccgcgccctgggtggtctgagttctgccggtggctccgtcacactgggaatgattgccgatctatgggaagcagatgatcagcagtacgccgtggcctgtgtcgtcttttcctccgttgcaggctccgtcattggtcctgtcgtcggtggattcgtcgaagaataccttccttggcgctggaacatctggattcaattgatcttcggaggagctgttcagctcgctcacctagtctgtgttccggagactcgcacaacgatattgatggacagaattgctaagagaagaagaaagaatggcgaggatatatggggccctaacgaggtgcttgagttccgggagcggtttgcaatgcgggaaattctctccacctggatccgccccttcaagatgttcttgaccgagcccatcgtcctgtctctgtctttgttgagtggcttcagcgacgctctcatcttcatgttcatccagtcctttggtcttgtctacaagcagtggggctttggcacgattgaactcggtttgtcgtttttacccatcctcgtagggtattttatcgcatggatatcttttatcccagccatcaaacgaaacatcatagagcgacgagctaagcctcaggacgaacgggctcaatacgagtctcgcctatggtggctgctttacacagctccttgcctgcccatcgggctgattggtttcgcttggaccagccagggtcctcccgttcactggattggcaccatgattttctcagccattgtcggcattgccaactacagcatttacatggcgacgattgactacatggtctgcgcctatggtccttactctgcttcggcaaccggtggaaatggctggtctcgagacttcttggctggtgttcttaccattcctgctacacctttcttcgagagtgagttatcctcttcactgatccgccttatcgtcacagcagctgacacaggactccacagacattggcggcaagcgtcatctcgagtacgcatctacgattttgtgtaa

SEQ ID NO: 17199 - DNA, 522 bp, A.fumigatus
aaaacttacaacagtcatggtcggatgatgcttctttgtcgcgctctgcgacgcaaccacattcaaaaagctctgcaccaaccaatcagcctccctagatctctcgcgaagaacaacagtcaggacaaaacccaccacagccttaaaataagaccgaaaataaaacgtctttttgattcccattctctccccgtccaacacccacccgttctcaagcaagcgttccaatcccccctgaacctgttctgcatcctcaccctgcgagatctgcacctgcggcttctccggctcctgcccctgctccagctcctgttcctgcgccttctctggctcctgttcctgctcctgttcttgcgccttctcctgctcttgctcctgctccccagaagcaccagtagtagtcgagtaacccacacccgcacccgccatcacaggtgtaagcaaccccctcccctcacggagcgcaccgccgcggagcggagagaccgtcgtgcggggagaactccgcgcccgaacggatga

SEQ ID NO: 17200 - DNA, 198 bp, A.fumigatus
tacccccctctcataacagagtgtttactaactatatgtatgagtccctccgcattaaacctgtatcccaataccttgatttctactcattcgtccatccccccgttcaaccatggtcaagtccctccagtggattacgtcgacataaggcttactgcctacagatcgcttgaaagctttgatagaaaaaaaacatga

SEQ ID NO: 17201 - DNA, 702 bp, A.fumigatus
ccatattcagggaccctcgttaattctgcaaagtgtcttttacactctgatgaccccaggcctcatggcggcagtctgggaggctgtgcgacactggtatacatcactttcggcacacaaaattctaaagaattctgtactgacgataaacagggcctcctggcaagaacgccagatcctcgaccgcgacccctacgccttcacaaagcgcagcagtcgacgccgccaggaatccctccttcctatccttttctacgtcttcgccatagccagcttcttcctgaccatccgccgcagctggacaggcatcgagctgcagcgcagcccagaactcaccgcgctgcgcgcccagcctctcgccacagacctccgcttcaagatcgcaggcttcatgtccctggcgggcatgctagtcatctgctacagcctcgagcacagcatctaccggtaccgcgcagcgcccaccagccccatcgcccaagcaaccttctacctcagcgccagcccgccggaatttctcctcgccctcatcctcctcggtctcaaaaccggctacgccatcgccgccgccttcgactggtccgtttccccgctgcgcgtggcagtcagccagggcttgctctacggcctcggcgtcgctcccgccctgcttatcatcgtgctcttcaacgcagtcggcttctgcgagctcaacgaggataa

SEQ ID NO: 17202 - DNA, 1536 bp, A.fumigatus
gagagaaaggaggcccatccgagcatcatgactatccttcacattcgagcagcgactccatatgagccgggagacaacgcgacggacgtaatcgtcaacgaagtccatctgaaccggacaacgttggacttgtacaattacacgctatacagcaacggcacgctctccaatggcacagactgctatctggcgttccaagagtttcagcctcgcatggatgagaacggcacctttgtcaatggtatctcctgctacgcgcccatccacggcataggccgacatgcttcgatcgggatggccttcaccgcgttctttgcagtctccatgttcctcaccatgttcaatctgcaaaaacacggacgcaagtatctacctggtcgcacgatgggccgtcgactcaagtggctgtggctattgtttgtcgctgcttgcggactggtcagctgcatcatgaccgtggacgtagaccgtagccatattcagggaccctcgttaattctgcaaagtgtcttttacactctgatgaccccaggcctcatggcggcagtctgggaggctgtgcgacactggtatacatcactttcggcacacaaaattctaaagaattctgtactgacgataaacagggcctcctggcaagaacgccagatcctcgaccgcgacccctacgccttcacaaagcgcagcagtcgacgccgccaggaatccctccttcctatccttttctacgtcttcgccatagccagcttcttcctgaccatccgccgcagctggacaggcatcgagctgcagcgcagcccagaactcaccgcgctgcgcgcccagcctctcgccacagacctccgcttcaagatcgcaggcttcatgtccctggcgggcatgctagtcatctgctacagcctcgagcacagcatctaccggtaccgcgcagcgcccaccagccccatcgcccaagcaaccttctacctcagcgccagcccgccggaatttctcctcgccctcatcctcctcggtctcaaaaccggctacgccatcgccgccgccttcgactggtccgtttccccgctgcgcgtggcagtcagccagggcttgctctacggcctcggcgtcgctcccgccctgcttatcatcgtgctcttcaacgcagtcggcttctgcgagctcaacgaggataaggccctcatcgtccagcgcggggagctcgactccgcgctcgccaccgatgccgatctcctcggtcgcaagcgctggtgggaatcgcgctggctgcatggcggcgatcgcaaccgcaaccgcgaccgtgaccgcgatcgctcctcgtctcgtgagcagctggatcgctacgtcgagatggggattctcgctccgcatgggaagggcgacggcgaggacaaagatggctctgcgggggcggcaggagccgaagcagcgccgagagtcacgacgcggacggcgagtgacgcctctagctcgtcggaaagtggtttcgtgactgttactgtcgcttcgccgggacaacagcgggcggatcgatga

SEQ ID NO: 17203 - DNA, 213 bp, A.fumigatus
cgcgggaaatctcttccaatcacatacagtaatggcccttacgaagtattgttgggttatgacaatcctattgcaaacttgtgctacaaagtacactttgctcgttccaaaatggctcgcaagttcacaatcaaaatagcccagttaatttacaagtgccgaggaggcgtcgaccttgcgcaaagccatcgtcattgtcatcgtccatgctga

SEQ ID NO: 17204 - DNA, 237 bp, A.fumigatus
  unsure (57),(76),(151): Identity of nucleotide sequences at the above locations are unknown.
tctcatgcaccccatcatctctttgcggggttggcctcaccgagatcttccggtctngcatttggtcaattcgtanttttgatgggtttcaaattgaagatcgcttcccaaaagcctcttggttctgacaaacgcactgcgctgttctgtnaaaagagccagaaagcttctcggattgctcaatgcagaagggctggtgcctcatccttccattcaggcgcatgcgttccatggtga

SEQ ID NO: 17205 - DNA, 606 bp, A.fumigatus
tcatctgctacagcctcgagcacagcatctaccggtaccgcgcagcgcccaccagccccatcgcccaagcaaccttctacctcagcgccagcccgccggaatttctcctcgccctcatcctcctcggtctcaaaaccggctacgccatcgccgccgccttcgactggtccgtttccccgctgcgcgtggcagtcagccagggcttgctctacggcctcggcgtcgctcccgccctgcttatcatcgtgctcttcaacgcagtcggcttctgcgagctcaacgaggataaggccctcatcgtccagcgcggggagctcgactccgcgctcgccaccgatgccgatctcctcggtcgcaagcgctggtgggaatcgcgctggctgcatggcggcgatcgcaaccgcaaccgcgaccgtgaccgcgatcgctcctcgtctcgtgagcagctggatcgctacgtcgagatggggattctcgctccgcatgggaagggcgacggcgaggacaaagatggctctgcgggggcggcaggagccgaagcagcgccgagagtcacgacgcggacggcgagtgacgcctctagctcgtcggaaagtggtttcgtga

SEQ ID NO: 17206 - DNA, 228 bp, A.fumigatus
atatggctacggtctacgtccacggtcatgatgcagctgaccagtccgcaagcagcgacaaacaatagccacagccacttgagtcgacggcccatcgtgcgaccaggtagatacttgcgtccgtgtttttgcagattgaacatggtgaggaacatggagactgcaaagaacgcggtgaaggccatcccgatcgaagcatgtcggcctatgccgtggatgggcgcgtag

SEQ ID NO: 17207 - DNA, 222 bp, A.fumigatus
  unsure (83): Identity of nucleotide sequences at the above locations are unknown.
gggccattactgtatgtgattggaagagatttcccgcgctatggtaaatctcgggcttgcctgaacggggtattccgctcacntgacacaaccatttctagctcgtacaagctggggacacactgggagtctgtcactctttgtacatcaagagagggaaacatggagcacttcatacggtatcgattctttgtatctggcacactaggaacagatatctaa

SEQ ID NO: 17208 - DNA, 561 bp, A.fumigatus
attatcggcgcccccgccttcttcccaaccgtctggggctggatcaagcgctggttcgatccagtcacgacctccaagatcttcatcttatccgccgcagaggtaaaacccaccctcacctccttcatggacccctccagcatccccaagcaatatggcggcgaactcgactggcagtggggtgatatgccgaacctcgacgagcccgcacgcgaactggtcggcgcgctggagatccctcctgccgaaggcgagaccaagccttctttcaccaaggggcccgtcctgttcaagggcgaccacgtcgaaatcctcggcaaggtcaacggcaagagcagacaaaggactgttcctgtgcctatgcctgccaagcaagaagagaacacgaacacaccggatgtagaactggaggccaagatggctgctacgagcctagcgccagccgcatcttcaacagagcaatctgaggttcagtcggagaatgaaaacgaaaaggtggcgttggacaacgttgccgcggagaaggttgctaacccgactgctcagacggtatctgcttag

SEQ ID NO: 17209 - DNA, 1266 bp, A.fumigatus
agaaaagaggtgcatgagatcaaggtcaagggcagcgatgtacgtcatcccgcaatgcactgtgatctattttcaatggatgctgacggccagcaggttataccatcggtacaatatgcagacattgtgtccggcagagtctcggatagagccactggtgagatattgcaccgcggatctgtcgtgatccgaaatgtgatccctcgaaaagaagctcgaggttggaaaaacagggttgaagagtatgtcgctgcgaataaggagcgagtcaaggcctttccgcctgattcacccgctgtcttcgaactgtactggactccctcgcaggccgaggcacgagcacatccgaacatgctcgaaactcagcgtttcttgcagcgtctctggcattcatctgacccggcgactcggatatctaccagatatcctctgacatatgcggaccgcctccgtatcaggcagccgggagatggtaaattctcgcttggtccccatgtggatgggggttcactcgagcgttgggaggatcccgagtattcgcgggtctacaccaagatcttggagggcaaatgggaagaatacgacccttgggatgcgaagcaccgagtttccgctaagatggatttgtacaatggagcgggagcatgctctatgctgagattcttccagggctggctttcgatgtccaacactggccctggagaaggttcgttgcatgtttgccctatgctcattcagagcactgcctataccattctgcgtccatttttcgatgcgaagacattgcagcccaacctggacgccacgtttccaggttccgtgccaggtgcttgccaagaatacaatccagttacccatcctcaccttgaactagacaccaccatggtttcggttccagaggtcgaaccgggagattatgtcgcttggcactgcgactcgttgcattccgtggacaaggaacataaggggaatggtgactccagcgtcctctatatccctgccactccaatgtgcgagatgaatgtggattatctcctcaagcagcggaacgcggctctcgcctattcaccaccttgggattttcccggcgccggaggtccgggtgaggcaggttttaagggtgcattggactggtcttctgtcaactctgatggcctgcgagccatgggtatgggcgcaaagccttgggaagtcactggtgacatgaccgagggagagaaggaagttgttgaagcagcgaacaaggcctgttttggccaagcttaa

SEQ ID NO: 17210 - DNA, 582 bp, A.fumigatus
ccgtttggagctgaggttatgaaaatgtggctacgggtggcactcttgctgctcacatcatgcgttccctcaacggtggccatttatcctgatgaggtcaatcatatcgatttccaccatgcgctcctgggcactccctcatcacactcgactttcttcctcaagccttcctcctcctctaatgcctcgctgctctatactctctcacagaaactgcttcttggtgcagtgaacccgagagatggctcactggtttggagacagaacgtttcccgatcattgctctcgaaggacgatggccaggttcagtcgttcctgcgtgcctcggacggatcgaatgcgatggtcagcgcagtgggcgattatatctcttcatggagtgctttggacggaaaattgatctgggagaattggttcgccggtgagcccgtgatcgacctcgagctgttggagctcgaagatgccggcgcgacttcatcggctcgagatgcgatcgcactgtacggtcacaaggcaggtgttctccggagactggattctgaatctggggatgtgaagtgggagtttaaggatgataggtaa

SEQ ID NO: 17211 - DNA, 2460 bp, A.fumigatus
  unsure (79),(80): Identity of nucleotide sequences at the above locations are unknown.
tgcctttctttggcccaattcagtggtgacattcccttccatatatcatctcgcgcaaccgaggtcttgtacatctctnnacagtcgggcctgctcaggggctacagaataaaatcgatttcagtggatcctctgaccggccgacagactcggcagcacatcttgaacacggagagtgacgtgtttggaccggagtcgattctcttcgtcggcgccaacaccgcttctccagtcatcatttggacggacaaggcacagaaagctctgaaaatcaaccagattggcctgaagcaagtgaatacactccacattgataatacgagcggcgaggaaattaggtcgattgaagtccataccccgaagaagcttaactctttgccgcatttccttgtccactatgaaacggactccagctcctgggcggaagtgtatcacatcgatctgacctcggcgaccgtttccaaagcatatagtctgcctcgtgtgcaagagagatcagccttcgcgacgagtaacattgatgccaatgtctactttacccgcatcacccagtcggaggctgtgattgtctcatctgcctctcatggagtcctgggcagatggccgctgcaggcgcctacgactgagcacgcccagcatgctgtatcagaagtagtcgctaagggggacgccgtcgctgttcggtccgcaacagtcttgtcgtcgggtgactggcaactcattcggaacggccaaactgaatggacgaggtacgaggcattgaatggagcggttgccgcttcctgggctgaggaagaataccaggaagatctcgctcatgaattggaagttgaggggcatgagagcttatacaaggcctatatccatcgcgttaagcgccacgccagagacctgcaacatcttccagagtggctgaaggaactacctaagcgtattctgactagtattctcagcgacgaaatttcgagccttgatggctttggactcagcaaaactgtcgttgtagctactgagaatggacgagtgtatggcatcgacaccggaaatcacggcgttgtctcttggagcgtcaaggctgctgaatcagacagctggaacgtgaaggccatcctcactcaacctgggtacgccactgtgtacgtcgacgatggtagctcagtgagcctgaacacgacatctggcgctgtcatcaagcgtacgcccgcttcaggcaagatcgcttctatcgccgtcatcaatggtccttcaaaccctatcaccatcggcgtcaaggaggatggtgtgccagtagagcctttggaaaaacctggctttttcgtgactctcagtgccgatggccgtgtcctgggatggagtgccgctgacaacaaaacgcctgtctgggaattcctgcctgctcagggacagaagatcatacgcgctattgcacgccccgcgcacgaccccgttgcgtctatcggcaaagttctgggcgacaggtctgttctttacaagtacttgaacccgaacctggctctgatcacggctgcgggtgaagacaacacagccacattctacttactggacgccatttccgggagaatccttcacagcagcactcagaaaggcgttgataccagtcaacctattgcttctaccatctccgagaaatggttcgtttactccttctatggcgatccactaaccccgtcagacgccaagggttatcagctggtggtttcagagctctacgagtcgccccttcccaacgaccgtggcccgttgggctctgcatcgaactactctagcatccacggtagtaacatcctcccactgcctcatgtgatttcccaagccttcatcatccccgaacccatctcgcacatggccgtcacgcaaacccgacaaggcatcacaacccgccaacttctctgcacgctcccagcttcgaactcgatcgttggcatcccccgcccggtgctagacccccggcggcctgttgaacgggacccaacctccaccgaggccgaggagggtctgttcaagtacaaccccgtcctcgagttcgacgggaagtggtacctctcacacaaccgcgatgtcgcaggcatcaaggccgtcctctctagcccaactttgctcgagagtacaagcttgatcttcgcgtttggaggggacgtctttggcacgcgggccactcccagccaggcattcgatgtcctcggcaagggattctcgaagttgcagctcatcatgacagttttggctttgagcgtaggtgtgattatcttggcgccaatggtacgtttccctgaccttccgcccacacttacccccgcgtgtacgccacatgaccttcaaaatactgaccaatctacaggtgcggaggaagcagaccaatctgctgtggaaggcagcctagaaaaagatagagaaacaggctcaatctatacaacttctcttcatgattgtgtttattga

SEQ ID NO: 17212 - DNA, 480 bp, A.fumigatus
gtacgatcccttatccgcacgtctctcacatatacgatgttcaggtccacgatctttcgacaggccgcgaaagccttcagtcagagatctcatcctgctccattcgctgctcctctccggtgttccgcctctaacaccttcttccgtcccctctcgtacacaattcctcgctcaacaggcggaaagaaagaccccgaagaatccgaggtagaagggcgattcgcgcgtactgatgagagcgttgtaattgaataccccaatgacgcggacatgccccgtactccgatcgtccagggccgtggaggaatgcacttcaagcgtacccttgcccaattctccctaaaaaacaaggtcagcttggtgacaggaggagcccgtggtcttggtctggtcatgtctcaggcgcttgttgcgtccggctctgatttggccattgtggatttaaaccgtatgtttcaggcgattaattgcaacagttga

SEQ ID NO: 17213 - DNA, 606 bp, A.fumigatus
attccagaaatgacagctaatgcgtcacaggagaggaagctgaagaccaggctcagaagctcgtcgaacagtttaagaaggaaaatccgggcttggaacagtaagtcgattggcgggttccaggcatttttgtcagtagcagacgctaacgttcttttcacttttcttttttctagaatgcccaacgttacagctcactacgccgacgtggcaaaccccgactctgtaaatacagcaattgcggaagttatctcgaagcacggccgcatcgatcacctcgtcacttccgctggttttaccgaaaacttcgatgccatctcctacccttatgaccgcatgcaaaagctctggggtgtcaacgttgatggaacatacttgttcgcggttggtgttgcgaagcatctcatggaacgcaaggctccgggcagcatggttctgattggaagcatgtccggcgccattgtcaatgttcctcagccccaggctccttacaatgcggccaaggctgctgtgcgtcacctggccgcttctcttgccgtggagtgggcccctcatggcattcgggttaactgcatcagtcctggatacatgctgacagctctgtaa

SEQ ID NO: 17214 - DNA, 237 bp, A.fumigatus
accgccctcttccacttggtagttttcttgagcgacaggctgacgtcaatctctaggacccgcaaaattctcgatgaaaggccggatctgagggacaagtggacctcccttattcctgttggaaagatgggtactccggaagacctgatgggcgccgtgaccttcctcctcagtgacgcatccaagtacattactggtgcggatctccgcgtcgacggtggatacactctgacctaa

SEQ ID NO: 17215 - DNA, 270 bp, A.fumigatus
  unsure (217): Identity of nucleotide sequences at the above locations are unknown.
gccttggcatcaggcgaacccatgcggcctttgaagtttcggttactggccgagattccaacttcgccctccttgagaagaccggcgcccagaccaatacagacggcgcaccccgctggcagggggatagcgccggcgtccatcagggcttgccagtcacccgccttctctgcaatcttctgttcggcctttggaagccgccgcaacgtagaactcnacgccgtccgcgaccctcacaggcccaccccctccgggcaacggcgtccttaa

SEQ ID NO: 17216 - DNA, 288 bp, A.fumigatus
agttctacgttgcggcggcttccaaaggccgaacagaagattgcagagaaggcgggtgactggcaagccctgatggacgccggcgctatccccctgccagcggggtgcgccgtctgtattggtctgggcgccggtcttctcaaggagggcgaagttggaatctcggccagtaaccgaaacttcaaaggccgcatgggttcgcctgatgccaaggcctaccttgccagtcctgaagtggttgcggccagtgcacgtatgccactctctatcggtgtaccttacctgtaa

SEQ ID NO: 17217 - DNA, 612 bp, A.fumigatus
gaatcggctaactcttggctagtgaacggtgttattagcgggcctggcatctacaagcgccccgaagactggaccggcgtttccatcggcgaaggtgaagttgtcgagtccggctctcgcatcgacaccactttggaagcaatggagaagttcattggacaactggatagcatgatcgactcgtcgagcaaggccgtgatgccggaagagtcgactggctccggagccactgaagtcgacatcgttcccggcttccctgagaagattgagggtgaaatactcttccttgatgctgacaacatcagcactgatggcatctaccctggtaaaccttctcagacaggcaatacactgcttgcgctaacgaacgtcacaggcaaatacacataccaggacgacgtcaccaaggacaagatggcacaggtctgcatggagaactacgaccctgccttcagcggcattgcccgcgcaggaggtttgtcaccttcccttttctcgtcatttctttcgatccgcaagagtctaacacacataaacagacatcttcgtctccggcttcaacttcggctgtggctcgtcccgcgagcaagccgccacctccatcctcgctaa

SEQ ID NO: 17218 - DNA, 1368 bp, A.fumigatus
  unsure (1294): Identity of nucleotide sequences at the above locations are unknown.
cttctcaagaaacgcaccggatctttgctgcttcggtgcagagcatcgcgagtccccgttatcggtcgacctttgatctcattatcaacctcctccacctccctgtctctatctcgtcctcgatcctttgccactacatcccttcgccgttacgcggaggcatcatcctccacgacacaaacttctccttcgtcctcgagttggcccgctcccgatgccgccccccgcgtcccccagaccctgaccgagaagatcgtccaagcatattctctgggcctcgccgaaggccaatacgtaaaggctggagactatgtcatgcttagccctcaccgctgcatgacccacgacaactcatggcccaccgcgctcaagttcatggcaattggcgcatccaaggtccacaaccccgaccagattgtgatgaccctagaccacgatgtccagaacaagagcgagaagaacctaaagaaatacgaatcgattgagaagtttgccaatcaacatggcatcgacttctatccagccggtcacggcgtcggccatcagatcatgattgaggagggatatgccttccccggcaccgtcactgtggcgagtgacagtcactccaacatgtacggtggagttggttgtcttggtactcccatggttcgtaccgatgccgcgaccatctgggctaccggccgtacctggtggaaggtcccccctatcgcaaaggtgcagttcactggcaccctccccgagggtgtcactggaaaggacgtcattgtcgctttgtcaggtctcttcaacaaagacgaggttctcaactacgccattgagtttactggctcggaggagaccatgaagagtctctctgtcgacacccgtctgaccatcgccaacatgaccaccgaatggggtgcgctgaccggactgttccccattgactcgaccctggagcaatggctgagacacaaggccgctaccgcatcacggacagagacagcgcgccgattcgccgaggagcgtatcaacgagttgttcgccaaccccaccgtcgctgatcgtggcgccaggtacgccaaatacctctacctggatctgtcgaccctgtcgccctacgtttccggaccgaactccgtcaaggtcgccaccccccttgatgaactggaaaagcacaagctgaagatcgacaaagcctacttggtgtcctgcactaactcgcgagcgtcggatattgccgccgcggctaaggtgtttaaggacgccgttgcccggagggggtgggcctgtgagggtcgcggacggcgtngagttctacgttgcggcggcttccaaaggccgaacagaagattgcagagaaggcgggtgactggcaagccctga

SEQ ID NO: 17219 - DNA, 393 bp, A.fumigatus
acagacatcttcgtctccggcttcaacttcggctgtggctcgtcccgcgagcaagccgccacctccatcctcgctaagcagctccctctcgtcgtcgccggcagcatcggcaacaccttcagccgcaatgccgtcaacaacgccctccctctcctcgagatgcctcgcctcatcgagcgcctgcgcgaagcctttggcagcgaaaagcaaccaactcgtcgcacgggctggaccttcacctggaacgtgcgcacttcccaggtcactgtccaggaaggcccgggcggtgaaacctggagccagagcgtacctgctttccctcccaacctgcaagacattattgcccagggtggattggagaagtgggtgaagaaggagattagcaaggcttga

SEQ ID NO: 17220 - DNA, 576 bp, A.fumigatus
accttctcagacaggcaatacactgcttgcgctaacgaacgtcacaggcaaatacacataccaggacgacgtcaccaaggacaagatggcacaggtctgcatggagaactacgaccctgccttcagcggcattgcccgcgcaggaggtttgtcaccttcccttttctcgtcatttctttcgatccgcaagagtctaacacacataaacagacatcttcgtctccggcttcaacttcggctgtggctcgtcccgcgagcaagccgccacctccatcctcgctaagcagctccctctcgtcgtcgccggcagcatcggcaacaccttcagccgcaatgccgtcaacaacgccctccctctcctcgagatgcctcgcctcatcgagcgcctgcgcgaagcctttggcagcgaaaagcaaccaactcgtcgcacgggctggaccttcacctggaacgtgcgcacttcccaggtcactgtccaggaaggcccgggcggtgaaacctggagccagagcgtacctgctttccctcccaacctgcaagacattattgcccagggtggattggagaagtgggtga

SEQ ID NO: 17221 - DNA, 1104 bp, A.fumigatus
tatttattctatcaaagcgcgttccacccccaactggaccaagttctgactgatgttcaaatagcttcttactggcttactaccaccgtcatcatggacttggtcggcacgccgagcgacaataacggtaacaaggctttcccgttcggcaagactgcaactcccattatcaataccatagtgaaatatgtctacttgggattcctactattgcaattcatcctcgcgctgggtaaccgtccaaaaggatcgaagttctcatacctcgcgtctttcgtggttttcggcatcattcaggtctacgtggttattgatgcactgtacctggtggtgcgtgccttcagtggaagtgctcctatggatttcactacggaccaaggcgttggcgagtttctgaaatcgttcttttcatccagcggcgccggtatcattatcattgctctcgctgctacattcggtctctactttgtggcatcttttatgtatcttgacccctggcacatgttcacgtccttccctgcctacatgtgtgtccaatcgtcatacatcaatattctgaacgtctacgctttcagcaattggcacgacgtctcgtggggtaccaagggttcagacaaggcagacgctctaccttccgccaagaccaccaaggatgagggcaaagaggttgtcatcgaggaaatcgacaagcctcaggctgatatcgacagtcagttcgaggcaacggtcaagcgtgccctaacaccctatgtgccaccagtcgagaaggaggaaaagactctggaagactcgtacaaaagcttccgaacgagactggtcacgttttggatctttagcaacgccttcttggccgtttgcatcaccagtgacggtgtggataaattcggcttcacggtatgtagacgtcggcagtccttgttagtagactgcgaaactaacatattgcagaattctgctaccgaccggacgcagcgtttcttacaggctttgctgtggtccaacgctgtcgttgccctgttccgtttcatcggagcctgctggttcctgggcaagacaggtttgatgtgctgctatgcccggccgttagaggggcgttcttcgtaa

SEQ ID NO: 17222 - DNA, 231 bp, A.fumigatus
  unsure (25),(26),(27),(55): Identity of nucleotide sequences at the above locations are unknown.
ggctttcggggggtgaacgatcttnnngacgctcgtcttcatccagccggtgtanaaaggccgcccggtgggttgcggcgttatgctacaagaaaggtcaagttggtgcagggttccgtcctgagtgtcgattatcctgttccgagcgcgatccagaatgctattcaggccaagtacagaaatgatctcgagggtggaagtgaggaatttacgcacatgcgatgtgagtga

SEQ ID NO: 17223 - DNA, 345 bp, A.fumigatus
cagatagcatgggaactagatctgcaggagttgactcttggaagcacgatgaagatgaattttccgaatcctgacgatatcctgaactttacgcttacgatcgagcccgacgagggcatgtacaagggtggcgcgttccattttaatttcagtgttaaccagaacttcccgcatgacccgcctaaagtgaagtgcacacagaagatttaccatccgaatattgatctagaagggaatgtgtgtctgaacatcttgcgggaggattggaagcctgtcctgaacttgaatgcggttattgtgggcatgcaggtgggtttgagagatggtcgatgtcgctgtgtgtag

SEQ ID NO: 17224 - DNA, 588 bp, A.fumigatus
gtgtcgattatcctgttccgagcgcgatccagaatgctattcaggccaagtacagaaatgatctcgagggtggaagtgaggaatttacgcacatgcgatgtgagtgatctcagacgctgcacctggcctttctatttcgtccacattgctgacaacccctcgtacaaatctcaagacaccgcggccacctgtgatcccaatgaatttacactgcacaatggttacaatcttcgacctgcgatgtacaacagacataccgaacttctcattgcgatcacctattataacgaagacaagacactcacttcacgtacactgcacggtgtcatgcagaacattcgcgacattgtgaatctgaaaaagtccgagttctggaacaagggtggtcctgcctggcagaagattgtggtctgcctggtttttgatggtatcgacccttgcgacaaggacactttggatgttcttgcgacaatcggtgtctaccaagacggcgtcatgaagcgtgacgtcgatggaaaagagactgtggctcacattgtatgtgcactccgaccagttgggatcactggacgtactaattggtcatag

SEQ ID NO: 17225 - DNA, 909 bp, A.fumigatus
tttgaatatacgactcaactgtctgtgactccgaatcagcagctgatccgccccaccgacgacggtcccagtacacttcctccggtccagatgatgttctgtttgaagcagaagaacagcaagaagatcaactcccacagatggctcttcaatgcatttggtcgcattctcaaccccgaggtctgtattcttcttgacgccggtacaaagcctggcccgaagtcacttctgtcgctttgggaagccttctataacgataaagatttgggtggtgcttgcggtgagattcacgccatgttgggtaagggttggaagaacctgatcaacccgctcgttgccgctcagaacttcgaatataagattagtaacatcctggacaagcccttggagagttcatttggttatgtcagcgtcttgcctggtgccttctcagcttaccgattccgcgcaattatgggccgccctctcgagcagtatttccatggtgaccacactctttcaaagcaactgggcaagaagggtatcgagggaatgaacattttcaagaagaacatgttcttggccgaagatcgtattctttgttttgagttggttgctaaagctggttcaaaatggcacctgacctatgtcaaggcctccaaggctgaaaccgacgtgccagaaggcgctcccgaattcatttcgcagcgtcgtcgttggctgaacggttcgtttgctgccggtatttattcgctcatgcactttggtcggatgtacaagagtggacacaacattgtccgcatgttttttctgcacatccaaatgttgtacaatatcttctctacggttctgacatggttttccttgggtaagttaatatttattctatcaaagcgcgttccacccccaactggaccaagttctgactga

SEQ ID NO: 17226 - DNA, 216 bp, A.fumigatus
cgaccagcaattatggtcgatcaagagtcgaatcctgccatggatgagctggagcagggtagtcctatgtccggggttgaaaatggtaagcgggagcaggtggaggacgttgaggagatggatgtcaaatcgaaggctctgatgcaccttctgaatacaagcgaggtatgttttcccctatcttatgttatcctttacttcataatgaaacactga

SEQ ID NO: 17227 - DNA, 870 bp, A.fumigatus
gtcttcgtggcgattatggcagataagatgaagaagcagcaggaagaggccaggcttgaagcggcgaagcagcagcagcagcgacagcaaaagctgacagaagatcaaaagaagccaactgctacacgctcagttgcgaggcgagagacgcgcgcgagggcgaagcagccgtctgcagatgagacaacacctgctgtgagcgagcaagcagatgaaaagacagccacgagctcgagaagaggcagaggcaagaagggtgcttccgccatgaacggtaacagcattgcaagctatttcaagaaagtggatatggaggaccctgaagacaaaccgacggtgcaggaagccctggaacatgctgcggacgagtatgaggccaatcccagtgctcttggtgggcaggaccttgtcgccacccagcaaccggagcttgttactggaggaagaatgcgcaagtaccaattggaaggactggagtggctcaagtcgctttggatgaatggcttgtgtggaattctggccgacgagatgggtcttgggaaaacagtccaggcaatctcattgattgcttttttcaaggagaagaacgtttccgggccttttttgattgcggctccgttgagcacagttagcaactgggtagatgagttcgcgaaatggactccgagcatcaagacggtcttgtaccatggctccaaagacgaacgtgccacgatccgcaggaacttgatgaagctaaaggaccagaggagtgcagattttccggttgtttgcacatcctatgagatctgtatgaacgatcgaaagtttctcgcgcaataccaatggcgttatatcattgttgtaagttctgctctaccatccacatga

SEQ ID NO: 17228 - DNA, 819 bp, A.fumigatus
aaggggtgtgcatctctaacccgaggtcaggacgaaggtcatcgcctgaagaatatgaactgcaagctcattaaggagcttctctcgtacaactctgcaaaccgactgctgatcacgggtacaccactacagaacaacattaccgagctgtggtcactgttgcactttctgctgccagagattttcaatgacctcaacagtttccaaagctggtttgacttttcctcaatgctcgatagcagtgggcaaacggacgtcatagagcgtcggaaacgcacactcgtctccaccatgcattcaatcctgaagcctttccttctgcggcgggttaagtctgacgtggagactgccttaccaaagaaacgcgaatacattctctatgcccctctcacagcggagcagaaggatttgtatcgtgagattcttaatggcacgggccgtcaatatctcgaggataaagccgcggaacgcctcttggccaagaatgagagattgtctcgttcggcaagcctaaaacgcagtgccgagagtagtaacgcgtcgacccccaataagagcctcaaatccagcagggattcaactccagccagtgtggctagttcaacccgcaggcgtagggcccctcaaaactacaaagaattgagtgaccgagaatttaatgcgcaattacgccgccttgagcaaggcttggaagacgatttggacatacaacagagccctaccgatactgagcaagaggaaatcgaaagagcaaatactatcaagcttgcaagtacgtatatggctggctcgaacttagaggccactgactcgtgctaa

SEQ ID NO: 17229 - DNA, 879 bp, A.fumigatus
cgaacctacacagagaaagaaattgctcagaagaagttgcagaatccggtcatgcaagcccgtctcgcttgtaactccccgcataatttctactggccatggagcgacgacccggctgccatcgacgagactcttgtcactgcatcgggcaagatgctccttctcgaccgcctcgtgccttgtctcctgaagaaggggcacaagatcctcatattctcccagttcaaaacacagctcgacattcttcaagattgggccacccagcttcgcggctggaactgttgccgcattgacggcgccatcagccagacagaccgtcaagcccaaatcaaagccttcaactcagacccgggctacaagattttcctgctgagcacgcgagcaggaggccagggtattaaccttgtcgccgccgacacggtaatcctctacgactcagactggaacccccagcaagacctccaagcacaagaccgcgcgcaccgcattggccaaacaaaacccgtcatcgtctatagacttgcaaccaaaggaaccgtcgaacagactctcctcgagaaagcggactcgaagcgccgtctcgaacgactcgtcatccaaaagggcaagttcagaagtctcctggactcgagctcggtgaatcacagtgacgtagaagagctcaagaaggctctcggtgaagacgaattcgagcgcttcgagacgggcgctgaccccaccgcgctcctgtcgcaaaaggatctggaaatcttgaccgatcgcagcgaggaggcgtatgcgcgtgccgaaaagggtctggaacacactgggcgtgcgttcaaggctgtcgagacgaagaaagagggaaactccctcatggctcaaattactgggaagtag

SEQ ID NO: 17230 - DNA, 669 bp, A.fumigatus
tccacccttttgccttcccccgcaatcaacaaagacgccaccttgccttccctgcacatcgtcaactaccggcagaagggtttccgcatcccccgcactatccccgcctctctccgcgcttccttcgagaacaacaagatcgactaccaaatcgacaatgcccgccccgcacaaaggtggggtgcagacggagacacagagaccccaacagggcgcaaagccaagttcggcgacacatatctgagccgcttgggcgtgggtggcaagggctcctacacgcccaagggtacggacttcagcgacacaatccaggacgaagaatgggagaaggtgcgtctgcggcgcgagctctcagagctgcaggcaaagcttgaagccgccaataaggcctccgaaagccgcagggatcggccccggaatgacggccggcctaactggaccctcatcaaaaaggaggcgcttcagcttttggaatacaaagagcgtgagctccgggagttgcgagaaggcacgggaagagcgaaggcggggcaggatctggagcggttacgggaggacatcaggaccgttggggagcaagttgaggggttaaagagtcatctcgcgcagcggaaagaagtccttgctgatctaaggagtcagattgaggaggaaagggcacggcggtaa

SEQ ID NO: 17231 - DNA, 768 bp, A.fumigatus
aggtctacaacacccccgtccatggcttcagcatccagtccgaccacctcaccatcaaggacgtcctcctcgacaactccgccggtaccaagctcggccacaataccgatgcctttgacgtcggttccagcacctacatcactattgacggcgccaccgtctacaaccaggacgactgcctggccgtcaactccggtgagcacatcaccttcaccaacggctactgcaacggtggtcacggtctctccatcggctccgtcggcggccgcagtaacaatgtcgtcaacgacgtcaccatctccaactcccaggtcatcaactcccagaacggtgctcggatcaagaccgtctacggcgcgactggctctgtcaccggcgtcaagttccaggatatctccctcaaaggtatcaccaagtacggtattgttgtccagcaggactacgagaacggcaagcccactggcaagcccaccaacggcgtcaaggtctccgatatcaccttcgagaaggtcaccggtaccgtcaccagctccgccactgatatttacattctctgcggatctggcagctgcaccaactggacctggtctggcaatagcgtcaccggtggcaagaagagctccagttgcaagaacgttcctgctggcgcctcatgctagacttgcttctagaaactggccggcgggcgctgtcgagagtgttctgttcgtgtctccacttcttgattcctgtcttgtattcgaccacgaaggctggaagtaccgcgtc

SEQ ID NO: 17232 - DNA, 198 bp, A.fumigatus
acgaacgaacctggacacgccgctcacctacctcgggaacggaatcaggtacacagtctctgcggagacaagtctactccaatatccctcactcatggaaacgacaaggttggcgtactaaacccgcagtgggttgagcatggcagcgtcactcagtatgaacaaagcagccagtgtccaggcgccacaagtcactga

SEQ ID NO: 17233 - DNA, 207 bp, A.fumigatus
ggggagtatgaatatctaacggcacttgtgtctttccttatagctttcaagcgtagaacgcgtactatccgcagtgcctgtagctgggataagaaggagacacggaagctcgtaaccgcaaatgagcacatgctgaacatggacagtctatttctagtcttcatctacttcttgggcttatttactccgatctccaattgtatttaa

SEQ ID NO: 17234 - DNA, 1209 bp, A.fumigatus
ccagaaccctgtcccatctttctaaaccgagtcccgaccattgacttccgctcttccaccatgcatttcttccaatcctccctcgtggccgcgaccatgggcgctgcgctggtcgctgccgcacctgccgctgatctcgagactcgcggctcttgcactttcacctctacgtccgcgctcaagtccggcaaggcctcgtgctccaccatcactctccagaacatcgcggtgcccgcgggtgagaccctggacctgactggcctgaagaccggtaccactgtaagtcttacccttgaattgtctgaatgccatcggctgatgtgctgccaaaaggtcgtcttcgacggtaccaccaccttcggctacaaggaatgggagggccccctgatttccgcgtccggaaccagtattaccatcaagcagaaccctggtgctaagattgactgtgatggtgctcgttggtgggacggcaagggaggcaacggtggcaagaagaagcccaagttcttctctgcccacaagctgaacaagtcgaacatcaccggcctgaaggtctacaacacccccgtccatggcttcagcatccagtccgaccacctcaccatcaaggacgtcctcctcgacaactccgccggtaccaagctcggccacaataccgatgcctttgacgtcggttccagcacctacatcactattgacggcgccaccgtctacaaccaggacgactgcctggccgtcaactccggtgagcacatcaccttcaccaacggctactgcaacggtggtcacggtctctccatcggctccgtcggcggccgcagtaacaatgtcgtcaacgacgtcaccatctccaactcccaggtcatcaactcccagaacggtgctcggatcaagaccgtctacggcgcgactggctctgtcaccggcgtcaagttccaggatatctccctcaaaggtatcaccaagtacggtattgttgtccagcaggactacgagaacggcaagcccactggcaagcccaccaacggcgtcaaggtctccgatatcaccttcgagaaggtcaccggtaccgtcaccagctccgccactgatatttacattctctgcggatctggcagctgcaccaactggacctggtctggcaatagcgtcaccggtggcaagaagagctccagttgcaagaacgttcctgctggcgcctcatgctag

SEQ ID NO: 17235 - DNA, 267 bp, A.fumigatus
acatcttccgtgtgccatttctcacggagcgtcctcaacaacatcattggaggccctgatgaggtgtacatggctggtctggtctctgtatgtccatgctcaactgtatggcccttgatgacgagccagaccaactacatcacatcaactggcgcgtacgctcttatcgaccccagaactttggctgatagtaagtctagcctccagccgagaatgaaaacactaatagaaccagctatggcgagtttgcctatgagtattatctga

SEQ ID NO: 17236 - DNA, 270 bp, A.fumigatus
acggctcattcactgccttctacaggagttggctccaatgaatccggagcagagttcggaagtggcaccatccctggtgtcccgggcaaagattgcatctggctcaacacgaccgccattggcatcatgaaggaagcagggaccagggttgaacatcttccgtgtgccatttctcacggagcgtcctcaacaacatcattggaggccctgatgaggtgtacatggctggtctggtctctgtatgtccatgctcaactgtatggcccttga

SEQ ID NO: 17237 - DNA, 327 bp, A.fumigatus
  unsure (234): Identity of nucleotide sequences at the above locations are unknown.
cctccagccgagaatgaaaacactaatagaaccagctatggcgagtttgcctatgagtattatctgaaggtttttggagccatattttccaaggtagagttatacggcaacgtcgacggggagggagactgctacggcgactgctttgagtacgagctcgacaacaggggtaacagggacgtctactgcagttgcacagtactggggtcaatggggtcgttagggctgaatggngctgacgacctgtgtatcccgtacatttgccaggtacagaacgcctatgttcgcagtgtttgtatgtgttgctggaatggttcccaaggttga

SEQ ID NO: 17238 - DNA, 318 bp, A.fumigatus
cgtttgcgcagctgttacaatgccttctcgcatctcgatatgcgtgtcgaagtgaagataccagggagtctggagagctattgcatcgatgagcgaggcgataagcgtgttgctacggaggcgctgtggcttgaaaccttcctctgtggtgtactgagagcatattcttacgcggacgacggtagtggtgatgccatcagaaaaatcgtcggtgttcgacgattcaacccggtaaccaacacggagatggagcacaagtttctggatgctgcggagaggctattcttcctaggtgcgctgcattgcaaattttgctga

SEQ ID NO: 17239 - DNA, 225 bp, A.fumigatus
actggagtttaccatcatgtcaccggcgttgatgcctcatcctccgccagcctggccgcctacgtaaacacacttaccttttctcctctggataagacacacaaggtggtttctggaatctactggtcagaaactcaaatgaacgaacgcaatgattctgttatggttaacgtttgcgcagctgttacaatgccttctcgcatctcgatatgcgtgtcgaagtga

SEQ ID NO: 17240 - DNA, 1023 bp, A.fumigatus
caagaacttatagggaggcagctcagctccgatccagaaactcaagtacccagtaccgtcagcaaccatctcacagcaggtcttctcaagtacatccagacaaccggccgctatacctccggagtgaatttgttcgagaaacttcgcacacgagatgtagaggtttcgtcgctgttggcaagggttctgttaatggcagatgaagaagtacaggctgtacggttgatgtatgatgctttacaagacgtgccgatggactatgcactactcgattgccaagcagcgttctgcatgagcaagggagaaggtgaattggccctggaatgcgcgaaacgtgctgtaaccgccgcaccgagcgaattcagcacatgggctcggctggccgaggtatacgtatcgctcgagcaatgggacttggcgctcctaaccctgaactcgtgtcccatgttcacataccaggacaaggacacgcctagaatgccgcagccgtcacgcattatgcttcctattcttgcagagagcatattggatgaaatcgacgagggacaacctaaacagggagaccctcacgactatatccatccgtcgctgagaaaactgcacgctgcatcataccaaggcacattcttaaaggcctacaatctactgacaaagattgctgcatcgatcggctgggaccagctactcaagattcgcagcgaggtcttcgtgatggaagaggagtaccgagttgagcgccagcactccacatcgaaacctggtaaatctgactctgtcgctgagatccagggtgttgagaccaatggtaacggtgagaatggagacgggtctggagctgaggatgcagatcaatcggccgagactgcagccagcaacaatggagtgaacgaaacgcaagtagaaagttctattgagaaaccagagcaatcgatggcatcagaagtcgtcaagtcaagcaacgatgatgtgagtttatctacctctcctttacttcttcccaggatgctgatgatgaatttctag

SEQ ID NO: 17241 - DNA, 339 bp, A.fumigatus
gccgacccgtcgcactcttcgtacacacaattcaagaacaagcgtttgtgtgagcgctggctagataacctcttcatggtcctatacgaagaccttcgcatctacaccatctggcgcacggagatggctcaattccggcagcaagcgattgagtacaagaagtcggcgactgaatgggagatcctgggcgaacttgcggagcgtctgcatcacttcgacgaagcaatcgaagcctatcaacactgcctgtctattcggttctcgcccaaggccatgcgcgggatcctgaagatgtatgacaaccggaatgacacgcgaggcattcctaggctggcctga

SEQ ID NO: 17242 - DNA, 315 bp, A.fumigatus
cctctccgcagcatccagaaacttgtgctccatctccgtgttggttaccgggttgaatcgtcgaacaccgacgatttttctgatggcatcaccactaccgtcgtccgcgtaagaatatgctctcagtacaccacagaggaaggtttcaagccacagcgcctccgtagcaacacgcttatcgcctcgctcatcgatgcaatagctctccagactccctggtatcttcacttcgacacgcatatcgagatgcgagaaggcattgtaacagctgcgcaaacgttaaccataacagaatcattgcgttcgttcatttga

SEQ ID NO: 17243 - DNA, 429 bp, A.fumigatus
gatggtgtccatcatagccaatttatcgcaggtgtcagggacctttttgcgggccgcgtagacgccgtcatgtcgagctgggtggcgttaaatatcgagcctgacgaggcaattgaagaagaggttgatgatacgaaggagatacagattgaagaagctttgaagctctatcaaaacgccctcaagctacattctcagggtccacagttctatgcccaagctgcggaggcctacgaagctctccttagttcggacatcttcaaatatcccgaatcgatttccgacttcaaaagatctgctctgcaagactccgaggcacatcttgatgatgatgtcgcagtcatcgacgcagtagagacattccctgaattcagtgtcaatgattccacgtctagcactctgttacagacgagttctttgtcctataag

SEQ ID NO: 17244 - DNA, 795 bp, A.fumigatus
acggtgagtttgtccgtcaccgacagagaaccatttctgaccgatatagcgatcggtgttttccaggactattatcaacataatcaattgcgcgagtactccgcatccagcatctcctggatcctgtctctcgagccatttgttctcttcgccgcaggcatcgtcctcggccgggttttcgacaactacggccccaaatggatgctcctcatcggcacattcctgcacgtctttggcctcatgatgatctccgtctcgagcgagtactaccagttcctccttgcgcaggggatctgcagtcccctaggcgctagcttcgtcttctatccggcttccgcctgcacagcgacctggttcgacaagcgccgcgcgctcgcattcgggattatgtcgagcgggtcgtcgatcggcggcgttgtcttccccgcgatgttatcgcggctgctgcctcgtgttggattcggatggtcgctgcgcatctcggcgtttgtggtgctggcgttgctggctgtggcgaatatgactgttcgctcgcgcatcgcgcctgtgccgaggagggtgcagttcagcgattatatcgggccgttctcggaggtgccgtttgtgttgttgatgctggcgtcttgctgtggcttctgggcgatgtttgtgccgatcaattatgtgatactggaggcgcaggaggatggggttcgtcgcagtctggcggagtatctattgaccattctaaatgctgcaaggttagtgtgtcccagtctccagctgcgcggattgacgtgtatgctgatgagctag

SEQ ID NO: 17245 - DNA, 453 bp, A.fumigatus
gctagtcttcctggtcgcatccttcccggttacttgggagataaactcggccggttcaacgtgatgatcgccatgtgtaccctttctgctctgacgattctcgtcctctggatccctggaacgctgctggccccgggatctgcggccgtttatgtcatcttcagcttgttgtatgggttcgcgtccggagcgtttgtcggcatggttccagcactgctcagccagatcacggcggatatgagcaaaacgggtgtgcgacagggagtattgtatacctgcatgagcattgcaacgttgaccggaagcccaattgcgggggcaattctgaatcgacagcaggagacttattgggggctacaagtctttgctggggcaatgatggtggggagtgtggtgttctttgttgctgcgagagtggttttacaagggacgtcgctaagaaagaaggtgtga

SEQ ID NO: 17246 - DNA, 282 bp, A.fumigatus
tcaaagcagggcttctctgtctggctcattacggccaaagacaaggacaccttagacgcctggttccgtgccatggagacctcacagtttggaaacatcgcgcgcatcaacgctgaatggtaccggtaccaaaacttccgcatcgaacattcgaccaccgactattgcctcactcagagatttgacggactaatcctcttcaagcctttgtatggctacaatgattcgtggcatacgatcaataacgggccttttgtcgattgctttcaatataactggtag

SEQ ID NO: 17247 - DNA, 390 bp, A.fumigatus
ctgacttgtgattcctgtaggtattacatccgctccaagaagtccaaatctctctattgggacgtcaaacgcaagtcagaggcggaatcactccaggtctacgtcagcaccaaatctcgcgcccggttccaagccattaaaatactctgcccgaactacgcaccgtctccggtagatcaccgcattctcggcgacgatcgtatgtctcttcatcatgccgccggcccggtgtcgttcatcaggaacgacatgggattcctcatattgactatatcctgtctgaacccccatttccggatcagtgagcttactaccagctttgctccacagcctgacaaccgcattgcctatatcccaggctttggtgcggaatgggagctggtgtattag

SEQ ID NO: 17248 - DNA, 681 bp, A.fumigatus
gacgagtgtcgaacttgctcggcactgcggacggattatatcgtgattgatgaccgtgatgctgagaaaaggagccaaaaggattcggggagttctgagtgggctagcgtggaggaagaatcgcctgatgacctgggagccctgtcttcctcagaagtggcccgtctcggtctgaacacggtcagctacgtgatggacagtgaggagcccttggatacgcttgtgaggatttctcaggattttcccaagcactcagccaagatcgcggcctacaatgcgtctgacgctctgctgaaagatattcgtacgagccggcttggaatgcttccttcaggcgtcaatgtcatgtggatcaatggcgtgcagattgatcctcgtcagatagacgcattctctcttttggatcacctccgccgcgaaagaaaactaatcgataaatttcgaagcattggactttctgctcaggaagctgtcgatctgctctgccatcagaccctcggagagacactggcgaaggattcgcctccgcgttacaactaccgagaccaaattgagggcggcggcgtgatcatctggatgaacgacctagaaaaggatacaaaataccaatcatggccggacgacctctcggcagtaagcttccaccttcaattctgtgtttgtgtggcatacttaccatga

SEQ ID NO: 17249 - DNA, 834 bp, A.fumigatus
tgcgaaacaccaagcataccgtcaaattctggtttattgaacaattcctctcgccttcattcaaatccttccttcctcatttggcaagagaatatggcttttcgtacgaaatggtcacctaacaatggcccgcactggcttcgagcgcagcgggagaaacaaaggagatctggggaatacaagatcctctttttggacgttcttttcccgctttcattagataagttcatcttcctggatgccgatcaaatcgtgcgcacagatatgtacgacatcgtctctctagatctcgagggcgcgccatacggttcaacacccatgtgcgattcccgcgaagagatggaaggcttccgtttctggaagcaaggatactggaagaactttctccgcggtctcccctatcacatctcagcactgtacgtggtagatctaaaccgcttccgggcgcttgcggccggcgatcgccttcgcggacagtatcagatgctctccgcggatcctaacagtctgagtaatctcgaccaagacctgccgaaccatatgcagcatcacatcccgatcaagagccttccccaggagtggctgtggtgcgagacctggtgctcggacgactcgcttagcacggcgaggacgattgacctgtgtaacaacccgcaaacaaaggagcccaaactggacagggcccgaagacaggtccctgaatggacgaaatatgacgatgaaattgcggcattggcggaaagagtcgccttggagcaacaacgacaacagctagaagagatggagtctgcagacgaagacgaggagtctggttgggaaaaggatgagctctag

SEQ ID NO: 17250 - DNA, 2160 bp, A.fumigatus
  unsure (1927): Identity of nucleotide sequences at the above locations are unknown.
tccgcagccaagaaaaagatagggtctccggacaaggccatcttccagcatgccatcaaggatcgaacttcgcggcctaataagcaaattctgtcattcgacgagattttgaagagcgatgagcttgagatcctggtttcccgaaccaagcaatatcaagatcgacttggaatcaagggcaacgcttcatatatcttggtgaatggagtctttgtgcctcgggacgacaactggcctcaagaaatgagtatgagggttggtcgcgacttgcagactatccaacaaggagtagtggatggatctatcgaggaagatacctggcttcccgaacttttcctctcggaagcattcgatcgccgcaatcccttgataatccccgaggattcaaaggatatccgaattgtggacatttcgaaactcgcaaagtctaggggagactccgctgatactcttcgcattgcatctgagatggatacactcgacagtaagcacttgatcgttgtcggagactttgactccgagaacggcctgaagttgcttgttgaggctcttgaacttcgggcgacacacggcgaagtggagatggttctgattcataacccagctcctgatgtagagacggaaagcggatctgccctgatctataacgcattgaaggggacagacaaagtggatgcttcccgagttctaagacatttgaagactgcggaaaacaccaactttcccgaagcagaggcaaagaaaatgtcccaattttgggaggcgcagcaagccttggctagagatctcgggtttttgcctggaacgaatggtgtcattgtcaacggcagagcgattgggcctctcccagatggatcgacgctatcgaaggaagatctggacggacttctgacctacgaagaggcgaggagaataggtcctgttgcaaaggccgcaaaagatctcggtttggagtcgaagctctctggccctcttgcgcttgccgaactcagctctcttgcggctctttcgaccgtgtccgacgttcctgagggcatttttgagcagatgtccagcattagaatggatttgttcaagaaatggaacgatttgctgtctgtcataactgtttctacttctgaagatccagctatcataatcgctgcttctattgatcctacatcggaaacagcacagagatggctgccaatcttgaaggtgctctcgagattagctggtgtccgggtcacattggccctgaacccacgtgatcagatccaggagctaccaacgaagcgattctatcgctatgtcttggactcggagccatcgttcaacgatgatggaactcttgcaaggcccactgccaccttttctggcgtgccagtagaggcacttctcacattgggcatggatgtcccatccccctggctcgttgctcctaaggaatcgatctacgacctggacaacatcaaattgagctccttgaaaccagatgccaatgttgacgccatctacgcactcgaacacatcttgattgaaggacattcgcgcgatgtcacggtcaagactgccccgaggggagtacagctaattctcggcaccgaagacaatcctcacttcgctgatactatcatcatggcgaatttgggttatttccagttcaaagctcagccgggactgtggaagatcaaccttaaacctggccgcagtcagcgcattttcaaccttgacagtgtcggcggccaggggtacagtccgcaaccgggtgatgagaacaacgaagttgcactcctctcattccaagggaagactctattccctcgcctttcgcgtaagaaaggccaggagatggaagatgtcttagacacagacgtcaaatccggctcagcgatggactacgtatctaagggcttcaactttgctcagggtgtactctcaagtgtangtgttggttctaaagatggtttggctgaaaagcaggcggacatcaacatcttctctgtggcgagcggtcacctgtacgagcgaatgctgaacatcatgatggtatccgtgatgcgaaacaccaagcataccgtcaaattctggtttattgaacaattcctctcgccttcattcaaatccttccttcctcatttggcaagagaatatggcttttcgtacgaaatggtcacctaa

SEQ ID NO: 17251 - DNA, 276 bp, A.fumigatus
cccttcacgcttgctttctgcatcgacgttggtgcttttggcgttacttttgcgggcttcctgtccgaaggttcttcggggccggatacagactcatcttctgaatcggaagtatcggacgcggactcggaatctgattcagactcggacaacgtctcttgcggtggttcctcttccttgatagttggctttgatggctttgaagctttaggccgtggagttgtgttcgtctcagcattgaccactgagtcagaagcagatttctttgtagcctga

SEQ ID NO: 17252 - DNA, 1965 bp, A.fumigatus
acatcatctcaaaagccgcaccactggacacatgaacaagatgacgaactcatcgacttggtaggacagtatggccctagattcgctcatattgccaagatacttggtcgagttgaggatgatgtggttcagagatggaagaatcggctcgagcaccggagcaccatgagaaggggtgcatggtccgaagaggaagtccgcgggctgctcgatgctcttcaagagtcctggaacaatctgaaaaaggacggccaagatgtgggccgagacatctacgaaatggacgagggcttagtatcctggggcacagttagtaacaaacttcagaactgccggtcaagacaacagtgcgcggataaatggcgcaagatcagacgcaagattatgggacagcgtcgcactggaaatcaggacgctatctacgacccagcaacggaagcaaagccacaaggcagagccaagtccatcacgctcgcggagcagatggaaatggagaggatgctgaagagctccgagtacgttgattccgaggatggagacgaagaggatgtggaacagtctctaggtacagagtctcagtcaccaaacatcaaggacgagggtgaatctgctgaaaaggaatctatcatcattcccgctccagaaaaaccgccggctccctcagtgaaggcactcaatgaaacctctcaatttaaggagtcccagaccgagaatgacgttgactctgaatccgacgcatcatctgactcggctgattcggcctcagacgatgcttccgaagccgaaatcaagttaggttctgaatctggctcggacgccgactccagtgtcgaaagcgacgcaaaagtcgacgccaggatgagggcacaatcgtcaaagaggcaggagaaagatgtgagaaataacaaagcatcctctgtaaagtcgtcgttagagcctacgaaacccatgccgaaacagaagcttgttgagcggtcgaaacccaaaacaagtgacggtaaacaatccgggagtcaggctacaaagaaatctgcttctgactcagtggtcaatgctgagacgaacacaactccacggcctaaagcttcaaagccatcaaagccaactatcaaggaagaggaaccaccgcaagagacgttgtccgagtctgaatcagattccgagtccgcgtccgatacttccgattcagaagatgagtctgtatccggccccgaagaaccttcggacaggaagcccgcaaaagtaacgccaaaagcaccaacgtcgatgcagaaagcaagcgtgaagggtcaggtctctcagaagactcaaaaaaaggatgagcccgaagagagctcctcaacgtcagatgagacgtcttccggtgatgataacaccgatgacagtgaagccgatgatgacagcgacagcgacagtgacaatagctctagcgctagcgccgacaagccggtggaatcgccgaaggcagccgcacttaagggcaccaaacgtaaagctcagcaacccgcggacaaggccggaacatccgagtcgaaacgtccgaaaacaggtcagaaaccaagcaagaagttatctacgtcatccgcctccgctacctcctcgtcagaagatagcgaaagcgaggatgacgccgacagcgattcagaagccgataccgatgagtcaagctcggcatctgacagttcagactccacgtctgagcctcagcccaaatccaagtccgaccccaagcagcctagtgctcagccaaaagtagacaaggctgttaatggacaaaaaccggagctctcaaagccacgcactccagtatcaaaggagggaggcaatgtcaagaatgggcaaagcggagcgaagcagaagtcgaagcaagtcaaaccttcccttcctcaggtcgggaaagatggaaagaaggaaaagagcaaactgggatcagcccccgtgtcaaaggggaaaaattccaagtga

SEQ ID NO: 17253 - DNA, 204 bp, A.fumigatus
aatcacaacatcccaaacagtctcataaccaccgttgaggcgcatatgcctctcagtgctttttcgcccccatctttggagcatcgcaaagccgacggttccaacgagaaggtcgccgacaccgatattgtccgtaccgatttcggcactgggacttctaaactcccgtcgaataagcgttatgatagctgcaatagctcttga

SEQ ID NO: 17254 - DNA, 3267 bp, A.fumigatus
tataggatccagttggccgccctgcacacaacagtcacctccgcctcgttctttgcagccgcaacatttcatttttcatcgacaacgctctcctccgctgcacatgtgtctcaggcccttttgtctactcttgacgcaatactcggctcgaccgaatcgtcaagagctattgcagctatcataacgcttattcgacgggagtttagaagtcccagtgccgaaatcggtacggacaatatcggtgtcggcgaccttctcgttggaaccgtcggctttgcgatgctccaaagatgggggcgaaaaagcactgagaggcatatgcgcctcaacggtggttatgagactgtttgggatgttgtgattttagacaatggcgcaagggccgacgtcattggcactcatccgatcgagcctgccgaatattctcggagtgcattagggtctgcgactagacgatcgtctttcatatcgcccggtaatgaggaggaacggttcgatgcggtgcagcggccgtcgagtgtggttgaacatgctgaagtgccggaaatggtgcttccagctagcgatcaacaagtctctgatgaagacgttcgcctacacataatgaagcagcttccacatggttgtcgtgcatcaatcagatccgatgtggtcaccacgcggaccataacagtcgatatttatgatgatgacaatgctgagcttgccgctcctcccggaatgatgatgattgaggaaagatttcacaatgacagaccggatgaaaacagtggtcttctttctactatgaaccagctacccaagcacacggtcgtcttcaggactgctttcaataagacacaaaatgcggatgtcaggccgtctctcaggcctgaggccttcgattcgcgagaacttgagaatccaatagctacgaaaagtctccctgcgttaccatccaccttgcttgatacaacgacgccaacggataacaaaaatgaagcagattcccaggcgcgaataagcgacagcagagggctgtccggtgagcagccctcaacgacggagcatatggagagtcttgaatatgacaagcctcgtagtcgcgccgcaccggaatcgagttcagaaggcttctcttcggcaggagcagcacgggataccaggtcgggtggcggtgcgaaaaagtctcgtgaagtttccagcagtggccctgtgaacgaactaagcacagggtctaaagggaccttcgggaaagcatcgctaacaagattggcgcagaaggtaaaaccagctaatgtagagagagacgagactggacaacggatagcacaacgatccactctcgataaggcccagaaattttcgaaaaatgggacccagcgtaacaagatgcagaaagggccccttgtcgacaagaaatcagcccaccatgacatgtcgacaacgccaactgctgcggaaagtgcaaccaagatgactggatcccacacgaacagaacattgttgccggtcgcaaacagaggcgtaccgagatcagccttacatgacccacggctgcgaatttctcccagccagacacgtcaagtacaaacgccaagcaggtcccaaagagatgcacagcctgattatttcaccgtccatgaagtgaaccaggagactttcatcaccaaatcagactcattctccctccgatccgcaggtacacgagcaaactcaccagccgctacaagaacccatgtgcgcagtagcagctccttgtcattgacgcgatcagagacagacatggctttgtccctgagtgcagatggccgcccaacgtcgtcgggttggcagcagaggactacctcgttcgcaccaagtatatattccttagcaacagcgggctcggaaacgtcactcatacttgctcatcgtgcacgaaagagcgcatacgacgatatagacactatcagatcgctaacccgtgacggcagaattcctggtatattcccagagcaacattttgtacagaacatcagacgcttctgccgattctcctcagcttcgtatggatcaaacgctttgaaagtgatgggtgtgacgaggcaaacgcaggctattcctcacctggaatccgacaaccaggagcactctgatttctcggtccacacgggactaccagcgtcgacaatcctcttgtcgtcgttcgttgatccggcgggcggaaccaatgctgccggggagactgacagcggtttccctttggttcattatgtatgcctggaccatgcttcaaaagccgttgttctgactctcagaggcacgtggggatttgaggatgttctcaccgatatgacttgcgactatgatgacctcgtatggcaagggagaagctggaaagttcacaagggcatgcatgcctcggcaaagcgccttctaatgggaggtggcggcagagttatgatcaccatcaggaccgctcttgaagagttcccagactacggcgtagtgttgtgtggccattccttagggggtggcgttgccgcacttctagccactatgatttcaattcccaacagcgagcaatttggaacctcgttcgtaaccgctacgcctcagtctgccgcacggcggatgctcctagggaacaacgacgacgaagacgaagagagccgtcttcccttctatctcccaactggacgtccaatccatgtctatgcgtacggacctccgtccgctatgtccccatttctacgccgtgcaactcgtggcttaataacgacgatcgtcaacggccaagatgtagtaccaagtctttctttaggcatcttgcacgatatgcacgcagtatctgtcgcgttcaaaagtgacacctccggaactaagtcgcatgtacgataccgagtttgggaaggtctaaggcaaagcattgttaacaaattttacgtcaacgaaacgcccatgcttctgcacgctggcgatggcctcggggaagacgcctgggcgtggaaaacattgaaggctcttcgagaagagatgtgtgctcccaagttgctgcctcctggagaggtctttgtggtaaagacgatgcgtgttcttcaacgcaatgcttttacgtctgactttggcggagacggctacccgatgcttggtcggcctgcaacgagggtacagttgaagtttatccgagacgtcgagtccctttttggagagttgagatttggctccgggatgtttagcgatcacaacccagcaagatatgaggccagtctggcggcacttgcgcaaggtatcctggacgattga

SEQ ID NO: 17255 - DNA, 261 bp, A.fumigatus
ctcctctgtacagccttgtctgcttctgcagatctcaattttgcctcatccttcctttatcagtcccttaaagtttctactttctgtttcctccatcctagccgcactttcactctacgcaagaattggataccagcaatcctcactatgggaaaggataacttcatccgacaagtcgaaaactcggctgagttcaaactccttgacaaagtagttaaggaccaagtcacagtgcaagatgcggtccaagaaagtcattga

SEQ ID NO: 17256 - DNA, 387 bp, A.fumigatus
ttaaggaccaagtcacagtgcaagatgcggtccaagaaagtcattgatatgactatgaccgcactctccgtccatggcccaagcaaacaaggcggtatcggcgtgcctgactacaatatctctcttgcggtgatggagctcgcgcaacgccgggagccagcagagcacactaagcttgccaagtttgtatctcatctccagaagcagattgccattgatccatctacaaacgaacccctcacggtccaacgagatatcctctggactgatatgccgtcattcggctatacagagctggagacgtggtccgagtttggtggtgattacaaaggtaatacatcctgtcattcaagcagccaaaacgctaacgtatgtagatccctgtga

SEQ ID NO: 17257 - DNA, 459 bp, A.fumigatus
ttggttaatgtcgatctttcagttgccaacgtggcgcagcggctagcagatcgacacgcgagatactcaaagaggatgcactgtatggatgaccgcacggactgttcgtctgatgtactgcttctactgcctttgtcgtccacttttggcactctcttcagccagataaatagcacgcaggatgtacatttgacggaaccggcttgcacagtgaccaactccctccctgccgctacctgcgccatctacacagtcctcgccatcccaatcctctacctcctcgtacgacatggacgcgatggtcttctgggatggctcttcctcttcttcttctgcaccctgcgcatcatcggcggagcgctagccgttaacagccccagtacagccgctaccgtcatctccagcgtcggtctttctcccgtcctgctcgcaacagccggcaccctacaggaggcataa

SEQ ID NO: 17258 - DNA, 249 bp, A.fumigatus
gtcccaactcacaaatattccatcaatgcgaacatgatcagccgacactatcgcattcaacccctccacaaaaaaatggaatgggtctccgtcctcgcctaccacatgctcgtcgtcgcaggcgtggccctcacagccgccggcccggtaaaactccaagaacacaagcagcccctcgacaaggccgcgaagatcgccaaggagggtattgccattctggcagtcgcgtggggggtcctggttgtctag

SEQ ID NO: 17259 - DNA, 480 bp, A.fumigatus
gatgagctggacgattcgggtgatataaagatctatggatcttgcgagacctttcatcatcgtcaacagcatcacagcaatccattcccacttggaagcgtctctcctccatactatcgtccaaagcaccagcctctcgaaatgttgttcgacatgaagtccgtcgtcctctacggactcatggccctcgtccacgcctctcccctctccgatctcagcaagcgcgccaaactcggcgacttccaatgtcccgacgacacactatctgaacatgacatccgcgaggccctacacgagtgccgcagactcgacgacggctccataggcaaatacccggcattctttggcaacaagagcaataaccaaaaggtattcggcaatattcccgatggcacggatctacgagaattccccatcatcgtgggcggagtgtacagtggtggtaagcttcgcgaacgcaaagatactgagccgagctga

SEQ ID NO: 17260 - DNA, 474 bp, A.fumigatus
tgcagcatactggtgctactgttgggggcgcctatacggcctgcacacgcatcacaaatacaaagcgtagagcctggcagagacaaagatgacaagaacaagcacgacaaggacgagggagacatgaagagtaataatgaggagcgcagcgtccaggagactgagactgaggtcgaggaacccactggccacattgtcagcgacctgaccacccgcagcaagaagaggagacttggtagcgctacctgcaccgacggcgtcacgctctcccacgatgatgtcgtcaatgcgttcagggagtgcaagaagtgggacgaccatggaaggggcgggtatccccacaaattcggcaacaagagcggtaacagtcaggtctttgagggcatcaccaaagacctgcgcgagtaccctatcattcaaagtggaacctggactggtaagtcatccacactctcgttatgggatgcagactga

SEQ ID NO: 17261 - DNA, 324 bp, A.fumigatus
gtggtctacttacttgtgatggcagccaaattcattccaaggcaggcatttcccagctatgcctccattccaagatcgtattatcttggccatcacaaagccggtttgaagaagatgcagaacatgctatcttctattgactatgttattgaatgccgtgactacagagtacccataacgtctatcaaccctatgtttgaagaggctttgggaaagacaaggcggttagtagtttacaccaagagggacctgggtgcggaacctcgatcatctgcgcagcgaacggtaagtccaagatcgaagtttggcccatacttgtcataa

SEQ ID NO: 17262 - DNA, 810 bp, A.fumigatus
gtccaagatcgaagtttggcccatacttgtcataatgctgacgggtggttctgtatgcaggccgaaaaaattattaagaagtttgattcgagtagtgctgtgttttttgtcagctcctcttcccgagcggatgtcagctcgattctggcgcatttgcgaaatgatgctgaaggacctgataagctcgtcggctgtcgcgtgatggttgttggaatgccaaatgtcggcaagtccaccctgatcaacaatctgcgcaaccaaggcgtaaaaagagccaaggccgtgcagacaggtggccagcctggtattacacggaagattgggacaccagttaaaatcattgagcgagacaatggagctcatgtttatgttttggacactccaggggttttcatgccctatgtgccggatgcggagaaaatgctgaagttagctctctgtggttgcgtgaaagattcagttatttcaccagtcacattggcggactatcttttatatcatattaatctgcataacccggggcagtacgagcgctggtcccagcccacaaacgagatatcgcctctcctggacagttttgctcggcaaactggtctcctcgctaaagggggtattcctaacatcgatcttgccgcactccatctcattcaaaagtggcgatctggagaattaggacgttttatgcttgatgacctacaagcagagcagcgccgtatcgacgaaggaatcgagaacgacgtgggtatcagcatatcccaggccttgaaggccgagcgaatgtcgagaaaacagcctgcctctaattcttaa

SEQ ID NO: 17263 - DNA, 1398 bp, A.fumigatus
tcgagtgcccggttcccttccagccccgtggtgaagacggtcaactggcgtgacgccggtgaagctcagcaagcggtagagatccttcctaagtggacggagattgatgttgatgatgcactggagctcctcggaccgactttcgataatactactgttcgttcctatgctgtagataggctccgaaaggcagacgacgaagagctgctcttataccttctgcagctggtacaagcgctgaagtatgaggaaaattctcggggcgccgcgcatgactcgtctttggcaaacttcctcatcacccgagctgccaacaatttcaagcttggaagctatctgcattggtatctcatggtcgaatgtgacgacactagccccggcaccctgtccactcaacgcagactttttgcccgagtggaatactacttcatggccgagctcgagcaagtctccccagaacacaggaagacactactgcggcagggtgagcttgtcgccgtactcacgaagattgccaaggatatccgcttcgctcgggagacgcgacctctgaagatcgaaaagttgaagaagtacttgaaagatcccaagaatgagctcgtccatatcgatcctccactacctcttccattggatccagaagtgtcggtaacaggttgctttccagaagaatctaatgtgttcaagtcctcgttgtcaccattgcacattaccttcaagacttctgagggacgcaagtatcccattctgttcaaagtcggtgatgacctccggcaagatcaacttgtaatccagattatcatcttgatggaccgtctactgcagaaggagaatctagaccttaagctcaccccttaccgtatcctcgcgacaaatgctacggctggcgctgtgcagttcataccgtcaacctctctctccgccgtctctgccaagtacaagtcagtccttgcttatctccaggcaaacaaccccgacgagaacgaacctcttggtgtccgcaaagagaccatggatacctatgtgaagtcctgtgctggatattgtgtcatcacctaccttctcggcgttggagacagacacttagagaatcttctacttgcaccagacggtcactttttccacgcagatttcggattcattttgggtcgagatcccaaacccttcgctcccatgatgaaactgtgcaaggaaatggtggaaggcatgggtggtacaacctcgcctcaatacctccagttcaagcagtactgcttcactgcgtacaccaccctgcgcaaatcggcgaacctaatactcaatttgttcagtctgatggtcgacgccaacatccctgacattcgtgtcgaaccggacaaggctgtatttaaagtcaaggaaaggttcacctcgagatga

SEQ ID NO: 17264 - DNA, 759 bp, A.fumigatus
gcacgtaacagcgagaaagcacagtcgatgctcttccgcttccgggcacaacaagccgcggatctcggaatcatcgacattggacggacgcgtcggcccaaagccatcacctctgtggattcgatccccagctgcgagaaatggcgcggccaggtcctcaaagaaatctcccgcaaggtgtcccggattcaagagcccagtctatccgactaccagatccgcgacctgaacgatgaaatcaacaagctgatgcgcgaaaaatgggcgtgggaaatgcagattcggaacctgggtgggccgaactatatgcgtggttcgggacgggtatatgatgacgagggccgggagatccccggtggtgggaaagggtatcggtactttgggcgcgccagggagttacctggtgtcaaagagatgtttgaggctgcggcgcggcgggggcggaggccgcccgaagaagaggaggaggaggaaggaaaagggcgaggtggggatattgctacgaagaaggttgatgcgaattactttgggtatgggctggatgaagaggatggatcgttacttgcgtatgagaggcagaaggagaaggaggctgtcgagtacctacgagggcagaaggatagtgatgcggaggatgggtgggagccgcttcccggcgacgctggcgatggggttgaatggaggttgccgacgctggaagaggtacaagaggagcttgtggaccggaggcgacgccgactgctggacaaaatttcttag

SEQ ID NO: 17265 - DNA, 312 bp, A.fumigatus
acaggaggcgagaacatctcatccgttgctctcgagtcgatgctcgttacccatcccgacatccttgaagctggtgtcgtggcggtcccagacgcacattggggggagcgacccaaggcatttgtgactgtgaagcaggggaagcagatcgatggacaagaagtgatcgcgtgggccaagaataacagtgcgatcagcaagttcatggtccctcgggaggtggaagtggtggcggagcttcccaagacgagtacggggaaggtcaggaagaatgtccttcgagaatgggcgaaaaggggaagtcggacatga

SEQ ID NO: 17266 - DNA, 759 bp, A.fumigatus
aatgcttctgatcgattcccgttgcctctgctaacaagtatctcccagctgaaacttaacggggtcgtccaagtaacggacaggtcaatcctatcctttgccgaaaactgtcctgctatccttgaaatcgacctgcacgactgcaaacttgtcacaaacccgtcggtgacctcgctcatgacgacactacgaagccttcgtgaactgcggctggcccactgcgtcgagatcagtgatgcggcatttctaaatcttcccgagtcgctctcctttgatagtctccgcatcctggacctgaccgcatgtgagaacgttaaagatgatgctgtcgagcgcatcgtcagcgcggcgcctcgcttgcgaaaccttgtcttggccaagtgtaggttcatcacggaccgcgctgtgcaggccatctgcaagctcggaaagaatctccattacgtccatctgggccactgctccaatatcaccgatccggcggtaatacagctggtgaagtcttgcaaccggatcagatacatcgacttggcttgctgcaaccgtttaacagataacagcgttcagcagctggcgactctgcctaaacttcgacgcatcggcttggtcaagtgtcagctgattacagatcagagtattctggctctggcgcggcccaaggtgtcccctgatcctcttggtacgagtagcctggagcgagtgcacctcagttactgcgtcaacttgacagtgccagtaagtttccggacatcagtctag

SEQ ID NO: 17267 - DNA, 462 bp, A.fumigatus
caccaactagccgttaattaccgactcaaggaagatgatatcgcatatatcttcacgcactcggacgccgatgtcatcattgtggacaaggaatatctcccactgttgcaagcatatcgagcggcaaagccagaaatccccgtcatagtcgacacggacacagattctacagaaggccaactctccggtccttttgacgaggctgttttattaggtctcaagtatgacgctgacacaggcgcaaagggctgggatgggctggaaagccaggctgcttccgaagacgatgtcattgcgcttgcttataccagtggcacaacagcccgccccaaaggcgtcgagtttactcaccgtggctgctacctagctgccctggccaacgtgatcgagtctggcctgaattctcaacaaggccgctgccgttatctatggactttacctatgtttcatgcaatgggttag

SEQ ID NO: 17268 - DNA, 717 bp, A.fumigatus
tctgctgtcatccggctaactcttccaggctggacatttccctgggcagtgaccgccgtccgtggcacccattactgcctgcgaaagatcgactatccggagatttggagattgctgaagcaagagcacatcacccatttcaacgcggctccaacggtgaacaccttgctgtgtgctgccaacgaggccgagcgacttccgcggccggtccaagtcactgtggcggccagcccacccaccccacatctctttgagcagatgaccaacctgaacttgcacccagtgcatgtgtacggaatgacggagacatatggaccgattaccaaggggtactacatgcctcagtgggatcaactgcccgcggaagagaaatacaagaagatggcaagacaaggacatggtttcgtgactagtttgcccgttcgagtcatcaagacggatgtcccagaaggaaccattattgacgtccagcgggatggcaaagagataggagagatcgcttttgttggcaacatctgctcccgaggctactacaaagaccccgaggccacgcgaaagctcttcgcggggggcgtcttgcactccggggatctggcggtctggcaccccgacggagccgtccaaatcttggaccgagcaaaggacatcatcatcagcggtaggcaatatctatcatcggttctcttttttttccccgttcattcatcacaatgctga

SEQ ID NO: 17269 - DNA, 327 bp, A.fumigatus
gaggttcagcggcgggactggaaccatcagttcttatttgcctcccatcgaccgtcaactaatcatccatcactttggcagccaccgccgaccctgtactgtgctgactctctcttttctagccgcccgatcaaacagctagctctttgggttccctcgagagatcccacccacccaccatacctgaagttttctttcagccatatcactacgcaacgcatagaccgtctggataatgctacttactctgagcataaaatctcgataactccaccacggacgtctttccctccccgatcgagcgtttgtcgtttccctggtcaataa

SEQ ID NO: 17270 - DNA, 861 bp, A.fumigatus
atagcgtatctcatgctgctggagaaccttgatcagacaaccctcatcacaagacctcctcaggcttcacacccgctatccagaatgccccgctcacggcaaccacttcgcttctcaagcgaagttccctccgagtcctcgtcatccacctctcccgatcgtaccgtcgatgatgataccgacttcttcatggcccaggccaacgattcgcagtcttccgtcggcgtggggaacttccgcgagccacgcgatcagggcccgagaaacacagtaattcctccgatcggacgtctaccgccggagctccttatctccatatttgcgaagctcagctcaacagcggatctgctgagttgcatgctggtatgccgagggtgggctgccaactgcgtcgcgatactgtggcatcgaccgtcgtgcaataactgggacaacctgaagagcgtaacagcatccgtgggaaagccggatggtttatttgcgtactcggagcttatcaaacgactcaatctctctgcgttgacggaagatgtcagcgacggcaccgtcgtcccctttgctcagtgcaagcgtattgagcggttgaccttgacgaactgttcgaagctcacggacaagggtgtctcggacctggtggaaggcaaccgacatttgcaggctctagatgtctcggatttacgataccttacggaccacactctatatacggttgccaggaactgcccccggcttcaaggactcaacatcacgggttgtatcagagtgacggacgactcactcattgtcatctcgcagaactgccgacaaatcaaaagagtgagctttaaaatgcttctgatcgattcccgttgcctctgctaa

SEQ ID NO: 17271 - DNA, 342 bp, A.fumigatus
ggaatacatgctctgctaaacaattgccctcggctcacacatctcagtctcaccggggtgcaggctttcttggatccggctgtcacccagttctgccgcgaagcacctccggagtttactcaacaacagcgagaagtgttttgtgtctttagcggtgaaggcgtcaatcgacttcgggactacttgaatcgcagtcctgaccccccccgtgaaatgaccgaagctacaatgtatgatgatgacgaagagttggatgaggacgaaggtcaagtgactggcctgatgcacgcgacagtcataaacgacgaagactatatcgatatcggacatgctcacggttga

SEQ ID NO: 17272 - DNA, 579 bp, A.fumigatus
tatccatcttcgctactccccctcactatcgagatgatccaatacttgggatgcctcttgcaagttcgcatcatcgcatgccatcacaggcttggcagcagtgggtcccatagaggattagtgtcgatagtgggaaaaatgtctcgatttagtgcctgccaccagaaaggggcaggcccatggataccctcaacagcactcgcgatctcgtattctcaatgggattctacttcagccgacacaggtcatgtccgacttccccttttcgcccattctcgaaggacattcttcctgaccttccccgtactcgtcttgggaagctccgccaccacttccacctcccgagggaccatgaacttgctgatcgcactgttattcttggcccacgcgatcacttcttgtccatcgatctgcttcccctgcttcacagtcacaaatgccttgggtcgctccccccaatgtgcgtctgggaccgccacgacaccagcttcaaggatgtcgggatgggtaacgagcatcgactcgagagcaacggatgagatgttctcgcctcctgttcagttatggtcagcattgtga

SEQ ID NO: 17273 - DNA, 408 bp, A.fumigatus
gcgagcgcccagtacaccgacagcacagtgagcaaatactggtgcgagcccgggaggaactcaaggaagatggccgagtcaacggggaggttcccgcccacgccgatggaccacagcgcgttgaagacacataccgccgcgaaggtgggtgagccagctgcaacgagcccaaatactgcagtcagaccgatggtcagattgaaggcccaacggcggccgaagatatcgcagccaaagccccagaacagagcgccaatgagcaggccgatattctgggctagagtcaagaatggcggactggagatgtggaattccgatgtaacaggacccagaatgagcgaggtcacaatcggccagaggttatcgcttgcccagccaaagccgatgacaataaagagctgccattga

SEQ ID NO: 17274 - DNA, 228 bp, A.fumigatus
accaagttaacgatgcaggctcttatactcggttcacggggaacctgcttagtgatcatttggctaataaaagtcaccttttatgactatgatcatgatacacatgatcagatgagactaaagtctggaattgagacctcatgcggaccgaaatcgaagcgtatggagtccatacaactcgaaaatgttgtcggtatgtatggaaccctaattatcgatcgtgattaa

SEQ ID NO: 17275 - DNA, 894 bp, A.fumigatus
gacccgcatctctacaatgtcaaccaagctaatggtgcaaagaatgaaaacggaacactccctcgtatcaagatagcgaaattcgatggattcagccagacccctcgactgctgcaggagatactgacctggttcaccggtctcgagcattttgcctttacttacatctacaatcgctcatatgcctggtactacagatggaattactctaatatcggagcggctctcgatcgtcacaaagagacgttgaagtcgattctgatccaactgtttgggtacagcaggataggctccttcgacttgagaagctacaagagtctaagagttctcgagctctctctccagaacatcgtagttgaatctcccgaagccgctgcgaccaaactcctcgcgccgaatttggagctattagtgctcaacttcgggacggtagaccgcaagaaggccaaatacaactgtatcgaaaagcgcgacgaggagtggttagtgcaattcggagaacatgcgtccaaaatccgaaagtccctacctcgagtgcacgccaaaatccccgcctacgcgtttcgaggcaccgagacggagctttgggacgctcgctgcacgtttgaggacctcgacaatatccaggacgagctgcagggatacggcattgacttcacatacaatgaccctcctgtctccgaagaggaattccgggaatggatacgagacaaggatgaaatggacttgcttggggggctttggagatatatgaaccgttatgctgcataccactcagacgaatcagattctgggtttgaatctaacgcgctggacaccaaggaccatgacgaaatggcccagcaatctacggacaaattggataccgaggttgaggaagaggcccagatctga

SEQ ID NO: 17276 - DNA, 837 bp, A.fumigatus
tcgataattagacagaactctaaggtcataaggtcatcgtcatccatggatcccaacgacatcaacattctcgctgacttcctcgccttcaaccaaatcccctcaacttttcctccatcagatgcggcagacgtcctcgtcctctgcgtctccgccatccttcccgtagcagagaaagtcttcgcgcatctcgaaaagaacccaacagcaatcaaaactctggttctctgcggcggaatcggccattccacgcctcatctctatgaagctatcgccaacgatccacgctacgcgcatctcctcccggagattgacggactaccagaagcacaggtccttcaccacattttcaggcagtgttttgatgcaccgaggattctgagctcatgtcgtgtcctcattgaagaccgctcgacgaactgcggcgccaacgcaattgaaacgaagaggcttctcgaggtgaatgggatctgtcctgagagtatgctgattgtgcaggatccgaccatgtctcgacggacggttgcgtcgtttgagaaggctttttctggacagaggaccctgcggttcaccagctggcccacttttgtgcccaaggtcaggcttgaaggaggcaggctggtgtatgatgagtctgccgggattgaggcgtcacggttgtggaggttaccgcggttcctggggttggtgatgggggagattccacggctcagagatgatgaggaagggtatggtcccaaaggaaaaggattcattgtgcatgttgatgttccagatgaagtagaggaagcgtggaagagaattaaggatgcggagatggaatgggagagacggtag

SEQ ID NO: 17277 - DNA, 522 bp, A.fumigatus
acggcgaatagatggttctcggtcacgatggggacaggcattgtatcaattctcttgaatacactgccctacaatgctcaatggctatactggatctctgtggtcatcttcgctatcaatgtcctcctcttcatcacaggatgtatcatcagcttcttgcgatatacgctatatccggagatcttcggagctatgatcgtccattctgtgcagtcaatgtttattgggacgttccccatgggcttgaatacaattatcaacatgtgttgtttcgtctgcgtcccagcgtggggtgaatggaccagaaactttgcctggggtttatggatcttcgacgccatattatcagtggtgacggctttgtcgttgcccttcttgctgtacgtcttccctctcttccaaacttatccgactgtgactctaaaatcctacagcatggcccatgggaacgaaacgcaactctcctccatgacagccatctggcttctcccaatcgtaagctgcatcgttgcagcctcctcg

SEQ ID NO: 17278 - DNA, 255 bp, A.fumigatus
caggcttcgcagcgaatcttccaaagtcacgtcgacaaagaccttgatatagtcaccttccacatccacatctctgttgcctgcaaatactccagcttcttctacccagccgtcatctggtccggggtccgatccaccggcgacgtcgtcaacctcccagactacgagtccgacacgtttgggctctacctgcagtggtgccacgccaatatccatcctgtcagcgaagaatcggaagagaagccagagtactga

SEQ ID NO: 17279 - DNA, 1068 bp, A.fumigatus
  unsure (1058): Identity of nucleotide sequences at the above locations are unknown.
atcaaaatggcggatgatcatgacaaactcaacgactaccggctcaacgccgccaccctcaacactgccatccagagtattggcatgggcgcctatcaatggcagctctttattgtcatcggctttggctgggcaagcgataacctctggccgattgtgacctcgctcattctgggtcctgttacatcggaattccacatctccagtccgccattcttgactctagcccagaatatcggcctgctcattggcgctctgttctggggctttggctgcgatatcttcggccgccgttgggccttcaatctgaccatcggtctgactgcagtatttgggctcgttgcagctggctcacccaccttcgcggcggtatgtgtcttcaacgcgctgtggtccatcggcgtgggcgggaacctccccgttgactcggccatcttccttgagttcctcccgggctcgcaccagtatttgctcactgtgctgtcggtgtactgggcgctcgctcagctgctcgccaatctgattgcctggccgattctcggcaatctcacctgccccgatgaagagacttgcacccgtgctaacaacatgggttggcggtactttctcatcgccatgggcgggatagcggcggtcatgtgtctcctccgctggacctgttttactctgtatgaatcgcccaagtttctcatgggaaaaggccgctacgaagatgccgtggccgtcgtccacgaagtcgcccgccggaatggctcctctgcctccttgtctgtggacgacctcatcacccctgaaacctccgcagagcagccccccactgtcggaacaaacgtgcttatccgccaccggctggatcacttgaccctcagtcacatccgagccctcttcgatacccccggccgcgcctgttccacttcgctgcttatcgtcgtctggggcctaatcggcctcggtttccccctctacaacgcattcttaccccacatccaacaaaccaaggccgccgaatttggcgatggttcaaccggttctgaactaaccggactccctgatcatcnccggcggtag

SEQ ID NO: 17280 - DNA, 507 bp, A.fumigatus
ttgctgatatctacctctttagtcaatatttcaagcacactaatatctcgtctttcgttcgacagctcaatatgtatggttttcataaaggtatatgactttcgacgagggtgtgaatgggttcgtacttttgctgaccctttacatcatatagtgagcgatgtctttcacacgggctctccagactctgcattatgggagttcaaacacgggaacgggaattttaaacggggcgaccttgtagggttgcgcgaaataaagcgccgagcatcacgacatgccttgatccatcgcgactcatttcccggccacaagaccgctgtttctcaacctggcacgccagccgagcccgtcccagatgcgactgaagcgcgattgcttaatttggaacattcgctatatgacatgcatacccgtttgagtcgcgctgaagaggcacatacagctctcaacttaagatgtcaagccatggcggagagtttggccagatgccatcatgttcgttga

SEQ ID NO: 17281 - DNA, 228 bp, A.fumigatus
cagcttctggttatctgcagatccgatcttttaacgcgcctcgtccgcgatactttcctgtccttccacggctctccctctcgaccctcgtcgatttcatgctacaccttcttccgagactacggagtagattggaacgagtggagaacaaaggggcaaagaggaactttggactggtctaagactcttcaccccccgttgagtctggtgggcgacaaaaattcttga

SEQ ID NO: 17282 - DNA, 2598 bp, A.fumigatus
caaaacgaatcgcgagcagctgcagaagaggcaacgcgactggtgcttgagttacaaacaatcgcccgagatgctggccatcctgtgcctttacttattgccttggaccaggaaaatggcggtgtgaatagcctgtacgatgaaatctacattcgacagttccccagcgcaatgggaatcgcagcaactggctcaaagtcactggctcatgatgtcgcatatgctacagcccaagagctgaaagccgtaggggtcaactggatccttggccctgtactacacgttttaactaacgtacgaacccagccgctgggggttcgcactaccggcgatgatccccaggaggtgtcgcaatatggcgttgagtttatgaaaggctacaaaaaagcaggattggtgacatgtggcaaacactttccgtcctatggtaacctcgaatttcttgggtctcaaacagacgttcccatcatcaccgagtcgctggagcagctcagcttaacagcgctggtcccattccgcaatgccatagtccacggtttagattcgatgatggtgggaggtgtctcaatgtcgtctgccggtgtgaacgtcatgcatgcttgtttgagtgagcaggttgttgatgacttgctgcggaaagatttgaaattcaatggtgtggtggtttctgagtgcttggagatggaggctctcactcataatatcggtgtcggcggcggaacagtgatggcgaagaatgcgggctgtgatataatcctcttgtgtagatcctttccggtgcaacaggaggcgatcaatggtttgaagctcggggtggagaacggcatcattggtcgggctcgcatagagcaatctttgcgccgggttttgaaaatgaaggcgaaatgcacctcttgggaccaagccctgaaccctccggggctgccatctctaatgcagatgcaaccatctcataccagcctctccaaaagggcatacaacaactctatttcagttgtacgtgataagcagaatttgcttccgctgtccaacatcattgagcctaatgaggaattgctacttttgactccgcttgtcaagccactgcccgcatctgcagtctctcgttcggtgacggagcacatgaatctttctatcgacccgattgcttcagatagaaccgcctctgtgctgagcggtgagagtgttttcaaggaactgggtcgttctctctcacgtcaaagaagtggtcgtgttctacatacatcttacacggccaatggcgtccgaccaatccacgagaatttaatagatcgggctagtgccgtcattgtcgtcactgccgatgcaaacaggaacttgtaccagcatggcttcacgaaacatgtctctctaatctgtaggtctcagttttctccatcgggcgagccgcgagagaagcctatgatcgtcatcgccgctagttccccatatgattttgccatggatacgtccattggtacctatgtctgcacttacgatttcacagagaccgctttggaggcgttggtcaaagttctctacggagaattgacaccaaaaggctcattgccgggttctatcagccgcagccagaagctccatcaagcgcggcagcactggcttgtagaaaactggaatgaagagagagatgcccagtccttggatactttactggatgcagtcagagcggattgcgcgcagggtcagcgttctgagctgctaggtgtgacatccagcagctttttattacgaagcgaagagattgatgaggcgcactttgttgtacgaaacagcagtacgcaggctttgtacgtattctgctcgacttatttctttaggtcgacgggcacaggcgttattggatctttgattgttgatcctgcaagacggaaattatctatcgggaactcactgcacaaccgcgcaatccgaacacttcttcagcgaaagggaatgaggaggtttcagctaggttctcgactcccaggcatatacttaggcattccgtcttcgaatccagtggagcgtaagaggttacgccagtggtttgccaaccttggctggaacactgccctttcacggccggtttgcagtgtggtgctgcggaatcttccaacatggacgccgcctgatggcctcatacaggggttgaaaaatgccgacgtctcctacgatcttgttcatgggtgggattacgcggagcctatccttgatcacatcaagacgaattctcgacaaggacttattgatatatacaagatcgctttgggaggagcaccaaactgtggcataatacgggccatgcggccgagcgatggagcaattctgggtaccgtggtgatatacaacggacggtcgtcattggcagagcacgtgcctgtgctgaaagccacacaaccgtcgagcggaggcatatcgtctccagtaatttctccgtctgttggcgagtatgctacggtgatgcaggggctcgtattactgggtatcaaacaaattcggagacaaggcgcagaggctgttgtcattgactgcgtaagttcaaatcccctttatccagcgttccaatcattccgttcactcccccggctcacgggttag

SEQ ID NO: 17283 - DNA, 285 bp, A.fumigatus
ctgcggtgtatcccgaaccataccctgtatgtcgtcggcaacaatgatggcggcctgctgaatgagcattatttgccatccagtacctgtggtccattcaacctgatttctgagttcgactccgtcctagtccacggctacgtgcgtaaggagacaaaggacgagattgaggccgagcccctactatggaatgacaagccacttggtggtgagggtcttaactcagtatcgaaaagcgatcacgccgaagaacaaggccacccagcaaatgatcatttctgctga

SEQ ID NO: 17284 - DNA, 573 bp, A.fumigatus
  unsure (556): Identity of nucleotide sequences at the above locations are unknown.
ttagtgtctctgccgtctatcatggcttctgtcgacccttcccttcacgatccgctccttgcgcttcgccgtgcgatcgcagccggcagtcttcccacgccaaccacaacctccgacctttcggatgacaatgcgaccgaggacctggccaaggctacccatctgtacttccgccagccaattccccagaccattccgctgacggcgtcgacgcgcttcgtctccgcctcgtcagactccgcggtcgatctccgtagcatcttcttcgcttggcagaagaaagatgtcgcaattcccgagtacatcgcctcggcgcaggaattgaacgagtcgctgaagcaaaaggagcgcaaggaaggcgagccagaggagaaagtgcagaatctggtcttcgtcgagcggctggatctcatcacttggctggaaggcgcgtcggatgagagcgagtacatcaaaccccttgagggtgcggcggcggccgcgccctctgccgctccggcggacgcgtctgctgcgattgctcctggggctgcagggtcttcaccgcggggctgcnagtggacgtctatcgat

SEQ ID NO: 17285 - DNA, 2931 bp, A.fumigatus
  unsure (875): Identity of nucleotide sequences at the above locations are unknown.
agccctcaaccgcccaacaatacaccacagcgcgtttttcatttgttcgtggagggggtactctgtcagattatgacagatacctccccagtcgccatcacgcattcaaccacggagccctatccggtcaccgtacccctaaactcacccgccctcaacggcgccgtttccgactctgccgcccctgacgaggaggagccgtataccatcaaatgcatctgcgcattcgaagatgacgatggcaacacggtcttttgcgaagggtgcgagacttggcagcacatcgaatgctactatcatggtcgccacgtgcctgaggtccacaattgcgtggactgcgagccccgctacctcgatgctaagcgtgccaccgagcggcagagacgtcttagggagatcggtgacagcggtgaccggaaagcgaaacgtgccggagcaaaaggtcagagaaaaagggtcaaggaccatggtgacaaggtgaatggattccatcagcgggcggactcgattgctcgagaccagccccctgccaaaaaggccaaagccacccatcgcgcctccggatccatcagttctcttcctggtgctgcgccattcccacttgatgcccgcagacgtgtcgcaacttccatgagccctactaaatcccttgggccgtccatccccctttactcaaatgaatttttacatctctatgaccatgatcaggactatgcccctatgaatagcaacctctttgtcaacctccctcttgcggcggacctggcatcctgggtgacagagccgactgcgctcgctcgggtttccaatgggcgatcatctcgtgacatcttcacctggtcggatactgcgctggaccggtcgctctggccttngctatctacagaaacaatcaccgatcccagcatcaatatcgaagggcggcatcccacatggaaggtgctaaggactcgcgagagtgtctccaaagatcacattgttggtgagatcactggcaagattggtcttctgcgagactattgcctggatcccagtaatcgctggcaggagcttcgtcatccggaaccttttgtattctttcacccccagctccccatttacattgacagtcgacacgaggggagtattcttcgttatgtgcgccgctcatgtcgacccaatgtcacgatcaagacttacatcaccaacgaggtggagtatcatttctgctttgttgctaaagaagatatttcggccaattcggagatcacagccatgtggtatctggatccccagctcttcgagtcgacgcacggtctggtcaagcaggagccgaatgacagcgctcaggaagtagctgcaatatgcattagcaacgtgcttgccaatttcggtggctgcgcgtgcgagcctccagctaactgcttacttgccagcgttgatcgccggcggcacccaaaggcgttggagtcgaagcaggtcaacggtaagcggaagaaagcaaaggcgaaatccgccgcctcgccgcccgcgacaaacagtcgcgcaagtagtgaaacgaccaagaatatggaggatgacgatcagcccgacagtcgttccacatccgggtcttcacggggccagccgcgcagtcgggatcttactcctacactgcagcacgatggcgagtctgagttgtccgctcgagaaaagcgcaagattgcggcagcggaaaagaaatttcagcagctagaacacgatcagcaggcgcacaagaagaagaagcgaaacagtggtcaagcaaccctcgtacctcaggcccaggtaagccagtcagcccatcaggctgtatcagcccaaggtcattctcgctcgtcctcttcagcccagccctcaggatccatgtcgaggaagccctccagtattgaagcttctcacgggcggtctccgctgcgacgttcgcactatgtggactcggctattcagacggagcccgaggctgatacgtcaatgctctccgttgcgccacccctacggcggcctagctatgtgcccctcacgcagcggctactcaggcgctgtcatgcagatcgtgttcgcttggaggaagacagtcgaagactgccatcgtcgtctccagctgcgctctcacctctgtcttcgagttctcacggtgcattgggcccgaatgttacacctctcaaaactcccttgatcgagaaagaagacgtggaaatgaaggattccgactcgcctactacggtcgtgtccgccggtcaatcaccgactcaagaaaccgaacaaaaagcatcgactcccccgtcagctccttggatgttgaccaagcctccattcccccctccttggccgtccactgctgcccacaatgctcggttaccaggaagcagggtgaacaatcaccgtacaaatctctgggttcctcttcctcccgctactcaccccgcagggccgactgccatcagtccggggtcggcgacggggtcgacggtgtcatcgccatctaccctggatgcaccagcgcaacctgccgcggcaactccagggtctggggtgactgcgccgagccctgtcaagaagaagcttagtcttggcgattatctcagccgaagaggagcactgaccaccccgacatccgagaagagccaagcgcaagcgactgccatgcttcctccacagaagcctgtttccgatcaatcaaccgcaacccgcgatgtgtctgcgccggtggacacactgcaccctgagatcaaagtgactggagaagctgaagcaactaagcgagaaagtcccacatcaccggacgtgactgtgaaaggcgcttctagttcggggccgacctcacatgttccctcgtctttttctaagcacaattgtctgctggtaacgctcgctgcgcttctgtggcaatttgcgggatctttctttttgttcttccacgttgtctcctaa

SEQ ID NO: 17286 - DNA, 216 bp, A.fumigatus
atgcgtgatggcgactggggaggtatctgtcataatctgacagagtaccccctccacgaacaaatgaaaaacgcgctgtggtgtattgttgggcggttgagggcttcaaataacccgttcagacccaacaggcatgccacctaccaccaaatcgatggttacacgtctttactcagttcttgcccaataatctacaacacttgcggtatagagtga

SEQ ID NO: 17287 - DNA, 240 bp, A.fumigatus
aaaatggcgttcccctacaaaaacgttttcattattggagccacctccggcattggcaaggcgttagccaacaagctggtgcagaatggtattccaaccatcattgccgggcgcaggcagggaaacttggttgacttcgtccagcaacacggcaccgacaaggtcaaatcaaaggtcatcgacgtcttgcaacttgacaaggtatgcctctccacaagattccataatgcatgtagctga

SEQ ID NO: 17288 - DNA, 606 bp, A.fumigatus
atcccccagttcgtggcggatgtgattgatgaaaatcccgaccttgactgcgtgtttgtcaactccggcattcagcgcccgtttgacttcagcaagccggagtctgtggatatggatgttttcgaccaagagctgatcacgaattattcctcggccgtgcgcctcgccaaggcattcattccccacctgcagaggcaatcgactgctgccatcgccttcaccacctcccagatggccctggttcccatgaagcgctgtcccaactacggtgcctccaaggccgcgctgcaccattttattctcgccctccgaacgcagcttcaggatgggcccgggaatgtcaaagtgatagaaatctatccccctgctgtgcagacggagttgcacgacgccaagcaccagcctgatctcaaagacggccatctcataggtatgccactgtgcgagtttatcgaggatgtttggtgtcagttgtgccacggcaaggagcaggtggccgttggttcggcgcgagagatcttcgaggcgtttgagatcaagagacaggaggtgtattatcaaatgacggagatgttatccaagttattgaggcagttcttgcggtag

SEQ ID NO: 17289 - DNA, 678 bp, A.fumigatus
caagatattttcgtttgcccaaagagcatctcaatgctgatgaaatggccttacagaccacgaggccaccgcgcagcagcaaaagccaacacgcatggcaacagatacgatacaagagactcctcctcctcctttgttggtcatcgtccttctagctcggccaactcagtttactccgccgtcagggcttctgaaagttctgcctcattacctggcaccaattcgcagtccccaatgtctgacgcctccatgcttacaccccctgccatcaacagtgctcatgaacctagcttggactcggattcacattacagatcgagacgacagagcctcggcagaccatcttctggcgctgaggatccgaaccgacggtctgtggaaggcatttcagcccgtgctacacccgattacactgagatactgatggaaatgagagatctggaccctcatgatccccttgcgcacgagtggaacaccgatcctttcgaacatgatgcggaactcacaactcactacgtcgagaactacttcacttatgtgaacgacagcttatattatatcttccccagaaggcgtttcctcttgtggttaaggtcgtgtcatgcgaagtcgctggaggacaaaatgcttctttactcaatgatgaccttggggagccattttctcagatcggcctga

SEQ ID NO: 17290 - DNA, 1005 bp, A.fumigatus
attgctttgagatcagctgttccattcatgaacgtcatgtcggcctattatgtgggacctttcgggcgtatgttacctgttaccgaccgaaattctccggagagggaaccagagcgttcagctaacgagccagtatctggaaaccatccctaccaacttcccccaccgcgcacaatggagtctctgcagtttggaacagacccctttctctcccggcgaaatctggaaggaaatggagactcccgactcggctcaagtgctcatggacatcagccagtcataaatgaacagcttccttccgtcagcgagctgttgaccccatcctctcgttccagccaatcggtgtcaccgaatcgctcacggctgttcggtttttaccatcctacaggcgaaagccccaagcccagtcagcccagtcagcgtccccatacgacgagtcgccatgatgatactggcgttccgcgaactcctcaaggaagaccagaggcccgcgcagagcgcttctcgcggccgacggcgggaaatttgccttctctatctcagatgtccgtctacacagccgggaatgaggctagtatacatggcggcattcgtacagatgtcccgcaacaacaagcacacctctctccctttacaccccagggtcgtgtgagccatgataaagaaataagggaagaaaattcattacccgggactcacgagattggaagcgcggctgcagatcaatcaaagatggcccaagtccgtcctcacgtggtcgacgagcggtatatagagggtgaaggctggtgttacatctacgctgacgggtcccattgtcccaagaccattgacggtgtgcctgtgaatgcgaattggggtgtaactaaggctggaaagccgcgaaagagattggcacaagcctgccttacctgccgggagaagaagatcaagtgtcaacctaacctgccaaagtgcgaccaatgtcagaagtcgggaagggagtgccggtttgagagcgcgtaa

SEQ ID NO: 17291 - DNA, 201 bp, A.fumigatus
agaaaagagaagaataagaaaagaaaggaggaacacagtggagagtctaacggaaaatggaacagagagagaaagaggatcattaagaagaaacacaagaaaaattccgacactctggtcattccggctgcgattagttcctcgctcactgtcctgcttggacacggagtctaccaacaaacgactttttccttcctctaa

SEQ ID NO: 17292 - DNA, 252 bp, A.fumigatus
acgtcatgtcggcctattatgtgggacctttcgggcgtatgttacctgttaccgaccgaaattctccggagagggaaccagagcgttcagctaacgagccagtatctggaaaccatccctaccaacttcccccaccgcgcacaatggagtctctgcagtttggaacagacccctttctctcccggcgaaatctggaaggaaatggagactcccgactcggctcaagtgctcatggacatcagccagtcataa

SEQ ID NO: 17293 - DNA, 420 bp, A.fumigatus
cgtgaagacactcagggtcccgacggtttctacctctttctttccccctctcctctctcctcaattgaaagttcagactatcgcgtcggattgcgaccgagtgaagtccggtattgggacgtacggccaaggaaacctgttatcaactgctctgctggtcgcgactccgacagtcgccttacgctagtcaacatgggtggacaagtttcgaagatgctggggaagatattcggcacgaaggaaatgcggattctgatgctgggtttggatgctgcaggaaaaaccagtgagtttcagttacgaggaagactaaatggaattgcctggaagctcaccagcgtcacccgcagctatcctctacaaactaaagctcacgaatcaggatgtcaccactattcctactgtcggtttcaacgttga

SEQ ID NO: 17294 - DNA, 258 bp, A.fumigatus
atggaattgcctggaagctcaccagcgtcacccgcagctatcctctacaaactaaagctcacgaatcaggatgtcaccactattcctactgtcggtttcaacgttgagagcgtcacctacaagaacgtcaaattcaatgtctgggatgttggtggacaggacaagatccgtcctttgtggagacactactactcgggtatgaaccgtcacgtttggtgcaatatctcgtctattagggtacttactagcattcggtga

SEQ ID NO: 17295 - DNA, 291 bp, A.fumigatus
cagacgacgcagcattccgacttccgctcttatgtgccgcatggtttcattttcttccccgtcttccattttcgctcttctatttcctttttctccatgatatccccctctgtttctgtgcgggtcattcatacatacccttttactaataatccacctgtcgtcctttgtacctctgactgttcaagcgccattcttgtcgaatacatctgtttccgtgactttccgtgtagaaagaacccaaatagatggcagatttggactagcacatacaatggaagtttacagtga

SEQ ID NO: 17296 - DNA, 414 bp, A.fumigatus
aaacttcctcttgttttggagatttggattacatctctgactcagttgatttatcggtataagtcaagtcaagccaagccaagcacaacaagcgccccagctacatcatactccacaggtcataatgcccgactacagaaaaggagaaaaagtccgctacaagcctgtcggaggtatgtccttcctcagtccatcaaaacaaatggaaaaagatggctagatgctaagctcattcgattaggccccgagtctaaaacctccgaggctgtcggcatcatccgcgaggttgccactgaatcgactcaaatgacgggtcgcaatgtagctgcttcggacgaagagccacggtacacggtgagctactacttcattcagtgtgttgctggcggagctaactggggggggaaagattga

SEQ ID NO: 17297 - DNA, 612 bp, A.fumigatus
accacactaaccccaatgtcaattccagcagccagcccggagctcgaacaatccgtccgccaactctccctccgcgacgatgcccccatcaaagacatcccccgcccaacagtgaagacacccactaggaaaaagaaggcccccgtcgtcgcagactcctgggaagacgaagcagactctgacccttccctgtccgaggttgagcaaagccgttcgtcgtccgcagctacgcccgatctctcaacactctcgccctccgtcagcaccagcacagaagggccgctcgatcctcccccgacacctatctcaccacagacatctcagctctgggggtcgagcgcgcccttaccgggtcgtgggttgagctcgtccccaccgcgagggtcagggtctaggtcgccggcgagaaggccggagaagcagacagctgttgcgggaaggctgattgcgggcgcgttggggatccgggctccaaagaggacggaggagcagcgcgcgtatgatcgggcgataaaggagcaggagcttcgccggcggaatcgggaaagggaggaggaggcgaagagaaaagaggaggaggagagggcgaaggctgctgtttgggatgaatga

SEQ ID NO: 17298 - DNA, 231 bp, A.fumigatus
tcacctatggatagcatcatggccccaaacggtaaacactccaggctgactcgagtagcttgcctaaccaagaattcatacaaagaagagagatgccaagctcagatcaatgctttgtacgagtgctgtaatgctttctaccaagagaaaggagaggatgcaaaaactcccagttgccctaaaccaagcttgctgaagctgaggattaagcagcaatctcaaggcaattag

SEQ ID NO: 17299 - DNA, 192 bp, A.fumigatus
gcaaagccgttcgtcgtccgcagctacgcccgatctctcaacactctcgccctccgtcagcaccagcacagaagggccgctcgatcctcccccgacacctatctcaccacagacatctcagctctgggggtcgagcgcgcccttaccgggtcgtgggttgagctcgtccccaccgcgagggtcagggtctag

SEQ ID NO: 17300 - DNA, 204 bp, A.fumigatus
acctctggcttcgaatgtttttccatggacacatgctcacggatacaggctcaagaaagggccaagcctgacgcttccgccatttatgtcccgggaaaccagacagcaaaggccattgaagaagcgattgaggcagagattccgcttgttgttgctgtagcggagcatgttcccattcatgatatgcttcgtgttagtagatga

SEQ ID NO: 17301 - DNA, 471 bp, A.fumigatus
ggaatgttgaaacctcgtatggctgacctcttgcaggtacactctatgctgcagacccagtccaaaacgcgactagtaggagccaactgcccgagactaatctctgcaattggcaagtgccgtatcggattccaacctttaccgtgtttctcacccgggaaagtcggaattgttgctaaatcagggacaataagctacgagactgtggcatcgacgacgcgcgctggacttggacagagcctgtgtattagcatgggcggagatgtactggccggaaccaatttcgtcgacgcgttaaaggtcttcgaggaggatcctgacacagaaggtatcatattggtcggggagatcggtggaattgcggaaattgatgcagcggactggattcgagactacaacaagcggaccgccaatccaaagtacgcacggtttgaacatgttctggcatatgtgagaactgacactgcctag

SEQ ID NO: 17302 - DNA, 264 bp, A.fumigatus
gaactgacactgcctagacctattatggctcttgttggcggtcgagaggcccttcctggtcgagtcatgggccacgccggcgcttggataactcctggagagccagatgcagaggccaagcacagagctctcgagagcgctggagtgacaatggtcgatcatccagaaaagtttggtcagggtatgaaggcgcttttagctcgcagaaccctgacgagtgctacggtaagtattgttcgatggccctgtgcatcgcgagactga

SEQ ID NO: 17303 - DNA, 354 bp, A.fumigatus
tgtacagtcagagctgaccagatagtcaatggcgccggcctagcgatgaacaccgttgatgccctgtccatccacggcggtcactgcgccaacttccttgacacagggggcaaagcaacgtccgaaacggtcaaatcgtccttccgaatcattcgatcagatccacgggtcaaggccattttcgtcaacatcttcggcggcctaactcggtgtgacatgatcgccgaggggatcatcatggcctttcgggacttggaaatgaacgtcccggtggtagtacggctacgggggacgaacgaggagatcgggcagaagatggtcagtctagttcctgattatggtatacttgactaa

SEQ ID NO: 17304 - DNA, 285 bp, A.fumigatus
ttacccgtcagcatggccgacaacggaacaccaagcgaagcccccgccccgcccccggttgagcacctcaacatcaaggtcaccgataataacaacgaggtcttcttcaaaatcaagcgcacaacacagctgaaaaagctcatggacgccttctgcgagcgccagggaaagcagctgtctaccgtccgtttcctgttcgatggtacccgcgtgcgccccgaagacacacctgactctgtacgtgcagctttccctctgtctgatgtctacgcaaacatagactaa

SEQ ID NO: 17305 - DNA, 255 bp, A.fumigatus
gacaccgcatccaaacatatgaaacccaatatactcattcatcccaaacagcagccttcgccctctcctcctcctcttttctcttcgcctcctcctccctttcccgattccgccggcgaagctcctgctcctttatcgcccgatcatacgcgcgctgctcctccgtcctctttggagcccggatccccaacgcgcccgcaatcagccttcccgcaacagctgtctgcttctccggccttctcgccggcgacctag

SEQ ID NO: 17306 - DNA, 594 bp, A.fumigatus
aaccgttttttgcgttcagattttattttgaagattcaacagacaagggcttgctttgcagcgctagctctactgctgttgttgcttccaccggggaacccatttctgaggggcgggggaggcctcaggcttgtcggagctggcaggagcggcggcggggggagtctgtgtgcgggaggggggttgggaggagctggattcgcgcatgtgacggggaacgtatttctcgggggcaggaccattcgagggaggagtagcgggcgaggcgttggctccagagcggaggtgaggggggacgtatccgccggttctgcgaggaagctggacctcttccttaggtgcctccgcggcggcaggggcaggggcagcgccggcagcctccttggcagcctggcgctctctccagctagggccactgccagtacgagaaacgaggttaaggcgaggagctgtccgctcaacgggccgctcgagctcagcagcacgggtgggaggttctgcgaggccagactttctagccgcacggcgagcctcggcttcctcctcacgctgcttctgccgctgagcaatctcgtcgagtctcctgtattgtaa

SEQ ID NO: 17307 - DNA, 2205 bp, A.fumigatus
tcgatacgcttggcagctggtgcggatgcgctcgttgagctcgttcttctccttctcgagctgggcaagcttgatggcgcgcagccggttggcatccaggtcctccaggtcaatctcgctgatgtcgatgcccttgacaccactcttaagctcctcaagctgcttcttgagctcctgctggcggatgcgctcctgttcatccctcagacgcttcttttcgcgttcccgctgctcgtcaagcagtctctgcttctcagcctcttgcagctgctgattacgaatacgcttgcgggtctcctcctctctctgcttgcgctgcaaagcatcggtggcagcttccttcttcttctcgatgaggacacggcgggcaagggtctcctcgtgctccttggcagcaccagcctcggcgcgggcctgggcagccttcttggcctggatacgggcctcgttataagaaggatcgacgtacatgcatgtgacgtgcagggtcttggcgagacgggtgagctgcaggcgggcgatttcagcaggggtgttctgaagacgctgcaccgagccgacctcgctctcagcagaaccggcggcgctgccggaatgcagagccttggcggaagagaagatatcggtgtcgaaggtcaaaacacctgcagtatggtcgacgcggatagcgaggtcgcccttcttgcatccgttcatgatgaacttctcgatcatggccggggtgatctggaagggatcggggaactgtgcaagctcgtagacaaacttgagctcgacggattcgtaaacctgggacagctgctggaagagacgggtgaggatgacctgctgcaggggcaggacgtacttctccatctcgggatcggcaccgatttgcttgaggatgggggtgatcttcttgcagatggaaagagggtggaagtcaacctcgaggatgttgtagagatcccgaatttcaggacgagcacgcttgagcaggcccttattaagagcatcccggaaaagcaccgcacggctgggtggctgagccataccgagcaggttggtcagacgggcattcttgttcttgcgggcctcatcgacatcgaccaaggcgcctcgagagcgggaggtgctgatgacggggatcgacagagcagacagaaggacaaaggaagcggccttggtcatgtcagcctcggtcaccgaggggttctccttcttggtgccctggcctgcggcgagcgcagcggcggactggcggagaaggttgtagtagcggttccaagcggcggcatggaaaagatagttctcgctgacgaggaagatccgtgcaagcttttcgtagtaattagccatcatgacgttcttggcggggcgcttgctaaggctgagaagagtgtgaatgtcttcaatgctgcggaaagcctcctgccacaactccagctccacggcaacattcagctgctggaagcgggtgtcaagatggcgctgcagggtgtcgggatcgctgaggttgatagcgtgcatctgagcggagtacttggcggcgttctggacgtggttacggagcagctcgcaaagacggcggaactcggtcttgcgggtgtacttgaggcaaaactggaaggcttgcagggcggtggtctggtacatgacctcaaggcgagcattgttcttcaagatctccaggacggtacggtaggtctcccagagaaacttgagccacggagtgacaacagcgcggtcggttcggtcgcgagattgttcgccagaaacagtagcaagcaagatggtctcgggggtctcgatcgcttccagatcctcgacgttggacgatggggcagcggactccagagaggactggatctcgtcggccttggcctgggcctcggtcaccttcttctcggcgagttcgatgaacttcttgaggacgacctatttagcagcacaaatatcagccgctgcaaatcacatcacaaatcagaaaaagttctgagcctacctcgatggttcccacgttggtgttctgggcgatgttcttgtactggtagagaccatccttggcagcctttcctttgccaaagatcgacacacaattcaacgaaaaggagcatgacaggttcgagagaggcgatcgggctgctccgcgtcctcttagaggtgacatgttcgtggaggacattgagggcggcgggagcctggcccacggcgataagttcctga

SEQ ID NO: 17308 - DNA, 207 bp, A.fumigatus
taccgtcgctttcagcagaagaactatggcttccacactgttcaaattttaaaattagaccattgtcggggcacccccccattgctctcagcgggttccactatctacttttggagtcagtacgggagcacccaaaagttcatcccacacaagtccgaaaatgggctggttcttgccaaagtgggaccttggcttaaccattcttaa

SEQ ID NO: 17309 - DNA, 276 bp, A.fumigatus
ccttgtgttctctcactgcagcgggctcaggaacttatcgccgtgggccaggctcccgccgccctcaatgtcctccacgaacatgtcacctctaagaggacgcggagcagcccgatcgcctctctcgaacctgtcatgctccttttcgttgaattgtgtgtcgatctttggcaaaggaaaggctgccaaggatggtctctaccagtacaagaacatcgcccagaacaccaacgtgggaaccatcgaggtaggctcagaactttttctgatttgtga

SEQ ID NO: 17310 - DNA, 1233 bp, A.fumigatus
gggatgaacaggagcgcatccgccagcaggagctcaagaagcagcttgaggagcttaagagtggtgtcaagggcatcgacatcagcgagattgacctggaggacctggatgccaaccggctgcgcgccatcaagcttgcccagctcgagaaggagaagaacgagctcaacgagcgcatccgcaccagctgccaagcgtatcgatcacctggagcgtgctttccgtcgcgaggagttgaagcacattcccgaggactacgaagcccagaagaagcgtgacatggagctttacgaggccatcaaggccgagactctaaaggaagccgaggagaagcacaaggaggcggttgcccttaagcaccgtctcagccgccttgttcccgtcttctccagcttccgcaaggaggtgtcggagaagcgccacgaagagtttgagaagcgccgcaaggccgccgagcgggagtttgaggccaagaagaagcagcgtatcaaggaagttcaggagcgccgccgtcgcgagagggccgagcgtgaggcagaagagcgccgcagaaaggaggaagaagagcgggccaaacgcgaagaggaagaacgtatcgccaaggaagaggagcgcagacgcatcttggctgaagagaaagccaaacgtgaggaagagagaaagtctgtgtctcccccagttctatcaatttgtcctaatggtactaacttacaatacaggagactcgacgagattgctcagcggcagaagcagcgtgaggaggaagccgaggctcgccgtgcggctagaaagtctggcctcgcagaacctcccacccgtgctgctgagctcgagcggcccgttgagcggacagctcctcgccttaacctcgtttctcgtactggcagtggccctagctggagagagcgccaggctgccaaggaggctgccggcgctgcccctgcccctgccgccgcggaggcacctaaggaagaggtccagcttcctcgcagaaccggcggatacgtcccccctcacctccgctctggagccaacgcctcgcccgctactcctccctcgaatggtcctgcccccgagaaatacgttccccgtcacatgcgcgaatccagctcctcccaacccccctcccgcacacagactccccccgccgccgctcctgccagctccgacaagcctgaggcctcccccgcccctcagaaatgggttccccggtggaagcaacaacagcagtag

SEQ ID NO: 17311 - DNA, 255 bp, A.fumigatus
aatttgaacagtgtggaagccatagttcttctgctgaaagcgacggtatcagaaagattggacatttgggggtcattgaaacagatcgagaatgtgtatcatctcgagtctacatacatccatctacgatttgatgcttttctgatgtatggactgtccatgttgaagtatctcacgtggacccctcatcagcggctggaatgtaagaatgtatcagaactgtccttaatgtaccttacaatacggagtacctag

SEQ ID NO: 17312 - DNA, 951 bp, A.fumigatus
aggaagccgaggagaagcacaaggaggcggttgcccttaagcaccgtctcagccgccttgttcccgtcttctccagcttccgcaaggaggtgtcggagaagcgccacgaagagtttgagaagcgccgcaaggccgccgagcgggagtttgaggccaagaagaagcagcgtatcaaggaagttcaggagcgccgccgtcgcgagagggccgagcgtgaggcagaagagcgccgcagaaaggaggaagaagagcgggccaaacgcgaagaggaagaacgtatcgccaaggaagaggagcgcagacgcatcttggctgaagagaaagccaaacgtgaggaagagagaaagtctgtgtctcccccagttctatcaatttgtcctaatggtactaacttacaatacaggagactcgacgagattgctcagcggcagaagcagcgtgaggaggaagccgaggctcgccgtgcggctagaaagtctggcctcgcagaacctcccacccgtgctgctgagctcgagcggcccgttgagcggacagctcctcgccttaacctcgtttctcgtactggcagtggccctagctggagagagcgccaggctgccaaggaggctgccggcgctgcccctgcccctgccgccgcggaggcacctaaggaagaggtccagcttcctcgcagaaccggcggatacgtcccccctcacctccgctctggagccaacgcctcgcccgctactcctccctcgaatggtcctgcccccgagaaatacgttccccgtcacatgcgcgaatccagctcctcccaacccccctcccgcacacagactccccccgccgccgctcctgccagctccgacaagcctgaggcctcccccgcccctcagaaatgggttccccggtggaagcaacaacagcagtagagctagcgctgcaaagcaagcccttgtctgttga

SEQ ID NO: 17313 - DNA, 1992 bp, A.fumigatus
gtcgtcctcaagaagttcatcgaactcgccgagaagaaggtgaccgaggcccaggccaaggccgacgagatccagtcctctctggagtccgctgccccatcgtccaacgtcgaggatctggaagcgatcgagacccccgagaccatcttgcttgctactgtttctggcgaacaatctcgcgaccgaaccgaccgcgctgttgtcactccgtggctcaagtttctctgggagacctaccgtaccgtcctggagatcttgaagaacaatgctcgccttgaggtcatgtaccagaccaccgccctgcaagccttccagttttgcctcaagtacacccgcaagaccgagttccgccgtctttgcgagctgctccgtaaccacgtccagaacgccgccaagtactccgctcagatgcacgctatcaacctcagcgatcccgacaccctgcagcgccatcttgacacccgcttccagcagctgaatgttgccgtggagctggagttgtggcaggaggctttccgcagcattgaagacattcacactcttctcagccttagcaagcgccccgccaagaacgtcatgatggctaattactacgaaaagcttgcacggatcttcctcgtcagcgagaactatcttttccatgccgccgcttggaaccgctactacaaccttctccgccagtccgccgctgcgctcgccgcaggccagggcaccaagaaggagaacccctcggtgaccgaggctgacatgaccaaggccgcttcctttgtccttctgtctgctctgtcgatccccgtcatcagcacctcccgctctcgaggcgccttggtcgatgtcgatgaggcccgcaagaacaagaatgcccgtctgaccaacctgctcggtatggctcagccacccagccgtgcggtgcttttccgggatgctcttaataagggcctgctcaagcgtgctcgtcctgaaattcgggatctctacaacatcctcgaggttgacttccaccctctttccatctgcaagaagatcacccccatcctcaagcaaatcggtgccgatcccgagatggagaagtacgtcctgcccctgcagcaggtcatcctcacccgtctcttccagcagctgtcccaggtttacgaatccgtcgagctcaagtttgtctacgagcttgcacagttccccgatcccttccagatcaccccggccatgatcgagaagttcatcatgaacggatgcaagaagggcgacctcgctatccgcgtcgaccatactgcaggtgttttgaccttcgacaccgatatcttctcttccgccaaggctctgcattccggcagcgccgccggttctgctgagagcgaggtcggctcggtgcagcgtcttcagaacacccctgctgaaatcgcccgcctgcagctcacccgtctcgccaagaccctgcacgtcacatgcatgtacgtcgatccttcttataacgaggcccgtatccaggccaagaaggctgcccaggcccgcgccgaggctggtgctgccaaggagcacgaggagacccttgcccgccgtgtcctcatcgagaagaagaaggaagctgccaccgatgctttgcagcgcaagcagagagaggaggagacccgcaagcgtattcgtaatcagcagctgcaagaggctgagaagcagagactgcttgacgagcagcgggaacgcgaaaagaagcgtctgagggatgaacaggagcgcatccgccagcaggagctcaagaagcagcttgaggagcttaagagtggtgtcaagggcatcgacatcagcgagattgacctggaggacctggatgccaaccggctgcgcgccatcaagcttgcccagctcgagaaggagaagaacgagctcaacgagcgcatccgcaccagctgccaagcgtatcgatcacctggagcgtgctttccgtcgcgaggagttgaagcacattcccgaggactacgaagcccagaagaagcgtga

SEQ ID NO: 17314 - DNA, 480 bp, A.fumigatus
ttagttgccactgcgacaacctgcgagcgcagccgtgatcccagcctccagaactcacctgctgcattccagtttgcctcgtccgatgacctgaactggttctccacgcataactgcaccacaattgacgatgatatcactctactggagagcttcaatggatcattttctcttcccgatgtcaccagtattcgcggaatcatcacctataccggccctactgagacgtttaaactcacgtcgatctcgctgccggacgtgctgtacctaggtggcatgaacgttgatctcccaggtagtcaaaagatcataaatgtatccgcaccgaaagtgacggccatcgactcgatcaatttggccgtaccttcaaccgccgcgatagactttcggtcgttgaaacaagcgacgagtatctcgctaacggggaactactccaggtattcagtctgttcctgcaatgtccagcagacaccggactaa

SEQ ID NO: 17315 - DNA, 216 bp, A.fumigatus
gctggctcttatagtacacatcaaacctactatcacagcaatgagtatgctcctcaggccaaccctactacctatatatataaccaagggaaaggcgacggtcgagcagtatctccttctccagacatttcattcgtgcttgcattgtgtcaaagattcacgacttgggatctttacagaatcaccatctatagcggggcatcttgcggtttgtaa

SEQ ID NO: 17316 - DNA, 198 bp, A.fumigatus
cggtccggaggcccgtccgaagagaacatgaccatggatggacaagacaagactgaacaggccgatgactacagatccgtctccgaactaggctacgtagtagtatatcactactgtgtatggagcaagtaccctcactctcggcttccccgcctttttgcccttctggccagggtggaatttttgtcctggaattaa

SEQ ID NO: 17317 - DNA, 2214 bp, A.fumigatus
ggacgcgtatccttccagtcccggtcggtgaagaacactgccttggagaacaacggccttgaggacattcgccggggcttggacaatcttggcagcacagggtggaccatcaatcgcgaggtcctcaatgttatgctcgaagcatggaattctggagaggctgtcgcaaaccttgctcctctagaaccagacctaccacttccgccaaaaccagctcctgaagcggggtatcacgctgaaaaggaatgggatactctggtacgcgaaattgaaaacaggagatctgggctccactcgatgcgatgtttccaaaatttccaaatggaacttgctcgtgcgtacaggaatgtcaccttttaccttccgcataacatggacttccgcggtcgtgcttacccacttcctccgtatcttaatcagatgggtgcagacaactccagaggtcttctgctgtttagcgaggcgaagccattgggagccagtggtttgagatggttgaaaattcagatcgcgaatctttcgggttttgacaaggctagcatgtctgagcgtgaacaattcaccatggatcacttggacgatgtgcttgactcggcggacaagggtctacacggcagacgctggtggctcaaggcggaagatccctggcaatgtttagctgcctgctgtgaattaagaaacgcccttcgccatccggatccgacccagtacccgtcccgcttgcctatccaccaggatggttcgtgcaatgggctgcagcattacgcggcacttggaggtgatagcgtcggtgcacagcaagtcaatctcgaaccatccgatcgcccgtccgacgtctacaccggtgttgccgagttcgttaaaaaagaagttgcgcgggaggcggcccagggccacccaatcgctaagatcctcgacggaaggattacaagaaagattgtaaagcagaccgtcatgaccaatgtgtacggtgtcacgttcatgggagcgatgagacaggtccgcaagcagcttatcgaccattaccccgacctgtcttacgaggataaaaagaatggatcgttgtacattgcccggaaaatcttcgaagctctgggtacgatgttcaacggggcgcatgaaattcagcactggcttggagactgtgcaagtcgtatcacaacctcactgtcccccgaacagattgagcaaatcgcgaaggaggctttgacgccttcttcttcaggtagatctgcagcaaagctcaaggatccatctgagaagtttaggtctacagttatctggaccacgcctcttggactgccggtggtccagccgtaccgcgtgcgaaaggctcggcgtatcaccacaactcttcaggatctgagtatcgtcgatactaattcggaagacgtcgtttcgaagcgcaaacagttacaggctttcccgccgaatttcatccactctcttgatgccactcacatgatcatgtctgcaaacgcctgcaaccaagccggcttgaccttctctgcagtccatgattcgttctggacgcacgcgtgtgacgtcgataccatgaaccagatccttcgggaagcctttgttcgtatgcactcggacgatattatcaggagactcgcttctgagtttcaggttcggtatgggcagaacctgttccttgcgaaggttgacgcgggtacgaagattggacgtgcaattcgtgacttccgaaaaggcgggaagaagaagtcgggaaaggttcaggagcttttggacgagtacaagagacagcagcttttgaggtcggacgatccagagttgcaagcgcagggtcgtgccatggtcacagctggtagcgtcttcgaacagcttggtggaactgataaagatctggcaattgcgagctcactcggtgaatcagcggtggggcatataccagaggatttggctgcagcggagcggaagacgcctggactagggattgatacgtcggatcctgcgatcgagagcttgttttcggactttcaggacctggaaccgaggggcggtgaggctgacaaagccactggggccgagctggaggatgaaatggtggcagaagacggtgcagggaagaagaagaaaaaggttcggcagcatgtgtggctttggctacccctgcggttccgggacgttcccgccaagggtgcctgggatctaacacggatccgagacagccagtatttcttttcatag

SEQ ID NO: 17318 - DNA, 195 bp, A.fumigatus
tctctctcttcccccccccccccattcattcattcattctttttttttttctttatttatttttattattattatctaatttcagccttttatcctttcccttcgcttttccttttcttgctcggtttgttgcatctttgctttttgtcctcgtggttcttagtgcctctctttttcctccaggaagcgctatag

SEQ ID NO: 17319 - DNA, 297 bp, A.fumigatus
gtttggcggaagcgccgtgagtatgacaagactgaacgtgatgacaggttggatgatatcgaggactcatcgcccctacgttgtggacgatccgccacgcacacggtcttcggagttggacacaggatcaactccgccagtttcctgttgattcaggccgctggtcaagttcgacgattggatgactctcaatgcatgaacattttcatggacgaatgcggcgtcctttctgtggtcagagctttgatctgtattggacgcgacagggggagtgtccctaggaggactatttggtga

SEQ ID NO: 17320 - DNA, 261 bp, A.fumigatus
tggctaccgcggcgcagagtatcgattgacagcaactccatgatcaccctggctcgaatccgtttggttccaagggttgagcgcaccgtctggcattctgtctcatccagaacgatgtcatttgctttgatgttcaattatgctattgccaatcttcccaatcagtcaacaaagaaaggtatacatactaacgacttggttgctgactctactacatattacatgaacgcatctgctgcccatcagtcccgtcagtgttaa

SEQ ID NO: 17321 - DNA, 471 bp, A.fumigatus
tggatcagtgtccctggagcattgatggctcaagtctatttcatacacagcacaatcaactcatctgatgccacctccgagacctggccggtcactgttgcctcccagttggtgcagtgcctgagcatcgtgacggccagcgcaccgcagtttatccccttcctcaagcaactccaatcaactggcatgagactcgacggcatgactcgctacacgctgtctagccatcataaatcgtcccgcggcaggtactacctctccaccgatcgaagacgcaccggcaatgagtccactcatgaactcgacaatattcctttggcaacaaccaaaacggtggtgacatcgaatgcgaatggtctagaagaggaccatgataacgagagtcagtcaagccagacaggcatcatccgtgagactcggacttggacggtgacagaggagcatacatgtctgcccggccacaacggatga

SEQ ID NO: 17322 - DNA, 531 bp, A.fumigatus
taccgagcaccacgcacttcattctttttgaggatccggtcaagctcacccatttcggtgtccgatagacggggaacaccgtgcaaattctgcgtaaccttgtcgctcgttgtacccccagggatcggaatgatggtaggcatacctggcttgccgctcagggtcagtatccaggccaaagcgatctgggcgggtgcgacgcccttgcgagaggccaggtccttgacctcgttgacaagcttgatgttgtgcttcattgcgtcctcctggtacttgggcagtgactttcggaagtcgccctcggggatctcagatacgctagtgaaagcaccggccagcactccgcgacccagaggtgagtatgcgacgaggggaatccccagttccgcacaggtctcggccacgccgtcgttcagggtgtgggtgtcccagagagagagctcaatctctaccgcggcaattgggtggactttgtgtctgtttccggtcgtcagtaacagcgtagaccaagcactagcaactcgaaagtag

SEQ ID NO: 17323 - DNA, 213 bp, A.fumigatus
cgatttgttgcatcattcatggtccaccccacatcggatgccgaccctgacggacttagctgtcttatcaccggcgtcaccgcaagacctaacggagcacacacagtgcctctctgtccatcttctacctatttctatgagttagccgggcgaaggggcggttatcgagaaggcgaaatctgtgattaccctggtttctcgctgtccgactga

SEQ ID NO: 17324 - DNA, 735 bp, A.fumigatus
cgcccgccatggaatggggtgccggacccagttccaaattggcccagaatttggactttggtgataagctcttccctggaggagcatcgggtcgagaagaaaaatgagcgcgcgaacccggatgataagacaaccaaaacccctggagcggttcatctggttcgccgggtcgagtatttgctgtcagtgctgagggacaagttgaccaacggcaccaatgcttctgccaggagggctgtcgagaaccatcatcgcaatcatcggagcaccgctcggaccaacgtgagtgccagcgtctcggcttcgcctgcgccgtctatcccacgcaagggtcaccgtgaggccgaccgttcaaggcaccgttctcaaacccatggtgcccgtgacagtgtggagcggaaccacactccaggtcgggattctcgcccaaagtccgtccaggagaatgaccgtcgtcgcaaattgtctgacgcctcgagcgaggatatccgtcgtcgtaaatcgagtgagcgtaaatctagcgataacggcaattccgacgagatgcttcgtctcttgttcaaacctattctttcgtctctggagcgagtctctggtttgactagggacagcatgacaagcaaagcacgccgcgcctctgagttgcgcaacctacttggctacatcggcggattcattcggaagactctcaaaggggagaattacatgccgtcccttgagattcgcttgtggtga

SEQ ID NO: 17325 - DNA, 729 bp, A.fumigatus
tgcaacaaatcgttattaatgttcttcaaattgaccgagggccgccgaagcataaatacatctccttttctaatcttttgcgtgagtcaaatcgctgaattacatctaggtgcacatacaccggtaaaaagaaaaagaaaaggaaaggaaaagggaaagaaagatgccgtctctcgttggaaaagaagtcggccctacggggtacggcatgatgagtatgtgatcaattcgcgtctctacactcaattgaatcctctactgaccaggacaggaatgacatgggcccctcaacttccctctgaagagaaatgcttcgaaacactaaacacggcgctcgccctgggcgcgaacttctggaatggcggcgagctctacggcaccccggagtataactcgttgcatctgctgaacaagtacttcacgaagtaccccgagaacgcggacaaggtggtgctgagcatcaagggcggcctgaagcctggcgagcttgttccggatggttcggaggaaaacattcgccgcagcgtggatgagtgtctacgtgtgttggacggaaagaagacgattgatatcttcgagtgtgcccggcaggatcctaacacaacggtcgagcagacggtgactatcctggctcagcttgtcaaggagggcaagatcaaagggattgggctgagtgaggtgaatgcggagacaatccggcgagcgtacgttctactttcgagttgctag

SEQ ID NO: 17326 - DNA, 636 bp, A.fumigatus
cacttccctccagaatgcgaccgcagtttcacccgttcagacgccctcgccaaacacatgcgaaccgtccacgagacagaagccctccgaccctctgaccccgtaccgaaaggccacaatgtcccagcctctgcagtgggaacccctaccggaacccccgtcagtaaactccagcgcatcagactgaagctatcgcaaccgaaggacgagacagaccggctcagcgagatcgccaacgatgacgcagtcgtcgccgaggacctcgacgagctcgaactccctgagttcggtcctgagatcgggttcgacgagcacgagctccagctccggccttacgatctctaccggctgcttcgtcggcagatccactgggccgagaaggaaggccaggagctgaaggaggaatgggagaagattagaccgaagaggaagcaggcgtggctggagaaggagagcatcttcgacgatgtcatcgacgccgaactccgcctgttcagcgccattgtggccacggagggtctcccaaccgaatcaggtaatgccccaaacggtgtccagaaagtgcagcaaggacatctagcggtggctgaagcagaagcgagtctgagccgcgactcgatgtccattcctccatga

SEQ ID NO: 17327 - DNA, 537 bp, A.fumigatus
ctccacatgtcgcagtcgacgcggtcatcgatgctcctgagcttcttcctcgtgaccatcctagccctatcctctctggggtcggctcgtcccatctccaagtcaggaaatggcttgtcaagatctggtatctattcgagatctgctagtcctagtcccgtacgtccctttcaaccccctatacttgctaccggtcgactaacagatttgcagagagtaatcccttcgagcggagaataccgcgaaaagctcatgaagaatatcttcgactcactcggtctcagcgccttgaacaagctagacgactggaagaagaagctggaggactccgatatcatcgacgacagcaacagtcccagcagcaccgtcacagaacagaacaacgcctccatcgtcgacgaatccacgaatgactcaaatgacgaagagaccgagaacactccggccacggtcgatatcgtggatgatatcctctccacaatgatcgacaagttccacgaggcattcctcactcaggatgaggttacactgatttga

SEQ ID NO: 17328 - DNA, 564 bp, A.fumigatus
atgcggagacaatccggcgagcgtacgttctactttcgagttgctagtgcttggtctacgctgttactgacgaccggaaacagacacaaagtccacccaattgccgcggtagagattgagctctctctctgggacacccacaccctgaacgacggcgtggccgagacctgtgcggaactggggattcccctcgtcgcatactcacctctgggtcgcggagtgctggccggtgctttcactagcgtatctgagatccccgagggcgacttccgaaagtcactgcccaagtaccaggaggacgcaatgaagcacaacatcaagcttgtcaacgaggtcaaggacctggcctctcgcaagggcgtcgcacccgcccagatcgctttggcctggatactgaccctgagcggcaagccaggtatgcctaccatcattccgatccctgggggtacaacgagcgacaaggttacgcagaatttgcacggtgttccccgtctatcggacaccgaaatgggtgagcttgaccggatcctcaaaaagaatgaagtgcgtggtgctcggtactag

SEQ ID NO: 17329 - DNA, 990 bp, A.fumigatus
gagggaagaggggagatttgttattgtgcgggtttttctttggttggaatagcctcatcacgtgttgctcgctgcaagtatactcgaatcaaacatcagcaaccctccgcaaatgtcgccattgaagcgttatcggcagcagctttttatccacttcgacatctatcctcagcctctacatcactggcgttggcttcaacgcctatcccaatgaccgaatctcccggctcccccctttcctcaattgcgtccgacgaaatgtcggatcgcgaagacctcaagcatcccttctctccatcagcctcaaccctgcctccatccaagcgccgtcgcaccggtgtcgcgtcatgggatcgcaatactccactctcaaccacatttcaagaagatctcccaccgacctccccctcgacctcgatctcgtccgatacctccggcgacatccccaattctcccaccctcctggccctcataggcggcagccaggatgacgactacagcggccagggcaatgaccaggttaccgtatgtcggtgggagggatgcaacgtaggggatctcggcaacatggacgatctggtccaacacatccacaacgatcatgtcggtaaccgacagaagagatactcctgcgagtggtccgactgtcctcgaaagggccaaacacatgcgagcggctacgcactgcgcgcacatatgaggagccatacgcgggagaagccattctactgtgcgctaccaggtgagcacctgtcgtcctccctcgttcctgcttgccagaatctccatttgtgcgacgctaacacttccctccagaatgcgaccgcagtttcacccgttcagacgccctcgccaaacacatgcgaaccgtccacgagacagaagccctccgaccctctgaccccgtaccgaaaggccacaatgtcccagcctctgcagtgggaacccctaccggaacccccgtcagtaaactccagcgcatcagactga

SEQ ID NO: 17330 - DNA, 204 bp, A.fumigatus
  unsure (163): Identity of nucleotide sequences at the above locations are unknown.
gcaattggttcccagattcttcttcattcagcatcatcattcatcttcatcatcccattctcctattctccattgggcgagatcaattggatcgtcaagacatcggttttttacatcaccggaacaccccccaagaatttagagaatctccatctactcagtngctccacatgtcgcagtcgacgcggtcatcgatgctcctga

SEQ ID NO: 17331 - DNA, 510 bp, A.fumigatus
tttactaaatatatacattcagatcatgtttacctaatttgcgaacctcctggagagccgtactaccttgctcgaatcatggagtttcttccgtccaaggataaacccaatggacccattgaagcgctgcgagtcaattggtactatcgacctcgtgacattcatcgcatcgtcgcagacacaagacttgtcttcgcttccatgcattccgacacgtgtccgcttacatcattgcgtggaaagtgccagattaagcatctgtcggaaatagacgatttcaatgcgtatcggaaaaccagggactcgttttggtacgacaagatgtttgaccggtatatccatcgctactacgaggtcgtccccaccaagaaagtgatcaatgtaccggccaatgtcaagaaggtcctcgatgaacgttggaagttcatcctagtggagataggaaaacgaaaagaactgtttagtgcggttaaaacctgcaagcgatgcggtttgtacgctgctaggtag

SEQ ID NO: 17332 - DNA, 831 bp, A.fumigatus
gggctggtcatggcctcggacaggtcgccgccccagaagcaatcgcaacagcaactacacgtgaagtctacctcaccgtcacatcgtatgcctacttctggtcaaacatcccgaaggggatctgcggattcttccaccgcccaaggcaacgccaccgcgaatgaatcattatcgcaacccatgacggccagcgcaacaccttcagaggctgcgggtacggagccgcccagcacctccgccactcctgcgccgtatggcactcggtccaggggtcgcaatgcgcctcgccccaactacgccgaagatcgcgacattgacatggacctcgaactgcttccaccttcagcacctaaatcatccaagaaaagtagtggtacagctgccactagcactactaatggtgtcaaaccagacggcgagaaagcttcatcgtcatcgaattctcgaaagagcctaaccgcagcgagtggacctaatgccgcaaccgccaaggacgcgattcctggcacatcttctttttctgcgaagccagacgattcaggcggatcctcgagctcgtcgagaaaacgtaaacaaccggcgagttctacaaactcgaattccacaaacggaaatgcggccaaaaaaatctttaccgctgcgccaagcgcggaccccaatttgcctgagtccaacatggtgtcttttgagaacactggtgcctacctcaaggatggcaaattaattgccgatgacggcacaacgttcgctgtgaacggtaagtaccttcaccatagccagtgtcttctgtgtgatttactaaatatatacattcagatcatgtttacctaa

SEQ ID NO: 17333 - DNA, 3045 bp, A.fumigatus
gaaaacgaaaagaactgtttagtgcggttaaaacctgcaagcgatgcggtttgtacgctgctaggtaggtgtttcattgataaagtcataagatcctttgagcttaccactgactcatcttatagcaatgactcagttgattgcgctgtctgccacaatacttatcacatgtactgtgtgcgcccagttctcaccaaaaaacccgcccgagggtttgcatgggcctgtgcaacttgcagccgtgcacaggaaaagaaacttgaggcccgaaacacgcccattatcggtgaatctccagccgaagccgaggaagaagttgcggaagaagaagaggaggagccgaatggtcttcctagcgataccaatgtcagtacgcctgccccggcggaggaacatcctcgtccggcgacgaaggaacagattgcccaggcccggatgtggccctaccgttatttggggattcattgtcgggtggaagatgcgcttgattacgatgaccgcatctatccccgagccagttctcgactgggaccacggcatcaagcgattgtcaatccatggcctggccgcccagtcgagtacgccaagccgattgatatcaaaaagaaatatttgagtcgctctggccgcaaagattcgaagctttcgaaagaggctcaggcggctattgaagcagcgaagcgggaaatcgcaagccgccccaaatgggtcatggatgaaccggttggatacgtgcgacgcggcgaggacgaaccagttctgataaacggcaagccaactcgtactgccgaagtcctgtttaagatgcccactgcaacgcagatcccgaaccgaggcgaagatgatgcgcctggagcggagctcagtcctgctgatcgagagaaattcatcgacgattatatggaacgggctaaggaaatcgcgcctcaattgggagaggagaagtacgctacaaatttcctggacaaggccttggagcttctgtattcgaacagttttgatgccgaggccgctctcgcaaaattgaaacagcaaaacaagtataaggacctgaaggaaccgcatttgcgccccgaggaagtgaagttgttcgaacagggcgttgccaagtacggatcagagctgcgcaatgtgaccaaacatgtcggtacagtcccacattaccagatcgtccgattctactatatgtggaagaagaccccgcgcggtcggcagatctggggcggctacgagggcaggaaaggcaagaaagaagctaaacggcataatgccaattcgaagcttgtagatgacgtggccgacgaccatgaagatttgggctttgacaatgagaaagccggcgagaagaaacgtggcttccaatgcaagttctgctccacgcggtcctcgcggcaatggcgacgcgcccctggcgttccccaaggcattacgaccccaagcgaaccatcgaagaaagacaagggcccgccgctcacggtggcgctctgtcttcgctgtgctctattgtggagaaagtacggaatccagtgggaaagcgtggatgaagttgcgaagaagatcgcgcagagcggcaacaagtcctggcgccgccgagtcgatgaggaattactgacgcagctcctgctctccactgagacaccgatcagtatcaatagtgccactgcagctactgcggcctcgatcggtgtgcctgtcaacgcgaacccgcaagtacagcaacaagactccaacaagaagaaggcaaagcccaacgagaaagaaagcacggccacacctgttgcctcctcggtcgaaccggcacccaagaagaaaccgcccccggagaaagcgccagagccgcaaccaatcgttccggaccctccaaaggccaaaacgttgccctgtgccgtgtgcagcaggctggagcctttgggcgaccaacatctatcgtgccgagattgccgtttgactgttcatcgtaactgctacggagtcagcccatcgcgtaattgtgcgaagtggctgtgtgatatgtgctcaaatgaccgcagtcccatgatctccacatgttacgaatgcgttctgtgccctgtgacctggacggaacatgaattgatggaagcgccaaaggtatcgcataaaaagaagacagaccgtgatcgggagaaggagagactcgagaaggagatggtgcaggaggccatcaagctttatcggcaacggcaagaggccgtgggcaaaccaattggcccacgagaaccgttgaagcgaactgccggtaacaattgggttcatgttatgtgtgctgtctggacccctgagatcaagttcgggaacgctaaagagctcgagcctgcggagggatttggactcatcgcagcagagaggtacagggacgtgtgcaaactctgcaagaccaccaaaggtgcgtgtgtcacctgcagccacagcgggtgcaatgcccgtttccatgtgggttgtgcttttcaagcacagtacacgttcgggttcaacatcacgccagtcaaaagctccagacgggacacagtcagcagtatccgactcggggaggaggtgggagcagcaacagcgggcatctggtgtccacatcacgctccctcatccggccttcaccagattggtgaggtgacaggagaagacgggttgaacgcacttcaacagtacgttcaatcgtacaagcaggcagacttgaccttgcccgggacgcttcgaagagcagcatatatacagcaaacggggaatgcttcttcccagcatgcatcgactgccggaagtcggcgttcctccgccataaacggtgttgtcactgctgcccctcaatcggcgcccacgacgaaggataatcaaaagctcgccgcgacggctccggaacaacatacggatgagatggagattgattccggaagccgagctccccggcaagtgtccagttccgaggttgagcggaaatgctgtcgttgctttacctcgttcagtcctcggtggtggccgatagacgtctcgcggcgactatattcgaccaggcggctggacaataagcgctcc

SEQ ID NO: 17334 - DNA, 792 bp, A.fumigatus
gtgcgttaccacttgattctcgttgtcgaatctagtggttttgtggccggatgtcagctaagacttcttttgcagatccgcaacaagcgccttgcaaagcttgggaatccatcctcatcctcgcaaaatgcgtcagggccagagacagcttctacccagccctctacaccttcactgcccagtccttctcctcaacaaaccttcgacgctccgcagccccagataagtatcagcagcgcaccgcggtcacaaacttcttcgcctcggctggagttgcaagaatcagaaggcaagcgaatcaagatcacaccgtcggcccctgccagtcctgcaccggagtcagtagctgataccccggtatcgaacacgcccccgccaccgaaggcagaagagagtattgaatcctttgaggatcgcacactaagcgccgtcttcaagcttagcttgagggaggaccgacagcgggatatccatgggcacaagttgatctacttgcctgggttgcggagtgaacttgaggaccagggtcgcgaaccgcgcatcgacacgactgtactggaccaggccctccttgaagccgcctcgaatacccagcagaagcctttggactatctattgccatgctggggccggatctcaaggctgcacaaagggtttcgccgtgcccgcgaggatgatccgaaattcgctgtcatcagtgaggcacgacgcctgtgcatgagctattgcatctttgcgatcacgatgccggagatgttcgggtgggttcttacctctcccctgttcagttga

SEQ ID NO: 17335 - DNA, 258 bp, A.fumigatus
gagctgccggcagttagattctctgaaggggagatattagcaagcctcagatatgcccttttccatttgacccgcgactttggttctctacaattcctttttggccgcagctccttctgtttgcttttctattttgcattagacgcaaatgactggcggagattttcgatggcgtcccatggactgatgagtactgatgtctatgattactcttattgtgcaaatactttcttatcgacggctgtgagacgagattaa

SEQ ID NO: 17336 - DNA, 339 bp, A.fumigatus
acccatcagattatctcgtccaccatgccgtccgcttcagcatccggcgcggatactggcggttcagccagatcacgcgaacacaatcaggggaaccaagatcgcaaatacactgcggaacagaaggcagccgtgatccggatacgaaaatgctcgagcacagcgtactacgagattctagccttggacaagtctgcgtcggatggggagatcaagaaggcataccgcaaactgagtttattgacacatcccgataagaacgggtatgagggggcggatgaggcgtttaagagtgagtttttctcctcagatgctaggatgatggcattgcggatgtag

SEQ ID NO: 17337 - DNA, 882 bp, A.fumigatus
ctgatgcatgtggctgcagtggtctctcgtgctttccaggtgctatcggacccggacaagaaatcaaagtatgataaatttggtggagatccggacagcaggttcacgcctagtgctgggccgtccggggcgtctccttttggtggctttggtggtggtggtggggggttcccgcgctcagcgggtgctggtggtccaatgttcgaggaggagatatcgcccgaggagctgttcaatcgcttcttcaatggcgggttcggaggaggagggtttggtcctttcggtacgcttggctcacattcttctcttgtctctttgagggctcatacttacggatgctatttaggaggtcctcagtttgtgttcaatatgggcggaggtccaggtttccgggtacaccagtttggagggccacgaccgcgacgaagaccccgcgaagccagcgctcaggccgaagccgcaccgtctggctgggcaaccttccagtcactactccctctcatccttctattcgtgcttcctctgctctcctctcttttctctggctcgtcgtctccttccggtccttcctacagatttgatgccgccgtaccccctcacactatgcagcggacgacaccgaaatacaacatcaattatttcgtcaatcctagggacgtggaagactacagtgcgaagaaacttcgccagctggacacaaaagtggaagtggactatatcaccaaattgcggtacgaatgcgagagcgaagtacatgctcgggaccggatgatgcaagaagcccagggctggttcttcccagatgtagagaagatgaaggaggcgaggtccatggaacttaagagctgccggcagttagattctctgaaggggagatattag

SEQ ID NO: 17338 - DNA, 192 bp, A.fumigatus
atagtccaaaggcttctgctgggtattcgaggcggcttcaaggagggcctggtccagtacagtcgtgtcgatgcgcggttcgcgaccctggtcctcaagttcactccgcaacccaggcaagtagatcaacttgtgcccatggatatcccgctgtcggtcctccctcaagctaagcttgaagacggcgcttag

SEQ ID NO: 17339 - DNA, 495 bp, A.fumigatus
gccctcaaagagacaagagaagaatgtgagccaagcgtaccgaaaggaccaaaccctcctcctccgaacccgccattgaagaagcgattgaacagctcctcgggcgatatctcctcctcgaacattggaccaccagcacccgctgagcgcgggaaccccccaccaccaccaccaaagccaccaaaaggagacgccccggacggcccagcactaggcgtgaacctgctgtccggatctccaccaaatttatcatactttgatttcttgtccgggtccgatagcacctggaaagcacgagagaccactgcagccacatgcatcagctacatccgcaatgccatcatcctagcatctgaggagaaaaactcactcttaaacgcctcatccgccccctcatacccgttcttatcgggatgtgtcaataaactcagtttgcggtatgccttcttgatctccccatccgacgcagacttgtccaaggctagaatctcgtag

SEQ ID NO: 17340 - DNA, 987 bp, A.fumigatus
atatctaagcgcggatcgtgccagccccgtggtgaagacggtaacatctgttatggggcgggaagtggactcggcggtgttttcggaggatggatcaacgacactctgggatggagatgggctttcttgatccaggtgcccttcgttgtcgtatcatgcatccttgttgccgtgacggtgaagataccagccaaggaaaccgacacggccaagttaaagcgggtggacttcctgggagctatcaccctggtcattacacttgtcttactgctactcggactgaatactggggggaatcaggtgccatggactcatccgattatcctcacgacattgccgctttccgctgtgtttctcttcatcttcattcatattgaggcaaacattgcgtccgaaccagtcatccctgtgcgtctgctgctcgaccggaccgtatcctcggcctgtcttaccaactggttcagtaccatggcgatcttcggactcctgttctacctccccttatactttcaggttgagggcctatcggccacggccgctggcgtcaggctggtacctcaggcacttgggacatcccttggctctcttgcttcggggtttctcatgcgtgccaccggacggtacaagatatttagcaacctttccatgattctcctcgtcgctgcaggtgccttgatctgcacactgaacctggcaacacctgcttggatccctttcgtctacttcttctgccttggcacggcctacggcggcatgctcactatcacgcttgtggcacttatgtctgctgtagaccacgaacaccatgctgtcattacatccgcatcctatgcattccgcagcacaggcagtacgatcggtatcaccattgcatctgcagttttccaaaatatcctgaagtcagggctgtggtcacgcttcggtgatcgtgagcatgcccgaaaagatcatctcacgcatcagggacagtttggacgagatcaataa

SEQ ID NO: 17341 - DNA, 426 bp, A.fumigatus
actaatgatgccacggaaatctttcacattcactcaaccttccagcgaacaatatgcttgacctccgaggagtccgtatactctttgatcttcgaatactcctggaacccctctgactgggcaaagtcgagatgctgctgcatttccatccacccactgaatagcacaaactcctcctttccctcctccttctcaactcgccaacccttgaagataggcaacggcatcgtagcgttctctagacgatgctgcatcccctcaaatacccggtcaaacccttctctcttctcagcgctcacaacataccgccccacagcaacaacaggtgcttcggccagtaactcccgctgccgcaccgcgtcaccatctacatgtaacaaccccatcacctccatctcacccgagagccgttccatgatcccctga

SEQ ID NO: 17342 - DNA, 2019 bp, A.fumigatus
agccttctttgtcgtccgggtagtcacttggacttttcgatttgctctccggaccacaaactctgctctgttgatttatcatcgccacaacctttctctagccgatttcaacgggtgttggccatatttctggcatggcagtggggttacggccggatagtcctacagaattgggtgttcccgctggtgctgcctcgaaaagccttgtgccgactgaaatggaggttgatggggagactgaggggagatcaactcagcattctgcatttaccaacaccagttcgaacaaagtcgtggaaaatgtcgcgatttcgtcgcaacgccgccgaagggcgcatattactgtcgacagagagcgtctttgttgataacatactaccctcccttctccagaaccccgatgtcgaactacggctgattacggacgagccttcggccctcttggcaggtgcaaacaagattcctcactacatggatactgtcgacagtcaaacatttgagaagaaaaccggtgcccgacggtggcttaaagccaaggcagcggagctcagcgagtgggctgatatgcttcttgttgctcctatcgatgctggaacattggggtcgatgctattcggcctcaccaacacgttgacgctggcgcttcttcgtggctggatttcaacaaaacctgtcatccttgtgccgggaatgactgtttcggagtgggaacatcctcttagcaggagacagctggcagaagtcgatcgatattggccttggatcaacatagtcaaaccagccctctggcggtcgaacggtcccgaggaacttgttcagttaccttgggatggtctaggagagttacacaacactatggagcggaccctagggctgtctttctctgagtcctcgacaatttctgggcaggctctcgatagcacacagcaagtagtcccggcagtgacaaaacagtccgcgagtgcaatgtcagcggcacagcatctgcggaagggcgcgcgatcactacgtctcgagttatggctcaacatattcgaagaacagttgcaagattgggaaatcgccaaagcagttggcattcctacaaaccttcctgtacctaaggagtggcaatctcacctactcaagatgtctactcccgcttctctggaatacacaatcctaagagggtcctttgctgctatcaaaaagcgcatagacagcttaccccggtggaaacctctgtcagacctagcctgtcacctcatcttcaagttctcgcgaaccgacatactgtcatatttgacagagaaccatcttgatatgctatggactacatcccgcctaacaaaactgccgtaccgcgcgtcggcaatatacggaaacccgaaggtcttgacatggtggcaggaaacacttgcgctgccgaataaggattacagcgccgatgcgatggatggcgcctctcgcgccggtttcgtcgaggtgctcgaatggtggcgaacatcgggactcgaattacggtatacggagagagcactcgagtcggccagtgccgagggtcgggtagcggtgctcgaatggtggaagaatgcctctgctaatgctccaccatcgaaccctattccgcttaaagtagggaaatccgttttactcgctgcacagtctggtcgagtggagtctctagcttggtgggatgcttcgggcatcccttatagtcatgcagagtccgttgcccgcattgccagcactcatggccatgtccatgtcctcgacttctggtaccgactaaagggacccaagatgatcttcgacagccagctgttggtcgggccgaccaagaacggacatgacaacgtgctagaatggtggcgccgcagtggtctgcgagtggagttcaaaacatgcgatatcgaagaagctctcgaggatgcggaccctgtctctggcgcggagggccgagttcgccggtggtgggctcgcaacgggctcaatctgggcgttggaacaagcgaatggatgaaaacaaaagtgctctga

SEQ ID NO: 17343 - DNA, 795 bp, A.fumigatus
gccaaaggggaggttttccgggataatggtgatttgaataatgagccgcaactgggccatacagtctccatttcggtagggaacgggccgactactgtcttgagccgttcccagcaccaaaataaattgagcaaattttttttccagagagaccaggaaggaaaggaggaggaaatacacaataggtcgttcagtttggagagggagaagccggagatgctgcagactctcgcctcttcctcggtcgccagcaccaaccttctgaatgcgctgaagcgggtaaaccgcgaaactcaccgggtgagtgaagatgcagagtgtctcaaccggtttgagacctgcaagctccttaggcggcaaattctccggtacattcagcatgtggagagtgaggagtatctgggaagtcttatccacgccaatgaggagttggttactgcacttatggcgttcgaagtcctggacaagagtatagactatgacagcgacagtgaccaggatgtgcttgaaagtggctggactcctgatcgagacgatatcaatgaatcgtttgccgggctggtcatcaaccctcccaaacctcctcggcctcctcgacctttgagcatatccgtaccatcatcctcccagcaaaagtacgttagcgccagtgagtcggagacggatgaggacgatgacgacgagaacaacccatttggcgacagaaatgctatccgcactcctggtcttgagaaggctgaacctacatggtatgtattatttgcagatcttcctggcgcgcatagttccggctaa

SEQ ID NO: 17344 - DNA, 621 bp, A.fumigatus
atgacgcccccagtcaccgaaatcgcgctcctacgcttgaaatctaatcctgcctccgcatcattcaaggcactcctcctcgacggcatcaaagcgcaagccgagttctcctcatacccggtttatctcttctcccaggtcgaggatccctcagtcatctacctcgtcgggggatgggactcggcgcaacagcactacgaggattggattccctcggcgacaaatcaggggatcatggaacggctctcgggtgagatggaggtgatggggttgttacatgtagatggtgacgcggtgcggcagcgggagttactggccgaagcacctgttgttgctgtggggcggtatgttgtgagcgctgagaagagagaagggtttgaccgggtatttgaggggatgcagcatcgtctagagaacgctacgatgccgttgcctatcttcaagggttggcgagttgagaaggaggagggaaaggaggagtttgtgctattcagtgggtggatggaaatgcagcagcatctcgactttgcccagtcagaggggttccaggagtattcgaagatcaaagagtatacggactcctcggaggtcaagcatattgttcgctggaaggttgagtga

SEQ ID NO: 17345 - DNA, 1026 bp, A.fumigatus
cgagttctattacagcctgcccatgcgattgaggcagttcgatctggccgtaaccaggccattgagatcattgaacaacgcgatgaccgcctcttggttgttgtaggcccatgctcgatccatgaccccgctacggcgctcgagtatgcaacccggctgaaggagctctctcaaaagctttcttcagagctctgcgtgattatgcgtgcctacctggagaagccccgcacaacagttggttggaagggtctgatcaacgacccggatattgacgaaacctacaacatcaacaagggcttgcgtgtctctcgtaagctctatgctgatcttactggtatggggatgcctattgctagcgagatgctcgataccatttcccctcaatatcttgccgatctcatctctcttggagctattggtgcccgtacgaccgaatcgcaattgcaccgtgagctggcctctggtctgagttttcctattggctacaagaacggtacggatggcaacctcactgttgctatcgacgccattggagccgcctcccacccccaccgtttccttggtgtgaccaagcagggccttgctgccatcaccaagacgtcaggcaatgagcacggctttgtgattctacgtggtggtaacaagggaacgaactacgatcgagagagcattaagagcgctcgtgaggcccttcgggccaagaagcagcgcgaggtcgtcatggtggattgctctcatggaaactcgaagaaggatcaccgcaatcagcctctcgttgctaaggaggtggcagaccagctgcgtgagggcgaagactccattattggcgtcatgattgagtcaaacatcaacgaaggcaaccagaaagtgccccctgagggtccctcaggacttctcaaaggtgtcagcattacagatgcttgcatcagctgggaaacaactgtcactgtgttggaggacctcgctgatgcagtccgtaccagaagggctgtcaaagcttctaaatcgaatggtgtctcgcaataa

SEQ ID NO: 17346 - DNA, 255 bp, A.fumigatus
tacgaaccccccgtcccgataccatgtccagatccgcagccgacgcgacgcgattcacagccacagggccctatgccagctccaagcccggcggggcaccatacaagctccccagctttatggcagaatccaagaaaaacgcagcacggggacccggcgaaagaccagagactccgaaggaaaaagtcgagcgattgcgagcccaggcacgggcggctcggctggcccagtcaacctcgcgcgtcgatcagatga

SEQ ID NO: 17347 - DNA, 642 bp, A.fumigatus
ggtcatggtctacagtttgatcaccgcgtccggtacgtatttaggaagcatgccaagcggcaactctcaatctcaaagcttgttgattgcagtgaaggttacgggattgtcggaatggaatgtgctaatatgttctgtctctggctaggtatctgcggtgtcctcacggtttattctatggtttctttgacactatacaaccgtcgtcagcgagcgttgtgggttgaaagggaattgcagaagctgcaagatgcaaaggcagcttatgccagcggatccgcaacaccagagcaactcgagttaatcaagaatgaggaaattggcgagattatgaagcggaagaaggaggaggcgaaggctcagagaccgtggaaccgggccaaggaatacctgtttggcggactaaagcaggacgagaccacttccgatctatcgtcaaaggttgacggagctgctgatcacaaagtgggagtgctcgaggccctcaacgcgaaggcggcggaagattctaagtcgaggacaccctccgaaacagcgacaatgccggcacagccgggacagctggatgttcttgctgagaatgtggagactgctgcgaagcagtcaacacgaagctggaaaagctggcttactggacggtga

SEQ ID NO: 17348 - DNA, 417 bp, A.fumigatus
cgtcttggtgatggcagcaaggccctgcttggtcacaccaaggaaacggtgggggtgggaggcggctccaatggcgtcgatagcaacagtgaggttgccatccgtaccgttcttgtagccaataggaaaactcagaccagaggccagctcacggtgcaattgcgattcggtcgtacgggcaccaatagctccaagagagatgagatcggcaagatattgaggggaaatggtatcgagcatctcgctagcaataggcatccccataccagtaagatcagcatagagcttacgagagacacgcaagcccttgttgatgttgtaggtttcgtcaatatccgggtcgttgatcagacccttccaaccaactgttgtgcggggcttctccaggtaggcacgcataatcacgcagagctctga

SEQ ID NO: 17349 - DNA, 234 bp, A.fumigatus
gagagctccttcagccgggttgcatactcgagcgccgtagcggggtcatggatcgagcatgggcctacaacaaccaagaggcggtcatcgcgttgttcaatgatctcaatggcctggttacggccagatcgaactgcctcaatcgcatgggcaggctgtaatagaactcgtcagcctcaatgttatacttttcacggaatggtttatttggcattcccgaaaaggattttgtag

SEQ ID NO: 17350 - DNA, 369 bp, A.fumigatus
gtccgcccgaaccccgaccggcgcgaactggcctcaacccctttctcctctaccagaaggactactggggtaaagcccgcgcgcaatgcgatgaaaccaaacaagccacaaccaaggacccgaatgccaaagcggcgcgtgacgaaatccgccaggcgttgggtctcatgtggcggcaagccagcgaagaggaaaaacgaccgtatatcgaacagacggaggtcaaccggcagaccaacacggagatctgggatcgatggaagcagaatacgaaggagtgggaaaggaagtcgctcgagatcaagaagcggtggtgcgcggccaatccgttcgagacgtggcagccgccggcgaagaggtaatgcttag

SEQ ID NO: 17351 - DNA, 3324 bp, A.fumigatus
  unsure (2959): Identity of nucleotide sequences at the above locations are unknown.
atcagtggaagcctatctggttattatcaagtttcaagtggtcccgtccaatgtccatcaaaccccttattagcgaagatggaggctaccgcatctatgggactgcagggtctcaatggcgtatcctacgatttatcacagcttgacaattacttatctcacgcaactacatacgtcaacggtaaccaacacttgcagcatccatcattgccaaatgaaaggatatctggaactgtcgacctgtcagagcccccggctaagcggcttcgccgctctccctcgtgtaatgaatcaaatgaatcgaacggcgagacatccagtcccgccgcgattatcgacccatcaacaaggcttcaagatgtcaatggaggcctcgatagagtcgctggcggatctgagagcgcggattctatgacacatgactcaaatgaggatacgagtaatatacttagtggctcagctacatccgtgtcattgatgtatgaacccagtcagaaaaactcaactccaccgtcaactgtcaataatgtgccgtcctcgtcgtctattacgtctgactcaaaagggctcagtggcaatacagactatgccagatatcggccaaggtcgtccataccttctaagctcacagctgccgtttacgctcagcagtgcgttactgccgcgtatgcatgcagactcaatccctactctctgcacaagaaggaacaagaaccactccaggatcatttgtgtcatctgcatgttacagcttatctgaacataagaaacggaatcctgcgcctctggacgcgaaacccaatggtcagtgtcacaaaagatgaggctctaggctgcgcgaaagattataggtggatgggattggcttcgtttgcctacgaatggcttgtacggaatggatacatcaactttggttgcgttgaaataccaccggctctagttgcccctaaaaaaggaagacgcaaggacggcccagtcattgttgtaattggagctgggatggcaggcctgggttgcgcaagacaattggaaggtctcttcaagcaatatcacgatccattgacatcgccgcgggttgtcgtattggagggaaggcgaagaatcggaggccgtatatattctcatcctctacggagccttcagtcatcgaagttagccccaggagttgtacccaaggccgagatgggtgcgcaaataatcgtcggtttcgagcatggaaacccattagaccagataattcggggccagttggcgctaccctatcacttgttacgtgatatatcgactatctacgatattgacggctcggcagttgatgaagttcaggacgccatggatgaacgactgtacattgatgttcttgaccgttccggactctaccgtcacaacgctgttattgtacctaccgctgaaggagacaggagattgatagactccggccgcgatctaacaatgagcgacggtctcaccgtaagacaatacgaagaggctcgcgccgctggtaccgttgagcttttgttccccaataaaaaggtgcggcgaggcgtgggccacaaaacagcggacatcaaagcaactattccccctgtgccgaccgatcttggtcctgcagaagaacagcccgctgctcttgcttgtcaagccatgggatggaagctgaaggatggggtccctccaacagcatctctgaacctagatcctgttgccaaagcttcaatgtggccaactctgggcgccgtaatggacgagggggtcaaacaatatcaacgcatgctccctcttacacccaaagatatgcgcttgatcaactggcatttcgcaaacctggaatacgcgaatgctacaaatattggcaaactcagtctctctggctgggaccaagacctgggaaacgaattcgaaggcgagcattcgcaagtcataggcggctatcaacaggtaccctatggcttgtggtcgttgcccacaaaacttgacgttcgaacgaacaagatcgtgagcaagatcgcctacgactcgacgggctcggggaagcggaaaactgtggttcattgtgaagacggcgaatcgttcgttgcagataaagtggttttcactgcgtcacttggtgtcttgaagcatcactcgatagaattctcgccacctctccctgattggaagcgtggagctatagaaaggctcgggttcggggtcatgaacaaagtgatactcgtattcgaggagcccttctgggatactgagagagacatgtttgggctgctgcgggaacccaagaatcgagacagcatggtgcaggaggactatgctgccaatcgaggtcgattctatctcttctggaactgcatgaaaacaacaggcctcccagttctgatcgccctgatggctggcgacgcagcccatcaggcggagtacacacctgacggggaaatcattgcagaggtgacgagtcagcttcggaatatcttcaagcacgtcgctgtacctgatccgttagagaccatcatcacgcggtgggcatctgacaggttcactcgaggaagctactcctacgtagctgcgcaggcgctaccaggcgactatgacctgatggcgaagcccgttggcaacctacacttcgcaggagaggccacatgcggcacccacccagccaccgtccatggtgcctatctctccggtttgcgagctgcatcagagatcatcgagtccgtccttggacctatagagatcccgaaccccttggttcccgaaaagggcaaggcagtcgaactgggcacatcagtagccacggcacaaaagaaaaaggaaccgccttgctcaaacgggttctccgcccccgtttctacttccgcacatcccaccgacgcatcagcacccgcacgatcaaacaactctttctccggcgatacggcgctccgacaagcctacgaacaagccatgtgggcagccatccacgccgagntaggtccgcccgaaccccgaccggcgcgaactggcctcaacccctttctcctctaccagaaggactactggggtaaagcccgcgcgcaatgcgatgaaaccaaacaagccacaaccaaggacccgaatgccaaagcggcgcgtgacgaaatccgccaggcgttgggtctcatgtggcggcaagccagcgaagaggaaaaacgaccgtatatcgaacagacggaggtcaaccggcagaccaacacggagatctgggatcgatggaagcagaatacgaaggagtgggaaaggaagtcgctcgagatcaagaagcggtggtgcgcggccaatccgttcgagacgtggcagccgccggcgaagaggtaa

SEQ ID NO: 17352 - DNA, 669 bp, A.fumigatus
tccagagtcgatctgtcctcgaaaccgttcaagctatggacagaatggaacgatggccctgataaggagcccgcttgtaccgcggatgccgtcatcattgctaccggcgccaatgctcgtcgtctcaacttgcccggcgaagagacctactggcagaatggaattagcgcctgcgccgtctgtgatggtgcggtgcctattttccgcaacaagcccctgtacgtgatcggtgggggtgactctgctgccgaagaggccatgttcctggccaagtacggcagcagcgtcaccgtgcttgtccggcgtgacaaactccgcgccagcaaggcgatggccaagcgtctgctggctcaccccaaggtgaccgttcgcttcaacaccgttgccactgaggtgctgggagagaagaagcccaacggcctgatgactcacttgaggatcaagaacaccgttaccggcgaggaggagattgtcgacgccaacggtctcttctatgctgttggtcatgaccccgccactgccctcgttaagggccagatcgacctcgatgaggatggatacatcatcaccaagccaggcaccagctataccagccgcgagggtgtgtttgcttgtggcgacgtccaggacaagcgttaccgccaggctatcaccagtgcaggtttgtga

SEQ ID NO: 17353 - DNA, 204 bp, A.fumigatus
ttaggatccggttgcattgctgctctcgaggccgaaaagtttattgccgaagccgaaagccccgaggaagagcctgtcgccgtatccgctcagaagtccgccgataactccaccatccagcccgccgctcaggaggtcaacggtgatgtcaagaaggaccctaagggcgccgttccagaatacaagtcgaaccctcttctctaa

SEQ ID NO: 17354 - DNA, 657 bp, A.fumigatus
aacgacctttacgattgcagtttccaacctgtccgaactgcatcgtccttcgcagcgacaatgcagtggctaagttgttggctgccactgttggtggcagcatccattcctcggacgctggcggcacaagataccgatacctctgctactagcaccacaacagcgacaaatgctctcttcaccatcacaggaacaatcacagaccatgtcagcgatgcaactttgcctaccggcacttatctctcctatacctccacccgcactctttccaccgacagcgatggcaaagtcctttcctcgatcgctgtgactaacgcgaccgctgtcggtaattcgaccattcataccacttccacagatacaatgacgagattggtcggcaatgccacggcaaatgccactatgaatggcttcggcttcggcttcgacatctcccgttgtcaacactcagccttgcaatggccatccccaaatcctgtgctcgcaagtactcaaacatcacccagggtgggcgggtcaatacatcccctttgtcaaaccaggcaatgctgctgcgaaccaagaattgggggtggtcagtcagttgaacgacggtatccgaatgcgtacgtactcttgaagaacatctcctttgcgagagaccaactgctaacctga

SEQ ID NO: 17355 - DNA, 399 bp, A.fumigatus
ttgaataaaaaaaaagaacgcgctatggctgagtcccatcgcgccagttacgtttcgctgcatgtgcgtgtctccaacactgccgccctgcgtctgtaccgggatacccttggcttcaaggtcgagtccgtcgagagcaagtactatgcggatggagaggatgcgtacgccatgcgcctggaccttaccgatcaatggttggactggaaggaaattgaacgcaaggacagagagcgcgctaagagtgacgaaaaggacgctgatgagggcgacgaggttggaagtttgggcaagaaggaagaaaagaccgttcgcgtcaaggtcggacggagtttgggtgtcggcgatttggtggagaggaatgaggccaacccttcgcaacaaagcgtcagctcgtag

SEQ ID NO: 17356 - DNA, 438 bp, A.fumigatus
accaagccgaaatcaaaaatggttgacatcgtccccctctcgtcctacccctcgtacatcgacctcctcccctccatccaaacctgcaacatcaccaaccttcccgaaaactactttctgaaatactacctctaccatgtcctgacgtggccgcaactgagcttcgtggctgtcgtgcggccccgcaatggctacgcgaagcacaagggcggtgccgcaggcacatcaagcacaggcaccgccgacctctccgggcagtatcccaaggtggttgggtacgtacttgcaaagatggaggaggagccgacggacggagtacagcacgggcatatcacgagtttgagtgtgatgcggacgcatcgccggttgggtatcgccgagagattgatgaggatgagtcgtatgtttccccccttttttacgtttccatattcctga

SEQ ID NO: 17357 - DNA, 486 bp, A.fumigatus
ataaaaaaaaagaacgcgctatggctgagtcccatcgcgccagttacgtttcgctgcatgtgcgtgtctccaacactgccgccctgcgtctgtaccgggatacccttggcttcaaggtcgagtccgtcgagagcaagtactatgcggatggagaggatgcgtacgccatgcgcctggaccttaccgatcaatggttggactggaaggaaattgaacgcaaggacagagagcgcgctaagagtgacgaaaaggacgctgatgagggcgacgaggttggaagtttgggcaagaaggaagaaaagaccgttcgcgtcaaggtcggacggagtttgggtgtcggcgatttggtggagaggaatgaggccaacccttcgcaacaaagcgtcagctcgtagaaaggagtcgtcatatatacctctgagagccagccctctggacagtttcgaatcctgggcaaacgtgctcgatctacagaatatgcagtga

SEQ ID NO: 17358 - DNA, 975 bp, A.fumigatus
acgacggtatccgaatgcgtacgtactcttgaagaacatctcctttgcgagagaccaactgctaacctgatacatgggacccgtgtagtgcaattccagactcactatgaaaacggcacgatgtatctctgccataccagttgtgatctactcaacgtgggcaccctgacggaatacctcaccacggtcacccgatggataagacagcacccgtacgacgtggtcaccatcctgattgggaactacgactatgccgcaccgggaaatttctccaagccgatcgaggactcgggcctgttagatctggtctatatgcctccgaagatccccatggccctggacgactggccgaccttgtcaaacatgatcctatccgggaagagagccgtcgtgtttatggactatcaagccaaccaaactgctcttccgtggcttatggacgaattttcccagatgtgggagacgcctttctcgccaacagacccgactttcccctgcaccgttcagcgtccccccggtctctcaaacgaggatgcttataatcgcctgtacatggccaaccacaatttgaacgtcgaggtcaacgttgccaatatcaatctcctcatccccaacactgcggaattgaaccagacgaatgccgtgtccggaccgggtagccttggatggatggccgagaactgcactagtaagctcatatcatgccctgcaagtcgctataaggaaaggatgtccgcctctaacttgtcaatagccatgtggaatcgtccccccaacttcctcctcgtcgactactacaactacggcaatttcaatggctctgtttttgaagtagcagcccagatgaacaacgttacctacaacggcgaatgctgtggatccacttctgctgcttttagcttgatgccggcaggggctctgtggaacgcgctgttagttgttgcaagtgttcacttgttcgcctcgatcttctaa

SEQ ID NO: 17359 - DNA, 774 bp, A.fumigatus
atagcccttgttcgatggatctatcactgcatattctgtagatcgagcacgtttgcccaggattcgaaactgtccagagggctggctctcagaggtatatatgacgactcctttctacgagctgacgctttgttgcgaagggttggcctcattcctctccaccaaatcgccgacacccaaactccgtccgaccttgacgcgaacggtcttttcttccttcttgcccaaacttccaacctcgtcgccctcatcagcgtccttttcgtcactcttagcgcgctctctgtccttgcgttcaatttccttccagtccaaccattgatcggtaaggtccaggcgcatggcgtacgcatcctctccatccgcatagtacttgctctcgacggactcgaccttgaagccaagggtatcccggtacagacgcagggcggcagtgttggagacacgcacatgcagcgaaacgtaactggcgcgatgggactcagccatagcgcgttctttttttttattcaatcaaatgccgtcagtcaggaatatggaaacgtaaaaaaggggggaaacatacgactcatcctcatcaatctctcggcgatacccaaccggcgatgcgtccgcatcacactcaaactcgtgatatgcccgtgctgtactccgtccgtcggctcctcctccatctttgcaagtacgtacccaaccaccttgggatactgcccggagaggtcggcggtgcctgtgcttgatgtgcctgcggcaccgcccttgtgcttcgcgtag

SEQ ID NO: 17360 - DNA, 375 bp, A.fumigatus
agagtgatgtcgacaccaagtcccagaacagcaatgcgcaagccagcggcgaacgtggcttatattcttggctccgaggttggcacgcagtcgaccacgcgattcattgccttcaaagcgcttccgccaatccaactccgtcgcaaaagacagtaccgcagtagcggcactgtgagtgaaaccgactgggtgcggtctatctgcgaagagattgagcgcgcgatgatggccggcgagggaccgcgtcccggtgaaggaggaaagcctccgtctgtcgttgagaactcagagattatctctctggaagacgccaagaaacgtacagggattctggagcatctggtttatgatatcaagaaattggtctgggcgtaa

SEQ ID NO: 17361 - DNA, 1602 bp, A.fumigatus
cgaggccgtttagctgaccctggatatccacagtttttctggaataagaacttgatgaatcctttcatcaaagccgacgcgcacagcttcatcttacctcttgtgcagggtttcgtaggccagcgagagttcaccgtgtcggctaaatcagaacagccagattccaacgtcgcagaggagcacacagaaggtcgaatgctcggtgagaaagacgagtcacagagcatcaaggttgatgccgcgaagcgaaatttcctattgactttgatttcgcgacggtcggtcaagcgacctgggctccggtatcttcgacgcggcgttgatgacgaagggaacacggcaaacactgttgaaacggagcaaatcctttcagttcctagttgggatcccggccacaatgtatattcttaccttcaagtgcgcggatcgatccctctctatttctcgcagtctccatatgctttcagaccggttccggtgctttaccattcgacggagacaaaccaatttgcatttgacaggcattttcggaatctcgctcgaaggtatggcaaactccaagcggtgtctcttatcgacaagcaagccggtgaactgaagcttggtaatgaatacgaaaaatatgcgcgggtgctgaacgactctggcggcattgacggtgtacctctcagaatggagtggtttgacttccacaatgaatgccgggggatgaagttcgagaacgtgagccgacttgtaaaacgtttagagtccgtcctaaacgagtacagcgatacaattgtacggaatggcacggtcactcgaagccagacgggcattattcgcaccaactgcatggactgtttggatcgtaccggtgttgcgcaatgtgcctttggtcagtgggccttggaacgcgaactgaagctcgagggcattgacatcgatttgagtcgcgactcgtctacccagtggttcaataccctctgggcagataatggcgatgcgatctcgaagcagtactcctccacggcagctttgaagggagactacactcgaactcgcaagcgtgactatcgaggcgcactgaacgatctcggattgacgctgtctagatactataacaatattgtcaatgactacttctcacaggcatgcattgattatcttctgggaaatgtatcgactcgtatattcgcagaatttgccatggagatgcgaacggcggatcccgggatctccgtgcagaaactacgccggagcgcgatcgatacgagctgcaagatcgtgattagcgaccagtcggaagagttcctgggaggctggactatgctcactcctcggcagcccaacaccctccgaactttaccattcgaggaagcggtcctgctcctgactgacgcggctgtctacagttgccgctttgactggaatactgacaaagtaacctcattcgagcgcatcgatttacgctcaatatcgcgtttgaattacggcacttatatcacatcgatcttgactgagtcacaagcgaatgaacaaggcaatgttggactagtcatcgagtaccgcgacggcgggcgagaacgcctggcgcgtcaacacccggtctctgaagagtga

SEQ ID NO: 17362 - DNA, 408 bp, A.fumigatus
aggtctaccccgccttgtcctagtgatttgcccctctctaccgtcaccattagtccactcttctctcgcgctttatatctgcacaccctcgccctcctcgcgggcgtcctacttgtcaccgtggctcctcctctccgtctcacctcccccactttcagactctcttcggtcttgagacagcttcgtggctctcgattacctaccactaccgccgtttacaattccgcattgactgatcttcgcaagtccctcaccaccgctagcatgggctcccgaacatctacgtcggccgccgcaggccccgcccctctttaccgcgactgctcagtccatcgtcgacgatgccaagcgcctcatcgagacatcccgcaaagtgcaggacaacatcgttgcgaatgtcaagcctga

SEQ ID NO: 17363 - DNA, 1287 bp, A.fumigatus
gaataccatggcgctagaatccacattctgagcttctaccaggctgtgtcaacagatcaggaactgcgggatgcgtcatccaaggcagaggaattgatggacgagttcttcattgagactgtgatgcgtgaagacgtattcaagctcgtcgatgctgtgctgaagaagaacgagagtctcgaccccgagtcccggagactgctggagaaggaacacaaggattacatccgcaatggcttgggccttccagccggaccgaagcgggatcgcttcaaggagatcaagaagcgtctgagccagattagcattgaattccagaaaaacctgaacgaggagaacggtggaatctggttcacgcgcgaggagctcgacggcgtgccagaggacgttctatctggtttgaagaagggcgagggcgagcatgaaggcaagctctggttgaccttcaagtatcccgatctgttcccgaccatgaagtatgcgaagaacgcggagacgcgcaagcggctgatgatcgagaacgagaacaagtgcaaccagaacgtgcctctgttccgggaggccatcatcctgcgtgatgaggccgctcgtctgcttggataccccaaccacgcggcgttccgcattgaagataagatggctaagaccccaaagacggttgacgacttcttaggagacttgcggtcgcgtctgactgctggagggcacaaagagattaaggctttgttggagctcaagaaagcagatctcgagtctcgcggcgagcccttcgatggccgctactatctgtgggaccaccggttctacgaccgcctcatgctcgagaaggattactcgctggatcagcaactgatcgctgagtactttcccctgcagacgaccattgagggcatgctgaagatattcgaagagctgtttggtcttgttttcgtcgagattaccggtgaggatcgtgaaaaggttgcgcccactggcaagggaagcgacatcgtctggcacgaagatgtccaggtctttagcgtctggaacgacgagggcgagggcagtgggttcgtgggctacctctacttggacctgttcccccgccccggcaagtatggccacgcggccaacttcaatctccagccggtatgtgaaacacataagagtcatatcactcgactaacaattgtaagggcttcatcgacgctgacggcaagcggcgctacccggccactgcattggtgtgcaatttcaccaagcccacggccaagaaacctagtctcctcaagcacgacgaggtggtga

SEQ ID NO: 17364 - DNA, 876 bp, A.fumigatus
gacaccacccactccaatccaactctcaacctgcggcaactacaactcaccacctcacataaaataaggtcttctgttggcgtcaacctcaccaaccccagacaaccacctgcaagagtcacactcaccccaccaaaagaaaatacaatgtcaactacaaacccatccgcctctccatcccggtcccccgctcctcgacaacaagatgaccaaccccagcaacaggaacaagagcagcaacagcagcagcagcaacagcgcctaaaagttcatacccaccactgccgcttctgcaaccacctcctcctagccacaacgcgcacgatcgcgacccttccgcgtcgaaaagccccagcgcaggataacgcgcttattctgcctcttccgcacgcggacgaggacgaggacgaagatgacgacgacgacaacgacgacgagaagaaggaggaggagaagccagacgcaaccacatcgcccgagcccgggagcgaaaccaaccaaaccataagaaccgaaggcgaagccgaaagcgaaggacaagcggggaggaaacggcgcaaacagaagcactacaccatcctgctatccacaactctccccgatcgcaaggcgacgctgatccgtcgggaagacgggttcgagaagaggcgatttctgcggtgtgggcggtgtcgggttgtggtggggtatttccttgatgcggtgcattttcctgttgtccggagggccgaggatgtagttgaaggggaaggggcgagtcaagaaccacgggttgtatatttacttcctggggcgttgatggagacggagattatgggtgatgaggagaaaatggaggcgctggatcgggagtggagtgggtggattgctcaatag

SEQ ID NO: 17365 - DNA, 252 bp, A.fumigatus
ctgatcttcgcaagtccctcaccaccgctagcatgggctcccgaacatctacgtcggccgccgcaggccccgcccctctttaccgcgactgctcagtccatcgtcgacgatgccaagcgcctcatcgagacatcccgcaaagtgcaggacaacatcgttgcgaatgtcaagcctgattccgcgactttcgattcggtgctgaagcctctggctcatgatgagaataccatggcgctagaatccacattctga

SEQ ID NO: 17366 - DNA, 273 bp, A.fumigatus
tgccggatactacggatatctcaggtaagcttttttctttacttcgtcttttgcgtacttgcaattctaaccgactgcagctcccaagtatactcgaccgacatgttctacactgtcttcaaggacgatccgatgaacccagccgccggccgcagataccgctacggcgtcctcgagaagggcggcagccaggacgagatgaagaccttgaccgacttcctcggccgcgaacccaagaccgacgccttttacaaggaattgggactggcctag

SEQ ID NO: 17367 - DNA, 837 bp, A.fumigatus
tattgcttagcgcggatccttccgccccctgtggtagaagacgtggcaggtctcggctggggtgactggtttggcggcttcatctatgccggtattctgcgtatcttcttcgttcagcaagccactttttgtgtcaactctctggcccactggctcggcgatcagcccttcgacgaccgcaactcccccagagatcacgttatcactgctctggtcactcttggcgagggttaccataacttccatcacgaattcccctcggattaccgcaacgccatcgagtggcaccagtatgaccccaccaagtggaccatctggatctggaagcagcttggtctagcctatgatctgaagcagttccgtgccaatgaaatcgagaagggccgtattcagcagctccagaagaagatcgaccagaagcgtgccaagttggattggggtatccctctcgaccagcttcccgttatggagtgggatgactatgttgaacaggccaagaacggccgcggactgattgctattgctggtgttgttcacgatgtgaccgatttcatcaaggaccaccctggtggcaaagctatgatcaactccggcattggcaaggatgctactgccatgttcaacggtggagtttacaaccactcaaatgctgcccacaacctgctgtctaccatgcgtgtcggcgttatccgcggcggctgtgaagttgagatctggaagcgtgcccagaaggagagcggcgaatatgtccgcgacgagtccggtcagcgcattatccgcgctggtcagcaggtcaccaagattcccgaccccattcccaccgctgatgcggcatga

SEQ ID NO: 17368 - DNA, 675 bp, A.fumigatus
gagtcatatcactcgactaacaattgtaagggcttcatcgacgctgacggcaagcggcgctacccggccactgcattggtgtgcaatttcaccaagcccacggccaagaaacctagtctcctcaagcacgacgaggtggtgactctgttccatgagcttggacacggaatccacgacctcgtctccaggacgatctactcgcgcttccacgggaccagcactgtccgggactttgttgaagctcccagtcagatgctggagaactggtgctggacaccgtcccagctcaagtccctgagcaagcactactctaccctgtcccctgagtaccttgccgcctggcaagagcaggccaacggcaagccccagccgcccgagcgcattcccgacgaaatcatcgagaacctgatccgcaccaagcacgtcaacgacgcgctgttcaacctccgccagctgcactttggcatcttcgacatgacggtgcacgaagctgagagccacgagcagatccagaagctgcccatctccaccacatacaaccagttgcgtaagcagatcgcgctgcaggacggccccgaggtcctaggaatgggcgacgaatggggccacggcgaagcaacctttggccacttgattgggggctatgatgccggatactacggatatctcaggtaa

SEQ ID NO: 17369 - DNA, 219 bp, A.fumigatus
caagctgacagtgcgctagtcgacttcgaatcgtttttgaaggtgctgaaccgtcctggtggattccgggagcccggcgagcccgaggagtattgtcggggattccaggtgtttgataaggatatgactgggtttattggggtggggcagctgcgctatagtatgttgttctgcgttgcgctgtgcgttcagctggctgggggattgggtgctgactga

SEQ ID NO: 17370 - DNA, 234 bp, A.fumigatus
tgcagaaataagctatgtcatctcatctggatcgtcggggtcagtcatccatccttggtggttaccacaacaaccacccgcctaaacaccgccaaacccaccccaggccaacttctaatcttcgctcctcctcgcatgatcatctctcagtcgagtatctacgccgtcatcttcgtgtttgtaaggatctaccattgtttaccatccgaacaatatagttgtcgcaggcattga

SEQ ID NO: 17371 - DNA, 333 bp, A.fumigatus
acttccctccctcattgcatttttcatccccaacttctgcccttcatcatccatcccactttctttctgctggaaaatagcccgttcttaaaaatgcctcgctcacccgattctcacaacgaccaggcctcaaccaactacaaggaagcgttctcgctgttcgacaagcgcggcacgggaaaggtatcgctcgagtcgctcggtgacctgctgcgcgcatgtggccagaaccctaccctcgcggagattgcagatctggagaagagtatcggcggagactgtaagttgcttctggtttctggcgctcggtgtagcaagctgacagtgcgctag

SEQ ID NO: 17372 - DNA, 273 bp, A.fumigatus
ctgggtttattggggtggggcagctgcgctatagtatgttgttctgcgttgcgctgtgcgttcagctggctgggggattgggtgctgactgatgtagttctcacgaatttgggcgagaagatgtcggacgaggaggtcgatgagctgctgaaggcggttgacaccagctctggcgagatcaactacactggtatgttttcttgtttgatttactccgaatggttgacactaactagtatcgcagaacttgtccgcacaatcctggccaactga

SEQ ID NO: 17373 - DNA, 516 bp, A.fumigatus
cgagcgcggaacctatccagcccggggcacgatcttgctcaacggcagccactcggccctgggctaccccggtcagctggcgggcttccagtacgtgcacgaggtcatggcgaacccgctgttccgcaagttcgtgtggcagatgatgcaggaggaggtcaagccgctcctgccggagatcccgggcgtcgacatcgacgagtattgcaacaccctcatcgagcgctttaccaaccccaccattatggaccagctgccccgtatctgtctcaacgcgtccggcaagattcctcagttcatcatgccctcgattgccgaggcgatctgggagacgggtccgttccgccgcctgtgcttcgtcgccgccgcctggttccactacatcaagggggtcgacgaccgtggcaagccgttcgaggtggtcgaccccatgcgcgaggagctccaggccaaggctcgcgccggaggcaacgacccgtccgagctgctcagcatcaagagcctgttcggggatga

SEQ ID NO: 17374 - DNA, 270 bp, A.fumigatus
gactctacagggcagtttcccggtcctacgatcgaagcagattggggggacacaatccgtacgactctacttgcatacacatgtaaactactgacaggtacaggcattagcgtatacaacaatttcaccgacaacaacaacggtagcgctatccactggcatgggcttcgtcagttcgagaacaatgtccaggacggagtccccggagtcacacagtgtccgagcaaggtaacaattagcccagcggagtatcgtcggagaagcgactga

SEQ ID NO: 17375 - DNA, 615 bp, A.fumigatus
gagcgcggaacctatccagcccggggcacgatcttgctcaacggcagccactcggccctgggctaccccggtcagctggcgggcttccagtacgtgcacgaggtcatggcgaacccgctgttccgcaagttcgtgtggcagatgatgcaggaggaggtcaagccgctcctgccggagatcccgggcgtcgacatcgacgagtattgcaacaccctcatcgagcgctttaccaaccccaccattatggaccagctgccccgtatctgtctcaacgcgtccggcaagattcctcagttcatcatgccctcgattgccgaggcgatctgggagacgggtccgttccgccgcctgtgcttcgtcgccgccgcctggttccactacatcaagggggtcgacgaccgtggcaagccgttcgaggtggtcgaccccatgcgcgaggagctccaggccaaggctcgcgccggaggcaacgacccgtccgagctgctcagcatcaagagcctgttcggggatgacctgcgcaacgacgagcggttcctcagggagatcaccaccgctatgaatgacattgcccgggacggcatcatgaagacgctccccaagtacattaactaa

SEQ ID NO: 17376 - DNA, 231 bp, A.fumigatus
agaatagagacaaatgccaatagctgtagcgaaacgatcgcagttatagaggagcccaggtgcaaagacgagaattgccccgatagtcagttcggttacatcaaagagctcggtctggtggatctggtcagaacaaatcatcccgctggccgatttaaggatctctgcgtcgtggaaaccgccagcatgcagattactatccagacccctttcatatctcgactcctctaa

SEQ ID NO: 17377 - DNA, 336 bp, A.fumigatus
agaagactaccgccgctatatgaccgaggtttccgccccgatgaccaaggacctgatggtaaaatatggcgtcaagcgatggacgatggtggatttgcactactcccattgtatactcggttactaacagaacaggtgcataacacgaccgccacccgcgcgctcatggccgagttgtgcgactcgcaaatgaccaacgtggtggactttgactgtttcagtcaggtcgtcttcgagagcctggaggactacaagcgcatgaagcaggatccttggtacaaggagcatttgttccacgatcatgagaatttcgcggataccaagaaaagcatgtaa

SEQ ID NO: 17378 - DNA, 825 bp, A.fumigatus
tcatcctacgccaatgtggctatactgaagacgtcgccaggaccgatcgtcattcatggcccatcaagcatggactgggatgaggacctggggccctggctcctgcacgactggtaccacgacgatgtgttttccttgctttgggtaggcgagacgaaaaatcgaggagcaattcccgagtccaccatcctcaatggcaaggggaagttcgactgtaatcaccacaacgacacgcgctgcaccggaacgggtggagagtattttgaggtcaacttccgaaagggcgtcaggtacaagctcaccatcgccaatacggggaccctgctagaatatatgttctggattgatgggcataacctgaccgtcattgcggccgacttcgtccccatcgaaccctatgtcaccgacgtggtcaatgtggcgatgggccagcggtatgaaatcatcgtcgaggcaaacgccgacttcacgcacggttctaacttctggatttacgcccaatactgtgacgaggtcgatctgctgccccacaaggcagtgggaattgtgcgctacgacgaacaggaccgtcaggacccccggacgccacctctcggcgaccagcatcgagactttggctgcgaggaccccgatctagacaacctcgttcctgtcgtccagcagtcggtcggcaggcgagtgaaccgcatggagatgaaggactacctgagaatgggccaagagggctaccccgacccgatgaacttcgacggtgacctccacaaatgggtcctgggcgatgtcccgtcttcaccacggggctggaaggatccgcgatggcgcatg

SEQ ID NO: 17379 - DNA, 417 bp, A.fumigatus
tgcaggaggaggtcaagccgctcctgccggagatcccgggcgtcgacatcgacgagtattgcaacaccctcatcgagcgctttaccaaccccaccattatggaccagctgccccgtatctgtctcaacgcgtccggcaagattcctcagttcatcatgccctcgattgccgaggcgatctgggagacgggtccgttccgccgcctgtgcttcgtcgccgccgcctggttccactacatcaagggggtcgacgaccgtggcaagccgttcgaggtggtcgaccccatgcgcgaggagctccaggccaaggctcgcgccggaggcaacgacccgtccgagctgctcagcatcaagagcctgttcggggatgacctgcgcaacgacgagcggttcctcagggagatcaccaccgctatga

SEQ ID NO: 17380 - DNA, 1017 bp, A.fumigatus
  unsure (267): Identity of nucleotide sequences at the above locations are unknown.
cagagtagatataatactattgacagcagccaacaacacagtagatcaaacgtcagcatggctgtcccccagagcattccccctccaacggcagcccctatcgagtccaaagaccaggttttcgcccgcagcaaggcgttctgggacaactatctccgaggccgccctcaggtgccaccgagcttcttccaacgcatctatcgctaccatcgagagcacggcgggcggtttgggacagtccacgatgtgggcgcaggaatcgggccntacgcaggggagatacggtcccagttcccccacgtcattgtctccgacatcgtgccgaaaaacgtccagctggccgaggcgcacctcggacgagacggcttccgctatcgcgccgcgccagtcgaagtcgccgacgacctgccgcccgggagcgtggatctggcctttgcaaccaacgtgatgcactttgcggaccagcacgcggccatgcaggcgattgcgacgcagctccggccgggaggcacctttgcgtgcgcggggtttggccccgcgcgctttgatgaccctgatatccaagatgtctgggagcggatcagccagcagggcggccggatcctcctgggcatggcggagcatccgccggacaccattaacgtcatgagtcgcagttcgaaggagtacaacgtggctccgctggagccgcagtggtttcgaccaggggcattgcgcatccggctgaacatggcccagggcggcatcacgggccttctgccgccggagcgacagcaggaagtgacggatcctgacttcgcgggaccgagggatgtggtcgtgtacgagacgaatgaggaatggcgctttgaaaccgactgggagggtttcctgcagcatttccgctcgtttcctcacgcaggggctgatcccgcggcctttacgggattgttgcaggagctcaaggacctcttggacgaggggcgatgtttgcgtggctgttggccggcgactttgatcctcgcgacgcggcgttag

SEQ ID NO: 17381 - DNA, 609 bp, A.fumigatus
ctgcgatcgtttcgctacagctattggcatttgtctctattctctagcaccttcgaactgcacttctatcaatatgccgcagaatgcttccgtgattattacgcaggcgactgcagtcattacaggctcctttctctcgggtatgtcatcctatgtcgaatccacgtagagagacttaacgccgacgcaggcctcatgatgggactttcggtcgttgacatccctgtggtgctcgacactgctactcaagcctcgcaactattgcaacatttcacacgcctttatgatattggacataagatgatgcccagtctggctgtcacaacctgtctgctctacggctatactgcgagcagcacgcgcactacgggcgggtcgggactcccccatatcattgcggcggtgacaacgatctcgatggtgccttttacgtggctggtcatggccccgaccaacaatgctctctttcgaatgcatgccaatcccgctgcagcgaacctcggtgaggtgcggcgactacttgtccgatgggcacagctgcatgcggtgcgctcgctattcccgctgatggggtcagtcctgggtttgaggcagattctcagggagtag

SEQ ID NO: 17382 - DNA, 684 bp, A.fumigatus
aatatgcaaaatttaaaaatctcgctcgcaaacgcaggggtgtaccatccaacaagtctcgccgggcgattagttaatgtacttggggagcgtcttcatgatgccgtcccgggcaatgtcattcatagcggtggtgatctccctgaggaaccgctcgtcgttgcgcaggtcatccccgaacaggctcttgatgctgagcagctcggacgggtcgttgcctccggcgcgagccttggcctggagctcctcgcgcatggggtcgaccacctcgaacggcttgccacggtcgtcgacccccttgatgtagtggaaccaggcggcggcgacgaagcacaggcggcggaacggacccgtctcccagatcgcctcggcaatcgagggcatgatgaactgaggaatcttgccggacgcgttgagacagatacggggcagctggtccataatggtggggttggtaaagcgctcgatgagggtgttgcaatactcgtcgatgtcgacgcccgggatctccggcaggagcggcttgacctcctcctgcatcatctgccacacgaacttgcggaacagcgggttcgccatgacctcgtgcacgtactggaagcccgccagctgaccggggtagcccagggccgagtggctgccgttgagcaagatcgtgccccgggctggataggttccgcgctc

SEQ ID NO: 17383 - DNA, 792 bp, A.fumigatus
ttgcctttgatctgtgcttgttacttgttacaatgccgagtggctgaactagagactaagcaatccattttctgccgatatagcttcctgaagctatgcaaagtcaaatattacaatttctcgccagttcatagcgttcagaaaaacttcaccttccagaccggcgatcctctcggtcccgattccccagaaagcgacggcgggtcgtcgatatggggcctgttggaagggcccgtcaagagaacattttcgttgaagctgtcgccaaagctgaagcacaccgagcgcggaactgtcagtatggcaacagtaccttcctcgcacgatcccgacgagcgcctcgctgccagtcaattcatcgtcacacttgaggataacctcgactatctggatgggaaagcagcgatctttgggaaagttgtggaaggcttcgatgtgcttgaaaagatcaacggagcctttattgacgaccaaggtcgcccgctaaaagatatccgtatccgccatacagtcatcctcgatgacccttacgatgaccctcctggcttagtggtgccagctgaaagtcctttgccttcaaaagcacagctagcgactgtaaggattgctgacgacgaggagctggatgacaacatggatgaggaggcgatggaaaagctgcggcgagagcgcgaggccagagcgcaagcattgacgttggaaatggttggtgatcttccattcgcagaggtcaagcctccagagaatgtgctcttcgtttgcaagctgaatccagtcactcaaggtatttag

SEQ ID NO: 17384 - DNA, 564 bp, A.fumigatus
cgtgttcgagaagttgaagcctgtactcaccgtttcgcctggcgctcgcgaactgtgcaaagctctgaagaagctcggttgcaaacttgcggtcttgagcggaggattccagcctctggcggaatggctcgctggccaactcggcatcgattatgcatttgccaatcatgtgggttctcccgtccctcatgccaactttccttgagccaacgattgacatatttttttttttctttccagcttgaaattgatgaggcgtctcaaaccctcacgggcaagcttgtaccgacccaccctattattgacgcaagcaagaagcgtgagcttctcaagtctctcgcggcagataacggcattccaatctcccaagtcgtctctgtcggcgacggggcgaatgaccttcttatgcttcatgcggctggccttggagtcgcctggcgcgccaagtccaaggtccagcttgaggcaccgactcgtctcaatggtgaaagtatgttggacattctctatctctttggtatgacgaaagaggacatcaaggagttagtttccgacgatgcttga

SEQ ID NO: 17385 - DNA, 657 bp, A.fumigatus
tatgatgacttttgtcatataataggcccaagagatggatactgcatgatcatacccgaagcgaagccgacgaaaaaccaacaagcgccgattaattatcctaaagacgtaaaagacagaaatagagagagcccaaaggacaattcaccgcgtcacctcgtcgacggtaactggccgaacgccgactgtttccgtgcctccagaagtagctcttctcttcttcagaacattctcaatgaacgcctcgccggccttgtaactgctccgaacgagagggcccgacgcgcagtagaggaagcccatgtcaagcgcccgctggcgccacagctcgaatcgatccggagtgacgtactcgtgcacagccatatggcgcttcgtcggccgcatatactgtccgaatgtgacaacgtccacgttagccgcgcgcagctggcgcagcgcatcccacaattggtcatccgtctccccgaggccaagcatcagcgaggtcttggtgataagcgagggctgggcgttcttcgctgcctcgagcacccggatagactgctgaaagttggcacggcgatcacggacctgaggcgtcagggcttccactgtctcaacgttgtgtgcgtagacatccaagccggagcgagcgaccagcttcaccatctctag

SEQ ID NO: 17386 - DNA, 309 bp, A.fumigatus
cttttgggtggccaggaaattactgaacgtgccatgaacggagagcttgacttctccgcgtcgcttaaagagcgtgtcggtctcttgaagggcgttccagctgacgtgttcgagaagttgaagcctgtactcaccgtttcgcctggcgctcgcgaactgtgcaaagctctgaagaagctcggttgcaaacttgcggtcttgagcggaggattccagcctctggcggaatggctcgctggccaactcggcatcgattatgcatttgccaatcatgtgggttctcccgtccctcatgccaactttccttga

SEQ ID NO: 17387 - DNA, 234 bp, A.fumigatus
ctgtctctgtgcgattctaatagcgcgaaactatgtggcctcgttggcatctaccccccgaggccccagcagcttatcctatcattcgacattgtcccgcttgggtccagtccaagagaagccaaactcaacgccagcaacgcaattcactccaacatcgccgtcccgtatcagagaccgcgtgctgggaccaagaagcatagagcttcgcacagacttggatcgagtcgttga

SEQ ID NO: 17388 - DNA, 1308 bp, A.fumigatus
tatcatcgatggtcactctgccaatcctcatatcgtccacataaccactccaggacttccataatggcagtatcaacaagtcacttcagatcgctctgtgcgtcaaggcccctgtcgcggaccgcaatcgttggccacattagctgccgtagttacgctacaacagaaccctcgccgtcggccacaagcacttcaacaacaacaacagcacgcagacggacaacgttcaaagataaactgaatgccggcccatcgttcgcagactttgtcgggaatggcaatacccctctcgacccctccgaagcatacgctctcaaaaccgccctcgtcgggcccgccggccgcaagaaggaaatgactcgtctgccgtcttggctgaagaccccgattcccgactcgaagaactaccagcgccttaagaaggacctgcgcggccttaatttacacactgtctgtgaagaagcgcggtgtcccaacatctccgattgctggggtggcagcgacaaatccgccgccacagccaccatcatgctgatgggcgatacctgcacccgcggctgccgattctgcagcgtcaagacctcgcggacgccggccccgctcgacccgcacgaaccggagaacacagccgaagcgatctcgcgctggggacttgggtacgtagtcctgaccagcgttgaccgggacgatctcgcggacggaggtgcccggcactttgcagagacagtgatgaagatcaaacagaaggcaccaagtatcctggtggaatgcttgaccggtgattacgcgggcgatctagagatggtgaagctggtcgctcgctccggcttggatgtctacgcacacaacgttgagacagtggaagccctgacgcctcaggtccgtgatcgccgtgccaactttcagcagtctatccgggtgctcgaggcagcgaagaacgcccagccctcgcttatcaccaagacctcgctgatgcttggcctcggggagacggatgaccaattgtgggatgcgctgcgccagctgcgcgcggctaacgtggacgttgtcacattcggacagtatatgcggccgacgaagcgccatatggctgtgcacgagtacgtcactccggatcgattcgagctgtggcgccagcgggcgcttgacatgggcttcctctactgcgcgtcgggccctctcgttcggagcagttacaaggccggcgaggcgttcattgagaatgttctgaagaagagaagagctacttctggaggcacggaaacagtcggcgttcggccagttaccgtcgacgaggtgacgcggtga

SEQ ID NO: 17389 - DNA, 1713 bp, A.fumigatus
agatctccttcgttggacaatatcacagccgccgcgagggagtcgaaagcggcacggccaatgtctgggaatcggacactgcgaacatggcgatcggacctgaacttggcttcgagtctggagacattcggacttctgcccagcccccctctgtctgattccagagattcgcggccatctacgtcgtcgacgtacttctcacccaaaccggattctgagatggaggcgggtgagagacgaatgaaacattgcggttgtattcctgatttcaactcatgcgacgcttgcgacggtgcgcggggtaaggttacgaaagcagaggaaagggcgacacaggaaccaaccaatgtccatgcggcgtactccaacctggtcaaacgatgtgagtccgacgagggacgattcacaccagactccaccgattcggaacgaacattatccccctctcagttttctgataatgagccaccagagctggggaaagcttttagctgtgttgccacggcccagagaagccggacaggaacggtttcaagcgtggggagtagctggatgccaagtaatatctcatactttgagagatggctccaaggtgttccggcgacgctagatgtcaaggacgagaggtcaaaagaactgaacaggagaaagtgtcagatagtccaaaacagtcctccacacctggaacgccggggtgagctggaggcgacagatgaagctgtggtaagtctccatctaagagttactcgttcgcttaccctgctaatacaaaagcagattcttgatctcaccggctgcagcataacaaagcccaaactggtcgatatatcccgacagtcatctcccgccatgagccacacgctcccgaatactacacagcatccagtcccttccactcccgacatgcgccaacatgaaatatctgccttcagtcctgacactccattggagatgtcagatagtggttatgttactcataattcctgttactcgccagacgagtttcaggatgacaaggagtcgcattatacagattctatctcaacccactcagaaacagccagcgaaacgatagtgtgtgagaagctggttctcaaagaaggaccgtctttctcgccacccaaaccaaagcctgagactagagccgactctccgccaaagaaccaaacctccccagcgcggtcgtccagtatgttagagaaggaagagcgaaggtggtgggaccacgaatggacgatcgaacagctggagcaatccgttaaagattttccacagaatatgttgaagcttacgtcgcctgtcattatgttccttcgtcaaaacaacgagaaggcattgattaggccgttccgcaaaatattcccagacgtcgcggagaatctacttgactgtctctgtgcgattctaatagcgcgaaactatgtggcctcgttggcatctaccccccgaggccccagcagcttatcctatcattcgacattgtcccgcttgggtccagtccaagagaagccaaactcaacgccagcaacgcaattcactccaacatcgccgtcccgtatcagagaccgcgtgctgggaccaagaagcatagagcttcgcacagacttggatcgagtcgttgacaacctgctattcgcagtgagcggccggtccgatgaaacattgaaatcggctgtgctcgttttagcccaggtgcttgaatgcaaagcctag

SEQ ID NO: 17390 - DNA, 1518 bp, A.fumigatus
acagatgaggggagttctatgaccgcggaattggctttctggagctcttttatggatgagccagacgcaaatgatttgtcgagggcagtgtcccgtgttttcaacgagtttgttcgatctcctgaggccgtattgcatgatctatcacctattggtcctctcaacgtcgagcagattgttcgattgatgccgtctgccattagcggagaacagcaatgtctccactggctgatcgagcagtgggtgtgtaggactcccgacgctccagcggtctgttcaacggagctggagtggtcgtacgccaagctacaccagctcacgacctcactcagccaccatctgtgccagctaggggttggtagaaacgatcgagcggccatctgcatggaaaaatctccgtgggtcattgtcgctatgcttgcggtacttcaagcgggcgcagctttcgttccccttgatccatctcatcccaggaccaggagagagtctatgatctcttccttggacgcccaggtgctgctcatatccctggatgcggacgaggacgcacaccttaccatgagctcatgtcgacaagttcgtgttggctctacgagaggggccgggtccgatacgggcgtttcaagcaatcttccgaaaaatgaacctgatgacgcagcatatattttgttcacatccggttcgactggccagcccaaaggggtggtcgtaccgcaccgagcggtctgctctagcatcaaggcttggtcggacatgttgaacatccgatccacgacacgctccctacagttcgctgcatatacgtttgatgcggccatcggtgagatctttgcagtcttggcgaatggaggctgtgtctgtgtcccttcagaatcagagaggctcaatttcctgcacgagaccataacccagctggatgtcaattggtccttccttacgccatctgtaatcaggcaaatcgacccgtcgagtgtgcctacattgcaaacattggctcttggaggggagcctctgagtaaggaggtgattgagacgtggtgcgatcgcgttcacttgatcaatgtatacggcccgacggagacctgcgtgttctcccacgccaatcccatcaccgacagcaagcaagaaccttctctgatcggaccacctatattggggcgctcgtgggtggtcagtccattcaatatcgacattctagttcccagaggatgcatcggagaattggtgatcgagagcccggccgtagctgcaggatacttcaataatccggagcaaacagcaaaagcgttcattgccccacctcgatggtggaagctcgcccaagatgccctttctggctcaaataaacttacagaggatgagcttccccgtttctacctaactggcgacatggttcgccaaaatgtggatggttccataacatatctgggtcggcgtgatacgcagacaaagatcaacggtcagcgagttgaactcggagagatcgaataccacattttgcggctcccagccgtttag

SEQ ID NO: 17391 - DNA, 3696 bp, A.fumigatus
gatcagaagacggttcgggcccgcggggaggccgttttaccagaggacttccgactcgaagttgttgagccacaaatagcagcccgttatacaagtgaccttattgttcatttggaacggaacctgcccgcttatatggttccagcgtttttggtggttgtccgccagctcccacttcagccctccggaaagatcaacagacgaatgatccttagctggttgagcgagcccacaatggcaggtctccagaagacacaacacaatttcactcgccgagaggaagaaccaacaacgcttggccctgtggagaagcagatgcgggagatctggagcgaagtgctgaacctccctgtaacccgaatccgccttgaccagtcgtttttcgaccttggtggaggttccatcaccgcgatgcaggttgtctccaggtgtcggcgtagtgggttgcagctgaccgtccaggacctcctacgttggaaaacaatcacgaaagtcacaccacggaccatttctttatcgcaggtgacgggagaacgcgtgtactctctgactagtgccggttcagttgtcgatatgcgcagcatcgctagcaagctcgaagccatcgggttgcccggcagggcaggcgtcaagggagtttacgcttgttcgccgatgcaagaaggaatcctactggcagctctcaaatctccggggaaatatgaggttgtcctgatgctcgaaatccgggccacagggtcccaggatcgggtcgacttggaattactagaatctgcttggttacaggtagtcgaccggcacgatatgctcagaactgtttttcttcaagagaagaccgcgactggtgtattctcccaggtcgtttataagcacatagacccaccaatagagataacaaccgtcgatgacctagatacactgagaagcgcttccttctccgcgtgtcatttcgattgcattccctatcgagtgactttatgcaagttatccgggtcttctctagcctatgttcgacttgatattagccatgccgttgtagacggctggagtttatcaatcctatcgcgagacctccagcaagcgtatgacggccaactgccctcccagccggttgctcaatactgtgagttgattcagtatcttgagtcgcaaccacaggagacgtcaatggagttctggaggcatctgttgacgggaatggttccttgccatctcccccacatgatcagctactcaggtagccattcgacacaggaagtgaagctgcaccagactcgactcgaggtcgatcgaaatcaagaactgcgtgatttctgcgcagctcatgatattactatcgccaatgtctttcaattggcctgggctgtcgtcctttatcgctacactggcatggaagatgtttgttttggatatctcatctctggtcgggatgcccctatcgacaatttagaggatgctgtgggcccctttatcaacatactggtcgctcgtgcgaccctccgacagggtattagcgtgaaggaatttctgggtgagatacgggacactttccttgccatgtctgctcaccagcacacctctttgactcagatccagcacgaactagctgtcggcaacctaggcttgtttaacacagcgcttaatgttcaacaccgcgccctgacacagcagaatccccattctgacattgagatatgtgaattgtcgggcagggatcctagcgagttcggggctattctgaacgtcatcgacgcgggaaatactctggagtttgctctctcatattggtcagatttactatccgaagaaactggccgagaaatctgctcgttcctctcttgtattttgtcggccgtcttggacaatagcggatgctcagtcaagaccgtcagccaaaccgccgcggatgctgcacggagcttcatagatcgcaagggcgacgacgacatctcttccacaccacgtggcaatccagcgcctgagtgctatcggccactgaaggaacccaccaatctgattgccttgactgttcaacaagtctgtgcggaggtcttggatttgtctgtatcgtccttgagcctcgacgaaaccttcctttcccttggtggcgattccctcctggcaatgaaggttgtgtcacggtgccgggagcatggtgttgcactcactgtccagcatatgctgcagaatcagaccatccgcgaagtgttcgagcacgcgcgcttctcggactcgttctcatatcggcagttgaggcacacgccagatcctactggtatcccttttcccctcagtcccatccaaaagcttcacttccatttgatgcccactggccagaattactataaccaaagcttctttctccgtgtgaccgaacggctggaagcctcggctatcgaacgggcagttcgtctgctggtcctcaggcattcagttctccgggcccgctttaatcaacagatcgatggggcgtgggcccaggtgatcagcccggacattgaaggatcgtatcatttctctgcaacgtctctaatctcttgggacggcttgtggcccttggttgaaggtgcccagaaaagactcaatatccggcaagggccccttctctcagtggacgtcctcaatctacaagggggcgatcagcacatataccttgtcggccaccatcttgtggttgacctagtctcctggcggattatccttgccgacctggagatcattcttcggggtggtgagctttcccatgatcccccactttcattccagacttggattcgactggcaaccgagtatgcccaggacaatatcgatccggcgacgacgttgccgttccagctccgaccgggcaactttgcgtactggggcatggcaggaataccgaacttggccaaggatgtttcctccttgtccatcactcttcctactgatatcacttcctccttgctcggcccagccaacgcgtctcttggaacggagccaacggatctgatgattgccgcattggcccacacgttctctcttgtgttccacgatcattccgggctgacgattttccaggagtcacacggcagagagccgtggacgccggaaattgacctctcggcgacatgcggatggttcacggttctgacccccttgtccgtagagacagataaagtagagtttcgcaataccttgaaaagggtcaaggatctgcgccgacgcattcccggaaagggatggccgtacttcgcgtctcgattcgcttctcgacggaggaccggtcagaaacttgacgagaaagacgagattgaagtacttttcaatttcgttggactctatcagcagtttaaccgcaatgactctctgttcgtccgtccggtggcagatgtaagccttccgccagacttctcaccagattccatcaggctcgctttaattgaaatcaatagtctcgtggacggccaagggcggatggtgatgcacgtcacatataactccagaatgaagcgccaggaaggtctcaccgcttggctcgagcgctctcagcaagtattggaagaggagatgccgaagcttctgacggcggccccggagcgaacacccagcgatttccaattgctcagcctgtcctataatgagctcagtgccctagaaagtcactgccacaagcagttcgtcttcaccacggggctggaagggaccgcgcattgggga

SEQ ID NO: 17392 - DNA, 1131 bp, A.fumigatus
agaaaaagtaaacaaagaaaatcgcatacgatgttgccggacgcagattctaaagatcagcttgtaactatcatacaatcagtcaagcctcccaccgtccccccgcatcgctcgcacgaccccgccaacaacctcaagcgcaccgatccctaccagttcggctcccgctacctcgaggaaggcgacgatgtcttcgagttcaacgcctgggatcatgtcgaaccggacgacgagttcaaagccttcgccgaagtccaatacgccaagcaacgtgaatcccccgtctcagacttcgacaagcagcgcttcaacaaggaccccgcgaaatggtggaatctgttctacaagaacaacacgtccaacttcttcaaggatcgcaagtggttgcgccaggagtttcccgtgctcgccgaggtaacgcagaagggagcgggcaggaaggtcgtgctggaggttggtgccggggcgggcaacacggcgtttccgctcattacacataataagaatgaggagttgatggtgcatgcatgcgatttctccaagacggcggtgcaggtgatgcgtgagagcgagcactacaatcccaagtttatttcggcggatgtgtgggacgtgacagccgtgccggacgaggagaacaatgggcttcctccggggttgacggaggggtcagtagatgtggttattctcatcttcattttttccgctttggcacccagtcaatgggaccaggctattcggaatgtctatcgggtattgaaaccaggcgggctcgttctgttccgtgactatgggcgcggcgatttggctcaggtgcgattcaaaaaaggccggtacatggacgagaatttctatgtccgcggcgacggcaccagggtctactttttcgagaaagaacagctggagaagatgtgggggacatggacgccagagaaaggtctgcagatggctgaggacaactccatcatggcggagtccgagggcgcattcgacgtggagaagataggcgttgatcgacgcttgattgtcaatcgccagcggaaactcaagatgtaccgctgctggatccaggctcattacagaaaacgcgagacacctgccgcagtggaggctgagaaggcggattcgtga

SEQ ID NO: 17393 - DNA, 285 bp, A.fumigatus
cgaaaagaacccgcgcgactttgccagcgcggacggcgacgagctcacctcggacgtctcctcggcgatttccttcccaagcagctacggcaacacctcgacggccacaagggagacgcccccgccgccgtattcgccgcgcatgtctcctgccccgtcgaggtccatgtctatttcctccttgaatcccccgccgctccctccgccgccgcctatggcgcatattgcgcagcctcggccggtgttgcggcgggagtgtttgccgcgggatcttgcgggccatag

SEQ ID NO: 17394 - DNA, 1311 bp, A.fumigatus
cggaactgggaaagacgcatgcattggatcgaacagtatcgaaagtcgcacatggttcacatcgactcgagtcttcgcagagcgtatgcgaccctagaagccgtgagagactcatgctcctacgcctccggggagcttatgggaggtggaaagaagagagccaagatcctggtcgagaccctcgaggaccgctacaacgatgcgctggctacaaaggagacgctggagcaaaaggctcaagccggagtacgcctgatggagtccttcctggtcgagctggagtctcgagcccatgcggttcgcgaccggggcatttatggcgctctggacgatggatggaaggccgtcgactcgaagttggtgcacgctcgtgaagtggtcgacgagggaatagaacaggctcgtcgagccaaggattcgctacgggaaagcattaaccgtgccatcttactagctcaagagcagcgattgatcacttacgctgaccttcctcacccgtggcgaatcaatccccacatcttgcagggatatcgcttttcctcatcgaaggtggaatgtctcatgtcagtcttcagcgtctgcaacgaaaccgtcaatatctggtcgcacctgatcggtctcttcatcgtcctctcggtcgccttctacttttaccctctcaatcctaattttcatctgagcaccaagaccgatgtggcgatcgctgctgtatttttctttgctgcgtgcaagtgtctggtctgcagtactctgtggcacaccatgaacagcattgccaatcagccgcttatggagagatttgcgtgtgtcgattacacggggatctcgcttctggtggccgcctccattgtgacgaccgagtacacggctttctactgcgagcccgtttctcgctggacgtatattttactgaccatgtcgctcggaatcggcggtgtcattctgccctggcatcccacttttaatcgtaatgacttggcttgggctcgtgtggcattttacgtgacccttgcgcttacaggatttgcgcccttgttccagctcacttatacgcgcggattcgtctggtgtctttacttctatgctcccgttgtgaagagtattctggtctactttgccggagcttgcatctatgcctctcagattcctgagcgatggcgcccaggacttttcgactacttcggtggcagccacaacatctggcatatagctgtgctcggtggtattctgttccactactgcgccatgcaggacttgttcgccaatgcgttcgttcgagctaagggagaatgccccagcttgacggcatga

SEQ ID NO: 17395 - DNA, 708 bp, A.fumigatus
tattgttccatatcatcaggggcttccataagccctcgtcgtacaaaaagttctgtcatgtcatttctcagcgggctgtgcggctgcttcgccccgaagagtcccccacgtgcaccatcagcccgggctctaagccgagcaatggccgaaacccatcagcatcatcactatcacaatgacagcaactttacctctcaccatcgtcctgatgaagggccggtttacatggccttcgatgaggatgggtacaccccgcccgtcccgctgccacggtacacccctcggccgatgagcagtatccaagaaaagacgctggaagcgcacatgcgcgatcctcccgtctcctcgtcacgctccatcatctcgctgcatgacgaaaagaacccgcgcgactttgccagcgcggacggcgacgagctcacctcggacgtctcctcggcgatttccttcccaagcagctacggcaacacctcgacggccacaagggagacgcccccgccgccgtattcgccgcgcatgtctcctgccccgtcgaggtccatgtctatttcctccttgaatcccccgccgctccctccgccgccgcctatggcgcatattgcgcagcctcggccggtgttgcggcgggagtgtttgccgcgggatcttgcgggccatagccgggtgagttttgagagccagcggcgcttctcgtgggagagtaggtga

SEQ ID NO: 17396 - DNA, 270 bp, A.fumigatus
gagttcgacttgttaaatagatactatcatcattataatctgttgagactatctgcatggcttatcgctttcttcttgtcctacatccaggttccctgtcgattcggtccttttgtttctattattattattactactaccacctacttcctactactctattattattattattattatttttatctattttcgcgctgccacttggatctcaacaacccctctcggcccgcctgtgaccaccactctttcttccctgttcgtctctag

SEQ ID NO: 17397 - DNA, 411 bp, A.fumigatus
ttggccttgaagaactcggcagcatcctcctcggcgctgccaccaatctcaccaatcaagatgataccgtctgtctcctcatcctcgaggaagatcttcaggcagtcaatgaagttggtaccggagaaggggtcaccaccgataccaacgacgagggactggccgagaccggcctgggtggtctggttgacagcctcgtatgtcagggttccggaccgagacacaataccgacacgaccacgcttgtggatgaatccaggcatgataccaatcttacattggccctacgatgtagaaaggaggatatcaacacgccgtacggccttagaaaaaccaaattcagatgcgactgaacttacaggagcgatgataccggggcaattgggtccaaccagacgggtcttgttctga

SEQ ID NO: 17398 - DNA, 1734 bp, A.fumigatus
actttcacaatggcgacccttaccatgacaatgccgccaccatccaaacccaagaacggcaacgagaaactcccgccagaaaatgaacgttatatgcgagcttgctctgatatcgcaaatgtgctcattcaggagtatgaagcgcagagggattcaaccaaacctaggaaagatatcaatctcaacaagctgcgcggccaaatcgcgaagaagcatcgcctggctacgcaacctcccttgacggctatcatcgctgctgtgccggaacaatacaagaaatatatcttacccaagctcatcgcgaagcccattcggacgtcgtcggggattgccgttgttgccgtgatgagcaaacctcaccgttgtccgcatattgcctacaccggtaacatttgtgtttactgccctggcggacccgattcggattttgagtattcgacacaatcatatactggctacgagccgacatcgatgcgcgcgatccgagcacggtacgatccgtttgaacaagcgagaggtcgggttgatcagatcaagtcactcggccatagtgtggacaaggtggaatatattgtcatgggtggcacatttatgtctcttccgccggattatagagaatccttcatcgctcagcttcacaatgcgctgagtgggtaccagacggacaatgttgacgaggctgttcaggccggcgaaatgagcaatataaaatgcgtgggtattacgatcgagacgcggccggattactgtctggatactcatctgagtgatatgcttcgatatgggtgcacgcgattggaaatcggtgtccaaagtttgtatgaagatgttgcgcgggatacgaatcgaggccatactgtcgctgcagtggcagagacattcaagctcgccaaggacgctgggtttaaagtcgttagtcacatgatgccagatctaccgaatgtcggcatggaacgggatcttttccagtttcaggaatattttgaaaacccagccttccgtacggacggtctgaagatttatccgacactggtcattcggggtacaggtctgtatgagctttggagaacgggtcgctacaagaactacactcccaacgcgctggtagatcttgtcgctcgaatccttgcgctcgtaccgccgtggacgcgtatctaccgggtgcagcgagatattcccatgcccctggtcacttccggcgtggagaatggtaaccttcgagaactggctttggcacgcatgaaagactttggtacaacatgtcgtgatgtgcgcactcgcgaagttggtattaacgaagtaaaaaacaaaatccgcccctcgcaagtggagctcatccgccgagactatactgccaacggtggttgggaaacattcctcgcctatgaagatcctaagcaggatattctcatcggcttactgcgcctgcgaaagtgcagcgcgactcacactttccgtccggaattcacgggccagcagacgagtattgtgcgagagctccacgtatatggctctgcggtaccgctccacggccgcgatccgcggaagttccagcaccgaggatttggaaccttgctaatggaggaggccgagcggatcgctcgagaagaacacggaagtcgaaagatcagtgtcatctcgggagtcggtgtccgcagctactatgctcgtcttgggtacacacttgacggtccttacatgtccaagatgctcgatccaattgaagacgaataa

SEQ ID NO: 17399 - DNA, 285 bp, A.fumigatus
attagcatcgctgacgccgattttccgcatttcgcagcattacggagggtattcctcagcacggtaagtcttttctctccgcgcaatatggcttctttcgacgcaaaaactgactcggaatcaacagacatggttcgcatcacggatatcttgaagactcagaacaagacccgtctggttggacccaattgccccggtatcatcgctcctgtaagttcagtcgcatctgaatttggtttttctaaggccgtacggcgtgttgatatcctcctttctacatcgtag

SEQ ID NO: 17400 - DNA, 408 bp, A.fumigatus
ggccaatgtaagattggtatcatgcctggattcatccacaagcgtggtcgtgtcggtattgtgtctcggtccggaaccctgacatacgaggctgtcaaccagaccacccaggccggtctcggccagtccctcgtcgttggtatcggtggtgaccccttctccggtaccaacttcattgactgcctgaagatcttcctcgaggatgaggagacagacggtatcatcttgattggtgagattggtggcagcgccgaggaggatgctgccgagttcttcaaggccaactacaagcacaacaaacccgctgttgggtttcatcgctgggcattaacgctcctcccggtcgtcctatgggtcacaccggtgctatcgtcaacggtgggtaaagttggtgctgaactccaataa

SEQ ID NO: 17401 - DNA, 231 bp, A.fumigatus
ccccttgatcttggttgtatcggtgtacgacaggagttcagaagcttacaattcccaggaaccaaggttgtcggtggtaccaaccccaagaaggccggtacgatgcaccttgatagacctgttttcgcaaatgtcagcgaggctgtgaaggaaactggtgccactgcctctgctatcttcgtcccgtatggaatcacaatttcccgtttccgtcgttgtcggacttactga

SEQ ID NO: 17402 - DNA, 327 bp, A.fumigatus
ggtggctgtagacccgatcatcaaaacagacagcattgcccgtggttaccaacctactcgcacccagcaactaacgaaacacaaccacctagtcgggtagtgtatagcagaccctccactatggctcatgagatgggtaagctgttcctgcgtctctttcggtgctccgaggcctctactttccatctgatctctcgttactgccctgccactagcctatctcttttagcctccgctttccgtcgagtgttgctaatccgtagtcaaaacaaacagggcgagctgcatctcaatgctcgagtgtcgcatcgcaaactacacagttag

SEQ ID NO: 17403 - DNA, 345 bp, A.fumigatus
aaatcctgtacagacaccgttattgcagtcatggcactccctcaaacacaaatcgcagcagtcgtgtcaggacccagaaagtcctcaagtgcacgggtagagattacaagtgaacgccctgtgccatctccaaagcaaggggaagtgctcatcaagctcgaatattccggagtgtgccattcggatgtccatagcattcgtggggatacgctcatgttaaccgacgtcgcaggtcacgagggagtagggaaggtaatacaaggtgaggcgcatagagccgacttgccatgtctaacggttcttctgatgtactctttgtctcttagttggatcgaacgtggatga

SEQ ID NO: 17404 - DNA, 393 bp, A.fumigatus
gatctgggaggtcaaacgtccattcgaccctactggcgttgctactacgccaacactgccgctgttatattcgtcattgattctaccgatattgagcgacttggcacagctgcggatgaacttgcggctatgctgaacgaagaggagttgcgtgatgcggcattgctggtgttcgcaaacaagcaggatcaacccggcgccaagggtgccggagagatctcggaagctctgaagctcggggagctgcgagataggaactggagcatcgtagcatgctccgccattgatggtaaaggtctagatgagggtatggactggttggttgtaagttgccctctctggctgtccgctcgcttcgtgcctatacttgatttacagggtactaacttgtaa

SEQ ID NO: 17405 - DNA, 201 bp, A.fumigatus
gtctcttggacaataggtctcaccattgtcggaaattccgctggtaccgcaaaggagatggaagagctcttaactatggctgtggcaggagacgtgaaggctcacattgagtgttttgacttctcctgtatcaatgacgtcctacaaagactggagagggctgaaatcgacggacgagctgtcttgaaaattcccgaatga

SEQ ID NO: 17406 - DNA, 303 bp, A.fumigatus
  unsure (71),(85): Identity of nucleotide sequences at the above locations are unknown.
atcttgatccagtggggacaaaaagaggagctctgtctctcgcttggggcgacggactattttgattatanaaaggatgatatgnctgttagtgtcacgtctgttactcgaggtctaggcgcccacgcagtgatatgcacggcgaacagtgagtcggcatacattcatagcatgcagatgctccgccgtctgggggtcttggtttgtgttggtatcccgaacgagcctttcagactgccgtcaaccccgttggacatgattgtgaaaggtatggggcgcaccaggcgatgtcagcctcattga

SEQ ID NO: 17407 - DNA, 285 bp, A.fumigatus
gcccttcttcgctttttcgccatgagctccttcagcagcactcctgctggttcatttctgagccgcatggagcctgttcatgcgtacattgcaggtgccggcttcttagtttgcgcacttgtcggggtggttctcatgctggcatcccagcacaagaagtttgactacaatagcggtatcttcacttacctcagattcatctatgcatcgttccttaagccccacaagaaaggtctcaatggccagcaagatgcgctagaaagcttctacaagactcaggtatga

SEQ ID NO: 17408 - DNA, 240 bp, A.fumigatus
gatagctacaacattgaggccatggcttctttcctaccagttacccaattcttctcgcacgtgtaccttgtcgacctgtctccctctctttgcgaggttgcccgtcagcgattcgagcgcctaggctggaagaatgtcacggtcgtctgtcaagatgcgcgctctttccgtctcccccctgagaaaggtatcagccaagggcccgaagacccggcatggttaatgggtggtcgagaggac

SEQ ID NO: 17409 - DNA, 267 bp, A.fumigatus
ctgaccttgtgcattggtttcttctctttcaaatggccagattttaccataaagtttgattatattggagaatcggtgaatgtgagggcacatccgacgtgggtaggctctacagtgaatgtcagaaagagtatggatgtggctctgtcaatgaatgcacagagtgaaataagcaaatgttcagtttgtatcctcaactacctagcatcctctgccacattacatttgactctgcaggacttttcagatcaatataccacattgtaa

SEQ ID NO: 17410 - DNA, 525 bp, A.fumigatus
aacggaacatgtctgtttgtaggccgccaacaaagtcagcatgcgcaaattatcgatatcatcatcatgttgttggcatacttggcgatgcacctcactttcctatcactctttatgtcaatgcgccagctcgggtcccgtttctggttggcctattcagtgctcctctctggtttcttctccttgttcttcggactaaaggtcactactagcagtggtgtatctacctccatgatcactctttctgaatgcctgccaatattggcaatcattgtgggatttgagaaacccatccgtttaacgagagccgtcctgcgtgctgcgaccgaatcctaccttcctgcaaaaccaatggcccgtcggtccacacccgaagccattgaggtggccatcatgcgcgaaggatggcgtatcgtgcgtgactacgctattgaaattgctatcctggcggcaggcgcaacttcaagggtacaaggggctctcccctcagttttgctttcttgcggcctggatcctcctctttga

SEQ ID NO: 17411 - DNA, 873 bp, A.fumigatus
cgagctgatagactcgcagaaaagcgaacagtagatgcaatgctacaagaaggacgagtatcgctattggaagatgaggagatagtcaatctatgcctccgcggcaaaatttctgctcatgccctggagaagacgatggaacgccatccgacgatgagccgcttggaagcctttaccagagctgtcaagatccggcgcacagttgtgtcgcgtacaccgtcaacgattgatgtttcaagtagcctagagtattccaaagctccctttgagaactatgactataccttagtccatggggcctgctgtgagaatatcattgggtatctgccattaccagtaggtgccggtggacccctggaaatagatggtcggaactattttattccaatggcaactactgagggagtactagttgccagcgcgagtcggggctgcaaagcaattaatgctgggggcggtgctgtgaccgtcatcaatgccgacggcatgacccgagggccatgtcttgcattctcatccgtatctcgcgcagcagaagccaaacaatggattgattcagacgaaggaaagaagatactggccacggcgttcaactccaccagtcgatttgcccgcctgcagggcttgaaatcagcgcaagctggcacgtacctctatgtccgattcaaatcgacaactggggacgcaatggggatgaacatgatttcgaaaggagttgaaaaagcccttgaagtcatgaaggggcatggattttcagacatgtcaactatttcagtgacaggcaactactgcgtcgacaagaaaccagccgcgatcaactggattgatggacggggcaaatcagtagtcgctgaggctttccatcccagctga

SEQ ID NO: 17412 - DNA, 963 bp, A.fumigatus
cgagagccgtcctgcgtgctgcgaccgaatcctaccttcctgcaaaaccaatggcccgtcggtccacacccgaagccattgaggtggccatcatgcgcgaaggatggcgtatcgtgcgtgactacgctattgaaattgctatcctggcggcaggcgcaacttcaagggtacaaggggctctcccctcagttttgctttcttgcggcctggatcctcctctttgacagctttgctcctattttacctttctacatcagtgtgctctgtgtgaaactggaaatcacgcgcatcaggaagcatgtcgagccgcgtagggctctggaagacgatgacataagcactggtaaccaggattttgactcccgtgtctttggctgcaaggtcaaggcggcaaatatatctcggttcaaatttcttatggttggcggcttcgtgcttttcaatgtgcttcagctttcgtccctaacttacggcaatgtcagggtttctgactggatgccgtacctgtcgaacctttccaacactctgatgcctgccccaatcaacccataccgagtcgtacgcaatggtttggacgatatatacgtggcttcccgtgcaaataacattgaaacgcgcgttacagtgttgccgccgatcaaatacgtcctgcagtctcagagtaggcattgtcgggataactttgctggcccgctctgcgatacattacgcggtcgtactcttgggtgcgtgctggcatggctagaggatccagtcatcagcaaatgggtgattgctgcgctcttcctaagccttgtactgaacagttatctaatgaaggcagctcgctggaatctacgccagagcgaggtaattccagacagctctgcaaccgtgagccagacaaaggactcttccaataagtatgaaaagaccatgtcaggacctagcgagctgatagactcgcagaaaagcgaacagtag

SEQ ID NO: 17413 - DNA, 198 bp, A.fumigatus
ctgggccaactgcgatcaaccgttcggtccacttcccttaaggcgctaagcaagcctcctccatttttttccggtgcagctagccaactgagaatagaactggtgaactatggtcaattggtgatcaactacgatgaactctcgggcccacttgggtcgaggcgctatgcaagccgcctctttccttttctgggctag

SEQ ID NO: 17414 - DNA, 1689 bp, A.fumigatus
atgggatttagtgcgctaagtacggagcttatccaactcattgctcgacagcttacagaaaaggatacggcgatattggctcgaacatgccaactcctttaccgcaccttaaacagtatcctgtaccgttataatgcgaaataccatgcatcgtcggctctgttatgggcctgcgaaaagggaatattagacactgttctccgcttcttggaatataataccaacgacaatacgcggttgtctagcgattggaaaggccgggatcacccgttatatgttgccgcaaagaacggctatgatgaaatcgtccgaacactcctgcaagaaggcgtcaaggtagatgcaacgagtaaccgccgccgtactgcaatttccatagcggcctctaacgggcaccagtctgtggtcgatgagctgctatgtgcaggggccgactatgaccttgctgacgatgagcgcaagacgcctctctcatgggctgctgaacatggatttgtggcagttgttgaacaactcgtcgctgcaggagccaacattaaccatatagacatacacggacaaacgccgctttatcttgccgcatggcgtggtcgggacgagtcagttaggcaacttctgcaagcgaaggctgatacaagtatatctgcagatataacaggccttacagcgctctcgattgctgcattcaagggaaacagcgccattgtcaagcagctcattaaagcgggggccgatatacaccatacaaatgccactggcaacactcctctcatgctcgcggtatgtatcagacatattgccacggttcgtgaactgctgcacgcgggggccaaaacaacaggttgcagtaccaatcgtgaaaacgcacttgcttgggctgcggaacacggagatattgatatggttcgaatacttattgaagcaggtgccgacgttaaatctactcatccagacggacgaaatgctctttccttcgctgcggaacgcgggcacattgagatttgcaaaatactggtccaggctggctcggaagttgactcggtagacatgcttggccgcacggcattatcctgggccgcagaacatggaagcattgatcagtttatttacttatggcagctcgacccccagcttggtcaaactgatcgatttggacgctccccgttgtcttgggcggcggagaaaggacataatgacatcattagcttcgtcgtctcccaaagagctccgttggatattacacataaagggaactgggacgtggaactgatttcggacgccattcgaaagctgcatcggagcacattcaaattactacctcctttgcgatttccatggcagtttagaagggaagagtttagaagggaagatgccgcgacactacagaggccagcctgcaaccctcttgggatagctgtggctcaaggacacactcaggcagtcaaaacattgctggacgcgggcgctgcaacagacatcaaagatatcactggatttactcccctaatgttggcagccaagaggggtgacttacacgtcgtgtcgctcttggtaagtgctggtgcgtctttggaccgaaaatgccaaagagggtgggacgctgcgaagatagcgagtgctagtggccaccattctcttgccttctatctgaaccgggaaagtggtcgcatgagatacaccagtccatga

SEQ ID NO: 17415 - DNA, 1704 bp, A.fumigatus
  unsure (313): Identity of nucleotide sequences at the above locations are unknown.
aaaactttatcgccgtgcacctctgacggcgtcgttgtcgccaccgctctggctcggtacatttatcgagagggcatgcgctctgaattctgggaaaggatggaagagcccagcgaggaaacttgcggtgtggcctttcatgtctttgaccgatatggaacagtccagactaagtataaggaccatccagtgcaaagaggaactggcgtctggggaaacgagcttgatcatggccctcttttccttattgaaaaagttcatgttacagcactggaactacgtcggaaagggctggggcagaaattagtgtctntacttttgaacaaagccagacagttctgcctaaacgagaagggagacggcgaatacgcagaccttatctacggttccgatgaggcctttgagcgagcatggactctacatgctctagccagtcccggaatactaacagctgatgtcgaatcacagttagtgggcaagtcagcggaagaacgcttgatgatacgggctcgaattcaatctggtgctattgacttttggcgatcgtgcggttttcgtcgaatcggagcatctcggtgttttgcattttcgttcgatctccagcatcagtctcacgctcttgcggcggcttctgatttcgacccccgtagaagccatgctgaagatcttgaggacgaagaactcgaagttatctatgagacagatcgttttactgaggtgaagaaactgaaaatgggaagacttcgtgacgcgttgccactccatcatgcagctctcactctgacggacgaagaactcaacgcatttttcgtgactcatgctgacgatgagattggttgggatcgagtgaccaactctgaagccacgcttctgcatttaacagcttgcgagctcaagcctctaagtacacggtggctacttgagaatgtccgccacgccgactcctggaagacggctcgtgatattgacgggtacaccccgctcgaagcattgcaggagactctagaaacaatgcgaacacgaaaggaatatggcttgtccagggtgttgaacctatcggaccactttaaagggtatcctgacgccgcagtatcctgtctctccttgctgcttggacaggactctttggggcttagtaaagcatgcctccgattcgggtgtacatgcggagagtgcgtggaaggacttctatctgcccgaatgaggagctctctgatctttcaggttgagattacgtacgaccttatgcaggaggaaattgatgatggcgacttttggataaaagacaaccactacatcctcgtgcacttcgatcccgatgtgcgaaagaacctcagaaccaataagtcacttcgaaagggctttgtgaatattttccaaattgccgtggagtgtattaaggcgagaaaacttcccaccgcggagaatctcaagtggtgctgtaacaaccggagcgagtggccacctgataccaagaactacctgcgacgcgctggtacgcagatgggctttcgggcagtgcttcgtcgtatgttcgacaccgctaaggaagaggatgagaaagcaggtaacggggagtgtcaactcatattgggggaggaatggtcacaactaccaacttgcagaaacgatcatgagtttgaagtagttgccagggcttgtgggtacggcggggatgatttcatttcgttaccatgctggtag

SEQ ID NO: 17416 - DNA, 255 bp, A.fumigatus
cgaccaggaatggacttcgaagacgatgaatcaacagattatggctctgaatacaatggattaagtgactccaaggaagaaggatggtggagggaagatgaaagcgaagatctggattgtgaagaggatattgaagatcacgagtataccacctccggtgacacgccacgaacggtgaagattcggctctttttgaccgatgaggcaatgggagagttcaagtggatgaaaaactttatcgccgtgcacctctga

SEQ ID NO: 17417 - DNA, 567 bp, A.fumigatus
tccgtcctcctccacttcgtctcctcatcctcgccgtgcccatcaccatcctccacaccctcatcctcgcgctgcctcacagtccccgccccaggcccaagcggcagcgacggctcctcacccccaccgatccaattgccctcctcgtcaaaatattcatgcatattctctgccgtgatccacccagaactaccatccatcggcggcggcaggcccccatccgcgctccccatcgtcacgaaaccagactgcatgagcgaatctccctcaccatctccttcctcgtcctcctccaacggatcggggtggagattcgaacacgccgatacagccgcatacatcatctgcaccggtgtctcctccttctcggcttggtcgtccatcgcatcctcggcgggagcggtggtcgcgccgccgacgtactctgcacccgttggcgggacgatcgtcagcgtgatgctttcctcttcctcatcctcggtgttcgtcccaggggcgccgggggtcgcgatctgcatgtataggccttggacttcggcggggtttccgggaaggcgcaggcgctga

SEQ ID NO: 17418 - DNA, 2583 bp, A.fumigatus
cggaaggaacgaactcgattgacaatgccggcgctggccaccgtgatcgcggtggctgctgtgtgcgccgctcttttcatcgtttccgcggtggtgggaacactcgtctggataaaagcctggcgggagcgtcgttcacgaaaagcagtcaaccttggtcagggtcggtacgctagacagtcacgagcattcgaagccgacacggcgacatcactatctcgcgaggagggttctgcgctgagactatacggacaactgccatacggaaagccaactgaatggggcgttttagctagccgggaaagtctcacttactctacagtggactcagaagcttcttctcaactcgctgaaaaagctcgttcgctgggtcgttcgctttcacggtcaaagtcaacccggcagctgaaaggtctgctgagaccgcagcctccaggtcccctggctccacttgcagaggcagcggccgagagaccgtgtgacaaaggccccaggtacaaagccagagaccatgtatctgtctcggcagtcgaaggtgccctagagttaccgacagagatgactcccagacaaacgccggaaaaggaagaagaacgaagccttgccggaccatcgatccgaccactgtcgacggtgatgccttcagtgcatagaagagagcgttcgggcaacctcttccccgttatggaagaccatcatgaaggatttgaactgccttttactcgagtacgaggtggaagcataacgacacagaccgccggtgccattccagaacagccagtgccgcctccgccgtcggcgtatcccccaaaccgattccgcctttcaaagaacgattcgatgcggttctcatcgctgagtctggagacggcggacagctccatcttggacgacagtcggagaacttcaactgctatcgagagtgatttcacttcaccggcattacctccctgcccaaccttcacacccttcagcgccaacgatgtcggccgcttggaattcgagcggcgaagtttcgcagcatcaaactcggcatatcctgcaccattcatctttccggacacatcttctactcgtgactctctgaggctcgaaccaaaccgtacgtcgcctcgccgcagtttaactacgcgtagtcctagtcaaacagagcgcgtcagccctcctcctaggaggagtgaatctctttgttccaaccagtccagaagggaggtcacctccatgccgcacctggacccgaacatgatcccgcatctgaatgccacgggctacaacggctcgctgctgccttacttcagtcagttgcaccggcactccatgtacgcaagtcggcgaatggatggagatcctttctaccgcgatcaggcgagctcacatatctcaatccacccccctcgagcacccgcaaggagggtcagcagtctctatgtgcccgaaatatttactcaggtccgcccggaaaatgctcctaagctaccattgacctccgccatgaagaatacccaaggccaccgaaaaggccacagacgtcagaactgcgtccgaatttcgatccaccctcccatcacctttgggcgtcctgcgttctcgccaatggctgaggagcccgaggagttggaagacatgagtgcgcacaggccagaagctcaagttccacgtccaaccagctacggtattccctcgatgaatccgagtgttgtcaccttctccgcgaacaaaaatgactcgcacggcttccaaagaccccggccacggatcacggacgacttctctactcctgacggaagcccaaccaagaaaaggaagcatagcagagctgactcgggggacgatttcctgagccctgcggggagcgacaagactctgccagaaatcatgacatcaataccgtcctgcaatgatggttgtctttcacagacaccgtctcccgaaaagaatgctcccctctggctgctccccatccatccaagctcgcccacatcccgggagaatgcatcaccgcaaaccagtccgcgtcgttcggcagtgaaggggccacgcacactgccaaatccgatggcgtacagcaatagttctcgctctgccgttccactcgaggagaacgatactccgtcagtacaacaagcctcctcaagtaatccccctcattctttgatgcctcatggtagtaggaaaggtgctggcactgctacggatcccttgccacacaatgaacgcagtgctgtcgtcctacacaacccacttctgcagcagcaagaccaaggggatctctcatgcgacgtgcagaaaacgtcgagcacgtccaacggcaatatagtcaccatatgggaagacaatgatacggaacggaaggctcaggcaatagctccgacaacccagtctaatgactctgcctcatgcctaaagaaattcgttcataaaggccgtcagcagaccacaaccgatgacaagacgccgcacaaatccagccaaaaaacgcccagaaagggcatcacgacgcctacagggaaaaagataggactaggaattggcgctgcaactcctgggagtttatacgatggagacggtttcttaaaagaatag

SEQ ID NO: 17419 - DNA, 201 bp, A.fumigatus
gggggagacgtggatgctgtgggtctcttccccgtgctcccaagcccctcccggtcggaggtcggattccccgattcggcgcagccgcccaaccacgtgatttatctacgctccgatactgaggagagtcaaagcagcaacaacaacaacgcactggatggaatgcttggcccgctgcatcatcagttcctagttaactaa

SEQ ID NO: 17420 - DNA, 324 bp, A.fumigatus
agcctttttcatccagcccctgaggattcgtccttcgttttccgggccgaacaaccattggggcaggcccgggtcatttcaatccgggccttcaattcctccattacccccagcaacaagtgcaagctggtcatcctcgaacgcgacctcctctccacaccggccctcaatgcaatccgcggctcagccccgacagcaaacggatctagcgaccatactaccaccgctaccgcgagcaacaatgtcgccgccgccgacggacaagaaggacaagaaaacgagcttgtcgtggacggtgtagatgtctgggtgacatccgagtga

SEQ ID NO: 17421 - DNA, 711 bp, A.fumigatus
gtctcccatcatcccccccccaacacactctctcttctagctttttatactgactcaatcggcagtaaattcctcctctacgcccccaccgtcgccgccggcgtctcaatcccctacccttccatctccctccatgccattcagcgcctgcgccttcccggaaaccccgccgaagtccaaggcctatacatgcagatcgcgacccccggcgcccctgggacgaacaccgaggatgaggaagaggaaagcatcacgctgacgatcgtcccgccaacgggtgcagagtacgtcggcggcgcgaccaccgctcccgccgaggatgcgatggacgaccaagccgagaaggaggagacaccggtgcagatgatgtatgcggctgtatcggcgtgttcgaatctccaccccgatccgttggaggaggacgaggaaggagatggtgagggagattcgctcatgcagtctggtttcgtgacgatggggagcgcggatgggggcctgccgccgccgatggatggtagttctgggtggatcacggcagagaatatgcatgaatattttgacgaggagggcaattggatcggtgggggtgaggagccgtcgctgccgcttgggcctggggcggggactgtgaggcagcgcgaggatgagggtgtggaggatggtgatgggcacggcgaggatgaggagacgaagtggaggaggacggattag

SEQ ID NO: 17422 - DNA, 2058 bp, A.fumigatus
atcacacaacgaacctcggtctacccccctcatgtagtcgcctcatcgtatcatcgtgaaatccagcaacctcatcataatttcagcttttccattcattacgggattgtcctctttgagggcatggctcataaagaaaggaacggattggcaggcttgaagattgaaacctcgtttcagcgacatcagtggcagcgggctgaaggtggccggggagcgacggatgatggcagtggcatcgagggcgaccgtaccaacatctttcacgattctggcgcgcgcggttgcggtactgatcaagacaacagcatactaagtggtcttcattcagcgactcctccaatctcggtacctcgtcacgatgatcgtcacacgcacgatgttagctatccccataagccagaagaggtttcggcctccccgcttgagagctacatccagaaacgacgaccctccataagctttgaccctaacgtcactctagattccggccaacagcagcctctcgaagagccacttgccaagggagatccgagagatcgaggtctcttaaagtatcaatcaagaacctcgggcttaaggaatgctttgtcccaagaagacgatgaggagcacgttgcgaagcagatcgactacaacgccagtcctagaagatatcgcagccagcgtatcttccccactggatatcgcggaagttttccgactagtcccgaggaagagatgcctatgagctccgaaattgaccgtccaacatccttgacgtctgtttcaaccgtatctcctataaacgatgaggttcggacaccgccggaaagttccagggacctcttatcgcccatctacatggcgtcaccagtacaaacattcgcttcactcgatgaccgcagttcttggtccacaggtgttataacgccattcggtagcaaaccaaggggatttcgaggccctacgcgtcagagctctcgccggtcgacgctctcaagcggcaagtccccagccagcacgtttctgtccatgtggaatggccgagaagagcccaccccacagccagatgacgagggccaaatggttggtactgagtacgtgcttggaaaacagattggctttggcggtttcagcactgtaaaggaagcatataaagttgaagagagtggtggaacgcgacgcctcgctgtgaaaatcgtccgcaagcaggtctctgggaagagcgagaaggaaaatgacatggttcaagctgagtttgatcacgaggtcagagtctggcgatacctcaatcacccgaatattttgacactggatgcggtgtacgagacagattatgccactttttgcttcacgaagctggctattgggggtaccctctttgatcttgttcgccagaaccgtcaaggcttggatatcaagcttgccaagaagtatacctaccagctagcatgcgccctacgatatctgcatgaggatgcccgcgttgtacacagagatatcaagcttgagaactgtctactagaccctcacaagtcccaggacggtacacagtcgtctactcttgtcctttgcgattttggcatgtctgaatggctaaacacggacaatgaaggagactccccaggcccttacgacgacgctgcggaccggccaccgccgaggaacatcggtccggccgggtcgagtactagcgttgcgggaagcttggaatacgcctcccccgagttgcttctctcagacaatggtgtgattgatccttcagtggacatctgggcattcggtgtcattgtctacactgtcattgttggatcccgtcctttccaggattcctttacccctcgtatacaatcgaacattctcaacggaacctggaaccgacaagccgttctgggtgacgcaagcgacccgcaagttgtaacggacagagaagctgcgcttgagctgatccagggttgcctagacatggacgtcagaagacgttggactattcgtgatgtattgtcatcacgatggttggatggcttttccgaaaatacacagaacggtagcagcgactcaatctggaagctttga

SEQ ID NO: 17423 - DNA, 654 bp, A.fumigatus
tggagattttctaacatccggcaacgcagtttcgctctcgacctcgcgcccgccaacctcgaccgcatccaggaatggattgaccaaggccgcatcgacccaacccgccctatcaccattcgcgaactggctaaatcccgctgcatccaccagaccaaggacggcgtgaagcttctcggccgtggcgtatcagctgaaggcggcaacgtcctcaagcaacccatccacattgtcgtatcgcgcgcctccgcaagcgccatcgcggccgtcgaagccgccggcggctccgtgacaacaagattctacactcgctcctccatagcccgcatcatgaagcgtgagacgcacccgttcatctcggccgcgtggtcgcgcgaaagcgccagcgacgccctcctcaaggccgccggcctggaggcccaggatctcgccgagtcaaatatcatgcgcgaaatgggctacaagtaccggctccctgacccgacgaagcgtcgcgatatcgaatactaccgtgacccggcccaccgggggtatctgagccatctgctcaagcctctcgagggacccagtttgttcttccgctcgccggcggagcgcaagtcgtctgctggcgtcaagaaggaaaaggtgctgccggagaacagactctggtag

SEQ ID NO: 17424 - DNA, 270 bp, A.fumigatus
ctggattcccagcagcaagatggaaagcaggaacatcctatggccatcatcatcatcagtctcagagcagaaggaaaatgttacagctgctatggctatggacataccttagtcactacgctccccgccccgattgtcactcccttcccaattgtaacccctgggaggacgatcacgttgccggccaaccagcaatcctcgccgatatggatctcttttcccagctccggaccctcagttccattgcgcacagcggggtccagcggatga

SEQ ID NO: 17425 - DNA, 930 bp, A.fumigatus
  unsure (89): Identity of nucleotide sequences at the above locations are unknown.
caccactaccacttccacactctcaccccgaccgaaaaccaaaatgaacaacagaattcatcccaagaacaaagcgtctcctccggganacggcccgaacccagcaacatcaccagctcaccaggttgggcgacccgcgcgacctgcggcggccacgatcccgattcccctccccccctcgacccatccaagtatcccaacggcgaaaagtccctcgccggcatatcgctacgcgctttccttctaggcacaacgctcggtatctcaaccagcatcacgctctacctcctcctcatctccccgcacccattgtggcgcgttcccttcttcgtctcctcgctcgccctcttccacttcctcgaatactgggtcacagcgcagtacaacacccgttacgcctctatctcagcgtacctcctctcctcgaacggctgggcctacaacgccgcgcacagctctgccgtcgccgagtgtctgctctcgcacaccttcggcccgcgcgatggatacacttcgttgaccgcgtccgtcaacgggatcaagtggcaggtcgttctgggagtcgcgctgatggtgtgtgggcagacgattcgcacgctggcgatgaagcaggcggggacgaatttcaatcatacggtgcaagtcgagcggcaggagggccatacccttgtgcggcacggggtgtatgcggtgctgcggcaccccagctactttgggttcttcggggggggtatggggacacagctggtgctggggaatgtggtttgcttcattgggtatgcggccgtgttgtggaacttcttttacaatcggatcaagcgtgagtgttttcttccgtctgtcgctgattgctggcgaactgggctaacggaacgtaggggaggaaaaattcttggtatgtttctttggagacgaatacgtcgagtataa

SEQ ID NO: 17426 - DNA, 483 bp, A.fumigatus
ccccaaccatctaccttgagatgtgggagcagcatgtcgcgcatactcactggaccccagctgatagtcgatagcattgttgatgacaagactcctcttccacctccaaaaaaggaccccgccgaagacgatgctcttctatcacgggagccgtggatcgaggcaccgatccggatcgactacgggttcaacgtgcggctaggagaaggggtgttcatcaacttcaactgtgtcatcatcgatacttgccttgtcactattggggcacgaacgatgctaggtccaaacgtcagtctatatagcggaactcatccgctggaccccgctgtgcgcaatggaactgagggtccggagctgggaaaagagatccatatcggcgaggattgctggttggccggcaacgtgatcgtcctcccaggggttacaattgggaagggagtgacaatcggggcggggagcgtagtgactaaggtatgtccatag

SEQ ID NO: 17427 - DNA, 648 bp, A.fumigatus
ttttttttgggccggttcccattccattctctctggtaccaacagcctaaccgctcttttcttctgctttttccaagaggaagctgtcccttctggcttcggtggccctggtgccattggtgtctgcccattatttcttggacgtccttgttatcgatggcaagggagaccagaagcaacgagttcgttcgctccaacacccgcccggccaagtacaacccgaccaagtggaagaacattcgcgacgacatgacacctgatatgcccgacttccgctgcaacaaaggcgcctttaccttcgccggccagacaggcacggctgaggtgaaggccggctccaagcttgctatgaagctcgccgtcggggccactatgcagcatccgggccctgccttggtgtacatgtccaaggctccaagcagcgccaagacctatgagggtgatggtgactggttcaagattcacgaagaaggcgtttgcaacaagaatgccgacttcaccaaggacgcctggtgcacctgggacaaggaccgcattgagtttaccattcctgctgatctccctgacggggagtacctcatccgccctgagcacattggtatgcgcttttttttccccctgcatctttcattatccatggatacgtga

SEQ ID NO: 17428 - DNA, 315 bp, A.fumigatus
gttcagcagattcaccgcgtgtctgtctctactattcgcttcttctacccacagtgtagtagttttttttgggccggttcccattccattctctctggtaccaacagcctaaccgctcttttcttctgctttttccaagaggaagctgtcccttctggcttcggtggccctggtgccattggtgtctgcccattatttcttggacgtccttgttatcgatggcaagggagaccagaagcaacgagttcgttcgctccaacacccgcccggccaagtacaacccgaccaagtggaagaacattcgcgacgacatga

SEQ ID NO: 17429 - DNA, 321 bp, A.fumigatus
ccatactccagctgcgcccaagtcaaggttgttggcggtggcaccggcacccccggtcctactatcaagttccccggcggatacaagaaagacgacccgtccttcaacttcagtctctggaatggctacaaggattatcctatgcctggccctactgtctggaccggcggatctggctctggctctagctcgtactccaaggttgccaacgtcaccagctccgatgagtcctcccagtctggtgcttcttcctctcagggcactgtgagcacctgccccaacaagtacaaccgccggcacgctcgtcagttcaagccctaa

SEQ ID NO: 17430 - DNA, 906 bp, A.fumigatus
gactctcagctgccctgtgagcaccacaatcttccatattgtcaccggctatcatatccacccatcaacattcctcgaggtctcacaatggtcccaaccattatatattcggccatcttggcgttgagcgccttcacgccctcggtctttgcccagactcgatcctctggttgcggcaaacagccgagtctcgccaacggcgtgcacaacatcaatggccgggagtatatactcaaggttcctgacaactacgataagaacaaagcccatcacctagtttttggcttgcactggcgcggcggcaacatgtggaacattgtcgacggccaaagtatccagccctggtacggccttgagacgcgcgctcagggcagcgccatattcgttgcccctaacggcaaaaatgctggctgggccaaatacggcggcgaggatattgccttcatcgatgcgatcatcaagcaggtcgaaagcgacctttgcgttgatcaaagctctcgctttgcaacgcgattcagctgggcgggtgatatgtggtattcgttagcctgttggcgtgcgaagcagttcaaggcagtctctgttctgagtggtggtgtgatcagcggttgcgacggtggaaacgacccaattgcgtatctcggcatccacggcatcaacgatggcgtgctgcccttccaagggggcgtcaacgtggcccagaagttagtccgtaacaatggatgtcagcaatccaacgttggcacaccacagcctggcagccgtggctcggtccgcacggacttcaagggatgttcgaagccggtttcattcattgcctatgatggtggccatgacgctgctcctcttggtgtgggtagttctctggcccctgatgcgacttggagattcttcatggccgcttga

SEQ ID NO: 17431 - DNA, 702 bp, A.fumigatus
gccaacaatggattggaggtctcctgcgactccttccccgccgacgaccaaaccgatcccgacgcctacaagacagcaatcgacgccctggagcccggcagcgccatcaccatcttcactcctgaccccacccacttccccattgccctgtacgccatccagcgtaaaatccacgtcatgatcaccaagcccgccacaaagctgctgcaggaccacctcaccctcctcgaggagtcccgcaagcacggcgtcttcgtctacatcgagcaccacaagcgcttcgatcctgcctactcggacgcccgcgccaaggccaagaacctcggcgacttcaactacttctactcctacatgagccagcccaagagccagctcgagaccttcaaggcctgggccggcaaggagagcgacatctcttactacctcaactcccaccatatcgacatcaacgagagcatggtccccgactacactcccgtcaaggtcaccgcgtccgcagccaagggcacggccgtcgggctgggctgcgccccggagacagaggataccatcaccctgctggtaaactggcagaacaagcaggacccctccaaggtcgccacgggggtctacacagccagctggaccgccccgcagaaggccggtgtccattccaaccaatacttccactgtagggtcatctcgtccagcttttttcggtga

SEQ ID NO: 17432 - DNA, 276 bp, A.fumigatus
tctccgggtaggttctacatgcgctacgcccccgacgaagagggcaactttggcggccagacgggctacgggtacgtcagtttcgaaaagttcatcgacgccgtcacggccctgaatgagggtcgcgtgacgctggaccagcttgatgcgcggcccctgccaaccctcaagaataccattgccaccacggcgatcctgcacgcgggccggatttcgctggacgagaaccgcgcggtggagattgttcacgacggcgacaagtgggagttgaagtag

SEQ ID NO: 17433 - DNA, 2043 bp, A.fumigatus
cttcaggcggaagccatggttatggcagactataatgatgaagacggtggcgtcattcttgatggtccctttgaccctgatgcgcaggccaccgttaccgacttcatagattacaccgaatacctccccgcggacctgatccgttccctcaccctcatacgtggcttggacgaacgttatctcgaggctacacaaaatgttcacgaactgaccaagacgtggggccagctccccgaccttccctctcacgagcgcccagacgcgcagacactccgcaaaaacatctcggcgcaacttgaccaagcaatcaacgcgcgcgagtgtgcttatgccgaagcgtgccgtctctacgacgttgtcgaccgacacttcaatcggctggagtgcatcaagcagaaactccatgcactgccgaaaccagagtcgcgcgaacctacacctccagagactcagaccacgcttaataagcgaggccgatcctcaaagaagggcgaggccgctgcgccgacgacaacgcgcataaaactacggcttgatggtgcggcaaatgcggggactagaccagaacaaaggtcgaggagtcggcggggaaagcttgctgcggatcacctcgccggccttcatccggactccccgatcgctagcaccgagcactcagatgtggaggctggaacgaaaccgactcgcagtgctgcgcctgaggagcttgcggtcgccaaaggcaagaaggagaaacagactcgtcgatcacggacctctgcgccactgacgaacggccatggccatggcgctgcgatgtcgaccagcaatgctctggcaatgctcaagcccccaccagaggatgccaaaccgggcagtgaagatttgccgtggctgcgcttgactgaatgggagatgacgaaactgcgcaagaagatgaagaagaacgccgtctggcaacctagtgaggtcatgattcaccgcgagctcgctctccgcgggcgagggtgggatgcctaccggcgagccaaagcggaggcagaagccaatggcaccgagtttcttgactgcgacgatatcatgaacaattacgtcccaggaatgttgacgcggctcaccgatgcgaacggcatcgagggtgtggtggagaccaagttgagcaatcgtggaatgaagctcaacgaggcgaagaaacttaagcgggaaaacatggccagggagcaagcggcagcggcagccgccgcagcggccgaggccaagcgtcttgccgagtctggaactacaggcgcagcagctcccgaccaatctcaggtggagtcatccttggccgctcggaagccaagcagagcgtcgaaaaagagaaaggtggatgaaagtgtagccgcgcaagctgcgcccgctcctccagtggactccgaaactcgtggttctctccgaagctcagcaaagcgccgtaaaatgagcaagacgcctgtggaggcagatgaggcaatggtcgacgagaccgctgatcaagcagcgaaaatcgagagttccaaggcgtcacccgtaccatcagcggccagcacagtagcagcagctcagaccaaggaaatcaaaacctcgaccccgcccgtcagccgacctccttcccggcaccttgcgcctggtggtgcatcggcagaagtagccgctcttgcgcctggcaaagatctccgtcgcaagagcaccacgcctgcaaggaggactcctgttccggaaggatctcaggcaggcggccgtcgcagaaagcgtcccgctcccggtccggtatcgtcgggacaggacggcggggcagcggtcagctacggccgacgcaaggcgaagcctgccaaaaagagattcggaccgcgcgaacaggggcagaaggatggtacaacgagggaggacattcgcatagatgaagatggcgtgttggaggagattgaccccaacgaaccgcggtattgtctctgcggcgatgtcagcttcggaacgatgatctgctgcgagaaccaggatgtaagtttttgccttgtgtcttcaatttcttcaattcattactaa

SEQ ID NO: 17434 - DNA, 2553 bp, A.fumigatus
  unsure (2525): Identity of nucleotide sequences at the above locations are unknown.
tgcttgggaatgccaaagtcgtgggccgactcgcagatcatgtgccacttgatcgtccgcagggagttgatcatgtcgcgtcgacaggccgacacacctccgccctcgttcggccaggtgcccgtgtcggcccgccatgacgtgcagcgacttgtccgtgtccgacccgaattccttggaccgggtgttgacgactgcttctcccccgggcccttttttcaccatatggttgactttgatcgccatgggcgtccagttgaagatgttgtcgtcgaggtcggcactcgccatgaccgtgtccgcgcgcaggtccaggtacttcttcgccgaggccagatcgccccggtcccggctgcgccagtacggggccagcgtcttgtcgcggcgcagcagccgctcgtccatccagcggacgatgatgccgtcaaagtcgacgcggtccttccacgccttccagaccagcgagcgggcccgcgaggtcgagacgggaaaccgcttggtggagaggcccaggaagcgggtgatggcgttggagctgagactgtcgcagtagaagagcggattgtcatgcacaaagctggtgtacttgggcttggccaggacgccgaggaagtcatgctcgatcatgggcggcgtctggatcttctgcccgttgagcgtggtgaagatggtcgggtggaacttgtggtcgtacagccagcgagcctcgtagacgtcggcgccttgcacgaaggtcgcctcggtgaccttggagtgcgggatccagcgctcgaccttctcgggatgccgcacgggaggcgcacaccaggagacggtgcaggtaatgtgcgagagcacaaactcggcgcgaagcagttcgtcgccgaaccgggggttcttccggtagtggtacttgaaccggatcaggttgccatctttcatgtaggaaccggcctcgatgagacccttgcggttatactggacgctctgcagatggctgtcgccgcggatgcaccgccggcccagggggatgcgggtatcggagccgcgggtcaaccggaggctcttcttgttcggcgcgcggtagtcatagtggaactcgttgatggccttgccgtctttgaactcctgccggatgagcagcagcatgtccttggagtacgtgctgacgtacttgagcgacttggtgccctcgggctcggtcttgtgctcgccgctgtagtagtagaccttgaagccgccgtcctcgtcgtcgtgcttgaacgccgtaaaggtgccgtcgaggctctgcagcatgaatcggctcttcttgatgctgatggtcatgcccttggtctcgtcccagagacgcttgacgttgtcccggccatggaagaggaagaacgacaggatcacatcctgcacgatcttcgagtacgaccagatcaggttgaggaggaacacacacggcacgcggatgatgcgggcgcgctgtttcatcacatggtcgaattctcgctggaattccggatcggcaatcaaggcgatgatgatgaacttgatggcggacgccaccgagtaccagaagttgtgcaggggatccttgacgaacgcgagcgccgcgggcagctttttggacacatagggaatgaacagcggcgtctcggagtccttgcccaaggcctcttcgccggtgccgtagtgggcgtaatccagaatgctgactgcggtggcggcgcccaggttgcatcgggcaacatggacatccagatcactggtatcaaagcggcagaggtgctcctgaagccattgccggtcgcgctccgagaagtgcgacggcttgccgacacaacggtccagcaacgccttccggatcgtcttgggcagcttctcccaatgcgtgtcacattcgaaccccagacacagctcccggaggagctccttcttggcccaccgcacgactaccggggtgttgggttcttcgcgaagctgccgggccatggtctcggtcacgccggccgtgacgagcgattccgcgagcacggcgtactcgtgaggcatccgcagcatggactcggacaccgcatgaagcagagtctcggcgatgacttggcagttgccgctcacgtcgatgcgctggtccagtccgcgtccgaccgccaggaccagtttcagctggtccgcggcatggcagctaagagcgcggatgccgggacccagcgagcccaagggaacgagctcgatcgaaatctccccctgggcccaggcttgcagggctcggtgaatcagctcggatgccttggggaaagcctcctcgattcgcggttcttcgcggcgcgagagcagcagcgacttgacttccatccccggatgcgcacccggctccagcttgagtcgcgtgtcggacggcaccagagagattctctcgaagaaggtttgcagctcctgctgggaccattcgggatccgcccacggggtcgtgtacgcgtggaacgtcttgcccaggtcgacgggcgagtccaccttcttcggcattcccattttcgccgggaccagagtgatatttnaacgccagcctggaaggtagcagattgt

SEQ ID NO: 17435 - DNA, 501 bp, A.fumigatus
ctcgtagaatccatactaacggactcagactcaatctacacggaacgatacatgcacaccccccagcataatcccaatgggtatgacaactcgaccataaccgacatggcggccctgtccgagagcgtccgcttccttgtcatgcacggcgcgtcggacgacaacgtccatctccagaatacccttgtgttaatcgacaagctggacttgtcgaacgtcgagaactacgatgtgcagttctacccggactcggatcatagcatctacttccataatgcgcacatgatggtgtaccaccgtatgtcccccccttcactacttttgtttcgcaacactaatcagactaggtctttcggactggctcgtcaatgcattcaacggggagtggcatctgatagcgaagcccgtgccggacgagtcaatgtgggagcgtatgaagcggtcgctgcggttattgtctccttagcatccagatacagttgctctatccttatgttgtaa

SEQ ID NO: 17436 - DNA, 420 bp, A.fumigatus
agaagccaaaaaatacctgtcctgttttatctgtacggcggaccgggctcgcagaccgtggaccgcaagttcaccgtcgatttccagtcctacgtcgcctccagcctaggttatatcgtcgtgaccgtggacggccgcggcacgggcttcatcggccgcaaggctcggtgcattgtccgcggtaaccttggcttttacgaggcgcacgaccaaatcgccactgcaaagatgtgggcggcgaagtcatacgtcgacgaaacccgcatggcgatctggggatggagcttcggcgggttcatgacgttgaagactcttgaacaagacgctggtcggaccttccagtacggaatggcggttgcacccgtcacggactggcggttctatggtatgacatccccttcatccccttctgactcgtag

SEQ ID NO: 17437 - DNA, 1998 bp, A.fumigatus
gagggtctgccgcggcgcgaagacaggcagggatgcgttgctcggcaggcccatgaaggagtccgagtcggtcgcggtggagaagttactgaaggaggagcggatggacgcgggccgggtcagcgggagcatggggtacccggagatggtggagtagacggtggacatgcccgaggcggcggacgagcgccaggagtgcacggcggactgcgggatggtgatgacttcttcctcgatggggtctgcgacctggagggcgtcggcgatgtcgatggggtccccgagggcggcgccgggggcgccggcggcggcgcggacggccatggtcttgacggccttgccgatccagagcatctgctcgtgttcgcgcaggtagcggtcgccggagaaggacttctggacgatgttgcgggtcatcatgccaagtttgcggcggtgctcggccttctcgtacatgcggcgggtgatcttggcgacgtcgtccggggtgggcgaggaggtgaggacgggggcgggctcggtgtcgtcggcgtactgggcccattcgccgaggagggcgagcatggtgatctgggcgcgggcgagcgcgagggcgtcgttgggggcgacgaccgcgctgaagcgggagaagtcgtccgggtcgctgaggacgcgcagggaggcaccgacgtcggtgcagacgacgggcgcgccggtgagggcggcttcgccgagggcgagcgggagcccttcggagagggaggagttgaggaagagccaggtgttttcgaggaccttcatggggtcggcgctgccgcggagggtgacgcggccgcggaggcccttggaggcgatgatctcctggcactcggtggagtaggtcggggccttgtcgatggcgccgtagatgtcgagatggtagtcgtcgaacttccactggttgatgatgatgtcggcggccagcagggcggtcttgatgtccttggcgtaccagacgtgcgacagcatggtgacggtgggccgctgcgacttgatctccttgacgggggcgaacttttgcatgtccgtgatgccgttgacgacggggtcgaccttgcggcggaagatgttgcggtgctcgatggtgccctggcaggtgccgatctccacctcccagccgggattgaagaagtcggcacacggcgagatgatgtcggcatggtggagggtgatgacggaggtgatgcgcatcaggcccaggagggcgttgcggacaaacggcgagagcttgcacagggccgaggagaggcagaggttggtttcgcgccagctgatggcgtggtcccagatctgcagggtgcagttccgcttgatcttgcagacgaccccgtacgaggcgctgacgctgtgatgcgacgcctggaacacgctggggatctgctcggggatggggatcgagaagatgaacaggtagcggtaccagagctccagcgccacgtcgagcgtccccagggtggggagctcggtgtggaaccactgcgccgacgggatcgtgttgggcatctcctgcgtgagccagaggtcgcgccagctctccttgacgatgtcgctattccagacctgcgtccagtgccgcgagtcctggaagtacgtgttgaggttgaccagcgcccgcgtggcctggtggatatcggccttggacagctcgatggcgcgcgcgcctttcaccagcgctgtcaggatcgggatgaagttcatcttgatgtccatgtcgttggccgacgtgacgttctccacctccgagtccagcttgttcttgaagagcccatgcgtcggcgtcaaaaagtccagcccccacagcgggatcatcttcaacgagagcacgttctgctccgtctgatgcttgggaatgccaaagtcgtgggccgactcgcagatcatgtgccacttgatcgtccgcagggagttgatcatgtcgcgtcgacaggccgacacacctccgccctcgttcggccaggtgcccgtgtcggcccgccatga

SEQ ID NO: 17438 - DNA, 2814 bp, A.fumigatus
aatatcactctggtcccggcgaaaatgggaatgccgaagaaggtggactcgcccgtcgacctgggcaagacgttccacgcgtacacgaccccgtgggcggatcccgaatggtcccagcaggagctgcaaaccttcttcgagagaatctctctggtgccgtccgacacgcgactcaagctggagccgggtgcgcatccggggatggaagtcaagtcgctgctgctctcgcgccgcgaagaaccgcgaatcgaggaggctttccccaaggcatccgagctgattcaccgagccctgcaagcctgggcccagggggagatttcgatcgagctcgttcccttgggctcgctgggtcccggcatccgcgctcttagctgccatgccgcggaccagctgaaactggtcctggcggtcggacgcggactggaccagcgcatcgacgtgagcggcaactgccaagtcatcgccgagactctgcttcatgcggtgtccgagtccatgctgcggatgcctcacgagtacgccgtgctcgcggaatcgctcgtcacggccggcgtgaccgagaccatggcccggcagcttcgcgaagaacccaacaccccggtagtcgtgcggtgggccaagaaggagctcctccgggagctgtgtctggggttcgaatgtgacacgcattgggagaagctgcccaagacgatccggaaggcgttgctggaccgttgtgtcggcaagccgtcgcacttctcggagcgcgaccggcaatggcttcaggagcacctctgccgctttgataccagtgatctggatgtccatgttgcccgatgcaacctgggcgccgccaccgcagtcagcattctggattacgcccactacggcaccggcgaagaggccttgggcaaggactccgagacgccgctgttcattccctatgtgtccaaaaagctgcccgcggcgctcgcgttcgtcaaggatcccctgcacaacttctggtactcggtggcgtccgccatcaagttcatcatcatcgccttgattgccgatccggaattccagcgagaattcgaccatgtgatgaaacagcgcgcccgcatcatccgcgtgccgtgtgtgttcctcctcaacctgatctggtcgtactcgaagatcgtgcaggatgtgatcctgtcgttcttcctcttccatggccgggacaacgtcaagcgtctctgggacgagaccaagggcatgaccatcagcatcaagaagagccgattcatgctgcagagcctcgacggcacctttacggcgttcaagcacgacgacgaggacggcggcttcaaggtctactactacagcggcgagcacaagaccgagcccgagggcaccaagtcgctcaagtacgtcagcacgtactccaaggacatgctgctgctcatccggcaggagttcaaagacggcaaggccatcaacgagttccactatgactaccgcgcgccgaacaagaagagcctccggttgacccgcggctccgatacccgcatccccctgggccggcggtgcatccgcggcgacagccatctgcagagcgtccagtataaccgcaagggtctcatcgaggccggttcctacatgaaagatggcaacctgatccggttcaagtaccactaccggaagaacccccggttcggcgacgaactgcttcgcgccgagtttgtgctctcgcacattacctgcaccgtctcctggtgtgcgcctcccgtgcggcatcccgagaaggtcgagcgctggatcccgcactccaaggtcaccgaggcgaccttcgtgcaaggcgccgacgtctacgaggctcgctggctgtacgaccacaagttccacccgaccatcttcaccacgctcaacgggcagaagatccagacgccgcccatgatcgagcatgacttcctcggcgtcctggccaagcccaagtacaccagctttgtgcatgacaatccgctcttctactgcgacagtctcagctccaacgccatcacccgcttcctgggcctctccaccaagcggtttcccgtctcgacctcgcgggcccgctcgctggtctggaaggcgtggaaggaccgcgtcgactttgacggcatcatcgtccgctggatggacgagcggctgctgcgccgcgacaagacgctggccccgtactggcgcagccgggaccggggcgatctggcctcggcgaagaagtacctggacctgcgcgcggacacggtcatggcgagtgccgacctcgacgacaacatcttcaactggacgcccatggcgatcaaagtcaaccatatggtgaaaaaagggcccgggggagaagcagtcgtcaacacccggtccaaggaattcgggtcggacacggacaagtcgctgcacgtcatggcgggccgacacgggcacctggccgaacgagggcggaggtgtgtcggcctgtcgacgcgacatgatcaactccctgcggacgatcaagtggcacatgatctgcgagtcggcccacgactttggcattcccaagcatcagacggagcagaacgtgctctcgttgaagatgatcccgctgtgggggctggactttttgacgccgacgcatgggctcttcaagaacaagctggactcggaggtggagaacgtcacgtcggccaacgacatggacatcaagatgaacttcatcccgatcctgacagcgctggtgaaaggcgcgcgcgccatcgagctgtccaaggccgatatccaccaggccacgcgggcgctggtcaacctcaacacgtacttccaggactcgcggcactggacgcaggtctggaatag

SEQ ID NO: 17439 - DNA, 1482 bp, A.fumigatus
cgacatcgtcaaggagagctggcgcgacctctggctcacgcaggagatgcccaacacgatcccgtcggcgcagtggttccacaccgagctccccaccctggggacgctcgacgtggcgctggagctctggtaccgctacctgttcatcttctcgatccccatccccgagcagatccccagcgtgttccaggcgtcgcatcacagcgtcagcgcctcgtacggggtcgtctgcaagatcaagcggaactgcaccctgcagatctgggaccacgccatcagctggcgcgaaaccaacctctgcctctcctcggccctgtgcaagctctcgccgtttgtccgcaacgccctcctgggcctgatgcgcatcacctccgtcatcaccctccaccatgccgacatcatctcgccgtgtgccgacttcttcaatcccggctgggaggtggagatcggcacctgccagggcaccatcgagcaccgcaacatcttccgccgcaaggtcgaccccgtcgtcaacggcatcacggacatgcaaaagttcgcccccgtcaaggagatcaagtcgcagcggcccaccgtcaccatgctgtcgcacgtctggtacgccaaggacatcaagaccgccctgctggccgccgacatcatcatcaaccagtggaagttcgacgactaccatctcgacatctacggcgccatcgacaaggccccgacctactccaccgagtgccaggagatcatcgcctccaagggcctccgcggccgcgtcaccctccgcggcagcgccgaccccatgaaggtcctcgaaaacacctggctcttcctcaactcctccctctccgaagggctcccgctcgccctcggcgaagccgccctcaccggcgcgcccgtcgtctgcaccgacgtcggtgcctccctgcgcgtcctcagcgacccggacgacttctcccgcttcagcgcggtcgtcgcccccaacgacgccctcgcgctcgcccgcgcccagatcaccatgctcgccctcctcggcgaatgggcccagtacgccgacgacaccgagcccgcccccgtcctcacctcctcgcccaccccggacgacgtcgccaagatcacccgccgcatgtacgagaaggccgagcaccgccgcaaacttggcatgatgacccgcaacatcgtccagaagtccttctccggcgaccgctacctgcgcgaacacgagcagatgctctggatcggcaaggccgtcaagaccatggccgtccgcgccgccgccggcgcccccggcgccgccctcggggaccccatcgacatcgccgacgccctccaggtcgcagaccccatcgaggaagaagtcatcaccatcccgcagtccgccgtgcactcctggcgctcgtccgccgcctcgggcatgtccaccgtctactccaccatctccgggtaccccatgctcccgctgacccggcccgcgtccatccgctcctccttcagtaa

SEQ ID NO: 17440 - DNA, 405 bp, A.fumigatus
tcgagcatgacttcctcggcgtcctggccaagcccaagtacaccagctttgtgcatgacaatccgctcttctactgcgacagtctcagctccaacgccatcacccgcttcctgggcctctccaccaagcggtttcccgtctcgacctcgcgggcccgctcgctggtctggaaggcgtggaaggaccgcgtcgactttgacggcatcatcgtccgctggatggacgagcggctgctgcgccgcgacaagacgctggccccgtactggcgcagccgggaccggggcgatctggcctcggcgaagaagtacctggacctgcgcgcggacacggtcatggcgagtgccgacctcgacgacaacatcttcaactggacgcccatggcgatcaaagtcaaccatatggtga

SEQ ID NO: 17441 - DNA, 2331 bp, A.fumigatus
aaaaagggcccgggggagaagcagtcgtcaacacccggtccaaggaattcgggtcggacacggacaagtcgctgcacgtcatggcgggccgacacgggcacctggccgaacgagggcggaggtgtgtcggcctgtcgacgcgacatgatcaactccctgcggacgatcaagtggcacatgatctgcgagtcggcccacgactttggcattcccaagcatcagacggagcagaacgtgctctcgttgaagatgatcccgctgtgggggctggactttttgacgccgacgcatgggctcttcaagaacaagctggactcggaggtggagaacgtcacgtcggccaacgacatggacatcaagatgaacttcatcccgatcctgacagcgctggtgaaaggcgcgcgcgccatcgagctgtccaaggccgatatccaccaggccacgcgggcgctggtcaacctcaacacgtacttccaggactcgcggcactggacgcaggtctggaatagcgacatcgtcaaggagagctggcgcgacctctggctcacgcaggagatgcccaacacgatcccgtcggcgcagtggttccacaccgagctccccaccctggggacgctcgacgtggcgctggagctctggtaccgctacctgttcatcttctcgatccccatccccgagcagatccccagcgtgttccaggcgtcgcatcacagcgtcagcgcctcgtacggggtcgtctgcaagatcaagcggaactgcaccctgcagatctgggaccacgccatcagctggcgcgaaaccaacctctgcctctcctcggccctgtgcaagctctcgccgtttgtccgcaacgccctcctgggcctgatgcgcatcacctccgtcatcaccctccaccatgccgacatcatctcgccgtgtgccgacttcttcaatcccggctgggaggtggagatcggcacctgccagggcaccatcgagcaccgcaacatcttccgccgcaaggtcgaccccgtcgtcaacggcatcacggacatgcaaaagttcgcccccgtcaaggagatcaagtcgcagcggcccaccgtcaccatgctgtcgcacgtctggtacgccaaggacatcaagaccgccctgctggccgccgacatcatcatcaaccagtggaagttcgacgactaccatctcgacatctacggcgccatcgacaaggccccgacctactccaccgagtgccaggagatcatcgcctccaagggcctccgcggccgcgtcaccctccgcggcagcgccgaccccatgaaggtcctcgaaaacacctggctcttcctcaactcctccctctccgaagggctcccgctcgccctcggcgaagccgccctcaccggcgcgcccgtcgtctgcaccgacgtcggtgcctccctgcgcgtcctcagcgacccggacgacttctcccgcttcagcgcggtcgtcgcccccaacgacgccctcgcgctcgcccgcgcccagatcaccatgctcgccctcctcggcgaatgggcccagtacgccgacgacaccgagcccgcccccgtcctcacctcctcgcccaccccggacgacgtcgccaagatcacccgccgcatgtacgagaaggccgagcaccgccgcaaacttggcatgatgacccgcaacatcgtccagaagtccttctccggcgaccgctacctgcgcgaacacgagcagatgctctggatcggcaaggccgtcaagaccatggccgtccgcgccgccgccggcgcccccggcgccgccctcggggaccccatcgacatcgccgacgccctccaggtcgcagaccccatcgaggaagaagtcatcaccatcccgcagtccgccgtgcactcctggcgctcgtccgccgcctcgggcatgtccaccgtctactccaccatctccgggtaccccatgctcccgctgacccggcccgcgtccatccgctcctccttcagtaacttctccaccgcgaccgactcggactccttcatgggcctgccgagcaacgcatccctgcctgtcttcgcgccgcggcagaccctctcattcgatgcgggcggggccgtgacgcccacgggtcggctgtccccgtcaggcaggctgtcgccggcgtttgggcggcaccgacactcgcacgcgcggtccatctccacgctgggccgcgagcagctgcgtggtttgcagcgtgaggagcctcatccgtaccgcaactcggatgtcagtctgcatatgcgcgaggagttcctgcagtccagtatcttcaagtctatcgacggtaatgcgggggggaaatcctga

SEQ ID NO: 17442 - DNA, 474 bp, A.fumigatus
aaggcgcgcgcgccatcgagctgtccaaggccgatatccaccaggccacgcgggcgctggtcaacctcaacacgtacttccaggactcgcggcactggacgcaggtctggaatagcgacatcgtcaaggagagctggcgcgacctctggctcacgcaggagatgcccaacacgatcccgtcggcgcagtggttccacaccgagctccccaccctggggacgctcgacgtggcgctggagctctggtaccgctacctgttcatcttctcgatccccatccccgagcagatccccagcgtgttccaggcgtcgcatcacagcgtcagcgcctcgtacggggtcgtctgcaagatcaagcggaactgcaccctgcagatctgggaccacgccatcagctggcgcgaaaccaacctctgcctctcctcggccctgtgcaagctctcgccgtttgtccgcaacgccctcctgggcctga

SEQ ID NO: 17443 - DNA, 432 bp, A.fumigatus
tgcgcatcacctccgtcatcaccctccaccatgccgacatcatctcgccgtgtgccgacttcttcaatcccggctgggaggtggagatcggcacctgccagggcaccatcgagcaccgcaacatcttccgccgcaaggtcgaccccgtcgtcaacggcatcacggacatgcaaaagttcgcccccgtcaaggagatcaagtcgcagcggcccaccgtcaccatgctgtcgcacgtctggtacgccaaggacatcaagaccgccctgctggccgccgacatcatcatcaaccagtggaagttcgacgactaccatctcgacatctacggcgccatcgacaaggccccgacctactccaccgagtgccaggagatcatcgcctccaagggcctccgcggccgcgtcaccctccgcggcagcgccgaccccatga

SEQ ID NO: 17444 - DNA, 309 bp, A.fumigatus
  unsure (215),(216),(220),(222),(223),(224),(230),(231),(232): Identity of nucleotide sequences at the above locations are unknown.
gtaaatgtcttggactggattggaatggtgatgcctcttcagccttctctgggattctgtatcagcaacgtcactaaggggccctgcttgctgctccaccacagtataaaactagactatgaacaaaagagtactattctcgactggattaaaataaagttgtcaatgaaaaaaaaaggactagtatgccacaattgtcaagcgagagagggcannacanannngaaaannnaaaaaggaaaatctgaggaagtcatcagtacaaaaacctcttgcctcaattctctcattccctcaacttcattctga

SEQ ID NO: 17445 - DNA, 285 bp, A.fumigatus
aatgtggacagcatcctgacacaaccgaatatgtacgcccgtggcattctcttcggaaagatgaagtatgagctcggtgatcacagctacgtccgttgtcccgaaaacaatctagtcgccgatatcgagttcaagacgaaaggatacttttccggcacctacaacgcaatcggagggacgatcaagaatgagaaaacgggcgaggtatactatgagctgtctggactttggaatggagagatgttcatcaaggatgttcatgtatggtgcccgagtgtgtcctag

SEQ ID NO: 17446 - DNA, 264 bp, A.fumigatus
tcatcatttctcgaaagtttcatggctcatccggagacccttcttcccatgcccacaatcaatgaccccctcgagcgcttcgtttccgtcgtcaagttttacctgagcggatggcacattaaacctccgtacgttcactcgacatgctcccattcggttttcaaagacgagaccacctctctaacgtggatactgcagaggcgtgaagaagccgctgaatccgattctcggagagaccttcacttgttactgggattaccctga

SEQ ID NO: 17447 - DNA, 318 bp, A.fumigatus
actcacaagaaggatatcctgttcgacgcgacacacgcaaaacatacaccgcccagtacccggccgattgaacagcagggcgagcgggaatcgcaacggctgtggcacagcacagtaaaggcgctccttgcccgcaaccacgaggcagcaacggacgaaaagtcaaagattgaagagcgtcaacgtgaagaggccgctaagcgggccgatgaaggagtggaatggcgtccgagactcttccgccctgttcacgggggccccggaggccccgatgagggtgaggaggacttggactggatcatcagcgcgcatatgtaa

SEQ ID NO: 17448 - DNA, 213 bp, A.fumigatus
gtgactgcgcggcccttccgccccgtggtgaagacgtatggggtcgaggagggcattgtgcatcttgtcgtgtggacaaagttcgagctggaagatgatcctgcgacggatgatttgacgcctcaagcgaggaaggagattgatgattatgtgaccaggacgtttcggtcgcggatgccggcggaacaggtttgctgttctaactgtccatga

SEQ ID NO: 17449 - DNA, 294 bp, A.fumigatus
cgtggatactgcagaggcgtgaagaagccgctgaatccgattctcggagagaccttcacttgttactgggattaccctgatggcacgcgagggtattacatcgctgaacagacttcgcaccaccctccgaagtccagctacttcttcatggcgccagaacaccacatccgaattgacgggacgttgaagcctcgcagcaagttcctaggaaactcggcggcgagtatgatggagggtgtcgccattttacgcttcctgaaccgtggccagaacccagagaagggcgaacgatag

SEQ ID NO: 17450 - DNA, 549 bp, A.fumigatus
aggcgctccttgcccgcaaccacgaggcagcaacggacgaaaagtcaaagattgaagagcgtcaacgtgaagaggccgctaagcgggccgatgaaggagtggaatggcgtccgagactcttccgccctgttcacgggggccccggaggccccgatgagggtgaggaggacttggactggatcatcagcgcgcatatgtaagtgtgacgggtacgttcgtctatcatataatcggaagttgaccaggacctacagtgactcgcaaaatcctgaactcgccgccaaacaaatcctagccatcgcgcccattctggatggccagaaagacaaccgtcagttccagattccaccccacgtaccgaagaaagagaaagaggggaaaaccgctccctccgcatctgaccctgttgatgcaaagaacactggtagtgacactggctccggagcctcagaagctccccaaccttcgagcgagggcaataactctgtagaacgcaaggattctcggacctccgaagtcgatgaatatgtcgacgcggaggaaaaataa

SEQ ID NO: 17451 - DNA, 414 bp, A.fumigatus
acacctaccgccccggcgccattgtcctccaatgcggcgccgactccctcggctgcgaccgcctcggctgcttcaacctcaacgtcggcgcccacggcgcctgcgtcgccttcgtcaagactttcggcctgcctctcctcgtcgtcggcggtggcggctataccccgcgcaacgtctcccgcgcctgggcccacgaaacctccatcctcattgatgcccaggacctcatcgatcccaacatccccgacaccgtcgccttccgcaaccacttcggcccggactactcgctcttccccccactgtcggaaatgcgcaagctcgagaacaagaactcccgcccgtaccttgccggtcttgtccagtccgtccgtgagcagctccgctatatccagggggcccctagtgttcagatga

SEQ ID NO: 17452 - DNA, 369 bp, A.fumigatus
gttgtgcttagtctagggcagctgcacatagttaggaaatgtttcctgctgatgtttgataagctgggagtggccgccacccgttcttctgccatcttctcgcctcaactttccaccactagtgacctctcagtcttcttcatttctccacattcttccgacgcttcagcccttcggattcaacctctccacctctactgtgtacatctcgaatctggtctctcacagtatgtcttagacgcatatgattttttttttccctttaggacactagcctcttctcctctttttatccatccattttcctctcctaatccttcccaaccggtccgacctcatggcgcgctccgccattgtccaagaatataa

SEQ ID NO: 17453 - DNA, 1527 bp, A.fumigatus
cctcttctcctctttttatccatccattttcctctcctaatccttcccaaccggtccgacctcatggcgcgctccgccattgtccaagaatataatcctccgcctccgtcgaatcccaccctgagcgttgatcgaaaagtctctctcgagcgccagaagaatggcatccctcgtcctcaaggctaccgagtctcatggcacgccaatccggctgtggaaccgcaccactttggccaatcgcatcccatgaagccctggcgactcaccctcacgaagcagctcgtcatggcctacgggatgcaccacgccatggacctctatctggcccgcgctgcgacgtacgaggagatggctgagttccaccagacggattacctcgatttcttgaggcaagtgatgcccggggacatggagaatccggagcaaagcgaaaacattgcgcggttcaatttcggcgacgactgtcccatcttcaacgggttgtacaactactgctcgctctacgccggtggtagcatcgacgccgcgcgcaaactgtgcaacaaccagtccgagatcgcggtgaactggtcgggcggcctgcaccacgccaaaaaggccgaagccagcggcttctgctatgtcaacgacatcgtcctcggcatcttgcagctactccgccaccacccacgcgtcatgtatatcgacatcgacgtgcaccacggcgacggcgttgagcaggccttctggtccaccgaccgcgtcctcaccgtctccttccacaaatacgacaaggataactttttccccggcaccgggcccctcgatagcactggcccaacccacccgctcaaccctggcgcgcaccacgccgtcaacgtccccctcaacgacggcatcgacgacgaatcttacatccagctcttccgcgacatcgtcggcgcctgcgtagacacctaccgccccggcgccattgtcctccaatgcggcgccgactccctcggctgcgaccgcctcggctgcttcaacctcaacgtcggcgcccacggcgcctgcgtcgccttcgtcaagactttcggcctgcctctcctcgtcgtcggcggtggcggctataccccgcgcaacgtctcccgcgcctgggcccacgaaacctccatcctcattgatgcccaggacctcatcgatcccaacatccccgacaccgtcgccttccgcaaccacttcggcccggactactcgctcttccccccactgtcggaaatgcgcaagctcgagaacaagaactcccgcccgtaccttgccggtcttgtccagtccgtccgtgagcagctccgctatatccagggggcccctagtgttcagatgagcttcatccccccagatatcctgggtcttcgcgaggacacggagaaggagattgaagaggcgacggctcggctggaggaggagcgcgaggagcgcgaggggcccggtagtgcggcggtcaagagcaatcgacgccgagaactggagaggggtgcgggataccggggagagctctattcttga

SEQ ID NO: 17454 - DNA, 186 bp, A.fumigatus
atgcctcgcgagccaaagaggggaatgacaccatcacaatcagcccaaatcacaacaccccaaattaacactgcattcatcccacaagtgatctattttggcatttctattgatagcaaaattatcagttcccctcgtccgtttcgtatcccaacaggagggaacccaataacgctctggatataa

SEQ ID NO: 17455 - DNA, 255 bp, A.fumigatus
caaggccaaggacaaagaccaagtgtatgtactgaccagcacagctcactcgtctcgaatgcggttctggcgtatacattgggcctgcgccatgcgtttgatgccgaccatatatcggtaagaccgaagcagtctgtagctcggcagctatctaacattatccaggcgattgatttgatgacccggagattattggcaaccggccagcagcccgtcaccgttgggacgttcttctccctcggacactcgacgtag

SEQ ID NO: 17456 - DNA, 447 bp, A.fumigatus
gtctcttccagtcggtcaatacaaggcttgggcttgtctgacggtaccagcattgtcatcatcacatccatcgtcgtagcagctaccgctgcggcggtgtcgtcgcgcttcgacagcttcagcaccgtcggcgggatcatcgggacgtcggtcagcgccgcgttcctgatcctgctgggcctgatgaatttctacattctgtacaagctgtacaagcagatgcagaaggtgctcagccttcctgaaggccaggaggacgaggcgtggaagattgagggcgggggtgtgctgttcaatgtgctcaagcgcatgttcaagctgatcaatcggttcgtggttcccagatcaggtgtacaaacgatccagctgattcggtggttaggccttggaagatgtaccccttgggtattctcttcggtcttggtttcgacacatcatccgagatag

SEQ ID NO: 17457 - DNA, 489 bp, A.fumigatus
ccaggccggcggctgcacctcccacaagccgattcgcgtcccgtcgctcgcgcgaaccgcacgacggcccatccagccagggccaccggcccaagctataccggcaaacgacgtccgagcacgacgaagcggtccccttacctcccccgccggactgggtcaagagccacgtcatgtacgcctgcatgcggtccgcaccgctccacccgcccaacgaggcgttcatcaaccagctggtcaaaatccgcaagacccgcgagctcacgctcgacgagatcggcgtccgcgcctacagcacctctatcgccgcgctggccgcctacccataccagattcgacggccctccgagatcctcaccctccccggctgcgacgccaagatcgccgccctcttcgccgaattccaagccagcgagcacggtacgctcgccgccgccgacgccctcgacaccgaccccgtcctcaaaaccctccacctcttctggaaca

SEQ ID NO: 17458 - DNA, 963 bp, A.fumigatus
actgctatcatgggtgttcttcgtttgcctcgcccgacgggcatctatgtccccaactctcccacccgcagcctcactaccgatatgatttcctcgcctctgtctcccggcttcaactttgattgcgaaacggtcacgccttccatcattcctgctctggactacatctcctccaagctccaacagaaaatgatgcacgtcaccctgctcgttggccggggaaagccctaccccacaggacaaccgtccgatctcatggtcatccccatcgcacaactcgacccgcagagctggcgcacgatatgccgcatcgtcgctaagggagccaagaaattctccctcggccagagctggaccgacgccctggcacgcagccagtatgagcgccaggccaacgaatacttgatccagcaatccatcctgcagaacgaagtcgtctttagccgggagggcctgactctcctcagcgtcgaccgcatctacaccttcaagcgccgcctctgcatcctgtcaaaccgagacaacggcatcgaagagccctacatctcctcctgcgtgcatctcctccaccgcaccatccgcgacttccagggtcgccccttcagcaaggcgtttttccaccgcgtgtacgaacagcttgatgtccgcgatgatctcctgacgcgcgtggcacacgcctacaagaaagaatacaaccaggagggcatcgtcctaccaccgcggcccaggcccgagtattcacggaaatcgcccattcgccccgttcgtccacgcagacagcctacgccgccgacctgcagaccggcctcggcgaagaagggacctaagacgcctctctcggcttccgacgttacacctattacccgaagcgagtggaacatgtttgtcggcgccggtatccgtccgatcaacccgaccgtgaccaagtggacgccgtcgccgactgtacttgctgccgcgtga

SEQ ID NO: 17459 - DNA, 597 bp, A.fumigatus
gaactatcagctggaatgtgtctcttggacacaaccgacggagctctaatgctttcgctctacatccaacccgctgccaacttcctccctgccaaacgcgacagcacctcgtccgagacgcccctgatcctcggcgaggaccatgagattgaaccgtcccagaaccaccgcgaccccgtcgccttcctgtactactctatcgtgctcactctcctgaccgtcatcgtggccataatcatcggcatcatccagctcctcacccttgtgctgaacgtcgccgaacccactggcagattctgggatggcgtacagaccgcaggagactactacgacgtcattggtggagcaatttgcggatgctttcttatcgtcggtattctcagcgtggtgctctacaagccctggcggaggtggatcgcgaagcggcaagggaagagcaccgcggcggatgaagaaagctcaagacctcgagatgaactgcctccagctaatactggaagagctgttctgagtgaggagagcaatgcctctacctctgttgtcagttatggggctgtaggcaagggcgcaacttcgcaggtcgtggcgcagccatag

SEQ ID NO: 17460 - DNA, 543 bp, A.fumigatus
agcaagcgcggaccagtcgaaaggaatcctggagcgggcgaagcaagatgccatgaccaggccggcggctgcacctcccacaagccgattcgcgtcccgtcgctcgcgcgaaccgcacgacggcccatccagccagggccaccggcccaagctataccggcaaacgacgtccgagcacgacgaagcggtccccttacctcccccgccggactgggtcaagagccacgtcatgtacgcctgcatgcggtccgcaccgctccacccgcccaacgaggcgttcatcaaccagctggtcaaaatccgcaagacccgcgagctcacgctcgacgagatcggcgtccgcgcctacagcacctctatcgccgcgctggccgcctacccataccagattcgacggccctccgagatcctcaccctccccggctgcgacgccaagatcgccgccctcttcgccgaattccaagccagcgagcacggtacgctcgccgccgccgacgccctcgacaccgaccccgtcctcaaaaccctccacctcttctggaa

SEQ ID NO: 17461 - DNA, 204 bp, A.fumigatus
ctctcctcagcgtcgaccgcatctacaccttcaagcgccgcctctgcatcctgtcaaaccgagacaacggcatcgaagagccctacatctcctcctgcgtgcatctcctccaccgcaccatccgcgacttccagggtcgccccttcagcaaggcgtttttccaccgcgtgtacgaacagcttgatgtccgcgatgatctcctga

SEQ ID NO: 17462 - DNA, 267 bp, A.fumigatus
gggcgggggtgtgctgttcaatgtgctcaagcgcatgttcaagctgatcaatcggttcgtggttcccagatcaggtgtacaaacgatccagctgattcggtggttaggccttggaagatgtaccccttgggtattctcttcggtcttggtttcgacacatcatccgagatagccctgcttggtatctcgtccatcgaggctgctcgcgggacggacttttgggtcattttaatctttcctattcttttcaccggtgggtctgcctga

SEQ ID NO: 17463 - DNA, 1263 bp, A.fumigatus
tcgcctaattgtcagatacagcgaagcaatggatatacaccccccgctatgtccgatatcacgacatatacctcgctgaaacatgacctaaacgagagccctgacgggctcgacttttcatccctgccacctatcttcgtcctctcgacacatctcgagctggatgctctgcatcaaatcgaggatgacctcgtgacgcgcggcgggcgcctgacgtatgatatctccgaggcacggctcgtcctagggcggatcagccagaagaagcgagcagcgctggagctgcggtcgagaggcgtctggaccgaggaggtctctggctctggctctgtctctgctcctctgcggacgagccatgaaccgcctgtgaagaggcggcgggttgacgtggttcagcagggtaaaccgcgtggggcgcagctagaggatattgacctcggtactgagaccgtggatgaggaagatgggatgcggagcttgcatgatacacggggccatttgcggcggccgcgatcggtatctcccgatacggcgtctgtggcctcgacgccgtcactgacgtcttcggtggctactgcgttggaggatcacgagcaggcggatgtggtgacggtggtcaagctggactggttaagtgaagtcctgaggactggcacgctcgtgcctcttgacccgttcgtggtttaccgcggccgcaggactgcgcagcctgcgtctgaagcaagcgcggaccagtcgaaaggaatcctggagcgggcgaagcaagatgccatgaccaggccggcggctgcacctcccacaagccgattcgcgtcccgtcgctcgcgcgaaccgcacgacggcccatccagccagggccaccggcccaagctataccggcaaacgacgtccgagcacgacgaagcggtccccttacctcccccgccggactgggtcaagagccacgtcatgtacgcctgcatgcggtccgcaccgctccacccgcccaacgaggcgttcatcaaccagctggtcaaaatccgcaagacccgcgagctcacgctcgacgagatcggcgtccgcgcctacagcacctctatcgccgcgctggccgcctacccataccagattcgacggccctccgagatcctcaccctccccggctgcgacgccaagatcgccgccctcttcgccgaattccaagccagcgagcacggtacgctcgccgccgccgacgccctcgacaccgaccccgtcctcaaaaccctccacctcttctggaac

SEQ ID NO: 17464 - DNA, 408 bp, A.fumigatus
tacaggccgttactagggagatccaagaaacttgggaaagtgaaaggaatcgtacctcgtaaaatcccctgtaagtcgctccataacttcctcatccagactctccaatgcataaacactttgcagctgtcgttcgtcatcctgataggcctctatcatggcctgttcgagatcttgccacctggagacatcagcagaagtgtcgtctgttgggaacatgattgcgaaggtcgactgcttccgccttgcccgcccccggcgctggatgaaggacttgaggttgggtggtttgtcatagcacacgacgacgctacaggcactaagatcaataccttcttcgaggacgtctgtggctatgataaggttcttgcgaccgctgcggaaatcgtccagtgtatcgcgctgtaa

SEQ ID NO: 17465 - DNA, 513 bp, A.fumigatus
cgggcgttccgtcagcggaaggaagcgcatatccgggagttggaaggcaaggtgaaggcatacgagagcatgggcgaagcgatcaaagctctgcaggcggaaaactaccagctccgggagtacatcatcaacctgcagtctcgcttgttggattctcaaggcgaggttccggagctacctggcaacatcgacctgagtcaaccgcggagcgaaattcctgtgcctcctattccaaactcggggacggccactactactgcccctcctccaactgcaccccagcaaccccaaccttctcacgatcaagcccccacatcgaatgacgatatgaactccctgaaccgcatagctgttgccgggcttggaatgcgcaaacctcctaccgaagaggcaaattatctcggcaacaattttcaggcacaggcaaggcgcgtccgtcctgacgaaggacaacccgaagcttcggaactgcccaagcaggaacaaacgcatggcctcccactcatatcatag

SEQ ID NO: 17466 - DNA, 447 bp, A.fumigatus
gtgactcttcatgttgtaccagttgaaaatacagcacaacgcacgcgttcctgcgcatgctgtgcattacacccgccaaacacctttcacaatcgtcgccttgcgtctgctaacatcaagtctctagtgctccatgatcagcttctagctgctcaacatcagcatctgacgcatcctcagcaagctcgaccccaacctcctgcaccgcagcctccgcacatgcagcccaacacgccggctcgcgatcagaataacatcgatcctgccatttcaggcgctaccatgctaaccggcccaccgcaaactcccacccagcctgatgtaactggccaggagaccccgaaaacctacggcaaacggccgttatccacctcgaaacgcgccgcacagaaccgtgccgcgcaggtacgtgcgctccggaaaactgtttacaagatttgtgactaa

SEQ ID NO: 17467 - DNA, 1224 bp, A.fumigatus
cagccagtcccgtggtcagatcgaatcacccagagctcttgtcagtactctaagttttttacgaactccctgcttgaacttgctgactcgccatccaagatggtcgaatccaaacctgatgcggtatgcagaacaccgcgcttgcaccgacaagaactcctgaaattcacccatagaccgcacttgcagcagatttggtacacaccgactgatcctgcggggttcaggagcgcaagtctgactttgggggcactttaccacgcctgggaaaacttggatatcggggatgacccttatatacagcggctcagaaaaagttcccttgacgacagagctctgaaaaaagcccttttaacgggcaaaacgtattgtcgggagcagttgagaagattcgtcgatcgaagtcgccatatcttcgaagagctcggagaatgggctgccgagtactacatctacgcgtccatcaagcagctcagggatcgcgtccgcgactcgtatatgagcggtgactgggacgaagccgagaaagcgtacctagtagactttctctccaaaataccgacttcagatattcattttgcgttgaacgatccggatggttttcgcatctccccgaagtttgaatctctcctcaacttcctggactcatcggatcagcgggagttctcggggctgatctttgtcaaacagagggtaacagtcagcgcaatgactagccttctttccgtgcatccttacacgcgcgaacggttcagatgtgctgcctacgttggctggtccaacagcagcgccagcaaggacatccttggtgatcttttgaacatgcagttacagcgcgatacactggacgatttccgcagcggtcgcaagaaccttatcatagccacagacgtcctcgaagaaggtattgatcttagtgcctgtagcgtcgtcgtgtgctatgacaaaccacccaacctcaagtccttcatccagcgccgggggcgggcaaggcggaagcagtcgaccttcgcaatcatgttcccaacagacgacacttctgctgatgtctccaggtggcaagatctcgaacaggccatgatagaggcctatcaggatgacgaacgacagctgcaaagtgtttatgcattggagagtctggatgaggaagttatggagcgacttacaggggattttacgaggtacgattcctttcactttcccaagtttcttggatctccctag

SEQ ID NO: 17468 - DNA, 1383 bp, A.fumigatus
aggggtggctggatacatacggggggaagcgacccggccatggaagtctactcgcgtggccacaacccactgctcatgggcgtggttcgagatcattcgcgttacggagaaacatttttgttccggaaatggcttgtctctcaaccagaacccgtcatgttcgatttgtggagttggaatgtgctcccttttccgcatagacgcaatttcgtgggtcgtcagacgctggttaatagccaggtggatgtcgatgaagcaatcccggactctgcagccaagaaccccattgtcgctgcagaggcgtgcaccatcgataggcttccattcacaatggctatattcggcctgttcatctccgccattgtcgagcaattggagattgaattgatcgcaacccgactcagagacacgatcctcagagatgtcagcttcaagagcactgatcacatcattaccgcaatcagtacccctttggctcacagactgaccaattaccagcggtacgagttcctaggcgactcgatcctcaaattctctgtttcctgccagttgttctttcagcacccgaactggcacgaaggttatctatctgaggggcgggacatgatcgtgcagaatcctcgccttgccaaagccgcgctggacaccggcctggacgcctacatcgtcaccaagaggcttgcgtcgcggaaatggtctgccccgttgatctcggaaaagctggagcgggtgccggccaagcgtcaaatgtcgacgaaagtgctggcagacgtggtagaggcgctgatcggagccgcatacgtggacggcggccactcaaccgcacaggcatgcatccgccgatttttgcccgagattaacctccacgcggtggacactcgaaccgcagcccggagtgtggctcccgagagcgcccggcatatgatgaacgatcgactgaaagaccacatcggctacacattcgaggatgagtccctcctcgtcgaggccctcacccacccctcctgcgactacgattcgacaacccagtcctaccagcgtctcgaatacctcggcgacgcagtcctcgacatggtcatcgtctccgcgatcttcaaccaccgcatccagcgcccgcaaggtgacatgaccaagatcaagcatgccgttgtaaacgcgaatctcctcgccttcctctgcatggaattcgccatctccgaggagaaacttgacgtcgcacagacatccaaggactccttcgccgtgacttcctcccaggaatccgtcgagctctggcgcttcatgcgctaccgcggtcagggtctcaaagccgcccgcgacgcctcgctcgcccgccaccgcgccctgcgagacgaaatcgcgtcgtccctgcggcccgcccga

SEQ ID NO: 17469 - DNA, 1032 bp, A.fumigatus
gtcgtattgctgattgctatgatacaggcaaaggatcgaccttatctagaagcccactttccactactcgtcccaccaattcttgccctgatagacgacgatagtgtcacctacaagacacgcggttgccttttcttgacccaactcctcacaccaatccgggaaagcaaatctgacatcctccagaggacaaacctggcgtctgtcttcgaggacgccgtcagaccatgtctcctgtcattgccatcaatcacacccgaagatgacgccatcaaattgctcggggtagcctacccagctctgctctccctcctacaaacaaattaccacactgccacctccagatcagctgcaaacgcaaacagagacaagtatatctccagcgtggcgagaactctccgagagaacctcatctcctcattccaccacatcagttcaacaaacaggacctcaatctcctcgttcgcctcgttcccgtacccgcgtctctccacccttcttgtcaaccagatgtaccctctcctcctggagctaggcatccacacgacaaagtacctccaggagatcgtccccttgctgtacagtacgctgtcgaaccctttcggaacagcatacccgcctcttctcctttccgcggtagccgtaacacgcgcgacgattctgaacgcgcatccgcgcctgtggcgatggcgcggtgagatcctcggcgcgctctgctcgtgttggctgcgtgtagccgaggaagaaggcgaaatcgccgagcgggctgccaaggggcggagtgctgctgaggaccaggagacgaataccacgctgaccaagctgaagaggcagctgcggggcgcggtgtacctgttgaggtttgcactgcagaacccagcgcaggcggacggagatgccggccagctggaagcgaaggctgctatagggaaggaattgcaggatctagttgacgctgacgagtctcttgcggacttgcttcttgcggatattgaccctaatgatgcggactttttcgggatggatccgtaa

SEQ ID NO: 17470 - DNA, 294 bp, A.fumigatus
cacctgatacttttgaatgaatttgtggcactgacctgtgctcgaccaacagtgatccaagaatatgacagatttatatcgtatatcattcagaacaacctgcaaggcgtgtgtgaaatgaaacctatcgtgaatggggctgaaatcatgaaagctctagaggcgaagaatgggccttggatgagcagagcattggatatggtgtttaagtggcaacttctacaccctgaaattacagagaaggaaacggccctcaaatatttgatagatagaaaggatgagttaggtctgtag

SEQ ID NO: 17471 - DNA, 2688 bp, A.fumigatus
  unsure (14),(15): Identity of nucleotide sequences at the above locations are unknown.
gtcgccttgaaaannagcgcagagcctcgatcggcatttttcgatctcggcgaagagagcatcaaccgcatgcacaagatctcattgtatgagacggcaactcgattctatatggtgggcatggatctgtcagacacacggtttcgcattttaaaaatcgaccgtacgtcagatacaaatgatttggttatcgtcgaggacgacattgtgtacacaaagagtgaaatgagccagttgctggatgcgattgacgatgggaataagatctccggcgggttgaagctcagatgcagcgcatgggccttgcttggctttatccgcttcacgggcgcatattacatgcttctggtgacgaagaggtcgcaggttgctatggtgggcggccactatatctacaagatcgatgggacggaactcatctcgttgacaacatcgagctcctcgaagctgaagcccgagaagaacccggaagaggcacggtatattacaatccttaataatcttgacctgagtcggtcattctacttcagctactcatacgacatcacgcgcaccctgcaacacaacatttgccgtgaacgcaagcttcatcaggacgggtactcgaaaggcttccatcaagactacaatacgatgttcatatggaaccatcatcttctcagtcccgcaatcgcagccctgaagaatccttatcagtggtgtctccctatcattcatggttatgtggaccaggccaagatcgatgtgtatgggcggctggcatacttgaccatcattgcccgccgatctcgattctttgccggggctcgcttcttgaaacgaggtgctaatgatctgggatacgtcgccaacgatgttgagacggagcagatcgtttctgaaatgtccgaaacttcattccatgctcccggtcctgctctgtacgccaaccctctgtacacatcatacgtccagcatcgggggagtatccctctttactggacacaggacaactcaggagtatctcccaaacctgatatcgagctgaatcttgtggatcctttctactcagctgcgggcctccattttgacaatttattcgagagatacggtgccccaatctacgttttgaatctgatcaagtccagggagcggacgccgcgcgagtcaaagcttctgaaagagtataccaacgccatcaactatttgaaccaatttctgcctggagataaaaaaatcatatacaaaccatgggacatgagccgcgctgctaaaagtcgcgaccaggatgtggtagggacactggaggagatcgcaggcgaaatcatcccgaagactggcttcttcaagaatggatatgacgcagattctggcttgcagcttcagaatgggattgctcggacgaattgcatcgattgtcttgatcgtacaaatgctgcccagtttgtgatcgcaaaacgagcccttggttatcagcttcatgctctcgggttcattgatggcaccactttggagtacgactgcgatgcagtcaatctcttctctgctatgtggcacgatcacggtgacacaattgccattcagtacggcggttcgcacctggtcaataccatggctacataccgcaagatcaaccagtggaccagccattctcgagacatggtggagagtttcaagagatactacaacaattcgttccttgatgcgcagcgtcaggaagcttacaacttgttccttggtaactacatctttactcaaggtcaaccgatgctgtgggacctgtccaccgactactacctgcatcatgccagtcccaaatcttgggctgagaagaggcgacccaactatatcaactggtacacccctgagaatctgaagaagcgtgaactgccacctcccccatcgcgcccgaaggagcctctctcgcgatttgatgattattggctggagtattataggccgttggctgtctcgactctcccaaagatcttctcgttcaaaatgaagtcaacgttccactacgttccgcaccacttcagcccattcgatgtgcgaattgctcacgaacaagccaatcgtgagaggcatccgcaacgaagtgtgagaatacaggagccagggagtagtgtcattgagcagtcgaggcgctcacccatgcacagctcgccacggaaccccaatcatacacagaacgggttgcaacagccggacttgacacaaccctccgcaaagtgtactaaagactccatatatgaactctctgtatccagtagcaaaataccttccatgcagacatccacggaatcggctacacccagcaaagcacagattgctcaatggacactcggccagctagtagccgactcgctaaatccgtccgtcactgccgcagaggccgaagaatacgagcggtacatcaaccacccgctgaacgttcctctcgttgtgacatcagaagatgaaattaccgccgcttctgctcagcatgagtcgaacttggacctactggaatacgctaataaatgcaatattgaagaggccatactcgaagctaatgccgaggagaacctagcggattatgccgagtttcttaccgtatcggaggaaggacttacagttgttgcagaggactatgagaagaaacgctataagcggtaccggcagtggctgcgaggaaagagtcttttcaagcaaagggtcgatatataa

SEQ ID NO: 17472 - DNA, 438 bp, A.fumigatus
tcaatagacaagctcaggaactgcgtgagaagagacgacttctgtaagcctgggtttagccccacatacatcgattaccgcgtctctgacccatcatacagcctagatcccagatccgccggcccgtcgagtatatggtatcctgatttgaggacactctgcgtcatgtgtcaatggccttatgcacagaggtgtagccgatgcctctccagctggtactgttccaagagatgccaaagcatcgactggcctttcccacaagctcctctgctcccgataccgcaattgcctggccacccgccgatcagaggaccacaggctcggcatctggtttctcagagacacaacccagccaacgctcatatgggcccctatctattctccagaatggggcttccactgtccctgcttggaccacttccttggcccaaagcatga

SEQ ID NO: 17473 - DNA, 291 bp, A.fumigatus
cactcgacggatgttgatatccatgggagtgtcttgctccgtcgattgcatggtgaggacctggatctggccatggcaaaacatatgtgcttctactgccttgaggtgctgaaacctttgtttgagaaagcactctctggcgagatctctcgccaggacggtctggatgaaattacactggagaaagctactgcgtggaagccgatcgatgcttatacggaagttaccgctgagcaaccaagaccacaacgtggatttgtaaggagaatggggtcctcaggttgggagtga

SEQ ID NO: 17474 - DNA, 609 bp, A.fumigatus
ccgatgcctctccagctggtactgttccaagagatgccaaagcatcgactggcctttcccacaagctcctctgctcccgataccgcaattgcctggccacccgccgatcagaggaccacaggctcggcatctggtttctcagagacacaacccagccaacgctcatatgggcccctatctattctccagaatggggcttccactgtccctgcttggaccacttccttggcccaaagcatgagctccttttcaccatcccattcgtcgaaaacaaaagaagaaccgtacagctcgaccactctcttacaatgtacctgcgactataatattgtgattaacaagtccgtccacgccgccgtggaagattgtcatggcatgagtacgccttataatatgcccggcgagtacgtggtgatgagcggccagcaaggatcatacacgggcaccgccaagcacgaattcaaggacataactcttgctgacttccgacatgcgctcggctggttcagtacctatttcgacgatacggtcagagagacctcgagcggtggctcctccgtgctcgcggttcaggctagcagtcccttcaagcagaacagctccggttga

SEQ ID NO: 17475 - DNA, 318 bp, A.fumigatus
tcaacacgcagctgctctgcccaagtccacagtgaatccaaccccttgatcttctatgagatctggttccatctgccgacaaagcgtgcccctgagctcccccgcgtcggactcacggacctcgtctcctacgatatccgcaagacaagtattcgcgccttacgacgcaagttccacagtaggaaatggaaggacacgtgggattcgctctgtggcgcgatcggtatccaacagatcatggtcaatctcatcatgacccaagcaaaacatctggcgtcggttattgccgaaataaacagcagtgagtgggtaaggtag

SEQ ID NO: 17476 - DNA, 393 bp, A.fumigatus
aatgacgatttagggaccgaagcctgcattatcatcaagaagatcgagaaggaacttatctccgcccaccggaatttaggtacatttccttctcagaatattgtaatttcctacatttcagcttttttcctgatcgtcggctttttaattcaaagtgttggattatctatgatgcattggccgactcaatcactgcaactacttgcaatatcggccatgtttggtctgaggtactggcttcacaagcagaccattccagatggtatcaaactacaatataaccaggatgatgggccaaagaaggaattcaacactggaaaggcggagaaagaattgatggccctgctacctccagcagctccagctggagatatagtgaggtggatatcatag

SEQ ID NO: 17477 - DNA, 300 bp, A.fumigatus
tttctaggaaagtataggaatactcagcaagcatgggatgcagaagctctgaggggtttagttttattagagcatgccttgtctacaaaggctggcttaatccctttctatatgtgcacctgtaatagcagatattataaagctatgccgtatataatcagacctggaaagtcatcatgctgcaggctgaaccaatcagctgtggcccttcctagtcatgcagaggggaacggactaactagtcctattgctttcaggaactcaagcagccgttgtggagaactcaactctacagtttaa

SEQ ID NO: 17478 - DNA, 1059 bp, A.fumigatus
attgtatgcttggaattccctgaccctcttctctgccgaaatgctgttttgcgcgccgggctgacacagcgattcagtacggttaagccatggcatgtggttgtggcttatgagattatcaacttcttctgctacctgtttaactgcttcgggaaatcgctgcctctggtcgcgaaggcgactctgtacatctcgctgatctccttcctggtgatcttggtgactgtccctgcttgtgccaagactcatcccagtgcatcatacgtctttggccactttgtcaattccacaggatggaagcaggatggcattgcattcatcgttggcctgatcaacccgaactggatcttcgcctgcttggactccgcaacacacttggcggaggaggtacctcaacccgagaagaacatcccgattgcgatcatggccacagtagtgatcggcttcgtcacttcctggacctattgcatcgccatgttctttggactcaacgacctgaacaaacttttgagcacggcaaccggagttcccatcctggagctctactaccaggctctccagaacaaggctggcgctattgtccttgagaccctgttgcttgtcacaggcatgggatgtctgattgcctgccatacatggcaatcccgtcttgcctgggcatttgcacgcgaccgcggtttgccaggccacaagttgcttgctcaagtcaacaagactctggatgtgccactcatggcacacactgtgagctgtttcatcgttgccgcattgggtctgctatatctaggttcgtctactgcgttcaacagcatggtgacggcatgcatcacattgctgtatctttcgtactcatgtccgattctctgcctctggtaccgtggccgcaataacatcaagcgtgggccattctggctgggtaaatggggcctcgcggccaacattgtcaccatcgcttggactgttttctgcctggtcatgtactccttcccagcgaccatgcccgtcacaacagggagtaagtgttttcttatgttactcgaccgtaaacacctttgctaa

SEQ ID NO: 17479 - DNA, 402 bp, A.fumigatus
  unsure (39),(193): Identity of nucleotide sequences at the above locations are unknown.
gtattgcgttttgtatgtcgaattccatggtttggtatntcggcgtccttagtcactgggatcaactctggcggtacagtcctcatagtgtacggtttgctgtggatcactttcatttccatatgtgttgcgtcgtcgctctcggagcttgccagtgccatgccaaacgctggaggccaatacttctgggctnatgaactggcaccccaaaagtatgctcggtttgcgtcctatgtcacgggctggtttggctacgcaggggctattttcgcctgtgccagtgttgcactgagtcttgggtctgctggtgtcggcatgtggcagcttggtcatcctgaattgtatgcttggaattccctgaccctcttctctgccgaaatgctgttttgcgcgccgggctga

SEQ ID NO: 17480 - DNA, 351 bp, A.fumigatus
cgtgaatcgcagcatcttgccgcaacctctccgtccgtcgagattctccgcttccttctgctgcagggggggtcagtgcatatccgaaaccgcaacgggcgcacaccgctgttcctcgccgccaatgccgggctatcagagcacgtcctcttgctgcgcaagtcaggcgcgcatctgcattctgatgagcggcaagcagccgaactccttgcgcggcgcaggcccgccgtttggggtctggccggcattgggccgagggaagttagcgatcgcgagatggaggaagagaacgagtcgctcctgggacgacgagagattcccagtcggatggtctctggctctgctccttaa

SEQ ID NO: 17481 - DNA, 1134 bp, A.fumigatus
cgtgagcaatcaacatcaggatacattcagacaagttccgagggcgaacttgcatgtagagttctttggaaactgcggttattctttgacgcatcaagtgggttgcctgacaatatgacggccgcagaggcaaccattcccgagctgctcgaggagcaagcggactcagtccctgagtccagggtcttgattattatgaccggagggacgatctgcatgaaacagtcaccctcagggtttgtgccggctcggggattccaggaacagtgcctggcccgcgtgcctactttcaacgatggctcctcctccacgatgatggacgttgtggtcaatgcagcgagagagatcagaccgcatccgagtctacgaacgccgcagacgttgtacggccgccgggtgcgatacacggtgtttgagttcgaggagctactggatagcagctccatcgacgccaagggttggaccgagatcgcacggacgatcgagcggaactacacactcttcgatgcctttgttgtgctccacggcaccgacagcttagcatatacgtgctccgcgctgagcttcatgctccagaatctcggcaagacggtcgttcttacgggagctcaggctccgatgctagagctacagaatgacgctacggataacctcctgggctccttggttgtggcgggccacttcgtgatcccggaggtgtgtctgtatttcaacaacaagctcttcaggggcaaccgatcgtgcaaggtggcggccagtgactttgcggcattcgactcgcccaacttcccgccgcttgcggtgacgacgtcgatgcgcaccaatgtcaactgggaacttgtgaatcggccaaagaatatcgaacactttagcatccagacaaatctggacaccacgcacgtcgcgtgtcttcgcatctttcctggcatcaaaccggagatggtggacgccgtgctgaagctcgaaggactccgcggattagtgctggagacctttggtgcgggaaacgcaccgcacggccaagataacgccatgactaacgtgcttgccgacgcgatcaagagagggatcgtcatcgtcaatgtcactcaatgtaagctcttgtgcagaacaatttgctacgaacgatgctga

SEQ ID NO: 17482 - DNA, 414 bp, A.fumigatus
ccacaaccaggcctgaccggcagcgtgagccccgtctatgcgccgggaatgagtctttcccgcgcaggcgtcgttgcgggtctcgatatgacgacagaagccgctctgaccaagatgtcctaccttctggctcttccggactccacgcccgagtctgtggccaaggccatgtcagtctcgcttcgcggagagttgactgaagtgtcgcagccgatgttccgccaccctgacggtgcacttccggagcgggtgcaaacgctcaccatgttgggatatgcgatcgcacagggagacttcgaacgcgtgcaggagatcttcaagatcgagcatcactggatcttgaacgatgcagattactccggaaacaccccaatcgtacgcaaagcgttctattcttgggtcttcagagaataa

SEQ ID NO: 17483 - DNA, 198 bp, A.fumigatus
agcagattatgtgcgtcatcgcaggagcgttcccttagattgaacactaagtgcagccaggaaggtttacactccatgaaagacaatgaaaacaatgaagatcgattgaagaacatgattagtttgatcaaccagggccactcgaagcatcacaaggtgagccgtcaaggaggacgtacaggaaggagaacgatttag

SEQ ID NO: 17484 - DNA, 684 bp, A.fumigatus
  unsure (28),(147): Identity of nucleotide sequences at the above locations are unknown.
ttggcctgcagagtgagtcaaaactctntgcacacaagcgtgtttgaagctgacccagatcatagccaattccaatcacaaacgccaaatggtcgtcgcaccgccgggcgtgcccgttccaataccgcacattcccaccatgaacgntacgagccgctgcatgaggagctcacaaacggtgttagtccccgaccgatcattaggtcagaccgtcatgcttcatctgttcccccaactctgcccgcgagggaagcgtacccagcagagacgccttaccagcgaccttttttgaaccgcacctcaacttttgagggcccttcgcaattgcggcacctgcagccgtctggtttgtcttcctggcaatcacgagcggccagtgaaaatctggtctcccgcagagatagctctcagcctcggcctgtcagcatgatgccagataacccatatactgatgcttacgaagaatccactgcgcatgttaattctcattcagacgtgttctaccagggacgatctagccctccttcacacggggaaatcatttccagaagggccagctcggggaccttgaacggttcggcattgaacaagaaaggtcctccgcctcccccgccctcgcgagcaaagaagccgcctccgccacctccgatgaaacggcccatgctgtctgtgggagatgcgtga

SEQ ID NO: 17485 - DNA, 576 bp, A.fumigatus
tatctttttccgtcctcagcggctcacacccgtctcaacaaggctcctgcccagttccgcacgctcgactacgctgagcgccatggatatgtcaggggtgttgtgaaggagatcattcacgaccccggccgtggtgctcctctcgctaaggtccagttccgtcacccttacaagttcaagatggttaccgagaccttcatcgccaacgagggcatgtacactggtcaattcatctacgccggaaagaacgctgccctgactgtcggcaacatcctccctctagcctctgtccctgagggtactgtcgttaccaatgttgaggagaagtctggtgaccgtggtgctcttggtcgtacctctggaaactacgttaccgtcattggccacaaccctgaggagggcaagaccagaatcaagctccccagtggtgccaagaaggttgtaaagagcaccgctcgtggtatggttggtatcgtcgctggtggtggtcgtaccgacaagcctctgctcagtatgttactccgactcgcaaactctctcttggtatggaaagtgtatgaaaggcgtcgttgctaa

SEQ ID NO: 17486 - DNA, 186 bp, A.fumigatus
cgagtatctacagaggcttctcgtgccaagcacaagttcgctgtcaagcgcaactcttggcccaagactcgtggtgttgccatgaaccctgtcgatcacgtaagatctccctttggcttgttttatatattttttctcgaacaacacctgacaagaattctctctgcagcctcacggtggtggtaa

SEQ ID NO: 17487 - DNA, 696 bp, A.fumigatus
tacctcaaaatgcatgtggtcgatgattcaaatgatgccccgaaaatacttccgctgcctagagccgctccgtccacatccgctgctgcgcgttggcaagcagttgtgaaccgcgatgcagcggccaatacattcgtctacgccgtcctaacgacaaaaatatactgccgtccatcctgtccggctcgtcttgcccgccgggccaatgtcagattctatgacacgccctcacaggcagaatcagcaggtttcaggccctgtaagcgctgcaaaccagaaatgcactgggcggcaaacccacaggtccagttgatacaaaaggcttgtgaaacgatcaatttggaagtcctgaatggctgcaaaccaacgcttcagaagctggccagcgaagcaaatctgacacccagtcatttccatcgcgtattcaaaaaggtcatgggcgttacgccggggcaatactcggctgccgctcaagattgtcggaaccgaaatgcgtcggttgactctggcctaggcgaggattggagtctgaaccggccgctttgcgacgatggcgtctgctatgaccctgacctcttgggcggtttagatgactcccatgctccgaccaccacggatgctgttgtttggaatgactttgatgctatgatagctgcagagaatgagtatattctttggccagacgaagtacaatag

SEQ ID NO: 17488 - DNA, 453 bp, A.fumigatus
aacatgagggtgggcaagatttgcgtccaatgcgctggttttctcatgttgcttttcgctgaaactattcacaccctaggggtcgaccgtatccataaatccttggctgcttatttaaagtccatctccaagcgcagcgaaggagatgacaaggagaaaacgctgcctatagctcatttgggtagcagcatggtcagccatggggaggatttcgatgccaattccgaatatggccgttgtttgacgagtaagcgaccatgccactcctgctgcttcacaagcgattggctttctgacgttgttttctaccaaatagtgtttgggagggcagaggagcggattgctcgtgtgcaggaaacctatatctcacaggctactgccacgtatcttgagtcccttgaacgatctctagcccagttgaaagaatatcaggtacggtttccctctgtatga

SEQ ID NO: 17489 - DNA, 297 bp, A.fumigatus
cgacacgagcaggctgcccgcaagaagcttgacagccgacgattggcctacgatacgtcactttctaagatgcagaaagcgaagaaagaggactttcgcgttgaagaagaattgcgtacccagaaggtcaagtacgaagaggccaacgaggacatttacaggcggatgtacgatatcaaggatgcggaggtagaaaatatcgccgatttggctgccttcctcgaagcccagctcaattaccacgaacgctgccgagaagtacttctccaaattaagaatgattggcctgcagagtga

SEQ ID NO: 17490 - DNA, 195 bp, A.fumigatus
atagtatcggggcatagctccatccactttgaatttccgaaattggaatccaccactaagggtctgtcatcctcgacaccgtcccacaagcggcccactaacgcgtgtacggttactctgtactccgtagacagatacgaccatggccgatgtctaaagcctaacaataactgtacaaagtcccatgctaactga

SEQ ID NO: 17491 - DNA, 366 bp, A.fumigatus
cttttcactagtctcggcgcgtttgtattcatttttggtctctcaactcttatctactgcctcaccttcctgtgtaacgatgtgtcaggctgtcctgttccgtcgctgctgaatccatcgacattgtccctagacaagctgaaggaggaggctggctggccacaagaaggcctcaaagcgttctttgacgttcgggtgaccgtgtgggtgctgagttattacgtactcagtctggttctgtacgtatttctaccaggtgaggtggtggagggcacggaattggcctgcaagggaaggcttcgctacaagttcaatggtacgaaactgggagctgtcttctacgtggtgtcgactgacggattatag

SEQ ID NO: 17492 - DNA, 825 bp, A.fumigatus
ccatggctggccatagcagtatccgtccgtagtctacccatcgcggtgtcaggacgcattttcgagggccttgcatcggataacctgcttcatttcaaccttaacaccatctatgtttctctaaccttgccatcctcagtctctggtcaaaaagcctcgcagcttatggcgacttcactcgggctatatatgcttgggacggctgttagtcctgttgcagtgagcctctttcagagctatacagcaagtttcgctgcagccttggccatctttggcataacactggcatacctggttatttatatcgatataccagctccgcaggctatgcctcaggtggaaacatattcatcaaaaattctttcaggcgttggtatcctgctctccccacttcgatcattccttgaccatccccatgccatcccctacggactgtccctgctgctttataccgctgtccaggcccatctcttcccggcaatcatggtatttgcctcaatccggctgcattctagtgcgtttcaaaatggcctgcttgtgtccattgctgctgcgtgtgccagtgtgtctcttttccttaaagtattcatcatgccccgcgtgcgatggctaaggctgaactcagagaggcctacagacagcactgctatactcgcagcactagtcatacagatgcatgctctcatcggcatcacacaagtacggaatgctggtcaactatacctagctgtctccgttgcagccgcagggctagctctgccagcgttcttcaagggccattttgtttcactcacgccagatgcatcgcgagcgatctcggcatga

SEQ ID NO: 17493 - DNA, 837 bp, A.fumigatus
gacgtttgcatggtccttcggccgtgtggtgaagactcgatctgtgactttgatatttaccgttaccaggctggcagcaacctacagatcggtaacatcttcccccgggaatatgcgcgggccttctacgaaggcatggaggccgagggacagaagaacatcgtgaacctgctccggtgcgcctgggccggcagccaaaagtacggtgctctcgtctggagcggcgacatcgcgtcgtcgtggggttccttccgcaatcagctagctgcgggcttgaacatgggcctcgcaggaatcccgtggtggacgacggatatcgggggctttcacgggggcaaccctgctgatcctgcgttccgggaactcttcacacggtggttccaatggggtacgttctgtcccgtgatgcgtctgcacggtgaccgggagcccaagcctgaaggccagccgactgctccgggcgccgacaatgagatctggtcgtatggcgaggaggtgtatgagatctgcaagaaatacatcgacattcgagaggagctgcgggactacaccaggagtctgatgaaagaggcgcatgagaagggcacgccggtcattcgcactctattctatgagttccccgaggacaagaagtcctgggaggttgagacgcaatatctgtttgggtccaagtatcttgttgcgccagtccttgaggccggacagcgaaagatcacggtgtatctgcctgaaggagctttatggaagctatggggggaggaaacggagcgccctggagggcaagatgttgaggttgcatgtcccattgagacgatgccggtctttgtcagggtatag

SEQ ID NO: 17494 - DNA, 1116 bp, A.fumigatus
cggattatagcccttccttccgccattctgatcctcggtggtttagccctgggcacatacatgcacggtgctgacttcgtcgtatggacttttctctgggataactacgtgcagatcattacggcaaacttgataatttgcgtagtcctcgccatctttgtgtatgcgagaagtttctccatccctgcacctggtcaacccaacccggagctgagagaattggcaccaggtggtcactctggaaatgctctgtatgattttttcattggtcgggagcttaatcctcgggtgcagttgcccattccctttgttgatgaggcctcacgaacgatcgatatcaatgtgtggtgcgaaatgaggccaggtctgcttgggtggatcatactgaacctgtccaatattgcccgccaatacaggacgtacggctacattaccaattccatcgtgctctctaccgtattccaaaccttctatgttctggatgcgctgtatatggagccggccgtgctaaccacgatggatgtgattatggacggattcggttacatgctctcttttggacacctggtatgggtaccgttcatctacaatatccaaaccaggtaccttgcggttttcccgttggaattgcgcttgagggaaatccttctgatcttggctgttactggcgcagggtacgccattttccgcggtgccaacaatcagaagaaccgattccgcagggacccaagcgacccacgcatgatgcatatcaagtacatccagacgtctagtggctcgaagctaatgatttctggctggtggggactggcacgccatatcaattatttgggcgattggctgatgtcatggtcatattccttgcccaccgggattgctggctacaccatcattgaaagcatcaatagcagtggcgacatgcagaagcaggccatacagactcccgaagtacgcggatggggaatgatttttacctatttcttcttggtttatttcggtgccctgctcattcaccgggagggacgtgatgaagaaaagtgcaagagcaaatatggcgctgactgggagcgctatacgtctattgttcgcagccgcattattcctggtatttactag

SEQ ID NO: 17495 - DNA, 879 bp, A.fumigatus
gacgtagaagcccacagcggcgacgtgataacccaagtccacacagctgccaccaactctctcgtctacaaaccgaacgttgtgctcattaacgccggcaccaacgactgcgatcgcaacatcgacccagcgaacgcgggcgcgcgcatgcgatccttaatcgaaaccctcatccatgcccccgatatggcccgcgcgctgatcgtcctgtcaaccctgattccctccggttccacatccgtcgaagccaacaggccctctgtcaatgcacaataccgagcactggtctcggacatgcgagccgggcagaatgtctccatcgtgctggcagatatggatcccccggccccgagtcccgggaataactggatcaagtaccccgatagctacgccgataacaagcaccccaatgactacgggtactcccagatggcggacatctggtacaatgcgatctacgacgccgcgaaagcgggactcatcgtcgagccggcggacctcagtatctcacccccggggacctgcgataaggagtacgggagcggagtctacgcgggcgggttcacgcagcaagggagtggtgaagatgacgggatctatcgacacgacagcgagtatagcggggcattgttcagtgtgcgcgccggaaagggagccctcgatccctaccgagatgatgacgagctgttctttttcttcggcaggctttatacgagggagtatgatgacttgatcatcttccagaaggatactgaatctggggcggtaacgtttgttccttacacgaatcatgttcacactgaaaagaaggagtttaccaagggggttcattctcgactcataagtcttcaccccgggggcgaagcaacgcgtaaggca

SEQ ID NO: 17496 - DNA, 192 bp, A.fumigatus
gtgcaattcaaaatgggaaacatgtcaagcgagaagacactacaaaacaacaagcatgcagatgacctcggcgaaggcgctatgcaacagattcaagagtgctctgccttttcatccaccgcagagaaacgtctcgttcgaaagattgacattatgtacgttcgacatgcaatcagtctgccacgttactga

SEQ ID NO: 17497 - DNA, 576 bp, A.fumigatus
tcaaggatcctcccgatcatgacatttgcctacatgatggcctttctggacaaacaagccctcagctacacggccatcatgggcctgcggacggatctcaacctcaagggatccgagtatagctggtcaggcagcatattctactttggctatctgttcttctcatatccggcctcgatactcatggtcaagtttccactgggaaagtatctggcctgcaacttgtttgtcattcttcctaaacgtctagggcttatcctgacaatgaacagcatgttatgggctattgttctcgcttgccatgccgccacgactaatttcgccgggcttatggtggcacgtttcttcctgggatgcaccgaggcgagtgtctccagtggtttcagtctgattacttcgctgtggtatcggacgtctgagcaacctctccggcatggaatctggttctgcgggaattccatttcgatgatcatagggaatcttgttgcaatggggatctggcaaatcaagactggcctgcagccgtggaaggtatgttcgcaccctctccaagactcaatccattctgacatgtaa

SEQ ID NO: 17498 - DNA, 279 bp, A.fumigatus
attatacagtggctattcattatcttcggcatcgtcaccttcctctggggcatcctcatgttcttccgtctccccgacacgcccaatacagccagctttctcacagaggcagagaagctcctcgccaccgaacgtctcaaagccaacaatgccggttacaagcgcaataagatcgacacctcccaaatcatcgaagccttcatcgaccccaaaacctggctgctggccgtcatgatcctaggattcaatatccctaacgggggattcacaacggcatga

SEQ ID NO: 17499 - DNA, 576 bp, A.fumigatus
cgaaaaaagaggataatggacccataccgccaaatcagagttcacactatagttgtgaacataatcagccatatccttgatctcgggatcatagttcctctctgtcggcgcagcgggagcaccgtgctgaagagcagtcattgtcgagaattgcgagactcggggagcgcaagggttgacggccttcgtgaaggagttgcgagcgacaatgcgggaggatggcctggagacggagacgatgcgggatggcaaagtgcggggagacctgtgggtcagccgtctcagcgccgaacacgaggcagacatgatgaaaggagaagggaaagaaggaagatggaatactcaagagacaggaggagaggagaggagaagataggagttggaattaaggatggtcgtttagcaatgaaggaggaagaaaaaaaaaagaagaggagaaaggaaggagaaaagggaccgcgagggataattgttgagcgagatcgaccttctcgctggaccgaggccggttccgtttgttgtcctgcggttactcccggctatccgaatgcagagggtagaatggcccaaagatga

SEQ ID NO: 17500 - DNA, 378 bp, A.fumigatus
ctccaccatatcctccagaatccacaactgccgctgcatcgtcatcgccgcagtaggctgtatcaggtaaaccccttgacaggttacaccgcaaccgaccctgacaaaaatgacgatcacagcatcctaggcagcgcccttgtctacgccaccgagtccatcgccgcgcggtacgccggcctccttctcatgggggtgtactcggtcagcatgcccctgagcctggcaatggttgcttcgaatatcggcgggttcagcaagcgggcgactgtcagcgcgatctatttcgtcatgtattgcacggggaatattgttgggccgcagttgttctatgagagtgaggcgccgaaatatcaggtatgttgtattcagttatag

SEQ ID NO: 17501 - DNA, 642 bp, A.fumigatus
gacaaggttaacggcccgttggcaagcatcaccagcagcccacgattttctggacatggtgttaggggaatgtctgtaggtacggagactctggccgtccacccaagcctgagtgatggcatcagcggtctgcttctcgttgaggccgagcatcttagcaaccacagcagtggtggcaaccttgaccagcacaacgtggtccaggccgactctgttgtacgaattctccaaggccagaacaccctggatttcgtgggccttgatcatagcctccagcacttccttgaccttcacgatcttgccatttccgaggttacctccggcacggttggtgcgggagatccagtcagcgacagccagaataccgcccagattgtcggaggggtgaccccactcggcggcaagccagcagtcattgtagtcaagccaccggatcatggcaccaatgttgaaggcaccattgacagggtccagttgatagggagtaccagggacacgagtaccgttagggacaacggtgccctcaacaacgggccccaacagcttggcgcattccttgaatctcaaggcctccagtccgcaacccagcgtgtcgaggaagaccagacgggcagtgtcatactaaatcaaatcaatgcatga

SEQ ID NO: 17502 - DNA, 573 bp, A.fumigatus
attgtatggactatggggtgccgcaatcacgaagaaggctcatcattattgcttctgggtaaggaccctgtttcctattgttctcctgtgggtcctctcctggcttcccaattgacattcctctgtgtaggagctgatatcttttctagaccaggcgaagtgctgccacccttcccaaagcccactcacgggctgcccggatcggggctgtctgattacaccaccataaaccagatgatagcaaacatacctcccaatgccccagatcacgatatcgaaggtgctaggagtcgaggactgcgcaatggaacgagggtccccttcgacccgaaccagcaggcaaaaaccgtgacctgcagcggcggggagaacaactaccatccgtcgggcacacggggcttcacaaaccgcgaattcgcctgcctgcaaacgtttcctctagactatcgctttggagcacgagaagttcggaggcaaatcggaaacgccgtcccccctgcgctgtctaaagcgatttaccgagagatcatcaagtcattgcagcgtacggacgagcaagaactcaaaggttga

SEQ ID NO: 17503 - DNA, 819 bp, A.fumigatus
tatgacactgcccgtctggtcttcctcgacacgctgggttgcggactggaggccttgagattcaaggaatgcgccaagctgttggggcccgttgttgagggcaccgttgtccctaacggtactcgtgtccctggtactccctatcaactggaccctgtcaatggtgccttcaacattggtgccatgatccggtggcttgactacaatgactgctggcttgccgccgagtggggtcacccctccgacaatctgggcggtattctggctgtcgctgactggatctcccgcaccaaccgtgccggaggtaacctcggaaatggcaagatcgtgaaggtcaaggaagtgctggaggctatgatcaaggcccacgaaatccagggtgttctggccttggagaattcgtacaacagagtcggcctggaccacgttgtgctggtcaaggttgccaccactgctgtggttgctaagatgctcggcctcaacgagaagcagaccgctgatgccatcactcaggcttgggtggacggccagagtctccgtacctacagacattcccctaacaccatgtccagaaaatcgtgggctgctggtgatgcttgccaacgggccgttaaccttgtcctaaaggtccagaagggcgagggcggtgttcccactgttctgtccgcccccgtctggggtgtctatgacgtcctgttcaagggtaacaagttcaagttccagcgcccgtatggcagctacgtcatggagaacgtcctcttcaaggtttcctacccaggtaagtttgtggaagtgagaattagacgagttcactattaa

SEQ ID NO: 17504 - DNA, 303 bp, A.fumigatus
cccttgacagccgagttccactctcagaccgccattgagtgcgcgcagattatcaacaggaagctggcagccatgggcaagagcgccaaggacatcaaggagatcaccaaccggacccatgaggcttgcatccggattattgacaagcagttcaaggctatggacaactttgcggaccgtgaccactgtgttcaggtatgtcttcagcttgaattcgacctcggaagctttgctgatcttgatcaagtacatggttgccaccatgctggccttcaaccgcctgaccgccgaggactacgctga

SEQ ID NO: 17505 - DNA, 1062 bp, A.fumigatus
ccaatgtttggtaaaacgaattggtccaacaaggggggccttcccttgaacttcccaagggcctttttttcaagaatcgaacttgtgttcaagaaactgttaaagagttctctttcaaggccttcatttgatcggaacgtggaatcacaaggggacttatatccaaaatggtccaaccgaactgtctggatcgtcaatgagtcaacagaggtcccattgagcttcgtcaagcgcttcatcaatattcgtttcaccaactgctgccatgttgagcaagatcttcagaaacgaaatcgaccaaatgatctgttctgtcgattgaaggagaatcttaaatcatctcaggcggcggtcgagtacctgtcattcgaagattctgatgaaggctttgcaatcggttcgatgtctttacgacattcatggcgaggggaaactcgtccgtttggtagtgcggatgctaattcacaaccacaatctccaatcatagtcctggatgcagaccctgtcattgatcttaccggaattgaaaaagaagacgccagagtgcagaaaaagcatcggaagtatacgtttggcgatgggttctgcggtgcaggaggtgtgtcttgtggtgcgtcgaaagctggtctgcatatcaagtgggcatttgataaatccgagaatgcgattaccacatatcgtctgaactttgcaactgcggtgtgtgaagcatgtgacatcttctgtttcttgacgaataagccggaggagttgaaagtggatgtcagccatggttctcctccgtgtcagactttttctccagcccatacgatcaacagtgtgaatgatgatgataattcagcgtgcatcttttcctgcgcggacatgatcaagaaatcgaggccgagagtgcacacaatggaagagaccagtggactttttgatcgacataaggagacctttcaccgagtcatacaagacttcattgagataggatactctgtgcgttggagaatcctgaattgtatggactatggggtgccgcaatcacgaagaaggctcatcattattgcttctgggtaa

SEQ ID NO: 17506 - DNA, 348 bp, A.fumigatus
gtattccatcttccttctttcccttctcctttcatcatgtctgcctcgtgttcggcgctgagacggctgacccacaggtctccccgcactttgccatcccgcatcgtctccgtctccaggccatcctcccgcattgtcgctcgcaactccttcacgaaggccgtcaacccttgcgctccccgagtctcgcaattctcgacaatgactgctcttcagcacggtgctcccgctgcgccgacagagaggaactatgatcccgagatcaaggatatggctgattatgttcacaactatagtgtgaactctgatttggcggtatgggtccattatcctcttttttcgttatga

SEQ ID NO: 17507 - DNA, 675 bp, A.fumigatus
cagccgagttccactctcagaccgccattgagtgcgcgcagattatcaacaggaagctggcagccatgggcaagagcgccaaggacatcaaggagatcaccaaccggacccatgaggcttgcatccggattattgacaagcagttcaaggctatggacaactttgcggaccgtgaccactgtgttcaggtatgtcttcagcttgaattcgacctcggaagctttgctgatcttgatcaagtacatggttgccaccatgctggccttcaaccgcctgaccgccgaggactacgctgacggctccgaggccgccacctcgcctttggttgaggacctgcgcaagcgcatccgctgtgtggaggacccccagttcacccgtgactaccacgaccctgccaagcgcaccatccccaacgttgtgaccgttaccctgaatgacggcaccgtcctcgaggaggtcgttgtcgaggctcatctaggacaccgtttcagacgtgaggaggccaagcccgagatcttgtccaagtacaagcgccacctggaggcccactttgaccaggcccgtattgacgagtttttcaaaattggcttggaccgctcttctctggagaactacgatgtcgacaagtacgttgacctatatgtcaaggacaagatggtcgtcgctgctcaatga

SEQ ID NO: 17508 - DNA, 447 bp, A.fumigatus
gaatcagatccaagagattactttctaacaatcttcaccctcctagaaactctcatgacccacgagttgactctcgatgatgttcaagtagccaccgctcctactcttcgcacattcctctgccttccattatttttgatcgcctcgggtattcagcacgattgccaccactacctcttctcgcttaagaagtataccctcccgactcatcctatgtttcaaagaatcgtatgtccccattacactgctgagtgtgtgatatacctgtcgttggctctgttggctgcaccgaatggcgagatggtgaacaagacacttttgtcatgtttcgcgtttgtaacggtgaatttgggtgtaaccgccacaatcagcaagcgatggtacgagcagaagttcgggccggagtctgtcaaggaaagatggaacatgattcctggactcttctaa

SEQ ID NO: 17509 - DNA, 222 bp, A.fumigatus
ggctcggcaaggtgcgtctctgtttctctctttttctttttttctggttcggacctgatggctgtaggcggctctcttggttggaaagtccgaggcagtctcaacgcggactttgagaaggctgcgtatgagcttgagcccagtacgactgcgaaccccaaatacgtggaggtgaagaccgggtttgggtaccatatcatcatggttgaagggaggaagtag

SEQ ID NO: 17510 - DNA, 639 bp, A.fumigatus
cgttggaaggtaacaactgcccctcttccacggtggactcagctttctcgccgacgtcttcaaacttggccatctgctctgacgacgtcgaatacactaattgcatcgccattgccctcatggctcgtctcacctatcatcaaccctcgtttggactcactcgacattttcgcagacgctcctcacggcgctccaaaccatgtcctggtgaacgaatactgtcccggccaaggaatcatgccgcatgaagatggagccgcgtactatcccctggttgcgaccgtgagtctgggagcaccgattgtactagatctttatccaaagcccggttcaagcaacgctggaaacagcagcggggtgggtggcgctcggcagccccagtatcgaatcttgcaggagaggcggagcctcctggttacgagacgaagtatctatacagatttcttgcacggtattgcagagacccgcaaggacgataacctaagtgctgagagcatctgcaattggaatctgctgcgtgaaccggatcgttatgagtgtggttggtatgagagggagactcggatcagtctgacgtatcgggacgtgatcaaggtgtcaaagttgggaaatacgatgaaattcctaggcggacggtga

SEQ ID NO: 17511 - DNA, 1479 bp, A.fumigatus
tatttctcccctctttcgtatcagaaagttcgacataactctgaaagcgccgtatttctcctcccctttagctaccgcgtcacctcaggtgcaacagcaactctcctccccaggatccgaacaaagtcttcactcatacgtaacttcgagtccagtgcggtggtcgaacggccgcgtgagaaactacgaaagacagggattttcgcttcgctaggcgtggtcgagcaccagcttccacgcgcgactgctggtggtttcgactactacgagtattctctgtccgccacggcctccgaaaatgacgatcggaacacccagcaatcgattactaccgctatgagtgatgttgatgcagtgtcctccttgccagctgccctgcgtgccggacaaaatgctaccgctgtcacggtgaacccccggtctgcttctggttcactgtcttccaagagggtctctccgtcgccccatcgcagaggagataatgctcgcgtcaaggaggttgattctgcgtcaggagaaggggatggcccgccgagccccaaggctgactcggaagcagaaactatcatccagtcgggccgcgagtcgctgtcgccagaaaagagacggaagtatattcaacatgagccaaggcgacttgacgttcaagttgacaacagtgacactgtggggaacagtgcactacctgatgacacacacattaggaagagaaaccgatcgatcgatgaatccatcgcggaacgcgaccgtggattctccccggaactccattctcgaacagccatctccccatcacatgtgaaaatcgagaaggcagaggaactacagcccgccctaaatgatcttcattccgctctgccttcacatagcacggaggctgtccccggtgggcagaacgtccacagctcacgaaagcgtagccatagcgatggtgtcgacagtgagagggacaggactcaacttagccgccacacaaccgcctcccgcgacaaagagcgaagggatatcaacggcatcagtctacctccaccagagtcgatcgatcgctcagtctcgcctattcggtcggctcacaagcgaacagcttccggtccgcagcttgggggcagtgacttgcaaaaaaaaaggaagactactactccactcatcactggatttcaacggcaaagctctgaggacaggctgtcggtttcgtcttcaactagtggctctcctctacccagctctcaactccggaaattagccggtgtcgacggcgcttcagcatctcccgctaggccaacgggtcacaagaaacagcgtgaccaaaatggccgaacacgtctagcacgtgcctgtgcggctcacgaactggaggcaacaatggcgaagcctgcagaacgcccggaagatttgaatgtgggcgacaatgcgggaaatactcccctccaaattgctgccctccgaagggtgtgcgccgattgtgaaatttcttcttga

SEQ ID NO: 17512 - DNA, 282 bp, A.fumigatus
accatcccaggtagtagtaaatcaactcctcagcaaagaagctgccagaaaaacaacagtcagcgtatacgagcgccaatcagccaccatctgcagttgcatcgggcagtccgaaccccatgtcccatcccatgtaacacgaggctgggctctgacagcgcattcagtccaacggtttacggttacaccgtcatcacaatgctgacgcctcttgcagctacactcaccaacccgcttacgcctgatcgtaccacatttctaacaaacaagctgtataaataa

SEQ ID NO: 17513 - DNA, 1014 bp, A.fumigatus
gatcgctcatggcttccatctgtctgtcatggcgtttgcctcgcagtagcaggagtcaagatgctctcctcacgcgcccactatatggacatccccgattccggccccggggtcgagcatcactggggttactacaaccgccaactcccatgcaccaccgacaagggcaaatgcgactatctcgacacggtgtatcattcgcatgatctgtccattctctacagtgccattctctggggtgtaattctcggtgtgttggtgctctgcgcgttgagacggctcatccgcgtccgtcgcacatcgcatccttgccctcaagatgcagagacgggaaagaatccgcctcagagcttcatctaccgctgtcaacaatccctcaaatcagcctaccaccgccatcttcttcgaggatggctccccggcatattcggccacacaaccggcttcaacatcctcgtcctgctcatcctaatcgcctacctcaccatcttctcctttgtcggcatcgtctacaaaacctggtacagccccgtcaaaggctatcccaacctgcatcagacccgcgtggggctcgggccctgggcggaccggctcggattgctagcctatgccctcactccgctggccgtcctcctgtccacgcgcgagtcccttctctcgctgctgaccggcatcccgcaccaccacttcctcttcctccaccgctggctcggttacatcatttacattcaggccgtcctgcacaccatcggctggaccgtcatcgagggcaagctctaccaaccgcagccctccacgtggaacgagttcatcgcacaagagtacatgatctggggggtcgtcgccatgatcttgctttcgttcttggttttctgctccccgcaatggtgcgtccgattgacgggggtacgaattcctccgccagttgcactatgttctggccatggtctatgttcggcgcctgctgggggccactggggcctgctgttctgctggtatgatcgcctccgttga

SEQ ID NO: 17514 - DNA, 489 bp, A.fumigatus
ccatgcgtgacaaacagctcccacagccagaagagatccgcacaaaacagccgcatcacccacaggaaccagcggtccgcaatctcctccagcagagtcttgatggcactgcgatgccacgcatccatgtccttcctcgtgttcaagatcaccaacgcctcgggatacgcctccaccagctcagccgcgaagaacgacgccgctgtatccaccaccgcatcgcagtgtcccagcagcgcgtcgaattctgcacgcgacacgcggaactcgccgtcctcctttccgttccattttgcccgcgccagtttcgcccatccctcgatgtaccccgcgttctcttcgaaggagatgtcccacccgtggtatggggttagaccaagctgccgcagcgcgacggccaggctctctgtggcggaccgcgggaggccgacgcagatcacctgcatgggcttggtgcgggtgcgagccggtggcttcgggaggttgtaa

SEQ ID NO: 17515 - DNA, 252 bp, A.fumigatus
ctgtcccatatgcaagatatacaaagcccagtacctaccccagacaaacgacccaggcgtctggtctgtatagcttctccgtattctacatctctgatagaaaatcagtatttcgccaactcggacaatgagcaacctgtaccctacactctccgtcggcaggcaggggaggccatcttcgatatgattctccccaagaacagatacgatgaatcagactcagaaggaccaaaggcagtagaactcatataa

SEQ ID NO: 17516 - DNA, 264 bp, A.fumigatus
ttatataatctacctcaactaacaatcattttcttcaacaagtccaataatcccctcgagaccactagctcacccatgaccaacagaccaaccctacgtcggcccctcattgttggacgtcacgggagtcaggtttggttcacacttgaagtccaccacacactgttcatttatttctccaagacccccaggagcagcgacagggctgccgtggtaatccacgcctttcgtagctctgacaccacggggcaggaaataccgcgt

SEQ ID NO: 17517 - DNA, 600 bp, A.fumigatus
agacctaccctcccagtcgaaaacggaatcaaccgggtcatgctgcggtctacaacaagagccggccaggtcactctgactgctacatccgacgggctcaaaccagcaacgattagcctcaacaccaagccatttgccagtaagggcgggttgagcaccgtcatccccgggtccgaccttccttttgttctctctcgcggtccgacaccatcgagtgaatcatacaccatatctcgcaaagctgtggagggtttgaacgtcactgctggatgtgacacggagaacatgatcaattcctacgatgatgacgaggaaacagagtggtcctgtgacggggacaaaagcagtacctggatcaagtactcctgggacagtccagtcaatgtgtcgcagatggtgatgaagctgcacagcttccgaacgacaaagtatccagtccagatcagtgtggacgacaccgtagtctatgaaggggtcaccccgacttctctaggctatgtgacgttagatctcaatgctactgttggccagagtgtgacggtggcttcagaggacagcgacctgggaattatcgaggcggagatctacacaccggcataa

SEQ ID NO: 17518 - DNA, 213 bp, A.fumigatus
ggtctctgttctccatcaaaaagctcccttgtatgtgtgctcgtttcaggacttttgaccactgagagactgagtcgcgtactagacattctagctgccctaaaatttaatcagttcactgacttggctgtttccctagctagtataagcctggtcctggggactaaacatgcggtcctccttcagctatctagattatacttaacgtcatga

SEQ ID NO: 17519 - DNA, 210 bp, A.fumigatus
ttgtatagcgttgaaaatgtcaacgacaccgaggagatcaaccccgacagtcttcgagcagcagcgagcggagctggttcgggaaatcgcagtggtaagcaattcggcgctggacaagacacaaaagtcactgcatcatgcaactgttcaagtccttattttattaatttcatcgatgggttggagtcactctattcagtacaatactga

SEQ ID NO: 17520 - DNA, 285 bp, A.fumigatus
ggtattgaactcctgaagacgcaaggattgactcccgtcacaccggaacagggcgagacagttgccagaagaatgaatgcttcttatatcgaatgcagtagcaaggaaatgcgcggtgttgatgaagttttcgcattggcagttgataccgtcgtgtctgccgaagaacaagactggatgggcaacagccagagcaacggcaccagcagcaaatttggaggaggtggcagtggtctcaggagcggcagcaagaaggttaagaagcgtacttgcaagattttgtaa

SEQ ID NO: 17521 - DNA, 399 bp, A.fumigatus
ttccacaagatgaagtcgctggctggctcattcgtgggactccttttccttttatcagctcctgttacatcagtttacgctgcctctgaacctacgggcaagaaagatggcctctccccgtgtgttgtacgctctccggctaccggcctctactacgatctgaatgcgatctcggtaccccgtccggatccctcggacggcaagaaaagcaacaagaacgcgccgagagaaagctggcacgccaagggccatgactatcatgccaactttacactcaatatatgtgcacccgttgtcgaagacataaaggatgtggtgggggtagagcgcgacagatggaagaatgtcagcgcctactacgagaaagaagggaagatatactccattgggtacgtttga

SEQ ID NO: 17522 - DNA, 411 bp, A.fumigatus
agcgcgacagatggaagaatgtcagcgcctactacgagaaagaagggaagatatactccattgggtacgtttgataagcgtacagtgcgatattccatgtgtcggctgattgttttgtacagagaacaagccgcgcaaccattgttccgcggccgcaagctcgtgttgaattacactaatggctcaccttgtcctggagagcagatcggacatagttcgcggaacaagtcgacaatcatgtcttttctgtgcgaccgggatgccctttcccaccaggccgttgcgtcttttgtcggcactatggaccagtgcacatacttctttgaggttcgaagcgcagccgcttgtggcagcatcggtcacgcccacggtgacggcctggggccggggggcgttttcggcgtgatgtaa

SEQ ID NO: 17523 - DNA, 297 bp, A.fumigatus
gtccatctcacttttcctttgtcggacagaatactaatactatcgatccttagtgctctgattgctgtcgccgcgtatctggttggtggttgtgcctatcagcgaacagtcatgcaccagagagggtggagacaatgtccaaactatagtctgtgggcgggcatctttgattttgtaaaagtgagtgccctggctttgatacctttccggtcatctcgcattcgatctggacgtggctccctgagtccctataaggagtttggtagtccgaggttgcccatttcccgaaccgattga

SEQ ID NO: 17524 - DNA, 1485 bp, A.fumigatus
  unsure (40),(41),(43): Identity of nucleotide sequences at the above locations are unknown.
ggcgggaacacagggaagtggtttctccccccaggggggnncnccctctgcaacctcgccatttcccgacgggagggcgagtatacactgcgaaaaaggaaatgggacccgcatcctctatggtcgcccgagtcgggttatatgaaattgaaacggcaaatcgaagacttctccgccaccctgcccagtcatttggcattcacatttgaaaatctacaagtccacgctgcagacaagatcgccaaccaatttctctatctccatatcattattcaccagaacatgttattcttgaatcaatttgccattccgctttcacctggagggcgacctcccaaggatatgcccaaatcgttcctcagcaacgctgggcgtgccgctgtcgaggcagcacaccacatttctgttttgatagaccgcgcgtcggcctatcctctcacagtgccgtttgcaggatattccgcttactccgccagtacggtgcacatctggggcatcttctcgaagaacgcacaattggaggctcggtcgaaagaaaacttgcggcacacctatcggtaccttaataaaatgaagaagtattggggaatgtttcactacatggttgaaagtgccaaagatcgttatcggcagttcgcagatgcagctatcaaggggaccgtcgtcacccagaatggcaatcatgtcacccccatgttccagtacggcgactggttcgataaatatcctcacggtgtttcaagacttcactgggaagatcctgacgccagacagaaggaccatgccgatgacggggtgatgggccaaaagcccgagcttcaaagcgtggaagacttcttcgcaagcctatctccatccgtgccacagcacagcactccccgtcggccagatccaagaagagacagcaagagtattgctcctccagaccaggcaatccctccgcaatcggtggtcgacgtaaacatgaacaatgctcctgggatgttaggcacatctagtacgggattcccgcatccgacaatgtacgatcaacaaggcggaacaacatcattagggccagccggattcgacttcaacattccccaagatcaactcccgctgttggatcggcagttcgtctacggatccttcgcggggatcgacccttcccctgccgcttttgcggctgttgataccccgggaatttccactcctggtgaggcaggcccacatacaaaccaggacacttctgctgcactcttcaccggccacatggaccccaacgccccgtcaggaaccggagagtactatcaaccgagcgcctggtttttacctttcaatctcgaccctgtcggtgcaggtgtcggtcttgatcccaaccctgcggcttccgtgcccagtagcgaaaatgccactccagacttatccgcgtttggcggtactggcataccactgggagggtatgatctgggaatgacgggaatgaatcaaaggtcccatcggtga

SEQ ID NO: 17525 - DNA, 327 bp, A.fumigatus
gtgtatttccacagtattggagctttcggaatcatttttggcctaccctgtctgctctacgcattcaccttcttctgcaacgatatctcgggttgtcccgcgccgtcgcttctgcacccatcgacactgtcaattgataagctggaacaagaggtcggctggccggaggatggaatcaaggctctctatgatactcaggttaccatgtgggttctgagctattacttgctaagtctgctcatgcaggtgttcctccctggcacagaagttgaaggtaccgagctggcgtgtggggggagactcaagtacaaatttaatggtaaatga

SEQ ID NO: 17526 - DNA, 312 bp, A.fumigatus
caattcgcagcattcctgtcggctgtcttgatcctgtcaggatgtgcggtaggcacgtacttgtacggcacggaattcgcgctatggactttcctctgggacaactatgtgcaggtgatcactgccaacctgatcatctgtactgccatcgcgatcttcgtttacctccgaagcttctcggttcccgctcctggtcaattgaaccccgagctccggcaactggcgccaggcgggcacacaggcaacgtcctgtatgacttcttcgattggctcgggagcttaacccccggatctgtctcaccgcggggctag

SEQ ID NO: 17527 - DNA, 690 bp, A.fumigatus
gacgacgatatcatgcgcttctttgatggtggacagccggtgcgcaatcaccacggtcgtccggccctgcgacgccttctccagcgccgactgcaccagcccctcggattttgtgtcaagagcggaagtcgcctcgtccagcaacaggattttcgggtctttgacgatggccctggcaatcgcgatgcgctgcttctggcccccggagagcgagaaacccccgatgttggtttcgtagccatccggcagggccatgatgaagtcgtgcgcatttgccatgcgggctgcatcctcgatccgtttctgtatctgctgagggggttcgtgttcatgcttcgagccgatgagtccgacccggatgttctccgcgatcgtggcggcgaagagccgtggttcttgcgaaacaagtgccatttgctggcgcagccagcgaagattcaactgctggatatcatgtccgtcgagcaggatattccccgcgaccgggctgtagaagcgttcgaggagtccgatgatggtgcttttgccggatcccgatggtccgacaaaggctgtggttttgccggctgggatatagacgctcaggtcgtgcgcgacgatgacctcgggccgagacgggtagacgtggcggatattttgcaaaacgatgtttccacggacatggtccagggtgatgcccgtgtcgaatga

SEQ ID NO: 17528 - DNA, 432 bp, A.fumigatus
cgtatcagacaactgcatgcaccacacacccgccgcgacatcatggtcgaggtgatggagcgatcggggggcagcgagctccctgaagacgagatcgccgaaaacttctcagcgatcatgctggcggggttccacacgacgcagaacgccctctgcgcggtcatttacttggtgctgacccacccggaggcgcatgtgaagctggtgcaggagttacagacggcgtttgcgtccgcggacgatatctcgggggatgttgcggcgcagctgccctatctcaatgccgtgattacggaggcgctgcgcttgtatccgccggtgccgttggggggcccgcgtgtttcgcctggggcgtatgtggatggggtgtatatccctgctggggtgagtacaatgcttcagtttcagactctagtccctctgctaacgtga

SEQ ID NO: 17529 - DNA, 210 bp, A.fumigatus
cagactttagtgtcctccgggaacgaactccgcaatggagcctgcaaacccatcaccttcatcttcgcgcgcgcatccacggagccagggctcatggtaaggaactccccgcaggctctcccaataacaacagaactaaacgtcaacaggggatatccaccggccccgcagtctgcaacagcctcaaagccgccaaacccggccaggtag

SEQ ID NO: 17530 - DNA, 336 bp, A.fumigatus
agacgggtcatccgcgagtgcatcctgcgcttgcacgaagtcatccgagacaaacttgagacgcacaacactatttcgctgaacgagctcctctactgccactcggtagacaccgtctccgaggtcctactgggcaagccactgggctgcctgaaacgcggcaagccatacttctggaccgagcagctgccgcgcatcttctactgggcaaccatccgagaccaattcgagggctccggcatcccaaccgcaatcaagtggctgctgcggcggtttctgcgcaaggggatccgacttcgcgcggagcaagcccgcatgcgactcatcaacgagtag

SEQ ID NO: 17531 - DNA, 1641 bp, A.fumigatus
gtcctctttggcaacttgacctccacctttcaagacatcgtcagcggacaaatcgcctacgcgcacttccaccatgagctcaccaagtacgtcgtctactttgtctacctggctatcggagagttcgcaaccatctacctggccacagtcggtttcatctacaccggcgaccatatcgtgcagcagatccgcgtcgagtacctgcgtgccattctacgacagaacatcgccttcttcgatacgctgggcgcgggagagataacgaccaggatcacggccgacacgaacctcatccaagacggcatctccgaaaaggtcggtctagccttgaccggactatcaacgttcgtcacggcgttcatcatcgcatacatcaagagctggaagctggcactgatctgtagcgccactctggtcgccttgctgctaatcatgggtggctgctccacagccatgctcggcttcaacaagcgcgggctggcttgccaaggccaaggcgcaagtctagcagaggatattctcgactcgatccgaacggtggtcgcattcgacgcacaggagacgctagccactaagtatgagaaacacctcaaggatgcagagagaccagggatgcgggcgcagatgatcttcgcgctgatggttggagctctgctgtgtgtcatgtatctcaactacgggctgggattctggatgggatcgcggttcctggtcgacgacgggagccatgtcaaggccggtgatgtgctgacgatcctgatggcgatcattctcggatcgtacaacctgggcaatattgcgcccaacactcaggcgctgtccactgcggttgcggccgcgaccaagctgtatagcacgatcgatcggcaatctcccctagacgcgtcattcgacacgggcatcaccctggaccatgtccgtggaaacatcgttttgcaaaatatccgccacgtctacccgtctcggcccgaggtcatcgtcgcgcacgacctgagcgtctatatcccagccggcaaaaccacagcctttgtcggaccatcgggatccggcaaaagcaccatcatcggactcctcgaacgcttctacagcccggtcgcggggaatatcctgctcgacggacatgatatccagcagttgaatcttcgctggctgcgccagcaaatggcacttgtttcgcaagaaccacggctcttcgccgccacgatcgcggagaacatccgggtcggactcatcggctcgaagcatgaacacgaaccccctcagcagatacagaaacggatcgaggatgcagcccgcatggcaaatgcgcacgacttcatcatggccctgccggatggctacgaaaccaacatcgggggtttctcgctctccgggggccagaagcagcgcatcgcgattgccagggccatcgtcaaagacccgaaaatcctgttgctggacgaggcgacttccgctcttgacacaaaatccgaggggctggtgcagtcggcgctggagaaggcgtcgcagggccggacgaccgtggtgattgcgcaccggctgtccaccatcaaagaagcgcatgatatcgtcgtcctaaacaatggatgcattgtcgagcagggctcgcatgaccgtctcatggacagaaggggcgtctaa

SEQ ID NO: 17532 - DNA, 1296 bp, A.fumigatus
  unsure (673),(745),(758),(818): Identity of nucleotide sequences at the above locations are unknown.
tacggcatggtcaaggcgcagcagatcaagaagcggctcacgcggatgagccagatggctcggagcccgatgcggacgtttttctttgacctggactatccgacagacgatgacgtctcggagtatgatgctcaggacgacgcgtctgacattgggctgaagacgggagagcggctgaagcagcggatgtctcgcctgtcgatatcggcgctaccggtgcacctgcacaaagccaaagagatgtcccactcactctgcacgctgttcaaattcctcgcctcgttcaaccgccccgaatggccgcttctggcgctggggctggctgcatccgtcctcgccggaggcatccagccctcgcaggccgtccttttcgccaaagccgtcagcacgctgagtctcccgccctgggaataccccaagctccggcacgacgcgagcttctggtcgctcatgttcctcatgctcgggcttgtcacgtttcttctgtatgccttccaagggagcttattcgcctactgcgccgagaaaatggtctaccgggcccgcagccaggccttccgcgtaatgctccaccaggacatatcctttttcgacgagccggagaacaccacgggcgggttgacggcgacgctgagcgcagagacaaagccaactggccgcattcagcggcgtncacgctcggcaaccctgctaatggtttcggtgaaacctgttggcctcgctgggtatcgcaatcgtcatgggntggaagctcgcgntggtgtgcatttccgccgtgcctgtcttcctgctctgcggctttatccgcgtctggatgntggacaagttccagcggcgcgccaaggcagcgtaccagcagtcggccagctccgcctgcgaagcggcctcggcgattcgcacggtcgcttcgttgacgatggagggggaggttttagagtcgtatcaaacgcagctgcaggaccagctcaagcgggatctcctccccatcgtcaaatcgtcgctcctgtatgccagctcgcaggccctgccgttcttgtgcatggctctgggattctggtacggtgggacgcttctcgggcatggagagtactccctcttccagttttacgtctgcttcagcgaggtgatcttcggcgcgcaggcggcgggaaccgtcttctcgcacgcaccagatttgggaaaggcgaagcacgccgccggggaattcaagcggctcttcagcggcgagaccatgcagtcgaagtgcagggctgcggcacgccacaaatcccagccagagatgcgcgggctgattga

SEQ ID NO: 17533 - DNA, 324 bp, A.fumigatus
acggagatctgcacgtccttgtttgcgctgcatcacaatccggagtacttcagctctccctacgagtttctcccggagcgatggacggagccaggatcgacagaccggaaagaggcggtccagccattcctgatcggaagtcgggcctgtattgccaagtactttgccaaacagatgctccaattgactctagccggcttcttcttagagtttgaggccgagcatgtgggcaaagtcagggactggcagcggcaatctcggtgttacgccttttgggacgtgccggacctccaggtgaaactgcgcaagagattgattgactga

SEQ ID NO: 17534 - DNA, 972 bp, A.fumigatus
  unsure (39),(52),(112): Identity of nucleotide sequences at the above locations are unknown.
aacctgttggcctcgctgggtatcgcaatcgtcatgggntggaagctcgcgntggtgtgcatttccgccgtgcctgtcttcctgctctgcggctttatccgcgtctggatgntggacaagttccagcggcgcgccaaggcagcgtaccagcagtcggccagctccgcctgcgaagcggcctcggcgattcgcacggtcgcttcgttgacgatggagggggaggttttagagtcgtatcaaacgcagctgcaggaccagctcaagcgggatctcctccccatcgtcaaatcgtcgctcctgtatgccagctcgcaggccctgccgttcttgtgcatggctctgggattctggtacggtgggacgcttctcgggcatggagagtactccctcttccagttttacgtctgcttcagcgaggtgatcttcggcgcgcaggcggcgggaaccgtcttctcgcacgcaccagatttgggaaaggcgaagcacgccgccggggaattcaagcggctcttcagcggcgagaccatgcagtcgaagtgcagggctgcggcacgccacaaatcccagccagagatgcgcgggctgattgaattccgcgacgtctccttccggtacccgagccggatggaccaaccggtgctacgcagactgaatctaaccgtcaaacccggccagttcgtcgccctggtcggcgccagcggcagcgggaagagcacgatcatctccctgctggaaagattctacaaccctctgacggggggaatctacgtcgacggcagtaatattgctgcctgggacctcacctcgtaccgaagccacctggcgctggtcagccaggaaccggcgttattccaggggacgatccgcgagaatattctcctggggagtacccggccgtacacgtcggaagacgagctgatcaaggcgtgcaaggacgcaaatatctacgattttatcatttctctcccgtag

SEQ ID NO: 17535 - DNA, 408 bp, A.fumigatus
gccaccctctccccgcacaaaaaatccttttgtagttctgggtcgctaatgaggaacagacaaggcttcgaaacgattgtcggcacaaaagggggcatgctctccggcggccagaaacagcgcatcgccattgcgcgcgccctcatccgtgatccgcggatcttactgctagatgaggcaacctctgcgctagactcgaagtcggagaaggtggtccaggttgcgttagacgcggcggcccagggccggacgacgattcccgtggcgcatcggttaagtcccatccagcgggcagatgtgatctacgtgctggatcaggggccggtggtggagtcagggacgcatgaggccctgcttcgcaagcgagggcggtattttgagttggtcaatctgcaggatctggcctga

SEQ ID NO: 17536 - DNA, 600 bp, A.fumigatus
ttagcaactctccccagacagacgccccagacaaacgcccaaacaaagatgaacctgcgcctgttgacccttgccctcgccggcctcgctgccgccagccccgtggccatcgaggagagacaatgtacgtacatacgctccgtgtctgcatcgtggtcgtggtcgtggtcgtgtctaacagactttagtgtcctccgggaacgaactccgcaatggagcctgcaaacccatcaccttcatcttcgcgcgcgcatccacggagccagggctcatggtaaggaactccccgcaggctctcccaataacaacagaactaaacgtcaacaggggatatccaccggccccgcagtctgcaacagcctcaaagccgccaaacccggccaggtagcctgccaaggcgtcggacccgcctacacagccgatctggcgtccaatgctctccccgagaacacctcccaggcggcgatcaacgaagcaatggagctcttcaagcaagctgcgtccaaatgccccgacacgcagattgtcgcgggggggtacagccaaggcacggcggtgatggacgggtcgatcaagcggcttccggaggatgtcaaggga

SEQ ID NO: 17537 - DNA, 324 bp, A.fumigatus
ttatcccttccaatgagatttttaaaagaacttgcacttggtatgttgcaaacattcaacaaggccatcgcggctgtggtttcttctccgtttcaatccctaggaatgttagacttgtgttccgaacatgaccgccagttgctgcaaaagtataccgagagcgtatctgaatcatatgaagtgctgctgcacgctttagcgttgcagcatgcacacctaactccagatgcgccggccatccattcctgggatgataacctgacctatgcacagcgggatgatgcgacatcccgacttggacagtcctggccaggatgggcgtag

SEQ ID NO: 17538 - DNA, 855 bp, A.fumigatus
gcctgggcacctttgtcatcagctgttttgagaagtctacatgggccattgtcgccccgactggccatctggagagctggcgctgcatatatctctgtcgacgcgactgatccgccgatgtacctggagaatgtgattcgccgcgtgaatgcaagaatcatcctcacctccgaggcctatcgttccagatacgcttcttttgtcccgtccgtcattgccgtgacaccagacatggtacgtgctcttccggtcagcacggggatcatttgcccctgggtcaaacccagtgatgtctgtctcgtcctgttcacttcggggagcactggagagccaaaagggattattcaagagcatcgagcgtatgctacagccgtccgagattacaacaaattgctcggcttaggccgccacagccgcgtgctgcaatttgatgactacgcgttcgatattagcaataatgactatttgaccaccgtcgctgcgggtggatgctgctgtgttcacaccccgaccaagtcggtcccgactcttgtggagaacatcaacacccttcaagtcgacacgacctttctgaccccgactatcgccgctcaaatatccccgcaggatgtgccgacgttggagttgctctgccttggtggggagccggtgccaaacgagctcctgatcagattggtcgccgcatgtgagactggtgaatcagtatgggatgggggaggcggccaccttgtgcgcgtacaacgaccaactccaaccgggccagaatgcgatcgtcggacgggctgggagcggagccatttggatcacaagtccggaatccccagagttcctgatgccggtcggagctgtcggtga

SEQ ID NO: 17539 - DNA, 207 bp, A.fumigatus
gctcttgctgataagtgtagagggggaggacacttgcagcatttgtggaaccaacctaattcagtcgacgatatggaagatgctcgtcgcaagtatctccataataagatattcaaagccattgtacctcatttcgttgacagcaagtatgaccatggtccgttcaagttaattgcgacgatttccggcttggaaatatacttgtga

SEQ ID NO: 17540 - DNA, 408 bp, A.fumigatus
tcagattggtcgccgcatgtgagactggtgaatcagtatgggatgggggaggcggccaccttgtgcgcgtacaacgaccaactccaaccgggccagaatgcgatcgtcggacgggctgggagcggagccatttggatcacaagtccggaatccccagagttcctgatgccggtcggagctgtcggtgagattctcattgaaggcccgcacctggcccggggatatctggacagtgtctgccagaagccgggcgttggattcctaccgaatgcgcccacctggctcaaagatctccacccgtctcggaccggcccatcaaggttctatcagctccggagacctggggagatacacacatgccgggactgtggaacatcttgggccgcaaagacaccctcctcaagataa

SEQ ID NO: 17541 - DNA, 642 bp, A.fumigatus
gaactgatcgcaatgatcgacgtgtgcattccctgtttctctccagtgtattcgtatggtctgaccccggacttatatgttgaccgacgctcgcgacaggccacggaaggcatcaactaccgaaacctacgcttccctttccagaatgccggcgcacgcgcagccgggatcacccatggcgcagtgcacttcgccgctgcggcagagagcagcggagccgaccaagcagacttcttcatcgaacacggggggaactggaccgcggatggacagacgctgcctggggtgctggagatggagggcaatcttgcggggaagctgtgccatgggatgacgccgaccgaaatcaccgactggatgcttgatttctctcaccggtacaagttccggacgggtcgcacgccgatcctgttcctatcggccggttggtgggcaaagtgcgctgggaacaatgccacgtttggcgcggaacatgcattatggttggccaactgggcggaggaaatgggtccgctgccggtaggctggcaggctgcgaagttctggcaatatgccggttggagtgagaatggaggagaggcgaatgtgtttttgggtagttccaaggacttggtgaagttggcaatgggagctgatgaatga

SEQ ID NO: 17542 - DNA, 186 bp, A.fumigatus
ttccccttctgggacctgactgctgcagttatctgcttcgattcagctcttaacaagtcaaagatgggtgcaaccgacgtgccacaggcccaagccgtcactgtgagtctccaggagcttgtcaatggtgagttgatcaactgcaagaatagctgtcgtttccgcgcagtggaatcctggagctga

SEQ ID NO: 17543 - DNA, 936 bp, A.fumigatus
tacgcaatagaatccctcacaagccccgctgccaaatacctcgtcggctggtcctgcggcaaagaaaccctccggtccggccacttcgacaccctcaaaggctcctactacgtcaactgtgccttctaccagaaccccgacctccaaggcgcccccgcggacaacttccacgatttgtccgaatacacagcccccaatatctggccgccagcagaccgtcttccgactttccgccgcagcctcgaggagctctgcacactcatcatcgacaccgccgcgctcgtcgcccgcgcctgcgaccgctacgccctcgccaacatcgacggctacaaggaaggatacctcgagcacgtggtgaaaaccagcctgaccactaaggcccggctgctgcattacttcccgaccgaccctaccgcggctgctaacgccgaggcagaagatgatgatgactggtgcgcgacacacctcgaccacggttgtctcactggtctgacatccgccatgttcgtcgatgaggcggccaatcccccttcgttgaccgatgcctcgacgccgctggcggaactgccccaatcgccggaccccaaggcgggcctgtacatccagtcgcgcacaggccaggtcgtcaaagtgaatatccccaatgactgcctggctttccagactggggaggcgctgcagctcatcacgcggggcaagttccgtgctgtgccgcatttcgtgaagggggcgaggccgtcgggtagagcgaggatcgctcgcaatacgttggcggtgtttacgcagccgaatctggaagaggaggtggagcttgggaagaccttttgcggagttttgccagggaggtggtcagtaggacttattagcgtatataaatttcgtttttgccgcaggttacaagttttgaccggtggaaaagggtacataagggaatag

SEQ ID NO: 17544 - DNA, 1782 bp, A.fumigatus
cagtgtcttctagatggcctgcccgcaagaggtccagggagaccaaccgggtcgctcagtactcctggttccgctagaccttcaagaccgccaggcagaccacctggccgaccttctggaaggccgctcggtcggctcgggcggccgcccggtagaccaccgttgaaccctattgttgaccgggaagggacgccagacgttttcaagatggccatagtgaaactcaaggacaggggtgaaatagatgagcccatctcagaacctttaagtatggactggaagtccgaaagacctggcctgggggagtatctgcaaaaactaagaatgcaaccttcctatgttcctcgcgctggtgaaattgtcctctgggttcctaatttcgagggcgagttggcctggaacccagaacacgcacgcgtcgagatgtacgacccgaccgtcgatcggttcataggcgttcctgagtggcgagcaggcatcgtcggccaggtcccagaggaagacacggtgctgcaggatatagtcgagacggctaataaggaatgggaagtgaattattctggattccgtgttgaaacgttccccgatcccaacagcgcggacaagagctactcactgcagtacaagtacgttcacctgaaatgcatcaagccattcaatgggtacgagctctttttgcagaatatgccccgggacgaactgcacccttcaatcgagtacgccatgaccgtcatgtcatcattcagcctacttgaaaaattccattttcgaggaaggtggccgaatgcgtccatctactgtatgggcatattcattggggcggaactcctcattgtaggagatgccgtccgcttgaaaccggtgggctattcgctcagtagcggccaaaaagcagttacggacgtcatggtgatcgacgagatccggctcgatctgatccaatgcgttgatgacatcaaatcagaccagctcgcagagagatatcaggtgcgccttggaggcaaagtctacacgaacaaccgccagcgagcggtgatagacaactcgatgcaaccgcccaaacccctatctcccgaagaagttctcagcgtcttccagtacatcggcatgagcgggtacggggactggtatagtctcaacggtggtaagacggtagacatctcccaggggatggtcatcggccggtgctatgaacccgatgccatgcggctgctgttcggtagtctctcgctgggccgggatctgcacggcgtgctgagtggacgacaatactctcggcaagcggatgagcgtatcccggaaggcaaagactggttctggggcgacttccgaacgcagaccctggcggtcgagacgctgaacggcgaagacgtcggccattacagtgaaatccgcgatgtgaagatgtggcgggccaatctgaaggtcatcgagggcagagccactgcagctgatctcagagaggccaagattcccggcgagctcggacgaccgagccacaagtcacgatcggcgtttgcggaggtgcgcaagacgagcaagctggtgagcactggtctaggggcggttatcacggatgtgagcaacaattccagctcggcggacgagagcaatgcccagactcggatgaacactgaagacgaaggggaggaagaatcgcccgaggatgaggaggattttacgttgcgtttggaggacctacgaggagggactgaggagacagaaggtggagactacgtgcctgggaacgatgggcatacggcaaagcggccaaaaacatga

SEQ ID NO: 17545 - DNA, 258 bp, A.fumigatus
attatttccttgggcctatctataattccatcggcagtcatgtcagtttctcaacactcgcaaacctcagaagaggatgcagaaacaatcactattcctattgatcggtcgtttagtgatggcgatccgtctacttggcctacagagccccggttcgggatgccggatgatacatggtatcgggagaagctggccatcatgtggctgaaggagacgggggcttatgaagagggtacgttactgacttcgaacttttga

SEQ ID NO: 17546 - DNA, 1869 bp, A.fumigatus
caatatgagggaaaactctgtagcgacctacttgtacgacatgagcgcttagttcatcctgccgaggctgcggccaatcgagaacatcgaaaccacaataatcatgaggtgtcttcaactccgtcttctatgatacagacgacccatcatgagtcgcgaatgctcgagcttgcagatgcaataccagtccagccacaaccgattccgccgcctccgcctgaggtccatgtccaaccagcaccgataatagagacaacgcatttcaatccctcatggggatacgatctgaatctcttgtctcatgctgctagccatgtagctcttgaaggccaacaggaagctcttgagtcgatgcgaaagccttcgcataccgtcggccctcctcagccaatccctcatgtcaccgacaggcctatcaccgaaaactatgggcttgaaccgtcaatgcttgatctcactgacttaggtgatccggtccaagacttcactgtctttttagaaagcgttggtctctcatccgactgggactcgggagtgttttccactgtcgaggaacccatgctgccaactactctctcaattgactctaagccacctcttcgtgaaacgtccagactcgggacagaaattatgaatgacccgcgctcggctgacgatcctccatcattctcaaactttggatcgcgtttgccttcgctgcaacccgagtcccacgaagtggacgatcgactcggtttcggcgacgacggcccacgtccagcatgggatatctcaaacgctgatcgccaggtcttcgtttccaaacttgaggagtttgcttatattcttccgaagggcttcgtgcctccatcaagacacgctctgtctcgtttctttgctggctatatcaacggactgaatgagcatcttccctttattcatgtcccaacgctttctgttgcaaatgcttttcccgagctgacgctcgcactagcggcagcaggatcgcattatcgctttgaaaacaatcgaggaatcgacttgtttcacgcagcaaagacaatactgctggaacgcctccgaagaagggacagtaagcaagtgccatgcccgacatggaatttttattctcccagttcgggattccacaactcgcgtggctcgtcggccatgtcaaatcatgctagtagccctttccagcaacaacagcagtctatgccgcaccctgtcgatccttcaatttatgtatcagatgattcggatgctcacatggaagtgattcgcacgttcttgcttctcaccgtttttgcgtcttgggagagacacccggaactcctccgggaaattttatcgttacaaagtacgttggcaaggcttgttcgagagcatggcctctccgaaccagcgaccagtcctgacccaaataattgggaggagtggatacggcgagagggcaacaggcgcacaaagctcatcgtctactgctttttcaatctacactctatcatgtacaacattcccccgctgatcctgaacgcggagttgaaattgaacatgccatgctctcatgacgtctggaaagcgagcaatgcgactcagtggagacggctcagtcgcacctggccaggggtggatgttcccttccaggaggcattcgcaaaactgttcctaaagtcgagcatctcgaactcttcggcaccaatttcgccactcggaaactatatccttatacacgctattatccagcagatattttttgcgcgccaactttgtctatctgcacccactatgcaaggtacaagtctcagaccagatgacttgactgttttagacaactctctgagcgcctggaaggcattatggaaacgcactccgggaatccagcattga

SEQ ID NO: 17547 - DNA, 501 bp, A.fumigatus
ttactcaagaccccagttcagattgctagggccttaagcgagtccccgcccatagcaagaagcccgcgtctcattatggccttattgcattctgcccatgcactgtccattcctgtacgtctcggaatcgactttgtggcgagaacccattcgtttttctggagtattcagcattccctttgcagtttggaatgcgcttttctcctgagccgatggcttctctcaatcccagctacgcactcggagcagaggttgtcagaccatgaaaggaaactacttctgtggatcaagagcatgatggacgagactgacatggccgttgacccaccaggggcgcctgatatggaatttatggccaacccttacaaggccaaacaactaagcgtcgctatcgtccgggtctgggcaagaaccttcaaaggaaacacgagttgggcgatagttgatttggttgggtcgagcttggatgcttatgcagatgtcttagaaaatcagctttga

SEQ ID NO: 17548 - DNA, 465 bp, A.fumigatus
ccttctacatcaatcgcatcctcaatgccacgtccgtctttggtcggattaacccccggcctggtggccgaccggctgggctccctcaaaaccctcatccccatgggcctgatcgcggcgatcctcgcgtacgcctggatggggatcaagaacattgcggggacgatcgtgtttgcgtgtctgtatggatttgcctctggcgcaatcgtctcgttgccgccaacggtcgtggcccggttgagtccgaatatgagtattgtgggcacgcggatgggtatgtgctttacgtttgccgggttggggctgttgattggcaatccgattgctggggcgctgttggatctggagaggggggtgttttggaaggccgagctgttcagtgcggttatggttaccgccggagctgtgtcgtttatctggttgaggctgttgaagtggagggatggagagaaggggaagtattaa

SEQ ID NO: 17549 - DNA, 1302 bp, A.fumigatus
  unsure (142): Identity of nucleotide sequences at the above locations are unknown.
gcaggctattctcgtctcgctacagttgactattccaaaatattctacgaggtcctcataccctatgcttcaacgatgatggctctaggaggaattgtgcgtcagactgcctataaatggcgcccgtatacaacactggacnactgcaagcaccatcagcgacttccgttctcacaaccaatcaatttaagtcagagctcgcttatttatttccattacatcatggctgaatctctcatctttgcgtacggatcaacggaacctgtcaaagacatccgtcttcattcaacccctgcacctgcggactgcggtcctcacgaagtggtggttgacttccttgcggcacccatcaatcctctcgactttctggtgttgcacggaaaataccccgtcaaaccgcagaaccacatcaccgtcgcggacggtgagcatcgacccattccgggctcagacggcgcggcccgtattgtccgcacgggatccgcggtgacccagttccacgtcgggaactccgtcatcctgcggacccactgccgaggctcatggcgcacgcacgccgtgcttgctgaaaacgacgtgctgcgcgttccatcagaactggatcctcgcctcgcgtgcatcctgcgcatgggtgtggcaccggcctacttcctgctgcgggattattcgactctcgagcccggcgactggatcatccagaacgcggcgacaggcacggtcagtcatttcgtgactcaattggcgcgcctgcagggtgtcaatgtcatcagcgtgattcgcgaccgtggcactgatgacgagctcgagcgcaccaaacggtcgctgcgctcgcacggcgcagcgattgtcctaactgttgacgagctcaagaccgtcggcgcggaggtactccagggcaagcgcgtcaacctcgccatcgactttgtttccgatgacgcactggcgcgactgatggcgtcgtttttggttcctggagccacactcgtcacggctggcttcctggggatagcgccatctagccccgaagccaacctgcgtcagttcctgtggcagcgtaacatcactctcaaggcttttcgactcagcgattgtcttggccgacgatcggcattccatcagacggcgctcctggaatggtttgcgcgcttattcttggaagggacgctaaagaccccggcgctggagtatgtccggtggaaacgaggcgatccgggcctggaaggcaagttgcaggaggtgcttgagcgccacgagaggggtgaagtgggcgagcgcaagaaaattttggtgtttgagcactag

SEQ ID NO: 17550 - DNA, 402 bp, A.fumigatus
ccaatctctaggggggtggtcaacacctttggcgtgtaccagacctactatgaaaccgatctcttgcatggtcactccccctcgtccatctcctggattggcacggtccagggctttctccttttcctggttggagtcattgccggtccagttttcgacaaggggtacctcaagaccatgatcgcggcgggctcattcctggtcgttttcggtctgatgatgacttccctgtcggaccagtactaccaagtctttctggctcatggagtcgttgttggcattggctgtgcgtttttgttcctaccgagcattgccatcgtggctacctactttaccacacggcgggccgtggcgacgggcatcaccgcttctggaggaagcattggtatgtctcgtcgttag

SEQ ID NO: 17551 - DNA, 825 bp, A.fumigatus
gtcactaaatccactgcaagcatactaaccaggccaggctccgtgatataccccatcatcttccgcaagctcatcgactccgtcggcttcggctggaccacccgtatcatcggcttcatcgccctaggcggactgtgcgtctccctcgccgtgatgcgcatgcgccttccaccacccaagcaagccagatcgctccttgacctgtccgccttcaaagaagcctcctttcttatcttcagtttcggtctgttctgcgccttcgtcggcctctacttcccgttcttctacctgcccacctacaagtccaacatcgtccactcaaccgacgacctagccttctacatcaatcgcatcctcaatgccacgtccgtctttggtcggattaacccccggcctggtggccgaccggctgggctccctcaaaaccctcatccccatgggcctgatcgcggcgatcctcgcgtacgcctggatggggatcaagaacattgcggggacgatcgtgtttgcgtgtctgtatggatttgcctctggcgcaatcgtctcgttgccgccaacggtcgtggcccggttgagtccgaatatgagtattgtgggcacgcggatgggtatgtgctttacgtttgccgggttggggctgttgattggcaatccgattgctggggcgctgttggatctggagaggggggtgttttggaaggccgagctgttcagtgcggttatggttaccgccggagctgtgtcgtttatctggttgaggctgttgaagtggagggatggagagaaggggaagtattaatctgttcagcatggtcgagtgagtga

SEQ ID NO: 17552 - DNA, 1185 bp, A.fumigatus
aaaacaaggccacgtgtgtgtacatcaattggccgaatatacatcatactaatcagtctatcagtggggagagtgaccctaaggacgctactggacgatggtctcatcctggagagagtgagctgtcctattggtgtcttgctgattatatttgaggcccgtcccgaggtgatcgccaatatcgcggcactgtccataaaatcaggaaacgctgccattctgaaaggtactttttgcatgatcgatagtgaaatccacactactgacatgagtgaaggaggaaaggagtcgactgagtccttcatcgccatatcaaaagtgatatctgaagcgatctcgggaacacgcgtacccgtggcatcagtccagctcgttaaaacccgagacgttgtttcgtcacttctagcgcaggattccttgattgacctggtcataccccgtggttccaacgaccttgtccgatttgtcaaggagaacaccaagattccggttctcggccacgctgatggtctttgttctgcatacctccatgctgatgcagacccagcaattgctgtcaaagtcatcgttgatgctaaaacagattatccagctgcttgcaattcgttggagtctttgttggtccatgaagatgcccttggaaccatattccccgctgtcgctgaggcccttctggccaagggagtccgtcttcgttgcgacatccaatcgaaatctgctcttttgaaaaacatatcctccccacccgcagatttactagaagatgcagtcgactcggatttcgacactgagtttttggatcttgtcctagctgtcaagaccattccttcaacatcgtcaccaatttcagctgtcgaggatgcgatttctcatatcaactcacattcgtcgaaacacacagacctaatcgtgacagagtcgaaagagattgccgaatacttcatgaggggtgtggatagcgctggggtcttctggaacgcatcgactagattcgcagatggaatgaggtttggatttggcactgaggttggcatcagtacgaataaaatccatacgcgaggacctgtgggtttagatggattgacaatctacaagtatctgctgaggggtcagggacacagggcaggtgattattttgaaggagagggaggtaaaaagtggaaacatgagcatctagttatatag

SEQ ID NO: 17553 - DNA, 270 bp, A.fumigatus
agtccggttttgcagggtcttacccgttcccaatttgatggcaaggaagtaatatcattcatccaagaaactaacaaatacagagataacagtccgaaaagtagcaaggaagatctcattccttgcgacgctgttgatatcatggcatcctttatccatccccggggttacaccctgaggcagacattgggattctccggtcaatcttggacatccttcaggtattcctctgtgcctattaatgcttgcagtgaacattatctttcttga

SEQ ID NO: 17554 - DNA, 195 bp, A.fumigatus
atccacccaattgcgtgtcgttttatgtcaagttgtgtgaaaaacaaggccacgtgtgtgtacatcaattggccgaatatacatcatactaatcagtctatcagtggggagagtgaccctaaggacgctactggacgatggtctcatcctggagagagtgagctgtcctattggtgtcttgctgattatatttga

SEQ ID NO: 17555 - DNA, 219 bp, A.fumigatus
agacgaacgcgactctctattcagtcagcatctttcgctgctctcggtcatggaggtaccgccaaaaaactgcctggaatgtttacaactatggttttgatttataagaatgagggtggttttgttgccctctatcgcggtattgtccccacagtcgctggcgttgctccatatgtaagtgaaatccgaatgatgataaacaggtgcttacgagtttag

SEQ ID NO: 17556 - DNA, 237 bp, A.fumigatus
taccgtcatagtgatgtcttgcgacgtcgtttccagataaacacgatgtcgggaatgggctatcagtataaatcaatttgggacgctgtgagggttatcatcgcggaggaaggcctgcgggggtttttcagaggaatagtgcctaaccttctgaaagttgctccgagtatggctagcagttggctcagctttgagttgacaagggacttccttgttggatttagcgatgagaaataa

SEQ ID NO: 17557 - DNA, 420 bp, A.fumigatus
tttgagttctctgttctgttaggccgcacggagtccaacttcaacaaagttgtgctgcgccgcctttttatgtcgagaatcaaccgccctcccgtctccctttcgcgactcgtttccaatgttaccgatgctcccaagggcaagaccatcgttgtgatcggaactattactgatgacaatcgccttctcactgttcccaaactctctgttgccgcgttgcggttcaccgctactgcgagagccagaattgagaaggctgggggtgagactctgactttggatcagctcgcacttcgggcacctactggagcgaacactctcctcctccgtggccctaagaacgctcgtgaagctgtcaagcacttcggatttggaccccacagccacaaggtgagacaatacctcactatcttgtgttaa

SEQ ID NO: 17558 - DNA, 597 bp, A.fumigatus
tctgttttagcatcaacgatgactttgacagcaattgctgggtctgcatcagcatggaggtatgcagaacaaagaccatcagcgtggccgagaaccggaatcttggtgttctccttgacaaatcggacaaggtcgttggaaccacggggtatgaccaggtcaatcaaggaatcctgcgctagaagtgacgaaacaacgtctcgggttttaacgagctggactgatgccacgggtacgcgtgttcccgagatcgcttcagatatcacttttgatatggcgatgaaggactcagtcgactcctttcctccttcactcatgtcagtagtgtggatttcactatcgatcatgcaaaaagtacctttcagaatggcagcgtttcctgattttatggacagtgccgcgatattggcgatcacctcgggacgggcctcaaatataatcagcaagacaccaataggacagctcactctctccaggatgagaccatcgtccagtagcgtccttagggtcactctccccactgatagactgattagtatgatgtatattcggccaattgatgtacacacacgtggccttgtttttcacacaacttga

SEQ ID NO: 17559 - DNA, 681 bp, A.fumigatus
cattgcactttccctaagactcagcctgccactcccttattctattctctgccgctgatggttcagccgtacacatatggttatctcaacgacgaagttattctcctcttgcatactctcggcgtttccgctgaggtattcctcagaaaacaaaaggaacacttccagcgtttacaggagtctgttacagaacccactgttgcattcacgtttctatgctccctgaaccggtttgaccttgccgagaagctagttctgcacggtattgagcgggtgtctggcgccttacgcagtctggttgcagatgaacataaaaagatgcttaataagcgcgaggaccaaaaatgccgaattcttgtcccggaatcccgcctagtcttcggcgtctgtgacccccgaggtgttctacaggaaggagagtgcttcttacgtgtgacagatgacatgaacgggggacgtcctcgaacgatcgttggatgcgaggttgttgtgactcgaaatccttgtcttcatccgggggatttgcggaagctcaaggctgttgaccggccagaactatcccatttgagggactgcattgtcttcgccgtcaagggagaaaggccagccgcagatcaaatgtcgggcggagacctggatggtgatacttgtaaatcaccgcctacaccttgccaacggtag

SEQ ID NO: 17560 - DNA, 249 bp, A.fumigatus
aatagagcggccccttccagccccgcggtgaagacagtcatcatgtcgagcatctccagaaccgcaaaccttcttctgcgctccagcaaggcttctttgctgcgtcctcgcgccctcaaccctgtccaacatgtgtttggcaacaacaaactagctgctcgtgggctggctactaccttcgagcgtactaagcctcatgttaacattggtaaataccattttcatttgcagactggcctcttccactga

SEQ ID NO: 17561 - DNA, 267 bp, A.fumigatus
accaccttgaccgccgctatcaccaaacatcagtcggagaagggccttgccaacttccttgaatacggtgccattgacaaggctcctgaggagcgcaagcgaggtatcaccatctccactgctcacatcgagttctcgacggactcccgacactacgcccacgtcgactgccccggtcacgccgattacatcaagaacatgattactggtgctgctaacatggacggcgctattgtcgttgttgctgcctccgacggtcagatgtag

SEQ ID NO: 17562 - DNA, 489 bp, A.fumigatus
cagtccgcatctcacagccccaatatatccaagtatctgagcctcgaaaatgtcactcatgctggtttcaactatcatctcatttccgtctttggctcgcagtcaactggcaagtctacgttgctgaaccatctcttcggcacgcacttctcggtcatgtccgattcggagagacgccagacaaccaagggtatatggatgtcgaagaacaagagagaaggagaggccacagtggacccaaccctgcgcatggcggataacatcctcgtcatggatgttgaaggtacggatggtcgtgagagaggagaagaccaggactttgagcgcaaaagtgctctgttcgcccttgctacgagtgaggtgcttattgtgaatatatgggaacaccaggtcggtctgtatcagggcgcaaatatgggtctgttgaagacagtctttgaggtcaatctgcaactgttcctgaaggacaagaagtatgtgttttactaa

SEQ ID NO: 17563 - DNA, 315 bp, A.fumigatus
caggttgacaaatctttagtgcttcgtaatcctgcctatttcttccttctgtttatctgtgccgtgggggcctatgtcacttatcagctaaacctctgggggccgataatcaagatgactgaagccgcttccagccaggcgctggtggagggcaagaagcgactgcgcgagtttcttgagtcttcggataccgggcggcaggccattgccatgtcggctgggtcgggacgctctggcgagcaatacgagctgtccgatctaagtaagaagggcaaggcaagaacgtcggccgatgaagacatggatgacctttga

SEQ ID NO: 17564 - DNA, 960 bp, A.fumigatus
aaacacgtcgcttacgttttcgcgaataggccccagactcgtgagcatttgctgctcgcccgccaggttggtgtccagaagatcgttgtcttcgtcaacaaaatcgatgctattgatgatccggagatgctggaactggtcgaactcgagatgcgtgagctgctgaacagctacggtttcgagggtgaagagactccgatcattttcggttccgctctctgtgctctcgaaggacgccgtgacgacatcggtaaagacagaattgagcagcttatgaacgctgtcgacacctggatccccactcctcagcgtgacctcgacaaacctttcttgatgtctgtcgaggaagtgttctctatcgccggccgtggtaccgtggcttctggtcgtgtcgagcgtggtatcttgaagaaggactctgaggttgagattgttggaggctccttcgaacccaagaagaccaaagtcaccgacattgaaaccttcaagaagagctgtgatgaatcgcgtgctggtgacaactctggtctcctcctgcgtggtatccgacgtgaagacgtcaagcgtggtatggtcattgctgttcccggcagcaccaaggctcacgacaagttcctcgtctccatgtacgtcctgaccgaggcggagggtggtcgtcgtactggcttcggtgccaactaccgtccccaagtcttcatccgtactgcaggtaagttcccgcacaccgtgtccagatcttccgagagattagcgatatatgctaatgattcatcagacgaggctgctgacctcagcttccctgacggcgaccaatctcgcagagttatgcctggtgacaacgtcgagatgatcctgaagacccaccaccctgttgctgctgaggctggtcaacgcttcaacattcgtgagggtggccggactgtcgctactggtctgatcacacgagtcatgaccgagtaa

SEQ ID NO: 17565 - DNA, 1818 bp, A.fumigatus
tgcagcaccacacaccgatcacttctcttctttgtgatccgtgactttgtcggtacaacacccctcaaaaatctgcagaagacattgatggaggacatggctcgtctctgggagtctatttcgaagccccctggccttgaaagctccagtgttcatgattatttcgatttccaattctatggactgcctcacaaaagctaccaacccgaacaatttgtggctgagacaaagaagcttagcttgcgattccgcgaaggccaaagagaccctagtatggatgcacgcagaggcgagttctctgagggaggagtcttcctcccggaatatcatcggcggatccccgcagatgggttttcgcgatatgcagagggtatttgggaccagatcgtgaataacaaggatctcgacctgcctacgcagcaggagctacttgcacaattccgctgcgatgagatcttgagagaagtgatgatagcttttgatgaagccattgtcccatttgaggagaagcagtcacagtctgcgcgtcttggtgagccggaggtacttggcggtttgggtgctgcgatgagatcatcacgggccaaagctgtcaagaacttcgagacagaagccagcaggtatcataaaggtgtctaccagcgcaagcgagcagagcttgaaagcaaagtcgatacccgtctgaaagctctgctacaaggacaacttaatgccgcgcacaagtcgggcattaacgagttcagtgaggcagtttcctcctcggtgaagtcaggccagaagcagggtgcaggttacgactttgctgaaattgtcaatgaagaagtgaagaaagccatagccaagtttgaagatgtggcgcgctcaactgtggtggaaggcacaacttggagtgactataagcaagaattggccttgtatgaaaaggaactagcggacgttagcggaagattacgccgagaagagatgcgccgtttggccaatcgcgtcgaaagatgggttcagtcccgtctgggagagtcggtcgggcttgagttcaacgctttgggatctggacgcgcaggaggaggtgctccggagacaggggagaagcctctggagaaggctttctgggatcgtgtgtggaacgttttcgtggagacggtgctcgatgccgagcgtaggttcacagaccgcgccagcagcttcgatgccagtttggaggaagtggatgtcggtctctggaggctccgaaggaagtcttggggtgtcttgcgagccaagatcgatgaagagatgaccgagggcaatcttttgctgaaactgcgtgagaactttgaggacaaattccgttacgatgatgctggggtacccaggatctggcgaccgaccgatgatattgaaggcatctatacccgcgcgcgcgaatcaacactgactttgatccccctcctttcgcgcttccgtctggctgagacgtcggccccgccccctcttgatcgctggataggccacactccaagctctgccactccagcagatgaggaagatttaccgcccatcggcggtgttgatgaggaagagggcaagagtctggatgaagagatgatgattaatcacgcgaggctaagcgtcaagaagctcactgttagattcaagaaagctgcggatggagtttatgttgaagctaagcgaagtgctattggcggcatgactcaggtgcctctgtacttttacggtcttctccttgctctgggttggaacgagatcattgcaggtaagtattccatgatgaaattttcaaacgaaatcagttgggctgacaggttgacaaatctttag

SEQ ID NO: 17566 - DNA, 813 bp, A.fumigatus
tctctcggaagatctggacacggtgtgcgggaacttacctgcagtacggatgaagacttggggacggtagttggcaccgaagccagtacgacgaccaccctccgcctcggtcaggacgtacatggagacgaggaacttgtcgtgagccttggtgctgccgggaacagcaatgaccataccacgcttgacgtcttcacgtcggataccacgcaggaggagaccagagttgtcaccagcacgcgattcatcacagctcttcttgaaggtttcaatgtcggtgactttggtcttcttgggttcgaaggagcctccaacaatctcaacctcagagtccttcttcaagataccacgctcgacacgaccagaagccacggtaccacggccggcgatagagaacacttcctcgacagacatcaagaaaggtttgtcgaggtcacgctgaggagtggggatccaggtgtcgacagcgttcataagctgctcaattctgtctttaccgatgtcgtcacggcgtccttcgagagcacagagagcggaaccgaaaatgatcggagtctcttcaccctcgaaaccgtagctgttcagcagctcacgcatctcgagttcgaccagttccagcatctccggatcatcaatagcatcgattttgttgacgaagacaacgatcttctggacaccaacctggcgggcgagcagcaaatgctcacgagtctggggcctattcgcgaaaacgtaagcgacgtgtttttacgacgtatttcccaagatgttccacctacatctgaccgtcggaggcagcaacaacgacaatag

SEQ ID NO: 17567 - DNA, 582 bp, A.fumigatus
ccctaccacaggtgcaatgcctcgtccgaccagcagctggagcggatgaatgtctatttcaacgatgtcggcaactcgaaatacgtccctcgagcggtcctcgtcgacttggaaccgggaaccatggacgcgattcgctccggcccccacggagcccttttccgacctgataattttgtgttcgggcagtccagcgccggcaacaattgggcaaagggtcattacacggaaggcgccgagctggtggatcaggtcattgacgttgttcgccgtgaggcggagagctgtgactatctgcaaggattccagatcacccattctctgggcggcggaacgggcgcgggcatgggcacgcttctcatctccaagatccgggaggagttccccgatcggatgatggccacattctcggtcctgccatcccccaaggtctcggataccgtggtggagccgtacaatgcgacgctgtcggtccaccagttggtcgagcacgcagatgagaccttttgcatcgacaacgaggtatccgtcctgatccttccaagtcgaaatgacaagctaaccagcccaggcgctctatga

SEQ ID NO: 17568 - DNA, 348 bp, A.fumigatus
ccagcccaggcgctctatgatatctgtacgcggacgctgaagctgtcgtccccgtcgtacggcgatctcaaccatctcgtttcgacggtcatgttcggcatcacagccagctttcggttccccggacagctgaattccgacctgcggaagctggcggttaatatggttccctttcgccggctgcatttcttcatggtgggcttcgcgccattgaccagtagaggagcccagtccttccgcgcaatgagtgtcccggaactcacgcagcagatgtttgattccaggaatatgatgacggcgtgcaactttcaaaacggccgctttctgacctgctcggctcttttgtaa

SEQ ID NO: 17569 - DNA, 489 bp, A.fumigatus
cctgctcggctcttttgtaagttttttttttttttttttttttttttggttccttttctccgcggcgtcccagaaaaactgatcagtttcagccgcggcaagatctccatgaaagaagtcgatgatcaaatgctcagtatccataccaagaactccggctactttgtggagtggatcccaaataatgttcagaccgccctctgctcggtgcctcccaagggcctgaaaatgtcggccacttttgtaggcaattccacatccgtccaggagctcttccagcgcgtggcgacccagttcacggccatgttccgccgcaaagccttcttgcactggtataccggcgagggaatggacgagatggaattcaccgaggcggaaagtaacatgaatgatttgatgtccgaatatcaacaataccaggaggccagtatctccgacggagaggagcaaccgtatgccgaggaggcggcatatgaggccgaggaataa

SEQ ID NO: 17570 - DNA, 1914 bp, A.fumigatus
  unsure (1164): Identity of nucleotide sequences at the above locations are unknown.
aaaccaaacgcaagaccaggggcagagcatgtcttttttggccgggcggtaggcatcaacctcgacgcggaccgagaagcaatcatctcctgtttccgctgcacacagggagcagacgggggttggagtaccgctcccgaccaggcgggggatatctcggtgaccgtagaggcgtatctggctttgaagatcctgggactctcggaggatgacgcggcaatgcgccgtgcacgagactttgcaattgccgctggtggtgttgctaaggtccgcatctttacccgcatatacctcgccctgttcggcttatttccttgggctgctgtaccggaattaccgcctgagttgattctgctgccttcaagggtaccagtcagtatctatcactggtcagcttgggcgcgggctactgtagtgccccttctgatcatctcccaccatcgcccgatctatgctcttccaggtggcggcaagagaacctctagcgattacttggacgagctgtggtgcgacccgcaaaataaaatgataccatacaatcacgacgaaccgacggcctggagatccgacccgtttgcgtcgatcttcaccttggctgactcgatcctgcaccgcttggacggtttgcgatccttcaatccctttcgccgctttgctcttcagaagtgcgtcgactggattctggagcaccaggaggacatgggagacatcggagacattatgccgccgctgcacggagctatgcttgccctgagactggaaggctatccgctgcattcaggccctatccaccgcgggcttgaggccattgaacgcttcgcataccgtgacaaacagggaaaacgaatccaaacaactgtgtccgcgttctgggacaccagcttaatgctgattgccctcggcgacgcaggcatggcctctaagccctggctcacaaggtcgttgggctggctacagcaacatcagagattaggcaactacggggactggaaggtaaacaaccatggactcaaggcgggtgggttcagcttcgggtatttcaacacctggtaccctgatgtggacgacacagcatccgcagttctggcaatgattcggcaagacgagcggctggttcactccgcctccgttttggatgcgctgaattggcttctgggaatgcanaatacggacgggggctggggtgcctttgaccgggataatgataagcattttctgaacaagattccgttcagtgacatggacgcattgtgcgatccctccactccggatgtgaccggccacgtcctggaggcttttggcctttttcttgcactcagtaaagcagatgcccttgctgatcgcgttgtgtcagcttctcgaagagcgatacgctatttgtcagacacacatgtattatctcggggctggtactggcgatggggctgcaactacatttacggaacaagtgcggtcctctgcgcattggcgtactttggctcggagaacgacgcgttgtcaggagtcagggttatgaaggatgcaatcaatcaagcaatacgatggctggagactgttcagaaccccgacggtggctggggagagaccgtcgattcttataaagatccttcgcgagctgggtctggtccatcaacggcatcccagactgcctgggcgatcatggcacttctgccatacttgccaccgtccacagaggtgattcaacggggaatggagtatcttttgcggacgcagacgaagactgcttctcagggagctacatggcacgagaaagcatataccgccactggattcccgaagtatttctacatgggatattcactctacgcccattactttcccatgatggccctcggccggtatgcttatccatgtcccgcgtggcacgagaattggcggctgaagagagactga

SEQ ID NO: 17571 - DNA, 657 bp, A.fumigatus
tcatcgacttctttcatggagatcttgccgcggctgaaactgatcagtttttctgggacgccgcggagaaaaggaaccaaaaaaaaaaaaaaaaaaaaaaaaaacttacaaaagagccgagcaggtcagaaagcggccgttttgaaagttgcacgccgtcatcatattcctggaatcaaacatctgctgcgtgagttccgggacactcattgcgcggaaggactgggctcctctactggtcaatggcgcgaagcccaccatgaagaaatgcagccggcgaaagggaaccatattaaccgccagcttccgcaggtcggaattcagctgtccggggaaccgaaagctggctgtgatgccgaacatgaccgtcgaaacgagatggttgagatcgccgtacgacggggacgacagcttcagcgtccgcgtacagatatcatagagcgcctgggctggttagcttgtcatttcgacttggaaggatcaggacggatacctcgttgtcgatgcaaaaggtctcatctgcgtgctcgaccaactggtggaccgacagcgtcgcattgtacggctccaccacggtatccgagaccttgggggatggcaggaccgagaatgtggccatcatccgatcggggaactcctcccggatcttggagatga

SEQ ID NO: 17572 - DNA, 900 bp, A.fumigatus
agacccttccgtactccagagacgaaaactccgacagctgcttcgctgaggactgtacctgctgtacaacaaacgccgaggcctgcgactccggtaagtacagcaccgttccgtgaccatccacgcttcaaggtgtttcagccagcattgagcagtcagtcacaattcaccccaagaccgacggcaggatctgcgtcgcaattaccgacccctggccctcaaagacagaagccagtctttgtccttcctcgctctccgtctccatcacgaatggatgatgaatcaatgattccaacaccattctccccttcctctcatgctcttcgtcggcgaggccgtccccgatccagcactgcagactacttacccggcggcatggcctcggacgtccgcagctggatcctggaaatggggaccaaaagcgaacagatgcagaagagcctagatgctcattctagcacgcaccacgcccaaggtccccctgatctaagccagtattaccttgttcttcgcatcctggacgttcggcagtctgcactgggcagctctggtccagtagcgtatatacacggcgtagaagtgactctccccgatgagtcagaaagtgcgacctcgcagtcaaggagagttctccttcttggaccgcctaggccagctagcttgcagtcctcccgtgcaagagctcaagttcctgagcttcgcactggtcatctggtcggagtgtttcggaatctggtctgggaggttggcttggaccagacgcatttagatggcaatgtgccgagtgaagacacgcagaagaaagaagagccggcgagcagccttgggcgcaatacaagtactgagcatctggagaaatggctcgtcggggtggaatgggaactgatcgaccagggttga

SEQ ID NO: 17573 - DNA, 414 bp, A.fumigatus
accgcagctgatccattccagttcttctcttccctctccgacctcctctccaaaacatcccaaaaagcccgcggctcagtcttcctcacccaaaagcccctcctcccaaacaacgccaacacgagcacatcagagaatgcctcttcgtcatcatctattcctcccattcttatcagagcaacagacggaaacacaaacgcaccgaatcccaagacagccaaagaccagagccagaaggccgcaaggacatccaaggtcaagctttcgactgtagtcgcgcaggaggatctcgagacgttctttgcgcggtatgctgaagtttgcaaggcgagcatgacggggctgaagaagcgggatcggaaaaagggaaaggcgaaagccaagggtggtgcttcgaaggttaccaaggcttga

SEQ ID NO: 17574 - DNA, 486 bp, A.fumigatus
cgtctcagtctcgtgagtgactcggattcagatgaagaagttgctcgtagtgacggaggaatatatttgccgggcttgttctcggaagacggagcgacaggtgcaacatatggattttctctttttttcggggcaggcttctcttcctcctcatcttcgtcttcgtcttcatccatatcgtcaaagccatcaccgtcaaaatctccaagctcctcgtcacttgccagatcgctgtcgtcctcctccgaaacggcctctggcgcaagaccttgcgccttccttctcttgttcttcagccattcgtcggcctctcgtttgcgctttcgaatttcgtcttcggacccatcacccaagtcccctagcaagtcaagcagtccgtcctcttcgaacgactttggtagctttttccccttcttcaatcccagctttttctctaacgccgcaatttcagcagcatcttcgtcaagcttgtctttcacgggctga

SEQ ID NO: 17575 - DNA, 456 bp, A.fumigatus
gtgccgcctccgctccgcaacttttttttccgacggcataaaaattaccagcggacatatgtgttgcgcagcctaacaataataatcaatatatttgtcgcggagatgagacgacccagaccaaaacacaatactacgtctttaccccgggcgcttcgcgccgaactggggatcaaagatcactacggcgaaaagaagcataaacggaacggacctggatcgcgaaaagaccgacgtcaagcggaacggacggagaagaaacggggacctcctccaagatcgaaagctcgacaatatgatggcgaggacgatgatgatgacgatcttgcagaatttggaaacgagtcagattttgattcagattcagacgaagatgtaccggcgtcaaaatcaaagtctgcgaaatccgaacccgaagccccattcgatactcaagaagaatcggaggggagttga

SEQ ID NO: 17576 - DNA, 1398 bp, A.fumigatus
tctctctactctcgcaactttataactttcacgtcgtcggaagcaccttggtgttcgactacatccggctgttcctgcaagagatcaacgaggagagcacagaattactgctcaaaatcatccgaagtacgttgtcaaccctcttttttgcctaagagtgcgttactgacagaattagactctgggccccagctccgacaagatgacccgtcttccttgaaagacattgttctcctgatccaacctgccgtagcaaaggtcggcgaagaatcgctgtcagtccggacaaaatttatgatcgacactatcaccgatctcaagaacaaccgtctaaaagcggcccccggctcaagtgtgacctcggaacatataaccaagatgcgaaagatcctaggctctctgaacaactcccgagtcctccgcgcctcggagcccatcagtatttcacgagaggacattcacaatgcctcccagaagggcaagtggtggcttgtcggtgcaagctggaaggaagatccccttgtgtccgctcgtcaggagctagccagcctaccgcaggacaacaaagctgctgcgcaggaagaagacagcgaggtggagcccgacctagccagcattgccaaggcacaccgcatgaacaccgatattcgccgctccatctttgtcgctatcatgtccgcaacagactaccaggatgcccacgtccgactaatgaaacttcgactgaaacgcgcacaggaatttgaaattccccgcgtcctcactcactgcgccatggaagaggaggcttataacccctactacacgctgattgcacggcggctctgcggcgaaatgggccgccgcatgaaggtctccttcatgtacaccctgtggaacaacttcaagcgaatgggtgaatcagacgacatggacgacgacgaggaggaggatgccgggttccgcgacgacaacgacgagcgcaaccagctctcgatgaaatctgccgtcaacctcgccaagatgtacgccagcctcattgccgacggcgcactgacactgagcgtgctgaaaacgctcaatttcgcctaccttcagcccaagacgaaggccttccttgagattctcatcatcacaatcatccagcaatctcagaaatcgaaaaaggggaagaaaaatggcaagaaggctggccaggaggaggaagccgagaggaatgaaaagccgctgatggagatcttcctgcgcgcgcgggacacgccgcagatcgtcaaggggctgatatacttcatacgaaaggtcgtcgcgaaaacagatattgtagagtccgagagggagcagaagttggttcggtggggctgcagggtcgctgtggatgccttgaaggttgtggcgaatgaagatgttagtcttggatga

SEQ ID NO: 17577 - DNA, 189 bp, A.fumigatus
tttttccttgctgtttcctgtctgttcccgggcgattgtaggactcttgggtggatcaagtctcgcattggatatgtactgcctaatgaagcctgtacctttagcgtgtatcatcatttgtcaatatacccgtttcaattgaattgcgcagatgaagcattgatcctggacaaggcagactgcgtttaa

SEQ ID NO: 17578 - DNA, 972 bp, A.fumigatus
agccccgcaagaattcttcagcccgtgaaagacaagcttgacgaagatgctgctgaaattgcggcgttagagaaaaagctgggattgaagaaggggaaaaagctaccaaagtcgttcgaagaggacggactgcttgacttgctaggggacttgggtgatgggtccgaagacgaaattcgaaagcgcaaacgagaggccgacgaatggctgaagaacaagagaaggaaggcgcaaggtcttgcgccagaggccgtttcggaggaggacgacagcgatctggcaagtgacgaggagcttggagattttgacggtgatggctttgacgatatggatgaagacgaagacgaagatgaggaggaagagaagcctgccccgaaaaaaagagaaaatccatatgttgcacctgtcgctccgtcttccgagaacaagcccggcaaatatattcctccgtcactacgagcaacttcttcatctgaatccgagtcactcacgagactgagacgtcaggctcaaggacatctgaacaagctgtcggaagctaatctcatctctatccttggcgaatttgagaagctctatcgtgaatacccccgacaaaacgttacatctacgcttctgacactactgttcggtcttgtatgcgaaggatctgctctgcaggatacatttatcatcttacatgcgggcttcatcgctgctctctataaagtcattgggcctgactttggcgcggagcttgttcagaagctggttgagacattcgacgcagccggggatgaacgtggcaagttccaaggaaaggaaatgatcaacttaatctctctactctcgcaactttataactttcacgtcgtcggaagcaccttggtgttcgactacatccggctgttcctgcaagagatcaacgaggagagcacagaattactgctcaaaatcatccgaagtacgttgtcaaccctcttttttgcctaa

SEQ ID NO: 17579 - DNA, 384 bp, A.fumigatus
acgatccaactcgtttctcacctccgcccatcggccatcatggcctcgaaccagccctcaaagcgcaagtccgcctttccggggccacagcctggtgcagcagcgtcccgcaaacgcgccaaaacgttcgatgctcgttccctcgcggttcagtcggccgacgcagcgctctctgcgtccggagagctgaatgtcgccgcgtatgtcgaggctcgggagtttgagatccgtgctctcgagtcggggatgcaacggtcgaagagtgccctgacaagccgtgcgtttcagaaagtgccccgcgcgttgaggagacggacggccagccacaatgtgaaaagggttccgcggaggttgagggcgagggcgaagagagaggtatgttga

SEQ ID NO: 17580 - DNA, 2307 bp, A.fumigatus
  unsure (476): Identity of nucleotide sequences at the above locations are unknown.
ccgctcgacgacgacgaccgacagaaatcctgcgccttcgccttgaaacggctagacggcttcgaaatctcaattccaagacaaaagccaagcgtgcggcagcgaaagcaaagcgggacaaagagacccaaaaggctttggaagaggcaggtagccacgcctataacatcgccccgcgagtgccgaagatcaagaaaaacaagctctcactgcccccgccgcccgaatcaaagtacaagaaacggcagcggtgcaagacatggcttccgacgcatatgttccatgcgaagcgcgcccacatggccacttcgaaggacccgttgtggcggttcgcggtacccctgtcgccgacgggaaaagagctatagaccttcgcaccgggcgaaaggtgccaggggtgcggtggcttgggatatgagctacatgtctacgattcagctagagggcaccgaggaggctatggaggcggtgctgangggaattgggattaatgggcaggatgcttggggtccgaagggaaggaagtggagggctgggacaagaagcttacatgcttgggcgtttgagcgcgacggcacacagagaccgatcgcaccgataaccttgatccgatgtgcggatggaaaagcggaagatgtggaaatggtcgacgctgatgggccgaagaagaagagtcaaaaggatagaaagaagcttttcatcagagttcacccgtctgctttcctgcaattgtggaacgagcttcttgggatatcgaagaggcagaatccgccagtgatggtggaagatctgcgcttcgagattggaagcatcgagattactggtccgggttctacagaggctctactctcagcgctcaagcccttggtgccggatggcgctgaaccgccagcaggcagtcctgaggccacctggacttcgttgcttggggtctcaaacccttcgtcattgccacaaaatgctttccttgggttttcagtatcagaccctcgtcttcactttcccccgaggaccctcaaaccaccagcatcggatcaggaaatgcagaacctggccatcttactatcaacgtggtcacccgacaccacccagacgtcaccggccctgttcgatcgccgtgcaagactaaccgctactcgtcaacttcccagacagaaagctattaatcgtcgacggaccttagctggaccaggtgtctaccctcctgctgaagcttctgacccgaagattccggtgatgatcctcgcttcgagatcaaccagtcagtcaaagaacaccaacgcgcctgggacatggaccgttctattgccatggaaatgcgtgcttcctctctggtattcgctcatgtattacccgctctcaagcggcggaaccgtgagatttggtggtctcaaagaacaacgacaactcgccttcgaagccggagagccctggttcccaggcgactttcccggaacccgtgcgggctgggaatggaacatccgcgaacgggagaaggccaagcaggaatgggaaagacggccaaagggccggagaaccgaatttgatagcctagatctggggaatgggcagaaaggcgagatcggccatggttgggcgtgcgactgggaaagactggttcagggaccgcccaagatctccacgcctgaacctaatgaagcgaaggaaatcgaacagagccaagacgctgagcaacaagatacccaaatgagtgatgccgaacagcaggctgttggcggtcacgctcccccgttcgacatacatcacctccccattgccaaagcagaagctgcaatcaacaaccggtcagagcccaccgagcaagctgccattgcaactgtcaaaatatccctcttgcaccgcggatcgcccaaccccgcggctcgcatctaccgtctccctaccaccaacccagacctacgccaagaatggctccgcctggcatccgacgagcgaaagagcaaaagtcgcaaagcccctcatcttcagggccatctgcagcagtctgcccagccatcagctgcccaaggcgatgcccggcagaagctcgcggcttcgcttatcactccggcagccgacacagagtcccggaaggagcacctccccatccccacggaagaagacctcatcggtttcgtcacaacggggaactataacctttctgaaggaaagggaacggggattggctcgattctggtatcgaaggttgcggcgtcaggcaagggccaggcgcgtgagaggaggatgtgcattgtccgtaatgccggcgagcgagtgggcagacttggtttctgggagcttatttag

SEQ ID NO: 17581 - DNA, 231 bp, A.fumigatus
aatccagataggctctcacattggttcatatacaaggcatatgtgcctcctttcagggccagttacttcgacgtcatccagacatgtacgcaagactacgcggccccgatgtcctggatttcggtgcgcgatatggctttcaatctccttttcatgctgagcatcatcggcactgttactgttaattattttgagagccactatttgctcatgttgccatttaaatcttaa

SEQ ID NO: 17582 - DNA, 339 bp, A.fumigatus
ccccaaattcttgcgcttgtcgaccttattgtgcctggcatcaccacgaccctgtcgttgagtcaatactcgaagggcccgttgccgagcgggcaaagtcctcgcaataaaagcaagctgcagcagaaagccctacggccgaaccagccatccaaatataagagcaatccgctgacttcccaatccaacagcaacgcccccatccaattctcctctaacctcgtcgatgccctccagacgaacaccgaggtacgtctccgagcccagctaacacaccccaacacccttgcaacccagactccaattgcactccgaaccagaccacaactattaatctga

SEQ ID NO: 17583 - DNA, 642 bp, A.fumigatus
cctcgtcgatgccctccagacgaacaccgaggtacgtctccgagcccagctaacacaccccaacacccttgcaacccagactccaattgcactccgaaccagaccacaactattaatctgacaaaaaaccagaccgactcctcccgcgccaagagcctggagctccagatccaagcccgcgtagcccaggaactcgagcgcctccgcgaacgcgagcagcagaccctcgccgaaatcgaaaagcgcctggcagaagccaaagacagcgccccggccgccccctcatcaacgccaaacattacctacccagcgggctcgctgaacctagacgcgccgcgcatccctttcgcgggccgcgagtacgagtctacccctgcacccactgtcgccgccgaccagcccatcaaccgtgatcttagccgggagtcggtgaatgcggagattgagcagctgcgcgctaagcttgagggacggcggaagctcgtcgaggtggatgagaatgttgagcgggcgcggaacgaggttgtgacctgtttgcggttgcacgatagacggcccttggattgttggaaggaggttgagggcttcaagagggaggttgccaggcttgaggaggcgtttgtggaccgtgttgtcggttga

SEQ ID NO: 17584 - DNA, 258 bp, A.fumigatus
tccagtctccgaaaacactcaagacatactatgctcattgtttctttagaatatttctgcccgataaagactgatatgatccactatattgaccctatttacaacaaagactgtaccaccctcacaaacaaaatccaaccatcaaaccaccaccatgccataattacaaaacgccctaatttttatacatcaagcacttttctttcaatccctgacagaaaaaatcaagtacaccttgccctcctcttctcaatataa

SEQ ID NO: 17585 - DNA, 387 bp, A.fumigatus
gacttaagccctttcccttgggcagagacaattccgcaccccagcacaggctctccgcatataaacccccaagattttagcgcaccgtcctccaaaccagcctccacgttcgccactgaccccaaagcagacaccgtcaaacgacaacgcgacctccagaagaaccgcgtggcggcgacgaaatgccgctccaagaaaaagctgtacatccagcaactgcaatcccgcttcgaggacctatcccttgcgaaacgcgagctgcagtgccaggtgcagatgctgcggaatgggctgatctcgctgaaagaggagttggtgaggcatgctcggtgcggggatgagccgatcacaagttatattgagaagaggagggcaaggtgtacttga

SEQ ID NO: 17586 - DNA, 201 bp, A.fumigatus
cacattgcgcgtgttactgacccgatcttgaggcgaatgcaggatctcgagcagcggctgaaggaattctaccgtctgctgcgacgcatcgaaccgagagccgatgccaaggaccagccattgatcgctaaagctttggaaaaggcaagtcctgttgaggtgcttgaaaccccctacctctttggattaacgattccatag

SEQ ID NO: 17587 - DNA, 681 bp, A.fumigatus
gagacgccgcccgcgagtcttagcccgagcagcgatctatccgtcgacgctattacccgtctcgtaactccgaccactgatcccatcgaagaagacttcaacaagaacaagattagccaggcgacaggattcatcggtgcacactctggtcggtcatggctgcatcaactgaagcgcaaagggctccagctggacgcctcatggttaggcccagagacccaggacgacttctttccagactcgatcagctctgtcaattatttcctggatggtgaggagctctcggtcgatccctcagtgcagccattcactatccctccccaagatgttgcagacgaacttctcgacacttactttaacatggtgcatccggggttccctgttgtcggcaaaacggtctttctccaccagtatcgacggttatactccgagcctcaatccaagccgccaaagaaatggttggcgattttcaacttgatccttgcaattgctgcgcatcagttgagcttgacatgttctggtgaagctgatgaatggcacgacacattgatatacttctcccggggaagcaagctgggattggctgaaatccctttgattccccacccggacattcaacaagcccaaattgaaggacttgctgctttttacctgctaatcattggccaagtgaacaggtaa

SEQ ID NO: 17588 - DNA, 207 bp, A.fumigatus
agatggaaattcagcagaaatctcctccctctccttgatctccatccaactccaggtgtttctcattcttcctctattctccaccagaaaatcacaatgggtgtcaccaaggaactcaagtcccccggcaacggtgtcgacttccccaagaagggcgactttgtcaccatccactacactggtagactgaccgatggctcaaagtag

SEQ ID NO: 17589 - DNA, 306 bp, A.fumigatus
attgcactatcaaacaatctatcatactttctatcttcttttttcaatataccccgatacgaacagcctgtcataatgtctggactgatgcacaaggtcaaggacgccgttactggtcatcaccacgattccacccacacctccaataccacgggtacacaccacggcacccaccagaccactgctgataccactaccaccaaccatggtcctcatcactccaagctcgccaataagctcgatccccgtgtcgacagcgacggtggtatgttatacttgcacctcaacctcttctgcaaatgctga

SEQ ID NO: 17590 - DNA, 399 bp, A.fumigatus
tctgacactgttgttgacagggcgtggagaatgtccggtacggcaactcgttccgccatcgctatgggccttcatcttaggagcgttagcaaagaatacttggatatctcgaaagaaactcgttgtcgagtttggtggtcaatcctcgtcctcgaaacaactctgtcagtcatgacgggtcggccgtacagcgtggcgaatcagttttgcacggcgccgttgccccttccatttgacgaggaccagtttggagatgcgtttgttgctcgcttgcttgcggatgccaacgctcgacgtgctcttttccaagtccctgctgtcgtcatcggctccggatgccgaaacctatcttcccgccgtcaagccgtgtgcgtcgctctactttctgttcaccgttga

SEQ ID NO: 17591 - DNA, 219 bp, A.fumigatus
  unsure (133),(139): Identity of nucleotide sequences at the above locations are unknown.
attttcccaaatttccccccaattcaacacatttttcccccggaagtttcaaaaaacctcaccggacacaaacacctaacggcggtcccgaccgaggtttacaccaaacgcgaacatcccctgtcaacccttnaattgngacttaagccctttcccttgggcagagacaattccgcaccccagcacaggctctccgcatataaacccccaagattttag

SEQ ID NO: 17592 - DNA, 321 bp, A.fumigatus
ctactctttgctgtgtatcttttccccatggacccccggagtcaggcttctcagatacggaagcgtcagagagaaggctcaccaggtggaattcagaaaaacaatagtccactacaatcatcatcaacccaatctttacccaaagtcagcttgccgcgcatcacaacggcaaagcctcggacccgtcgagcaagcagagcgtgtattagctgcagagagcaaaaggcaaaatgcacggggggatcgccatgtgagagatgccgcgagctgaaaattgagtgtgtgtttgtagctaacaagaatgagaagattgcaaggtag

SEQ ID NO: 17593 - DNA, 870 bp, A.fumigatus
  unsure (767): Identity of nucleotide sequences at the above locations are unknown.
gaagaactaactggaattattccaatgactttactaactctttcatcagataaccgtgcccacactggtgctggagccaccaccaccggcgcttatgccagcggtgcccacaacacttacggcacaacatttaccaatgccggacctcacaactcgaacatgttaaacaaggtcgacccacgcattgactctgacatggacaaccgtgctcgccatgagaccatgggtggtgcccatggccctcacggctctagcattgccaacaagatggacccccgggttgacagtgacatggacaaccgtggtgcttacggaaccaccactacgcacggcaccggcgccggaaacaccttcggcacccacaccagctccaacgctggcccccataactcgagcatgatgaacaaggtcgaccctcgcgttgattccgacatggataaccgtgcccgtcaccaggccttgggaggtgctcagggtcctcattcgtccaaccttgccaacaagatcgatccccgcgttgactctgatatggacaaccgcggcactacccatggaaccactggccacgcctacggttctggcgctggtatgaacaccagcatgggaactggcatgggaactcacaccagcacaaatgccggtcctcacaactccaacctgatgaacaaggtggacccccgcgtcgattctaacagggacaaccgcgcccgacacgagacacttgcttccaacagctacaatactcctggcgctaccactcacaccgntgggccccacaactccaacctgatgaacaagattgatccccctgtcgattccgacttggacaaccgtggcacccacacccttggcacccagcgtggcatctaa

SEQ ID NO: 17594 - DNA, 579 bp, A.fumigatus
ccggaatcacgtattcttgcaggcatttcaagcgaaacctcggctctgtacttggcgtccaaatctaactatcagcatattctggacggaacgctactgcctggtgtctcatatcccgaaaccttggctgagaatctcagctcaaagagaacgaatcacaagctcgcagagcagggtcgcagaaaccgaatcaacaacgccctcaaggaaatcgaatctctgatcccatccgcgttcattcagatgaagcaaaccaaagagaatgtggccagtcatgtcaaaggtgataaagaaaaggagaaagagaaagccggagcaccaacaatcagcaaagccagtacagtggaattggctattgactatatcaaggccttgaaacaggaattggaagaaacgaaaggaaagctggccgctgctgaggctcgaataggagagaatggagccgcgaaggatgaagactgcaaagcagccacggtatcttcaccgggagatgagaagtcgaagagctcgaatggcacacaggactcgagtacggcagagggcgctgtttctagcacggaagctactggctcgtcataa

SEQ ID NO: 17595 - DNA, 966 bp, A.fumigatus
cctcatcgtccatattctgcagtttccaacatagaagagaaagaagtcgagctgctaaaaagactcgaaagcgaaggcaaccgaattagatcacgatcgattcttctgcgcccgcccgcccgtaccaaggtcattatggaccaggacaactcgatggcatggccggggtcccttcaggaacaatcgctcatggccgcctctggcgaagatgaattcactaattttctggagtttggaatgcatttccccgatttggaggggcacggaccaggcgagcgacagctacagcctcctcgttctcttcccgcctcagcgtcgatgatgccgacgaccactgctgagcaggaacaactgatccgcatggacacagactcccttcccaacgctcactcgtcttcatcctacagcaatcggatcatgggggatttcccgtttgacctttccaaccacaaccagcaatctcaacctcagggccaaataccctcgtcctacaccagcgctcctgtaaccccagccttctacaaccagaaacttgcacaacctcaaatataccatcatcctcaacaaccgccacagaagcagcagcagcagcaacaatcccatcatggactgcctaccacctcgcaaccctacattccccacggccaagcgatcattccccctactccgaacagcattgagcttcagggtaatgcggcacgatatccggcccaggtggatgagaaccacgaattgtacgaccgataccctcacatgaacgaagagcaggtgagactaaatcctcccggggcgtccttcgctcattgcgacggaagcgcacaggctaatgcatgcgcccgcattgacacaggcactctacacacctctcgtctctcccgccatgacaccgttagaaactcaatttcgactgcccgagtacacaattccaggggagtattttacccccctcacatctccagctcttga

SEQ ID NO: 17596 - DNA, 1149 bp, A.fumigatus
atcctcccggggcgtccttcgctcattgcgacggaagcgcacaggctaatgcatgcgcccgcattgacacaggcactctacacacctctcgtctctcccgccatgacaccgttagaaactcaatttcgactgcccgagtacacaattccaggggagtattttacccccctcacatctccagctcttgaggcccagaactccaacggcaatggctatccattccagtcggtatccgaggtcggttttctgcactcccctgccgacgctatcccggcctcttctgctccttcctctcctggcttgatgaggaaacatcgtcgccggccatcggccaccaaatcattttcctcacgcgccaagaaacaacaatcgccatctgtgcgcccacagacacgaaagaagtcaatgctgaatctcaactccgacgaagttctcaatggtctcagccaagatcaaggagtctccaaaatactgcctcacggtgtgagtgggcttcgccagagcagcaatgagagctccgaccaagattctgtatcgccggaacccctttcggaaccattgatgccgcctcctgccctgccccctgcgcgaaagtcccccaccatagtgccacaagccaaccagtctcaaacgagcactccggcaaccccagcaatgttgatgcgtcttcaacggccgcagcccgccgagaatccaacgggtcaattcaatggccaagcaaggctcgtatccacagaatcttatgacgatgtcatggaggatgtcatgctcccggaagctgccaacccgtcatcggaactttctcgacctcaggtcggacgcattgataccgccatgaagtcaggctcagctacaccagttacatcagcgagtatcacaccgtcgttggaacccaagtcagcaccagttatggatcggaatcttacctccattgcgccgagcccacgcacgatggccatgccttcacccagcgggccgattgcgaagaagtcggacacgcctaagcttggtccgatggggaggaaacggcagagtctgagctcgacacacgccagtcctaatttgagacccaagatcagtcctagcattcagcccttggtgcgtggcgaaggtaagcaatgtcatctgtcctgctattgttcccgatga

SEQ ID NO: 17597 - DNA, 1026 bp, A.fumigatus
agctgtgacactcagtctgggttggttgtccgagtcaattataacaagctcgatgtcgcactacgaaatcgccgctttgtagagttagctgagcagggtgtgtcgccagcaacagccaaagtatatgaatgcttacttcgacgcattgagtaccagacccaccagtgccgagacactgccgagatacctcgcgaaggagaagaaggagagcagtactctgtgccgatagcactcagtgcattagctgaagacgtcaatccacagcttgacctttctagttctacgggtccgatggatagctcgcagccagatggcaggcgtgggaaacggccctgggacggtgatgttgagggaacaaatcacgaagaggcgaatggactgtcttctggcggtaatcgtacttttgagattgatcaacacctttctcttttggcgcagccaccacacaacctcacgtctaaacgcatggtgtcgggcctcattacgtggacagtagagttccgtcatctggcgcgaaagctccggcacctcgaactggagcggatgatcgaggctcggtacggcgatgttgcgttgcgggtggtccgagttctccatgccaagggcaagctagacgagaagcgactccaggaaatcagtctgctccccttcaaggacctgcggcaggtccttgcgagcatgcaagcaggcggattcgtggacctgcaggaagtaccacgggacgctcagcgccagccatcgcgcacaatctacctctggtactacgaccctgaccgcatttgcaacagtgtgttgcaggacacgtacaaggccatgtcacggtgtctgcagcgtctgaggttcgagcgtagccggataaaggatttcttggagaagacggagcggagtgatgtcaagggcaacgagcagcggtttttatctgaacccgaattggtgcttctagagcagtggagggccaaagaggcgttgttattaggcgaggtggcgcggctggatgagatggttgctgtaatgcgagactattaa

SEQ ID NO: 17598 - DNA, 195 bp, A.fumigatus
gggaggctgtctgcaagccattttactactttggagtacgtgcctagttttgcgattctagaactgaagccaaacaactattcacagagcaacatgaatattgccgatttaaaaaaacaaaaatggctcctaccgcgaggacaagaattatcaggcgaatccagaattaggattcggatgggttatcacaattga

SEQ ID NO: 17599 - DNA, 261 bp, A.fumigatus
aatggcttgtcaaaagacctttatgcaaacatcgctttgttccagcatcacctcgattcctgtgacaaagagtttcaggcacttggatttttccaagccacccccattgagagtctgcctacattacatgcagttttccttgcggtgcattacaccactgccaaatgctggatggactgcggcctaaaggtggatgccgtcatagggcacaaggctgagcagctgactgctctctgtatttcaggttacctgcctctctaa

SEQ ID NO: 17600 - DNA, 1656 bp, A.fumigatus
  unsure (150),(176): Identity of nucleotide sequences at the above locations are unknown.
gccatggaggaccaaggccatccaccgtctgagccaagagcgctcttcgacaggcgagatgatacagacagcaccaacaatgctttcgatgagaccgatctgtcgcgtactctttttcaggacacttcccacacccctaaagcggaagantggagtttgatgcccgacttcaaganacagcatgaccggaatgtagcgtcgggttttcgacgtcgcgaacttggcgtaacttggaagaatctgagcgtggacgtcgtcagcgcagatgccgccatcaacgagaacgttttgtctcaattcaacattcctcagcatattcgagaatcccgtaacaaggctcctttgcggacaattcttcacgaaagccatggctgcgtcaaaccgggagagatgcttcttgtttttggtcgtcccggctccggctgtacaaccctgctcaggatgctttctaaccatcgactcggctacaaggcaattcggggagacgttcgttttggatcgcttactcccgaggaagcctccaaataccggggccaaatcgttatgaacaccgaggaggaactgttcttcccaaccttgaccgttgcacagacactggattttgcaacccgacttaaagttccctttaacctccccgacggtgttacttcaccggaagcttttcgccaggaaacccgcgaattcttgctcaagtccatgggcatctctcatacttcggatacgaaagtcggcaatgagtacgtgagaggcgtcagtggtggtgagcggaaacgtgtgtccatcatcgaatgtcttgcgactcgtggctccgtcttctgctgggataacagtactcgaggcctggacgccagtactgctcttgaatgggcgaaagctgtccgtgcgatgactgacgtttttggattgtcatcaatcgtgaccctttatcaagcaggaaacggcatctatgacctttttgataaagttctggttctggatgagggcaagcaaatttactatggtccaatgtcgcaggcacgacctttcatggaggagcaaggcttcgtttgccgtgaaggatcgaacgtggcagactttttgactggtgttactgtcccaactgagcgtaaaatccgaccaggatacgaaaatcgcttcccgcgcaacgcggatgagcttctggccgcttatgagaagtcgcccatccgagcccagatggcgatcgaatatgactaccctgatactgagtcgactcgggagcggacggaggaattcaaacttggagttcttgatgagaaagctaaacgcttgtcgaagaacagcccatttaccgtcgactttctgcaacaggtcaaagcatgcattatccgtcagtaccagattatctggaccgacaaggcgacatttgctatcaagcaaatctctactgtgattcaagcactcgtcgctggttccctgttctataatgctccagacaactccggtggcttattcatcaagtctggtgccctgttcttctcgttgttatacaacagcctgctcgccatgtcagaggttacggattccttcagcggtcgaccagtcctgatcaagcacaaatatttcgctttcttccatccggctgcattctgcattgcacagattgctgccgatatcttcaccgccgggctggaagga

SEQ ID NO: 17601 - DNA, 2121 bp, A.fumigatus
gttccggaattgtggaatgaaagtggtgacacttatgtctatctgttcccccaaaacactggacggtcaccgtcgttcaaagtccattcaaccatcttcgcggaatcaccgtccctcacattccttgcccggggcacagacccgagcagggtgaacgctttggagcaacaagcgcgctccatgtcattgaatagtccgatgacaagtcccgcttcgcctcctctgactcctcaggacggataccccgacaatgataatgacagtaccaacagtcggcggatggccttcgtggatgacgagggattggacgatttccaagagcttcatctataccttccaataccgctgaacagcgatgtgtccagccccgacagtcgaatctcacccgaggacacggagacactcattttattccgcaatctcttcgccttcctccttggccaatccctgatcgccactccccggtcacccacactcttctcgatcttcatggatgtggccagtctactgtcgcgcttcgagttcagcaactttgatggaacgaatttcggcgaaacggccaccagcagcttcagcaactactgtgacgaactgcaactggacgatgtccggaaaagccgcgaaaagaccattgaggccatcgtgctgggagaacggctgcgtttcttccccctgtatctcgagggcttcgtccacggtgtcggtaagctggacgagctgaagcagctgcggagtcccaagttcagtctcatcagtcccgtcacccaaaaacggatggaacgcggctttatcgacctcgatacgcgcctccgagtcttgcatagcaaattgaacgagtttgatttcccgtcggtcttctccggagtggccaactcgaccacatccgcggaaagcaagattgtgcgattcaagctgtggaaggccgcattcatggagttccgacggtttaccgtgcactactaccgacagaagtacggctcatggccaccaaaggcccggtcgaagaagaatcaattcgaggagagcggcctcaaccgccaggtcttgaaggacctgtacgatgactttgccaatctgtacgacatgttggtcgatcggaccgccctgaccactcgaaccgtcgatatggcggccctggagacggtcgagtccgaagacacgcaggaggtcatgatccgtgccctccgccaggtgttgagtgagtacgaccgcgccacgccgccggttcagccacccatcccattcgacgttccccagttcccgtcattagactcgctgcagctgaaggctgtggaccccaagaaggaggccaagcgcagggccaagaaactgaaagactcggacatcaatgccgtgctcatgggttcatacacgcgggagagtatgcggccaaccccgttcatcgaagcgttcatgcaattcgagcggcgctgtgcgcacggcaagaatgtggaagatctcatcgatctccgctgtggccagtggatcttcctctactgtgtgatccaagctctaccgttgctcgtggtcgatgtgcaggatgtcaagtacaccgacggcgtcgagtatcttctgtgcatcgcaccccgcgggggtgccccctggatccacaacgatggcaagaccgcacgtagctggtttggggttgccggcggagccggggtggtcagcctgccgtcggacgtcgtgatcaacggcgtcgagggtatctaccgccgcagtcattgctggcaggtggcggagcaatgggccgagaaggacgccattttaggacctccgaccatcgatgacccctatgataacgaatcctcgctatcctcgccctacccgggacagccatcgtcgggcgggtcgtccacggagcaaccccagcaatcggcacaactcctgagtcccaacggtctcactccaccacctccggtgattcctcgcaccagctcaccggctgcgcgagctcgacccgagcatcgccattccatttatcccggtctcgaggccctcccattgcccgctggagttgcgcccgttgatccaccagcgagacccgtcagccggctcaaccccaacatgagcttcgacgatattctgaagcaggttcccaaccaaagagcgaagaaatga

SEQ ID NO: 17602 - DNA, 231 bp, A.fumigatus
atctgcattactacttgtctgattcccatatcaccttgtccagtccgcattcccccttcattcactgctttcgtccatttctggttgtctctttattatggttcattaatcatccgtggagtgcacacactgtacaaggaccaaaagaatgggtcagcgcaatataagactgggaatccaaccaatgtcgaagcgaacttcgctcaagaagaagaatccctaatatcatga

SEQ ID NO: 17603 - DNA, 495 bp, A.fumigatus
tacttacgcggcaaagaatgcagtcaggatgttgccaacgagtcccccaatgccgtggacggcaaagatatccagggcgtcatcaatcttgagccaatacttgagtttggtggcatagttgcaagcgatagcgccgacaacaccgaagatgaaagcggcccatgggggcacgaagccagatccaggagtaatagcgaccaagccagcgatgactcccgagcagaaacccacagtagaccacttcctctcgagtcggtaatccagaagacaccaagtgacaccaccaacagaagcggcgaggttagtcacaaatgctgccataacagctcgcatgttggcggcaagggccgagccagcgttgaatccgaaccatccaacccagagaaacacagtgccaatgacaacgtgggtgacgttgtgagggcggtagttgagctcatgggtgccgtgaccacggcgtttcccgagcatcaaagagtacgccaatgctgctga

SEQ ID NO: 17604 - DNA, 237 bp, A.fumigatus
agccaaggtgcaatgcaacggataagcccatggctgattagttttcgttttacaatgaataatcaatatgacaaggatgatgtccagggaaataggtctctacctaagttcgtctatcaagggaactctaactcagcctatctttctgggtccagtagtatgaccctccatgtactggaaggttgggaccctgctggggaatcccgggcgaggatgatgagtcgaggagtgcgatga

SEQ ID NO: 17605 - DNA, 3129 bp, A.fumigatus
ctattagttgcaagtatggaccccggaatgcaccgccacaccctatcaagtttggggcttggagctcccgcttctcctcattctccatccaactggaccaaaactcccaaaaagccatgcaagatggagtcgcctcaggatcgtaaatttcgagtcttggagaatccagacattcccaatcatgactcggatagctcagggtcatccgacgagcttctacagcagccgtatgcaatgagggccaattctacctttccagagatcttcgagcaagctccgccagccaccactatcgcttcgtcccctcccccctcgcacgctaccggcttgccagcctgggccagcacatcaggtctacgccctcgtggctccagtgtcggtgcaggcgctgctctcgacaaagtctcgcctgtcgacggcctcccactaaccgatcgagatttgcgaccgcaacgcccgtctggccctgctaggaccccatccaacacttacgctccgcagcgccgtccacctcaatacattagcctccagagcgaccgccaaaggtcctcatcggctaggagaagttcccgacgtgatcctaacgcgcaataccgggcgcaagaaaaggcgtatgtccaacgcattagggcaaatccacaggcgtggtataaccatttcgacgatgcccagaatatgggcctgacacctggcgactcggacttggaggagccttcaccatcgtcagaggctccgttcgaggatgacgcatatgatcctgacatccaactgttcctcccggatgataaccagccgacgctcgaggaactcaagaaccccaagaaccaagaaagactcgagtggcattctatgttagcctctgtcttaagaggagatgttgtcaaacaggagaaacaaagattgcttggctcggcggagacaaagaggtccgcggctcagaacaatgcgatctggttgggggttcgagctaagacatgcggccgaagtgttgccttacaacgaaaactcattgaggaagctagagctggacttgggcctctcattgaagatatcatcaattttaaaatcaagggtgagactgagattggcaagtcgcctatcaagcaggtcgaggacattgttcaaaagatcgaggaatgtgagatgctgtactctacacttaaagagttcgaagctgcaaaccctcgagtggcatcggaggaatactgttcaagccgcgaggctgtctttgcatggcacaacactatcgctctcatcaacaccgaactggcgattctgcaaaagtgggtaggcaatgatgagcttgatttcagcaaacccaaggtcaaatccgccaacagcgatctctcagacggatcgtcattcctcgatcgcattatgaaggaagacggtctcaagaccctacaaggagagcacaatatgcttaacggcattggcgaagtgatcaagaaagcaaaaactacgctgattgaaaacgcggactcattcgcccaaagacatctacctccatacatcgaagagcttctcaccctgatcaattttccctcgcgcctcatccaagagatcattcgcgttcgcttatcttacgccaagaacatgaaggaccctgcccagcaatcaccgattctcatcgatcagatgatcccgcagtttcagatactgatgaaagtcgctgttgacatcaaacaacgctatgtagacatatcaaggcccgagcccggatgggatttaccgccttgcattgatgagaacttcgactcagtcgtattggatgccttgaaatactactttcgccttctgaattggaaattgaacgtgaataaaaatacattcgaggaagctgaaatcctggagcaggactgggagttttcgaacgacattggtcgccaactcgaaggtggtgacatcgaggtcgctgaacaatttaggtatgagttttctttctatcctcaagtatacgcgattgctaataagcattctagtgctctgacagctaagtcacttcaacgcctaatgatccattttgagcgtgagttgacggcacgaccaaatgaagatccgatcgacatggatagagattccaaaagtgtgctcgaatccaccagaatcagacaacgggaagctatatcgatttctcccgcttttctgcgtcaattgtttgaaacgcttactgaatacaatatctcggctgatatcgcgtacgacttcttcgaagcgttgcttatttcggatcattttctggtgaagtcaaacgcctctatcggccagaaaggtgtctacctcttcgcgcatcgtgagctgtggaacagacctacagatattcaagctatccttgcgacctcgtttcgggaggaagatgtacccaaggactccgcgcacgcaccgtatattctggtcatccggcctgaaaagcctctgtcctgggctggtaaggagatgcaggttgatttcctggaacagcctacggatgtcagacttggcaaatgtcgtcttgtagttgaaggaacgcagcaacgactcgctaatgctcggcatgagctggtccagctaacgggcatgcaactggatatggctattgaacaacgggcgaaccttggacgagtcaacgtggagttgaacaagattaagaaaatatcattcaagctttctatgactatcatggacagcgttgcaatcatcaaagatcaattgaaatcgagaggcatagagaacacggagcttatccaatcttgttatgctttcgcaacagagtttggcaagcgttcctcgaactatgtcgaccctaaccgacgtgctatgaatagcgctagacttgtcgaactatcactggaatgggtttcgttcatttgcgatgactgcgatgccgctgaccgaaagacatttaaatgggccgtagctgcccttgaatccgcgatggccatcacctcctccagacaccttctatcaatggacgattcccaattcagtcagttaaggtcgaaggtggccggatgcatgtcgttgctgatttctcacttcgatatcatgggtgcccgttcctctcttgcagcacaagcggagaagcagcgcgtggaggagcgcgcgggagcccggaaatttggcgctggccgaatccttacagatgcataa

SEQ ID NO: 17606 - DNA, 1167 bp, A.fumigatus
gctacaaaacttgttcgcgagcaacgtttggctcgcttgcatgatatcgaagacaagcgagtggaagaagacgccaagcgccaggccctcggaagagtacttgaagggtccaatgaggctgaccgatctcttgcagtcctctcgtcctctgcgaccaacgttacgcttagatggcagcaaggccaatacatcggaggtggtactttcggatctgtctatgccgccatcaacctcgacagcaactatctcatggcggtcaaggaaattcgtcttcaagaccctcaacttattccaaagattgcccaacagatccgggacgaaatgggagtattggaggtccttgatcaccctaacattgtctcctaccatggtatcgaggttcatcgagacaaagtctatatcttcatggagtattgctctggcggatctctggccagtttgcttgagcatggtcgtgtggaagatgagacagtcatcatggtctatgctctacaacttctcgaaggattggcatatctccaccaagccggcattgtccaccgcgacattaagcccgagaacatccttctcgaccataacggcattatcaagtatgtcgattttggcgctgccaaaattattgcgcgccagggcaagaccgtagttccgatggatgccttcaccggacctaatcacaaggatgctgctctcgttcccaaggactcccaaatggcgcatcagcggggcaaaaaccaaaagacaatgaccggtacaccaatgtacatgtctcctgaagtgattcgcggcgatacttccaggttaatccaccgtcagggagcggtcgacatctggtcattgggctgtgtgatcttggagatggccaccggtcgccgaccatggtctaccctagacaacgagtgggcgattatgtacaacattgctcagggaaatcagcctcagctaccttcaaccgatcaactcagcgaattgggcattgatttcctccgccgttgtttcgaatgtgatcccatgaagcgacccacagccgcggagctgctacagcatgaatggattgtctctatccggcaacaggttgtcgttgagcctcaaaccccgagcagtgacggcggcagtagcagcattagcagctccaattcatgcagccgtcataattccacatatatgtag

SEQ ID NO: 17607 - DNA, 195 bp, A.fumigatus
cctcaaccatcgaatcgtccctacctacaaatctgcgactgtgctgcaggtggtttcacaatggcggaatacccggtggcctacaatggcaccatagcaacgggtggagattccttgacggaggaattgaacatatactacagcgtcagtcaacctcaccattgtaatatgttgttctggaacgaacgcttgtag

SEQ ID NO: 17608 - DNA, 192 bp, A.fumigatus
acctttcctagcgcccgacagtggagcattatgtttgatttcaggaactctggccgtggctccattatccccggcgattttgacttgtatcagcgtcgcatatttatgggtctggccctctctccctgtcacatttctccctttatcagacatcgaagccttccctttccttcttctcgtgttcagctctga

SEQ ID NO: 17609 - DNA, 294 bp, A.fumigatus
gactcatcttcatgtccatcgctaacaaattttagcttcttctactccggtcttgcccgtcgaaagtcagccctctctctgatatggctctcgataatgtctgtcggtgtcgtttccttccagtggtttttctggggctactcactagctttttcccatactgctggaaagtacattggtgatttatcgaattttggattcaagggtgtgctggcagcgccttctgttggcagcagcaaggtgccggatctgctcttcgccgtgttccagggaatgttcgcttgcattacgtga

SEQ ID NO: 17610 - DNA, 690 bp, A.fumigatus
caactcgaaagtgtagcgcttgccgtcggtgctgtggctgaacgtggccgtatgcttccgtgcatggttttctcctttatctggaccacgatcatctatgaccctatcgcttgctggacatggaattcctccggttgggtcttcaacctcggtggcttggactttgcaggcggcacacctgtgcacattgcctccggctcagcagcattggcgtactctttgatgctcgggaaacgccgtggtcacggcacccatgagctcaactaccgccctcacaacgtcacccacgttgtcattggcactgtgtttctctgggttggatggttcggattcaacgctggctcggcccttgccgccaacatgcgagctgttatggcagcatttgtgactaacctcgccgcttctgttggtggtgtcacttggtgtcttctggattaccgactcgagaggaagtggtctactgtgggtttctgctcgggagtcatcgctggcttggtcgctattactcctggatctggcttcgtgcccccatgggccgctttcatcttcggtgttgtcggcgctatcgcttgcaactatgccaccaaactcaagtattggctcaagattgatgacgccctggatatctttgccgtccacggcattgggggactcgttggcaacatcctgactgcattctttgccgcgtaa

SEQ ID NO: 17611 - DNA, 828 bp, A.fumigatus
ttcccccttagcgctgcccttcctgccccgtgcgtgaagaccgaccggataatacctttacagttgaacgtctccatggacctcaatgagactgtggttggggtgagtggtggtttcagccgaatactctcgtttggcaatgaatcagcattcgatgtatctgggtttgctgtgtgggttccctcgcgcaaaaactggcttcaaaaccttaacattagccaaatcgcatacactgggcaattagcatcttacgccaaatatgaaaacacaactattctcgcaggcaatctagcttcaagcggtattgcagcggcaggcgctgtggcgctgctatataatgatgggatgagtctggaccccttgttgacaaaggtgggcggaactgataccagtgctgggacattcaccggcacctatgacacgagttctggccgcaaccttactattctgggtggtcatttcaccactatcgccagcgatggttcttcagtccaaaatctcgctattctcaatggtgctgacaataccatccgcggcattgcctcggggcttgacagcaattccacctttttggccttggccgtctcagatgataccctgtttgcaggtgggaatgtcaccggaacagtgggcaattccatgattaatgggttcgtggcatacaacctgaagaacgagtcgttcgttgagaatgtgcctcccccatttaccgggaaagacgtctccgtcaatgcaatagccttccgccccggaaccaccgaaatctattttgggggcaacttccaaactgctggagcactcccttggccccgccgtctgtttctatga

SEQ ID NO: 17612 - DNA, 261 bp, A.fumigatus
tcatatatactaactcttgctacaggccatcaccactcgaacggaatcgtggttctcgtagctttctgctgcgctcttggttgcgtcttcttgattgtcatcgccggagttatcttcaataagattcaacggcgccgccagggctatatgcgcgccccccaagcatatggcactgaccggccgtcgaccatgcgacgggttcctccagaatacctgtttaacacgctcaagcatccgaacccaggtacaccagtgttataa

SEQ ID NO: 17613 - DNA, 678 bp, A.fumigatus
ccttccgccccggaaccaccgaaatctattttgggggcaacttccaaactgctggagcactcccttggccccgccgtctgtttctatgatacaacggaggcacagtggactcgaccaggtgtgactctatatggtaacgtcttggcactcaagtggattagcaacaagcaattgattgccgttggaaatcttactgtttcgggaaatcagactgtcgtcgcgacctacagtcctaaagatcagagctgggagccattggcggggacctctacggccgacaatcttggaactgtcactgcttttactcctgccaacacggatgtctcgagattctggctcgctggagaatcgaagaatggctcttctttcctcgccagttacgatgggtctagtctccactttgctggaagcatcttcggcgacggcacaactatacgcagccttgaaatcctcccactgtcccagaagcatcgtgatgtttctgttcttaataatgaccagatcctgctgatcacaggacaacttgtgattcccgattttggcaatgcatccgctgctctattcaacggaaccgacctgactccgttcctcctatcctcgaggtgggatggccagtcgggcagtatgtctcaattgttctatgagaacaagaatccttacactagtggtggtcagtag

SEQ ID NO: 17614 - DNA, 231 bp, A.fumigatus
aaatcaggtgatgagcaaaaaccgcagtgttcccaatgtcgcaaaggatccagagagtgtcgccccagtgaaggtgtgatttttcggcatcagcaaaatgcttcgatgaacaagagtctcgagaactcgtcgaatggccgcggtagtctgaaagggttttattcctacaagaatactttcgatgatgacagtgtctggctggatatacctaaagacggtacggacaagtga

SEQ ID NO: 17615 - DNA, 213 bp, A.fumigatus
tcggtactctttttctcccctcgctaccgacaacggatctcattctctggcactggatcacaacacaccttccaatatactaggccttaccgccccttcagtaccgtctggatcttcaacaaatgtaccgcatactgcattgccccctcagccatcgcctccaatatcaatttcttctttctccaatcccaacagcacaacacgaaccaatga

SEQ ID NO: 17616 - DNA, 693 bp, A.fumigatus
  unsure (418): Identity of nucleotide sequences at the above locations are unknown.
tatcactttattgctctagtggtctttgtcgacaattccgatccgtgtgcggaggagctggagactgttctgggggaatctgaagccgctgttctagcctccaaggctcaccaaaaaggtctacagacgccttcgtctgccgacggggagattcgaggcttggaacagtcgtccacgtggggatctactaatcggtactctttttctcccctcgctaccgacaacggatctcattctctggcactggatcacaacacaccttccaatatactaggccttaccgccccttcagtaccgtctggatcttcaacaaatgtaccgcatactgcattgccccctcagccatcgcctccaatatcaatttcttctttctccaatcccaacagcacaacacgaaccaatgacatcaaattcattntgaatccttcccaaactctatcaccgcccattgatccaagtgcccagcatacctcggagcagatgatatcttcaattccttccagatcagtgttgccacgaaatacagggaataccgagcaggagtccgagcagccagtggaaactgagtatgaagttgtctttctcctgagacacttttcagaagctccagggctgtggtacgtctttctcgaccctcggcaggatagtgtaccttctaacgggaagtatataggatggatctcttcgatttag

SEQ ID NO: 17617 - DNA, 246 bp, A.fumigatus
cactggtgtacctgggttcggatgcttgagcgtgttaaacaggtattctggaggaacccgtcgcatggtcgacggccggtcagtgccatatgcttggggggcgcgcatatagccctggcggcgccgttgaatcttattgaagataactccggcgatgacaatcaagaagacgcaaccaagagcgcagcagaaagctacgagaaccacgattccgttcgagtggtgatggcctgtagcaagagttag

SEQ ID NO: 17618 - DNA, 564 bp, A.fumigatus
cgctgcagactaatcgacgaaaacggagacaacatctccgcatttgacgtccgcggcgagctgtgcgtgcgtggccccactattaccccggggtacttccgcaacgactccgccaacgccgagtcctttgacgcagagggctggttcaaaacgggcgatatcgcgtactgcgaggggcgcacgcgcaagtggtacattgtcgaccggaggaaggagctcatcaaggtgcgtgggttccaggttgcgccggcggagctcgaggctgttctgcttggtcatccgctgattgtcgatgcggcggtgattggagtggtgtttcctgggacagacacggagtatccccgggcgtacgtggtcagacagcctggtcgcgaaggcgagattctgacggaggaggatgtgaggaagtatctgggagaacggctggcgaagtacaaggcgctggttgggggggtcaagtttgtggatgctatcgcgaagagtgctagtgggaagattctgaagcgagtgctgcgggagaacagtaagaaagatatcgaggctggattgagaccgaagttgtag

SEQ ID NO: 17619 - DNA, 741 bp, A.fumigatus
gcaggaagcagtttaccagtaaagccggagaattgcctccttcatcacaacccacccaacatgcatttcgctatgctcctcttccctggctttgaagccctcgacgtctttggccccctggaagtcctcaacgtcctctctgagagaaagcagatttatctctcgctgctcgcgtcaagcctcactcccgtctcaactcaatccccggacccagccgcacgtcgggcaggctccatctgcgcccaggaagtacttccaacaggtactttcgccgactatttacaagacgcacgcgccccggatggcgtcaagggcaatatagacgtgctcgtcgtgcccggcggcgcgggaacccgctacccccacgccatcgatcccgtcatcgagttcgtgcggggaatcgccccgccggtgaagtacatcatgtccgtgtgtaacggcgcgggtgtgttagcccgggcaggcgtgctagatgggcgacgcgcgacgaccaacaagatgctttgggggcagacaacggcgctgagaggggaggtgcgctgggtcagagacgccaggtgggtggctgatgggaatgtgtggacctcttctggagtgagcgcggggatcgatatgatgttggcttttgtcagggagacatatggggaggatctggctagtgggatagctcaagagatcgagtatgtttgggatagggaggaggacgggaccagggatccgtttgctactgctgctctctga

SEQ ID NO: 17620 - DNA, 990 bp, A.fumigatus
tcactccatcactcatccgccagacgacgatggacaatggctaaccggaccctcgaatcattctacaaacccatccgcaaaccgggcaagccgcgtgtggaggacactcctccaccgtcctactcccatcatcccagctatcccttccccatcgcggatcttcccccctccatcgccaacacgctgctggatctcccagccaccccccctcgcagcattaccaaccagccgcacctggatctcctctactaccaaccctttatcccgtcagccaccgcccgcgagctcttccacttcctccgccgcgaactccctttctaccgtgtccagtacaccatccgccgcggcccgaccaccacccagatcaccaccccgcgcttcaccaccgtctttggcgtcgacgatacctccctcttcacccattcgcccggtgactctggctctacctcttgtctagtcgacagcgaatcccacaggcccgtcccgcccaacaaatacaaatcccacccccgccccattcccccctgcctcgacgccctgcgccagcgcatcgaggccgctacccacggcgccgtctacaacttctgcctggtgaactactacgcctcaggggacgacagtattgcctaccactccgacgacgagcggttcctcggcccaaatccatgcattgcgtcgttgtcgctcggcgcgaagcgcgatttcctcatgaagcacaagactgcggagggtgttgcggcggcgccggtcaagctggccctcgcggacggggatatggtgatcatgcggggcgagacgcagtcgaattggttgcattcgatcccgaagaggaggggtagcaggggcgaggcgcgccaggggaggatcaatattacgtttcggagggcggtggtgcctgcggggacggagaattattataggtataacgtgggggagggaaaagcccacagatggagggaggaggaggggaggatggtcgaactcttctaa

SEQ ID NO: 17621 - DNA, 468 bp, A.fumigatus
tcgcttcttgatcactccatcactcatccgccagacgacgatggacaatggctaaccggaccctcgaatcattctacaaacccatccgcaaaccgggcaagccgcgtgtggaggacactcctccaccgtcctactcccatcatcccagctatcccttccccatcgcggatcttcccccctccatcgccaacacgctgctggatctcccagccaccccccctcgcagcattaccaaccagccgcacctggatctcctctactaccaaccctttatcccgtcagccaccgcccgcgagctcttccacttcctccgccgcgaactccctttctaccgtgtccagtacaccatccgccgcggcccgaccaccacccagatcaccaccccgcgcttcaccaccgtctttggcgtcgacgatacctccctcttcacccattcgcccggtgactctggctctacctcttgtctag

SEQ ID NO: 17622 - DNA, 516 bp, A.fumigatus
cagttgctgcatgccagccagggatgtgtgcaagggccaaccagatggtgcaactgcatggtcagctgtgtctgggcagttccacgaggcaaggatacgagggtcagcatgaatgccccgctcaggctgacggaggatttatgtcgggaccttcctggcgatgacagagcagtcagcatggcttcttcgcgtcctgtctattcgctgcaggaggtctcgcggcataacatcgcaaaggacctctggatcgtaatcgagaaggaagtctacgatgtcacccaatttcaggcagagcaccccggtggcgcgaggagtgagtcatctactgagagaccaagaaagcagtctgacgagacagtcctgcggaagctcgctggcaaagacgcaacggagaaattcctcgagtatcatgatacatccatcctcacccgataccgagagcgcttgcaggtcggagtgttggtcgagggaccggagccgcagaagggattccttagtagattcttccgctcatga

SEQ ID NO: 17623 - DNA, 1329 bp, A.fumigatus
aaccttagcgcggtcctatcctcctcgtggtggcgatctcgcggtcggtcggctgattctcgctatggaacagcgcgatggtcttccaaaccgcgctcccgggctagattgtatcctccgtcgacgatggggtccagccgaaccagcttggatgaccagtcgtctctctggagtccgtctgcctctagtacgtggagtaaatactctctcggtaaattgacttccgcgtctgtcgattctttcggctcggattatccgcgtggggattatcaacagtcgattgggttcgcgaacgcactcagccaagcgatcatccgagaggattctgcgcactccatcacgagtgtggaagaagaaggcacagctcatcttctggaggatgagactctacaactggccggggcgccgtgggccaaagaagggagcctcaaacacaagcaacacctggattcggtcgacaagagggccaaggatcgtaattggaatgaatgcttcgctgtgattcagcaaggctggatgcgtctgttctcgttcagcaacgcggcgaagacgccgcgccagaaacccaaacagcgtccccatggaggggttgtggtggggggtggaaactggacagaaaatgcccaggagctgtggaaattccttctgcggcacacaattgctagtgcactcccgcccccaggctattccaagtcacgcccacacgtctgggcattgagtttgccgacaggcgccgttcacttgtttcaggcgggcacacccgagattgtccgggaattcgtctcatccgccaactactggagcgcgaggttgtctaaggagcctctagtcggaggaatcagtaacattgagtacggatggagcgatgccgtgatcaacagcgctctggtgcacgccgacaacaacagaacgccaccttcatccgggcctcgagctagcattcagagttccatccgcagctctatcgaccagcagggcatgcgacctaggctgccggcggaccgggtacatatcagtgattgggcgccacctcagcagagtatggcggcctcaacactgcccgaagccgagcagctgaaagctttacaaacgtacgtcaagaatgtggaggatgacttgtcgcgtcacaacgagcttcgacctgccatgatacttgcgttttcccctcgccatcccaacgcagccaaggcgatggccaactgggaacgcaaatcttcttatttgttacgggagattgtgaagttccggacgtatattgattcgctccaagcggcaatagatgccaagaacaagatctatgcaactcgcgaagaagatgtcccttcatga

SEQ ID NO: 17624 - DNA, 2361 bp, A.fumigatus
gaattgagctcacaaatcatgatatctatctacccgatccatactgattcatttcttcaggcgaatgtggagcaaggaaaaggcctgtgtcactgtgtgcctagacgctggatccaagccgccaacgtcagtccaaaaccgactagactaattggactaaaccataataaaaataataataataataacaacaataatactactgtcaccatgtcgaccaattccgacctttcgccgccgtcctctccgtctccgatcttccaaatcactcactgcgcgcagtcgattctcctcccgtcgtgcgtgtcgatacctgacgcctttgatacagacgacgaagtgttcgcatcggtggaggagttttgtaacccttttgatttgatggtgcaggacaccacatgggcagatccgcccctcggcggcagcacaacaatggacgaagctcacgatacagacagcgaggtttaccatacccaagatgagacgacgctcgatttaggccgagatgacgatcccacctccacgatcgatccttcggaccatgacgattcgaatatatcccacctccctcccttacccgatcacgatgacagtagcttgttcctctccagcgaggatggagaccatgagcgcgctgagaaccagaccctcttggaagagaaagagatgcggaggaaattgatggacatggagtcgagtttcttaccggagccctcgacaatcgaggtcgctccttcgaaccaggcggcgggtatcggcgacactctgttgcaagataactgtgataatgcgcatgagccggcagcatctgagaccaaccagtccttcatgacagcggacaatacgagccccgacttgatatccactggcaaggaggtgtcggttccgcaaactccgagtttgggtcctcatgacgattctaccatgggcctggatgctacgcccactaccgtgccgcaacatcatggagatgacacaaccgcgttggaggcgatatcttcgtcgccagcagcagacgcggcggcgcgatcgtcggccagagtacaatctaccttctcggagggttcgcagtcaaccaacagggatggccaagaagaggctgaccactctacgacacttgacctgactcgctccatgcaggcggctaatctaagtacacagacaagttttcgaagctcatcgttggaacgcccgagactctttcagaacgagagtgcccaggatgcagaagcagcctcccgcacaagcagtcgaaggagcaacaggccgaaatacttgaacagtcgccagtcatcgcatcgtctctcttattcgtccgtcgccagtaacaacacagagattaccaataacgatgcgacgctgggcgcggactacgcccttcagtccggtggcgcggtcccaggcaactctcatcctgcgcaaggtgaccctcgcaacaacctaacgagatccgttagcttaggcagcatggcttccggcatttctagcttgagtgaagagaatgtcatggagaggagaaatccctctgccgttgccgagggtggcctgcagaccctgactgaggaagaaggcatatcgcagtcgcggcccggctcagctcagcagcagtcgcagtcgcagccgcagccgcaccaagaacgccaatcgcccacgttaggggatgatctagggccgatgacaccaaaggcaaaacctcgagacaacatctttccaacagacactgccatcgcagaacgcgtcaaggacgtccaggtaccaagcgcctttgtcaggcagttccgggaagactttgcgggtcgaccatcctctcctgagaagcgtgcaggcctcccgactccaggtttcgcgagaagcggtcgaaccatgacgctcaaagagcaaagcagcaccattgaccgtttgtccaaggagaactttgatctcaagatgcgcatccacttcctcaatgaagcgctgaacaggcgttcggaggaaggaatcaaggagatgatctctgaaaatgtcgagctgaagtcggacaagctcaagttgcagaaagacaatcagaatttgaagaggaaaatccgcgacttggaaaagcagctcaaggatcaacaatcggacaaagagtccatggctaaccacgaccctgagggctccgacgaggattcccgcgatgccgcacaggacgaagagattctgtttatgcgggagagacaggaggcttacgaacttgaaatcgagaggcttcgatccgagagtattgttcgggaaagcgaaaagaggagactcgcggagatggtcaaagcattgagtgacaggccgatcggttcagaggctggagctagagaagagagggtaatgaccaccgatgtcctgtaa

SEQ ID NO: 17625 - DNA, 255 bp, A.fumigatus
agcccgcttcatttttgctctaaaacttgtatagcatcaacgtcgaatatatactcgtatacatcaattctagccgcatctgttgcatacaccctctccttctctccttctctccttatcttcaacccatccatcaacgatatcgaatcggatattctatttgtcactcctatccccagaagcttcagctgtggatctctcaaccggtgcttcggtggcggacgttgtatagtctcccagaccaaggccaggtga

SEQ ID NO: 17626 - DNA, 375 bp, A.fumigatus
ttgagagtctgctttcggacattgccttggaaacgggaagtatgtgtcatattattgatttggatcataaaaagatggagcagcgtcagcggattgtgccggttgtctcttgtttctgtcttcagttcattcatacacgacaacaggatgtggtatcaatcatcttccttgcttggtgtcgctgcggtcgcccaagcagccacagtgcactattccctcgacctaacatgggaaactggcagtccgaatggtgtcagccgggagatgatctttgtcaacggtcagtttcccggtccaaccatcattctcaacgagggcgacgaggcgattgtaagtatatggcagcatggcagcatagaaagatcgggatactga

SEQ ID NO: 17627 - DNA, 489 bp, A.fumigatus
caaggggtgggtcaatccatgcatattgcatattgcagatccaatagaaatgctaattgtcaaagatgcgtgccatatgtgcctcccatccaaggcaactgggaacatcaccctgacaaggtcccccccggcctgaacgagggctgccatcccagcaccacgcaagaaacaatcttcactgtggatgccgcacaccaatgggcaagtttccacttcatcagtgcggccagtctcaacgtgctggtcgtgtccatcgacgaacaccccatgtatgtgtacgaagtggacggccggtacattgagccgcagctggcacacagtgtgaaactgtacaacggcgagcggtactcggtcatggtcaagctggaacaagaaccagccaactacaagatgcgcgcggccaacgacggggggcaacagattgtctccgggttcgcgacagtcacttacgaaggcgggggaaaccagccggggcccatcccagcgtaa

SEQ ID NO: 17628 - DNA, 1245 bp, A.fumigatus
gtatatcgtcgccagaagcaagttcagacgtgtatactcacgggacaggtcaatcaaaccgggacttattggtatcactcgcacgaaatgggacagtatcccgacggcctgcggggtccgttcatcgtgcgggatccctcgccgccatttgcctacgacgacgagtttacgctgactctgaccgaccattaccacgagcaaatgtcggttcttctgcagcagtacgaggccgacagcgtcggcgcccaggcaggcgtcaatgaacccttgccagcggcagctctgatcaacgagggctttgacaccaccactctccgcgtggagcccaacaagacatacctcatccacctggtttgcgtgggcaactggccaggccacgttattgtcttcgatgaccacgagatcagtgtcgttgaggtggacggcacctgggtggacgcgtaccctgcgcgagacaagaagatccggctggccaccggccaacgcatgagcatcctgctcaaaaccaaggacaacaccgacaggaactatgccatctgggactcgatggacgtcaacatgatgttcttctatcagaatcgcgcgatccccgaggggttcaaccccaacacgacggcatggctggtctatgacgaagcaaaggaacttcctcccgcaccagacgtccacgaactcgacccgaataacgactttgtcgacgatctcgtcttcgtgccagcgagccacgagcccctcctcgagaaagtcgaccgtcagatcatcttcgacaccggtgtgactcaacgcgacggccgcagcgtgtacaccatcaatgggcagacatacgtcgatccggaggaaccaacattgtacacagcgttggcggcgagcccagaaaacgcttctaatgcgtcgatatacggtcaggtaaatcccttcgtcgtccaatacggcgaggtcgtggagatcatcatcaacaaccaccacggcaacctgcacccctggcatatgcacggccatcagttccaggttctgcagcgcacgatccccgagggcggctacttcgatggctactttgcaaatatctcttcgaccccggtgaaacgggataccatcatggtgcagaaccatgggcacgcggtgcttcgcttccgcgccaataacccagataagttaccctctgccttgggagagatgcatactgacctgtcctacgagtttggctcatccactgccatatcgaatggcacgtcaccaaggggctga

SEQ ID NO: 17629 - DNA, 447 bp, A.fumigatus
acagaaaaataccccgtgggccgacggagttgtcggtctctcgcaatgggccattcagcccggccaatcctacacctaccaatggcgagcagatacttatgggacttattggtaagctggtttctcaaaatgtatctccaagctaacgtctcaggtaccatgctcatgacaaggctgaaattatggacggactttatggaccggttcatatcaggtgagatctccacacaaggcaagacaagactcatactaacgacagatagacctcgtccaaacagagattcccccttttcaatgatctccgacgatccggccgatattcgggccatgaagcaagccgagcgcaacggcaaacttgtcatgctgtcagactgggatcatctgacaggccaagagtacatgaaggcaatggaggagaccggatacgatatcttgtgcgtcaaataa

SEQ ID NO: 17630 - DNA, 801 bp, A.fumigatus
  unsure (208),(217),(334): Identity of nucleotide sequences at the above locations are unknown.
aactgtacaacggcgagcggtactcggtcatggtcaagctggaacaagaaccagccaactacaagatgcgcgcggccaacgacggggggcaacagattgtctccgggttcgcgacagtcacttacgaaggcgggggaaaccagccggggcccatcccagcgtaacattgattacgggagccgtaacaccagcgccgatgtcattccantgaacacanaccatttgccccgtaaccgggttatcagtcttgcttccgagccggacgacttccacattctgatgctgggccgcaccaattctttttgggagtggtcgctggacggagcggccttcntgcctagcaaccttggtgcgttgccgccagccattctgagtccgcaagctcccgagtttgcggacgcgctcaagatcacgacccgcaacgatacgtgggttgacattgtcttccagctggttgtcagcgaaacgacccccatccagcctcctcaccctctgcacaagcattccaacaagggcttcctcctgggaaccggccacggcaagttcaactggacctcaatcaaagaggccaaggaggcgagcccggagagtttcttggagacgcctgtctaccgagatacatttaccacctcgccgcaaggagagacgtggacggccatccggtaccatgtcgagaatccgggtccgttcctgttgcactgccatatgaccactcatttgcagtcgggaatgggtctgatcctgatggacggagtggatgtgtggcccgaggtgtatgcagacatgatcactcctatgtga

SEQ ID NO: 17631 - DNA, 843 bp, A.fumigatus
ttggtttccccatcgaaaggctgcccaagattactgcattgggatgtcctggccccttgcattcctcgtctacgcgcccttccttgcatcgtactagtccgatctcagcattttcaacacatagctattgtttacatttccgtgttcatagatgtccgaataccttcaatagcttcggtatatctcgatggactcagcccagtctctcacacgaccgaccagcgacatcgcccgcagcacaccatgttccattccagggctctccttctctcctggcttgtgggcttcaccgcggccaaggatattcatctcgattggaacatcacctgggtctgggcagcgcccgatggctttggccgtcccatgatcgggatcaacaacgagtggccctgtcccattgtcaatgccgacctgggcgatcggctcattgtcgatgtacacaatggcctgggaaatcagtcgacgggaattcactggcatggcttccatcaatacatgactggaactatggatggctcgaaccaggtaacgcagtgtgcgttgcctccgggaagcagcatgcgctatgaattcgatgtaagtatatcgtcgccagaagcaagttcagacgtgtatactcacgggacaggtcaatcaaaccgggacttattggtatcactcgcacgaaatgggacagtatcccgacggcctgcggggtccgttcatcgtgcgggatccctcgccgccatttgcctacgacgacgagtttacgctgactctgaccgaccattaccacgagcaaatgtcggttcttctgcagcagtacgaggccgacagcgtcggcgcccaggcaggcgtcaatga

SEQ ID NO: 17632 - DNA, 546 bp, A.fumigatus
  unsure (527): Identity of nucleotide sequences at the above locations are unknown.
cctgtcctacgagtttggctcatccactgccatatcgaatggcacgtcaccaaggggctgaccggcactctcatcgaagccccggcgcagatgcataaaatttccgtaccgttggatcatcagcgaatctgtcccagctacggcacaccaccgggtggtacgccctcgtctcctccccacgatgctccccgtcctgatggggcatcaggctcacctcagtatccccctaagccgtggggtgagccagatgcatctgctcctgagcaggatgattcacaacctggcggtacaccagattcacctgaggattttccccagccgtggggtgagccagaggaatctcctcaggagcctcctcaaccctggagtccatcgaacaacgcccagccaccggccaacacgtacgcaccggagtatccctctggctacgttcctgttgcgcctggccccgtgattatcgactcggagttgcattcacggtggcaaggagtgtcttacaccgacgaagcgcgccaggaagccgcgcntagatgccccccgaaaagg

SEQ ID NO: 17633 - DNA, 1227 bp, A.fumigatus
cttatctgggttattggcgcggaagcgaagcaccgcgtgcccatggttctgcaccatgatggtatcccgtttcaccggggtcgaagagatatttgcaaagtagccatcgaagtagccgccctcggggatcgtgcgctgcagaacctggaactgatggccgtgcatatgccaggggtgcaggttgccgtggtggttgttgatgatgatctccacgacctcgccgtattggacgacgaagggatttacctgaccgtatatcgacgcattagaagcgttttctgggctcgccgccaacgctgtgtacaatgttggttcctccggatcgacgtatgtctgcccattgatggtgtacacgctgcggccgtcgcgttgagtcacaccggtgtcgaagatgatctgacggtcgactttctcgaggaggggctcgtggctcgctggcacgaagacgagatcgtcgacaaagtcgttattcgggtcgagttcgtggacgtctggtgcgggaggaagttcctttgcttcgtcatagaccagccatgccgtcgtgttggggttgaacccctcggggatcgcgcgattctgatagaagaacatcatgttgacgtccatcgagtcccagatggcatagttcctgtcggtgttgtccttggttttgagcaggatgctcatgcgttggccggtggccagccggatcttcttgtctcgcgcagggtacgcgtccacccaggtgccgtccacctcaacgacactgatctcgtggtcatcgaagacaataacgtggcctggccagttgcccacgcaaaccaggtggatgaggtatgtcttgttgggctccacgcggagagtggtggtgtcaaagccctcgttgatcagagctgccgctggcaagggttcattgacgcctgcctgggcgccgacgctgtcggcctcgtactgctgcagaagaaccgacatttgctcgtggtaatggtcggtcagagtcagcgtaaactcgtcgtcgtaggcaaatggcggcgagggatcccgcacgatgaacggaccccgcaggccgtcgggatactgtcccatttcgtgcgagtgataccaataagtcccggtttgattgacctgtcccgtgagtatacacgtctgaacttgcttctggcgacgatatacttacatcgaattcatagcgcatgctgcttcccggaggcaacgcacactgcgttacctggttcgagccatccatag

SEQ ID NO: 17634 - DNA, 294 bp, A.fumigatus
gtttctgaacccaacatgagcgaacccatagatagcgacagtacctatggcacctacgacgcccaagcatcgaccaactacggtgtccggggaaccagacagctcaacaacagaaacaaaaacacacccatgagaaaggaatactatgcatccggcatcaatgacatcggctggtggtacgactatgactacaaatcacctggccttggtctgggagactatacaacgtccgccaccgaagcaccggttgagagatccacagctgaagcttctggggataggagtgacaaatag

SEQ ID NO: 17635 - DNA, 1110 bp, A.fumigatus
acggattcatttagtagactggttctttgtggatgttcatgcagtgaccaatgttttcctaatttcacactcagatggttgtggatgccccaggccgacacccaagcccatcgcggtttgcggcttactcaatctgaggccagcgctatgacactagttctcaatctcagcaccggaggtttctgctttgacttacagagtataccctcttccgttctgataatactttatttttatagaagatttagacctcacattccagtcaaaatggacggaacaggacctacagagcagtggctctcccagctcacagcaatgcgcgaggcgattgcagcgttgaagctcccaaaggaccccgccaccgaacagctcagctacggaagcgatttagatttggaccttgacgatgaatactcttcaccagtgaccgtagacgatatctgggatattatcagctccgatgacgaaaccaacgatgacctagacgacatcaacggcgtacctctccctccggcgccatcaacctctctctacgaccaagcatggctggagcagagatgccaggccatcaccctccagaaacccggaatgagtgcgcaagagctagcccagcagatcactgcttcgctagctaccgacagcggagatgacgagctgcagatgtcgctggccgaaatcgttgggttcgacgatctcgacttcgttattgaattgatcggacaccgagcggagatccttgcgtctacgacctcaaagacggaagcccagacggacggtctcatgacgggaaagttacaaacgagggccgaacgggaacaggcgttgcggcagcaggactttgagcataagcatgcgccgttgttacctgcgcaggcgagatctgaacccaggtacccgcatgtcttcaagacgcacgattccagaaatacgcttgcgctgggtgggaagagatacgggctccctgtaggtagcaggcagattgacgagcagcggtataccgagtttgagatcccggcatcgagggtcggcacgctggcgtcttcgcagaagttggttgagattaagtcactggatgctcttttcatcacgccggaatcggcaagtacgctc

SEQ ID NO: 17636 - DNA, 390 bp, A.fumigatus
tctttctcctgcattatagttccagagcgcaattacgacagatattatgcgatgagactttcctaccgtgtcgggttagccgccctcctaatcctcgccttcgtcctgatcaagcgccatctagattcccttcaggatggttcgcacgtaccgtcctcctggcagttcagcaacgtggtatggggcggcgctgcggagcctgtcgctactcccgccagcaaacctgaaaaagaaaaacctcagacaccggccccggcagtagagcaatctcttccaatcaaacaaacctacgagatcactcctattatcgttcccaatgaccgtgtgatcgtgatggccagattgagccgggaggatacgtcatgggtgagcactgatttgaatgagtga

SEQ ID NO: 17637 - DNA, 687 bp, A.fumigatus
atgagtgagttgtttatgggcaaggccttgcgcggtgagctcaggctgactcaatccagatggcgcaatttcatctacaccgttgatgacgtgaacgcggctcgacacaccccgaagaacaaaggccgcgagagtcttgcctaccttcaatacattgtcgatcattaccatgatcttccgtccacaatggtcttcctccacagccacaaagacggctgggaggcgggttggcacacggatacgctggattatagcaatgtggaatcggttcgaacactccagaccgaatatgtccagaagagcggcttcgtcaaccttcgctgtcagggaaatcccggctgtcccgacgaaatccgtccgttagacgatccgcctcggccaggaaaggagaacagtagagtctatgcccgggcgtgggaggagttgcacaacaacaccaacatacccgaagttgttggcgcaccgtgctgctcgcaattcgctgtgtccaaagcgcaagtcttgaagcgccctctcagtgattatcaacggtactacaattgggttctcacgaacaacttgccggacgagctcactgcctggatcatggaatattcctggcacatcatatttggaaaggatccagtgttctgtccagatatttaccagtgctaccagaatgtttatgggaatccatattcctggtag

SEQ ID NO: 17638 - DNA, 372 bp, A.fumigatus
aatttactcaatcccagtctctggcacagtaaaatgtcgctaggaccccatctctactacgacggcgaagactataaatgcctcctttgcgataggtggtttgaaaccgaaaaggcactgtatgatcattgtcgatacaccagtcgccatgaatggtgcgaaacgtgcaggagggttctcgtttctacgactgcaaagaatcagcatctgtttgactccccagtccacagccacatctgtaccctatgctcttctcgacctcgatttgataccgctttggaactaaaggctcatcgcatcgactatcacaatctgtgtggcatttgcggcaaatactttgacaacgagaacaacctgcgaatggcaagttga

SEQ ID NO: 17639 - DNA, 375 bp, A.fumigatus
cgttatctacagatgtcgctgactattcttgacctgcagcatcagcagcgccaccaggctaggaatttgcaatgctacgggtgccaccagtccttcaagactttctctggcatgttgatccatctcgagtcaggcagctgtccctccggaacagacattgatgatattaaccgtctggctcgtcagtgctaccagagtcgcaagtatattgatacagccggcgattacatttgtcctgcctgtgataagttctgctcaaagctctctgcattattccagcatgttgaggactcccttggctgtttgtacctcaaagagggtggccagtgtctagcaaagttggagtattatatttcttggaatgtgaggcgctag

SEQ ID NO: 17640 - DNA, 297 bp, A.fumigatus
actaacatcgtggcagagatccggcacaagcgtcgtatcaccgttgctgcggcatcaaagattctcgccaatctgacatacgcctacaagggaatgggtctcagcatgggtacgatgttggcaggcgtacgttttgatcccctcttttgcagatcggatgagtgtgaaactgataacaccgcagatgacccctcaagaaggaccggccctctactacatcgactcggacggcacaagactctcaggaaacctgttctgcgttgggtccggtcagaccttcgcttacggtgtgcttga

SEQ ID NO: 17641 - DNA, 444 bp, A.fumigatus
catacgcctacaagggaatgggtctcagcatgggtacgatgttggcaggcgtacgttttgatcccctcttttgcagatcggatgagtgtgaaactgataacaccgcagatgacccctcaagaaggaccggccctctactacatcgactcggacggcacaagactctcaggaaacctgttctgcgttgggtccggtcagaccttcgcttacggtgtgcttgacgcagagtaccgctacgacttaagtgaagaggaggccctcgagcttggtcgtcggagcattcttgccgcaatgcaccgtgatgcttactcaggtggtttcatcaacttgtaccatgtcaaagaggaaggctgggtccaccacggtttcgacgatatgaaccccattttctggaaaacaaagctggaaaagggcgagttctcgaacgttacgtcggccctttaa

SEQ ID NO: 17642 - DNA, 288 bp, A.fumigatus
cattgtcaccgcccacgtagcgacggccgtctccgtcctcccacaccacggcacgggagtcctcgaagacagcctcgcgggcacagcgtcggcagcgcacaatgcccggcgcaccgctctgctgggcgaaggcgttcttggcggcagccgcggcggaagcggccaggcgggccttactggagccggcggatgagacggcgacctgggtggagaggaaggagccgcagtcgcggcagatccaggcgcgctgggagtcggagcagttcatcagacggtcctgaaggatga

SEQ ID NO: 17643 - DNA, 231 bp, A.fumigatus
atcgtcgcgacggattcgagagctaccgctggaaactggatcgccagtcagacagtgaagaaggtcattcccgtgtcgcggttgagtcggggtgaggacaagaagcaggatactccggttcctggtctattgggtaccatggctggtggtgctgcggtatgcattcttctgcgtactggtggcatggcgacactgacagaattgccctccaggattgccaatactggctga

SEQ ID NO: 17644 - DNA, 333 bp, A.fumigatus
aatcttgtcccttcagccacttgctcaacctttgtgtcctcatcctcccgaaccttctgggcgtctctccataagccgctttctctattgctctggggcatttactatttgatttacttctgccttaactccttcgacagcggtttagcccatctcttccctgcggtaactggctaccaaatataccaaaccaccaagaggctgactttcagcctacccccacttcccgcacttcgatccaagtctccaggaccttggatctcgacttatatccacgtccattcgtcatttgccaccaatccagcaaacaccctgttttcatcgtggtattaa

SEQ ID NO: 17645 - DNA, 1512 bp, A.fumigatus
accaatcgatgccacctggagaaggcaactccccaggagcttgttcagcacaaagaagagtcggaggagctgggaggctactttatcgtcaatggcaacgagaaactcatccgtatgttggttgtcggcaagagaaatttccccatggcgattgtccgtagttccttcgttcgtcgtggccatacctacaccaaattcggtatccaaatacgatcagtgcgccctgatcagacatcgcagacgaatgtcctccactacctcagcgatggaaacgtgaccttccgattctcttggcggaaaaacgagtacctcatccccgttatgatgatcatgaaggctttggtggaaacgaacgatcgcgaaatattcgaaggcattgtcggcagcgctacatccaagggtgtcaacaatacatttgtgacggaccgtgtggaactgctgctcagaacatacaaagcttacaacctacatacccgttcctcctgccgagcttatctgggcgagaagttcaagcccgttctgggtgttccggcagatatgtccaacgaggatgctggtacagagttcctccgcaaaattgtcttgcctcatctcggtaaccagaatgtcaccgagatccaagactatgacaaattcaagttgatcatgttcatgatccggaagctgtacgcgcttgttgctggagattgtgcccccgacaacccggatgccgtttccaatcaagaaatcctgctcggcggtttcctctatggcatgatactcaaggaacaacttgaggaatggatgagatcctttggccccatcctgagagattggtccaatcgcaacggtggtgcaaaattcactgatccagctttcgaaagagacttcttgagcaagattgtcaagaggactaatgagaacatcggtggtaagctggagtatttcctgtcgactggtaacctcgtcagtcccacgggtctcgatttacaacaggtgtctggttacacagtcatggcggaaaagatcaacttttaccgattcatcagtcacttccgaatgattcacagaggtagtttcttcgcacagctgaaaacaactactgttcgtaagctgcttcccgaaagctggggcttcctttgtcccgttcacactcctgatggagcaccctgtgggttgctaaaccatcttgctcacaagtgcttgatcgccacaagcgatgtcaacgtctctcatctaccaaagctgttggtgcagctcggtgtacgatctgagtcgtccgttgccttggaagacagcgtgacggtacagctggatggcaggatcgtacgatactgctcacccaagcaggcccgtatgattgcggataccgttcggcactggaatgtctcaggtacacacaacatcacacgagaattggagattgggtatgttcgcaactcagatgggtggccaataccctggtatctacatgttctctcaagccgccagaatgtacagacctgtcaagtacctacctctcgacaagcttga

SEQ ID NO: 17646 - DNA, 561 bp, A.fumigatus
tcaagacaaacagagaaggaggcacggagtgcccaaattctctcaaaaatggctccttcagcgactgataccaattggtccgtcgattttgacaccattcggcggcaccagctattcaagaaccccccgaaggaccacaccgcatttccctcgttggcggctgctattcggccccatctcgactctttcaacgcgcttttcgagggcagcaaagtcatcgaagcaggtttgaaagatatcggcatcaagacgtttttggatggtgatgctgagacccccgaggagaggagagcacggaaagcggagggacgacgacccccgaaacgcaacaggcttaatgttcgaatcagggaaatctttctagagaaaccggccattcccgcaacaaataaatttgctactcgtaaccggaatatctacccttcagaagccagagagagacatgctacgtaccgtgggaagctgcgcgcgaggctcgagtatcaggttaataatggagactggatggagtctatcagagaacttgggcaggtgcccatcatgctgagggtaagtggttga

SEQ ID NO: 17647 - DNA, 1935 bp, A.fumigatus
ttgcggataccgttcggcactggaatgtctcaggtacacacaacatcacacgagaattggagattgggtatgttcgcaactcagatgggtggccaataccctggtatctacatgttctctcaagccgccagaatgtacagacctgtcaagtacctacctctcgacaagcttgactacgtcggtcccttcgaacagccatttatggagattgcatgcttacccgacgatcttgtggcgggcgtgtccacacacattgagtacacaccaacgaacatcctgtccatcgtcgccaatatgacacctttctcagactataaccagtcgccccgtaacatgtaccagtgccagatgagcaagcagacgatgggtacacccggcacagcgatcgaataccgtacggacaacaagctgtacagattgcagaccggtcagacgcctattgtacgacctccgctgtacaatgcttatggattagacaacttcccgaacggcacgaacgcagtcgtggcaattatctcgtatacaggttacgacatggatgacgccatgattatcaacaagtcgtcgcacgagcgtggcttcggctacggtactatttacaagaccaagattcactctcttgacgataaggactcgcggcgcagcaagtccagacgcgagattaccaagctctttggtttcgctcccggcggagagattcgggcagagtggcgtactactctcgacgaggacggtctccctcatgtgggtgccagagtcaaggagggaagtctaattgctgcatggcatactgtgcgctatgatgctgcttctgactcttacgtgaacgttgacggcatcacgcacttcgtaaagtacaaagacgcagaagaaggatacattgacagcatccggatcatgggtgccgagactggtttggagccgtgccaggcattgagcgtcaagtaccgtatccccagaaaacctgttatcggtgacaaattctcttctcgtcacggacagaaaggtgtctgctcccagctctggcctgcggttgacatgccgttctccgagagcggtatccagccagatttgatcatcaaccctcacgctttcccttcccgtaagttcacgtttgcgggcttttcccaattgcatttcaagcgacatgagactaatttcattgcaggtatgaccatcgcccaaatgatcgaatccatggctggcaaggccggagctctgcacggccatcctcaagactccactcccttccaattctcggaagaaaacaccgcggcagactatttcggccagcagctgcgcaaggccggctacaactactacggcaacgagcccctttacagcggtatcacaggcaaggaattcgccgccgacatcttcatcggcgtggttcactaccagcgtctccgacacatggtcaacgacaagttccaggtccgaacaactggccccgtcaaccagctgaccggccagcccgtcaagggtcgtgcaaagggaggtggtatccgtgtcggagagatggagcgcgactcgctcatcgctcacggtgctgccttcatccttcaggaccgtctgatgaactgctccgactcccagcgcgcctggatctgccgcgactgcggctccttcctctccacccaggtcgccgtctcatccgccggctccagtaaggcccgcctggccgcttccgccgcggctgccgccaagaacgccttcgcccagcagagcggtgcgccgggcattgtgcgctgccgacgctgtgcccgcgaggctgtcttcgaggactcccgtgccgtggtgtgggaggacggagacggccgtcgctacgtgggcggtgacaatgtcaccatcgtcgctgttccgggtgtcctgcgctaccttgatgtcgaactcgccgcgatgggtatcagaatgaagttctgggttgataattaa

SEQ ID NO: 17648 - DNA, 276 bp, A.fumigatus
gaaatagaagagaaggaaactgtctggtcgcttgaaagcgaaataaagcataccgcgagcacccgcaacagcgacgatttccccgcattctgcagtccgatcatcgtgacatccatctccgtcgccctatattcgcaacatacatttacccctcttagcaagccggagcattcaatgtctttgcggggggccgagccgggagagctatggccgacagggcgaatacgtttgaaaccacggcccacttaccaaaacatcctcaggagccagtcatag

SEQ ID NO: 17649 - DNA, 336 bp, A.fumigatus
actgctccgactcccagcgcgcctggatctgccgcgactgcggctccttcctctccacccaggtcgccgtctcatccgccggctccagtaaggcccgcctggccgcttccgccgcggctgccgccaagaacgccttcgcccagcagagcggtgcgccgggcattgtgcgctgccgacgctgtgcccgcgaggctgtcttcgaggactcccgtgccgtggtgtgggaggacggagacggccgtcgctacgtgggcggtgacaatgtcaccatcgtcgctgttccgggtgtcctgcgctaccttgatgtcgaactcgccgcgatgggtatcagaatga

SEQ ID NO: 17650 - DNA, 390 bp, A.fumigatus
tcgtcgattggtatgtcttgttccccacaatgtaacaaggccttgctaatttggtcagggatgttcatcatggtaatacctgcaaatatcggactcaagtatggcatctcatcatgcataggcaacggtattcagaaagcattttacgatgaccccaatgttctctacatctcccttcatgtttatcaagacggaaagttttatcccggaggggacgagggcgactgggaccactgcggggccgacgctggtattggaaagtatgcatatccggagatctgcagaagcgagctctgtgcgctgattccccgtctaggaatgtcaacatcccctggcctagccaaggtatgggcgatggcgactacatgtatgctttccagcaggttgtga

SEQ ID NO: 17651 - DNA, 237 bp, A.fumigatus
ggtggttacaattttagatcaatttctaagtctgccctagcggtcacaaaaacactcatgggagatccacctgaccgcctacactcgacacttccttcagatctggcaacttctactgtgaggcgtgtcatgatgatccagtctcgctattggcgctgtatgtacccgaaagtgccgcaggagcagggtctttggactgataggttgcacggtaaggcaaaccagtatcagatctag

SEQ ID NO: 17652 - DNA, 255 bp, A.fumigatus
tctgctttcactctgaatattactgacggtttgttattagacatcctcggctacactgaggacgatgttgtctccagcgacctgaacggtgatgaacgctcctccatcttcgatgccaaggctggtatctccctcaaccccaacttcgtcaagctcgtcgcctggtacgacaacgagtggggttactctcgccgtgttgtcgaccttatcggtaagtttaccttcggcctagtgctcaggtctgccgtgtactga

SEQ ID NO: 17653 - DNA, 747 bp, A.fumigatus
aaagaccataacatcatcctcctaatggctatggagcaggatggtgacactctgatgggagaggcaggcccccatctccccagcggtagtgcttcacatggccatcctaccagcaaccccagcatgccagcaattccagggaatctcaacgggggaactgaaccttggcttgccccaccgcttctggggcagtctatgaatctgcctctgcctgctctattgggcgaccagcatgcggctgcacctgttgctcaagcacaacccacagtgccatcaagtgctccggaacagtcagctggacttagtgctgctgtcactgaccccgccaaaagagcagacagcatcgttgaggaaacgtcagactggtccgaggaggatttaggggcgcgtgtagggcttcctcttgcgtctctaccgtcagggctctgctatgatgtccagatgcgctaccattgtgaggtgcgaccaactgcagatgtccatcctgaggatccacggagaatctattacatctacaaggagctatgccgagcagggctcgttgatgaccccgaatcttcaagaccgcttgtcgcacgacctctcaaacgtattcatgctcgcaatgccactgaggctgaaatctctctcattcacaccccggatcattttgcctttgttgaaagtacaaaaggtaaaagggaatgcaatgggcctaggtttctcccgacatcaagttctaaccattatcacagacatgtccgatga

SEQ ID NO: 17654 - DNA, 219 bp, A.fumigatus
gcagttgcgtccggctttgatgccgctgctggtgatgagcttggaggctgctttgtgacgccctcttgctacgctcatatgacacatatgcttatgactctcgctcatggcaaagttgctgtgtgtcttgaggtcagtactacagtctatctcaatttgattaacgctgaacaaattagggtggttacaattttagatcaatttctaagtctgccctag

SEQ ID NO: 17655 - DNA, 696 bp, A.fumigatus
gcctacatgctcaaatacgacaccacccacggccagttcaagggtaccattgagacctacgaccagggtctgattgtcaacggcaagaagattcgcttctatgctgagaaggatccctctcagatcccctggtctgagaccggcgctgcctacatcgtcgagtctactggtgttttcaccaccaaggagaaggcctccgctcacttgaagggtggtgccaagaaggtcatcatctccgctccttctgctgatgcccccatgttcgtcatgggtgtcaacaacaccacctacacctccgacatccaggtcctctccaacgcctcttgcaccaccaactgccttgcacccctggccaaggtcatcaacgacaagttcggcattgttgagggtctcatgaccaccgtccactcctacaccgccacccagaaggtcgtcgatgctccctccaacaaggactggagaggtggtcgtactgctgcccagaacatcattcccagctcgactggtgctgctaaggccgtcggcaaggtcattccttctctcaacggcaagctcaccggtatggccatgcgtgttcctacctccaacgtctccgttgtcgacctcacttgccgcctcgagaagggtgcttcctacgacgagatcaagcaggccatcaaggctgcctccgaggagggcgagctcaagagtacgtga

SEQ ID NO: 17656 - DNA, 654 bp, A.fumigatus
ggcttcctcttgcgtctctaccgtcagggctctgctatgatgtccagatgcgctaccattgtgaggtgcgaccaactgcagatgtccatcctgaggatccacggagaatctattacatctacaaggagctatgccgagcagggctcgttgatgaccccgaatcttcaagaccgcttgtcgcacgacctctcaaacgtattcatgctcgcaatgccactgaggctgaaatctctctcattcacaccccggatcattttgcctttgttgaaagtacaaaaggtaaaagggaatgcaatgggcctaggtttctcccgacatcaagttctaaccattatcacagacatgtccgatgatgaactcattgctttggagcatacgcgtgattcgatctatttcaacaagctgacatttgcttcttccctcttatcagctggaggagcgattgagacatgtctagctgtagccactcgcaaggttaagaatgccctagctgttattcggccgccggggcaccatgcagaacacgacaagactatggggttttgtctgttcaacaatgtttccattgcggcgcgtgtctgtcagaataaactcggagaaagctgcagaaaaattctgatcgtcgattggtatgtcttgttccccacaatgtaa

SEQ ID NO: 17657 - DNA, 285 bp, A.fumigatus
ccccaatgttctctacatctcccttcatgtttatcaagacggaaagttttatcccggaggggacgagggcgactgggaccactgcggggccgacgctggtattggaaagtatgcatatccggagatctgcagaagcgagctctgtgcgctgattccccgtctaggaatgtcaacatcccctggcctagccaaggtatgggcgatggcgactacatgtatgctttccagcaggttgtgatgcccattgcgcaggagttcaatcctgacctggtcatcggtgagtaa

SEQ ID NO: 17658 - DNA, 255 bp, A.fumigatus
caaagagcaggcctgaaatcatgggcttgcctcatccagtcaccaacaagctcgaggcccataactgctggctggtatgtgcgatggtcgttaggctcaacagcgtatgctaacaagggcaaggctgattgcatgaagaactatatcggatgggccgtcgggaaaggctacgctgtcattgatgtcaatattcccaaacacgtgacaatagagcctgtaagtatcatggacttttcctatgatgttcctcgctga

SEQ ID NO: 17659 - DNA, 309 bp, A.fumigatus
cctcgaactgacagattcgcgcagaactcacttgtctttgtgtcccacatgcatggtgtctggaccaatgtggaaacacggcgtaagccgtccaaacgctacggacacctgatccaatcgcccaaggccggactcagtgagatgctgatgcatcataaagacgaggttttcaagtggatcgaggaaagagctgatgaggctgaaagtgaggaggaggaggaggaggaggagaccaagagcaagagtaaaagcaagagccggtcaccgaccaaggagaagccagttgatcttcctcctgggcctggatga

SEQ ID NO: 17660 - DNA, 300 bp, A.fumigatus
acatgcacttcaccactcccctccctcggcctcgcggccctcattcccctggcctcagccgtcggctatgccgtcttgaccacctattgcgacgctccatttctacctctggttctttcggcggctccgtccggccctaaccataccatcccagccggggccagttcctcctccggaggccctggccccctctatccccgcgtttccggcggtctctgtgctctactattacccgtctccgacctccggcctccttcaatgtgctccccccaagcttccactaccgcctattaccccccc

SEQ ID NO: 17661 - DNA, 741 bp, A.fumigatus
aagcagatcagtagttcacgtactcttgagctcgccctcctcggaggcagccttgatggcctgcttgatctcgtcgtaggaagcacccttctcgaggcggcaagtgaggtcgacaacggagacgttggaggtaggaacacgcatggccataccggtgagcttgccgttgagagaaggaatgaccttgccgacggccttagcagcaccagtcgagctgggaatgatgttctgggcagcagtacgaccacctctccagtccttgttggagggagcatcgacgaccttctgggtggcggtgtaggagtggacggtggtcatgagaccctcaacaatgccgaacttgtcgttgatgaccttggccaggggtgcaaggcagttggtggtgcaagaggcgttggagaggacctggatgtcggaggtgtaggtggtgttgttgacacccatgacgaacatgggggcatcagcagaaggagcggagatgatgaccttcttggcaccacccttcaagtgagcggaggccttctccttggtggtgaaaacaccagtagactcgacgatgtaggcagcgccggtctcagaccaggggatctgagagggatccttctcagcatagaagcgaatcttcttgccgttgacaatcagaccctggtcgtaggtctcaatggtacccttgaactggccgtgggtggtgtcgtatttgagcatgtaggcctaaagtatcgtgttctgtcagtctcttag

SEQ ID NO: 17662 - DNA, 222 bp, A.fumigatus
gaagcacccttctcgaggcggcaagtgaggtcgacaacggagacgttggaggtaggaacacgcatggccataccggtgagcttgccgttgagagaaggaatgaccttgccgacggccttagcagcaccagtcgagctgggaatgatgttctgggcagcagtacgaccacctctccagtccttgttggagggagcatcgacgaccttctgggtggcggtgtag

SEQ ID NO: 17663 - DNA, 336 bp, A.fumigatus
gatagaagaggtgcaggcagaagtcacaactatcaaggggtattcggatttcctcgagggtctactctgttcgtgtcaatgatcttgtctgttaacacaatctcgttgtctgactatggtgcaggcgtcctctgcgctatcccatacggtttcttggcagatcgatacggacgcagacaagccattcgtcttaccattcctggatttctcctgaatgcaatcatcactaattctgtactgtggttctctgatatcttccctccccgggctatctggcttgcagcgctgagctggactattgggggaggaccaattgtcgcaatggcactgctatgg

SEQ ID NO: 17664 - DNA, 1194 bp, A.fumigatus
tgctatctttttcccactcagaagtccgtccttgtgattgacactcacaccatggacaagaatcaacgcgttgtcatcatcggcgcaggcgtcttcggcctctccaccgccctcaatctcacccaggatggcttcaccgcgatcacagtgctggatagacacatgccgcccgtccccgacgggtccagcaacgatatttcccgcgtgatcagattcgactacggggatcctgtctacgcacagctaggcaaggaagcgtacgagctgtggaacaccagccccgagtatgcggattcgttccaccgcacgccgtgcgtctggacggcgcagcggactggtccggctggtcttgttcaagccgggggctcggactttatccggaagacgaaggagatcctgacaaggatgggggccgagtggcatggcttggcggatgcggcggagttgaacgcgcgcttccccgctgtcagtgggacgccgattggggagggattcgaaggattctacaacaatgcggcgggatgggcggatgcaggtgttgcgatggcgggcctacgcgatcggtgtattgctgctggggtatcgtttgtgacgggtcctcatggccaggtgacggagctggagaagagctcggacgggaggatcacagcagtcaagacggctgatgggggacggatcacagcagacaagtttatcctggcgacgggtgcttggacggctagcctgatcccctcatggaattcaatggtggcgacagcgcagattgtgggctttgtgcggcttacgccgcaggaggtcagggcgctgaaggacctgcctatcatcttcaatctctcgacgggattctttagcttccctccgcacgaaaagacgggatacctcaaggtcgcctgccacagttttggatacacactgtcgtcaagccagcaaatatcctcaccacccagtcaggctatctccgcgcgcgcaaacttcatccccgaggaaggtaggcagagactgcttgcaggtctcaaggagatcttgccgcagctggtagaaagagggttcgagaagacatgcctgtgctggtataatgagacgccgacgggcgactttatcttcgattatcatcctgaccatcccaatctgttcatcgctaccggcgggactggacagtatgtaccccaccgaatccttaccctgagaaactaa

SEQ ID NO: 17665 - DNA, 453 bp, A.fumigatus
tgggtataccagctgctcactctatataaagcacaacctgtcgtctactcgtcaaacattctccatcatccagtttctctcttagtttctctcttcaatttcatcaaaacctcagcaccgcctgatctcattgccaatatgcagctctcttgccttctggccctccttggagcttcaaggattgcctgggccgcccctgtcgcaaacaataatcaagtcgagtcagcctccggcgatcttgaagaacgcttcttctacaccaattacgaccttgaaaagcgtgacgaagagctcgacaagcggttcttctacaccaattacgaccttgacaagcgtgacgaagagctcgacaagcggttcttctacaccaattacgaccttgacaagcgtgacgaagagctcgacaagcggttcttctacactcattacgaccttgagaagcgtgatgagtga

SEQ ID NO: 17666 - DNA, 546 bp, A.fumigatus
cataacagtgtgaaaaagagctgtaatattttggaacacgatggtctttcatacaagtatagagccttccgtgaacgacaaatctgtatcttcaatccttccgcaccccgacgcacccccacgcccgcccccacgcccacatactcccatgctgccccacaccatcccgcgatctgccccccccgcccccccgccccccgccccccccccccccccccccgccccccccccacacccgactcaccctcatggcccctacggaccgcctccccgcccccccgcccccccccccgccccccccccgcccccctactccccccacgtctgcccccctactcatcacacctaactaatgccctgcgccgtgatgcgcatgcatatcgcccagaccttcctgcatatgatgctgacccagcttctcacccaactccgtctcttgctttttccacggcgcaggccatacaaaagcgtcttttggaacgggcattcggtcaaatttgtccggatcaacagcattgctgtgttgccagtcgagcagcgcattga

SEQ ID NO: 17667 - DNA, 288 bp, A.fumigatus
ccctctagggtgctgtttctattcattttatgtttcttttacttcatggtcggttctgatgtctcctgtcaaccaggattgactcgtggccagttaatactttgccttgctattgccctgtcagtcgctcaatcccatggatgcgagttttgccgacgcggctttctgtttcgacatgtcctgcgttttaaccagagactgtctttatatcaggttgaattcaactctgtcgctctctacttttttcagcgtagctctatcccgctcgtagcaggtgactatctttag

SEQ ID NO: 17668 - DNA, 1581 bp, A.fumigatus
ccgagcttctccattgatcgttggcgtgcatgcagattgcttatgtctgaacaagcgatttccgcgaccccggctccggatggacgaccggattctcagtgggatattcatgacgatcagttaaaatcgattcaacagcaagcgacatcgtcagggaccgtatcatcggtgtcggcgcataatgacccctcagcaacacatgaggctccacgtcagggcgatgagttaggtaagaggaaggagattcctcaagatgaagctccaacttctacgtttgagtcgccaaacataacatcggagaaagtcgctccagcttgctcaaaatctacatccgaaccccaggggacgttgtcagcgcgtgtgaaaggattgtcggtctcgacgaaaataacagaaaccggctcgttagaagacagcgatgtgccgccgcctcccccagaaaaagatgaatcttatcttagtacgaaatcccagcttgcaccgccgctgcagaaatcagtgaatgcgacttctgaattgagcgagaaagagctaccggatgtaccaagtcccggacaggcggaagataaacgggatgctagcatggatggtactcgagaggatgactctgaatccgagattcagagcatcatgggtcagtttcaggaccctgaacgcaggggcagccaggagcagttgatgtctcctcgtttggagctggctgagcaattccttggaggccagggtcacttcccgccgcgtcattcaagtctttcaaagtcagcagagggtggcactcaggcagcacaggcgaatgcaagtgcacaatcttcggctgacgataagccaccggttcctatttcgaagagcgctcaaagagcttacgaagattatccagcactaactcgacgatcttctacgtcaactgttcctccgcctccgccagaacctgagcccgatcagccgttcgatttccatcgttttctggagcagctcaggcaccgcactgcagatcctgtggccaagtttctccgctcattccttcatgagtttggcaaaagacagtggatggtacatgagcaagtgaagatcattagtgacttcttgacctttattacccataagatggccatgtgcgaggtttggagggatgtttccgacagcgaatttgataacgcgaaagagggtatggagaagctagtcatgaatcgactgtattcacagaccttctcccctgctataccggctcctccctcaatcccaagaagtgcaagcagaagcagacgaagagaaatggaacgacttcatgggccatggaggcgtggccagcaccaggaagacgtcgaacgtgatgatgtattggcgcaaaagatgcggatttacggttgggtgaaagagcagcatcttgacataccgcctgtgggcgctcacggacgtcggtttctgaacctggcgcagcagggtaggtctcgatgtccgtttatgctgggactttttctgacactgaacgaagagcttctgaagatcaatggctaccgtgcaccacgcgataaggtgatttgcatattgaattgttgcaaagttatcttcggtgagcagtag

SEQ ID NO: 17669 - DNA, 312 bp, A.fumigatus
ggtgcaccactgacgctgatgtctcctgcagggttgctcaaaaactcaaaacaagctgatacatcagcggattcatttgtacctcttttaatctacgtcgtgctacaagctcgccctgatcatctggtttccaatatccagtacattcttcgcttccgaaatcaagataagttaggaggagaggcggggtactacctatcttcattggtatgtcaatcaacattatttgctgataatgcatgcaacgtgactgattccataaacagtccggtgctatccaatttatcgagaccctggatcggaccagcctga

SEQ ID NO: 17670 - DNA, 204 bp, A.fumigatus
gattcatctttttctgggggaggcggcggcacatcgctgtcttctaacgagccggtttctgttattttcgtcgagaccgacaatcctttcacacgcgctgacaacgtcccctggggttcggatgtagattttgagcaagctggagcgactttctccgatgttatgtttggcgactcaaacgtagaagttggagcttcatcttga

SEQ ID NO: 17671 - DNA, 876 bp, A.fumigatus
cgtatttgcagccactgtgctgcaatgtgcggcatttatttctctttgagcaccaatgggtcagtgctcccaaatgaggagacttgcagtctactgcgcaaccggggacccgacagctaccaagttcatacaagaaaacaggaattgtatgtgagtcgtacggaccagtcaggggtcactgctactctcacattcatctccacggtgctttcattgagaggagatcatgtccatgctcaaccactcgtggattcgtctacgcaatccgtgctgtgctggaatggcgaggcctggaagatagctggcgaaccgatccaagacaatgatactgagtccatttttcagtcgttactgcgtgctagccattcatcgttggacgctgttgatcgtggatatcccctacagaaagtattgagtgtcataagtaacatttcaggtcccttttcctttgttttctatgatgcagtgaactcaaggctatatttcagtagggactgccttggacgacggtccttgttgcggggtctagatgactctggaaatctgagaatttgcagtgtctgcgatagttcatcctcgtcacattttgaggaagttgacacaaatggagtgcattgtatcgactttgaacaagtcgtactgcagaatgctcttgcatcaggtgccgtcaaattcaatcctgacgccatccaaactcttcgctgggagcccaaagatgcaaatgcctgctgcctggtatacacgctttctcctcctcgattaacgcaatcgctgacaggacggacagaaaagtccaataccacacatgaacaaatctctcccgaatggaacgcccccgtcattgacagtcgactcttgcgccgtccaagagcttga

SEQ ID NO: 17672 - DNA, 1065 bp, A.fumigatus
caggacggacagaaaagtccaataccacacatgaacaaatctctcccgaatggaacgcccccgtcattgacagtcgactcttgcgccgtccaagagcttgagcggaggcttcgtcaatcgttacacttgagaattcagaaggtgcccgaaccaccatccattaccacaagtgatgtgaaagtcgccgttctgttctctggtggccttgattgtactctacttgccagagtgtcccatgacatacttcccaaaaatgagtcaattgatcttctcaacgttgctttcgagaacccgcgagtcgctgccgcagctgccggcaaggaaggcgccacattgtcagtctacgaaagctgtccggatcgcattacgggtcgcgcggcattcgcagaacttcagagagtctgtccagagcgcaactggcgcttcgtcgcgatagatataccttacactgagactgtcgcacaccgtgatatggtgaaacgcttgatgaggcctcacaatacagagatggacctctctatcgcgtgcgcgttgtactttgcttctcgcgcgcgaggaatggccgtaaatagtcaagattcctcgtccgaaccgactcagtacaccagcccagcgagagtacttctctccggcttgggagcagatgaactgttcgcaggctatgctcgacacggagtagcgttcgcccgcgatggtttcagaggtctcattgacgagattcatctggacgtcagtcgtctcggcaagcggaatctcggtcgcgatgatcggatcctttcaaactggggccgcgaggcgcgatgcccgttcttagatgaagacttcgtctcttacgtgctcgaagctccggtatgggagaaatgtggcttcggcgtcccagaccccccagaaaccaccggtgtggattataccggcatcgacccagagaagagagcgctgcgcctcctggccatcaagctgggcatgactactgtcgctcgggagaagaaacgagcaatccagttcggctcgaggacagcgaagatggaaaagggtagaaccaaaggaaccgatgcactgagctga

SEQ ID NO: 17673 - DNA, 195 bp, A.fumigatus
aagcaccacaaggccagacgtccacttttgcacacactcctgaagtctttcattgggcatatgtcctccggcgaaataagtcatgaaaccgcctgtgctgattgtgtccaacgacagactgtcctgactaactattacacgcaactagcatttgctacggctacgcagaaccaacacatgcaaaattctcagtag

SEQ ID NO: 17674 - DNA, 744 bp, A.fumigatus
tcgactaaagcggggatgattccatgccgtataattaacctggaatcggccctgtcttgcacccaacactgtccattcgcaaggttgttatgctcatcaaagactagcaccatggctcctgctgcaattgatccccgcattgtcgacgtcgcagagcctagaaaggagacccttcctctccctcccaacgctcgggaaaggctcgaaaaggccggcatcgatctctcagcggggtatccataccggcctgcacggccactctacgtggatgatgtctacaacatccggaactatgatcgccctcacatcgacccgggaacccgcgccgatcccgagaagaaggctctgctgtcggcagcaaaggaggtcatacacctcaccaagcacattggaaccgagatcgtggggctgcaactcaaggacctgaacgacaaacaaaaagacgagttgggcctcctgattgcggaacggagcgttgtcttcttccgagaccaggacatctccccacagcagcagaaggagctgggcgaatggtttggtgaggtcgaggtccatgtacgtcgttgcatcatctctgccaaattgctaggacactggactaattcttgttcagccgcaagtaccacaggtgcctggagtccccggtgtaactgtattgtggccggcactgcaggcagcagaaaccccggctgcgttccgccggccgggaggcgcttcccgctggcatacagatcttgtacatga

SEQ ID NO: 17675 - DNA, 570 bp, A.fumigatus
gacactggactaattcttgttcagccgcaagtaccacaggtgcctggagtccccggtgtaactgtattgtggccggcactgcaggcagcagaaaccccggctgcgttccgccggccgggaggcgcttcccgctggcatacagatcttgtacatgagcgacagccagcgggtgtcacccatcttcacaatgatacggtgcccagcattggaggggacacattatgggcaagcggttacgctgcttacgagaagttatcaccatcgttccgtcaatttatcgacggcaagacagccatttatcgctcggcccatccttatttggaccgcaagcatccggagaaggggcccgtatatgtggagcgagagcaccctcttgtcagagttcacccggcaacggggtggaagactctttgggtgaaccgagccatgacagttcggattgtaggcctggacaaagcacagaatgatgtcatccttggatatctgtgcgatgtctatgagaagaacattgacattcaagttcgcttcaagtggacaccaaagacaagcgctttgtgggataacaggtaa

SEQ ID NO: 17676 - DNA, 201 bp, A.fumigatus
agatgcactctctgtttgtgcggctacctcgatagatgtgtctccaaattttctgactttgctactctacactctatgggcttggcaaggttgtcaaggacaattttctcagagacgggcgacgctaccgttcccgttgcacctcatggtacgagggtgatctatgagttttcgatagattaccagtcggcaggaaattga

SEQ ID NO: 17677 - DNA, 882 bp, A.fumigatus
aacatgcgcgacatcggtgccaacgccgactccgcggacagtcccagcactcccttgaagagccccaggcccttgtccaaccctctccaagaccaggccctgccctcggtcgaatgtacttcttcctgcagcccctcatcggcaggccgattgaccccggtatcctccgtagatgactcgctcgaccaccaggtcgaacgaagctccctgacgcccaacacccagtctctctttcagaatttgcgcctgagcgaagccatgagacatccgaatcacagttcccagacggatcctagtagtggcccgagagaatctgggttgacccctcactcccatcacacgacctacagggacctctacaatgccactcctagtccaggaggtgcttctttcacagaaccgagccaacaacggcagccaccgacgccatcatctccactggctgcagtgggcagctctcgttctcagaacctgcatccagcagactcgggggatacggcagccacggatgcagatcgcgacaacgagcctgaaccgcacgaggactccctgcagaacaataacagggagagcaacaacaataacgaggatttcctctacaatatccgccaggaggaacttcccccggtgccaatctacgatattcggctccaaattgcactccggagggtgagaggcaagctcgtcgacctcgcgcaagtgatgaatcggcgcgagttggcacaagaccccaccaccacctttcataagctgtacaacgagacgctcgaggcgagcaggttcgcgtatcctgcgacgcggacggttggattcatcggtgactcgggaatgggtaagctttgcctagcgtccagggggcgcgaaggagacgaacggggctaa

SEQ ID NO: 17678 - DNA, 300 bp, A.fumigatus
cagctggtggttgtgggagaccagagcaccggcaagagctcggtgctccaggccataaccgaggtatcctttccggtcaaggacaccatgtgcactcgttttccaatccagatctccttcagacagacgtccgtttcaaatcaatacccagtcaaggccactattgttccggggcgactgtccgagaatgacgaggcgcttgtgcttcgcgcacaagactttatcatcgaaagggaagagctgacttcggaagtgatggaagagatcatcgagcaggtatgtgagattgaagaaatataa

SEQ ID NO: 17679 - DNA, 222 bp, A.fumigatus
aagatccgtggcttttcagctgactggttctcatcctttctcgactttgtagcactctctgataacggcatattcacgaatggtgttgacagcctattcaagcataacctgcagccgtgcaaacgccatcagagtagatatcaccagcctttgcgtaggtatccaagtccattctatgtgtctatgctgactgaaacagactcggtacagtggatttcatga

SEQ ID NO: 17680 - DNA, 1353 bp, A.fumigatus
atggtcaagctcctgcagaatgatttgcctactgtccctcatctcgaccacggctggttcggattgcggaatagaatccccgccgaagcccacatcacagacgccgaacgcgacgaacgagagataaaggagttcgcccagccggcttgggagggagtggggaaagacaggacaggcatacactcgttgatcaagtacgtcgacaaggagcggcgggcccaaattcagtcaggcctgccccagatcatcgcggaaattcgtcggaaacttcacgattgcgagtccgacctgggcagaatgggagaggcccgtgatagccccaaagcccagcgatacttcatcttccaattctgcaatgaaatgcagaagatggccaatgcgagtttgataggccaataccatgacataccctccgaggatccgcggatcatgctccgataccgagtgcaacgtcgtcttgatcggttctatgaagagatggtggatttagataacatgcccattctcttttcgagctaccagcacgacctggaaatactcagctcgatgaatccggaagagtgggaagacaaggtcatgaacgcccccggtatatattccgagatatacaaggaagccaagatcagcgaggggcgcagcctccccgggagcattcaccccgatgtggaggagaggatgttccgcaagctgaccacccattgggagaggatcgctcgaagctttgtggaagacgtgaaggacctcgtaaaggactgccacgatgtccttgcgaggatagccatacccaatagcaaagtgcggcttgaagtgagtcgcgttgttgcgaagacgctggaagagtggaaccgagatgcagatgcggctctcttggaactcatcaaggataaccaagcccggccgctcgtcactcgccatcccctgctgatctcggagacgatagcggcagataaacaacgcggcgaaatcttgctcgggaagaagtcgacaatggcaccgaatggggagagtgaggggacccccaacaccatccgcgggggccatcaacaacggtttatctcgactttgctgagccaggtgctttttgtccgtgcaaggctggagtcgtactacaaaattgcgctgtaccgattcattgacaatgtcgcgatgcaagttgtcgagcggcatgtgctgggaccgaaatgccccatgctcactgtctctgtcaagacctttgcaaacttgaatgacgaggaactgaatagcgtggccggggaagacgaaacagatattcgtattcgcgccaggctggaaaggcagcggtctcgatatgtgcaggcgttggaaaagtgggagagattgagagcactttag

SEQ ID NO: 17681 - DNA, 189 bp, A.fumigatus
tatttaaaatatatgttatgtacctatcagggttatttatataaaaaggatttttatactaaaaaggagtgggatttacttaaaagagctgaaaagaagattgcttctaaactttctataactaataataaattagaacttttataccctgagcttcgacagctgcaagagtatttagagaagatttag

SEQ ID NO: 17682 - DNA, 924 bp, A.fumigatus
  unsure (10),(52): Identity of nucleotide sequences at the above locations are unknown.
gagatagtanctgcacaaggaagttatccatccgaaggattgcccgttcatnttagaagtccgcggctcaaagctggcgagcaacttctctatgcgatgttgaggaacatccgcatctgcgaaacagaaggacttagttccgagttgcatctcaaccaagacggaaaggatatcatggtggaaatcagccagagtgagctccatttccacgaatgtgaatcagggcttacaatctacgtaccgcgtgacgaacaagcgcagtatctgtgctttttggacaggattccccaagctctgatggaatggattatgactgagccatcgaccggtatctgcgagccatccaccgataaggctctagacgttctatcaaaggtgctacaggcagagccaaagtacacgagcatgacccttgaccgagctggtattatgtcggtcgagacgccagaagaaatggcagctggccaggtcgccgaaaataccgaggatgagcttactgaacggcataccgaaggacatgactcgatcgacgatgctccctcgaccggggcctttattagatcggctcgcagcgaatcatctgtcaccctaactgacgaattcgcctctggcccctatgccagaccctccagtccttcacgaggattgagctggacaccacttactccacgtggtgtgcctagtgacgcaagctacttatcccggggatctgctcaaccaattgacgtggcctatgctgccattcttcgccgtgttgttactgccgctagaacaactacattcccaagtaaaggggcttttaacatgacagccttaagcgactctctaggccctggcaacgaacccttccagctgcgcgccatcgataagctttcccgagataagctcatcggcgcagcgggagaactattcgtaagtagctga

SEQ ID NO: 17683 - DNA, 315 bp, A.fumigatus
gtcttcgaaacactgtgttgtctcaccccgtcccttcctcatttcggccgtgataactggcaaagcaccattcggaaccatgtcaaactccacgacgattacaccgaccttgagccttggaatggtcgagagacggctgacatcacctactccgacaggcaagggattctcactgccttactcattaataaggggtatttagatgccacatgggccggagcgagaccggattattttctagaagtcaagactacgacgtcctcttgggagaccccgttctacatgagcaagtatcaatatgaaagggtgtgttag

SEQ ID NO: 17684 - DNA, 276 bp, A.fumigatus
  unsure (240),(251): Identity of nucleotide sequences at the above locations are unknown.
atgcgaatcaacgatactgcagaagaagaagaggacaaggggaaagttttgaccccattgatgaaaatggtggcctattcttggggcggtgacgagggtctgccgtggctccggaaatacggtgaggtgcagcgctcgtctgtcgacaacagtgtctatctgaacaatccttgcgaagaggacccgatattccttggcacgggccacttaacaattattgaccggtccaataacctaagncagggggcacnatgcaagctgcttgccccacaataa

SEQ ID NO: 17685 - DNA, 489 bp, A.fumigatus
gtattgcaggtatacgtccatccgactccttcctccaaggacaatatccctggctttatcgctctgctccaacaaaaaccagctcctactccgagcagcgatattgcatcaacaaatagcgctaagaccaccgccgacctctcttcatacctccttgcctgggtccctgagtcctccctcggcgacgcctacagtacctatgtcaaagtcgatttgtctggtgactcttcacccccgaaacaacgatatctggtaccaccgctcccgactacaactacatataaagatcctataggtttatatgctttcgcggtaccgctatccgaaatttattcgctgctagtgcgacctcctagcttgggttggtggtttggtagcctggtgatcaacacccgggctggtgatagtttcccggcgctgttcttccatgatagtgaatgcgaatcaacgatactgcagaagaagaagaggacaaggggaaagttttga

SEQ ID NO: 17686 - DNA, 717 bp, A.fumigatus
ctcacagttttacaacgagtccagtctcttcatgcagcccatcaggtaacgaatggagttgaccttccttggggtcatcaaagttgttgtcctttaaatgcttcaacggctcccccacgctgtggggttgaccacagaagaaatagctggagaattaccatggaggctctgaccccgcctacactaacacttgtaacactgttgactgccttcttcttcctatatcgagcctggctccgtgcggtatacccgaagacgcccctcataggacgatctgagttattccttcacgtcccagaagccgacaacacgcaagctgtctccaaggaatcggattttcctgagaactggctgaatagcaatgatatctttgaactcgaacggcgcgcggtgttcagcaaggtaagcccgaacagacatgctcagggttcgaaattcacacctcctaacccttgtggatcacagtcatggctgtatctttctcaccgcagccagttcacgaaacctggcgattatcagtccttcgaagtggccggctttcccatcttcctcatcctgggcaaagatggtgaaattagaactttccacaatgtttgtcggcatagagcgtacacggtagccgaattaagagcgaggaagttctaccggtctcggatgtcgctaccatggctggagctacaacacgaaaggcgagcttatcaaagcccctcattttga

SEQ ID NO: 17687 - DNA, 456 bp, A.fumigatus
cggggaccaaatagggtcgatggttatcaggaatgcctacattgtcaatatacacatccctcgttctctgtttattatccccctacgttctataccgtcaacaatcaccagaacttctcccagcatatcgctgatcccaagaaaccggacgacggactgtttctgtatttcttccctatctgcactctcaatgtttatggcggaggcatgtcctcgttccgtgtctgtccggctgaggatccaagccagacaaggatggaatttgactattaccacagcgagtcggggaataaatttgaggagtattaccaattcgttcgacaggtcgcgatggaggactatgagctttgcgagaaaacgcaaggtaatttggagaagggagtatacaccgaaggcatcctgaatccacagaaagagaacggagtctcatgtgagtataatattgatgcccgctaa

SEQ ID NO: 17688 - DNA, 321 bp, A.fumigatus
gagcgaggaagttctaccggtctcggatgtcgctaccatggctggagctacaacacgaaaggcgagcttatcaaagcccctcattttgaacaaatacttggtttcgataaatcacagaatggtttgtttgctattcatgttcagcagagcaccgacggcttcatcttcgtaaatctcgaagccgatgcgccaggggagctgctggagaccgaccgtctggtggacttcgtgaaatgtaatgggcctatacctcagtcacggtggattgggggcagggctatcgaaggcgtgttcaattggaaaatggctagtaagttctga

SEQ ID NO: 17689 - DNA, 282 bp, A.fumigatus
acgcaaggggctaattttaacaggaaattcgagcattcgagtacgttcgggctcgttgcctcgggttcgtcgaatgcgatttggacccgagacgatgatctcactggtactgtgcgtcgcacaggtgctggaagggccattgtcggtgccggtgaggaggttctctgctgggatgtcaaaaaaggcgacttacttggacggtggcgtgacacatcctgcaaggcgcaggtgactgtgatcactcagagtaaggccgatgaggacgttttcgctgtcgggtag

SEQ ID NO: 17690 - DNA, 2745 bp, A.fumigatus
ggacgttttcgctgtcgggtaggtcttcctcccttatcagagatgggacaattaccttcttggtgcttacatccagaattggttttatttaggtacgatgatggaagtattcgtatctgggactcgagaacagagacagtgatcatttcgttcaacggccacaaatcggccgtcactcagctcgccttcgatgctgccggtgtgcgcgtcgctagcggctcgaaggacacagatatcatcgtgtgggacttgctagcggaagttggacttttcaagctgcgtggacacaccgaccaagtcacttcgctccattttctcaacctgtcttccgaattgctacacgccgctggactgagcgaacacgcgggatttctgctcactaccggcaaggactccttaatcaagatctgggatctgtctacgcagcactgtatcgagacacatgtggcccaatcgaacggcgagtgctggagcttgggcctctcccccgaccaaagcggctgcatcactgcaggaaacgatggagaactcaaggtttggtcgattgatgaaagcgctatgctcgagatctcgcgagagaaagttggttctgaagggcgcaaaattctgacagacagagggacgttttatcggaacggcaaggatcgaacgattggtatcagctttcacccgcgtgctgactatatcgggttccacggctcggagaaggcaatagaaatttggcgcattcgttcagcgacggaggtacagaagagcttggccaggaagcgtaagagaagaaaggagaaagaagcccagcgggaaggggcggtggcagaagttgataatgagaaggtcgacgatgtttcgtctgcgccggtcactgaagtctttgttcctcacgtcattgttcgcactggcggcaaggtccgttccttcgactggattcgaacaaaaactacgggcaacctccagcttctggcttcgactacgaacaaccagctggaatcgtacagcgtcaccactgcgaataaaaagaaggatgatgatggctccgactacaatcgcaacctggctgttgacatcccgggtcaccgtaccgacatcagatctattgccctgagttccgacgaccgaatgctggcttctgcctccaacggcagcttgaagatttggaacgttcgtacgcagagctgtctgcgtacattggaatgcggctattccctgtgctctgcctttctccctggtgacaagatcgttgtagtcggtaataagaacggcgaactggaagtttttgacattgcatcctcgactctgctggatacgatcaaggcgcacgatggaccagtctggtctctgcacgtccatcccgatggcaaatcgatggtcagtggtagtgctgacaagtccgcgaagttctggaacttccaggttgtccaggaagaaatacccggcaccaaacgaactacaccacgcctcaaactggtacatacaagaaccctcaaagttgcggatgacattctcagtctccgcttctcacctgacgctcggttgcttgcagtcgccctcttagacaacaccgtcaaggtcttcttcaccgactctctaaagctcttcctcaatctttacggccacaagcttcctgtcctcaatatggacatttcctatgacagcaagctcattgttacttgttccgcggacaagacagtccgactatggggtctggactttggtgattgccacaaagcattcctcgcccatgaggacagtatcatggctgtcgctttcgttccaaccaacaaggagggcaacggccacaacttcttcagcgcgagcaaggaccgtgtcatcaagtactgggatggtgacaaatttgagcacatccagaaactccaaggccatcacggtgaaatttgggctctgactgtcagccattccggcgaattcatcgtcagcgctagccatgacaagagcattcgtatttggcaacagacagatgaacagctcttcctggaagaagagcgcgagaaagagctcgaagagatgtacgataacactctgacagcgtctctagagcaggacgaggatgcagacggcgagaaggccgaggcagtcgatgctgggaagcagaccactgaaacgctcatggccggtgaaaagatcatggaagctctagatttgggcatggcagacctcgaggtgatgcggcaatggcgcgccgtcaaagccagccagccaaacgcggcgccaccggctcgcaaccctctctacatggcactgggtaacatctcagccgagcaacatgtgcttagtgtggtccagaaggtccctgctgctgcattgcaggatgctttgctcgttctgccgttctccaaagtccctgcgcttttcactttcctcaatatatgggccaaccggggctggaatatccctctcacgtgccgtgttctgttcttcatgctgaagacgcaccatcgtcagattattgccagtaagatgatgcgacctatgctggatagtatccggtcaactctgcgtcgagtccttacccgtcaaaaggacgagatgggggtcaaccttttttgccttgcagaacttaggccaacaaggggcgggaaggcagcccccaggactacgtcgatgaggaaacgtgggaaccaggaacccccacaggtggcgggtaccggccagaaaccgggcatttggcccaaatggcttcttagggcttggtcttaccagcatgatttttttttttcgggggcataa

SEQ ID NO: 17691 - DNA, 771 bp, A.fumigatus
ctaattggcttttctgctggttgcaatagaggtgcgcctgtttcaattgaccaagttgtctccgactttgacggagtgacgttccacctgtcgacaccggaatcgaagaccaagatccttatctccatccacgtgaaatgcttcaaagaactagttcaatacggtgcccaagaggtattggaaagagaatatggtccttatatcgtcacaccagagcctggctatgacttctcggtacagattgacttggagaatctgcccgcagaacaggaagctcgagacgagctcatcatgcgacttgcgttgctgaagcgtaacgccatggctgctccgttcgaaagggcattcgacgaatttgcgaagttgtcagaagaggcatccaggtatacgtcggagtccgcaccccaaggagtcaaggaaggtggggagttgatggcaattcattaccgggaagaggaagcaatctacatcaaggccagtcatgaccgtgtcacagtgatctttagcactgttttccgcgaagagacggatcgtatctttggcaaggtcttcttacaggagtttgtcgacgcgagaagacgagtggtgacgttgcagaatgcgccgcaagtgctcttccgcagcgaccctcccctggaacttcagggggtacctggtctgcagacagctggggacggtaaaatgagttatgtcactttcggtaagcaaacctcgttgcatatgctgcgagccttgattgacagctcacagtccttttccctcgacacctga

SEQ ID NO: 17692 - DNA, 198 bp, A.fumigatus
ggaacaaagacttcagtgaccggcgcagacgaaacatcgtcgaccttctcattatcaacttctgccaccgccccttcccgctgggcttctttctcctttcttctcttacgcttcctggccaagctcttctgtacctccgtcgctgaacgaatgcgccaaatttctattgccttctccgagccgtggaacccgatatag

SEQ ID NO: 17693 - DNA, 654 bp, A.fumigatus
caactctcttttactctcaggcgcataactgtcagcgttattcgaccggaccaggccgactctgacatcatttcccttgaagtcggcggggatatgacggtcgagcttctcaaagctatcgttgagagcgaaacttccatacccacaaataatcagcgccttgtatataataatcaactacttggaaatgatgcgcagactttggaacagattggtattggggaaggcgacatgctaggcgttcatgttacaatgcggagccctcaggcacctgctcgcagcatcggaggaggccccagtgcagcggctcagcaaaaccttcagcggcggcaaccgatgacccccgaccccgagacaatccggctacatatcctgggtgaccctcgcgtgcgagaggctgtccgacggcagaaccccgagctggcagatgctgccaccgacgcgcagcgcttccgtgatgtcttgatggcgcagcaacgccgggaagctcaaatggaagcagaaaaggaggcgcgcattgccatgctgaatgcagatcctttcaatccggagaatcagagggagatcgaggagatcattcgacagaatgcagtgaccgaaaatcttcacactgccatggagcatcatcccgaatgtaagtggcagcggatctga

SEQ ID NO: 17694 - DNA, 708 bp, A.fumigatus
  unsure (524),(542): Identity of nucleotide sequences at the above locations are unknown.
gggttgccaccaaagactaacaagcgcgcagcatttggtcgcgtgaccatgctgtacatccctgttgaggtcaacggccacaaggtcaatgcgtttgtcgactccggagcgcaagtcacgatcatgtctcccgagtgcgcgaccgcgtgcaacataatgcgactggtggaccgacggtatgggggaattgcaaagggtgtaggaacagcgaccattctgggacgggtacactccgcgcagatcaagattggaagcatgtttttaccctgctccttcacggtgatggaagggaagcacatcgatctcctccttgggttggatatgttgaagcgacatcaggcttgcattgacctgaagaagggtgccctggtcattcaggatgaagccgtgccgttccttggcgaggccgatatccccaaggagctgcaggagggtttcgaagacgaacccctcttcaaggtgccgatgggcgccgaagtcggcgctcgaacgggtgcagtcacacaccaggccagcggatccgngacatcagcggctgctcngtcatcgtcgacacctaggaccaacatccgccctgcgccgtcctcccgttggccgcaggactcgattgcgaaaatcaccgagctcggattcactcgggaggaggccgtccgagcattggatgcagccaatggggatctcgatggagcgattggttttttgatttga

SEQ ID NO: 17695 - DNA, 615 bp, A.fumigatus
aatcggatcaccaatatcacaatgccgtcaccaacaccctccccctcaatctggagccggaagcgcgacctggtctacctcatcttcttcgtcatccacatcccaaccatcttcagtaagtgcagccacagtcgaatacaatatagaaatatagctaattgcaaagcagtggtcgacgccgttcccctccttccgaccgccctccaaacagacctcgcgcaccaaatccgcgccttctacgtctcctcctacaacgacaagttcttcgccgagccccctcccccctggttcaccgcgttcatcgcaatggagctcttctaccacgccccgctgagtctctgggccattcccgctttgatccgcgacaacgctatggtcccggtgcatctgctggcgttcggcgtgcaagcgttcgtgacgagtttggcgtgtttggtgcaagtgtggagttgggaggatcggacggttgcgcagaagaggagtatcacaatgctttatgggccttatgttgcgttaggttggtatcctatcttactttgcttgtgtttttgggattttggatgggcgctgacgggtgtgtctaggggcgtttatggcgctggatatggtctttag

SEQ ID NO: 17696 - DNA, 366 bp, A.fumigatus
caggcggccctctgcctggcaccagggttcttaaaggcaggccttgacccgcctgaccagttctttttcgatttctcgtgtccctataccagtgacgatctgcgaatgaacatggcgatgcacgacccccatgagaaaaatggccccgatgccgttgagtcgcgtgtccagactgacttccccgttgaacgatttggaggcaacggtagtcccggtgtgaggcggatcgaggtgatctcatcgcagttcaatttggtccatcgcattatcttcttcttcggtgtcttccttatcgcctatgtctatggtttggatggaacaattcggtatacttatcaggtattttgtcttacacatgcatcttga

SEQ ID NO: 17697 - DNA, 258 bp, A.fumigatus
ggtggtcacctgaccgcgtgtgatttcgtgtctgttctgcctctcggtctctctggaggcgcgaacttatcgtggagctccaacgatcaaactgtcgctcagctactccaccatatccttaccccaagtgaagcgatagaatcggatcaccaatatcacaatgccgtcaccaacaccctccccctcaatctggagccggaagcgcgacctggtctacctcatcttcttcgtcatccacatcccaaccatcttcagtaa

SEQ ID NO: 17698 - DNA, 297 bp, A.fumigatus
ctcgacgtttacatgcctagtattcgtgtagcgtggcagaagcaggtgaacagtctcgatgaacttgaggctagcctagtactcagaacatatcagttcagcatcttcaacctcaagaattatattttctatttgctgagccattccttcatgctctccttgcgcttcttgttacctagcttcctgaatcggtccacaagcgctatcgtccaggacaagtcacccggctggggcttatctcgcagtttgatcatcccctgcctctgtgagatatccaggttcaggatacaacgctga

SEQ ID NO: 17699 - DNA, 252 bp, A.fumigatus
aagactccagaggaagcaaacataggcaccacagcagaagacttgaaaatggccgctgaacttcctcccttgctgaaggcttctctggagcaaacgaaagtctcctatcgtcagctaggcaagagtggcctacgcgtttcggtgcccattctcggtggcatgagcattggctctccggaatggggatcatggattcttgacgaggagaaggtgagtccatgtacagtcaagtttgatcatgaaatagattga

SEQ ID NO: 17700 - DNA, 372 bp, A.fumigatus
cttaactctgatgaatcatcgactcatgagacatcccaacagtggggtcctctcgacggtggtaagcttgcacgtccgctctcacaagtccgagggaccacccgctcggagaacaccgacccgaacgcagtgaccaaggcagatgagatgaccatctccagagtggaggagttggccaagaacaagggctggacaatgggtcaagtggctttagcctgggtcaaaaagcgtgtggccagtccgattgtgggtttcagctctgttgagcgaatggacgaaatgattcaagtcgcagaccggatcttgacgactgacgaggagagattcttggaggagccatacgtgcctaagccaattggtggtcatgactag

SEQ ID NO: 17701 - DNA, 525 bp, A.fumigatus
atgactcgattccgttgggttgcatgccatactgaccctgcaggtctatcccgccaagccatcttcaacgcagtcaacgcctcgctgaaacgcctgggtaccgactacattgatctccttcaaatccaccgctttgatcccctcactcccatcgaggagaccatggaagttctaaatgatctggtccgaagcgggaaggttcggtacatcggcgcgagctcgatgaggacgtaccagttcatcatgatgcagcactgcgcagaaaagcatgggtggacaaagttcgtctccatgcagaatcagtacagtcttctctatcgcgaggaggagcgggagatgaatcgcttctgtaatgagacaggcgttggtctgattcctgtaagtaccgatgacttaactctgatgaatcatcgactcatgagacatcccaacagtggggtcctctcgacggtggtaagcttgcacgtccgctctcacaagtccgagggaccacccgctcggagaacaccgacccgaacgcagtga

SEQ ID NO: 17702 - DNA, 213 bp, A.fumigatus
gttgaacagtgggacaccgcgaacaactattctaacggcaaatcggaagaaatcattggcaaggccatcaaacattacaatcttcctcggcataaaatcctcattcttacaaaatgttggtcacctgtcagtgaacatgacaaccattatgttgttccgttcgccgacaacatgcggcaggacaaggaatacgtcaatcaattcggtaaatga

SEQ ID NO: 17703 - DNA, 495 bp, A.fumigatus
acttttgataaaaaatttcaggaagcggaatcaacgcctttcaccgtatcaactccaccgacagacatcacgatggggaaagccgcacgaggcaagcgcaatgcgccctccagctctccgtatcagaagcccggtgcgccactctccaaagcagcttctgcgatatttaagttcaatacggacatcggccagcacatcttgaaaaaccccacaatcgccgatgccatcgtcgacaaggccaacgttcagcccagccagacggtactcgaagtcggtccgggtacgggtatcctgacgacgcgaattcttgagaaagcgaaaaaggtcattgctgtcgaactggatccccgaatggcagcggaagttacaaagacggttcaggggacgcctgcggagaagaaacttcaggttattctgggcgatttcgtcaagacagatctctccaagctgcctcccttccagatctgcatcagtaacactccttatcaggtatga

SEQ ID NO: 17704 - DNA, 783 bp, A.fumigatus
acgctgacgagtccgccacagatttcctccccgctcattttcaagctcctttccatgcctaatcccccaaagacctgcattctcatggttcaacgtgaatttgcccttcggttgattgcccgtcctggagactcgttatattcacgactatcagtcaacgcacagtttttctctcgaatctcgcacattatgaaagtcggcaagaataacttccgaccccctccacaagtcgagtctagcgtggtccggattgagcccaaggcggaccgaccgaacatcagctgggatgaatgggatggtatgctccgcatctgctttgtacgaaagaacaagaccctgcgcgcaggtttcatggccacgaaagtgcgtgcgctgattgagcgcaactggatcacttgggtctccatgcatccagagaaggttactcaggcggacattgatttcctccagggcaaggatgtttctgccctacaaagtgttgatgaggatatggatatggaccaggatggcgatgaggcggttcagggaggtgacgacgaggatgatatcttcatggatctgggaggggagaccgaggccccagttactacgagcaaggggtcgctggtggcaatcggtgaccaacaggtccctcgggctatggtgacgaaactggttcaagcgaagatccaacgagttttggagcaaaccaatttggcgaacgctcgtgcccagaagtgtgatgagaacaacttcctccgccttctacatggattcaatactgaaggtattcacttttcttga

SEQ ID NO: 17705 - DNA, 402 bp, A.fumigatus
acaagacggccgtgggagaaagctccagccccggcaattacccataatcgaacaagccccctctcctacccaggccgaacagtcaccctgtcgtgggacgctcccgggccaagggtgtgggtccgaacaacagctacatcacgaacacaactgcgggatcccccgagttacgtcctgtgggcttcgcagttgaacgtcacctactcgacactaaccaccagtggcaattcaagctatggaaccaccactcagcctgacctgtcgacatatgccggcgacccagcgctcaatggtaccatctttatcgcaatcacggacactgatcttttcgtgactccgttcaatatcagcagcatcaatcctcatatagttgccggcccggctctttaccaagctggctaa

SEQ ID NO: 17706 - DNA, 1140 bp, A.fumigatus
catctcaattaccttctggatgtcaggaggatatcgccctttttaaccatcactatgaattggagacactttctgctgatcaatgtgctgggtgggctaccttacaccttcgcaggccctaatgtgaggagagccgacggccctagttcagagccacctattttgagccacacgacctcgttaccgcactcttcctataccgcgacccccacgaccagtggagccgagcgcgccagctccgttggttctgggatctcgactttggggccggctccaggagctaccagctatccaagcgatggaaagctccatgacctccagccggctccttttacgccggcaggcggcgttgggacgaacggcacaactcctatctccaacgcaaaaagcgactttgattatgaatcactggtaggtttctatcgattagctgggagaacagtagctgaccgctgccaggcccttgtgctctaccaagagtacattgagctggacctgttccatgatggtctggctcggttctctgtagcggaatttactgccgctggtctcacggcagaagaccgattcttgattgaattcatggctgaccaggaggctggacatgcaacaatgctgaccaacatcctgggtgatcaggctcctagacaatgtgtctacaattatccttatgccaccgtccatgagttcatcgacttgtgccaaaagctcacccgctttggagaagctggtgtttacggcttcttgcctcacttggattcacgagaggcagctggcctcttgacccagactgtcaccacagaggctcgtcagcagatgatcttccgccagtttgaaggtctcttcccaatgcctgtgtggttcgaggttggggtgcctcagtcctgggcatggacactgttggctccgtatatcagctactgtcctgccaaccagacgagactggcatggcagaacttcccgtcattgtatatcgagaaccagccacatccttaccgggtcaatggatcgtcttcggttaatgaaacacttgcacatggtggtatgaacactttggctagccggaacgtgaccgggcccgagtcatgtctgaacaagacggccgtgggagaaagctccagccccggcaattacccataa

SEQ ID NO: 17707 - DNA, 2937 bp, A.fumigatus
agcagtatcggtgagtggaactggttgaacaggaaatccgaccgaacgaataaatctcactgggtgcagcgtgtagtgtgctcgatttctcgtgctcataccgtccatgtcacgatggaggacgtccgaccgaccgcaaaatgggcaaatcgcattttgcgcccgttgacgtccatttatcatcgactagaaaagcaccatgagattgtctcatcgatcgcacaatcaaaatggaaagaacggccagagaacgccgacaccgagcaggcgaaaccccggacagtccccagtaccgaagcgagttgccaattctcagacgaagaaccggacgatcctgcgtgggtgcctggaaagcgggaaaagcgccgcatacgacacaattattcgagtcgagggcagaggaatgggggtcgacggcgcagtaggctgttgatccgcagcccggagttgcagcgcaccctgcctggcgcgatcgaaattgcgacgcctttgatcaccggtaaagcgcgacaggtgtgcgagggattatcgattcggaaacgcttatttagcgtggacgcacctgcggcggcttctgagagtcatgaggggggcactggtcggcgaaagacgacacgcacgaaaaatagcagttttccggcttaccaaggttcttggaaagaagttctcgacttgtcaggtgatgcagggtttgcggatattgcgcacttgttggatcgtatctttttgaagtttttgtatactacccggacaaatgcgccaggttcgcagcagcaaggccagggagctcgctctctggtatcaatgatcgcacggcgccttccggagtttattgcgtatgagcaaagattccaagacgagaccgacgaggactgtgaggtggacatgtgcgatgcatattttacggaattagaggcttactacgcgccgaatgggaatggctgggagcctcttcgtgaagccgtgcgcgcgcaaggcgttcacttggttgtacggatgattgagaatggatggcttacgaaattggtggcttgccgacttatggacgaatgcatgcggcatggcgaagctgatgcttttgaaatgattatctcaagtactttgtcgactatcaactcataccactatccagctacatttgatccacaaaggccgtcgactcattgcgacgaccctgtatatatgttacggacctattactcgcggtgcggcgggcgagcttttgtgtacaacgagctatcaaagctccttctgcgaagagtggtaccaccagaatggatggtgactacgtggtggaagaagtgtgtggacgaagcgatcagatcagtgtcgaccgaagataccgactcagctacagcaacgcatctaatcgaagccattcttctatcggctgggggcattgaccaatccacggaaagaacagccttgcttgaaaaggacctgaatcaaaggaaaatactgcgcttgaaagacagtcgtgcgtcagccgtgacaagtccgctgccgaatgacttgacaccatgtccgataccagttcaagatgctctgagcaatctcgtctcgagccttgttaccgcgctctgcggtatgcacattgcgcgatcgaatgcttcagatgcgcctgaaagacgtgttgggctcaaagccagacatacaatcaattgcctagcgttgacagtggagacggatattggattacggcatcgacaagccattgatgatgcgccatcctaccaaactttgcgccgcggatatctcttgctgggcaactacatgcttcaaattggcgaagaaacgcccgtcaccatgaggcctcgatgcgatcccgtttccaagcagcgcatcgactccttcttcgagtcactagcgctgcagcaagatatgctcaaagaattttcggacctcgttcaaagagtatcccgctactgcgggcaaggtgacttgcgcgagcagaggcgaacgtctgtggcagttcggactaagatctctcagctggctcggcaggcaggtgtccgcgggttatcatattttcttggaaaagtggcagcggagacggcaatggcgcttgcacacaagaccttggatccggacgaccatgtctgggccgttcagatccaagagagcgtcgtttcggcgcagcaggggcaacgcgtcaatgcggacttctcggacgaacctgaagagcgagacgaccgtacaggactctaccgatgggaggaaagtattggggaatggatcgcaagcactcccaaacctaaagccggacaaacgaattggaaccaaagtccggtgatttcagatgcagggagagcttcagtcatttcttgctcggatagcagtgagtcagttgcctccgccgcttctgagcgcagtgcctccagtgtcacatcgtcggctccatcccttccggccaagaggacatattcaggcgatgagcttgtctcacggcccatcaagaagctgcggtcacgaaccgtggagatctacgctgatgaagcacaagatcagactggcggagcagaaagccaaccggcttgttttacgtcactatattactcgtcgcctgaagcacgctgtgtcccgggagccgcccataccaggagcgcgcggggcgcgcttggggaattagtgcaagctaaaaacgtcccgaatcgggcactcgttgggaaactgaagtcggcgaatccatctcccaagttggaggttgtcatcatcaataggaagaactcttcctcactggatgaaccaattgaccagaccaccgatcatgcactcaagacttgcagtcttccacctcgaccaccacgcctccccatcatttcgaagccagcaaatcctaagtggcgcccaagctctcgtatcaacgctgtttcacgcttgaatgtcataccttgctcccaggatgatgatagtgaggatgaactaagcttcctttga

SEQ ID NO: 17708 - DNA, 753 bp, A.fumigatus
ttgtcacggggcgcactttggggtgttgattctgcggacaccattttggcttacgtctacgtcagtcttttggagcacgcttccggcaacaccaagaatgccgttgtttatatcaagcacgccatggatctgtggaagattatatacggatccaaccaccctgactccattaccaccatgaacaacgccgcagtgatgctgcagcacctcaagcagtactctgattctcggaagtggttcgaggcttccctggccgtttgcgagtcgctctttggcaagcagtctatcaacaccgctaccatcctgttccagttggcgcaggctctggctctcgaccaggactcgaagggtgctgtcggcaaaatgcgggatgcctacaacatcttcctgaaccagcttgggcccaacgatcgcaataccaaggaagccgagacttggcttgagcagctcacccagaatgccgtttccatcgccaaacacgccaaggacatccaggctcgccgccttcgccgcatcaatatgaaccctcgcgtgaccacccttggcaccaaggtccaaccccaggttggccaaacagctcccgaggcttcgggcgccaagggtgctgctaacgcttctatggactcgcgcagcattgatgagttgctcaagttcattgagggaggtgacgctacctcttcgcgctccaagcagaagaagcgtgctgcggcaagcaaccccaagctgcggggctccaagaagtcttctgcttga

SEQ ID NO: 17709 - DNA, 747 bp, A.fumigatus
gttagaattgaaagtctttccaagagccagcaagaaaccttctctacctcagttgaactcgccctaaccactccaagtcgggtccaacaaggtattgacagcttgggtgagatggctttatggcgttcattagcgacttcaacttcgcgtctttttcgtccatcgctgcgctccaattcgtgctttcggcgtcccctggcgacaccgccctcagcaggtccgaatgactaccgctctcgactccgcaggttgaatgatcgtcttccgccgtttttacgctcctatacaaccccgttactgggggcccctgggacacatataacgtcctttttgatactacacgagattacagccattgtccctttgctcgggctggtcgcttcgttccattacggcgattggttgccggatttcacctcaaaaagcggcttcgacgaaggagtccaacgattcggtcgctggctgcgaaagaaaggttgggtggaggatgctgacgtggatattgtgaactccgacggatctgcttcgggcaatgactctactactggatcgcccggtcaatctcaattgagaccggaagacagaaaaggcgtgcgtcttgtgcttgagttcgcgactgcctacgcaatcacgaaagctctactacccgtaaggatagtcgttagtgcatgggcaacgccatggtttgcgagatctgttctcgctccggtaggcaggggcgtcggggctcttcttggaaaaaagtag

SEQ ID NO: 17710 - DNA, 498 bp, A.fumigatus
tttctccaaaaggatttagcaactggccaaagttttttcagttattcaggtcacccccacgcattttgcggcaggtatctttgggcgcgaatttcttcaccattcattcttggggaggcctcggatgcaggattagcttggattttaaccttccaagcccagtccacagtgaagacgattgtatgcgtacctcgacctctagcattagacctgtggtcaacgtcgttaaaagtagacacggcacctctgaacacatcctgtgagtgctacacatgcaatagccaccaccgcgcttacatcctccatctactatccgcaaagaaaatgctcgcatggacattactccagatccataaccaccacatcatggacaagttcttctccgctatcagaacgagtatcgagcgaggaaccttcctcacagatgccgacatgttccaccggttttacgccccagaactaccagagaaaaccggcgagggccccaggtgcgtataa

SEQ ID NO: 17711 - DNA, 228 bp, A.fumigatus
cgcggaatcaacggacacatcatctctcgcttcgagaaccgtgggtatgtaatttctgggactcaatggctattgcttgcgctaattgtgcatagcttcaagctcgttgccatgaagctggtctctcctcctcagtcccagcttgagcagcactacgccgacctctccgacaagcccttcttcaagggtcttgtttcctgtgagcttcccttccacatgagaaactga

SEQ ID NO: 17712 - DNA, 225 bp, A.fumigatus
cgagcatatgctaatggcacgataatagccatcctcggtgccaccaaccctcttgcctccgctcccggcaccatccgtggtgacttcgctatcgtaagctcaattgagacctcactgtcatggtttgtcgctgacattgcattaggacgtcggccgcaacgtctgccacggttccgacagcgtcgagaacgccaagaaggagattgccctctggttcaagcctga

SEQ ID NO: 17713 - DNA, 300 bp, A.fumigatus
gctgtaaatggacgtcatcaacctctcgttgggctgaccatctatggtcggcattcgggcgtctttccgtctccgttaataggaggggggcaagtccttcactcccgtatgcgctggctcaagttctcctccatcaacttcaaagatccccgttatttttctcaccacagaggagaagttcgggtcaagatggaaaagatcacagacaagattgcggcattgccgccaaacgaaaattacttttctctcgagttcttccctcccaagacgcagatggtggggtatccccgcactttctga

SEQ ID NO: 17714 - DNA, 1527 bp, A.fumigatus
ggcttttccaatctacaggctcgtttagagcgcatgtcacaagcactacgtcccttgttcgttaccgtcacttggggagccggtggaagcacggccgctaggtcgctggagcttgcagaaatctgccagcgtcagttgcagttaacaacatgccttcatctaacatgcacaaatatgagtcgagccttgatcgatgaggccttggaagaggctaaggttctcggaattcgaaacatcctggcgcttcgtggcgacccgccacgcagtgaagagtacaacacgcacggagaagatgatagcaacaaggacttcacattcgcggtggacctggtacgatatattcgcaagatgtacggtgattacttctgcctgggcgttgctgcgtaccccgaggggcacccggtcgattcttaccaggatgtacaggatccagtgagggatctaccatacctggttgagaagaccctggccggtgcggacttcatcatgactcagttgacatacgacattgacgcctacacaaagtttgagcaaatgctacgaaaccacgagtccggtgctttcaaaaccatcccaatcatccctgggttgatgcctatccacagctataagattctgacaagaacaacgaaactgagtcatgtcaagattcccccacagatcatgtcgaaactggaagcagtgaaacatgatgatgatgcggtgaagcgcatcggcgtggatgttctcagtgatttggttgaggctatcaagaagataccctgcccaggatttaggggctttcacttctacacattgaaccttgaaaagacagtttctttcatcatcgaacgatgtggtttgatacctgactatccagaagacagcggtgctgttgtggacgacgactacactactgctcccaccggagctcagcatcgttctctatcccggcgcagggcttcgtccgttaactcactcccacataaccgtgtcattgtcgacaggttgcaggtgccctcagatgggtcatcgagagcatcgacacatgaggcgcccgccgctagcgccggaatgcctgcgatgcccccagatcgcaacacaacgctccagatttcggaaggtcagggagcgctcggcagagaagcgacgtgggacgacttccctaacggtcgttggggtgacgctcgctcgccggcttttggagagattgatgggtacggcccttcactccacgtttcgggcgctgtcgcacggcgcatctggggctatcctgtgtcccgcgaagacataagtgcactgttccgtcgccatgtctctggcgacctctatatcgttccctggtctgaaggcggagcggaagagaatagcagtggcttgaacgctgagacagaagtcatccgacccgagttactaaaactcattgacggcaaacgctggtggactcctggcatcccaaccggctgtccatggcgtccgaagcgacgatccaacctttggatggggtccgccaggagaaggattcgtcttccaggagccattcgttga

SEQ ID NO: 17715 - DNA, 588 bp, A.fumigatus
aactcattgacggcaaacgctggtggactcctggcatcccaaccggctgtccatggcgtccgaagcgacgatccaacctttggatggggtccgccaggagaaggattcgtcttccaggagccattcgttgaattcttctgtcctagcaaagacttccggacagtgctcaaaccactctttgcgaagcacggccatgagaagctcgcatggtttgcaaccaacgtgaaaggcgaattcgagtcctctcttcccgctgaccctgcccatgccgataccattgagatgaatcccaacaacgtcaacgctgtgacgtggggtgtcttccgcggcaaggagatagtcactccaaccatcattgaagaagtcagctttagggcctggggcgaagaggcgttccgtatctgggatgagtggcgccgcgtctatccccgcggcactccgaccgagcgcctccttgaagaagtcaagaacgacgtttggcttgtgtgtgtcgtgggccaggactttggagccgggacggaaaacgggtcggaagaagaacagcaggagaccaagtggatgtggaatgtgttaatcaacagccagtga

SEQ ID NO: 17716 - DNA, 450 bp, A.fumigatus
aattcgacaaagacagatgaaaccagcttggcatcacctgcacgatgcttagcctggagctcttcgatttccgggctaagccgctcaatctctgacctggcccagtttatcgtatcgactttctttccgataaggaatttcaggcggtgcgtgggtctctccgaaggtttgacccagcgagctgccacagagcccgattcgtcatctggctcgtcagacaagttctcaagtggcacagcatcatcctcggcatttccctctttcttcatggccttggctcgcgcagcatttgcaagcttaatcagtttcgtttcggcggcttccaatttcatggcggcagcatcccgttccttgaccttatcctctagctccttgacgtcggtagcgatccaaacgttcttcaccttttcaatgccgaacattttccgaatcttgtcacggttgagatag

SEQ ID NO: 17717 - DNA, 471 bp, A.fumigatus
gatgaggacccccaaaatgcatccaactcggcttctagcttggtgtccactttggttcctgcactagtggtagctggcattatggtcttggtcttcgtgattctgcggcgaagtgaacgtcgcatgtacatgccccgaacctatctcggctttttgcgccctgaggaacgcagtccccccgtcggcactggcctgtggaattggattatcgatatgtacaagttacccgacgaatacgttttgcaacatcattctatggacgcctatcttctgcttcgcttcctgaagttgatctcggtcatttgctttgtcggctgcttgataacctggcccatattgtttcctgtcaatgccacaggtggagctcacaaagagcaattggatatcttgaccatgtccaacattgcacaggacaataacgctcgctactatgcccacgccttcgttgcttggatcttcgtcggtcagtaa

SEQ ID NO: 17718 - DNA, 648 bp, A.fumigatus
ctggcaggatttgtgttcatgactgtcacccgcgagggcattttctacatcaatctgcgccaggcgtattccctctctcccgcctacgccagccgactctcatcgcgaacggttcttttcacagccgtgactgacgactatctcaaccgtgacaagattcggaaaatgttcggcattgaaaaggtgaagaacgtttggatcgctaccgacgtcaaggagctagaggataaggtcaaggaacgggatgctgccgccatgaaattggaagccgccgaaacgaaactgattaagcttgcaaatgctgcgcgagccaaggccatgaagaaagagggaaatgccgaggatgatgctgtgccacttgagaacttgtctgacgagccagatgacgaatcgggctctgtggcagctcgctgggtcaaaccttcggagagacccacgcaccgcctgaaattccttatcggaaagaaagtcgatacgataaactgggccaggtcagagattgagcggcttagcccggaaatcgaagagctccaggctaagcatcgtgcaggtgatgccaagctggtttcatctgtctttgtcgaattctacactcaagcggacgcgcaacttgcgttccagtcgggtatgtcaggcgtcggattttga

SEQ ID NO: 17719 - DNA, 384 bp, A.fumigatus
  unsure (236): Identity of nucleotide sequences at the above locations are unknown.
cagatgtggtcagtcgctcataatctacctctgcacatggcccctcgttacattggtctagaccctacacaggtcatctggtcgaacttgcgtatcaaatggtgggagcgcatcatccgttactctgccacaattggacttgtctgcgctctcatcatcttctgggctatcccagtcgcggttgttggttctatctcgaacatcgattctctaactgacaaggtcccctttcttanattcatcgaccatgtccccagctggatcaagggtgtcatcactggtcttttgcctactgttttgatgtctgtgctcatggccctattgcccattttcctgcgatgtaagccgagtcttccccaagccaacgtgacagagctatactga

SEQ ID NO: 17720 - DNA, 459 bp, A.fumigatus
tggtgcgttgcagtgatggccaagctcggtggcgcccccagcgcggcggctgttgagctgactacacagaatttctactttgcttttcaggtcgttcaagtcttcctggttgtgaccttagcttcctcggcggcaagcgtggtcaccaagatcatccaggaccctacttccgccccccagctcctcgcaacgagaatccccaaggtttccaacttctacatttcctatatcgttctgcagggtctttctttcagttccggtgccctgcttcagatcaccggcctgatcttgggcaagattctgggcaaattgctggacactaccccgcggaagatgtacaaccgctggtcgtccctcgctggtttgggctggggaactgtttatcctcccttgaccctccttgcagtcatcggtaatgcttcgtacttattggtaatcatattagtaccctgcagctaa

SEQ ID NO: 17721 - DNA, 654 bp, A.fumigatus
cgatgtcgtcccattgggaatagctgtcacctactcgtgtatcgctccgctggtgcttggtttcgcgaccattggtctgtacttgttttatttccccttaccgggtacaatatgctttacgtgtcaaatgccgatatagacactcagggcaaggcttacgctcgtgccctgcaacacattactgtgggctgttatttgcttgtggtctgcttgatcggcttatttgccatcggaactgcggccaaccggatggcactgggccccttgatcttgatgattatcttccttgtcttgatgattctttaccacatttctttacataacgctctctctcctttgattaactatcttcccaagaacctggaggctgaggagcagagtcttcttgcctccaacccaatcaagcacggcgatactgttggcgaacacccggacgacattaccgcgacgaacgcagggaagaatggggatggcggtttcccggatgttgacgctgccgagaaaggcctgaccaccacccctgccacccccgagaagaaacctaatctgatcgtgaagtggttccgtcccgacaaatacgatggatactggcaactgcggcgccttgtccctgaggctcatgagactacacagtacccgccagaagttgaacgc

SEQ ID NO: 17722 - DNA, 306 bp, A.fumigatus
aattatctcgtgctttcgccacaaaggagtttcactgcatttaacttcggctttttgctcctcgctattttggcagtgcacactattgaaacccggaagattccaaatttcttcatcaattggcgtgcatggcatgtgcaagttgaatactccgagcttttgagtgatccgacgtccttttctttttccgacccgattaaacttcgcgacgagggctccgacgtcaagctgctgctctcgcccctcgtgccctttgagatttgggttccttggtctttcgactgttgcttgacctttatctactag

SEQ ID NO: 17723 - DNA, 774 bp, A.fumigatus
aactgccttacaaagcctggcattatatttttgtgtcctaatcagtttcagcatcgatacttgtcagcaaaggaagcaggacgcagtccgcctcgacttctaagcaggctgtaccccttcgattatcaaaatgaacccctcaattccaccatcgactgccgaatacggcggaggtatgttggaccttgtcggctatatctaaagcgatggatgctaattgcgatatgcgtacaagatgagatctcggccattgttcttgacccaggattttcaacaacgcgcgcagggtttgccggtgaagatacgccgaaatcagtgatcccgacatactatggaaagtacacctacgaggcgcaagagaaacttatctttggcgatgacatctttgtcacccctcgccctgggttgtcaattcataatccgatggggagggacggcgttgtggaacaatgggacatggcggagaaagtgtgggagtactcttttacgtcgcgcttgaccggaccaaaggctggaaatccttttcagaacggcctgaatgatgtcgccaatggcgaactgccttcggaaatggaaggtgtggaaaccgaggagaagcctcttgcggatagccccctcctcatgactgagtgcggttggaatcctacgaaagcgcgcgagaagaccgttgagatcgctatggagaagtgggggacgccagccttttacctagccagaaatggtgtgcttgcggcgtatgttttcaccattctatgcactcattcccttagctga

SEQ ID NO: 17724 - DNA, 243 bp, A.fumigatus
tttgacatcctttatccccccccctccctttcccttggcctccctgtctacttatgtggattagactttatcctcgatcgtggtaaaagtccgttcggtttcttcggttctagtggcgttttatgtgctatcaaactactattgaaaggcagcttcagccctccctcttcctttttttttttacctcactatcgtcttgtcgatagtgattgggtttctgaaattttgagctatgcaacgtaa

SEQ ID NO: 17725 - DNA, 963 bp, A.fumigatus
ccagaaatggtgtgcttgcggcgtatgttttcaccattctatgcactcattcccttagctgatcgttgtgcttacgttgctcttagcttcgctgctggtaaggcttctgctttggtcgttgacgttggcgcctcgaacatttccgtaactccggtccacgatggaatgatactgaaacgaggtgttcaacactctcccctggggggtgactacatttcatcgcaactccgtgccctgttcaagaccaactcaccacagccaatcactatcacgcctcattacctcgtcgcctctaagacagctgtcgatgctggtcagcccgcgcaagcgaagtacaagacattcccacctgacaaggcaccggatgcgtcctaccgcactctcatggaagaacggacgttgtctgagttcaaggagtgtgttgtgcaagtgtggcccggacccaacaaactctccgctaccggtccgaacggtgtctccaacgaggaggttgcgaagagtagccccggaagaccttttgagttccctgatggctataatcaggtgttcgggatcgaccggtacagggtggttgagtcattgtttgacgccaaagcggccattccagaccctgagtcggtgtttccagctccaacgcaggcgcagactgtgccggaacttatcaaagctgcgctgaatggcgttgatgtcgatgtccgcccccatctcctggcaaatgtcgtcgtcacaggcgcatcgagcttgctctatggcttcaccgatcgcttgaaccaggagcttatgcagagttatcctggacccagagtgaggatctctgcgtccggaaacacggcggagcggaagtttggttcgtgggttggaggcagcatccttgccagtttggggaccttccatcaaatgtggatttcaaagaaggaatacgatgagcatgggcccaatattgttgagaaacgctgcaagtaa

SEQ ID NO: 17726 - DNA, 249 bp, A.fumigatus
aaggcttggaagatcccgcaagtgtccaatcttatcaaaagctcaggtacaccatttctctgccgcaatctcaattgcattaacgtatctcactaccgagcggccaccaccaacaagcggccacctcacgcgtttttcgccgcgttcaaaaacctcacctatttcaaccaccaaccatgcctccaaaagcacattaaaattcaagagcttcagttgagcaagagggcagaatcttacttgctatcttag

SEQ ID NO: 17727 - DNA, 870 bp, A.fumigatus
catcgattgacttgtcgtcgacaggttctttacatcatcccggtgcccctggacgcagcgacaatcggagacgcaaccatttgttgccctttggtaataaaacgcgatggagattcaataatctgctcgatattaccaagcgcaaccacggaccggggcataatgtgcaatagtaacaagttggttagccctgccttcccagaagcgataaaatgcgccgacttcactatgcgcactcctgacctaactgcacgaagtaagtatcgccaccctcaaacgaacgaagctatgagcaaagctaatatgtatacagaaacagccccagtgaatgattcagttgtagaggacacggcgtcgaattcagacaacctgcgtaaggtcattaccaaggaaaatgccattttcactaccggttcatccgctcttcctccgttcattgatctggagaaaacacagatcatccggttcggcactggtcttgagtttcaactaccagatgaagagtcacacatgagagaggagccctccgctattgtcctgccatgcatctttggtacggagcttcaaggcccaattctactcgcgaccggaacagtcccttcgaatgttccatttcccaatgcagatgcccttcgtgactactacaagcaactcaagaatgccgtggtgatcgtcgacgaacgaatgacagataatgcccggaatctcgcatctgcctaccgaatcaatgcactcttcatcgttcgactcactccagaaacagaactcaaggataccaataatgtcatttcgttgatgaattccgcgaatataaaatgcagtgccggcactcgcaggaccccagtccttgattctggttcagatctctga

SEQ ID NO: 17728 - DNA, 318 bp, A.fumigatus
gtactgatgtcctggttttcctctcctacttgtgcggtggagcggatggagaaaggtgatttcagctcattctgtcaaactatcttgtggaatatgtctggctacctggacccagctaatctggctattactgttaccacatctgacactgcagctccagctggaaagaccaaggaagggctgactcatttgatccacgtgcatttgacctttcctcaatccattacagtgtcgagttctcaagccacaatcgtcaagacgggcaaaacccgcataatatcttataattatatacaacacaaatggattatcgattga

SEQ ID NO: 17729 - DNA, 405 bp, A.fumigatus
caacgcacagaggtatttgacgacttccaaattatgcaagcaccatcatcaacatttaaggttcctatcgtctcagaccagattacaattctagcagtttctgagcgaacacccacttactacgacttctgctttgcggatgaatcatgtaacacatgctgctggcttgcgagaaataccttcccaggtatcacccacagcggagatattctcaatggacaggatctccttgattatgtgacgatcaacaaggacaccctaacagagaaagaaatctgtgtgttcatctccggctaccggtctacgcttatcacaaggttcttgggaacataccctgctttgctagtcgccgatcatgtggataaggtatgttcagaatctggccatgtccctagcatcgattga

SEQ ID NO: 17730 - DNA, 828 bp, A.fumigatus
aatgcagtgccggcactcgcaggaccccagtccttgattctggttcagatctctgagaagtattacttctatagaggcattgccaatcgggcacacctcaatacgtcgggactagcatttggctcggatgtaaccagtgtactcgagtctgtaggcaccggctccattctcgatccgaggatagagcgagtcattaacctgggcggcgtcaattctatcgtcctcccaagtaccggtcagttagtccagccccaagatctacagaagttgttggaagatatttcaatcgaccagatccaaaacttggaagaagacatatctgcggtagttccacagctccaggtgcttctgaaccagaaagacctacaagaactctccagaagcctagtgactgcactctccgccaagatcagcaacgctgcaaccccattaagagacagctacaccagattcctaacacaggaataccgtatggaagatcccaaatccgtgcagaagaagaatcaaatgtttggcgaattgagaaaggttacaaaggacatgcaaaaggctctggagccagtgatctcatgcctggctaacatgatgtcgtctcaaacgacttcgaagcgaacgcacgatttgaagcgccttatccgccaaaccactattcagaagaatgtcgaggcagtgaagtccatgacttttgagactctcatgggatacctcgaggaatacgcaggagaaatgggtgttatgcttttgaatattgagacgacgcactatcatcagcttctaggtaacctgaaaaacagcgccattgatgccaggtatgtacaaccagcttga

SEQ ID NO: 17731 - DNA, 1545 bp, A.fumigatus
aaaacagcgccattgatgccaggtatgtacaaccagcttgaagccaatccttttgtcggcaatactcccctatcaagcctccaaaagtgtacttcgactgacactgactttttcagccaatgttgcgccctcgactcgagaatcctacacctggaaggattcgatgcaggcatcatcatggaacagtcacaagccaaacacaacggcccactcaaaagcaccctagggccctgccagcccatcctggcgctaccctgtctaagccagttatcagaaaccggatcaatgttagcctgggtctgttgggatgaatttgtcaacctgaaaagcccctatacagtgcgatggatagagaaatgcaatgaaccgcacatcgccgcgctccgaattatcatgagaagcacgcttagccaagcagtcgcgtccagagaacatgatattcagcccagtagcccagagactggccatttaatgagtgcactgttaatggccgccatgtcgaaactcgcagcgatgaggatatctaagcccgtggaactagacaaagccgaggatactgtcacaaagttaatgcgcggacttttcggtaatctcttgacaatcgctggctcaggagtccgtcccctcagcatggtctggcaacttttcggtacaaatcccctgtacgacctccccacaagttcggctgagtggatctggtacgaaaacgtcgtcgcactatacccgtatacgggctggccaccccgacaattccacgaaaatctagaaaaattcctcgacaaagccgtcatcagggtggtgactaagaatgaaaatgtagccagtatcaaagcaagtcgcatggctgagctggtcaagttctgtaaactgaggaatatccagctcgcgcattcgcgcactattattaccgtcttcatgcgcatgcttacagcagaggatattgatatccagcccgtcgcggctcagctgctcacgcagctgccacataaactggagagacagtcgcagagttacactaggatgattaggtacctgaaccatctcgccgggggaggcgaacggtgcgtccacgacgacctcaccgccgcgaacgtctacacttcccgctccgcagccttcgcggaactgaagaagcaagtctgcgaagcatgcaagaggagtgattggccacggatgaaagaagcctgccaggagataatgacgaaacatatcgagatcgcaacgctgtggcgcgtcaagcccgaatcgctgaaaatccaaaacatgaagttgtacaaagcgctgttagccgcggatttcgacagtcttgaccagaacactcaggctaagaacctccaacttacgagatatgtcttcagtgatgcggagactaaacgtgttccgtggcaggttgggaagaagggtcaattcggggatagcatcgagcctctcgatgaggtctttcttcatgagattatgaccggggaaaagtcagagccggcaccccctgctactgtgaatgaattttcaggggaagagaaaaaggccatgattgaaacggaagat

SEQ ID NO: 17732 - DNA, 804 bp, A.fumigatus
ccacccaagcccctggcacccacaaacaaggcaggcgaatacgatacaaaaatggattcacatgtctacttgggagcagccgcagagacatcgtcggttttccgactgacctcacatctaacccatggcctcactgttcttcctacgaccgtggagactgatgatgcagtgcagcgtctgcaagagtctctggctgctgctgcgcgaggtagcaagaagacggcggatggatcagcgccagttatcgaggttaaagaggaccctgaactggccaagcgacaggccgagatggcggagcgggagaaactcaaggctgcacgtcgccgtcagcagctcgcagagcgtgaactcgaccgtggtcgtcgtgtcggcttctccaaccgctcaggtggagctggtctgactgtaggtggtctagaagatgacgacggcctcctcgctacgcgaccccgagcacgcaagcctcgcaagcccaatcgtcgtggtgaaatttataccgacgacgaagaagattatgatcgtcgcggacgcacgagggaagatgagtacgacgaagacgatggcttccttgtcggcagtgacgaagagcctgaggttattgaagatgatgaggacgaagagatcctcgaggatgacgagatggatgcagaaggcgaagaggaggagactgtccctgcccagaaacccgccaaagaaaagcggccgtcaccagagcgacctgtttcggaagcaggagcatcgggaacgccaccggtaaggaagaagaatcgttacatcgttgatgatgacgatgaggacgaatga

SEQ ID NO: 17733 - DNA, 984 bp, A.fumigatus
aaaacgcagcttgtcgttcaaagcttccttgttgcacggacgcagccgcttttcgcgaatatgaatacttcaaaggcttcaaagaagcgcaaggcagttacccgtgatgtggaggaggaggcaggcgtgttttctggagacgaattgaacacaggcaaccttgacggagcgctttcggataacgcccacgacctgtcgagcgacgaggatgagagcgattcagaggtcgagctgatcgatgattttagtgatgaagaggatgaggaagaagaagacgtacttgacagtgatgagatcccgtcggatggagaggattcagccaagaaaaagtcgaacgccgcgcctggtgaacttggcgcagtgatagatgatgatgatgatgatgatgatgatgatgatgagagcccgagcgaggaagaacagttgaactaccgcattgaaaaggacgccaatgggaatgaccgcttcgtctacgacgagatcaatccggacgataattctgactattctgatgtcgacgagaatgccaacactatcggcaacattcctctctcattttacgatcagtatcctcatatcggttacgatatcaacgggaagaagattatgcgccctgcgaaaggcgaagctttagatgcactgctcgatagtattgagatacccaagggttggacaggtcttactgatccttccactggtaaacctctggagctgagccaggaggagctggagctgctgcgcaaagttcaaatgaacgaaattcccgaagatggatacaacccttatgagcccattgttgagtggtttaccagtcagcaggaaatcatgccattgagtgctgcgccagaacccaaacggcggtttgtgccctcgaaacacgaagctaagcgggttatgaagattgtgaaggcaatcagagaaggccggattctcccatttaagcctcccacggaagaggatgaggaggatgatacgattgtctag

SEQ ID NO: 17734 - DNA, 1476 bp, A.fumigatus
tatgatctctgggccgatgaagcggagcggaaggatcgtcctatgcatatccctgcgcctaaacttccacctccaggctatgaggaaagttaccacccgcctccagagtacttgcctaatcggaaggaacgaaagacttgggaggaagctgaccctgaagaccgggaccgcgagtttcttcctaacgatttcggttctctgcgcagagttcctggctatgaaaactttgtcaaggagaagttcgagcggtgcctggatctttacctagcccctagagttcgtaggagcaaattgaacatcgaccctgaaagccttttgcccaaacttccgagccctgaagaattgaaaccgttccccactgcttgtgctaccgtgttcagagggcataagggacgggtgcgcacactggctgttgatccttccggtctgtggctggcttctggtggcgatgacggaactgttcgtgtttgggaacttcttacgggacgccagttgtggagcgtgaaattgagcgaggaagaccctgtcaatgttgttcgctggagaccgggcaaggatgctcttatccttgctgcagcggctggagacgacattttccttgctgttcccccaattgttgacccagcaatggaaaaagctagcctggacattctggatgcgggctggggatatgctgcatctgtccctcctcccactcctgctgaagcaaacaagaagaataaccctcccaagtggatgcgtccttcatcgtctcttgccgattcgggagtttgcgctgtcatccctcttcgctacgtcgccaagtccctttcgtggcatcgccgtggagactactttgtcacagtttgccctggctcatcaaccccagcttcggtggccattgccatacacactctttctaagcatctgactcagtaccctttccggcgacgtatcaagggcggcggccctcctcaggctgctcacttccacccctcgaaaccgatcctctttgtcgcaaaccaacgaagcattcgcgcatacgatctttcacgtcaacttctcgtcaagattttacaacctggtgctcgatggatttcttctttcgacatccacccgacttcctccaccgcttccggtggagacaatcttattgtcggctcgtatgatcgccgtctcctttggcatgatctcgaattatcgcagcgtccttataagactctgcgctaccaccgcaaggccatccgtgctgtcaagttccacccaggcggccgttaccccctgtatgcagatgccattgacgaccgctcgcttcaaattttcctacggcagtgttaccggagacatgctcagcaatgccaccattgtttcggctcaaggttctcaagggacacaaaatcactgggcaaactcggtgtattggacgtcgactggcatcccagagacccatggtgggtcagtgcaggcgcagatggaacttgccgtctctggatgtaa

SEQ ID NO: 17735 - DNA, 912 bp, A.fumigatus
agcgcgtatccttccagccccgtggtgaagatctttgtctccaatgcagactttttcaccgctcttcccaaaatccagccttcctccaagcgtgagggcttcgccactataccagacactacatgggcagacattggtgctttgggacagattcgcgaagaactcaatactgcgatcgtggacgcaatcaagtctcctgagctctatgcgaacgtgggtattacggcgcccacaggtgtcctgctttggggtccccccggctgtggtaagacgttgctggccaaggctgtggccaacgagtcgcgcgccaacttcatcagtgtcaagggacctgagctgctcaacaagttcgtgggtgagtcagagcgtgcagtacggcaggtctttgttcgtgcccgctcgtcagtcccttgcattatcttcttcgatgaacttgatgccctggtcccccgtagagatgatgctctgtccgaagcttccgcacgtgtcgtcaataccctgctcaccgagctcgacggcctgggcagtagtcgtcaagggatctacgtgattgccgccacaaacagaccggatattatcgaccctgcaatgcttcgtccaggccgtcttgaaacgcttctctacgtcagcctgcctaatcccttggagcgtgtggagattttgaaaacccttgttcgcaagcttcctatcgagttcaacgaagatatgaggaggctcgccgaagaatgcgaaggattcagcggtgcggatttgggaagtttgctacgccgtgccggttattctgcaatcaaaagacgcgatcagatcagctttgaggacttcgttgccgctaaggctttcattcggcctagtgttaccgatctcaaaaagtatgagaagctcaggagagagtggagcggcggcgtgttgtag

SEQ ID NO: 17736 - DNA, 411 bp, A.fumigatus
ttcaactgttcttcctcgctcgggctctcatcatcatcatcatcatcatcatcatcatcatctatcactgcgccaagttcaccaggcgcggcgttcgactttttcttggctgaatcctctccatccgacgggatctcatcactgtcaagtacgtcttcttcttcctcatcctcttcatcactaaaatcatcgatcagctcgacctctgaatcgctctcatcctcgtcgctcgacaggtcgtgggcgttatccgaaagcgctccgtcaaggttgcctgtgttcaattcgtctccagaaaacacgcctgcctcctcctccacatcacgggtaactgccttgcgcttctttgaagcctttgaagtattcatattcgcgaaaagcggctgcgtccgtgcaacaaggaagctttga

SEQ ID NO: 17737 - DNA, 606 bp, A.fumigatus
caagcttccaatatagggaaacggaagttgaaatgctctggtgaagctacaggctgtagtcgttgccttaagcagtctcttccttgccactactcattgcagaagccgatgggacgcccaccgaagaagcgaccccgtgaggacaatgatgcatccgtatatgaaatcacagacaatgggatgtgggctgacatagatgatggtggaattttgactgaggaagccggggccgaagctacagcggcgtcagatgccctgcgactttgtcctccagtgtacaccgcaccaatgcgaatgccgcaggcttttcctaacctattatccactgacgatagtcacagccacctatggcagttggaatctggtagatcgctcgaccctatccctgcgactaccggtccctggcctgatttttccagcgtaacggccgcaacgtcttctccgttcacattaccgtcgagcttgacgcttattgattctcctagcgtatcatcccccagctcggacggtggtaacagttctcagtgtacctgcttatcctacttatgtctatgtctcagtcacctttcttcccttgctccctttccaatatctcaacacacgtag

SEQ ID NO: 17738 - DNA, 549 bp, A.fumigatus
tgttcgttatttattgctgccaaaacagcgcgggctgtcattcgttgtgaagtctgtcccacaagctttgctctggggatgcagaatgtcatgtctactggaaccctcttgaacgtcattgcggatgcctggctgcgagtgtcgcaagctgacgctgaagaactcggcaagttagcagccccgccagcttatgtggcttcagtgacacagaacagcccaaaccccgcagaggcttggaaggactggctccgacaaactgtcagaagcgccattacaggcggcccggcagatcctgctggtcaggtgaagtgctcggattcgccaacactactttctctcattgaggaaatggaagcccgccagcatagatggcatcgaactcgaactgtggaatccccaaacgaacctgggtcttgttcacctgtctcccatgaggaccatcgagaagaggatatgctttgctttcgtgtaatccgaagcgccagagatgttatagccaagtttgaatttgcaccgcacgagtacccggagggtgtggttccggtatga

SEQ ID NO: 17739 - DNA, 375 bp, A.fumigatus
acccatgcgatggagccttttcaagtgcgcctcaactgcgtggaccactatcaggcaaccccatcagaatttgatcctcctcttccctacagggatggagccgcgagaaaatatgatggatggaaagtacctgtgatcagaattttcggagccacagaaactggccaaaaggtttgcgtccacgtacatggcgcatttccttatttatacattgagtacgatgggcctcttgaccctgaacaaggtaagttcagaacgcgttgcactccaagtatttttttctcatcaggcggcagttcgctccgcaatcaggaggctccatctctccatagaccatgcactggcattgaactatcgtcgcaatgcgtacgataa

SEQ ID NO: 17740 - DNA, 1182 bp, A.fumigatus
tatgacattgcagagctttcggaccatattccggtgcaaacggatgagattatgccggctgaatcatcggatcgttcactgcacaatggaaaattacaggaaaatgttcagaagcacattcccagtggcaaggcttttcatgatgacactgcgaatgcaagaaggaatcctaagagatcacaccagggcgtacttgactctggtgttccccagaagaaaccgaggttcttcaatgacggtgcatctcactcgccggataacaacccccttcagaaagctgctgacattcacactgtgagggaaggccctaaagctacatacattgcccgcaccagcacatcatttacggcatctaaaagggtttcttctcaggggacaccaccagcgtcccaggacactcatttgaagaacaacggacaaggtggaagactaaacttcccggttgtcaaagatccaaacgaccctatgacaattatgcgtctcagccaggactgctctcccaaggcaattatggaatttgacaaccagactgtctctcagtctctcggcagtgctcagaaaagtaccagcggaagtgggactgcttcgcaatcccaaccattatcgtctggcctagagccaaacattacaaatactcatgtgtcagatctggcgccgaagatttatgatgcattcaatatctccgaaggcgtcaggatttgttactggcggtacgcctgccccgatgccagtgaagtttcggcaacacttgcagaccacggttatctgtctgttatctaccagaaagctttctatagtaacaatcaagatgtccctgatcggccacgagattatgcgggtcgagtgtctcgactagagggaagcagcatacattatcttcctgattttgatccttccggacggtcgcctgctatgctcggcgaatacgcttcgatgccgagagaccgataccaacaggaacaaatagatcagcgtttaagggaagcctccacctctagagtatgggagtttgctcccgtacccccaagccgtgcagaagtcctggaatggttcgacgaagaacaatcccggtgccaagcgcggccgaaagcagataaagagccagaatccgagccacaattgcaccccaaaattcattcgcaaatcgaaggacttaactcaaaagaacgattacgggtttaa

SEQ ID NO: 17741 - DNA, 1557 bp, A.fumigatus
tcagaattttcggagccacagaaactggccaaaaggtttgcgtccacgtacatggcgcatttccttatttatacattgagtacgatgggcctcttgaccctgaacaaggtaagttcagaacgcgttgcactccaagtatttttttctcatcaggcggcagttcgctccgcaatcaggaggctccatctctccatagaccatgcactggcattgaactatcgtcgcaatgcgtacgataagaagactgcgtttgtcgctcacattaccctggttaaaggagttccgttctatggctaccatgtgggttatcggttcttcttcaaaatctacttgcttgaccccgtttacacgacccgattagcggatcttctacttcaaggcgcggtgttgaagcgccctatgcagccatatgaaagccacctgcagtatgtcccgcagtggatgtgcgactacaatttgtatggctgtgcctacatgaagtgcagcaaagtcaaatttcggtcgcctattccggagtactatgagctttcgaatctatcccatcggtggcatgaccggtcaatccagcctgattgtgtttccgatgcaacagttcttccaaagcagagccattgtcccctggaagcggatgtctgcgtacatgatattctgaaccgcgtcgacataaaggaaagacctctccatcaagatttcactgaaatgctgaagccaatcgctcagaaagaacgactggttcctagtatggcgggtctctggcaagatgagactcgtaggcgtaagcaacgtatgggcctcgttgaccccggcagtagccctttcggtcctgaggagttgatgtcgttctcagctgatccgaggaataattctgagggtggctggatacatgaagatgaattccggcaattgatgtcgcaaatcgttgaggaggagcgcaagcagaataatgaaaatgtgactttagataatttcttgcaggaggatccccttgagaagaggattaaaacagccttgcagagtgtcgaggactttttcccagacaaaattgagctcactcagatggaaatgcgacagtcgttgatcgcagtcgatggagacggagaagcccaggtcaatgagaatgcggccttgtctgctgacgcagacattgacttttactcgtcagtagattattacatttccaatccgttatcggacgatcatggagctattgaagaggttgttgacggtatcgatgaaagcacgggtgatgacatttttgatatgacattgcagagctttcggaccatattccggtgcaaacggatgagattatgccggctgaatcatcggatcgttcactgcacaatggaaaattacaggaaaatgttcagaagcacattcccagtggcaaggcttttcatgatgacactgcgaatgcaagaaggaatcctaagagatcacaccagggcgtacttgactctggtgttccccagaagaaaccgaggttcttcaatgacggtgcatctcactcgccggataacaacccccttcagaaagctgctgacattcacactgtga

SEQ ID NO: 17742 - DNA, 2787 bp, A.fumigatus
  unsure (2714): Identity of nucleotide sequences at the above locations are unknown.
gggaagcctccacctctagagtatgggagtttgctcccgtacccccaagccgtgcagaagtcctggaatggttcgacgaagaacaatcccggtgccaagcgcggccgaaagcagataaagagccagaatccgagccacaattgcaccccaaaattcattcgcaaatcgaaggacttaactcaaaagaacgattacgggtttaagtattctcaaaaagggaaatctacgagcgtcgagcatcagacccagtatatgagctctatgagcctagaagtacacgtgaacactcggggtgtacttctaccgaatccggaggaggatgaaatatcctgcatcttctggtgtatacaatcggacgatcaggatgtcgacgtcaatggcaaccttccaggtgttcatgtgggaatgattgctcaagggagtggcgatgggccaacgtcaaagttgtcgaaagctttgcgtatcgaactggaacacgaaccgacggaactcgatttgatcaatagattggtcgatattgttcgctatcatgatcctgacattatcaccggctacgaagtccataacggctcctggggatatttgattgagagggcaagaaagaaatatgacttcgacatatgcgatgaactatcccgagtgagatcccaagctcatggaagatttgacaaagatgctgacagatggggctttaatcatacgtcctcgatccgggtcaccggtcgacacatgattaacatctggcgagctatgaggagtgagctgaatctgctacagtatactatggaaaatgtggtgttccatttactgcaccggagaattcctcactattcctatagggacctcaccgcatggtatcagagtggaaaacccagggatgtgctcaaggtggtccagtattacgtctcgcgcatacagatgaatctcgaaatcctggagtctaacgaactgattccaaggacgagcgagcaggcacgactcctggggattgattttttctcggtcttctcaagaggctcacaatttaaagtggaatctctgatgtttcggatcgcaaaaccagagaattacctactcgtttctccgagcaggaaacaagtcggtcagcagaatgctcttgaatgtcttccgttggtgatggaacctcagagtgacttttatacaagtcctcttcttgtcttggatttccaatcattgtatcccagtatcatgattgcgtataactattgctattccacgtttctcggaagggtccgcctttggagaggtcgcaacaagatgggattcatggactacaaaagacaaccgcgagtattggagttgctcaaggacaaggtaaacattgcacccaatggcatgatgtacgtcaaaccggaagtacggcaatcgctcctcgcaaggatgcttgctgaaatactggagactcgggtcatggtcaaggccggcatgaagatggacaaggacgacaaagcgctgcagcgtcttctcaacaatagacaacttgctcttaagctaattgcaaacgtcacatatggttatacatccgcctcgttctccgggagaatgccttgctcggagattgcggatagcattgttcaatcgggaagggaaacgctggaaaaagcaattgccctcattcattctgtggaaagatggggcgccgaggtagtttacggagatacggacagtctttttgtgtacctcaaaggacggacacgtgatgaagctttcggtattggagaggagatcgccaaagcggtcactgacatcaatccgcatcctattaagctcaaatttgagaaggtttaccatccatgcgtgcttctcgccaagaagcgctacgttggcttcaaatatgagcataggaatcagaaagaacctgaattcgatgcaaagggcatcgagactgtaaggcgagatggtaccccggcggaacagaagatcgaagagaaggcactgaagctccttttcaggactgcggacttgactcaggtcaaacggtactttcagaagcaatgcgcgaagatcatgcaagggagagtttcgatacaggatttctgtttcgcgaaagaagtcagacttggtacctacagcgaaagaggtttactccctcccggcgctatgatcagcaccagcaagatggtcgaagatccccgctcagaaccgcaatatggagagcgagttccctatgtcgtagtcactggagctccaggatcgagattggtcgaccgctgtgtcgcccctgaaacgcttctccacaacgccgagttagagcttgacgccgaatactacatcaacaagaatatcatccccccattggagcgaatcttcaaccttgtgggagcaaacgtccgccaatggtacgaggaaatgcccaaaattcagcgaatccgccgcattgaaggagcagcatctgccgccgggaaagatgcaaaggggaagaccctcgaatcgtacatgaagtcatcatcgtgtatcgtttgcaaatcaaaactcgatcacatcggtattccagtgtgctctgactgcttgcagcaaccgcacatctcgctattgtctctcgtttcgcgccagcagcaagccgaaaagagggtctctgacctccatcgcatctgtcaatcctgcatgggtgtcccatctggtgatgatgtgatatgtgatagtaaagactgtcctgtcttttattcgcggactcgacacttggcgagttgganacatacaaaagccacattggcgcctattattaaactcttggagaaccaaagagagagcgcattggagtggtaa

SEQ ID NO: 17743 - DNA, 1398 bp, A.fumigatus
ttgataccattattatcgccgatcatgaaggaacgacaaatcaatcctcggtactccagagacagggtcaaattcaactgtctagcgcgaaagtggagaccgcaactatccatttcaacctcttttaaattgaacgtcacgatcaggctcatttcttcggctccaagtctattatttctgacctcctttgccaatattcacacgatgtcgcgaaaaccagctgatgtggcgtcaaaagaacgcaacgaatatatcccgtcttttatcgcgaagaaaccgttctacatcgacgatgagtcgactgctaatgattatctcgaacatcaacgtcttcagaaacaagctacagatcaatcgaaatggtacgatcgtgggaagcgcgctggtccggcagccaccaaatatcgcaaaggcgcttgcgagaactgcggtgccatgacccacaaatcgaaagagtgtctaagcaggccccgaaagctcggtgctaaatggacgggtaaagatatacaggccgatgaggttgtacagaatgtcgaactgggatgggatgctaagagagaccgatggaacggctacgatcccagcgaataccgtcaggtcattgaggaatatgaggagcttgaaaagctgaaacgcaatacgaaaccgggagctcaagacggaaaaaagattatggatggcgaattggacgatgaggaagctgctatagaggaagctcggtacgctgaagaatcagatatgggacgacaacaaagcactgcaactcgcaatttacgtattcgagaagatactgcaaagtacctgcttaaccttgacctcgactcagccaaatacgatcctaaaactcggcgaatggtcgatatgggtgcgcaggatgatcaagctgcagcgcttgttgcagaagagaattttgttcgtgcgtccggggacgctgcagaatttgagagagctcaaaggtatgcttgggagtcgcaagaacgtggagataaaaagatccatctccaagccaatcccacatccggtgaaattctacgaaagaaagagcaggccgagactgaggcgaagcgtcaggctcaacggaaggcactattggagaaatatggcggcgaggagtatctcaaacctactcccctccgggaaaccatggtcattgagaacgaaaggttcgtcgaatatgatgagtctggcgcaattaagggtgcaccgaagaacgcagtcaagtccaaatatccagaagatgtattggtgaacaaccacactacagtgtttggaagctggtggcataacttccagtggggttacgcttgctgtttttcaacagtgaaaaatagctattgtaccggtgcagacggtaaggccattttcacacacagacctggaaggaccgctaaatgcgct

SEQ ID NO: 17744 - DNA, 384 bp, A.fumigatus
aatacatttaacccgatggactcagctacaacaggacgtagcccgcaggctgtggtcctcccggtgctatcctccattgctgttgttgtcagtattccaccaatcatcctacattggaagaaccgtaatttccccgctactgccctcattggctggtttcttctcatcaatacctttaacattatcaatgcacttatttggcccacggacgatgtggattcatggtgggatggtcatggtctttgtgatgtcgagaccaaggtgatgatagcgagctatgttggcataccggggactctggtctgtatcttccgaagcttgggcctctgtgctcgacaccagaagcgctatgctcgtccccagcatcggccaacgttggcgtga

SEQ ID NO: 17745 - DNA, 348 bp, A.fumigatus
cgagctatgttggcataccggggactctggtctgtatcttccgaagcttgggcctctgtgctcgacaccagaagcgctatgctcgtccccagcatcggccaacgttggcgtgaccgtctgatggatttctcattctgtgtgatcatcccggtgatcgcaatgggtacacatatcctctaccaaaggagccgatacctgatcctcactatttcagggtgcgtcaacaactttgatcaaagctggatgagtcttatgctagcgttcatctggcctcccataatctgccttctggctgctttctattgcggtatgaatatggcaccgtcgtccttctctgctcatgactga

SEQ ID NO: 17746 - DNA, 5661 bp, A.fumigatus
gaggcacagaaggcggccatgcctccggagcacttgcgaaaaattgtcaaagatatcgccgccgtatcacaaaagaagttcaccaccgaaaagcgcagctatcccggtgcgctgaagttcatgcctcatgccgtgttgaagctgctggagaacatgcccatgccttgggaatcggcgcgtgaggtcaaggtgctctaccatgtgaatggttgccttacgctcgtgaacgagactccgagggtcatcgaaccggttttccatgctcagtgggctaccatgtgggtgtgtatgcggcgagaaaagtgcgaccgcagacatttcaaacggatgcgctttccccctttcgatgacgaggaacctcccctatcgtggtcggagaatatcgaagacgtcgagcccttggagccggtccagatggagctcgacgaatccgaagatgctcccgtgtacgagtggttctacgatcaccggccgctacttgatacccctcatgtcaatggaccaagctataagagctggaatttgacccttccgcagatggcaactctctaccggttaagccatcagttactcagtgatgtggttgaccagaattactttcacatgtttgatctcaacagtttccttacggcaaaggccctgaacgttgctatccccggtggcccacgctttgagcctttgtacaaggacatcgatcccaatgacgaggatttcagtgaattcaatgcgatcgaccgcatcatcttccgagcacccatccggacagagtacagagtcgctttccctttcttatataacaccctaccgagaagcgtgaaagtttcctggtattctcatcctcaagtcgtttacgtccgagccgaccctaaccttcctgctttctacttcgaccctgtcatcaatcccatctcgtcgcgctctgtcgcccccaaaaacattacagtcagtcatgaggatgagatctttggacctggaaacaatgaggatgactttgaactcccaccagaggtgaagcccttcttcgctgacgaggaactgtacacacctgataccgcctcagcgatcgccctgtggtgggctcctcatccgttcaataagagatcagggaagatggtgcgcgcgcaggacgtgccactcgtcaagcagtggtacctggagcattgccctcagggccagcctgtgaaggtccgagtctcgtatcagaagcttcttaagacgtatgtgcttaatgagttgcacaagaagaagcctaaggcccagaacaagcagaatctgctgaggaccctgaaatctaccaagtttttccagcagacgacaatcgactgggttgaagctggtctccaggtttgccgccagggttttaacatgctcaacctcttgattcaccgaaagaatttgacttacctgcatctcgactacaacttcaatttgaagccagttaagacactgaccactaaggagcgaaagaagtcccgcttcggtaacgcttttcacttgatgcgtgagattttgcgccttacgaagttgattgtcgatgcgcaagttcaataccgtctgggtaacatcgatgcttttcaattggcggatggcattctgtatgctttcaatcatgttggacagttgaccggtatgtaccgttacaagtacaagttgatgcatcaaatccgttcctgcaaggacctgaagcatttgatctactaccgattcaactctggccctgtgggtaaaggtcctggctgcggtttctgggctcctgcttggcgcgtttggctgttcttcatgcgcggtatcattcctcttcttgagagatggcttggaaacttgctttctcgtcagtttgagggtcgtcatagcaagggcgttgccaagaccgtcaccaaacagcgtgtcgagtcgcacttcgatcttgaactgcgagcctccgtcatggcggatctgatggacatgatgcctgaaggtatcaaacagaacaaagtcaacacagttctgcaacatctgtctgaagcatggcgatgctggaagagtaatattccttggaaggtgccggggctcccagcacctatcgagaatattattttgcgatatgtgaagagcaaggccgattggtggatatccgtcgcacactacaatcgtgaacgtatccgccgcggtgccaccgtggataagactgttgccaagaagaatcttggtcgactgactcggctttggctcaaggctgagcaggagagacagcacaactatttaaaggatggtccttatgtatcttccgaagaagcggtggcgatttacacaaccatggtgcattggctcgagtctcgcaagttctcgccaattccgttcccaagtgtctcatacaagcatgacaccaagattcttattcttgctctcgaacgcctccgcgaggcctactctgtgaagggtagactgaaccagagtcagcgagaagaacttgctctcattgagcaggcatatgactctcctggaaccacgatagcccgaatcaagagattcttgctcacccagagagcatttaaggaagttggaatcgacatgaatgacaattacagccacatcaaccccgtttacgatgttgagccgatcgagaagatcacggacgcgtacctggaccagtatctttggtatcaggcagagcagcgccacctcttcccagcttggatcaaaccttccgattctgaagtccctccactgttgacctacaagtgggctcagggaatcaataatttgtccaacgtctgggaaactgccgatggcgagacgaatgtcatgatcgaaacggagttatccaaggtctatgagaagattgatcttactctcttgaatcgtctgctacgtttgatcatggatcacaacttggctgattacattacttcgaagaacaatgtgcagctgagctataaggacatgaaccataccaacagctacggattgatcaggggtctgcagttttctggtttcgtctttcagtattatggtcttatgattgatctgctgctccttggtctgcaaagagccagtgagatggcaggtccgccgcagagtcccaacgacttcttgcaatttagagaccgtgccactgagacaagacatcccattcgtttgtacactcgctatgtcgacaagatctgggtattcttcagattcaccgccgacgagtccagggatcttattcagcgcttccttacagagaaccctgatcctaattttgagaacgttattggatataagaacaagaagtgctggccgcgtgattgccgtatgcgtctgatgcgacacgatgttaatctcggtcgcgctgccttctgggatctgaagaaccgtctgccgcggtcaattacgacgattgaatgggatgatacctttgctagcgtgtacagcaaggacaacccgaacctgctgttctccatgtgtggctttgaggtccgtattctaccaaagattcgcaatcagaacgaggagttctctgtcaaggacagtgtgtggtctctggtagacaacaccaccaaggagcgcacagcccatgctttcttgcaagtaacggaggaggacatccagaaattcaacaaccgaatccggcaaatcctcatgtcctcgggttcaaccactttcaccaaaattgccaacaagtggaacaccgcccttatcgcgctctttacgtactatcgtgaagctgctgtctccaccgtcaatcttttggacacgattgtcaaatgtgagactaagattcagactcgtgttaagattggtctgaactccaagatgccctcgcgtttccctcctgcggtcttctacacgccaaaggaattgggtggtctgggcatgatttcgggttctcatattttgattcccgccagtgacaagcgatggtcgaagcagacggataccggcattacccacttccgtgcgggtatgtcacatgacgaggagaccctcattcctaacatcttccgatacattattccatgggaggccgaattcattgactctcagcgagtctggatggaatactctcagaagcggatggaagctcagcagcagaatcgccgtttgactttggaggacttggaagatagctgggatcgcggtctccctcgtatcaacactcttttccaaaaggatcgaagcacactcagcttcgataaaggcttccgtctcagagccgagttcaagcagtaccagctgatgaagagcaatccattctggtggacaagtcaacgtcatgacggtaaactctggaacttgaacgcttaccgcacagatgtcatccaagcacttggtggtgttgagactattctcgagcacaccttgttcaaggcaactgcttttccatcttgggaaggtctcttttgggaaagagcatgccttgccaaggggacacggctgctacggtatgacggtagcgaaattgaggtccaggatgtcaaagagggagatttgctccttggtcctgacggcggtcctcgccgggctttcaacatcgtgaacggtaaagaccgtctctatcgtatcaagattggtggaagtaaagaggaccttgttgttacgccaaaccatattctggttcttcaccgggagaagagagcgagaaatgtgtatactggaccgtccgtccaaggtcatatccaacgttccgaaaacgggcatggtaaccttccgatgctcagttccagccctgcggccgcccatcacccgaataaccttgtaaagaaccgtggagatttctggtctgctttgaagagtgctatcgcttgggttctccatgccgaacgaagttcgaccggcgccaacatggtgcggaatgtcctcaatggtaccgttggtcttacggctcataaagagagctatactgttaccaatcctcagcaaaaaggcgtatactacacctatgtatggggaaaccctcaacgaacgagcatcaagggccatcgcgaccacccgcccgtcttcctaccaaccaaggaggatgctttctctgctgcaattgcgaaaagtcgtgaactctattcgcaaagcgaagttacgctggctacacttcgtcaaagattccttgcaaagtctgccgatggtaaaggcggagagattctggtcgacgccaacttgccaaacatattccttctgtgggacaagaacagatctaacctcaagttccgcgtgctctgttcccgcaacttcaagacatacgggcgcgtatatactttcgagtcaatgccaagcaccaacgctgaagaaccaggatatggagacgatgacgagctacctcaggtttcagcagaagagcgctacgataccgttgaaatgacagcagctgagttcgcctcactgagcacagaagaacggagtcggtatcgtgtgttcagatgtcctggcttcgagttgcctgagcagccagtgccggtaaacccgtatttcctcggactttggcttggcgatgataaccatgagaaaaccacgaatcacaacattcatgaagagaatgttcgcgaattcctcgtgaaccatgctgctgagttggatatgtaccttgcgtggcagggtctgattgactatgcgactgtcgccaaccctgcacctatgatggttcggctcccgcccaccaatcctgataccattgagcatcgtccggttgtttgtcaagcacggtag

SEQ ID NO: 17747 - DNA, 564 bp, A.fumigatus
cgagaattgccgtcgaatacggaaactgctctccgatcggaggctgaagcctcgagtatctcggcaattcttgattcgaaggccggtcattccagtctggatactggtgatcccaattctgatgtcgttcctgagtctattcccaacgacgtcgccgattttggcctcgatggagtccccgaactcacttctagcggtttctcagagcttacctcagattctgaactcatgcggttgatcgaacaagtggagcggtcaagccaaggttcgacggaagaaccaagccaggcttctgtggtagaacaggaagctgatctcaatctgcttgaaaccgatagcgaggacgaggaagccgacagcgctgacgatgatgagtttggagacccagaggcttccgaatttcggccggagccagaaagccaactttcccagtctcacttctccaatcgtcggcggaaccaccgcttgcgaacaggtcgtcgagtatacggagatttgaatggcgaggaggaaggtatacttcttgaccagatcgtggagcaatctgaagggcagtcgtgttaa

SEQ ID NO: 17748 - DNA, 348 bp, A.fumigatus
gcaataatccccaaggcatcgagcgcccggaggagcgagttaacacgactgcccttcagattgctccacgatctggtcaagaagtataccttcctcctcgccattcaaatctccgtatactcgacgacctgttcgcaagcggtggttccgccgacgattggagaagtgagactgggaaagttggctttctggctccggccgaaattcggaagcctctgggtctccaaactcatcatcgtcagcgctgtcggcttcctcgtcctcgctatcggtttcaagcagattgagatcagcttcctgttctaccacagaagcctggcttggttcttccgtcgaaccttggcttga

SEQ ID NO: 17749 - DNA, 357 bp, A.fumigatus
gagtcggaggccaattcggtgtgccgttctgtcagtcaacagatcatactccaagaacttgaaccattattcagaatgaagcttagcctctctgtcgccctctcgctcgccgcagcgactgcccaggcagccacccagttctgtgaccaatggggctcggtcaccgagggcaactacattctttacaacaatctttggggtcaggcccaggccacgtccggctcccagtgcaccacgttcgaatctctttcgggcaacacgatcgtctggaacaccaagtggtcttggtccggtggccagggccaggtgaagagtttcgccaatgccgcctcttgcagttcacccccaagaaactga

SEQ ID NO: 17750 - DNA, 468 bp, A.fumigatus
  unsure (405): Identity of nucleotide sequences at the above locations are unknown.
ctcgacttggaagtggaagtaaggcagtccttacagattctccgtggatgcgaagctgacgataacagctattctggctccaacattgtcgccgatgttgcctacgacatgttcctcagcacgtcccccggcggcgaccacaaatacgagatcatggtctggctaggtgctttgggcggcgctggtcccatttcctcgacgggctcgcccatcgccacgcccaccgtcgctggcatcaagtttaacctgtacctcggcccgaacggctcgatgcaggtgtacagcttcgtggcccagtcgaccacgaatagcttctccggcgacatgcgcgacttctttacgtacctggaaagcaaccaaggtctgtccagcgacctgtacctggtcgacgtgcaggccgtaccngagcctttcagcggaagcaatgccgttttcacggtatccgactactctgtcagtgtcgcctaa

SEQ ID NO: 17751 - DNA, 1008 bp, A.fumigatus
agagatacatcgcccccaaacaaagaccattgtcaacatctcttatcagctcttctcgccccatttaccatcggaaagagtacgagcaagaccaagacaaatacgagatactacttttgtctcttcaatttcgggttgttgacgtttttcaataataagcatcagtttcgttcgctccggagtaggtattactttctatacttccgttgctcccatcaccataaacaccaacaattacaacgccaccacaacagcatcaccatggatgttcccgtggctctcaatcgagccgctcttaatgactttgtcacccgcccagtatcacgagagatggtggcctatctggctcagcaagcttcgctggtcatccgctgcgagtcgcatgtgacctctgccgttagccgtcatggccaccctacgcctccaagcacacctccactggatggcttgcctcctctgccatcgctcgagacgtttatcatctcgctcgtcactcggtctcaggtccaggtccctacactgatgacctctttggtctacctggctcgactgcgggctcgcttgccgcctgtcgccaagggcatgcgctgcactgtccatcggatctttcttgcatcgctcatcctggctgcaaagaacctgaatgactcgagcccaaagaacaagcattgggcccgctacacggccgtcaagggctacgatggcttctccttctcgttgccagaagtgaatctgatggaacgtcagctgctgtttcttctcgactgggacactcgggttacggaagacgacctttttctacatcttgaaccctttctggctcctattcccccgcgattcgacgcgcaagagcgcgaggcagagctgagacgcccgcaacagccaccgcagcaacactaccgcgaatggcggcgccctccatgcatcggcagaactccttggtaccccgtctgcttcgccgagaaggttgaaggggcgtggagacgctccccccatgcatgggtataa

SEQ ID NO: 17752 - DNA, 393 bp, A.fumigatus
  unsure (3): Identity of nucleotide sequences at the above locations are unknown.
ttntacacgacgacctccacaatgccctctaaatcctcctccccacaatcaaattccacccgcaagaattcctgcggttgctgctgcttctccgtgcgcaaattcggtttcctcgcggtcttcgtggccatcttcgctgcactgtacagctacctcgatgctcgtcttgagcaattctacatcttcaatcccgaacacctgcacgatctctcccagcgcgctattcaggctcatggcaacgacacccgtgcgatggtcgacttcattgtcgccgagctggaccagaagattcccggtaaccacctgaacaagaacgaggaatggattttcaacaatgctggtggtgctatgggtgccatgtacatcattcatgccagtaagtttgttcaatag

SEQ ID NO: 17753 - DNA, 258 bp, A.fumigatus
gatgctccagcctccaagccaataagagaggaaaacaaacagaacccgatgccaggggaactcattcaactaaccaaggatttacttactgtgtacggtgtagactcaaaatatacgcgggcgccgcggactccagcgttccttttttttctgcctagtctaatcatccctattattactcctcttgttaagcctcttttcgtccccggattctgtcaattgtttcaattgtcaattttagtctctcgattggcttga

SEQ ID NO: 17754 - DNA, 237 bp, A.fumigatus
tataaactaggcaccgcgattggcaccgagggccacaccggccgccacaccgccgatgactacttcaacatccttcagggaactcaggtcgctttcgttcctggcacttttgagcctgaggtctacccccctggcaccgtccaccacctccgccgcggcgaggtcaagcaatacaagatggagcagtcctgctttgccctcgtcttcaccacgggggtcgacggatccgcgctagca

SEQ ID NO: 17755 - DNA, 243 bp, A.fumigatus
ctcatcatgctcaactgcatcatcaacaccatcaatgtccaccagcccctctcgacttcccttgacctcatggctcgcagggtattcccaggccagaacgtggcctttgggttgagcctgttcctctttacgtttatgttcctgccgacgctagtgatgctcttagctgtcattgtgttctttgcgttctactatccgcagctggggaagtcgacagctgctcaaaacgatgactatgagtga

SEQ ID NO: 17756 - DNA, 318 bp, A.fumigatus
actgctttccacgcatcttggtcgaacagtgcatcggccgataggaacactttgaaagttagccgaggaaccagtgtggtaagcattgttctgatcagcatatatgtttatgattctcatattgtgcaggtgctgctcctcgtgtatattctctacattatctttcagctcaaatcccactcctacctttacgcgagcatcccacagcggatcattgatgaagaatctcatcccggtgtcctggcggagtttatgaacagctcttccgattcatccaagcactcgtctgatgattccgatgaaccctcgacatcctgg

SEQ ID NO: 17757 - DNA, 537 bp, A.fumigatus
cctgcagacacatatcaagcagttgaggtgttccaaaatttgatccacaatcttaaagcagcacaactccaaatccaagtcagacatggttatggctcctcgctgctggtctgtgtccgggttccccgggatcacttgggacggatgatatacgagtcgaggtaccctccccccgtctatacacaactggcttcaccgactaacttcatcagagtaaaagactggctatatggaatcgtccatgaactccccgttgcaagcgaccacgccgtggccgaaacccccgccgaagaactccgatcagtctaccatgctgtaacctggcagagacacctgggtggtgctggcatcaccccaggaataggacagtggaagaacattgcgtctgcgtttccgcttcatgaccaggccgctaacgccgagctgctgcgtaatatgagtcgatcattgacgttaactgataaggatctggatgcgatccgtgccttgtttggcgagaaggtttgtgatcataaaaacggcgataatcaaagctga

SEQ ID NO: 17758 - DNA, 198 bp, A.fumigatus
cctatcactgcgcctcatctcgttatcaatcacgcttcacttttctatttgtctacggcaggtatggtggctgtaattgaatgtcatccaggagtcaccttgagctgctgtcctacccaagaaaactgtctctgtaatcctctctcctacaataacacttgcgactggagtagactttcctttcgtgtgactatttag

SEQ ID NO: 17759 - DNA, 759 bp, A.fumigatus
tctccaacccactgtcagttggcgcggatggtaatatttttcggtacagttcaggcaggtattcgagcattcatcgtcgataatgctcccgctcatcagcaggaatcggcgaatgcttgggctagtcggcttactggggtgggcaatatccttggatacatttttggttacctcgatctacccaaaatattcccatttcttggaaatactcagttcaaggtgctctgtgcattgtcctcattggtgctcgccattacgctgagcatcagctgctcttatatccatgagcgagacccacggctcgaaggaccaccgtccaaagatagtcaaggacttgttggcttttttcggcaagtgttcaagtcgatcaagtttctacctccgcagatcgccaaggtttgccaggttcagcttgctgcctgggttggctggtttccgtttttattctatgcaacgacatacatagggcagctctatgtcaatcccatcttcgatcagcatccgaacttatccgaggatgacattaataaggcttgggaagaagcaactcgaattggaacgtttgcacttttgatttacgcgataatctcgtttattgccaatatgatcttgccgctctttgtcgtcccaacatataggccgatcacgtgggccggagcaggcttacccggatactccagaagaagaacgaaccctgtctatccagaaggatgtcaatctcaagtctgcccgttggtgtcgcctcagaaccctccctag

SEQ ID NO: 17760 - DNA, 1230 bp, A.fumigatus
ctgacaggcttaggcatcgtctcgcttctgttctgtggtatcacgatgaaacactacgcctactacaacatgtcgcggcggacgcagttgactaccaaatacctcttccaggtcatggcccaattgtcggagaacttcatcttcatctacctgggtcttgatttgttcgtcgaaacgaatttacagtttaagcctctcttcattctggtcgccgtctttggcatctgccttgctcgttacctcgcagtgttcccgttgtcgaaggcgatcaactggttcattcggtacagggcacgccgtcacgggttggaagtagcggacgagctgcccttcgcccatcaagcaatgctattctgggctggcctgcgcggagctgtgggggttgcgctggccgcggggcttacaggggtgaacgcgccggcgttgcgtgccacagtcttagttgtcgtcgtgttgaccgtcatcatcttcggaggtacgactgctcgcatgctggagattcttggaattcgcaccggtgtggtcgaggagatcgagtccgacgatgaattcgacatcgaggtcacccatgggggtacctattataagcgctccgacactggcttggggtatacgccccggcgcactgattctaccattcctctggacgggatacagcgagcaagtctcggtgacagggtcggcagctattccagtggcaataaccgccgtcctagcccacctccgtcaactcggggccatggacggatgtattcgaaagcctacagatccaaggacgggcgcgataaatcatcgatggccacgcttctcgggaacggggctggaatgcacagtgatagcagtgctgctagtgaggatgaatttggcctgagagccgatgggcgcggccgaggggcgtcagagccggaccaggttgatgcattcgatttggatatcgatgatggtgcttctgacgacgatctacccccctctgcgccgactgcggcttctagaatgcggcggtcaccgtcgcaggcacagaatctgacgccttcacaagctgctccgtcgaacggagcgtcgcccgcaaggagagagacaggactgagtgcgagggaagctcttcgtgatctgttctcgggtggaccatccggcgatcatgcggcctggttccgacagctggacgaggactttatcaagccgcggctgctgctagatcagtccaatcacaagggcccaggtgccgtttga

SEQ ID NO: 17761 - DNA, 486 bp, A.fumigatus
ttgtgcgtgcagcgctcccccggtctggtggtaactgaggcgtatgctgacgcacatgatgtagatgggtttgcgaccatgttgctctcgctcgtgtctattgcccgcgatggggagtggactgcttcccgcccagtcgtgtatgccacctacgtcgcttgtgtcgtcgtacacgggttgatcaccacgttctttgcgcgcatcatgccgaagatccagacgctctgtatcgtcagcaacatcgggctcgtggtagcaaccgtgattgcgctcccgattggcaaggcgataaatggcgggcccgtgaacccgggttcctatgtcttccgacatactgataacctgaccacatggcccagcgggctgggcgtttatgcttgcgtgggctcttccctatctggacaattggcgcctttggattctggcttcattataacgaggaggctactcatggccacacttgccgggccggttggttttctttgg

SEQ ID NO: 17762 - DNA, 1044 bp, A.fumigatus
cctggtgtctttgttctgcagggagagcagccgactcggatgagcccgatgaccgtacgcgcgtggatctcttatattcagaaacctctggggtcggttgctgatgaactattccagatgcctcctgatgccgggaaaaaaagagttcttcagctcctgggctccttttcatcctggatcatgcctgttgatgtctggccttgtttacgagttatatcttgcaacaaaagaagatccagcggtttcatgaaacagttctgtcgatctttgctggtatgtttgactttatttctgctttttgtctcctcggagggtcggcggtcgctcatgcgcattaacgcaggtatgtttgtcgggttgattatccgactgagtcccgagtcgcctatacaagacagcgtcactttcgactatcagttcttcttcaacctcctccttcctcctatcattttggcctcgggctacgagttacatcaggcgaatttcttccgcaacatcggcactatcctcacctttgcttttgcggggacgttcatctccgcgatagtgctgggcttggtgcttttcatttggacgcggatcccgttggacggcttgaacatctctttcgtcgaggctatatctgttggcgccacgctctctgcgacggatccggtgacgatcttggccattttcaacatctacaaagtcgagcccaagctttacacggtcatctttggcgagtcgattttgaacgatgccattgccattgtcttgttcgagacagcgcagaagtatgcggaaagtgacgctggctcactgacgatcctcaatctctttgaagctatcggactctttctgcttgtcttctttggtagtatgctggtgggcatgattgttggaatcatgaccgcactggggctgaaatacacacacgttcgtcgcatgcctaagatcgaaagctgcctgattgtcctcatcgcatatgccagctacttcttttcgaatggtgtccatctatccggtgagtgtctttgcgacttcctccatcgtcctggtaactga

SEQ ID NO: 17763 - DNA, 207 bp, A.fumigatus
cctttcttgctaatctcagcttcgcgtctctcttgtattgttgactcctccctcaatcaccaaaccatggcggaaaagtctcgagctatggacgccaagtccaaggttgcgcagacagtcgatcctgatatcgctgtcgagactggcgacatggagttactcggtgtgtggcatggtgtaccatctacaatgcgaatatgctgctga

SEQ ID NO: 17764 - DNA, 348 bp, A.fumigatus
tggatatggattcttccagcgacgctggggtacaagcaagagcttcgacgacattactccactacccagatctttgcggttgcgttcagcatcatggggttgttaccctccattgcatctaccttgtcgttctcgttgcctgcgggtccagtgggcatggtctgggtaaactatctccatgaattgcaatgtggatttttgaagtgtccgctgactagtgacagggtaagagctttgggtcactgtctgtgggtgcattcattcagcggtattgactctctttctataggatggctcgttgcaagcgtgttcatctttatcgttggcctggctatggtacgtgtttga

SEQ ID NO: 17765 - DNA, 417 bp, A.fumigatus
ccttaccttctgtcccttggaatgagcaaggccctgcttgcctttgtctggatcgcgggacccctgaccggcacacttgtgcaaccctacatcggcattcggagcgataactgtcggataccatggggtaaaagaaagccttttatgatcgctggtgctgcggcgaccattgtggccctccttgcgctcgcatgggtgcaagagattgttggaggggctctcgggatattcggtgtcgatccggcctctgatgggactcgggcgacaataatctttctagcgacagttctgatgtactgtctagacttcgccattaatactggtaagcacatgatctccaacccactgtcagttggcgcggatggtaatatttttcggtacagttcaggcaggtattcgagcattcatcgtcgataa

SEQ ID NO: 17766 - DNA, 753 bp, A.fumigatus
gccgatcacgtgggccggagcaggcttacccggatactccagaagaagaacgaaccctgtctatccagaaggatgtcaatctcaagtctgcccgttggtgtcgcctcagaaccctccctagaaccaaccagcggtaagcaaaccgaaagtagggatgaatcgacatggttatcaaagctgcagatacctgggctgacgctgcgccgggcatggcttatctctcacgtcctgttcgcggtctgcatgttcagcacctttctcatctcctcttatcaggttggatcggcagttattggacttgtgggcatttcgtgggccttgactctatgggctccctttgccctgatctcggcggaggtgtcccgcattgacgcggagcgtcggactcgacggcatcaggcagagatggacgcatctcctgaacagtataccgctgcgaatgtcgctggtgaccgcggggatggtgctgattacgacgaagatgtagagaacggtgctcgaccgcgacgtaccaaggtcgaggacgaggaagaaaatcttgcccaagcgggcatcattctcggactccataacgtggcagtgtctgcgccccagatcttttcaagcttgattagtagcgctatcttcaaggccttccagaagcctaggggagagccctgggatgacagtgttggatgggtgctgagatttggaggatgcgctgctttagttgcggcctggctggccagtcgcgttggggatcgcacggcgtaa

SEQ ID NO: 17767 - DNA, 534 bp, A.fumigatus
tccaatgaggttgctaggaaaaccaagatccatcggcttcacactctccaggtactcgatctgctccggggtcaatttgatgctcaacgcctgaatgttgtcgtgcaggtgctcgaccttgcgtcctccgacgatcgggaacacattcggcgccttggcccgcacataagccagagcaatggccgtcacagactcgataccgtgctctgcggccaccttcgcgagagcctcactcatcttcacctcatcctccgtctgctcccctggcccgaacatgctgcgcaggccctcgcccttcttcttgcgctcctcgagcgcctttttggtctgaaacttgccgctgcccagtacgtcccacggcgccagggccataccaaaatgccgcgtcatggggatgatctcgcgctcaaagtcccgcagcatcacgttccaccgcccctggtagacgctgaagggcgtcttaccgtgtgcacgcgcacaagtgttcgccgcgctcacaacccacgctggtgtgtccgaaatccccagatatag

SEQ ID NO: 17768 - DNA, 183 bp, A.fumigatus
tggcgccaaatggcgccaaatggtgaagaagttgatctaatttacaactcgtctatcacaacatataaaattgatcagactatacgccgtatcgaaatgctctattatcttgctgaaacaccaacaacgccagacgatgtcgtacgaacaagcccagggccccacaggcggtctgaaccatga

SEQ ID NO: 17769 - DNA, 624 bp, A.fumigatus
ctagaagtcatggcggtcggaccgacccttgggacaggcctctttatcggaggtggccaggcgctggccgctgggggtcctgcttccttgctcttctcctatttgttcttgtctgttctggtatactgtctcgcaacagccttgtcggagattgccgctcatatgccggctcaagatggcacaatggtctctcacgcctaccgatatgcttcgaaacccttggcgttctccatgggttaccttcgctggtattcactgtcgatgctcatcccgtttgaaatcacgaacgctattgtcagtcttggaatggtaaatccctcgcgtgcggttgcgctccgtgtcagcattcctactttgatcatatttggcttcaacatgcttccagaaagatcgttcaagaggtcagaagctgtttttacctacttgaaactgatcacgaccacgggcctcgtcttcctcaccattgtctttgccattccaggtgtttctcactctcctgttcaaggattccagtactggaacaatccgggccccatgaacgaattcatatacgatggtcacctgggccggtttcttggcctgctgtcttccaccacggggccggaaggatacgcgcaatgcgta

SEQ ID NO: 17770 - DNA, 246 bp, A.fumigatus
caagggacacctgatcggcccgacatgtcctctgggttcaccgacttcgacgccggccatcgtgacttggtgacagtgaccaaattcaacttttatggcaatcgcattgtcaccgcttcttcagaccaccgcatgaaagtgtgggatcagaaagatggtgaatggcacctgatcgatacctggcgcgctcatgacgctgaaatccgtgatgtaagcatccgcttcatgggcccattgcgtcgataa

SEQ ID NO: 17771 - DNA, 894 bp, A.fumigatus
caggctacgtggaatggcccatttactggccagcacataggcagtgtaggggaagacatgaagtgcaaaatctggcaggaagacgttacccaaccgcccaattcggggagacgcttcaggtcaattttccgtatgacggcgccgcagcggcatcccttcgtttctatggactttcgcaacattgaccttgagacctggctcgctgtaattactcgggacggctatctcatggtcatggaacccgtcagtcccgactccctcgcggactggcagcccctggaccagtttcgagtttgcactgcgcctcaacgcggtgaggaaaccagcttcaaagtgcagtttcaccatgatccaacggatattactcacttggtcaatccgagctgggaccgtaagagcctctctcttgtcgtcgccgcgatggacagcgtcaaagtatatcgcaccgacgccaatcgtcgcttctaccacgctattgaattgactgggcatggcgggcttgtcagagacatctcctgggctaatggctctgttcgaggctacgatctcattgctagtggctgcaaggatggcttcgtacgagtctttgaagtctatacgtcgatgtcaaacagtggttcgcagaccaccaatggatcacacgtcgagtctcagtcacagtcaccctccttgcgtgccaccgcacaatcagggattgggtccgctcttgcaaatcgaacacctgaatcggtgacaaatcgtccagcgactggtgattctcagttcaagcattcatacaaggaagttgcatgtatcgacagcaaacatctcgatgtatggcaggtagagttttcctacgcaggtgagttttcaggtcactcttggaaacccatcccgggcatgccactgaactaa

SEQ ID NO: 17772 - DNA, 261 bp, A.fumigatus
cctgaagcgtctccccgaattgggcggttgggtaacgtcttcctgccagattttgcacttcatgtcttcccctacactgcctatgtgctggccagtaaatgggccattccacgtagcctgttacagatgagtatattatcgacgcaatgggcccatgaagcggatgcttacatcacggatttcagcgtcatgagcgcgccaggtatcgatcaggtgccattcaccatctttctgatcccacactttcatgcggtggtctga

SEQ ID NO: 17773 - DNA, 1086 bp, A.fumigatus
gattgctcatgtcgagaatggtcgctttctccatcgctttccacactccaaggtccgtcctgcgagttctcctatcacgcttggttaactgacatgttgaagcttgcgtcttatctgtcggggctcctctcgttgcaatgtattgtcatactaggaattggggatgatctgctcgatatacgctggagacacaaagtcctcattcctgcattcggtgcaatcccaatgctcattgtttactttgtggacttcggggttacgcatgttgtcgtgccggtgcccctgcagccgtatttgggcactttcgtggacttgggaagggctgtactatgtgaacaaggccggctaatgccaatattttgtcccaacgccatcaacatgcgggcggggatcaccggagtgaaagttgcacaatcactcgtaattgcggtgctactggttgcgaatgacctgttatacattgcccctacaacgccattcccgcacccggctaccgactcgcatctattttctttatacttcctgctccctttcatcggggtttcagtggccttgctgtgccacaactggtatccatcgaaggtgtttgtgggcgatacctactgctactttgcggggatggtgtttgccgtggtggggattctcggccatttcagcaaaaccctcctgctgctcttcattccacagatcttcaactttctgtattcgactccgcagctcttccacatcatcccttgtccccgtcaccgcctccccaagttcaacgccatgagcgggttgttggacgcatccgtgactgagtggaccgtgcctcccggcccattggtagccactggcctagagatcctgcacaggatgcggctgattcgcattacaaagaacgaggagggtgagatcgtcgagtcgaccaatctgacgatcctgaatttgtggctcatttggatgggtccgatgcgggaggatcgtttggcgtggcacatggtcatggttcagaccgcctgtggggccctgggcttgttcgtacgacatcgtctggcgttgttggtgtttcagcaagataatagagcatttcgatacggcgtatag

SEQ ID NO: 17774 - DNA, 225 bp, A.fumigatus
tttgctagaccggagacgatgggggctgtttgcgcagttgtgtatcttctggcgctcatcttcttcattccctttgccttttataaggacatcgttgcagctacttcaggtggtggtaaccgagatgtagtgcttgagattgctcatgtcgagaatggtcgctttctccatcgctttccacactccaaggtccgtcctgcgagttctcctatcacgcttggttaa

SEQ ID NO: 17775 - DNA, 1188 bp, A.fumigatus
ctttattgttatcaacataacaacaatctcaacatgtcggaattcttcagaccagcacccgagcctcgcaccgagcttggtcggtatcgcatcctctcctcgaccgcgggcatccgcgtgtctccactgcagctcggcgccatgtcgatcggagatgcctggtcggattttatgggctcaatggacaaggaatcctccttcaagcttcttgatgccttcgtcgaggccggaggcaatttcattgacaccgccaacaactaccaggacgagcaatcggagacctggatcggagaatggatggctgcccgccagaaccgcgaccagctggtcctcgcaaccaagttcacaatcgactacaaggcccacgcgctaggtaaaggaaatgctgtcaatcacagtggtaaccaccgccgcagtctgcacatgagcgtacgcgactcgctcaagaagctgcagacggactggatcgatatcctctacctgcactggtgggaccacactacctccatcgaggagatcatggacagtctgcacatcctcgtggagcagggcaaggtcctatatctggggatttcggacacaccagcgtgggttgtgagcgcggcgaacacttgtgcgcgtgcacacggtaagacgcccttcagcgtctaccaggggcggtggaacgtgatgctgcgggactttgagcgcgagatcatccccatgacgcggcattttggtatggccctggcgccgtgggacgtactgggcagcggcaagtttcagaccaaaaaggcgctcgaggagcgcaagaagaagggcgagggcctgcgcagcatgttcgggccaggggagcagacggaggatgaggtgaagatgagtgaggctctcgcgaaggtggccgcagagcacggtatcgagtctgtgacggccattgctctggcttatgtgcgggccaaggcgccgaatgtgttcccgatcgtcggaggacgcaaggtcgagcacctgcacgacaacattcaggcgttgagcatcaaattgaccccggagcagatcgagtacctggagagtgtgaagccgatggatcttggttttcctagcaacctcattggatcagatcccaaggtgactggcaaacctacactacttctggctgccactgcaccatttgttttcgagactggatcaaagccaattgggcaggcgtga

SEQ ID NO: 17776 - DNA, 507 bp, A.fumigatus
ctaggtcaatccatcaccatagatgcatctgctgactcaataggatctgggaagaccactttcgcaaaatcaatctgctccgcctatccatctttcactcgtctctccattgacgcgtatgtctactctcatcatggcctttggaacgtggactaccccaaggaacactatgagaagtatcaagaagaggcggaagcagctctgaggcagcagcttgtccatattctccaacatgacgatgcaaacgtcgtccttgacttctctttcgcattccgtgaagaccgtgaggcgtggaaagcactcatctcggaattcggtgggcgctgggtcctggtttatctgaacgtggatccaacagagattcggcgaagagtagccgctaggaatgcactgattgacaaagatggagactcggcattctacttaacagaagatctgttggaacggtacattaatggattcgaacgaccggttggagagggggagattgtcatcaacttggattaa

SEQ ID NO: 17777 - DNA, 219 bp, A.fumigatus
atgaagacatcaggaacttacaaattcttagaaaactatgtccagaactcagtatcggatccactgcgcccgggggctttaggtcttggacaatccaaagcatctctcttggtcaatatcttcttgatcatcagttatatgacgcccatggcagccggtatactggcggatgggtatttgggccggtatcgtacagtgctattgtccatgacgtactga

SEQ ID NO: 17778 - DNA, 192 bp, A.fumigatus
gtgctaacgtgtttcagtctctacgtattgggcgtagcagtgctctttgccacctccattccgtccatgctccacaggggagctgggcttcccggccttattgtggcgatgatcctcgtcagcttgtcccttggtggaattaaagcttcgcttcccccccatgcttggtacgcgggtcccccgacatgctaa

SEQ ID NO: 17779 - DNA, 741 bp, A.fumigatus
gctgaagagcgccttgtttgcctgccgtgcattgtaggtacgagggtttgcatttcgaaagaccatgtactgacagatcgaagcacgccatttgttatcttctggctttgccaggcgcagatgactacgaatactgtgtcgcaagcggctgaaatggagactcacagggtgcccaacgacatgctccctaatctgaactccataaccgtgataattgcactaccgctcgtcaccaaattcgcctaccccttcctccaccgtcggggcattccgacgcctccgctccggcgcgtcgccttgggcttcttcctggaggcactggcgatgggctatgccgctggaatccagggctggatctacagctccgggccgtgctacgagcatccacgagcatgtgctgcgtcgatgaatggatctcttccgaaccacgtcaacatcgggtaccaatcgcccgtttatgttctcgaaggtctcagcgagatatttgctagccccgccgggtacgagtatacattcaccaaggcaccgaagagcatgaaatccatcatccaggctctttatggcttgactgcagctgggggatctattattgcgcttgcgcttaccccgacgaacaaagatcctgatttactcggcatgtatgcaggggtttctggggcgatgtttgtggccgcagtgattgtcatggtggtttcttacaagcatgaggggaggactgcacgggatgatgattcgtcctga

SEQ ID NO: 17780 - DNA, 219 bp, A.fumigatus
tcctcgtcagcttgtcccttggtggaattaaagcttcgcttcccccccatgcttggtacgcgggtcccccgacatgctaaaaatcctagactgacctccacaatagcggagcagtgtagtaaaatcaagcagcggatccggattaccaagaaaggagaacgcgttattgttgatcccgacgtcacactggaatatgcttttgatgtctattactgctaa

SEQ ID NO: 17781 - DNA, 189 bp, A.fumigatus
gcgctggtaaacagagtggaaaaagctgccatgggccatttgacacggatcttcatcgaaacatatgagatttgtgagaagtacgataacccttttaaggacttcaaacttccctcgtcgagctctatgaatgatgattcgttgcctaatgttggattaccagatgcccaaacagggttgccgtggtga

SEQ ID NO: 17782 - DNA, 1077 bp, A.fumigatus
cagttgtctgcgtttcaaagcctaaaaacgcaggcccctccagcggtgaataacaaccatcatcaatatatcgaggcattccgcagcgacaaaatgactgatatcgaaaacatcgccaacctgatcaaaagcggccaggtacacaaaatcgtcgtgcttgttggcgcaggcatctccaccgcggccggcatccccgacttcagatcgcccgagactggcatttatgatcgactcaaacctcttcatctgccctatcccgaagctatcttccacatcaattacttcaggcacacccctgagcccttctacgccatcgcgcgagccaggcatcctcgctccctcaaaccgaccatcacccacgcttttctcgctcttctagaaaagaagggccttctccattttgtgtttactcagaacatagacggcttagagcgggatgtcggtattccagaggataagattctcaatgcgcacggcagctggcggacccagcgctgctggaagtgcaagactccgtatcccgatgacttgatgaagcaagcaatcagcacaggcactgtcccttattgtcaagttcctgactgtgggggagcagtaaagcccgacatcgtgttctttggacagcctctccccgcggaatttgatgaaaaggagaaggaagtatccgaggcggatatgatgctcgtgatggggacgagtctaaaggttgctccatgctcgagactgcctcgtttggctcgcgaaggcattccccgggtgcttgtcaatcgtgagaaggtaggagactttggaaagcgggcggaagatgtgtccatcttgggtgattgcgacgatggggtgcgcaaactagcggatgcccttggttggactgcggagatggagtcactgtggaagaaggccatcgcggccaaagaagcagcacaggaggattggggagaggaggagagtctggacgagctgattgacaggtacgcgaaaacgctgacggacgccaggaagatctctgctgggcataaacggatgttggaggaacacctggagaacaagtttgccgaggtcctaaagaagagcacatag

SEQ ID NO: 17783 - DNA, 207 bp, A.fumigatus
tggattgacctagttacctgccacggcgcaggtcatcaagacaaccgggcgaggatccgaggaagtgcgctgaatggcaggaccaaggcgagctatagcatccaacagacggctcatgatgcgaatgtgtatttggcagagaatgctattgaaaatgctcgaccaatagttggagatcaatacatgtttaaaaagttcaatgtatga

SEQ ID NO: 17784 - DNA, 543 bp, A.fumigatus
ccagtgcgtgtcaacaagaaaagccaaatactaaactatgtgctcttctttaggacctcggcaaacttgttctccaggtgttcctccaacatccgtttatgcccagcagagatcttcctggcgtccgtcagcgttttcgcgtacctgtcaatcagctcgtccagactctcctcctctccccaatcctcctgtgctgcttctttggccgcgatggccttcttccacagtgactccatctccgcagtccaaccaagggcatccgctagtttgcgcaccccatcgtcgcaatcacccaagatggacacatcttccgcccgctttccaaagtctcctaccttctcacgattgacaagcacccggggaatgccttcgcgagccaaacgaggcagtctcgagcatggagcaacctttagactcgtccccatcacgagcatcatatccgcctcggatacttccttctccttttcatcaaattccgcggggagaggctgtccaaagaacacgatgtcgggctttactgctcccccacagtcaggaacttga

SEQ ID NO: 17785 - DNA, 264 bp, A.fumigatus
aacgcagacaactgtcagccttccatgatcatcaatcaccacggcaaccctgtttgggcatctggtaatccaacattaggcaacgaatcatcattcatagagctcgacgagggaagtttgaagtccttaaaagggttatcgtacttctcacaaatctcatatgtttcgatgaagatccgtgtcaaatggcccatggcagctttttccactctgtttaccagcgcctattccaacccctctgatacctcgtggatggtcgggtga

SEQ ID NO: 17786 - DNA, 243 bp, A.fumigatus
aatacatacacgctatgcgttgatattcacttcattcccttttccgaaactcaagctatcgcaaccttccttctgtttagtttgaccgacccatatcctctcaagcctcagccccctcaacactgggagacattgacaatggctccttctgtgctgccctttcgcgacatcaacctgcacgcctctccctctcattatgcattcacttctccatcatcacctaatgctcagacgctcgttgtc

SEQ ID NO: 17787 - DNA, 282 bp, A.fumigatus
acgcgggatgctcgaaatgacaaggaagatttgacccgcggttggcctgcaacgaggctttcctacaatatcatctatggccgggagtcccgggagtgcatgcgttcttctactatgttcacccttgattatactcaagctgctcagtcaagtatttgctctgttttatactgtcaatgcattggacccagaccagggccactaaacaacgtcaccggcttgcaacttcgcctccgaaaactatcgaaaagcagatcaacccaaaaaaatcaaaggaaataa

SEQ ID NO: 17788 - DNA, 678 bp, A.fumigatus
  unsure (385): Identity of nucleotide sequences at the above locations are unknown.
tacacatcgcaaagcagcaatcttagttctttctacgatgtctctcaatctaggcgagatgtcttgatattcctcaagatactgcatcgagatgtcttgctcttgtatataaatgcagtccgatcactgctcaagtcttgtcatccaaaccatcctctcacctctgcttctcccgtcaactcgcaagaaaggtacgcatcctccgtcataatgtctcctcgttataccgctcaacccaccgagcaaaccactcagtgcaccgattctgctatgcaaacccgcgaggatggaaaaacggagcccacggacacctacgaattcgctcacgtcctcttcgaaatcaaaacctccccgaagaaactggcccccatcctgctcgagtccntgcaccacagactccaccacagcgacgtcaaggtctacccatctttcgacgttctccgagccgacagcgccatcaagcgcggcaacgtggtctttgccctgcccgctgcgggccagactgtcgatcaaatcatactggcggtgcggcggcaggtccagcatttgatcatggactgggatacggaagagctgagcggtgagggactgtatctggtaacgggggataaaacatgcccctggggatggagcttcctggactatcaggcttggagggagcagaggaagcgccgctga

SEQ ID NO: 17789 - DNA, 951 bp, A.fumigatus
caatcgacttcgtggtggtcttgcaatcgaagctcggaaatctatctagactattccatagtattatataaacttcgaaaacctcgattgtcctggttggttttcttgctgcctgaaatacgagtttggggcctcatgacattcgccggcgaccatcaaaatgatataaaagtcctcgcacctgcggttagctatacttctgcacacgacgcgagcagtatgccgcaatcactctatttatcttcatcttcgatcccagaaaaccacatcgcgcggttatctacggagaccgccgcacacgacatcccctccaacccctcctacggcatcgactctcctctgggactgatcgcctccaacgtcctctccccattctacctctacgcaaccctcaagggcaaattccaggtctgggatgacctcctcgcccacaccccccaggaaactttcagagcacccaccctcgacctcggctgcggccgaggattggtcctgttgaagatcgcccaaatcaagaaacgactcgcctcgtcagagtcccccgtgccccccgcctacggcatcgatctcttcgtcaagggcgatcagagcggcaacgcgccgctggcgacttacaagaacgccgctgcgttgggggtctgcgagcagacggtgctgcacacggggagtgttgcggatctgccgttctgcgatggggtgttttcgctggtgacggccagtctgtcgattcacaatgcggataaagctacgcggaagaaggcgataggggaggcggcgcgggtgttggtctcggggggatacttggttgtggtggatatggcggggtatgttgaggagtatgcggatctcgtcaagcagatgggctggacggatgtctcgacggagtttgggggggtgaggattatgtatggggcttggccgtgtcggatcttgagggcgaggaagccgtga

SEQ ID NO: 17790 - DNA, 1026 bp, A.fumigatus
cggaacgcacacagccctctcaacaccatgaagctcttcctccttcttctcatctccgcccttgcggcggcggcggccctgcccagcagcttcaaatggagctccagcgggcctctggtcgagcccaagaaggatggccgcaacatcgcagctatcaaggatccctccattgtcaaagtggacgggacgtaccacgtcttcgccagcacggccaccaaatccggctacaacctcgtctacttcaacttcaaggacttcagccaggccaaccaggccacgttccactaccttgaccagaccccgatcggctcgggctatcgtgccgcgccgcaggtcttcttcttcaagccacataacctgtggtacctggtcttccagaatggcaacgcagcgtattcgaccaatccgaacattgccaacccggccgggtggagcaaaccgaagaatttcttcagtagcatgcccagcatcatcgcccagaataagggcaatggcaactgggtcgacatgtggacgatctgcgattcaagcaactgctacctgttctcctcggacgacaacggccatctgtaccgctcgcagacctcgttggccaacttccccaacggcatgggcaatacagtgattgccctgtccgactccaacaagaacgccctgttcgaggcgtccaacgtctaccacaccggaaacggggagtatctgcttctcgtggaagccatcggcagcgacgggcagcggtacttccgctcctggacttccaacagtctgaccggatcgtggaagggcctggccaacaccgaggcaaacccctttgcgcgctcgaacaacgttgccttcagcgggaccccctggaccaagagcatcagtcacggggagctgattcgcactcagacggatcagactatgaccatcagtccttgcaagctgcagtatctgtaccagggattgagcccgtcggcgggtggggattacgacttgcttccttggaagcttggtctgatcacccagaccaactctaactgctga

SEQ ID NO: 17791 - DNA, 594 bp, A.fumigatus
agctcttcctccttcttctcatctccgcccttgcggcggcggcggccctgcccagcagcttcaaatggagctccagcgggcctctggtcgagcccaagaaggatggccgcaacatcgcagctatcaaggatccctccattgtcaaagtggacgggacgtaccacgtcttcgccagcacggccaccaaatccggctacaacctcgtctacttcaacttcaaggacttcagccaggccaaccaggccacgttccactaccttgaccagaccccgatcggctcgggctatcgtgccgcgccgcaggtcttcttcttcaagccacataacctgtggtacctggtcttccagaatggcaacgcagcgtattcgaccaatccgaacattgccaacccggccgggtggagcaaaccgaagaatttcttcagtagcatgcccagcatcatcgcccagaataagggcaatggcaactgggtcgacatgtggacgatctgcgattcaagcaactgctacctgttctcctcggacgacaacggccatctgtaccgctcgcagacctcgttggccaacttccccaacggcatgggcaatacagtga

SEQ ID NO: 17792 - DNA, 1269 bp, A.fumigatus
ccacgacgaatttctgggacgagattggcacaggtctttgcggcggtcttggttttgttccttatattcctgctgggtgcatataaagcctctagtggcttccgagcttcgcactcttcccaacatctgctctccaacggctccgccctctttggtcctaccaccatattaatttccctcgatgggttccgtgcggacttccttgatcgtggtctcacgccgacactgaatgcgctgatcgccgagggcgtttcgccaccatatatgctccccagctttcccagcgtcacatttcctaaccacttcactctggtcacaggcttatatccagaaagtcacggtattgtgagcaacactttttgggatcctgccctaaaggaaaatttccactatacgaaccagtcaatcagtatgcagcctaagtggtggaatgccgaacccttgtggatgaccgccgaaaagcacggccttaaaaccgggattcatatgtggcctggctccgaagcgcacattggaggagtagacccaacatttttggacaagtacaatgggtcagaaaagctctcgcgaaaagtcgatcggatcctggagctgcttgacttaacaggcgcggaagaagaatctttgatggtccccgagcgaccgcagttcatcgctgcatatgttcccgatgttgacgcagatgggcacaagtttggccccaacagtactgagatccgacatacaatatcgcaggttgacagcatgttggctgagctgatgtctggccttcgaagccgcaatctgaccgatattgtcaaccttattattgtgtctgatcatggtatggctacaactgctacggaacggttgatacaactggatgatttcattgagctgggtctggtcgatcgtattgatggatggccattgcgcggtatccggccgagaaagcctgaggatcttgaggtcttgcaaaaacagctggaaaacctgacgctacaatacccacaagcggtggaagtctacacacgggagacaatgcctgagcgatatcacttttcccgcaatgaccgaattgctcccctctgggtgatccctaagacgggatgggcgatcgtcgagcgaccagactttgatgctcaagaggccatccgaactggaagagtttatcacccaaagggtgttcatggttacgaccatgagcatcctctgatgcgcgccatcttcattgctagggggcctgcgtttcctcatccacccaacagcccggctggaagttttccgtaa

SEQ ID NO: 17793 - DNA, 420 bp, A.fumigatus
gctaacatgcgtgcagagaatatcaatgtgtataacttggtctgcgattctctggggattgatccgctccccaacaatggaacgatgcgccttcctctacagccagtgggctttcattccgatgaagatgcgccgattgtcgacaagcctgctgaccctccgatcagcagcgctagcatgagtgtaatcccctcgcaaaccacgacaccggcctcgacatcttcagaggtgccggcaacagctcttcttgcccagccaacctcaccatctgaaaatgagcccagctcagagccgcaaaacgaaccggaaagcgacgacgagcaaggccctacttggtggggaaccctctggagcaaagttgaggagatcaaggaatgggctactgatatgatcgagaccgtcaaggacaatatcgcgtaa

SEQ ID NO: 17794 - DNA, 774 bp, A.fumigatus
tcttcttttctctttttcgacttctcgtcatttttttcacggtggatggctgtgccgaacatggcgtcgtatttggacagcaatatcagcaataatagcagaaatgccaccaccaccaccttcgacacggctgtcctggacgcctttataccgggatactctattctctctcgctttctggtgtcgtacctccagatcgatctgtcgtactacctgcccttccttgtgatggcggccgcagtgaccgcctccttgcgctacaccattaagagaattattcatctactgggggaacacttcacctcgacggcggagatccgcctcgacgatgaaatttataattatttgatgttctggatggcacagcagccgttcacgaagcggacgacgcatttcgtcgcggggacgaaaatcagcagtgggatgcggtactgggattctgataacggcgaggggtccgacgatgaggacatctgcgatgacgatgacgacgacaacggcagtgccggcgacaacagcgacacgctggccaactttgaccggtactggcaaaaggtcatcagtaaggacaagtaccgcacgctgcggttcacgcccgccgaagggacacactacttctggtacaaggggcgtccgctggcgttcatccgggagcgggaggagaacaacagcggcatgagtctgcggtgggtgccggagcggctgtacctgtcgtgtctgggacgcgacaggtacagcgtcttcacccaccggggcaggaaggtaccgcgctcc

SEQ ID NO: 17795 - DNA, 603 bp, A.fumigatus
ggcgatgattatcatctatggagtacggagtatgctggttgccatcaacacttgaatcctcatttctgcaatctctacactgtgtatgtcgtgacaaaggacctgtcctgcacggccatgcctccgagacctgatcttctcagtccttccctcctctccccgggtgattacgacgatgatgcctcctccttgcgatccctatcagagcaggactctgactccgacgacgatgaattccttcgcaaggctcgcactacactagagctagccgaacatgatcgtgcagttctggaagaggaggaagagatggagaaattgttggtcagaagcgggccagctcatggtctgcgacgaatcttcagcccgaacggcagcagcgtcaagatcgggaaatacgagcggaatcgggaccgaaggaggaagcgccacgatgagcgcaaacggcgtcgtcgtagtgcggtaggggaaaatggagagctaacgtacgaaatggaagagggctatcgagagtccgaatcctctctcctgagcggctcgtcatcggagctagaccagaggctggagaagcagtatgcgagtattcgagtaagggcggacttttag

SEQ ID NO: 17796 - DNA, 399 bp, A.fumigatus
tgggtggtgagtagtctctcaatcgtcatggtgtcgtcgtcgggaatgctgaactcccttaggccttctggatgggctttcttcgtcggtttgctgcaggcagcttacaccttgacggggtacggcatggtcgctgccatgtgtgaagaagtgcagaatcctcatcgggagggtccccaaggcaattgtcctttcggtcgtcgccgccggtatcaccggtctcatctacctgatccccattctcttcgttctgccgaccgtgaaggacttccttcagtgtggccagtgcccaacccatcggcctcatcttcaagacagcgactggctcggccggtggtgggttcggcttgctgttcctcatcctcggtattgccatgttcgccggcattggctccctga

SEQ ID NO: 17797 - DNA, 276 bp, A.fumigatus
gcatttgccgcacattgcctgcactgcgccactgatcttcccacttgggtgctgcccctccttttatgtgactgtttctgtgatgatgctttcccatatttgctcctcttagctctcaccgtcttttctctcacccctgtcgtcctcattcaccgtgccgggtctctcaagcatgattcgacccactggacttactcttcgcttgcgatcatgcggacttcacacagcacacgacccgaagcgaatcttaaaaaaagctcaaaggagataaaatga

SEQ ID NO: 17798 - DNA, 585 bp, A.fumigatus
tcggtcgcatgtccaaacagttcctttgccatcatggccgcgcccttcggtctcagcaccaccatgtacatcaccctgaccgacggtcaatccgtcaccataatctggggctgggtcctcgtcaccttgatctcgatcgcgatcgccgcctcgctggccgaaatctgcgccgtctacccgaccgccggcggcgtgtactactggagcgccatgctgtcgaccaaggaatgggccccgatgatgtccttcattgacggatggttgacactcgtcggaaactggaccgtcacgctcagtatcaccttctcgaccggccagctgatcctgagtgcgatctcgctgtggaacgaggactttgtcgccaatgcgtggcagaccatcctgatgttctgggcggtggtgctcgtctgtgcaatggtcaacatcttcttctccaagtacttggatttgatcaacaaagtgtgtatcttttggaccgcggctagtgtgatcatcatcttgatcgttcttttatcgatggcggataatcggcgggatgcggcgtttgtttttgggcattacgatgcgtcggatagtgggtggtga

SEQ ID NO: 17799 - DNA, 585 bp, A.fumigatus
  unsure (548),(562): Identity of nucleotide sequences at the above locations are unknown.
ttgaatcccacagaaggcgatgtggagggcgtcatggaccgacccgtcgggaacactgctgatgtctacgcggaatgtgagaaatggtatgctggtcctttcgcttttttgtttgctggtcttatcgggccgatgctgatcagacgcagggacgcatggtacgcccagcgcgggctctcccgcacggaggccaaacggcgctacatctccaccctcatcgacacaatgcaccggtacgcttcgcagacccccgaggcgcgcgagctcgtcgcggagctcgagttcgtctgggaccagatcaagtcgaatacctcgtcctcgtcctcgtcgagccccatgcagaatgtgggtgtgccgccgctaccccagccgaactatgcgagtatcgggggccggttggcccgtccgatctacgaggatatcattgctaccgcgcgggataatcacagtcgggagcggaaccatggagattccaggttacgtgtactcagtccggtgagtcagcctgatgggctgtatgagcggcgcgggcacaaggacctggggtnttcgcgtcggggcntgccagatccgaaaatagttaaa

SEQ ID NO: 17800 - DNA, 297 bp, A.fumigatus
tataactccggtactgatctcaaaactttgctgcaccatcttctagacatcgccgaggccatgcacgcggccactgttgatgccagcgccgacgcggcgctggccaggatgggctataagagcgaattacctcgtaatctgagcatgttgagtattctcggactgtgcgtgattcttcaagacgtcttctccctgcgtggcactggtgcagctactgatcggtcgcatgtccaaacagttcctttgccatcatggccgcgcccttcggtctcagcaccaccatgtacatcaccctga

SEQ ID NO: 17801 - DNA, 723 bp, A.fumigatus
aggacttccttcagtgtggccagtgcccaacccatcggcctcatcttcaagacagcgactggctcggccggtggtgggttcggcttgctgttcctcatcctcggtattgccatgttcgccggcattggctccctgacggcggccagccggtgcacctacgcatttgcccgtgacggggccatccccggattccgcatctggcgcaaagtcaacaagcgcctcgatgtgcccgtctatgccgtcttgctctccgccgcggtcgactgcctcctgggcttgatctacttcggctcgaccgcggccttcaactcgttcaccggtgtcgccacgatctgcctgtcgacttcgtacggtcttccaatcctcatttccatggtccgtgggcgccgggacctcaaggaatctaccttctctctcggagcattcgggtatgcgatcaacgctgttacagtgtgctggatcgtcctggcggtagtcctcttctgcatgcctgtctccctgccggtaactgccagctcgatgaactacgccagcgtcgtgttcgcggggttcgcgacaatcagcatcatttggtacattgtctatgcccgcaagcatttcactggaccacctgcgtcggccgaagaagtaagggcgcggcctgtgatgacaggaaaagcggttgtagatgccgagaatgcatattcggatggatcgatgtcctccaagaaggtggagcaatga

SEQ ID NO: 17802 - DNA, 885 bp, A.fumigatus
cgttcttattgtggtgatacatatagaaacagatgggtgctcgatggataccttcatctgcaccaggcacagaaagagctcagtacacagaaaaaagaaactagtacaacagcaggaagatcattgctccaccttcttggaggacatcgatccatccgaatatgcattctcggcatctacaaccgcttttcctgtcatcacaggccgcgcccttacttcttcggccgacgcaggtggtccagtgaaatgcttgcgggcatagacaatgtaccaaatgatgctgattgtcgcgaaccccgcgaacacgacgctggcgtagttcatcgagctggcagttaccggcagggagacaggcatgcagaagaggactaccgccaggacgatccagcacactgtaacagcgttgatcgcatacccgaatgctccgagagagaaggtagattccttgaggtcccggcgcccacggaccatggaaatgaggattggaagaccgtacgaagtcgacaggcagatcgtggcgacaccggtgaacgagttgaaggccgcggtcgagccgaagtagatcaagcccaggaggcagtcgaccgcggcggagagcaagacggcatagacgggcacatcgaggcgcttgttgactttgcgccagatgcggaatccggggatggccccgtcacgggcaaatgcgtaggtgcaccggctggccgccgtcagggagccaatgccggcgaacatggcaataccgaggatgaggaacagcaagccgaacccaccaccggccgagccagtcgctgtcttgaagatgaggccgatgggttgggcactggccacactgaaggaagtccttcacggtcggcagaacgaagagaatggggatcaggtagatga

SEQ ID NO: 17803 - DNA, 186 bp, A.fumigatus
gctgcctgcagcaaaccgacgaagaaagcccatccagaaggcctaagggagttcagcattcccgacgacgacaccatgacgattgagagactactcaccacccactatccgacgcatcgtaatgcccaaaaacaaacgccgcatcccgccgattatccgccatcgataaaagaacgatcaagatga

SEQ ID NO: 17804 - DNA, 201 bp, A.fumigatus
atattcctgagttcattatctctgatgtcgatggaattcccttatctccattctacagacaacatgcttgattcggtccagatgtcaatctctagctacataatgatcatgctcgttcaatactttcaactgttaaaccatgactacgtgaaaaaaatgtctagcgcaggacagaggagaagtagtgcaatatgcaaatga

SEQ ID NO: 17805 - DNA, 1074 bp, A.fumigatus
  unsure (97),(101),(151): Identity of nucleotide sequences at the above locations are unknown.
aacgggaaacgcaccacgccacttgggcattttttcaatagaaggttcgatttaaattttgtcccaatggcgtcccccctacccaagcatcaatgtnattnttgcccttcggcagcggggtcggaacatgacctccggttacctcccgatntgtatccgacttcccacaatccccaagttgacgcgattattcgaacaaaacggaaggcgcgcgagcccaaagcatgttatccatgccatgcacgcaaagttaaatgcgaccgcaatcttccatgcgacggctgtgtcaagcgcgaccatcccgatatctgctcgtatgagcggccgtcgaaaaaaagaatcatagcgagttcagtccctccgtcatacaacgacagccccgccggagcctctcagcccgatgtggcggagcacacggtgtcggctgcccaggaggagcctcatctgcggatcaagcaggaggccggagcaagtcggattaactccttgggattcaggcaccgcatatctattgcgcgggaggagtgggacaatgttcgcaacaggctaaaggagatggagaagaccatttcgaacctacgagctggactggaacgggccgaggagggccccggtgggatcctggagacggccagtgcgcatagcgcggatgagggtaatcggtccaaggctggttctccggaacgggagggcattcatgcagcgaacacattgggcgaaggcaccgtgcacttgggatctcgatccgtccttgcgtacattctcaacaacaagtccgggtctgatcagctccaagctctccttgagggtggaatcctgccgaagttgggtctcgacaatgagtccgccacatatccgtttgttgatttgtggtcgtcggatatgtcaacctttgacattagcgcagtctgcagtgcgcttccaaatgatcagcagtgcaaggagtcagttctttacctgtggctgggatgttatgcgcctcgttggatgctaacgggctggcagatttttcttctactatcgcgacgtcgcaggcgccatttaccctgtcatcgaagatatccagcagtttga

SEQ ID NO: 17806 - DNA, 186 bp, A.fumigatus
  unsure (65),(101): Identity of nucleotide sequences at the above locations are unknown.
ttgaaatcgacaatgtcctggagatgtctcggcagcgagacgcgggagttcaggaccggtggttntggaatgactctagtgcgtctagggttacgatccangggagatggtggtttcgacggctatgtccttgtttttttgcagaccttggatgtcacgggcttttcgattcgaggaggactgtga

SEQ ID NO: 17807 - DNA, 480 bp, A.fumigatus
  unsure (11): Identity of nucleotide sequences at the above locations are unknown.
agtcattccanaaccaccggtcctgaactcccgcgtctcgctgccgagacatctccaggacattgtcgatttcaactacaccgtcaaaggacaagttggagtatgacgcatttcacgaccttgctgagtgagcctcgcgccaagggtctgttcaggggtgttgtcggcagatgtgtgatgtccgcgcgccttgcgagcacgatatgtgacttacggattagagacatcctcggcacggggacggtaaatgaatccatggaagggagctatggaaatttgcttgatatcatgcaggttggcaaggtgcctttggcgttattggatgcgtcgccgaggcgcttcgtgcagaatggggatctgcccaatgaagccagcaagagcggttcagtagatagatgtatttcagtcatgaaagaaacattccaggtccctgtgttgcaataccatgaagctggagtggattatagattcatatactga

SEQ ID NO: 17808 - DNA, 984 bp, A.fumigatus
aagaacatcgagttattcttctgcctttatgcacgtcactggaacaatgcgccacaatgcaattcatcccactcccggctcttgggattcttccagtgcttaccatcgatttggcgagcgttgcaatgcctccgacgttatggagatacgaaaaacgtatttccacatgtcgtgaattttggcaaatacatgttcggagtcatttattacgccacgttgagcatgtaccgtatcgagaagatgacgcggttccaggctccctttgtcacttttgctttgctcaacgccgtctatacctcagtttgggacttgattatggactggagtttgggcaatccctatgccaagcatccactattgcgcgaagttctggcattccgaaaggtttgggtctactacgccgcaatggtcgccgatgtcatcatacgtttcaactggatttactatgctatttttgccagggatatgcaacactcagctttactgagttttatggtcgccctgtctgagatctttcgaaggggcgtctggacgatatttcgcgtggaaaacgaacattgcaccaatgtccttcttttccgagcatcaagggatgtccctttaccctatgaagtggcctctcccgaagtcgaagcggaccatccaggagaggatgtgcaacttcaggatcaacacgccaccacaccactgtccgctcctgcagacattgaacagggaacgccaattccgccagggctgactactcatccgcgcggcctctctcgcgttggttcgcttatggcgactgctcacgctcaagacttcgagcggaggaagcgtccagatcaactgactggggcttctgcaacccacggcccgacaacaaccgacgacacaagcgacgaagaggaagatgatccggttgactctagacaagataccgacacagacgaagccatgtcagaacgcttgtcagatgcaaatgctcaaatctcacccaagtaa

SEQ ID NO: 17809 - DNA, 1569 bp, A.fumigatus
tttttctccgagcagaccggcaagaagaaagtcaaagccatcgcccgggcaattcaaaagaccaatcgaagtcctcggcatccgtctctcagacgtacagctattggacctggtgatccgactattacaccctctggcacgcttcgctcctcaccaggtcaaacctcagacaacaagagactcgaagcttccaactcattccgcagcccgtccatcccgatccgggccgatgcccatgcgacgacgtccagatcgactcctggccaacgcgatgaacgtcagcccttgcgagtcccaggatcgcgtttctccgcagtcctgggaagttacggcagcatcatagcgtcacccccacaacatggcgcagcttcggatttggtctctctagagctccctgacccagcactcgatccgaaggatgatatgtcctattcgccctcagcagacacaatacgtcgaggtgtaccgaaaactccatcgcccgtgatgtctcggtgcgacaccaatcgaagtctgtctcgtgatgccgccagtaaaagtcctgccgcaaagttcgcggggagcaagggaagcctgagaaacaatttggcagggccttccactaccagggcttctcaaatccttaagcgtgtcttctcgcatccagactggggaccgcccgagaaacgcgcggaggctgacactccagtatcggaggtcgagcgacgagaggatgaattttttgcgtttctggacggcgaactcgccaagatcgaatctttctaccagatgaaggaggatgaagccacccagcgcttacaagtcctccgacaacagctgcatatcatgcgagataggcggatacaagagattttgggcaccaaatcaaaatccaaaaaagatgaagcgcatcagtccaacgggttcagcacactgaatgctctcagtgcctttcacctgaaggaaacattgctggggcgtggccgcatcgggaagaattccgaagcgctggcgcagatgaactccccggccgcacttcaagcgcagaatcccgaggcagtctcgggtcgtagagacttcatgcgccggccagaggactcacagaacgatgaagtcacctatcggtttgcgaaacggaagctgaaatatgcactccaagagttctaccgcggccttgagctgttgaaggcgtatgcctacctcaatcgcactgccttccggaagatcaacaagaaatatgacaagctggtcaacgcacgcccgacgatgaggtatatgtcagagagagttaacaaagcatggtttgttcaaagtgaagtcgtagagaacctgatggctgctaccgaagacctatatgctcgctatctcgagcatggcaatcgcaaaatcaccatctccaaacttcgccatacgaccaacaagtcaggcgattattctccaaacacgttccgtgccggtcttctttcaatggctggtgtcttgtttggcgtccagtcgttgatttacgccactcggcaccttgagcactcggaccctagtgtacaggtccaaaccagctatctacttcaggtcagtgtcgcctcgcaataa

SEQ ID NO: 17810 - DNA, 312 bp, A.fumigatus
tggcgtcttctgctcgctggtttatatcctgttgagtttcgcgatttcttccttggcgatatgtattgctcgcaaacttacgctatgggggtgagttctatccaatgcatttcaaaagatagtttgttaatgtttgaaagaacatcgagttattcttctgcctttatgcacgtcactggaacaatgcgccacaatgcaattcatcccactcccggctcttgggattcttccagtgcttaccatcgatttggcgagcgttgcaatgcctccgacgttatggagatacgaaaaacgtatttccacatgtcgtga

SEQ ID NO: 17811 - DNA, 270 bp, A.fumigatus
caattccacctccctctgtgcataaccatgaattcacttactgtgtctcctaacgccctatccgcagagatcgagctctacagattagagcagcgctatgctcgtcgcaagcaccgcagcacattctccggcgtccaatacgtcgacggcgaatatgtctactccaacggctcgaactcgccaacaggaactgtctccaaacattcaactggcagttactggaagaccccgacctggggtggttccggttccgagtcgcgatggcggtga

SEQ ID NO: 17812 - DNA, 342 bp, A.fumigatus
gcgatagctccttggcgcctaaatatacaagaaactctaacaaacatgcttttagacggagttacccgaatcggagctactctatttcaagagcttcgcaacgctgtcttcgcgagcgtggctcagaaagcaattcggagggttgcacggaacgtctttgagcacctgctgcgtttggatctcaactttcacctcagtcgccagactggtggattaacacgagcaattgaccggggaacaaaaggtatcagcttcttgctgacgtccatggttttccatgtagtgcctactgctctggaaatctcgctcgtttgcggtatcctggtaagccgcagtaattga

SEQ ID NO: 17813 - DNA, 1053 bp, A.fumigatus
acataccaatatggattccaatttgctgcaatcacagcggcaacgatggtggcatacactgccttcaccatcacaactactgcctggcgaaccaaatttcgaaaacaggctaatgcggctgataaccgtggagcgacagtggctgtcgattcgctgatcaactacgaagctgtcaagtacttcaataacgaacaatatcaggtggcgcgctacgataaggcactcaaggcttatgaggatgcctccatcaaggtgacgacgtctcttgcctttctgaattccggccaaaatatgatattctcgagcgcgctggccgcaatgatgtaccttgccgccaacggagtcgctaacggaaacttgacggttggcgacttggtcatggtcaatcagctcgtctttcagctctcggtgccccttaatttcctcggatccgtgtatcgtgaacttcgtcagtctttgctagatatggagacgctgtttaatctccaaaaggtcaatgtcaatatcaaggagaagcccgacgccaaaccgctccagctccacaaaggaggcgagatcaggtttgaaaacgtcactttcggctatcatcccgaccgtcctatcctcaagaacgctagcttcacaattcctgcaggacagaagtttgctatcgtgggccctagtggatgcggcaagtccaccatcctgagactcttattccgattctatgatgtccaggaaggtcgaatcctgattgatgatcaagatgtgcgtgatgtatctcttgagagcttgcgtaaagcgattggagttgtgccgcaggatacgccactgtttaatgacactattgcccacaatatccgttatggaagaatcgatgcaaccgacgaggaagtacacaaggccgcacaacgagcacgtattgatgctttgattcagaaattgcccgaagggtatcagactgcggtgggagaaagaggtatgatgatatccgggggcgagaagcaacgattagccatctcccgtctgattctgaaggatccggagctcttattctttgacgaagcggtatga

SEQ ID NO: 17814 - DNA, 318 bp, A.fumigatus
acctccgccctggacacatacacggaacaggcactgctgcaaaacatcaacagcatcttaaaagagaagaagcgcaccagtgtgttcgtggcgcatcgactgcgaacgatctatgacagtgaccagatccttgttctcaaggatggacgtgtggcagaaatgggatcccaccgagaattgttggatctgaatggcatttatgctgagctgtggaatggtgagtgtactccgcaggaatatgaaggtacggattggactggagctaatgatagattgtgcagcgcaagaaatgtctctagcacaagatctcgagtttga

SEQ ID NO: 17815 - DNA, 471 bp, A.fumigatus
acccctctccactttgtgacatccagcttacagacaatccagtatgacaccagcggcaaactcgccggcagcactcccgaagaacgcgccactgtcaacaagtggctcgcctggcaggtgtccggtctgggcccctaccagggccagctagtctggtttctcgccttccacgagggtgctcacggcgagaagcccaatggctctgtgattgcgcgctaccaagcggaggtggagcgcctgcggtccgtgctggagaagcacctcgcgtccgcggagaacgggttcgttgcgctgggccgtctgaccatcgctgactttgccatccttccatggttgaagatctcggtgctggctgggtctgcactcaagtcgtttgaggaataccccgctatcaacgcttacattaagaagctggatgcactgccggaagtgcaggctgcttacaagaaggctgttcctcctatgcagtag

SEQ ID NO: 17816 - DNA, 1713 bp, A.fumigatus
gcctttactaattgctattgcgcgtgtactggtagccctgaccattcgttgcctccatcatccatagcaaaaatgttgtccaacaccatcacgatcgttcccagcatcgaaacccgggtcgttgagcccctcccgcaatttgatacctcgcgccggttgagcttccccgtgagccttcccctcgattcgctggcgggggcgagaaagaaggccgcaaatgaagctcttgtcgaacgcatcgcggagatcatcgcctcataccgcatcagcggacctgacgaccggtatgaggttgtatacaagcccaagctgctcgacacgctgcggtattttgtctccaagcaggaacccgtcaacatggtggtccccgcatacccgttcaagagcccgaaccgggacgagaaagtgcttgggcccgacccggatgtcggcgagcgcatgtccctcgagcatttcaactcgatgggtgcgcgcattcagcagatctacccgcctgggggatatgtgaccatcgtcagtgatgggtgctgttataatgacctgcttggcgtgtcggacgaagaggtcttccgatacgcagagggcctgcaccgcatcgtggaccggctggggctgaagcatattaaattctccgaccctttcgacctgatcgagggacggcacaatgtccccgtcactgaggaggaatacgccagccgcatcggcgagctgaaggactatctgttccgctcgtaccaccccgatggctacgactttgacgaggaactgagcaaagatcccaacgcggccctgacatatcgtggctacattcggtttctcatgtccgatctcgccctcttcttcaaggagagacagatgagcaagaacgcgatcaagaaacactgctccaccgtcgcccgcagcatgatcaagcgcggcaaggcattttccgccctcgtcgccagggcctctcccttgcacgtccgactctcgatccacgccagcgacaacacgggcaagctttccgttgccctgctgccgcacaagcggtacagcactttcccggtcaccccctggcacaacacaccctacctggacacgaccagcgtctcactcagcttgagccggaagcccacggacggggccaccccttaccgtctctgccaagacgagctgggccttcacttcctctgcgcggatgtccccatgtaccgcgtcatcgaaaccccggacctcccggcgctcgcccagcaagtccaattccagccgctctacccgttcgggctcaggatcaaggtcccaaggggcacgcccatcggccaattccgcctggagcgggtcgcggaactagccaaggtgcattcccccattatcttcgagggactggacccgatggagtacaccgctgccattgcggatgacttccagcgcgtcgccggcggcacgatgtcgctgagcatcttacatgagggcgtcgcaacgaccgccaacacagcaagacacctgggcggatccgcagcggcgtcgtattttttgcagatttcggccgcgaccggcgacgatgcgcagcctgcgcttctgcccttcctcgcggcggctgcggcgctggacgatgtgcggtatcgtgtgttgcatcactggcaggccggccatgcagttgtctcggaccaccgggttgcgctgccagtgcatttgagtccgtccagtttgagggtgctacatgggggcgtttaa

SEQ ID NO: 17817 - DNA, 213 bp, A.fumigatus
tacagctgtgctggtgatgggcttgcgcctggctctgaagtttctgctctcagcttgatcaatgccgctgctgccgctcctatgtacgtccagcacactgggctgagaccctcaagtaccaaccactggaggtattctacccacggtatccgtcctccgcggaagggccttgcccctaagcaccgcaggacgtctttgcgtccttcaaggtaa

SEQ ID NO: 17818 - DNA, 351 bp, A.fumigatus
gagcccatgacgaggtacgaatacccgagacttgccctcatttccacaatttctgggatttgcataagctcagctaagtcttcgatgcagggcagcataaggcttccacctgagaggacaggatccagttgtcgtgatgttggaatgctaggagttttgctccatgttatcggagatgcagtgaacaatctcggcgttatgattgctgcactggtaatctggttcacagaatatgaaggacgatactacgctgatccaggagcaagtttatggatcggcgtcataatcatactgtcttctcttccgctccgtatgttatcctccatccggggagttgttaggtggtgctga

SEQ ID NO: 17819 - DNA, 309 bp, A.fumigatus
  unsure (239): Identity of nucleotide sequences at the above locations are unknown.
acctcaatcactattctcctcttagataacaatactaaccgcatgcacaggtgcgttcgcccccatcccccagtcacccgagccctgcgccacgccaaagaaaagctcctcgcagccggcctaaaagtcgtagactgggaaccctaccgccacgaccacggctgggaggttatcgtgcgtccttcctcattctcccctcatcccttgcatctgctaactaacaagtcaagtcatccctntacttccccgacgccgccaacagccaacgcaccgtcctctcccaaagcggcgagcccctcctccccctaa

SEQ ID NO: 17820 - DNA, 609 bp, A.fumigatus
gaagaggaagctactgctactatcgaccgcgactgggggggtgttcgtcgaccctacagccgcaaattccagtggcttccctgtgacgtgcatttcactgacaatggcgaatgtcgcattgcgtcgtatataaataacctgcatccgaacaaacatcgccagctgtaccaagtcatcgagaagatcctggagcacaccatcccgctgtggaacaccaccttgaccctcgtgcgggataagtacaagcgaatcccctacaatgaagtccaatatgacgagcatcccgagccggagccgcagccagaaaacgaggaagacgagcatagtgacgaatattatcaacgatacgacgaatggcaaaagcgagagcccatccgacgcccggaaccgggcgagttcgctccccatgtaaccgaggccaagaagcaggtcaacctgcacaaggactttgccgagagaggcttgcaagtgatcattaagctggccaatatcgagttgacaccggagaagcccgagtacgagggcggatcgtggcacgtcgagggacaactggtatgttgctttgctggagcacacaagcacacacacacacacacacacacacactga

SEQ ID NO: 17821 - DNA, 609 bp, A.fumigatus
ctttcacagaatgagcatatctgcgcttcagccatctactactacgacagtcagaacatcaccgacagcagactcgcattccgacaacgggcggatacagaagaagtctcacatatctcctatgaccaatcgcgacacgaattcctccacgaaatctttggcttggataatgaggcgggttggaacgagggcaatgtcactcaattcctcggcggggtggacactcgtcaaggacgcttgctcaccttcccaaacagcctgcagcaccaggtgtcgccgtttgcgctggcagatcggtccaagccaggccatcgcaagatcctcgctttcttcctcgtggacccccatctctcgattatttcttcagcgaatgtgccacctcaacaagaggactggtggaaggaacggcaggaggttgtcgggaagttgttgagcgagagactcccggctgagttgcagaatatggtcaatgagggtctcgacgctacgccaataactttggaggaggcaaagcagtaccgcaaggaattgatggaggagcgctccaacaaggcgcaggaacagaaccgggactttgaaaggggggagtttaacttgtgcgaacattga

SEQ ID NO: 17822 - DNA, 315 bp, A.fumigatus
tacatcatgtctgtacaaaattgggaaattcgagcacgtcgtgctaaagacgtacttctgaactcagttcccaaacaatggatccttcccgcacacaaactgcctccggcgcaccagaaaaatgtcgaagactttcctcgaaagagcggcatcctcagtgatagagaagtctctattaccgagatgtctgctaccgcgcttgtagcaggtatgggagcgggcctattgagtgccgaggaagtggtcgttgcgtttctcaaacgagctgtcttgggccaccagttggtatgctgcgcaaccagaagcgacgtttga

SEQ ID NO: 17823 - DNA, 243 bp, A.fumigatus
ctcaattttgctacggagttcatggcggagagagccatttctagggctaaaaagcttgacgagtacttcaagagaactggaaagcttgttgggcccttggtaggttggcctatcatgtcaaaaagagcaaacgcccctaacggcgagtctactgtagcatggcgtccccatcagcgtgaaagagcatatcgagatcaaaggtcgaacctgcaatgcaggctttgtggcatggtacgattctag

SEQ ID NO: 17824 - DNA, 501 bp, A.fumigatus
ggaacgcagagcatagaagcactgacacagcaaacaaagctttctgagatcgacgatccgccgaagattctggccttcgggtggcagcgagcaccagtactgggagctttctttaacggagcgcttctctttgcgctgggaataagcattctattgcaggctgtggagagattcatatcattgcatagttcgtgcctgccttcaacgtgcaggcgactcactgatattttacagagatcgagaatcccagactcatgttcattgttggatgcgttggcttgggtcttaatatcctcagcgctcttattcttcatggcaggcttgtctttctggatgtgcagtcccgttgctaatgtcaaggcattagagaaaagttcccatacccatcgacacgcgttagatacgtcgacagactcgtccataggagcccatgacgaggtacgaatacccgagacttgccctcatttccacaatttctgggatttgcataagctcagctaa

SEQ ID NO: 17825 - DNA, 225 bp, A.fumigatus
attcagggagtgctgtcgattcatgagatcaatgtgtggcatatcagccagcacaagtccttagccgtcattggagtgctcctcaccgatcaacaagtcccagggtccaccaaggtgatcagcatggtcaacgagtgttgtcagaagtatggcattcaatctgttgctcttcggcagaagctacattcacaagaattgtcattggcagcgttagacagaatttga

SEQ ID NO: 17826 - DNA, 462 bp, A.fumigatus
  unsure (430): Identity of nucleotide sequences at the above locations are unknown.
catctctgctgcgacaacaatctcaccggtcccacgaggaacccttataaccgcaccctcacacccggcggctcctcaggcggcgagggcgcctcaatgggcttcaagtgtgctgctctcggtgtcggtaccgacattggcgggtccatcagagcccctgctggcttctgcggtgcatatggattccgtcctaccgctctccggatgcctgcgacaggaatcaaagtccccggcccaggacaggagtccatccacggcaccgccggaccgttggcaagccaaagtgtcgaagatctaaatctcttccaacgagccgtcatcgaccaggagccatgggagacagaaacatccctagtcccgttaccctggaggcaggtaaaagccaccaagaacatgacggttggcatcatgtgggatgatgggtattccntaaacctcaatcactattctcctcttagataa

SEQ ID NO: 17827 - DNA, 291 bp, A.fumigatus
  unsure (18),(286): Identity of nucleotide sequences at the above locations are unknown.
caagtcaagtcatccctntacttccccgacgccgccaacagccaacgcaccgtcctctcccaaagcggcgagcccctcctccccctaactgaatgggccttcgcctacagccgcgcctccccgctcagcatccccgagaactgggccctgaactgcaagcgcgacgcctaccgcgacacgtaccacgccctcatgaaatcccgcgacgtagacttcatcctctgccctgtctatgtcggcgcggcgggtcttaaccagcgggctggaacgaaatgcgtacaaatcnccgcg

SEQ ID NO: 17828 - DNA, 1356 bp, A.fumigatus
  unsure (1168): Identity of nucleotide sequences at the above locations are unknown.
gaccatcccaacaatatcttgctgaccgatagttcgtttataggccttttggtcttctggcactcttatcgtctactgttcctggtcgctctctcaaccgtcttcgtcggtttacgattctaccgcaaacttcagtccagaacaaaaaccactgcctcgtcttcagttccgccatcaccccgaagccaatcccccgaaaagacagagaaaggcgtctcgcgtgagagcagcaacaaagcaacggcacagaaggctgaacagcaacccgccctggccaacggttcagcaaaacccacttcaggtccgaagagagttaccggtaaaaaaccatcgaaggttgctggacgacgaggacaaacagaggatgcggagccccttgcctttatccaacccatcatcttttacgcttctttgactggcaacaccgaaagatatgctaaagtactgctggatgaattgcgcgttgcggcgcaaaagcgggctgatttgcgggatcgcgagcgtggccttctgccccctcagatttacgacctctcctatgtcgatctcgacgactacttcacctctgcaccgaagcctccgccaacctcgcccggtacacgttacgtatactgcttattgatccctacctacaacatcgacagtatcctgaatacgttccttgaccatctcaacgagactcataatgacttccgcatcgacacaggccctctgtcgagtctcgccggttactctgttttcggatttggtgataaggaaggctggcctaccgaggaggaaggcttctgctctcaagccaaagagctggacaaatggatggccaaactaacggggcggaaacgagcatatcctttgggattgggtgatgttaaaagtgacgctgaaacctccttgaaagagtggtctctgggattgcaagacatcctttttgacatcctcgagaatggtggactgggagaaggcgtacctggcagtggagatcccgtggaaagtgacgaggaattgaacgatgaagacacagacaaggacaatactcaaaacgtcatggacttagaggacatcaagtttggaggtgatcagaatgcggccgggtcgccaatccccgtggatttcacaactacagggaaatcttcctctgttcaatcgaccgagaaggagatggttccanagacatcaacgacatacgctgctctgacaaaacaaggctacacgatcggtgggtctcattctggagtcaaaatctgccgctggactaaatctgcgctgcgtgccccgaggttcatgctacaaattctccttgtacggtatccgatcacatctttgcatggaggctacaccgtcgctgtcttgcagtaa

SEQ ID NO: 17829 - DNA, 1131 bp, A.fumigatus
caaaacaaggctacacgatcggtgggtctcattctggagtcaaaatctgccgctggactaaatctgcgctgcgtgccccgaggttcatgctacaaattctccttgtacggtatccgatcacatctttgcatggaggctacaccgtcgctgtcttgcagtaataagtgtgtcttctgctggcgccacggtaccaacccggtcggaactacttggcgttggaaagtggattctcccgaattgatcttccagggagttaaggagggccattacaagaagatcaagatgatgcgtggcgttcctggtgtgcgagccgagagattcgcagaggccatgcgcatccgacactgtgccttgagtttggtcggcgaaccgatcttctatcctcacatcaatgagttcctggacctgctgcacggcgaacacatctccagctttctggtatgcaatgctcaacatcctgatcagctccatgctctgcgtcgcgttactcaactatacgtatctatcgatgcaagcaaccgtgagagtttgcggaaaattgatcgcccactgcatcgggatttctgggagcgcttccaacgttgcttagacattctacgggagaagcgccatgtccagcgcactgttttccgtctgaccttggtcaagggattcaacatcgatgatgaagtcatcggctacgcagatcttgtggaaaaggcacttccatgtttcgtcgaaataaaaggtgtgactttctgtggcacaagcaccacggctggagttggcttgaccatgcagaacgtacctttctacgaagaagtcgcccagttcgtcactgctctcaacgccgagctgcagcgccgtggcctgaagtatggcatcgccgcggagcatgcgcacagttgctgtgtgctgattgcctcggaacggttttacgtcaatggcaaatggcacactcggatcgattacgatcgattcttcgaacttttggagagggagaaggccgatggcacgtcttttacccccgaagactatatgagggaaaccgaggactgggctctgtggggtaatggtggtttcgacccgaacgatcagcgcgtatacaccaagggcaagaagaagcatatgcagatcacggcagagccttga

SEQ ID NO: 17830 - DNA, 2112 bp, A.fumigatus
cttttgcttgatcgcatgtcgtcgtcgttgtcgtcgtgcacaaccgcagaatcgccggctaaatacattgcctatcacgtgcctcgaatcgccaacccatcgcagacaacacctcatcctccatttggttgttgtcatggctcaggttgtgtcgttgttttttcctcaaagatgtcgagttctagaccatccaagaggcagcgtatttgtcgcgcttgcgaccaatgccgccggcgtaagtccaaatgcgatggggcacaacctgtctgtgggatctgccgctcggcgggtcgaacatgcacatacgaggctggtggtggccgacggggattgccatctggttatgtccgaaagcttgaaacagctcttggtctggtcttcataaacattcccaacagtgaaggtatcttgcgtggtctactagccgagtgtggtgatgccaaagccacggatcgggcagtcgcagcatggcgcaactcccaggtgaaccgtgggatatcacagatgctcgttcctggatgcaaagagacgtcgatggaagactcggttgaggatgaggctgagtgggaggacctggagaatcgtgatattatacccactatagagagctccgaaccctttatcccgacggaagagatacccctgcaggcccaaccgattatagcagctgaaccaaaggatgtgctggacgtgcctattccaaacaacacgtctgacctactggagctctacttcacttacactcactgctggttccccatattggagcgccgagacctcctccgggcgatgtatacgtaccctctccgatccacgcctcgggatgaaacatgccatctcgtattatgggctgtcatcgcctattcgtccgttatccatccagatcacaatcatggccgacccaattctatgcaaatagtgcattccatccaacgccggatcccgtcgcaattggacaaactggagttgggccacatccaggcgctcctaattcttgttctactacatcttcaggtcggggatgtcaaactcgcctgggtcctagttggtcaggctacaaggtttgtaacgatgctgccgacgtcgtcgaagtcccgattcctccataccgttcacgcatgtatcctactggacaatttagcctcagcccttctggacagatcgccctgtttgtctctcgaagagcagctggtgtatggacccgttgaggaagacgatgtcgaggagtgggatcattggactgcacggaatgggttcacatcaaacggaccattacgagcgttgagcatgtttaacgctgtgagacagcttatgcagctcctaactcgggtattgtacagtccagttgatctggctcagttgcactccctcctgctccagatccaggaacaacaggcgattcttctagcacaatactcaaatcccaggtccgactctactacgccgcctcttcttaccttgcatctaacagccgtctttgtgattctcgcacttgtccgccactgtcggtctcccagtgccgatatgattgatctggccgtcgaaacctcgcaacgaatgttcgatctattcgatcgttatgtcaagttggccggacaccaacaatcgcctcttctccgttgctgctttctacagtgccggcattgcttcgagagttacctttcagctgcggatggccctgagattggcgtcttgaaaagtcggctttcaacatactcacaagagtttcagatggatgggattttccgtcacgaaaattgcccggctgttatccaacctgcagatgaatggcggagcgccttaacgaccgaccccagagccggccagtccctccaagatgggatatcaaactccctacagagaacctacgcaacacctgtatcagccactgcaactgcttcaccggctctagcaggggaagctgatagttttgatgcgttgttcgaggagatggcgaatctgatccctagtacaaggtataaatcatgccgtcttcttctcttctttgtgctgattccacgcagacttgagcccgagttcgcacataatctaggtttttgcgccggagatctagacacagacttcctgattcaactccagcagccgccatag

SEQ ID NO: 17831 - DNA, 510 bp, A.fumigatus
tccggcttgaacggatccacgctgcaaccggagccctcctcattaagaacagctgcaatgccttccatccttctcatcaacgggcccaacctcaaccttcttggcacccgagaacctcacctttacggccgcaccaccctcccgcaactggaagacaatgcaaaagccctggcggcagcgaaaggtgtgaaactagaatctttccaatccaaccacgagggacgaatcatcgaccgcatccatgaagcccgtgggcacaccgatgcgattatcatcaatcccggcgcgttcacgcatactagtgtcgcaattcgagatgcactgatcggcgtgtctgttccgtttatcgaggtgcatattaccaatgtgcacgcgagggaggagttccggcatcatagttatctctctgataaggctgctgcttgtatcattgggttggggacttacgggtatgaggctgcgattgagtatgcggcgagggagattatcagtgccaaggaggtatattag

SEQ ID NO: 17832 - DNA, 183 bp, A.fumigatus
tatgcattgcaagttgcctataacacccggggtattaataagtacggcggatatccatggaaccatggcccttattcctccctttcaattttcatccccatccatcatcccctccatccaacctctggtctctatcgtagcaaattaacagatctaggctattgcagtcttcttctgttatga

SEQ ID NO: 17833 - DNA, 1443 bp, A.fumigatus
atcatgtcaatatcggcagccccatacagggaatttcttcgtcagaaagaagccgagttcttttctttgattgatcaaggagtcatttccccatggctgttcccgcatgattttctcgtgctgatcatccctctcttggtgctgatgatacccaacaaaggccgggcatgggtggtagtcgtcagacgaacagcattcggactcgtatgctgccttacaatcaggaacctgctgtacacgcgatgtctcaccggtgggggcactgttatcggcttttactacgcctttgctgtcccctggaattcattattcctcctcttcaaggatgtccagaatgagtgttcccgacttgagcggcggtcgaatgggatcctctattggcaaggctatccagactcgatatgccaccgactgagctggcttctggatatgttcggcagtctgcgaggtgcaggctggaactggaggattcctggactacctccgcttccaaagatccgttccaaggatgagcagacatccacggacgggaaggagttagctcaggaggcgccatcgtcgactcttcttcggtcctctattgtgaggacagctcgctactacctggtgatggatatcttgaaagtcctcacaatggtggacccctatttctggggactcatcgatgccgctcctctctaccccctcgacaaaatataccagttttcaccagccctcttacggctcttccgagccgtcgtaacagtggtctggatccgcacaagcatggcctttatagcctctaccgtgcctctcatcatcagtttggctgtcactgtttgtccgggttttgtcaaatggagccgtatccctctcaacgcaccgtggttatatcctcctctgtttgatagcttttggaatttcaaaccagtcttcgactacggtctggacggctggtggggaaggcgttggcatcaggcttaccgatatgccttctcagagacagcgcgtcatgttgtcccccacctcgaaaaaacagatatggccagatttctgagacattccgtcgcatttttattgagtggcctggttcatttctgcgctgttcattcacattttgtcgccccggactctgtccattttggagctatagtcttttttatgcttcagccgctggggatgctcgtccagagaaagctacgggggatattattctcggaaggaagtactttatggagagcattcaacatcatctcgacatatgcgtggttatatcttgtcatcggaccattctgcgatgaactggctgccgcggggacatggttgtatgatgaggcatgtcccatcagcattattcggggattgggcttgatcgagggggagggttggtttgtaggaacaaggcgatatgttcgattgaggacgggtgagaagtggtggcaagctgctatccagattctctga

SEQ ID NO: 17834 - DNA, 552 bp, A.fumigatus
tcaacatcccacatgcttcctcagaaaggcacacgacttgtggcaaaggtatatgaccctctctacttcaacgacgacgaagggtacctcaacccgttcctttgcatggacaaatactacactcatgaggccaatgcatatatggtcctccgcgactttcaaggtcaatggatcccgaactactatgggtcctactctttagttttatctgtcgattcagtccgcacacggacagtccgaatgattctggtcgagtatatcccaggaatcactatggccgactgtgagccgggaaatttctgccagtcagcccgcctacttattcggaagtcaattgtggaccttgagagccgtatctacaaaaaggacattctgctcaccgacctcgagccgcgaaaccattatcatacgttcgccagacaagggaccggcctggcgttgtgtttatcgatttcggcacatgctcttttcaaccgccaggcgagaagaatcctcttccgttccgaattgaacgcttttctagaagagtacatttcacccctccttcggtga

SEQ ID NO: 17835 - DNA, 555 bp, A.fumigatus
ccggcgattctgcggttgtgcacgacgacaacgacgacgacatgcgatcaagcaaaagtcaaatcaattcagaaaaatgcgaacagcgacatgcaaactcctgaatcgaccagaacggccgaatcttcaatgattcactctcgaaaataccttcccgatgccacacttttgcttattgggttctttggcgcgggaaagaagacccttggcatcatcgcctcggtagcattgcaccgccgcttcatcgatttcgaggctttcttccgggagaagaccggtttgtcgccgcaggcctatatcgcagcgcatgggttggctcagtatcgcactgttgaggaagatctgacccgggagctgctcacaaaatgccgcaacggctgcgtgattgtcggtcttggcgctttggcaagcaaccagcagcaaatcttgttgaaagatttcgcacaggatcatcctgtggtctacgtgaggagagctgaatcggaattgcgacggtacatgggtaccagccaggacaagttcgaacgcttttggcagttttcaacacggcgctag

SEQ ID NO: 17836 - DNA, 633 bp, A.fumigatus
ccctcgtccgattgtcaccacctcccggtcacctccgttcgcctaggcacatttgcgaaagaaatccgattgctactacccacctcaattcgccttaatcgtggtaatctcgtgcttcccgatcttgtggcgagcgcaaatgcagccgcgctgacagacatggttctcttacacgaacaccgtggaacgcccaccgcgatgaccatttctcaccttcctcatggcccgacagccagtttctccttgcacaacgttgttctccgtgcagatattcccaatgcggcccgtgggactgtttcggagagctaccctcacctgatctttgagggttttaaaacgaagcttggtcttcgtgtggttcagattttgaagcacctcttcccacctcgtgaggctggtaaggtcggcaatcgtgttgtcaccttcgtgaacaaggaggataatattgaggttcggcaccatgtcttcgttaagactgggtaccgagatgttgagttggctgaggttggcccgcggatgacaatgagacttttcgaaatccgtggcggctcgctggagaagggctcgagtggtgatgtcgaatgggctctcacgcagtacacaagaacgagcaagaagaaggactatctatga

SEQ ID NO: 17837 - DNA, 306 bp, A.fumigatus
cgccgtcaagcccgtgagcgtcgagactatctctatcggagagccctgcttctccgcgatgcctctatcgccgaaaagagagctcaactcaaggcttctttagccaccggaaagactcttgacccctcaatagcgaatgacaagaagctccgtgaagacttcaaatatgatgaatcattagagacgcccaacaaggagagcaaagataccgactatgctgaccttgacgatgaatatgctctcacctctggtatcattgaccctcgtccgattgtcaccacctcccggtcacctccgttcgcctag

SEQ ID NO: 17838 - DNA, 588 bp, A.fumigatus
ctttacctccctttctatagttattgcggtattcataatccgagcagtgtggtaaaatgcctggcttgtagcaagtggttttgcagtgctcgtgggaacacatcttcttcacatatcgtcaaccatcttgtccgagctcgccacaaggaggtccagcttcaccccgcctcgtccctgggcgacactatcctggagtgttacaactgcggaactaagaatgtttttctactgggttttattccagccaaatccgatacagttgttgttttgctttgtcgtcagccctgtgctgccatgccgtcttcaaaggatatgaactgggacacttcgcgctggcagccactgattgaggatcgctcattcctgccatggcttgttgccgcaccatcagaccaagagcagctccgagcccggcatcttagtccgcagctaatcgcaaaactggaggaaatgtggaaggagaattcccaggcgacttttgcggacctggagaaagccacggcggtagatgacgagcctgcgcctgttctcttacgttatgacgatgctttccagctacccaaaacatcttacggtgcccctaggtaa

SEQ ID NO: 17839 - DNA, 435 bp, A.fumigatus
gttcacgagtcaaacgatgttcctcacacttatgcgacgcaggccaagtacagtcgtaccgggaagtccacggacgagattcttgcgcctcccggcagtgaccaggacgctgccatggcagcattcacagacttcttcgcggccaagacaggaaagaaatgggaaaatagactggatgggattcctatggccccgaagcaggacgtcgatggaaaggaacttccggctcatgctggctggttctactatgaaaccggcagatctcttctttcagactttcttcgccagggagagtctcaaagttctgcaatgggccagggtgccatgcaaattgctgtcagctcgaacagtgatgaccatggtcctttgatgccgccggatagtaaagatggatctgtggatgatcaggccgagtctccgcccagagtgttttga

SEQ ID NO: 17840 - DNA, 249 bp, A.fumigatus
caatatggtttcaaagcgggcaacatgtaccttactggtctcacactctacttcattggttacgtcgcttttgaggtcccttccaacattgtgctaaagaggactacacctcggatatggctccccacactcacattgctctggggtatcgttgccacacttcttggagttgtccagaattacgcgggatacctgacatcacggacaggtaaagtgataaacattgcatacgctcaaaagaagtgctga

SEQ ID NO: 17841 - DNA, 255 bp, A.fumigatus
ctcgaaaggggcccatgtctcaaggggccttgtagtccgttgaggcgtggtgcttcgacgtctgtagccttggggatcgctgaaagtggactgtttccgggcgtcgtcttctatctttctatgtggtataagcgaaatgagcagcactatcgcgttgccctcttcttcagcgctgcgtcgcttgctggtgcttttggaggcattcttgcctgggttcgtacatcgcaaaccagaggcaaagtgacatcccgttga

SEQ ID NO: 17842 - DNA, 1866 bp, A.fumigatus
atcagcccagccattggcacctttattttgcctgggcttaatcaacaaaaccccttaatcccgtggattgtcaatcccgtttcccatgattttgaaatgttcaccagggttttgattgctgctggtttcagcaggattcgcgtcatgcccgtgggtgttgacgcttctgtcacggatgctcgcgctatcagagttgccccagcagaatgcccagaaggcatccttactgtgacttcaatatttcccgttgtggcgacatccaccaattccgagcagttcggccaagtcaccggagagtggggctctctgttcattcctttcaaccatctgtctgggcacatcagcaaggtcactgctgtgactaaccacttctcggtgtggccctcgagcaagcccatgatcaccgacgccaagtctaccgatctcgcatcaatcttgttactggcgagcctccatagccgcaacattcacgtcatgagcgtcacctcaaaggaagatatcaacctcatcgctcttagcaaggagaagggtctgaaggttacctgcgacgtctcaatcttctgtctcttcctctctagagaagatttccccgactgcaacttcttgccgtctgctgaggaccagaacgccctgtgggagcacatgagcaccattgatgttttctccatcggcagtatccccttccaacttgctggcaaacaggcctctccggtttctggtattgccgagtcgctgccattgctcttcaccgccgtgtcggagggtcgccttaccgtggaggacattgtttctcgcctttacgagaaccccaagaagatcttcgagctccatgaccaagccgacacttctgttgagattgaagttgaccgcccatacctcttccaaagcccgtactggtctcccttcaatggcaagagcttgcggggtgctgttcaacgggttaccttccagggcaagacctcttgcctcgatggtgaagtgactcgcgatgctcccaagggaaccgatatgtctggccatcgtattgtgcctgcatctccgtctgtcaaggccatgtctcccatggtccaggctcgcccggagagttctcttgacagacgactgtcgatttcgggaactccaggtcgctcgttcaagcaaaggcccgctgattcggccgccaatgagctcggtcctcctttgtatgctcctgtacagacttcctcctccctgcacgatttgctgtcgcggtcgaccttcagacagaagcatgttatctccgtcaaccagttcaaccgtgctgacctgcacctgctcttcacggtggctcaggagatgcgtctcggcgttcagcgccagggtgttcttgacattctgaagggtcgtgtccttaccactctcttctatgaaccttcgacccgcacttcggcatcctttgatgctgccatgcagcgtctcggcggacggactattgccatctccaccgagcattcttctaccaagaagggtgagaccttgcaggacactgtccgcaccctgggttgctacggagatgcagttgttctgcgtcaccccgatcccagcagcgctgagacggctgccaaattctcgccagtgccggtcatcaacggcggaaatggcagcgtcgagcaccccactcaggcattcctcgatctcttcacgattcgggaagagcttggaactgtcactggcttgacgatcacctttactggtgacctcagatatggacgcaccatccactctctcatcaaagtgctccagttctatcacgtgcgcatccagctggttgcgcccaaggatctttctcttccccgaggaagtccgacagacagtcgtcgcgtccggacagctggtgctcgagtctga

SEQ ID NO: 17843 - DNA, 399 bp, A.fumigatus
actcttctaatatttgacaggctctttgcccgtggctacctcggatccaactcgacctacggcgacatctatgtcgttaatccggacgttgcagcagccaccggcaactctcttgcgacatccgacatgtgccctaacttcaaggacaccagcggaggcacctatgcctcgacgtgggacaagatttatctgccccccatcaccaaaagactcaacaagaagatctctggtaacctcactctaaccgatgaccaagtctcgattttcccgtacctctgtggtttcgaaactcagatcaccggcagcagaagcccctggtgcgatgtcttcacgcctaacgaaatcctgcaatacgaataccgtcaggatcttcgttactactacggtacaggtgagtga

SEQ ID NO: 17844 - DNA, 450 bp, A.fumigatus
cgatcacctttactggtgacctcagatatggacgcaccatccactctctcatcaaagtgctccagttctatcacgtgcgcatccagctggttgcgcccaaggatctttctcttccccgaggaagtccgacagacagtcgtcgcgtccggacagctggtgctcgagtctgaggagttgacaccagagattgttgcacgctccgatgtcctatactgcactcgtgtgcaaaaggagcggttcgctgatctcgagcagtacgagcgtcttaagaacagtttcatcattgacaacgctctcatgaagcacgccaagagccacatggtcgtgatgcacccgctgcccaggaatgcagagatcgccgaggaggttgatttcgaccagcgggcggcttacttcagacaggttagttgcttgtctttctcgtctctcgtttgtgtcgagttgtgctga

SEQ ID NO: 17845 - DNA, 315 bp, A.fumigatus
tttaagctaactagctcgaaggaaggactggtgactgttgtcatgtccattgtcgcttatttctgggtctacaattaccctgcaactgcagagttcttgacagacaaggagcgcgcgttcatccaattccgcctgaagaacgatagcgatgccacccgggacgaaaagttcagttggacggcagtgtttgaagcgttcaaagatgttaaggtttggttgtacgggctctgttttcacacgatgtctctgcccttgtacacattatcgctgttcatggtaagatgcgtcgacacaatagactatattgctgtctga

SEQ ID NO: 17846 - DNA, 597 bp, A.fumigatus
cccacgatcatcaaggaactgggttattcggctgccaaggcccagctgcttactgtccctccttatgccttgggattcattctgacaatcatcgtcgcaatcctttctgaacgcaatcggcgccgcgcgccattcatcattggctcgaccacgttcgcctgcatcggatatatcctctttctcacttcaaaaagagcatctgtatgctacgctggggtcttcttcgccgctggtggcatctacccttcggtggccatcgtgctgtcttggccggccaacaacgtctccgggcaaaccaaacgcgctatagccaatgcgatgcagatttcgattggaaacttgggagctgtaatgggcacgcaactctatcggactgaaagcagtccgcgctactatgttggccatggatttgcattagggtacctccttgcgaatatcgctgtggttagtgtcctgtgggctgtgctcaatcgggagaacatcgataaggccaagcagagagaggcaaagggcataactgcaattatcggagatattggggatgcaggaggcgatttccagggcgacagagactctcggtggattttccagacttga

SEQ ID NO: 17847 - DNA, 288 bp, A.fumigatus
atgacgctgtctatcgtaagtttgtcccgttgcatccatctgtcagcgtatactattcctgcagtgaggctaacgtccatagccgttccgtcttgccgctctggacctggccacagctgcccgctcgaccaatataccgcgctggtggccaagaagagggagcagtacggttcctttgcatcggtctgtggcctccccgagggcaatgtcaccactgccacgttggacggagctgtgactttcttcaatgacttgaccctccctttcttgagtgttgtcaagccttga

SEQ ID NO: 17848 - DNA, 1533 bp, A.fumigatus
gccgcccgctggtcgaaatcaacctcctcggcgatctctgcattcctgggcagcgggtgcatcacgaccatgtggctcttggcgtgcttcatgagagcgttgtcaatgatgaaactgttcttaagacgctcgtactgctcgagatcagcgaaccgctccttttgcacacgagtgcagtataggacatcggagcgtgcaacaatctctggtgtcaactcctcagactcgagcaccagctgtccggacgcgacgactgtctgtcggacttcctcggggaagagaaagatccttgggcgcaaccagctggatgcgcacgtgatagaactggagcactttgatgagagagtggatggtgcgtccatatctgaggtcaccagtaaaggtgatcgtcaagccagtgacagttccaagctcttcccgaatcgtgaagagatcgaggaatgcctgagtggggtgctcgacgctgccatttccgccgttgatgaccggcactggcgagaatttggcagccgtctcagcgctgctgggatcggggtgacgcagaacaactgcatctccgtagcaacccagggtgcggacagtgtcctgcaaggtctcacccttcttggtagaagaatgctcggtggagatggcaatagtccgtccgccgagacgctgcatggcagcatcaaaggatgccgaagtgcgggtcgaaggttcatagaagagagtggtaaggacacgacccttcagaatgtcaagaacaccctggcgctgaacgccgagacgcatctcctgagccaccgtgaagagcaggtgcaggtcagcacggttgaactggttgacggagataacatgcttctgtctgaaggtcgaccgcgacagcaaatcgtgcagggaggaggaagtctgtacaggagcatacaaaggaggaccgagctcattggcggccgaatcagcgggcctttgcttgaacgagcgacctggagttcccgaaatcgacagtcgtctgtcaagagaactctccgggcgagcctggaccatgggagacatggccttgacagacggagatgcaggcacaatacgatggccagacatatcggttcccttgggagcatcgcgagtcacttcaccatcgaggcaagaggtcttgccctggaaggtaacccgttgaacagcaccccgcaagctcttgccattgaagggagaccagtacgggctttggaagaggtatgggcggtcaacttcaatctcaacagaagtgtcggcttggtcatggagctcgaagatcttcttggggttctcgtaaaggcgagaaacaatgtcctccacggtaaggcgaccctccgacacggcggtgaagagcaatggcagcgactcggcaataccagaaaccggagaggcctgtttgccagcaagttggaaggggatactgccgatggagaaaacatcaatggtgctcatgtgctcccacagggcgttctggtcctcagcagacggcaagaagttgcagtcggggaaatcttctctagagaggaagagacagaagattga

SEQ ID NO: 17849 - DNA, 303 bp, A.fumigatus
gcaaaaatgcgtcaactcacggagcaggagttgcagacgttgcttgccaagttggcgggctataccggacgctcactgaacaacctcatcgtgccccagtccgattccgaggacgaccgccatgtcttccgtctgcagggaaatcgagtgtactacgtgaagaagtcactggcagatctatcgacaagtttccctcgggacacccttctttctctcggaacttgtattggcaagtttaccaagactggaaagtttagaattcacatcacaggtccgtgtttctttcgtcacgctgagtcgtga

SEQ ID NO: 17850 - DNA, 2193 bp, A.fumigatus
agaccgcagacgagcgttgagtcctgtgcggtggctagttccatggcaaatgactggcagccaaacaacgaaaagttgagcctcgggccctttgggggcagaaacgccatgcagagccctgtcgagcgagagtgcgagaggaaagtgcagcttgataccctgctactgactggctcttctcctgcggcccgcgcaggcgagctcgagaacagtggacaggcgcaggtcatcagagagcaaccaagcatccgcagcctgagagcggagaacgattcgggcagtcctacatcgacaaatatctctttctatgctgttgaagatgaatttgctgaaccgatctcgccgtccatatacgacaatgccggtgccaagatcaccccaggcctcccggataccgcccacagacggggacgagttcgtacgaatgaacaaagatttcctgagatgcttgcgactgatcagccaagctttcccgcatctttcaatcatggccacgagggagttcagcctaccgtgatgacagcatatcagccagcactcgaagagacgcatgaccagcatttcaatgctcaatctcacgctgcagtcgctcaacaccccttcgatggtgttacaagtcacggaggctacgctccacctccaccagatccagactaccggaacacagcggacctggagcagcagctcacgtcccatatcgaagcagtccatgcccatatgaacaacgttgttcataggctttgcagggtacttgagaactcgaacaattggtcaaaggatcagattctgcgacagacagacgccatgttcgatattctgcgtttaatcaatgcccgcacggcaggccacaatgaggccgtgtcagacttgcaccgcggtatgaccaatcttcaatgtcaggttggagcaattgaatttcagatgaggcgcatggaagagaggttgttgatcggtgtctcgagccaaatcaacaaactgagaggagaaatcaacgcgtcaaggacgtcgcctcagaaggcgcgtgcctcctgcaactcagcacccgatccgaagatcgcaggtactgagtttcaggcgcctgaaattactcccgttgtgaccaaagacagcgagaaacaaccagatacaaatgaacagcggtgtgtcaagaagggtaaaatggaagtaagcaggaaccaagacaggaagaaaggaaaggagaaggaagaaagtgagaacgtgtctgggggtgagggctctttgacccaacataacaaccaaggacccgctcagaacattccgtccactaccgtgtccttccgcaacacgccttcaggagagaaacgccgagagatcacatactctcaggtgaagagaggggtgagaagaaaccctgctcaggagtcctcaggctctcctgagcctaaggcgccgaagcttagtcgtcaacctgcagccaactttgctcctgagaatggacagagttcagtcatccaggactcacaccttgacaacaatgaaggtgtgaagacccctcacaagaaggggatgtttggattccgccgccgggatgatggtgaaagtcgtgctggcggcaaattcttgcacacgccccgtcggaataagaagaccagggactcccatggacagaacggccattcctcaatgccttctgccccagctggtgcagtcggagtctcacagccttcgacactcgctgaggagagcccaagctctatccaccccgctttacgcaatgacaaacagaagcagatcatgcgtgatcgggagcgcctcgaacctcagccgcatacgcagaccggacagatgacctgtacaacggagagacctaccccgcagagacgcggattgaaaaatcctcatcctcatcagaacatcggtaccagagcaccaacctctaaccgcttgcccacaaacgccttcgttgttacaccctcttcgtcttcgtcactcaacgaggatatccagttgtgtccccctgcggcggctgccccccctcgagcccctttgatacggccgagctatgccggccaaaacccgcccaatatatcttcttcccctcaggtttctgatactgtgtctgtctctgcctcagctcaaacggggacacagggctggcaggctgcaacttggtatccggcagcgcagagcggagcctcccatgagagtaatcagagcaaccatcatgcttag

SEQ ID NO: 17851 - DNA, 327 bp, A.fumigatus
agctatttgggatcatatatgaatgctaacctttgtgtaggaagataccctgtttacgacgtgatagaagtttttttcacaggcaggatcatatatggtgttcgcatactagatatcaagggattgtcgcaggagtttggagtctcgcatctgttcggctacaaaagtcttttcgtctctatgtccaatatcaactatcatcttccgttctacattctgcattctgctctccgactcgccggtaacatgcaatacttcgttggccagaaagtccgacaacatcgcaccatagccctcaaaatcctttgtcaatactttccatattaa

SEQ ID NO: 17852 - DNA, 255 bp, A.fumigatus
gtcgtgatggcatggctggctaacgcagtggcatcattagcgctcgacgtaattgctcctcatgcgagatacaaggtatggatcaaggacaatggtatcatgccttatctctacgggtcgaatgttgtgaaagcgcacgtcggaagatggagtgaggatatccccgagcatacaggagtcttggtgtacgactctaacgacacacctttggtatggatggtctgcagcgcgacagttctctggataagcaactga

SEQ ID NO: 17853 - DNA, 2208 bp, A.fumigatus
acaaggtggagcgggagctctagcgcgagattcttggcgttcggggaaaattcaaaagaagaaaaaagtttcgactcccaacttcgacgattgccgtctttgatttcgaacgacccacgcacagaaattatggcccctggacgcacgataaagaggagacgactaagtcctcctggtgatgaggaggatacctcctcccgaccctcgcgtgattctttcaacgatttctacaacaatgctgccaaatgggatctcgaacaggactacgagcgccgaccgcgcaaactaggcaagaaagacaaagagaacacaaggttgcccattaagacggcagaagggctgcagatggttgagtcggaaccagaggcggaagagtctgacagtttcctcggtactgacgacgacgaagacggtgatgaaaatgaggccgattttgacgacgaggatatggaagatgccgacgaagctgcagaggaaaccccgaaagttccattaaagttgcagatcattcaagcaaaggaagagcttgcgagactggcgacaatcatcaacgaggatccggaagagcacatttcctccttcaagtcgatggctgatatggtggagaacggccaacatgtcacgatacagaagctagccctcgccgcgcaggctgctgtctacaaggatgttattcccggttacaggatccgtcctctcagcgaagaagatatgtccgcgaaagtctcgaaagaagtgcgcaaactccggagctttgaacaatcgctattgtctgggtacaagcactacgtccagaagttattggaccttacaaaatcctcaaagcgcgatactgcagcggtcgaccccggcctaaagagcatcgcgatcaattgcgcctgcaacctcctcctttccgtaccccacttcaacttccgcacagagctgctgaaaatccttgtgaatcgtcttgcaaaaaggcagattgatgctgatttcgtcaagtgtcgagaaacagtggaagaggtgtttcggaaggataatgatggaatagtctctttggaagctgttcgtctgctgtcaaagatgatgaaagccaaagatttcagggtacacgagagtgtcttggacacattccttcatctacgactgctctccgaattttcggcaaagggctcgagagatagggtagaccgccggccagcagaagaggagactaccttccacggcaagaaaccgaagcagaagcgcgaattccgcaccaagcgagagcgcaagctgcagaaggagcggaaggctgtggaaaaagacatgaaagaggcggacgcaatagtttcccacgaagaaagagacaagaaccaagcggagacactgaagcttgtctttggcacttacttccgtatcctgaagcttcgcattcccaacctcatgggtcccgtcctcgaaggtctcgccaaatatgcacacctgatcaaccaagactttttcggtgacctgctggaagcgctgaaggacttgatcggccacgccgttaaatctgaggtagaagatggcgacgaagaggaagcacaagaggaaagcgaatcgacgtcgcgagacgctcaacgagaggctctactgtgtaccatcactgcctttgcgcttttggaggggcaagacattagcaaagcggcgtcatctcttcatctcgacctgagcttctttgtcaaacatctgtaccgctccctttattccctctctgtcaaccccgacgtcgaatacaaccccaccaaggcacttcgcctgcctgatccaaactcaaatgaagcaaacggctcaacacatcgatccaaaagcaaagtcaacttccagacacccactgttctcctccttcggtgtctccaatccactcttctttcccgcgctcatggaacgccacctaccattcgacttggcagttttaccaaacggctcatgacaacatctctccaggtacctgagaagtctgcactcgcgacgctgtcgctcctcaatcaagtcgccaagcaccatgcgcgccggatcgcacctttgtggaacagcgaggaaaggaaaggggacggagtgttcaacccattcgccgctgatgttgagaccacaaacgtatttgcgggaacagtatgggaaggcgagttgctgcgtcttcattattgccctcaggtcagagatgcggcagcggatatagaaaagttgattgtgggccggaattga

SEQ ID NO: 17854 - DNA, 453 bp, A.fumigatus
tacatactctacgacatacaggtgctaacttcgcctagatacgcgcttgatggtatcccttacacgattgtcttttatctgcacctgaaagatggtagctacaagtgtttaggtggtgtctacacctttagtactaagctgagcgacgcccaagacacggagagaggcggctgtgacaactgccgtgagcaaaagaaggcaggtgtcctcgcgtccgctcagattccgttgacgtataccctttatgagagacaggagtggcataacctaggaaaactactccccgtgaaagaaacagctgatattattagacaacacctctgctggaaggtcgtgggggtcaataactcgatactgttcgacgtgagtagagattatgctgcactaccttctgtgctcttgcaccatgcgctgaccaaggatgttatctactccagtctgagcaacccatga

SEQ ID NO: 17855 - DNA, 657 bp, A.fumigatus
catgctagggcgcaacggccatcctggactaccatacgatccagtccccgctgggctcagccgcgcagttccatcctgggacatgtgctcggggccgtggtcggggtgggagtcaccaagctattcaagctccggtccgactttgaggatctccgctgggtcgccggcgcagtctgcaccgcggtggcgtcgttggtgatggggctcaccaacaccgtccatccgccggggggcgccacggcgctgctggcagcggtcgattccaccgtcgacgcgatgggctggttcttcgtcccgctggttctcatcgggtcgctgctgatgctgggatgcgcgctggtggtcaataatatccagcgtcagtttcctatgttctggtggacgcctcgggatgtggtccggaagacgggaccaccggatatcgaaaaggcgtcggaggttccgcaggagagtcgcgaacgacggatcagttgggctgtgggagtactgcgggcgaattcgatcgtcatttcgcctgatcgggtggtgattccggatgggttcacgctgggactcgaggagaaggggattctcgaggtcttgagggaccggctgcgagacccggatcagtatgatagtagtgttggagaccagagtacggatagtactgaaagttag

SEQ ID NO: 17856 - DNA, 237 bp, A.fumigatus
ggcggaacaatcactttctctactcgtccgacgcctcgggaagacctcaattacgctcagatttcaattccgtacaacttgatttccttatacgaacacggttcctgcctcacgatgagcgcgcaacattctcgttccgttgttcggttgctgcactacggacacatggctgacaactactgcaccgttacaacacataagacaacgactgctagcagtagttttgtttggcattaa

SEQ ID NO: 17857 - DNA, 393 bp, A.fumigatus
cggactacatgttggtgccaggtatggttgatcctcagtcgaccggataatgctgacttctgcagctggaacaaagctctagctaggcaacgggcggtgcagatggccacagagttccgcaagaaaggcgtcaatgtcttacttgggcccgtcgttgggcccctaggtcgtgtggcagaggcggggcgcaactgggagggtttctcaaatgatccgtacttgagcggcgccttggtctatgagaccgtcgatggagcgcagtctgttggggttgcgacttgcaccaaggtcagtcaccttgaccaattcttggttcagcccaaggactttttccttttcatacagcacttccatcttggaatgaaccagaaaaccaacccgaaacccccgtaa

SEQ ID NO: 17858 - DNA, 423 bp, A.fumigatus
gtcaatatagcgctcgtggtatcgggagattactggctaactagagctagcaatgtggaccgccttacagctatctggcaggtcttaaatcaagaccactggttcgatgaaccacaccccagcgacgctaaacccgatgatcctctcaaaccattccatgtgagcaaagacaagtatttcacatcggatgatgcgcgattctggcgcaaatacgggtacgactacgatatagtaaagaaacccggcacgaatgaagaccgcgcccctgaagaagttaagatgaagatcaatcagctctacggcgaaccaatatcgaggctccatgagggccagcccgtcgaatacgactatgtgatcaatgttatctacgaccggtgggtggtcaatcagtttaatacatactctacgacatacaggtgctaa

SEQ ID NO: 17859 - DNA, 270 bp, A.fumigatus
tgcgaagtagctgagggcactggaaccggctcctgggctgccgcttatgcaaaggcgaagaagtttgttgcacagctcaccccggaggagaaagtcaaccttactgcggggactgacgccaataatggctgttccggcaatattgcagctattccgcgactgaattttcccggactgtgtgtctctgacgctggcaatggacttgtacgtgcacacatgcagcagttgctggaaataactaattcttgtagaggggaaccgactacgtga

SEQ ID NO: 17860 - DNA, 525 bp, A.fumigatus
gccctggtcgctgttagcgtaacacgacgtaagaaattccatcagtgtggtcatacgtcttgcggctttttcctgttcctctttctcgtccttttcaccaggtccagggactgcttcttcctttacctgctctttctcttctggccggtccttctcttcatgcttttgctgctcctgctccttctcttctatctcatgatctggctcgcgatcaactttcttttccctctttggttccggtcccttttcggtggtctccttgcgctttgcacccgcggttttctttggcttgatatctctggtgctagtgaaggcctccttcgccttctgagcggcctgtcacgacgatgttctaatggacattgtgagagaatcgtgtttgctcgcgaaggagaattgggccaattgcgcggatccgagatatctcgatcaatgcgacagatttgcgagcgattaaagcgtacgacaagcagagcaaaggtgagatgcgaatacgacatcagtcgccccagtcggagcgactga

SEQ ID NO: 17861 - DNA, 297 bp, A.fumigatus
gtggagtggagtttcgctccacaattcatgttagctacggagctactatcaacaactggtcgaaaccgccagctatctcagggcctcaattatgtcacgatcatcctcttaagggttctaattaacccgtatacgctcatttctgcctggacttctatggactgtgacttgagaatcaatgtcgatgtctatatgttggagcatgagaaggacactctttatccgcgacctcgtcatcctagggtcggcttaattcaaaatgcccgccaacgaacaaagaagtccagagagtcatga

SEQ ID NO: 17862 - DNA, 486 bp, A.fumigatus
caggccgctcagaaggcgaaggaggccttcactagcaccagagatatcaagccaaagaaaaccgcgggtgcaaagcgcaaggagaccaccgaaaagggaccggaaccaaagagggaaaagaaagttgatcgcgagccagatcatgagatagaagagaaggagcaggagcagcaaaagcatgaagagaaggaccggccagaagagaaagagcaggtaaaggaagaagcagtccctggacctggtgaaaaggacgagaaagaggaacaggaaaaagccgcaagacgtatgaccacactgatggaatttcttacgtcgtgttacgctaacagcgaccagggctcagtgaacagcccgaagagcgagcagagaagtcagaacaagaaccccaagaaggtgaaaacgaagaggctgccccaggacctcgtgatgaagagaaagccgccaacggtaacaataaactctgcggagatacttaaccatcgctaa

SEQ ID NO: 17863 - DNA, 576 bp, A.fumigatus
atccaaatccaaaaggagactccaataagggtaaggctttcgccggccacagctgtgtcctctgtctccgtaaacgatcattgtggtctccatataatgcttcctgcatcaggctcgacagcggctgtacctgcatctatcacatctttgaaccattgcgtcgttgacatgtccataccgactgcaaacggcaagccatatgccagtctcactgtcaaggatgtcaacgagagcttattgatctgtggccaaattgacgggccagcacatataaccggtgttgaaaatagtgtgattgtggtgtcgtgtcgccagttccgcatgcacaactgttctggcgtggacgtgtacctgagcagctccagcaaccccataattgaagattgcaccaacgtccggtttggcagaatccccagagcatatgtaagtgatctctctgttagagaccattccaatacatatactcatgttcacaggctctggaccacgatcgtccggataatgaagaccgctggagccaagttgaggacttcaaatggatcaagcctgaaccgagcccgaactggagcttgttaa

SEQ ID NO: 17864 - DNA, 330 bp, A.fumigatus
ttagtgcttatcaatgactggtgcgttaagttttcgacatgcttcgcaatggagactaggcgttatttatttaatagtatatgtcactctcagttaactagcagtcaatttgatgagtcattctatacaactctcgttaaatctgcctgtttctcgaaagtaacaacatcctcaggtcatggcctccagcatgctgattatgcctcttccatcgcagggattgaatttatcttacaattctccttgactgggtataaacgtatgatccagcttagggttaacaaatggttatttctgcatagctattattccctactaatcgatgactga

SEQ ID NO: 17865 - DNA, 231 bp, A.fumigatus
acgactctgtgggagaaaatggcgccaacgagctggcgaaaggcaagtgaagttctatataacccgatcaagagcactgtccttaacgacgatcaacaagctaattggtcacaggtatcatcctctgtggaaattgatctctcagatttcatttggagtacatttgctggccaaaggattggcgaaatccaaactagaagttttgaagatcctccagcgtcatgtggatga

SEQ ID NO: 17866 - DNA, 681 bp, A.fumigatus
aaacatggaagtgcgtccgtgttcctgaagcgggcaatttgccttgtggccgccaaggatcaagccgccagctcgtttcttcgtacaagcattaacggtcctctcagtacacctcgacagtttggttccgagatttacactggactagttgtcgcgatggacgccgggctcgagtcagaccgaatcacccgcatacgtacattagcgctgatgtctttacattgtgaaggccacgaaggcgcagaggctgcatctatgcatctgtgtcgggctatccacgaggctcagaccgcaggtctgcacctgaacagacctgatcgagtacaaggggattctctctcgcgactattctggtgcctctggactttggataagatgcacgcaagcattgggggccgtccagtactccttgctgaccgggacattggactgaggaaacccattgtcaatacctctcatcctaagactacattcgacgtgtggtttgccatctcggatttgctctcgagtgtgatctcattctataggccatctgcggatcctaccgtcggttgggaaaccagctttccgtcttttgaggagctcatgggtgacaacttcggggaggaactggactttaccatgttgagtatgctccacgatctctcaaggagggttccccttcctactgtctactactga

SEQ ID NO: 17867 - DNA, 264 bp, A.fumigatus
gctctcctgtgcgtaaaatcgacttcacaccaagaaaactcagccagtcggtggacgaaaaatggtgagcccaaccttcaatccacgaaggcagtggacttcagtagctcgctgtttatgtccagtcttgcccggggggccccccccttcgcccttccactatacggtcaaggagacaccaagaggagctcgcttgtccttcaaaggaagcgcgaaatcgattgcccagccgagtttaaccccaacacaaaattcaccacttaa

SEQ ID NO: 17868 - DNA, 1056 bp, A.fumigatus
ttcaaaatggctcgcgcagctatcatcccaaagtcatccccaaaacgggccacccgtggccgtcccccagccaacacagtcaaagccgccagtctcaccactgccagcaaaccggtcgtgaggacggcgaggacaaagtcaggaacttctgcgacagaaaccagaaaaaaaactacgagaacagcaacggcgaccagcgccaggactagacaggcagactctgacacagatgaggctacggacgacgaactgggactcatagatacgaaggaaaaagcgaaaccaggcagacccaaagggaagagctcaacttcttccacaagcgctacaggtcggggaagaagacccgcgactcctgcagctgcagagtgcgagagcgacaacgacgaggacgagcttgcccagaccgatgcccccaagaagcgacctggacggccaaggacaaagccgctgccaaaggaggacgaagttaaacccgaggcagcgcctagaccgagaggtcggccaagggcaactgccgcgacgaagcctactgtcactacaggcgctgataaagacagtacaaagaagaagactcgagcacagacaggcgcagtcgaagcatccagcagtggtcccaaacatattcttatcgccacaaactctacaaccatgaggtcaaatttgctccggggaccagccaagaagaaaaccgtcacattcaaagatgtgtccgattccgaagaggaggatgccaatgaaccagctcctactacgactggaagacgccgagcagcaactacagcagcaggcaaggtcggtctcggagccaagccagttcgtaagcctgcgacaactactggtcgaggacgcaagcctgcaggctccaagatagaagccggcaagcctctctcacccaagaaagccacgcaagttgctaagtcaatttcctcatatatcagctcggacggggaggatgatgaacttagcagcgtccaggaccaaatgaagttgatcataaattcgcctctcaaaaagggatcaggaagctactgggttgagctctcctgtgcgtaa

SEQ ID NO: 17869 - DNA, 2907 bp, A.fumigatus
aatcgacttcacaccaagaaaactcagccagtcggtggacgaaaaatggtgagcccaaccttcaatccacgaaggcagtggacttcagtagctcgctgtttatgtccagtcttgcccggggggccccccccttcgcccttccactatacggtcaaggagacaccaagaggagctcgcttgtccttcaaaggaagcgcgaaatcgattgcccagccgagtttaaccccaacacaaaattcaccacttaaagcagctccaaagaaagccaacttggaaacacccagacacggaggattgggtctctgtgacgaaataatgcctttatcacagccaaatttcacccctggacacaattcacctctcaaatcgtcccctaagaaaggcatatttggcgtgtctttcgctcaggctcccttacaggaatcatcatcaacgccattcaagtcccggtcgctgttgctccaaagccctgcaaagagaattgcttccccgttcaagaatagtctcttctcgagtgttcgttcaatgccggaattgcgtaggaacgaaagcggaatgggtcttgttagcggtgctgaccaggccaatgatgcggaacatgttgaatcgtctttcaggactcctgaacctcaagggccaatggatgtcgattatgataacgaaggactagaacaagacgaggttcctcaacaagaatcgtccgatgagcatcctgttgtggattctcgggcgcaatttgctgattctcatgatgttaatgacgagcagcaaacaccctccatgaccgcagaagatgtcgaggaagctccagaacagctgtcggatcatgatgatgtcgccgataatgtcgaggatcttcaagcttgtgagttgaccaacgaaggtcctgaagtcgaatttgaagaatctggagaccaaacccttgcagggaaggaacctcgagcgttagatgacaacgacagtgaagagggttccaagattgatgaaagcgatatccatctggcggacgagagtattgtcggccataccgcctatgtcagcaatatgggtacccacaccgagcaaaatgaccacacgcctgattatgatgacgcagaggatccggacgcaactgaatcagagccagaggaagagcacatgatgcaggacgtatacggcagcgagtttcaagctgtgacagaggagtcaagcctgccgtttcagcgacactcgattgagggacttgaagatgttttcactgacgcaccggtagcctatgaagacgttgatggtgaatctgacactgattctgttccggaggctacgggaagtgccgccgttcaagtcgatttccagcctggagagctcaacaatgagtacgttgacttccacgatagcgaatactttgatgatgacgaggcgacactcgtcgcatctgataccacggaccactatatctatgaagttcagcctgatgaagaaccgaatgcgcagttaaacactcagctaggcccccagcaggaactggaaagaatgaatagccatcttcatgaccaggatggttcccttgcaccacaagcgtcgacaactcaggatggcattttctaccacggtgatctgaaatatcgcgaagaagtggatatgtctgaatctgagctcactacagacaaccagagtcattcaattgagcataatgacctgcccgattcacctacctccgctgcagtttgcaatgacgaaccggaaagcggattcctgatgcagcgaaaccgtggtccacggttcacccttttggcagagcagctcagtcaatggaaagctagcagtcccgagaagtctgagccacgacgcaccaggcgaggggtgttctccatcggaggacttcgaaggtcttctcgtcgtgggactcgtcttcctcaagaagtggcctaccccgacatcgaagattgtcttggatctcctcaagagaaagcctcagatcgccctcgcgatagcgagatctatgccggtgttccagagatctacgaggaccaggatgaccaaaacctggaagagtctcgttctagtgctgtagcaacatcatctccccagagagagccaatgaccgagttgttcagcgagccgcaacccgaattctccgagccgactgcatacaaaaaggtcctgaaccgtcagcctgcgcatgcttctgataccaccaagagcccaattgcatcgcctagctctccaaaagaaggcgattcggatgagaacaaggagaatgaaagagtcgaacctcctgctcctgccacgccagtcaagcagaaaagcatcccgctagagaccttccatacggtatccaaagtacctctgaaaccggaaggtcaagtttcgcccttgaaactgtcccgcaaaaggggccgatcgctctcaatctcttcgcctatccgctcatctcctcggctccgaaagcgtgtgcttgcttccccccagcagagtacggcgcaagcctctcctcgcaagatgcccaaactccaacataacgagactccccgatctcaaaaatgtgagtccaggcggacgagtgtagccagccaatcaagtaggcgttccatggctccttcggcatctccaggaccctcaaagactcctgcttgtgaaaacattcttggaggagcggttgtatatgtggatgtccatacaactgagggagaagatgccagcggcatattcattgaacttctgcagcagatgggagctcgatgcgtcaagagttggggatggaatccacgcgcaagtatgtcgtcaggcgatatgacaaaccgcagagacagcaaggtgggtattacccacgttgtgttcaaggacggaggagtgagaaccttggaaaaggtcagacaagcagctggcctggtcaagtgtgtcggtgttggttgggttcttgagtaa

SEQ ID NO: 17870 - DNA, 783 bp, A.fumigatus
  unsure (762): Identity of nucleotide sequences at the above locations are unknown.
tcttgctcattgttacatagaaaaccatcagtccccttatcacgcttcactacactctggcttgccttttcattgatgcacgccgcccctacaagtcatccgcgacatcatgatgatgaccatctccatctcaaccatgtagacgccagccctcacggattaacttgcctcgacaaagatagagatggagacattccaaacagtacgaacaatgacggtagtcatcctccaacctctcctgacgcacacgtattcgacatcaccagtcatggacgaacctcatcagacacatccttcaatgatagtgacggggatgacgatgcagaagacgccgatctagtcatcgacacccctagtgagaagcccgtcacttgggcctccctgcccaaaaagggccaacttgccatcctcacctttgcccgtctctccgagccactgacccagacatcactccaagcatacctcttctaccagctcaagtcgttcgacccttcgctgccagactcgaccatttcaacgcaggcggggatcatgcagggcagctttaccgcagcgcagtttctcacggcggtctggtggggccggttggcggacgcggagtggatggggaggaagcgtgtgctgctgattgggttgctggggacgtgtatctcatgccttgggtttgggttttcgagttcgtttgcggcggcggtagtatttcgggttcttgggggcattctgaacagtaacgttggggtgatgcggacgatgatatcgganattatcgagagaagaaagtaa

SEQ ID NO: 17871 - DNA, 342 bp, A.fumigatus
  unsure (324): Identity of nucleotide sequences at the above locations are unknown.
gtattaacacagtatccatggaatagccagtggcttaccacgttgaagcaccgagatcttcacctcggcaatgtgtgtatcaagacaactcgttcggacggctctatgacacctccatccgatatcgagataatgcgtcaaacgtggaccagcggctttggcctgagctcattagaaaccacgatcatcgactactctctctcacgtgcggagctgcgagctagtgaggattcccaccagatcgtggacattgcttcatcagatctcgataaaaagcaaattttcgatgctatcggccgagacgaggacgagattctgttgagngacacggatagacagtaa

SEQ ID NO: 17872 - DNA, 477 bp, A.fumigatus
tacggcaatcatgatattaacttgatatctagtatgcgcgcggaggtatacacaggaaatcctgtcgatactaaaaggactcccgatattccagggatctgggaggaatatgcgcctagaacgaacctcatttggcttttgttcatcctaaaaaacctcctcaagaatcgcaagagcgagccctctacatcggccgcaacaagaccacccttggccccatgctcacccaataaaaatatcgaatcgaagcaagcgaaaaatttgggcgagaaagctaagccgccacttcttgggcagacacaagtcactgaagcagataagagagttgctgacttaaagcagtcgctcgaggacagactcaagtcagttctagacctgctagatctcgagcatggccataaagacatgtgctgtgctgcggatctggtagcttacgccattgactcacagtggctaagcgaggaggactttttctga

SEQ ID NO: 17873 - DNA, 447 bp, A.fumigatus
ggcgttgctaccgagaaatacagaacaaaggagatgagtcgggacgctcatgcatgtccttgtgctcaaggtagaatggcgagtgatctccttggacaatgtgacaaacctagcattaaatggtcacgatcagtgactattataggtcaagcctataccgtctatatgctcttgcctcgcagaggacattcatatgttggcgacaaggaagctcatgagacttcctacagccaagccacccacaaggaccatgctcatgaacccaccagcagcctctcgttcatccacagaaacccagtgactagctcccatcatacagctgctgccaagatatccgttggaaaccccgaacaaaagctgcacaacgaagagataaaagaaatcactctgtacaatggcccctctccctccaatgttacaaagcaggtaaagtgggatgaaccctag

SEQ ID NO: 17874 - DNA, 198 bp, A.fumigatus
cactattcactgtctaagaagaaatctatagacacaaataaaggggatattctaacagatcaagatgccaaacccgcgaggaggggagttaatgtaagtaaacaaaaaagaaataagcggacatgcaagggagtctatgtgagcgcctccggccccgacaatccacctaaagcactaatcaatttttcgcggctctga

SEQ ID NO: 17875 - DNA, 579 bp, A.fumigatus
ggggatgttggtatcctcggatatctctgtcccgtcatcactctgcaagtcccaagaagtttcctgcgccaccgggttggcaggagtgttggcgagctggtccatcacctcaccgccgctcatctgccactccatcaatttggtgaaggcgccatcagggcgagcactgagctcctcataactgccttgttcggctactcttccgtcgggaccaaggacaataatcgtatcggatctcttaatagtagagagtcgatgagcgatgctaatggtagtattgttaccacgaaggagcgcggtaagagcactgttcacaagagtttcggactccgcatcgagagcagaagttgcttcatcgagtatgagaatatcaggatccttgatcagagcccgggcaatcgcaatgcgctgcttctggccaccagaaagctgagcgccccggggtccgacctgggtgtcaagaccatccggctggacaacacaatcagctcatatttaaaccaaaatggacgtcgaccaacttacaaagtcacttatgaactggcagttcgccttgcgcgcagctgcaacgatctctga

SEQ ID NO: 17876 - DNA, 591 bp, A.fumigatus
caattgggagaattaacttcattcctgatgtacacagcgtacgcagggtcaagcatgttcggtctttcgagcttttactctgaactgatgaaaggtgtcggggcagctagtcgactgtttgaattacaggatcgtcagccaacgatatctccaaccaagggcgagaaggtggcttcggcgcgaggaccaattcgcttcgaaaacgtgacttttagttacccgactcgtcctgctgttcctatttttagggatctcaatttcgaaattccccaagggaccaatgttgctatcgttgggccctcaggaggtggaaaatcaacgatcgcttctattttgctccgtttctactctcctaccgaaggaagagttctcatcggtggcaaagacatcacccatatgaacgccaaatctcttcgacgaaagattggaatcgtctcccaagagcctgtcctcttttcggggactatagcggagaacattgcgtatggtaaacctcaggccaagcggtcagagatcgttgcagctgcgcgcaaggcgaactgccagttcataagtgactttgtaagttggtcgacgtccattttggtttaa

SEQ ID NO: 17877 - DNA, 513 bp, A.fumigatus
gctgattgtgttgtccagccggatggtcttgacacccaggtcggaccccggggcgctcagctttctggtggccagaagcagcgcattgcgattgcccgggctctgatcaaggatcctgatattctcatactcgatgaagcaacttctgctctcgatgcggagtccgaaactcttgtgaacagtgctcttaccgcgctccttcgtggtaacaatactaccattagcatcgctcatcgactctctactattaagagatccgatacgattattgtccttggtcccgacggaagagtagccgaacaaggcagttatgaggagctcagtgctcgccctgatggcgccttcaccaaattgatggagtggcagatgagcggcggtgaggtgatggaccagctcgccaacactcctgccaacccggtggcgcaggaaacttcttgggacttgcagagtgatgacgggacagagatatccgaggataccaacatcccctcagagccgcgaaaaattgattag

SEQ ID NO: 17878 - DNA, 1182 bp, A.fumigatus
ctctgccgtacatgggttaggaacatgtttctcgcagcagcaccgtacttctaccttcgtttccggtcggacaaatggacagcaacccatttccaaccctcgattctgacagtgtcaaccatcacgaacctgggatctgcattcattctcgccaaactgcagaaagggccctcatactcgagacgagtaacgctttctttacttataaacattgtcatcttttcgctattggcgctttcgacagtctttgtgaaagatgtcgatgttaaaacctacttcagctttctgatgttcatggtgtttggggcaagcttagcaaccggcatcaatcagaatggcgtctttgcctacgtgtctgggttcgggagagaagaatatacacaagccattatggcaggacagggagtagccggcgtgcttccttgtgtcgtgcaaattatctctgctttggcagtgccgaagagagaggggcagaacatgccgcaggcttcatcaaagtccgcatttatgtatttcactacagccaccgccattgctgctatttcgctggtcgccttcctttcccttgtcaggcggcgatcggttctatccctacagttgccagaggaacaactcgactcaatctcctctggttatgctcataagacggtgagtctctgggttttgttcaagaagctacggtatcttgcatcggctctattcctttgctttgccattactatggtgtacgcagtcttcaccgcagaaatcgagtccgtacatcaagatcccaatcattcccggttattctctcgagaagtcttcatcccagtggctttcctcttttggaatgccggtgatctaattgggaggatgtcagtcatcatccctcgtctttcattagcccatcgtccttgggtccttttcgtcatttctgtgacccgcctagggttcatcccactttacctgctttgtaacattggagggagaggggccattgtacagagtgatttcttttatctcttcgttgtgcagcttttgttcggggtttccaacggatatcttggcagcagctgtatgatgggagctagtcactgggtttctgtggatgaacgagaggctgctggtgggttcatgagcatggtccttgtgggtggcttggctgtaggaagtctcatgagcttccttgtcgccaacatatga

SEQ ID NO: 17879 - DNA, 729 bp, A.fumigatus
gctggagcattcttctggttcgtggagaagcaatcacagatcgcaaactatcgccgtcggacgctgaccagacgacagggctgtgtctacctaatcggccattcgatctatgctatatactttcatcctttgagccgatatccaggacccaaaattgctgctatatctccaattgctctgcttgtttgggagatccgtgggaaagtgcactcaaaggtcaaacatcttcatgacagatatggcgacgtggtccgcattggtcccaatgcacttgtctaccgggttccgcgggcctggaaggagatatacggatacagaacgaaaaagggtcaaagaacatttcagaaggatccttccctttatgtcccgacacccaatggcgtgcacgcaataattacagcggcagagtccgatcatattcgcatgcggcggctcatcgcccatgcattctcagacagagccttacgggagcaggaatcgctactgcacttatatgccgatctcctcgtccaaaagctgcacgagaatctcaatcattcgcactcggaggtcgtcgatatcgccaggtggtacaacttcaccacgtttgatctcatcggtgacctcgcctttggcgagccttttcagtgcctgaaagatagtaagtatcactggtgggtatccatcatgctcgacgcagtcaagctcagcgtatacctcaaggtcctttggttcttccccattccctga

SEQ ID NO: 17880 - DNA, 492 bp, A.fumigatus
  unsure (249): Identity of nucleotide sequences at the above locations are unknown.
gcccccttgacgaaactgctggttccacgttacctgcaccagagacgagaggcaagtttccagttgaccgtggagaaagtcatccgtcggttgcacagacagacaaaccgcccagattatttatcgtatattatcaggcataaggacgacgagaaccgcatgtcccggcaagaaatagacggtaatgctgcgacttttgttctggccggcagtgagaccacagctgcattgctgtctgggtgtaccttntatcttctgaagaacccgcatatctaccggcgactggtgactgaaatccgtagtagatttcagcatccatcggaaattcggttatcgtctattgccacgctttcttacctcaacgccgtcctggaggaaagcctgaggatttatcctccaattcccgcaatgttaccacggcttgttcccgaggagggagccatgataaatggagaatacgtccctgctggagtgagtccgggcctctgttga

SEQ ID NO: 17881 - DNA, 207 bp, A.fumigatus
acaatccatgagcaatccatggacaactcaggaagatttagagtgtctctgcataaggtcatttcgggaactgtctggcgacaatggctacagaaagcctacaattccattccaaaagccatcctgctcttagtctactccacggatgagcttctaaccacttgtgttacgtcacctctcactttttcattgtttgttagggagtag

SEQ ID NO: 17882 - DNA, 192 bp, A.fumigatus
ctggaggaacaaagggcgtcccttaatcctgtcaagcctgccatttcgctgatgggcattcatgcagttattacggagtcaagaccccaaggcatgcatccacttggtgcacctatcgtggccaatcacaaaaatacctcacttgcatctgatacctacaatcggcctggtggctgctgggcgcataggtag

SEQ ID NO: 17883 - DNA, 225 bp, A.fumigatus
tgtcaaattccagccccattcataactcgcttcgcttctggggaggaaaccgacctggccaaccccctcaaagacacagtgatccggccaagcattgaagcccctacagaggtcaagagtgtggtgtccactctaatcactcctctttcaagagagcaagtccgtcactcaggtaagcgcttgttacaatatatacgctttcctgttgttgtacgtctttcctga

SEQ ID NO: 17884 - DNA, 528 bp, A.fumigatus
ccggcctgcgcggccagatgcagcggcgtgaccccgttcaacaactgcgcgttgatcttggccccagcctgcagcagcaaccgcacgatctccactgcgcccttgtcacaggcattgtgcagcggcgtccagcccccatcgctccgcgcttcgatgtccgccccgtgcttgagcagcagctgcacgatatcctccctgccatgcgccgccgcgatatgcagcgacgtcttgttcctcagctcgacggcattcacatccgcaatcgggccccgccgtcgtgtcagcagcagctccgcgactcgcagtttccccgtcgcacacgcccagtgcagcggcgtgcggcccaactcatcccgcccgtccgcgccgtcaagcgcacaccccgtccccagcagaagctcgatcacatcctcgccccaatcgcactgcttatccgccgccaggttatgcaagacattcctcttccgcagatctttcgcattgacgtccgccccgcgcgatatcaacacctgcaagacgtgccagtga

SEQ ID NO: 17885 - DNA, 1125 bp, A.fumigatus
ccggccgtcgacgagcagggcgccgttggggccctttttgaccttccaggaggtattctcgtccttgatcttgtcgcccttggcggtcgccgaagccgagggaaagacatccacctcctccagcgagtttcgcacaaattcgttcatctgattccccgtcacccacacgcacatgcccacgccgacctccccttcctccttggtcgtcagcgtcagacaccgcttcggatccatctcatacggcggacttgcacctggctccccccaccgcaacccggccacatgatgcgacgtcttgatcgtgatgccctccttcttcatcgtctccatcgcatacgccgccagccgctcatcaaacatcgacagcaccgtcggcgcaacatcgtacagcgtgatccgtgggatccccgccaggctgggatacagctgcatgagatcgcgggagatgaaatcgcgcagcgacgccgccagctccgtccccgtcggcccggcccccacaatcgcaaagtgcagcagccactgcctcatctccggcgccgtcgtcggcagcaccgccagctcgaagcactcgcgcacccgccgcctgacccgccgcgcgtccccaatgtccttgaagaagagcgcgttctcgcgcaccccgggggtattgaacgtcttggtgacggtccccaccgcgacgacgagcttgtcgtagggaaccgtaaacgtttcgccggcttcccaccgtcgtttggccatcgtgctggtgacaccccccgcctcgtccgtccgcggcgactccgtcaccccgctcttgacgaccgtcgcctcgcagaggatggtcttccggtggaagtccaccgctcgcgccgccgcctggatgaagtccacccgcgccctgcgatcccggaccggctcgacgatattcgagaaatcaagcgagcccccggctgcatccgtaagcagcggcgtgaagacaaagtacgaccgcggggagacgatcagcggcgcgaacttgctgggggagagccgccgcgagagactgtagcctccccacccggagcccaggatgacgacccgctctttgccttggtgtctttgcttgtcgtcagggaaggccgtcgagtgttcgacctgtgttgctag

SEQ ID NO: 17886 - DNA, 1383 bp, A.fumigatus
ttgcttactacccttcgtgtcgctcttgttgggcgaaggcccagacttggcccgtttaggtgtccctttgccctttttgccctgcgagctgctgaacccatcgtcaagcgagcaggtatccgcccgttcaagcttcatgccctggaccttggactttttggccttggacgggtcgtcgttcccgttgacaacgattgtgggcagttccgtctctccactctccttgatccgctcatcctcgcggaacgggcgtgctcgcggggtgctctgacacagcggccgcatgaagtgggagtgcgtccgttgtccgcggtgctggtaattgaacgaccgttccagtcccttgaagctctccacgtcgtgggcgccttcttcgataaacgacttggtgagcaacgcttccacccaggccatgttgttcgcgggcagatggatccagcgaaaatccgtcgccttgctgtcggctgggatggtgcggaacgcttgcttgcgtggattttccgggtcgcgcccatacaacaggttaaacacggacgtcttctggacccgattctcgttgtgaaagttgccaaagtcaaccaccgttgcgtcaaaggcctcgcatgcgccccgcgcatccgccgagagcgcatcgatgttgttgaacggcgccaggagcagcacgatgtccttccgcttaaactgtgccgcccggaggaacggggtgctcccaaagttgtcccgaacacggcgtttcaggtccggtcgttcgagcaggcactcgacgacctcgcggtgaccggcctgcgcggccagatgcagcggcgtgaccccgttcaacaactgcgcgttgatcttggccccagcctgcagcagcaaccgcacgatctccactgcgcccttgtcacaggcattgtgcagcggcgtccagcccccatcgctccgcgcttcgatgtccgccccgtgcttgagcagcagctgcacgatatcctccctgccatgcgccgccgcgatatgcagcgacgtcttgttcctcagctcgacggcattcacatccgcaatcgggccccgccgtcgtgtcagcagcagctccgcgactcgcagtttccccgtcgcacacgcccagtgcagcggcgtgcggcccaactcatcccgcccgtccgcgccgtcaagcgcacaccccgtccccagcagaagctcgatcacatcctcgccccaatcgcactgcttatccgccgccaggttatgcaagacattcctcttccgcagatctttcgcattgacgtccgccccgcgcgatatcaacacctgcaagacgtgccagtgattcctccacgcagccgtcatcagcgaggtccgccctttcttatccgccgtctccgtcgaggccccgtaatccagtaa

SEQ ID NO: 17887 - DNA, 561 bp, A.fumigatus
tttctcgaatatcgtcgagccggtccgggatcgcagggcgcgggtggacttcatccaggcggcggcgcgagcggtggacttccaccggaagaccatcctctgcgaggcgacggtcgtcaagagcggggtgacggagtcgccgcggacggacgaggcggggggtgtcaccagcacgatggccaaacgacggtgggaagccggcgaaacgtttacggttccctacgacaagctcgtcgtcgcggtggggaccgtcaccaagacgttcaatacccccggggtgcgcgagaacgcgctcttcttcaaggacattggggacgcgcggcgggtcaggcggcgggtgcgcgagtgcttcgagctggcggtgctgccgacgacggcgccggagatgaggcagtggctgctgcactttgcgattgtgggggccgggccgacggggacggagctggcggcgtcgctgcgcgatttcatctcccgcgatctcatgcagctgtatcccagcctggcggggatcccacggatcacgctgtacgatgttgcgccgacggtgctgtcgatgtttga

SEQ ID NO: 17888 - DNA, 3180 bp, A.fumigatus
  unsure (110): Identity of nucleotide sequences at the above locations are unknown.
aaaggttgcagcaagattgtagacctggccccgggaaaaatggccagttccaacgagaatctcctgcgcgtggttctcatgcgcagctgcgagcgcggatccttcgccgngacacagtacctgttcagtctcggcgcgaagaccgaggtccccagcaaccgtgtggcaccgctgctgcgcgccgtcgagcacaaccatgtccggatcgtgcagctgttactggattacggggcctcgacggagacggcggataagaaagggcggacctcgctgatgacggctgcgtggaggaatcactggcacgtcttgcaggtgttgatatcgcgcggggcggacgtcaatgcgaaagatctgcggaagaggaatgtcttgcataacctggcggcggataagcagtgcgattggggcgaggatgtgatcgagcttctgctggggacggggtgtgcgcttgacggcgcggacgggcgggatgagttgggccgcacgccgctgcactgggcgtgtgcgacggggaaactgcgagtcgcggagctgctgctgacacgacggcggggcccgattgcggatgtgaatgccgtcgagctgaggaacaagacgtcgctgcatatcgcggcggcgcatggcagggaggatatcgtgcagctgctgctcaagcacggggcggacatcgaagcgcggagcgatgggggctggacgccgctgcacaatgcctgtgacaagggcgcagtggagatcgtgcggttgctgctgcaggctggggccaagatcaacgcgcagttgttgaacggggtcacgccgctgcatctggccgcgcaggccggtcaccgcgaggtcgtcgagtgcctgctcgaacgaccggacctgaaacgccgtgttcgggacaactttgggagcaccccgttcctccgggcggcacagtttaagcggaaggacatcgtgctgctcctggcgccgttcaacaacatcgatgcgctctcggcggatgcgcggggcgcatgcgaggcctttgacgcaacggtggttgactttggcaactttcacaacgagaatcgggtccagaagacgtccgtgtttaacctgttgtatgggcgcgacccggaaaatccacgcaagcaagcgttccgcaccatcccagccgacagcaaggcgacggattttcgctggatccatctgcccgcgaacaacatggcctgggtggaagcgttgctcaccaagtcgtttatcgaagaaggcgcccacgacgtggagagcttcaagggactggaacggtcgttcaattaccagcaccgcggacaacggacgcactcccacttcatgcggccgctgtgtcagagcaccccgcgagcacgcccgttccgcgaggatgagcggatcaaggagagtggagagacggaactgcccacaatcgttgtcaacgggaacgacgacccgtccaaggccaaaaagtccaaggtccagggcatgaagcttgaacgggcggatacctgctcgcttgacgatgggttcagcagctcgcagggcaaaaagggcaaagggacacctaaacgggccaagtctgggccttcgcccaacaagagcgacacgaagggtagtaagcaatcatcggctcaggatgacaaacgtcgagcgcccctgtcactctgcaaggatcactctcttaccccggcctgcaacgtgtgcgtgttcatgccttatttgcattttgagacggccgagcgcaggcagaagatgcaagaagccatccagcgcgccgaaacactccgcttccaacacccagggatctcgcgatcgtcgacgagggacgagatgctcattagtgcgcatctggcctcgtcgacgacgtcgctccatgtgcgacgcactctggaccagttcttctatccgaacatcgatacgcagagtcgcgatcaggaccaggtgatctaccgctaccagaccaaagggcagggccgcgatcggttccggtcggatcccaagatcttcatggtggaccagctgtggatgtggatcctggggacgaacctcatcgtcacgagctttgcgcaacggtgggaccagccgaagaacgacccgctcaacgtcttggacggcattatcgaggatatcaactccaagacacgggagccggtgcgatccgtctacgatctggcgatcatcatcaccaaccgctgctcgggggtattcgaccggcaccgcatgggtgacgaggaataccagttcctggacatgttcgaagcgtcgatcggcgtcgccacggaccgtgagaccctgctgttcaacatgttcaacagcgcctccgcgcaggcatcggactggctcaagaaccaccgcaagctgagccgttttgcgcgcgacgcagacaatgcaaaagggaaagcgttcgcggaggaagacgagcagccgctgttcgtggacaacctcctggacatcggacaggaaacagatctgctggccgaagccaaggacatccgcgacgagctcaacatgatccgcacggtgctgcagcaccagcagcacatcctggacgacttccaggaggtgatctgcgagatctaccacggccagcaccggtcgcagtacgaggtcaagaagcggttcaaggagcagcagcgcacgatcgacatgcacctcaaggacatcgagcggatggacaagcaggccgagcgcatctactcgtccattacggacctgctcgacctgaagcagaagcatgccaatgcgtttgaggcccgattcgcgcgcgaccaggcagcggacaccacccgccaggggaagacgatcatggtgtttacgatcgtcaccatcatcttcctcccgctgtcattcatcacatccattttcaccatcaacctcaccgagttccccaaggggccggacggcgtcggggagctgcatctgtcgtatgtggccaagtatacctttggcattggctttgctatttccatcccgctgattctgctggcgctgtcggtcgacgatatcggcgatgtctgccaggaagcgatgcgacacatgcgacggtggttatcgcgtcggcgaaaaagcacggacgatcagctggacgaggccaccctcgagatggagaagattatcagcacgagcaagtcccgccggagcatggacacgcgctatgcagggagcctcttgccggtttcgactagggggagtcgtcctgcttga

SEQ ID NO: 17889 - DNA, 1326 bp, A.fumigatus
agaattgcaaattgtttgtccagcagtatgaagcctgcgccatctccagttgtgcatgggagccgacggcaccacccatggacgttagtgcgccagtggaaatcgataggaacaaggaggctagcaacacaggtcgaacactcgacggccttccctgacgacaagcaaagacaccaaggcaaagagcgggtcgtcatcctgggctccgggtggggaggctacagtctctcgcggcggctctcccccagcaagttcgcgccgctgatcgtctccccgcggtcgtactttgtcttcacgccgctgcttacggatgcagccgggggctcgcttgatttctcgaatatcgtcgagccggtccgggatcgcagggcgcgggtggacttcatccaggcggcggcgcgagcggtggacttccaccggaagaccatcctctgcgaggcgacggtcgtcaagagcggggtgacggagtcgccgcggacggacgaggcggggggtgtcaccagcacgatggccaaacgacggtgggaagccggcgaaacgtttacggttccctacgacaagctcgtcgtcgcggtggggaccgtcaccaagacgttcaatacccccggggtgcgcgagaacgcgctcttcttcaaggacattggggacgcgcggcgggtcaggcggcgggtgcgcgagtgcttcgagctggcggtgctgccgacgacggcgccggagatgaggcagtggctgctgcactttgcgattgtgggggccgggccgacggggacggagctggcggcgtcgctgcgcgatttcatctcccgcgatctcatgcagctgtatcccagcctggcggggatcccacggatcacgctgtacgatgttgcgccgacggtgctgtcgatgtttgatgagcggctggcggcgtatgcgatggagacgatgaagaaggagggcatcacgatcaagacgtcgcatcatgtggccgggttgcggtggggggagccaggtgcaagtccgccgtatgagatggatccgaagcggtgtctgacgctgacgaccaaggaggaaggggaggtcggcgtgggcatgtgcgtgtgggtgacggggaatcagatgaacgaatttgtgcgaaactcgctggaggaggtggatgtctttccctcggcttcggcgaccgccaagggcgacaagatcaaggacgagaatacctcctggaaggtcaaaaagggccccaacggcgccctgctcgtcgacggccggctacgcgtgcagctggcgaatgaccacggagaaacaggtcttcaccacggggctggaaggatccgcggtggcgttacaatc

SEQ ID NO: 17890 - DNA, 252 bp, A.fumigatus
aggttactatatcgtgcatggcaagtttgtcagactccgaacgaagtactggttgaaaagctcgggttggacatccctccgccaccagaggttactctagaggagattaccgcccgtgaggttcgcatcgcctggaagctgcccgacttccacaattccattcacaagcacattattcaagtgaacggctccaaaggtagcttattctgcgtattactgtcgcgagttacatcaacactaaacatgcaatag

SEQ ID NO: 17891 - DNA, 351 bp, A.fumigatus
atcgacatgattcgtcactctgacaatgcccagcttcgtttttcaccccagctgtcagttgttcgagcgacgcagcgcgtgagtcatccacagccagagcgagcatcattgccccgtcttgaccttttgactctgcaaacactgaccttgggcgttagtaaactcgtcacgacgattgtatctacgtttacagcacattatatctaccactgggggacatatttcccgtctacgcctctgcagcctccgtacctgccctcgttcgatgggcgggcggtcctgtacccgaccactaggattctacgcgattatatgagttggaggcaggtggattgtgcgtttgacctctag

SEQ ID NO: 17892 - DNA, 1956 bp, A.fumigatus
  unsure (1624): Identity of nucleotide sequences at the above locations are unknown.
aagaaggctcagcaacagtaccaagaggcccaggagcgtctcaagtggttgactacccagcgttcgggcagcagtggaccgttcactctacccgctctcgacctggacatgtcaaatactgcgactatccgtccgcgtcgccatcgcagctctctaaacagcaacgtttcttccccgatgaatttccctggcttggaaccatcgttccctggcggtgtcaacttcaatccaccttccaccaactcgcctacatttgctccggctcctgccttcttcaatatcaataatggcatgacccttccgggtctctcggacctgcaagatccgatgcgcggggatctcgatgtttccttcggtaatcctcaaatgagtccacgggccgatgccctgcttccgtctgatcttttaggggatgaagaatctccagaacccccacgtccaattgttcgaccccgtttttcaaacctagaattgtccgaatcgcagcgggaaagctattcgcgcggcccatcgtctcctgagtccgcagtgggaagcaaaccagctagcattttcgccagtccccatgaggatcgcaaagggaccgaacctcagtctacacatgttgatgaatctagtgacgctcctaagagcgcgacgagacggctgtcgggactatttggcttccatcgtcctcgtggtaaaacactggcagatgagccacctttgctgggcaccctgaaacctggacagagccaatccttccctaggaatctggacgaaatggaccccatcggttcaaggcgtcggagattgagtcatactggcaactggaccaacccgatatcgttgcttcccaggagtaatactgcggctgtcactgcagacagctcttctgaccacctgccgtcgcgacgagcaggcttcaccagcatcttctcccccagccgattcggtttcggcggtggaagtagcagtttgctaaagtcaagcgagccctctgatgtcagcactggttataatcaattcagtcctcgtcacgatccaattgatccagcatcgattctaggcactgtccggcgaggttccctgtccccaagaccttcgtcaaccttttccttcgataatcagcttcctcatccttcgacggataatcgtcctttcggatggccgtctgctgaaaagcctaaccatcgcagtcttcttgggttcgattgggcctctccatccagctggtccagggctcaatcccgtcggccgtctattacgtacgggtcctctggtcacttgccccttgggctgactggtgaacctgattttcctcaggagacttttgaacgccaaggtcggccgttacaagccccgattggtacgcggccttcgtcctcccatcgcccagtaactccaaaattaaatccggcagcacccacgtttaagaccatcttcagcagaaagtccgacaaagataaggataaagaaaaaggaaaggagaaagaatccgatatgccttttgattttcacatggaggagggctctccgtcagagccgcgcatttcgagggattcacgttcccggtccttgtccatctttaatgaagattcgtacgtttcgctagagcgcaccccatcggccacttttgcggacnacagcaactcaaaggagtcattcattcgaaaaatcactcgaaagggcagctcgagcaaatttggttcgtggaaggaacgctccggcttgttttcgaaaaagggcgattcttctcagggtgacatcgacgaagatgcaagcagcgaggcgcaacttgccaaaagtattgacagcactgtctccagcgcagacagatcgactagaagcagtctgggttttttcagccggaagtccaagaaatcggacaaagctgctagtgagacaagtgaaaggccgagtgaattggccagcgagactggcgatgatgagattgccgaggaagaggaaccttga

SEQ ID NO: 17893 - DNA, 414 bp, A.fumigatus
tttactccacatgagctgacgagatcgtgtcaggggactgtctcatccgacaagaatgagatcctcttcaagaggttcgggatcaattataacaacgaggatgagatgtttaagaaagggagtgtggtttatcgtcaggtaggccagcagggatgcctctatgatcgccgtctaacgtggattctgcagtatcaattagaggatcccaagcctgagtccaaatcaaggcatggggatgatgatgaggcgcctatggacgaaagcaagatttccagggcgcagcaagacaaattgcgaaaattgcgacggaaagcgcaggtggttgttgatcatgtcgacattatcaaggacgagttctgggagaggaggccttggattctctcgggcaagccaggtaaattgcccgaggcatga

SEQ ID NO: 17894 - DNA, 1119 bp, A.fumigatus
cttattctgcgtattactgtcgcgagttacatcaacactaaacatgcaatagttggtgaatcgaaacgagtggagactgcggtagaaatctcaaacctggtcccaggaagtatatatcacatttgcgtcttttccgtcagtgcggcaaattttcagacacccagcgcagttattcatgttcggacgaagcctcttcctttgtcgcaatctcagcaaaatgccccggttggtagcccgacgatccgggcctcgattccaagacccactgccggattggttgccccctccgcccctccgatggctcgcgagcttagtggaggacaactgcaagggaaacgtacgtctgctggacggaaacaatcccccgcggctagcggcgtcgacctcccgcatggccatccagaggagactcagaaacacgcaacgcatagtgacagcagtgagaccttggagcggttggctgacagattgaagactctgcagcatgaaaatgaaaatgtggagaagcaggcggcggaggaagaggaggagcatatcgcgcttttgaaagagcttgagagacagcgtgaccagctgagaaagcgtgtgaaggagaaggacgaggccagtggcgatttgaagaagcacgttaacaagctggagagcgtcaatcgaaccgtccaaaacgaaaaggccaagcgcgagaggcttctccagcagaaagagactgaacggaagaagcgcaaggaggacattattcgctggcgtgaggaaatggagcgaatgaccactgaggttgcgcagatcaacgaggagaaggctcgcatggaagaggaagggaaaaggagtgcagatggggttcgagaaaagattgccaaggagcaggcagagatgaaagttctcgatgatgagattcaggacaaaggtgggcgtgtcaagaagctggaggaggagcggaagcgtcagcaggggggagacagcgaggatgggaaggagttggaccgcatcgacaacgagcgagcaaggcagtgggaggtcaagttgagcaatctcaacgcgcgatatgctgccttagtgaatcttcatgcacaggtgggtgcccgaacaacgtactggcgtttccagatcgagggttattaa

SEQ ID NO: 17895 - DNA, 189 bp, A.fumigatus
ataacaaatgacagactttccgatcgctatgggtttatcaaacccaacgaccgccgcgcgctggacttgatgaacgccgccgcggtggaggtcatgaaagaactccctgacctatgcatcgcctatggtgtgagcgatgaatacaggtctgtccctcgccagctagatcgacatgattcgtcactctga

SEQ ID NO: 17896 - DNA, 342 bp, A.fumigatus
tctccatgctgtgtattatatgtcaaggtactgacgaaaagcaggtccgacgctttgggtcatgtgttgaatatgatcggtcgggattggacacatgctggtgtggcgaagctctacaccgatattgtcaataacggctacaatatcatgtatctcacaagtcgatctgtgggccaggcggataccacgcgtacgtacctttacggagtctgccaagatggctacagattaccaaagggtcctgtgattatgagccctgaccggactattgcggcgctcaggcgggaaatttacctgaggaaaccggaggtgtttaagatggcgtcttcaccgcggggctaa

SEQ ID NO: 17897 - DNA, 402 bp, A.fumigatus
gaagaaggtaccgatttgctgttccgtagaatttcttcggatctgactgagctggattttttttcttttcaggtggaatttcaagtcaatggagtcaagcaggactatgcgatgaagctcggggagggcggagaggcctttttcgtctttgaaacatcagacgagatccccgtttcgctgcagacgtcaccgctagtatcgccggcggctagtccgagaacacggagtgaggtagatcttccatcttctcttcaggaaccggagtttctggacctcgaaaagtcctctgccactactcagtcgcaggatgtgaaagcaggctcggacatacctctgctttcgagaggggtgagggcatctagtgatttgggtacggtggcgctttccttggtcaggatctga

SEQ ID NO: 17898 - DNA, 204 bp, A.fumigatus
gcggggccattgatgtcatcgtcatcgagcaggaagatggtagctcctcatattagtggcctctctaacattttgttgctaatgcttgcgataggaacactcgcctgttctccgttccatgttcgatttggcaagttctctttgctccgtccatatgagaagaaggtaccgatttgctgttccgtagaatttcttcggatctga

SEQ ID NO: 17899 - DNA, 1107 bp, A.fumigatus
  unsure (654): Identity of nucleotide sequences at the above locations are unknown.
gggcatctagtgatttgggtacggtggcgctttccttggtcaggatctgaggctcatgctcatatggatataggtgccatgactcctctgtcgcaatccccggaagaagagaccaatgtcggccggctccgccgcggctccttgggcgacgcaccaggttttgaccgggcatcgtctgagcctgtactaacagcgaagagaaataccggtacttccaacgagggtggtttggcagttggaacacagcctcccagtcccacaaccagcgacggcgacaatcacaccgatcgccctcggagtcctcctttactcacgccgcaggaagcagtttcgcgggcgctttctctgtcaaagaaactgtcttcatccaacattccaactcgcgtcaatgagacgggcgatctcatgctcgacatgaccggtcacaaaagcaacgaggaggacgctttgcgtgccgaactcattgcccgtaagatattggcggaggaactggagggaagctatgacattggcagccttatcggagcggacgagcatggaaacttgtggatctacagtagcgaggaggcaaaggaggctgccaaccgccgggcgactttcaattcgatgcgaccgcactcggccatgagtgaaaatgccgtctctgacccaggntaccacagcgacaccgatcaccctatgtccgagtcgtcgtatccgactcggcatcaccgtgccaaatccgatgtgcaaccagggccccctactcctccgcagtcacctactcaagactcgactccaggagagcaaacccggaattatgcaaagactcttcgcctgacgagcgatcagctcaaggcactgaatctgaagcctggtgctaatccaatgtcgttcagtgtgaacagagctacctgtactgcgaccatgtacctctggaatagtaccacgccgattgtcatttccgatatcgatgggacaatcaccaagttagtctccatgctgtgtattatatgtcaaggtactgacgaaaagcaggtccgacgctttgggtcatgtgttgaatatgatcggtcgggattggacacatgctggtgtggcgaagctctacaccgatattgtcaataa

SEQ ID NO: 17900 - DNA, 207 bp, A.fumigatus
ttaaactattctgctatgctaacactatggttccctagattaataaataatagtaattctatgaatatatttactaagattactatctattactatttagttaatgacctaaagcctaacctacttatcagaactaatgtcatctgtagtaaaggatttatacttaattttaaatatagtattataataattagttcttatagttaa

SEQ ID NO: 17901 - DNA, 243 bp, A.fumigatus
aagatccatccagttttgtctgtcacccaccttaaacctgcgccagccacccccaatctattctaccatgagttaccaaagcctcccacagtcatcaacgctaaggtctaccctagtgaggatgacatatacaaagtcaaatgcttactagacaagcatactattcagcatagacgcaaacataccccttatatagaataccttatgcagtggaagggatacagactagaagacgaccaatag

SEQ ID NO: 17902 - DNA, 213 bp, A.fumigatus
ataacagtatggttcagcaaaggaactaactgcgcaacgggacggataaaccataggccgttagatacatggataagcaatacatggattagcgtacgctatgcgacactaataccccctaaacagtatattaaattaattaatttaatcatcatcttcttaatctatcccccactaaagaagatttattttatactactctttctaagctag

SEQ ID NO: 17903 - DNA, 195 bp, A.fumigatus
aatggtccttgggtgtgcttagaacctagacttaactgggcagaggcatcactgaatgtggctaaatgcaatgttgaagattggattaatataaaggactattacatagccctactagagtgctttatagatataattcaaacattcagcctctggaccctcttagctgaggttttctcagttattcttttttga

SEQ ID NO: 17904 - DNA, 207 bp, A.fumigatus
tggtggcaaaggaggcaatatgcagaggtgggaatcattactcatgtgtttgtgactcttacttacagaacaccagcggacgaattgcagcatgaccatgagtttgagcggtcactatactatgccactttcgggacccgcgatatggcggagggagtaactgcattcctcgaaaagcgggcacctgtgtggagaacgccatcatga

SEQ ID NO: 17905 - DNA, 189 bp, A.fumigatus
ctttatcagccccctctgctcaaagctaatgggccctcgttttaccctgaccccatggctagcagaacatccggcgctagtagtttcatgagccagccaattctaggccgtcggggacctaccgatctggtcagaggccgactaataaaccattttcaacaaatcttactatccaggaacccacaaagg

SEQ ID NO: 17906 - DNA, 219 bp, A.fumigatus
gctgactgtgccgctttccaggcagactttatcgtcgctacaccggaagtcgagtttcgactgcctgaaatatcaatcggtctgattcccggtgctgggggtacacaacgagtgaccgccgctgtgggcaagtatagggtagctgctctttatgctcggtgcacaaagggttcgactgacaaggtccgtgaaggcaatgaatctgattctactaaatga

SEQ ID NO: 17907 - DNA, 372 bp, A.fumigatus
atgcgcatcgtcatggattactcaacacagaccgaacggtttattttggctcgaacatgtcagagttctactcgtattctcactctggatcgtcctaacaagcgaaacgctttatgtcagacgcttattgacgagctattgcaacagctaaagatagcctcggctgatccgcacattcgagccatcgtcattgctggttcgggcgccatcttctcgggtaggtgtctccacattgaatgtaggcagcatgtagctgagttgccgccacttgcgatttccatacagctggtgccgacatcaaagagatcgctcagttggatggcgagtctgctcggcagaagcggtaccttgaagacctctgtcatgggatga

SEQ ID NO: 17908 - DNA, 297 bp, A.fumigatus
ctgctctttatgctcggtgcacaaagggttcgactgacaaggtccgtgaaggcaatgaatctgattctactaaatgaaccactttccggaagcgaagcctatcaggtcggactagttagcaaactcgtcgaaccaggaatggctttgtcgggggcgttggagattgcagagaagctggcttcttggagtgccccaaccttgatggtggcaaaggaggcaatatgcagaggtgggaatcattactcatgtgtttgtgactcttacttacagaacaccagcggacgaattgcagcatga

SEQ ID NO: 17909 - DNA, 813 bp, A.fumigatus
gtgatttggcacacttttggcgccctctcaactaatttgaagctaattagatctaccggcgcatattcgctttcgatctggacacgcaactttaggcacatcgtacatcaaccttcatggcctgtacctgcctccaaccacaccgaagacgtcatcatcattgggagtggcaacaactggggatctatatacactgccgttcatgctatcaaccgcaccgtcgtcggcgggcaagacgctaccgtaggaccaggcggattgatccagaacggaggccatggtctgctttctagccaccacggtctggcctcagatcaggtataccaagttacagtgatcaccactgacggccgccggctagtggccaaccacgccgagaatgaagatctcttctgggctgtaagaggcggtggtggaggccagttcggtgttgtcaccgagttcgttctcaagacgtaccctgtgcctgcgaacgttgtctctggcgggctctcattctatcccagtcgcagtacaaaagcctgtgagctcgcgtcatgggatgccctggcggaaaccacacgcttgattcctgatctgatggattcaggtatgacaggaactgtcactgcgatgacgaaggaggccgccattaggcttaccggcgtcaaggagtcgattcccggagtaacagtcagcattaacatgatcggataccatatgacgatgacgaaaatgaacacttccattcaccacctcgcagcgcgcatccggaagtacagcatttcaagctccctcacagtgactttatcagccccctctgctcaaagctaa

SEQ ID NO: 17910 - DNA, 1290 bp, A.fumigatus
cgcgcaatgtctctcaacatctacctcgaagacccgcgccaatattacgcggaaaacgacatgatcaaggggcgaatagtgttcaactgtcctcgagatttccaacagctcaaaaatgtcacactaaccttctcgggttgctcgaaagccaagattcggaaggtgaagggaccggccggcccgacaggcagttaccagagcaagtgcatcttattcaaaagggagaggatccttgttcctgcagaagaatgcaaaataccgcccacaacttatgagtggccatttgagttccgcttccatcctcatgttgcatcgccgaatgcctggcctgaggcagagtcattccgtgtcgacgagaatcagccactacccccatcattcaatacagagtgccacaactcactgcgaagggtatccgcaagcatcgaataccggttaaaagtgcagatcttcaagcccacgaagggcctgttcgagagaaagtcgccggtatttgagaaggtactgcatcttccactcattccgatggcggcacgagcacacacccacgttatcgaactagagaagaagcagaagatcaaccgaacattcaccgtacgcagcctctcattgctgccaggtaataccgatcgctccctgagcgtgcaggagagattcaaggcctggctttctcccggacaattgccttacttttccttcggtgttgagttccggtacccattgtaccttgttgcgggcacgccgattccactgttactggaggtgaagccattaatagacaactccaatgctccccacgtcccagagattgttttgcaaacggcctccatcacactcattggtaggacggctgctcgtgcatctccgttgctgatgggatccatgtcaggccagatggatgaagagactatgctactttcaaaaacatcattgcgcatggttatttctggtcagatgggcctttctgagcggttcggacagatatcttttcctactactgatgtcacttttagcactttcaatctgagtcgttcataccggctgaggatctcgctggtgttcgaatgtgcaggaaagttgtttaaattcgatgctacagatctggaagtaggagtactctcgaacgctggaatgacggtagaaaaggatggtttacatagggtttcagcaaatgagggctccagtcattctcgaggaaatgtggtccatggttcagacgaacaaccgccgccgtatttgctttcatcaggtgtctccgagtggagctcggaaggcaagtccagtgtctag

SEQ ID NO: 17911 - DNA, 639 bp, A.fumigatus
tcttgcaaagtccccccagaaatgatgtctcctctagtctcaccgcgagacgggaatcttttccgatcgttcggcttcggcccccagcgccctgtttcttatcctactgttcaccatgccttcatagattgtgcgaagcagtatcctgacaccgtcgccgtctgtgatctttcccggaacaaatcggtcgaggtcacatatggtaagctgctccaatatgctcaattcgttgcactacggcttcaaagtcatggtgtggtccctggcagcaggattgtgcttgcgacaaaacggagcgtggagatggtcgcaggtatcctaggcatcctcatgtgcggtgcgcagtatattccacttgacggcgctgttgtcccagacgagacactggcacatgccgtgattcaatcccaaagctctgtagctctgtgcacgggtaccttcagatcgcgactgcactctctgccacaggtatcctcggttttggttctggaggacctacttgctgaggcggagcatactgggatccgggccagcacgactcctttgatctgtgagggagacgagaattcaggctgctatgtgatctacacttctggtcagtttgtttcgctctgcgtaccgaatcgaaccctaagctaa

SEQ ID NO: 17912 - DNA, 399 bp, A.fumigatus
gtctcacctgggtttctctggaattcttgccttaatacttctcttctcaatttcgcgactcttgcacgtactgatgaaattgcctttgcagcaaccggcgaacccgaaggtcatttatggcgagccgacgacaacgactatgcccccaacagcgcccattccgcccgcacgaacgctgctctcatttccctcgtccgtaatgaagagctagaagatcttatatcgacgatgaaagacttggagcggacatggaatagcaaattcaactacccctggatcttcttcaacgacaagccctttacggaagaatttaaaaagcgcacacaagcagagactaaggccaagtgctattatggtatttgcgcccaattttacttctactcaatgaaagaaacctga

SEQ ID NO: 17913 - DNA, 660 bp, A.fumigatus
aagaaacctgacaaaaagtgtccagaacaagtgccaaaggaacactgggaccctccggaatggatcaacatggaactcttccgcgagtctgcggccatcctcactgaacagaagatccaatacagcgataaactctcgtatcatcaaatgtgtcggtggaatagtggcatgttctacaagcatcccgctcttaagaactacaagtactactggcgtgttgagccgaaggtccagttcttctgcaatgttgattacgatgtattccgattcatggaggatagaaacctcacttatggtttcaccatcaatcttttcgacgatcccaaaactgttcccaccctctggccagagaccaagaagttcctagctgcaaacccctcttatctctccagcaacaacatgatgggatggttgacggacgactcactgcggccagaccacaccgaggcggcgaatggatactctacctgccacttctggtcgaactttgaaatcggtgacttagatttcttcagaggagagcagtacgatgcctatttcaaccatcttgaccgtgccggtggtttcttctacgagcgatggggcgacgctccagttcattcgattggtttgggactgtttgcagacgcagccaaggttcactggtatgttacttcttga

SEQ ID NO: 17914 - DNA, 498 bp, A.fumigatus
agactccgtctcagggaattgattcctggtgcatccttctggcccagttttgaacgcaacgccagcgagcaatacgaaggccgtgtctgcatggttcgtatctcggatcccgacccggccaaccccagcgtcttcctccacggcatgaacggctcctcgctccctattgccgtcgctcacggagaaggtcgcgcttcgttcgctgcagctcccggcacctcggcgcaagatttcgttcgtcaaggcttggcccccgtccagtacgtcgataacgcgactctcaagccaaccatgaagtatccattcaaccccaacggcagtcctgagggcattgccggtattcgcagcgccgacggccgtgtcttggccatcatgcctcacccagagcggaccgtgatgggcggtattgccagctggctgcctcctaatgctgaagaatggggtgatattggtccgtggggtcgtgtattcttcagcgccagaagatgggttggctaa

SEQ ID NO: 17915 - DNA, 225 bp, A.fumigatus
acgctttcttcatccccgcgtgaagacgccgtccgcccttccggcttcatcagagctcctcaattcccccggtcccgcgtgcaggtcccggctgctctggccctcaaccgtcccagcttcagcaccaccaccaagcgtctgtccggtgcccacgaggatgagacatacgaggaattctctgctaggtatgctatcacaattagcaaaccattggatgcgatttga

SEQ ID NO: 17916 - DNA, 246 bp, A.fumigatus
agagtagcaaactgtattggctttctcttctgtccacggtatatgacgctgatcatttctccgttacagcgtaacctcaacaactgcttcgcttatgatctcgtcccctccgtcgaggtcctctcagctgctctgagggctgcccgccgtgtcaacgacttccccactgctgtccggatttttgaaggtgcgcctcttgcttttcttctgctctacacacacaggcactcatgtatatgtacttga

SEQ ID NO: 17917 - DNA, 2622 bp, A.fumigatus
aatacgtcacgactcaaacatctaaagcatcatgtcgaagacacgttcaaatccgcctctcatgtccggactgaccagttcgcggtctcaaaacagctagagggcctgcaggagaaattccaggtacttaatagagatgatctggcggacgcactccggaatcgcttgactgagttagatgaacaccataagtcatggtttcccgagatactatctttccttttacagctctcttctcacccggctgtattctcgcgggtagaccgactccccaagcccaaggttgacgaaggcgcgaagcaactctcctggacggagatggatgcttcgggatccgcgtactgtgatgaagatatctgggaatgtgtagatttcggcgcagattcctcatccgaagaagatgatgatcttgcgtcttcggggcgcagtgacgccccaatcccacagacactaccttccagtcccattgcctccgaagaagactatgaaattcccgatgaagtctttcctcctggaacggatatggctcttgtggactccgttagagaagctcaattctggaagcctaggaagcatgcggaatccaaccaagtcgggaagctttcctgccgtgtgatcacggagcttcaaattgtaagagaaacactgtttatgttgcagggtttgcccacgtctttattctggcgactcgatgacagcatcgaggttgatcgacggtatactcttgcacacacttcgagtgaggccctatcttcgcttttgcggtcattcagcatgattggcgccaggctagatgttgtaagacgcttcgtcaagattacccaggttgttccctatatgcaaacctttcaccgatgtgttgaggactgcttgagccaattcgatgcgttcttgtcggaagtgcaaactcagtgcatttcgcaaggagcccctttttctgtcagcctattacaactggccgaagacgttcgcaccgcatcagcgatgctcgtgcttctggccgatttgatctccaatctcgagtatgactctccagatgacggtgtacggtgccttgacctattgtacgatgtggtatgcatgaagcaagctacaggggacgatgttgagttcacttttctggcaaagttgttcttttcatgtctcgaaacctacattcgtccgattcgtcgttggatggaggagggacgactggatccaagagaaggggtatctttcataatagaccaacgtgacgataaagatctgcggtccctttggcgcgactggtatgctgtggacgactcatgtgggcttccacaatttatgagacctgttgctcaaaaaattttcactacgggtaaaagcatggtctttctacaacacttgaatgctctagagacactgggagactcgaaggcgattacccttactttggaacatacctatggtgatgaatcaagttccttactctgtcttccctttgccgccatatgcgagtccgctattggcaagctcgtcgaggctaaccactcctttgcgtccgatttgctacggaaagagcttgaccagcaatgcgggctgtggagatccctccaagccttggaacacatctacctctgcaaggacctcagtgtgtcagctattatcgacaacaaggtctttgacctcatggatcgcggcagaggcacctggagcgacaggtatctcctcaccgaactcgcacagagcgcgtttagcagcatgcctttcatcgaccactccagaataattgtccgctcacaccaggattcgcaaggacgcagccgctcagttaagggcctcaaaaccatctcattcgattacatcctcccctggcccatcgcgaacatcatccccaaagacgccatccatcgttaccggcgcatctcgacatttctgatgcagatacgccgagcaaaacacttgatcgtaaaacagcgtctgaaatacgccgatgagacggacgaattctcccgtgacaggagcagcaacgcactgagctattcccttcggcaccacatgctctggttcctgaacaccctctacagccacattacggactttgtcatctccacagcgacagagtccttgcgcaagtttctctccgccacaaaggatgtcgatgcaatgatcgcggctcattgtgcgtatatgtcctctctggaagaccaatgcctcctgtccagcaatctatcacctctttaccaaaccacaatcagccttctagatctctgcgtgtactttgcagacatccaggcaacacgctacggggacaagctctccgatcagagcacgccgacaagacatgccaagtttccgcaaggcagaaaaagcctcagcacgacgcatcagattccatacaccgacgacacgataccaagtgatgatgacgatgatgacgatacacaagacgagtcggacgaggatgttggcaataccaccggcatttccttctacgagacaccctacgcgcatcgactgagagatatcaaaggtcgttttgaccagttgcttgcatttctgacctctggtttgaagggtgtgggacgtgtggatggtcagatcagttgggagattctggctgagaagctggagtggcgtaagaagcggttagctgtctag

SEQ ID NO: 17918 - DNA, 570 bp, A.fumigatus
gcgacatattcaggtcgcgctcgccgtccgccttgtgtcaccaactgcgagccaaagcccccagcgcccggcttgggcgtcgcccctaccatgttgaggagagcagcaatacccgtagctcctcctgcatcccctgctgttgtgcctggagccccatcagctggtggagacagcatctctcgcgcgtctgtaaagggcaggttgtcgtcgtcatcgtcggccataccgagcccgttcgggaacgcgagtccatcgtcgtccgcgaagaagtcggcatcatacgcgccaggggcagcatcctcgtcggcggccgcttcctcctcctgcttgcgactagcccagaacgcctcatccatttccccattaactgcggtccggtcctgtcgtcggctgttgaattgtcgcaggcccaccagtttcttcgagcccatgcgagccttaggtttgaggaagagacggagtagctgtctggagttgaagtgtttgtcgtctggtagcagattccgccctttggttttccactgtgtcttgggcagggaaatggtggagttggaactagcgggggtataa

SEQ ID NO: 17919 - DNA, 516 bp, A.fumigatus
actttcagcattggctccagggcagcctcaccggcccatgcttcacccccattaccaaaaccggcatcttcactaagatcgaacccagctagagtaccatcgtcgtcgtcaaagccaacaacattgtcgtcgtcgagcatgatcccagaggcatcgtttccgcctcgtccgtcctcgttgcctttttcgttgcgccattcttcaggcgccttgagaaagggaatatcgagtgatccggagggatcgccaagatcgaagttcttgagggacggacagatatcctgctcatcgaggcgcgtcaaatcggggaaaaattggttcgctagtggcgttatgtcaatctcaacgtcttcaaaagcatcgtcagaagaccgcttcggagccggtgaagaggacttcggatgttcggggtcctccgagccttcgcgactattgtccacgtcattagggctttcctcaacagcgtcgtcgctgctgtcaaagacgatacgtccctgcccatctatcgacaggtga

SEQ ID NO: 17920 - DNA, 2757 bp, A.fumigatus
cagtgccgtctggtccgtcaagccaaggatcaatgctcctttgtccgcgtcaattgctccgaccttgaagatggattactctcatatgtccagctgtattattgcacatttgcgaacgccaaacctatagcttttatcgtcctcatcttgtggctatccttgcttttcagcactataggtattgctgcaagcgacttcttgtgtatagatttgagtaccttggccagcattctcgggatgagtgagagtttaaccggtgtcacatttctcgcatttggaaatggtagccccgatgtcttctcgacgtttgctgccatgaggtcaaacagcggtagcctggccataggggagctgatcggtgctgcgagcttcattacgtcggtagtggcaggctctatggccctggttcggccgttcagggttgcccggcggagcttcgtccgggacgtgggttactttgtcattgctgtcagcttcagtatggttcttttggctgatggaaggcttcatgcctgggaatcggcaactatggttggtttatattgtttctacgtggtcttggttgtcacttggcactggtaccttgtacggcgccgtcgggcgtacgagaggaatttagctgcacgggctcacttccacatcccagaaaaccaggagctggaaatcgaagaagaggtggaagaggatcccggcgttgcgtcggagtcgagaagtcttctccgcggaccgtcgaccgaagatttcgacgcattgcaaggatctgatttgccggcttggaaagatggtgacgaggatgatgacacgcgcaaccgctatctcgctgaaataagtgagaatatgcatgtattccgcccctctacgcgcaggcgcaacaccttcaatcccatcagacccagcctcgttggggcgttggagttccagaccgtactttcttcgcttcagaagtcccgtagcatcaatcggggcacacccattgggcacgatttacattttgataatccagaacttgcgcgcgccccttcagcactgcaggacaatttatcagtcgcatcccatccccgaacaagcagaccctccgggaacaactctcttctatcgccgaatagcgcagcaggctcgtctcgagttcgtgctgtgtctgccaacgatgctgcggggcttaagctggataccagcatcttcaattctggcatgccacagcctcgtgtgaccgttagtcgaccttccggaaccgaagagacgtttcagcctcagatatcccaaattgatcagacctcagcaactccgtcattatcctcctccggcagaccctcgcgggattcaagtgccgcccggtctgccagccctaatctacttgcaccgccaggtactttccactcgccaaactaccaggctgactctccccttacgcggtccccgctggatgtctccccattagggacttcatatgccacgcgcggagctgaaattgctccggaaagcccctccagcccgtttcctccttttccagacgccatcgatttcatgcagtcgagggctccaagcatacgtcttccggcccctaccagccctacggagacgttgcaagttcatgacaacgactttgaggatgaaggtcatcgctcgtcatcaccagcaaagtggtcattgctttccccatgctgcatcgcgaggtccgttatgccggtgctcttcccgaccttggttgactgggggaccaagagcttcctagaacgactgttgggggttgttgcagcgccaagcgtgttgttactcacaattactcttcctgttgtggaaccggcacaacgtgaaggggaccccgcgcctaatatattaccctcggcggacggtggagagtcggcagcaccccgagtgagactgccggaagacagtccacttattcgaactctagaccgtgatctaggcgatcaggatatggcttcactcgcgggcaaagctcagtcgctacaagaaaggcgacgatgggactccgaattgcctgcccttgagccgccaacctcatcagcttctcagccaaaagactggtgtcagtggctgctttacatacagctcttcattgggcccttttttgttgccttgatcacatggactacgatggatcccgagatgaaagtccgcaatctgttcctcccatccttgtgctcccttcttttctcatttctatgtcttgtgtgccttgtggtgagtacaaggaattgccgctcctcgcggccttcctctttttggcgccccttcctggccatgttgggcttcgtagtcgcaatcttttggatcgcgaccatagcaacagaagtggtcagccttctcaagacttttggggtcattctgaatattagcgactccctcttagggcttactgtgttcgctgtgggtaactcgcttggcgatcttgtcgccgatattaccgttgcccgcctgggatacccagtcatggctttgagtgcctgttttggaggaccgatgctaaatatcctgttgggaattggcctgggcggtctttatatgacagtgaaagcgaagccagaaacggaagccgctcgtcagggttcttacgatattgctatctctaaggtcctcgtcattagtggcgctacacttctgactactttactccttttgctgattgtcgttccattgaataattggagaatggatcgaaagattggctggggtctgatcattttatgggcctgcagcacgttagggaacgtaatcgctgaggtccttaactag

SEQ ID NO: 17921 - DNA, 186 bp, A.fumigatus
agaggacttcggatgttcggggtcctccgagccttcgcgactattgtccacgtcattagggctttcctcaacagcgtcgtcgctgctgtcaaagacgatacgtccctgcccatctatcgacaggtgattcaggagcaagcctttggcccctccctcgtcaaaatccgcggaggctttcttgaataa

SEQ ID NO: 17922 - DNA, 657 bp, A.fumigatus
gaactcaaaagattgaatggcgctctagggtgcaaaggagaagacgatattaacgagctcaggatccctttgaacgatgacacgggggagaaggccgcccgtttggaggcccgacaagcccgccatgaccgccagatggatcagatcaaggctgccgtcaagacgccaatgcctcctcgacgatacacatatgaccgcgcttcgagtatgagccccggtacccctaggggatcaggacaccgccgacgagagagcgatgctgatggacgacgagcggtgaccccaatgaaacgggtccctatcttggcaaactttgaggaatggatgaagatggccacggacaacaagatcaatgcgaacaactcttggaactttgctctgattgactacttccatgatatgtctctactcaaggaaggcgatggtgtcaacttccaaaaggcgagctgcacgctcgatggttgcgtaaagatttatacaagcagagtcgacagcgttgcgacggaaacgggtaaactgctaagtgggctggcggacagccgtgagaagcggggtcgtgacactggcgcggagggtgagggtgacgacgaggacgacgaggaaggggaagatggaacagccaggaagtcgcggagaaaggtacggagaacagtataa

SEQ ID NO: 17923 - DNA, 2001 bp, A.fumigatus
cttcaccaggcccagagaacacacgaggccacgcttgcgccttcctttgccgcccttcaactgaaaaagtttgagctagaattctcagttgaccctttattcaagaaagcctccgcggattttgacgagggaggggccaaaggcttgctcctgaatcacctgtcgatagatgggcagggacgtatcgtctttgacagcagcgacgacgctgttgaggaaagccctaatgacgtggacaatagtcgcgaaggctcggaggaccccgaacatccgaagtcctcttcaccggctccgaagcggtcttctgacgatgcttttgaagacgttgagattgacataacgccactagcgaaccaatttttccccgatttgacgcgcctcgatgagcaggatatctgtccgtccctcaagaacttcgatcttggcgatccctccggatcactcgatattccctttctcaaggcgcctgaagaatggcgcaacgaaaaaggcaacgaggacggacgaggcggaaacgatgcctctgggatcatgctcgacgacgacaatgttgttggctttgacgacgacgatggtactctagctgggttcgatcttagtgaagatgccggttttggtaatgggggtgaagcatgggccggtgaggctgccctggagccaatgctgaaagttcatcgcattgaccgtgatggcgatcagaatcaggacggcggcgaggcaatggacgacgaagatgggtatgctatttcgcttactcatcagccagataagcgtgaccatgagaacattcttagctattttgacaatgcacttcagaaaaactgggcgggccctgaacactggaagattcggcgtatcaaggaaaacgcggctgccatctctgcaactgcggcgccgaagcagcggaaggaaaaggagccgtttgaaatcgacttcgcggcacctctagatccaaccgtcgctgaattgatttatacccccgctagttccaactccaccatttccctgcccaagacacagtggaaaaccaaagggcggaatctgctaccagacgacaaacacttcaactccagacagctactccgtctcttcctcaaacctaaggctcgcatgggctcgaagaaactggtgggcctgcgacaattcaacagccgacgacaggaccggaccgcagttaatggggaaatggatgaggcgttctgggctagtcgcaagcaggaggaggaagcggccgccgacgaggatgctgcccctggcgcgtatgatgccgacttcttcgcggacgacgatggactcgcgttcccgaacgggctcggtatggccgacgatgacgacgacaacctgccctttacagacgcgcgagagatgctgtctccaccagctgatggggctccaggcacaacagcaggggatgcaggaggagctacgggtattgctgctctcctcaacatggtaggggcgacgcccaagccgggcgctgggggctttggctcgcagttggtgacacaaggcggacggcgagcgcgacctgaatatgtcgcctatgcaagagtcgccaagaaaattgacgtgcggagactgaaacaggagatgtggaagggcatgggcgaaaggttgattgcatccacacaatttgattccatgacgcaagcaagcgctgggaacggtgttaatcaagtactaaatactgagactgagcccgatgcaccgccaacacccactcctcaaagaccgcagccggtcgacagctcggaagaaccgaaggaagaccgtcggttacgattcacgcaggtcatgaattccctcaaaacggtctatccgccagagaagcttcgtgacatcagcacctcttttggctttatctgtcttctccacttggctaacgagcaaggtctcattttgcaaaacgatggcctgtccgagggcgctggcgcgggctcattagaagagatttatattgccaaagacgtgaatgctgttattgacgaagcgtctgcttga

SEQ ID NO: 17924 - DNA, 351 bp, A.fumigatus
ttttacttccagcctgccctgacaatggagaaagagcctttgaaatcgactttcccttcagtatcctacagaggtatgctcaagctagaggaacaatttaggaatgcatcatcatccactcgaacagacatgcaatttgactcgcttgttagtcctacaaattccaaggttgctattcctcggattgcgcgctcccagtcacggaacgcagtccgccgtgctaagagagcatgcctgggatgcagacaaaaaaaggccaaatgtgacggccaccaaccatgtcatcaatgtgtccttttcgaagccgcttgcgagtatgccgaggggaaggaagacagaatcaaaaggtag

SEQ ID NO: 17925 - DNA, 720 bp, A.fumigatus
tctcgtatatctatggaaatccaatccatgtcatgctgttgtaacgaccgggatattcaacaccaggaagtgcgaacacaccagggagtgcaaacacaccaagaagtgcgaccacaccaagaagtgtggacaaaccaagaagtgcgaccacaccaagaagtgcgaccacaccaggaccctggtgcacttacactctctagtgcacttacactccctagtgcatttacacaccctggtgcacttacactccctagtgcacttagactctctagtgcacttgcactccctaatgcatttacactccctagtgcatttacactctctagtgcatttacactccctagtgcacttacactccctagtgcatttacactccctagtgcatttacactccctggtgcacttgcactccctagtgcacttgcacttcctggtgcacttacactccctagtgcacttacactccctagtgcatttacactccctggtgcacttacactctctagtgcacttgcactccctagtgcacttgcactctctagtgcatttacactccctggtgcacttgcacttcctggtgcacttacactccctagtgcatttacactccctagtgcacttgcactcaaaatagtatcatttctgatatctggagtccgcattatcttgctataccctaccggagaaaaggtggtaccgggacctgggccagctttttga

SEQ ID NO: 17926 - DNA, 675 bp, A.fumigatus
agattggtgattaatattttttggcacagacaggttggtagtctcgtatatctatggaaatccaatccatgtcatgctgttgtaacgaccgggatattcaacaccaggaagtgcgaacacaccagggagtgcaaacacaccaagaagtgcgaccacaccaagaagtgtggacaaaccaagaagtgcgaccacaccaagaagtgcgaccacaccaggaccctggtgcacttacactctctagtgcacttacactccctagtgcatttacacaccctggtgcacttacactccctagtgcacttagactctctagtgcacttgcactccctaatgcatttacactccctagtgcatttacactctctagtgcatttacactccctagtgcacttacactccctagtgcatttacactccctagtgcatttacactccctggtgcacttgcactccctagtgcacttgcacttcctggtgcacttacactccctagtgcacttacactccctagtgcatttacactccctggtgcacttacactctctagtgcacttgcactccctagtgcacttgcactctctagtgcatttacactccctggtgcacttgcacttcctggtgcacttacactccctagtgcatttacactccctagtgcacttgcactcaaaatag

SEQ ID NO: 17927 - DNA, 606 bp, A.fumigatus
tactattttgagtgcaagtgcactagggagtgtaaatgcactagggagtgtaagtgcaccaggaagtgcaagtgcaccagggagtgtaaatgcactagagagtgcaagtgcactagggagtgcaagtgcactagagagtgtaagtgcaccagggagtgtaaatgcactagggagtgtaagtgcactagggagtgtaagtgcaccaggaagtgcaagtgcactagggagtgcaagtgcaccagggagtgtaaatgcactagggagtgtaaatgcactagggagtgtaagtgcactagggagtgtaaatgcactagagagtgtaaatgcactagggagtgtaaatgcattagggagtgcaagtgcactagagagtctaagtgcactagggagtgtaagtgcaccagggtgtgtaaatgcactagggagtgtaagtgcactagagagtgtaagtgcaccagggtcctggtgtggtcgcacttcttggtgtggtcgcacttcttggtttgtccacacttcttggtgtggtcgcacttcttggtgtgtttgcactccctggtgtgttcgcacttcctggtgttgaatatcccggtcgttacaacagcatga

SEQ ID NO: 17928 - DNA, 777 bp, A.fumigatus
gaaattcctgtgttggctgacaaagggataatggtactgattgaggtcattaaaggacttacgacaggactttgtatcattagtcatatcctgagtagaatatcttggacaaatcaaaaagctggcccaggtcccggtaccaccttttctccggtagggtatagcaagataatgcggactccagatatcagaaatgatactattttgagtgcaagtgcactagggagtgtaaatgcactagggagtgtaagtgcaccaggaagtgcaagtgcaccagggagtgtaaatgcactagagagtgcaagtgcactagggagtgcaagtgcactagagagtgtaagtgcaccagggagtgtaaatgcactagggagtgtaagtgcactagggagtgtaagtgcaccaggaagtgcaagtgcactagggagtgcaagtgcaccagggagtgtaaatgcactagggagtgtaaatgcactagggagtgtaagtgcactagggagtgtaaatgcactagagagtgtaaatgcactagggagtgtaaatgcattagggagtgcaagtgcactagagagtctaagtgcactagggagtgtaagtgcaccagggtgtgtaaatgcactagggagtgtaagtgcactagagagtgtaagtgcaccagggtcctggtgtggtcgcacttcttggtgtggtcgcacttcttggtttgtccacacttcttggtgtggtcgcacttcttggtgtgtttgcactccctggtgtgttcgcacttcctggtgttga

SEQ ID NO: 17929 - DNA, 543 bp, A.fumigatus
ccccggatgttagacaatgagtatcacgacatggaccagacactggtactgaacctcaaccaggccgctatcaacggtatccgcgctgcaggagccacctcgcaatacatctttgtggagggcaactcctggaccggcgcctggacctgggccgacgtcaatgacaacctgaaggctctgaccgacccccaggataagatcgtctacgagatgcaccagtatctcgactcggatggatccggcaccgcggagagctgcgtgtctaccacgattggtaaggagcgggtttcggccgcaacaaagtggctcaaggataacggcaaggttggcatcattggtgagttcgctggtggcgtccatgatcagtgccggaccgctatttcaggaatgctggagtacttggctcacaacacagacgtgtggaagggagctctctggtgggcggctggcccctggtggggaaactatatgttcaacatggagcctccgaccggtgcagcttatgtgggcatgttggacatcttggagccctacctgggttga

SEQ ID NO: 17930 - DNA, 333 bp, A.fumigatus
gagaagtatactgctgctgacaacatcaaggggaaagaattcatcttcccggacccttctacaatcagcacattgatcggcaagggcatgaacatcttccggattcaattcctcatggagagactggtgccaagctctatgacaggctcctataatgaggagtaccttgccaatctgacatcggtgggtttgagcagcagcatgttggactgtatgaggctgactcgaccaggttgtggacgctgtcaccaaggcaggatcttatgctattttggacccacacaactttggcagatagtgagtaatgcccggcatactgtggacttgttctaa

SEQ ID NO: 17931 - DNA, 1515 bp, A.fumigatus
acagacggagattatgtgttcacggctcatgacgcaaaactcagtttacatgtggtagagaattctcattctgtcaacacgatttacctacagcaactggttacgggggttaagtccattcttttctccgctgacactatagcgctgtcgtcttctcacattctaattgctgcgggaaccgtctttggggagatcatagtctggtcttgttttgtagacgacgatgagagtcaacccttgacgctcaatgcagttggctccatccatcactttttcactggccacgaaggttctatttttggggttcggatgtcacctcctatcagctccttaccgggaggccaaccaggaaggcttttggctagctgtagtgatgatagaactgtcagggtatgggatatcacggactgtgaacatgcatcccgtcaagacccttctgcctactcgacagatggcttcgagctacggaccacggggtttggtgccgttgcaacaactgatgataaatctggttcggaatcatgtgttgcaaaggcattcgggcattcagcacggatttggggtgttcatttcgtgcccaccgcggtggagaatcagagccaactgaccattgtgtctcgtggtgaggatgctaagtgtattctgtgggacctgagttggaatctgtcgccaacacataagaccgagttcaaattgactcagtcatcgtctcctcatctccacaacggcaaacacatatggtcactcgacttgtgcagctccgggacacaaaccacgatttacactggaggtgcagacagctctgtcaggagcttcaaaatagacgtagatgatacggcgtcgatctctttaccaaatagggataatcgcattatattttcaagcgatcctcaaaacacagttcttgcaagagaaaggtcgttcaaagctttcgcatttatctcaccggagttgttcgttgcaactactttccaaggtgagatccagctttgttcgatacgaacagacagtggtaaagggcaattcatcttcaaggagactctgcatgttgaggacgatctccggtctttttcagtagtttccagtctaccacagaagggagtggcgctacttggcaatgcacgcggtttgattcggctctatactcacggtactgggttgttgaaccagattgtacaagcggatggcaggccgcttcaattgtacttccttgggtacgatactaacacgtcagaagctctggcgactctcacgttcgccatatcttacgcaacacttaggaaagcagatctctttcaggtcaccatgcaagctaataccgagcctaaagttgtcaaaacagaattgtccttacctcatggtatggaagtatcctgcgcttcatacatctctagccagtatctggccttgggaattaaaagtggcgcactcatagtttccagaactgcaagaaattggtgcgtttctccagcggatcatttgcgctctgagagtccatggtcgagagggcgttaa

SEQ ID NO: 17932 - DNA, 990 bp, A.fumigatus
atctggcatccagataacctacacaagttacgtcttttgaatgtcgaagaaaaacccttcaagcgtatatcgaaacgactccttaatccaagctcactcgtgatttccaatgcgacaatccttcctaccccaccgcccgacgaaacagaggagaacgctacagcagcagccgaagctgagaagcagaaaaggctggatgaatggcgcaatttccgcgaggatgtgactctagattttgcttcttttgaaggcagcatcgcgcgcattcaatttctccttacgagcaacgagcgagaacgcgagcggtatgccgccgaaaagcttcggattttatccacaatgcaggccgttcgcgaaaacacagcagaactacgggtgcaacttgaggaagctcaacggctactagcattacgaaaaagctatgacgagctggcggagaaaatcacaagcaacaggcttctgaagccacgcgaagatcagcaggcgaacctacagaagctccaagcagaaattgcagatctcgagaatgaaagcaaggaatatgccaagacatgggccgagcggcgagaacagtttggccgcattgtagaagagggcatgcagcttcggcgcctcattcgggatgagaaggaggaggtggagcgcagagaaggcatgcaagaaggcgaagatggagatgaaggggacgttccttcgaaaggcaaatctagcggagccaatacacctcgaccagagtccaataccatcactccctctcagcacagccaggatgaagcgggccgaccttcagccggtttgcacgcagagagaatttctgcgacaacaggggcagcgtctcccttacgaaacgtgtccaccgcggaccaagaggataccaacatggacgaaggtgaagtaaccggagaggatgggtcagagcaccctgacgaattagaggaaggagaggctgaaccggatgataaaactgccgacaggatggacactacgtga

SEQ ID NO: 17933 - DNA, 237 bp, A.fumigatus
cggctaatacactggattcaaatttttgacatgcaactgtacctttttatcatggggccatatattttccctaggctgtggctgtgttcgcggacggttatcgttttgcccatctataatgacctcgtcgtggacgaacaacggatcgggcaacgtcttggccaaatgcagaaggctatggtatctgaacgcctgcacgtgggtacgaaggtaggtgcatctaaacgtgcttattag

SEQ ID NO: 17934 - DNA, 240 bp, A.fumigatus
attactgacaagttatgtagccaaatcgtcaacatggcaccacgctcccaactagagattgctacatcatctgttgaacgtctggtgaaggaggaggcctcgtaccaccgcgagctccaacagcagacggaaagaatccaaaagctagagtctcaagagcctggcgaggatgagaatcgagaatacatgctgaagcaggaggtgggtctcatgagaataaaggcatctcctcaattctga

SEQ ID NO: 17935 - DNA, 618 bp, A.fumigatus
cggaacgttttgttgacaccacaagctaggccacaaaggcgcccaaacatgagtcgacagcaggcggcggaaaaggccctgcatgaccagatgaacatcctaccaatagtacagttattggtagtcttcgctggtcttgctgtatctctcctcatcacgtttgtggatcaaaatggcatcagcgttactcttccgacaattgccaaagacctcaatgcagaaaataccatttcctgggcgggtacctcgtcgctgatcgcaaatacaatgtttagtgtgctttacggacgtctctctgatatctttggtcggaagattgtttacttatcagcactcgccctgctgtgcatcgctgatttgctctgtggcctctcacagaatgcggcaatgttttacgtctttcgaggccttgctggtattgcaggaggtggcgtcggttcgctgactatgatcatcgtatctgatattgtgacccttgaaaacagaggaaagtatcaagggatcttaggagcatcgatgggactgggtaatgtgatcggcccgtttattgcaggagctttcatcatgcattccacttggcgagggctcttatggctcatatctccgctcgcagcatga

SEQ ID NO: 17936 - DNA, 1227 bp, A.fumigatus
gtgaccgctgtcatgacggagatgtactcggggctccatgtgggccaacgattcgcctcgctggaagaattcaagtcagttgtgcgaagtatatcagtcagacagcactgggaacttcgggtgacccgaagcaacaagaaaagcgtcgtcatagggtgccgatcgtctgccaattgctacttccgcgttgtttgccgtgcaaacaaaaacgagacttacataacaagccttcaggatagccatagctgtcgacggcatgctgcatccccaggaacaactccagcccggtccgaggcttcgcatgtgcgcttcctactcaacgagataccaaagttgtttgacttgagtcacaagatcaagggacaagatgttgtggatgcggtcaagcggtatcatggatatgacatatccataagacaagcgcaccgagcgctcaccaaattacaaccaaggctaccacatcaccagattgaggaaccacgggatcgcggtctgaatggggatgaccaaccggggccccaagttcctgcgacgccgtcagtcaatggctcagtttacagtgccatttccgagcaaagatggatttccgacaatgttcatcagtcaggattcctggtaaaacgacctgtcgagctgacagctggcccaagtcacgaatctccacaaccagcagagcttgctcgcgatgctgtgcagccacagatcccttcacaacgtccacagccagtgcatggctcatcccaagtacaacttccttccggggcacaaccacaggagcagattgcgctcaatgatgggctgcgcacgtctgatgagcaacagtcagattacatactatcggcacctacagtactgtctgcaccacaacaggggccgtctcaatcaccccaacagccacgcggtagtggacatccttctgcgccacagatgatcttgaccagtttcaagatcgagtttacctgtactgcttgtggagctttgaatcaaagctttatcccatatcaggggaatataactggtggggcgtacttgccttcaaacaacgtaatcaaccatggtcctgtcggcagacctacaagttcttcaatgcactcaggtgctagcggtgttgaacgtgtggcccagaataatgaatatgtggaagctccttcagtcaacgcacgaggcatacagccgttatggcagccggggagtgttcctgtttcaattccgcccacacatacgtga

SEQ ID NO: 17937 - DNA, 993 bp, A.fumigatus
ttgcttggaattgttagactgatcttcccagacaatgaataccacgatatggaccagactctggtgctcaatttgaaccaggccgccatcaatggtatccgtgctgccggtgccacgacgcaatacatctttgttgagggtaaccactacagtggtgcctggacctgggctgacaacaatgacaaccttaagggtctgaaggatcctgaggacaagatcgtctttgagatgcaccagtaccttgattcggacggttctggtacctcggagtcctgtgtcagctccactattggccaggagcgtgtggagtctgccactcagtggctgaaggacaacagcctcaaaggattcctcggagagttcgccggcggtgtcaactcccagtgcgagacggccgttgagggtcttctctcttacatgtccgagaacagcgacgtctggcttggtgccgagtggtggtctgctggtcccatgtggggaaattatatgtacagtctggagcctagtactggccctgcctactcaagctaccttcccattctgaagaattactttgtcagcggcacctcctcttcgtcctcgtcgtcttcctccatcaccagctctactacttctgtgaacaaccccaccacttctgccactactcaggctcaggttgtcaacacttcttcctcttcccctactccttctccaacctctgtgcctgcagccgaggctcccgctcccacgcctactgaggctgctaagacttccagtgctgcttcgaccaccccgacgaccgccgctgcttcgactacagcttttgcttgccgtgcccccgagcctgcagacgaaaccactctgcccagtgctactccaactacttctgcgtctgcctctggcatcgccaagcactggtaccagtgtggtggaatcaactggaccggccccacaacctgcgagagcggctacacctgtgttgagcagaacccttactaccaccagtgtgtttaa

SEQ ID NO: 17938 - DNA, 204 bp, A.fumigatus
gcacatcaacaccccgaatctggaatcatggttgtcaattcctccacaactggctctccctcttcttcctcttcaccttccctctcaactaccttctcctccacatacttcaagacaatcacccagcgacgtcaacagaagaaaatgagcattacacaaacatactaccttgctcacaccgcccggaagaatcttatcctataa

SEQ ID NO: 17939 - DNA, 657 bp, A.fumigatus
tcttcacgggcggaccacgatctccgtctcctggttggtcatgccaacctgcttgattcattgatgttggatctcgccgatgccgaacaggaacaggaacggtggttcaaccagactgtcaacggagctagcaagtcctctcaaagctcacaacctcgacacatccaatgggccgacactgtgattgaagaacccgaggaagactgggaccctgaagatgcctccgaccttgactcggacagtgatgactcggactttgacggtgaagaagactacgaggaggaacaaacattcgccacgatccagttgcctgcccggcaacgggcaccatcgcccgtggctgtcatcaccgagaaggaggtggacgaggactacgattcggattcagactcggattttgaatacgacgatatcgaagatctggatgagctcacattgactcgctcaccatcacgacaaacccctcccgagctctcctcggactctgacgaggactccgaggatgatgcaacgcctccctcgccgccgcaacccacgctggccggttttccagagaagcagcctcaatcggccgagcttccactttccgaccctgaatatgggactgggtattacgttactggacaggagcagagcacattcatcgaggcgtattga

SEQ ID NO: 17940 - DNA, 210 bp, A.fumigatus
ttacgtcttgtttcgattgattgtttctccaccagtgtatatttttgtgatacccttttgtctgataatttgggcattcattttcagcggtttgcatacgctaagcaggaaaggcacggcgtttttctgggactgatttcagctatcgacctgatgcatttatgggcgtctagatttttgttagtgtgtccgctgtttgggcactattga

SEQ ID NO: 17941 - DNA, 198 bp, A.fumigatus
aattttttttcttattactcctctctccattattcatatattctttttatttctcttagtgatgtttttctacctctggttgccgtgatcccgtctaagtccgaacggcgatcggacgccggagagaaagcgagcctgacatccatggctcgggcacaacgggataactgggtccacctgagaaaacctgaaaaataa

SEQ ID NO: 17942 - DNA, 582 bp, A.fumigatus
attacatgtacaactgaagcgaaatgcgatcgtgcaaccttgtctgtcctagacgtcccacctcatgctcagttgcctgtctctctccgggtgcagcgaccgacggctaatttaaacacactggtggtagtaagggttctgctcaacacaggtgtagccgctctcgcaggttgtggggccggtccagttgattccaccacactggtaccagtgcttggcgatgccagaggcagacgcagaagtagttggagtagcactgggcagagtggtttcgtctgcaggctcgggggcacggcaagcaaaagctgtagtcgaagcagcggcggtcgtcggggtggtcgaagcagcactggaagtcttagcagcctcagtaggcgtgggagcgggagcctcggctgcaggcacagaggttggagaaggagtaggggaagaggaagaagtgttgacaacctgagcctgagtagtggcagaagtggtggggttgttcacagaagtagtagagctggtgatggaggaagacgacgaggacgaagaggaggtgccgctgacaaagtaattcttcagaatgggaaggtagcttga

SEQ ID NO: 17943 - DNA, 297 bp, A.fumigatus
ccgtctttggagggtgatctgctgtggaatgccggccggacgagcgccacatatatagaagagaaagctagttcccttgtcgaggggaaagatgtcttggaggttggggctgcggcaggcgtcccgagcatcgttagtgcagtcaaaggagctcggaccgtcgtcatgaccgattaccctgatccggacctggtcgaggacatgcgatacaatgcctcgctctcggcggttatcattccgaggtgtcatcccttcatgttgcttgatacaaatggggtgatccggttgaaccgttga

SEQ ID NO: 17944 - DNA, 360 bp, A.fumigatus
cagctcatcgtcctctcaggttatccctgctccggtctctcgtaccgcgcccaacaactcgcctcgctcctcgaggtgacgcaagatgaactcttcaaatccggcgctatccccgcctcgagaccccgatacaagatacacatcgtcccaacgcatgatccctcgcacccacgaaccgtttatgacaatgcgaggacggaaaaagaggcgcgcggagtcgcatatacgcgggccaagcgcgccttgggccgagatagtttcgtgattcttgatgggatgaattacatcaaggggtataggtatcagctttggtgtgaggcgaaggcgttagggacgacctcttgtgtcgtaagtctataa

SEQ ID NO: 17945 - DNA, 945 bp, A.fumigatus
tgtgaaatgctgaaggtacacgtcgggacccctgtcgatcaatgcgtcgcgaacaacgaagccaggatacgtcgtcgaaacacacaacaggagaagtctgaatcgcacgacaacgagccaaaggaagcatcgacaataaatgcagacccggaagtcgaagcgcaaaacactacacaaaccgatgccccctctcccgctaccgatgacaccgaagaaccataccctcccgacctcctcaagaacctcatcttccgctacgaagaacccagcacctacagccgctgggataagcccctctttaccgtcctgtggagcgaccctgaacctcccatcgcggagatctggaccgccctaaccggcatcccacacccatccacctccactgaacccgaaacccccgtcacatcactcacaagtgtgctcgcatccagcgccctcctctccgacacagccagcatcaacacctccgccacagcacgcaccccgcgcactgctgcgctccaccgcccaaagatcaaaccccaccaggccaccgtccaacccactgcaacagactcctccgccctctacgccatggagaagtgcacctccgccattgtcagcgcaatccggtcctacgcactcaccaacccctccgccgaggcagcattagcccagaatcctgacgcccgcggcatcgcaattccggtccctgaggcctcatcccccattttcatcccggcgcacgtggcaacgtcaggcacgacggacgagcttgccggtgcgggcggtatccttgctttaccgcgtctgcaacgtctgcggaggcagtggatcggactgaatcgggcgtatgttggggtgaaccatgcgtctgcggtcaagggcggcctggcgcctgaccaagtgggagatgcctttgtaagattcctgaacgcggaatttgcgggggagagcggagtttaa

SEQ ID NO: 17946 - DNA, 678 bp, A.fumigatus
cgggctatatatgagaatgttcagatcgctgataaacctaccagcaaataccttgattcccacctaaagccttaccgctgcaaggtccctgcctgcatggaggctcagctgcagttctcatccaatgcctgtctcttccgccacgaacgtgaggctcatgggttccacggtcatggtgataaccctcacctttgcctgttcgaaggatgcgacagatccgtccctggatatggattcccccgtagatggaacctcttcgaccacatgcgtcgtgttcacgactacgcctcttccgagagacctagctctccagaacactctccctctggcgtttccgcccctaaaaagaaggaggctagcggacgcaagcgcagagtgacgggtgcatctggtgcgcagacaatgaagcggaccagatccacgcactctcagaccagtacctcgaaggctctccagcagactgcaagccacaacagccagaggctccaaaatgccgagcgcaactactacaactgccgcgcgcgcttgctcgaggaactcagcaatatcacccctcaggattcctccatgcacgacaaggtcaatgccagccttcaggaattgatcactctgggactgaactaccgtcacatcgaagccagccagacttcctctcttcccaacggacttcccgcatga

SEQ ID NO: 17947 - DNA, 207 bp, A.fumigatus
aaaatcacagacacgccccggaaagctttccactctggccattggatttgcttttgtgtcccaatgatttcttccatgctcaagagttctcgcagtgctcgtcacaccttttctggcatcggcacgtcttgctttgagagctctttctttaaacagactactggacccatatcgggccagtaccactgcagcgtcaaacttgcttga

SEQ ID NO: 17948 - DNA, 513 bp, A.fumigatus
ggttggaatcaagctcgaagtaagtcatccgctcaggcactcataaacacaacaatcactaactgcaaattctcatccaaggtcactggcttgccagagtttgttgttcccaggttgcgagatcttctcagagactacctgaccaactccggcgactctgacatcaatccttcagagcctggatcgcgctctctgaaggtgaaactaaaaatcgccgggaacagatcacagaatactatccgcgtcatcgaaaaggaaaagaagttgataaggtcacaccgggtgacggactacatcaactcagtttgcgaacggtttcaagaactgcttgcattatactttccgtatgatgaggatgacttcgactatgagaggcgggtcactttgactttaaaggtcattatgaagccgttacatggaaacacaaatggccttgccaagtcctatgtggtgagttttccagctgtcttggaagagtgtacttctaagcaagtttctggaacaggaaattaa

SEQ ID NO: 17949 - DNA, 219 bp, A.fumigatus
ccaaatacctccgaatcctcctctaactgttcttccacaatggtcttgctagacttcgtgctcaacatcatctggcttccgattggcgctcacgacacctggggcttccggtcagctcacgaagcgttcatgtccacctacaacggtaccgggggccccgccagcttggaactggtgtctctcctacctggccactgcaggtattctgattgggtttga

SEQ ID NO: 17950 - DNA, 645 bp, A.fumigatus
tacgctcttctcattcggctctccccagccatttgtgtccctatacgccgttgtcctcggcaaaggcggccacgtcttcatgaacatcatctgcattgtagctctgtggcttgtaagccgtctttcgctcactatacccccccaaagcacattctgacccctccgcagaacacggccatcgccatcgtcgccgcctcgcgtctcgtcttcgccgtcgcccgtgacggagtcctccccttctccggctgggtctcccgcgtccacaacggccagccccgcaacgccgtcgtcgtcgtctggaccgtcgccgccctcgtcacctgcaccctcctcccatcaagtgtggcgttcacatccctcgtctccgcagccggtgtccccagcgccgccgcatacggcctcatctgcctcggccgcctcctctgcacgcctaagcgcttccccaagccaaagtggagcctgggccgcctcagcaagccattccagttcatcggcgtattctggaacgcctgggtcgttgcaatcctgttctctccatacgcatttcccgtcacgggggaaaatctgaactgtaagataccgcaattcttcatccttctctcagtctcagtttgtggcagaatattgatgtgcttgtctgaatag

SEQ ID NO: 17951 - DNA, 327 bp, A.fumigatus
cttattggtaagacaagactcccttttcgcggtatgtggaaactcacaatgagtaggacgagctacctggttactatggtcttcacattcatcactgcagcggtcatcgcggaagtatgctctgcgtccccgtctgcaggctcaatctatctgtgggctgccgaagctggcggtcctagatttggaagacttcttggtttcaccgttgcttggtggagtaccactgcttggactaccttttgcgccagtaacactcaggccgctgtgaattatatgctctcggtaagcttgcaagtgtattcatctgctaatcagggcccgagctga

SEQ ID NO: 17952 - DNA, 186 bp, A.fumigatus
gatactgacgtgctccagccggatgctgatacgctcttctcattcggctctccccagccatttgtgtccctatacgccgttgtcctcggcaaaggcggccacgtcttcatgaacatcatctgcattgtagctctgtggcttgtaagccgtctttcgctcactatacccccccaaagcacattctga

SEQ ID NO: 17953 - DNA, 411 bp, A.fumigatus
cccctccgcagaacacggccatcgccatcgtcgccgcctcgcgtctcgtcttcgccgtcgcccgtgacggagtcctccccttctccggctgggtctcccgcgtccacaacggccagccccgcaacgccgtcgtcgtcgtctggaccgtcgccgccctcgtcacctgcaccctcctcccatcaagtgtggcgttcacatccctcgtctccgcagccggtgtccccagcgccgccgcatacggcctcatctgcctcggccgcctcctctgcacgcctaagcgcttccccaagccaaagtggagcctgggccgcctcagcaagccattccagttcatcggcgtattctggaacgcctgggtcgttgcaatcctgttctctccatacgcatttcccgtcacgggggaaaatctga

SEQ ID NO: 17954 - DNA, 243 bp, A.fumigatus
ctggacaaagtcgtactggaaatggacgagatcaacgatgattttccggacacggatgtcaccctggtaatcggtgcgaacgataccgtcaaccctatcgccttggaacccgactctccgatctccggcatgcctgttttgcatgcctggaagagcaaggaagtaattgtgatgaagcgcggcatgtccagcggatacggtaagtgctttctttctttcatcctatccagaacgtatcactga

SEQ ID NO: 17955 - DNA, 192 bp, A.fumigatus
atagatgcgccgattatcatggccggtgtgacgattctcgctctcatctcgtacttcgtcatgcccgaggacgcctggttaccccggaaccgtatctcgcatttcattgacagcaagggcgccgtctcggagaccgtggaggaggtcggttcgtcaagaatggcacagcatgagggaacagcgtcacaatga

SEQ ID NO: 17956 - DNA, 207 bp, A.fumigatus
ggaggagcctttgattgccgaaagggcgaggaactccggcagatcaaatgccagttcaggctcacgagcgcggaggcaagcgttaaggaaccaacgacacactcttattccatcttggatgagtcaacgagtaagtatgctcgcttcgtccaacgtcataatgctctaacacagcatctaggcttacagggagcgacgcaaacttga

SEQ ID NO: 17957 - DNA, 735 bp, A.fumigatus
gatgacacgtttggggaaggaagaaacgactatgatactcctgcaactagcattgttatgactcctgcagagtccgatgtgaataagcccaggaggagagttaatgcttctacgcgagctcgggaacttcgctcaagaacaacgcccctcagtagcatgcaaagagggcttaagcggaacgccgcagcactctccccggatgactcgactctgggtgcctcagacgaggctttcgctgaggctctgcaaatgcaagaatatcaggaatccttttccaagcgtcggaagattgccgtgagcgccagtcgtgacaccccagagatcgaaaaatctaccgaggatgatgacatcctggagcacatcgattctgacggcttcgaggatgctgaggatgaagaggaccttgagccttggcagccaaagcgcagtattaggacttctcggcggtcgacaacgcagcaaaccgttccggatagcgaagcttctgacttaagtgatgatgaagcaggggatggaaactatcaaactgaatcggaagcagagggccccccatcgtctagtagtgaggaggagcctttgattgccgaaagggcgaggaactccggcagatcaaatgccagttcaggctcacgagcgcggaggcaagcgttaaggaaccaacgacacactcttattccatcttggatgagtcaacgagtaagtatgctcgcttcgtccaacgtcataatgctctaa

SEQ ID NO: 17958 - DNA, 345 bp, A.fumigatus
gcttacagggagcgacgcaaacttgaaaagcaacatcctctcatcacaaaaatgtgggacgacttgaagaacacgccccctattacaccggtactagcagaacagcctccgggcatttcgagaacgctgaagtcgtaccagctcgagggcttgaactggatgttgcagcaagagaaaagccaatataaaggtggtttgctgggtgacgagatgggcatgggcaagactatccaggcggtctcccttctcatgtctgattatcctgtcggcaaaccatcgcttgttgtggtgccacctgttgctttaatgcaatggcagtctgaaatcaaagtacgtttgttctag

SEQ ID NO: 17959 - DNA, 1215 bp, A.fumigatus
catcaaggtatttcaaaaggacccctggcctttacatatttgatggttactaatgcctctcagcaacggactacaagtgttgcacgtgcatgttttgcccttaaagcctcttataagtggtgtctttctggcactcctgttcagaatcggatcggcgaattcttctcccttcttcgcttcctcgaagtacgcccatttgcgtgctacttctgcaaacagtgcaaatgtcagcaacttcattggtcccaggatgcggataaacgttgtggcaattgcaagcacagtgggttcagccatgtatcagtcttcaatcaggagatcctgaatcccattaccgaacgagacaatccagaagcccgcaaggaggccctggccaaacttcgcctgataactgataggatcatgctgcgtcgagtcaagcgcgatcacaccgcttcaatggagcttcctccgaaacgcgttgttctgcataacgagtttttcggagaaatcgaacgtgatttttccaggagcatcatgacgaattctacccggcagttcgatacatacgttagccgaggcgtgatgttgaacaactacgccaacatcttcggtctgatcatgcagatgcggcaggttgcgaatcatccagacctgatcttgaagaagcatgccgccggtggacagaacgtcctggtatgcagtatctgtgatgagcctgcggaagaggctattcggtctcgttgtcatcatgagttttgtcgtcgttgtgccaaagattacatccagtctttcgaagcagacagcgtcgttgattgtcctcgctgtcacatccccctctctattgatttcgagcagccagatattgagcaggatgcggatcacatcaaaaagaactccatcataaatcgcatccgaatggaggactggacttcgtcgacgaagatcgagatgcttgtttacgagctgtacaaattgaggagccagaagcagactcacaagtccatcgttttctcgcaatttacctctatgcttcagcttgttgaatggcgtcttcgtcgggctggtttcaacaccgtcatgctggatgggacgatgacacctgcacagcgtcagagatcaattgattatttcatgaataacgttgatgtagaggttttccttgtgtctttgaaagcagggggtgtggccttgaacttgaccgaggcctcaagagttttcatcgtcgacccgtaa

SEQ ID NO: 17960 - DNA, 246 bp, A.fumigatus
tgggaatccaccaggtggtggaatccagctgctgaatggcaaagcgcagaccgatgccatcgtattggtcaacgacggccctgtgtcatcacccggctctgcattgaggattctgtagaatcgcgaattgttctgctgcaagagaagaaggcaaatctcatcaacggcacgttaaacaaagatcaaggggaggcgctggaaaagctcaccccggaagatatgcagttcttgttccgcggatcgtga

SEQ ID NO: 17961 - DNA, 390 bp, A.fumigatus
gtgatatcttactcttgcccagttactggtggagcaggaatgctcgctatagcctctgcacgagcccttcttgagcatggactttctggtcttgctttacttgatcttccctcggctctccaaaagggagacgctgaaatagatgcacttagaagagactttccttctgcgaggatcataacgcatcagtgcgacgtcacagacgcggcaggcatgcaggaggttgctgaaaaaataaagattgaactaggggagcttaacattctctgttgctttgcaggcatagtcaactgcgtggcagccgaggacatagcagtcgagcaatggcgccgtgttattgatgtaaatacgacaggatcatggatcgctgcacaagcagtggggaagtaa

SEQ ID NO: 17962 - DNA, 438 bp, A.fumigatus
gaccctgacgcagagtccagatatatgattgccagtggacgcggaggcaaaatcgtcctcgtcgcatccatcagcggtcatcgggtgaattatccccagcctcaaatcgcgtacaacgtctccaaggcagcggtgctacacatgaagaatagcttggcagcggaatggacgcaatacggaatccgagtcaattccatctccccgggatatatggatacggtgctcaatgagggcgaggatcttgcgccgtggcggcagatatgggcggatcggaatcctatgcgcaggatggggtcaccacaggagttgacgggaccggtggtgtttctttgcagtgatattggggggagctatatcaatggagctgatattgttgtagatggtattcctcttccgtcaggctgtccaggttatatgaaggagctaacaggagtatag

SEQ ID NO: 17963 - DNA, 243 bp, A.fumigatus
tgggctttactggctccggccaacagatgcgcaaagatccctccagggcacgccatgtgtatcagcaagcagatgacgacgcctactagtctagctgtcaccgacaaagtgtccagtgttccctttgtaatgaaatcaattgggcatcgggttttgcgtttctgcctcacaacatttctactttgcctgtccgttcctatggctaactggaatattgacaacacagatcatcattttgactga

SEQ ID NO: 17964 - DNA, 384 bp, A.fumigatus
atcgatgcactcgccaagaacctgaagcttgctgagggcattattgcatcatgtcctgcgtgcaaagccaattttttcaacatcttctgtacgtttacctgttctccggaccagtctctgttcatcaatgtcacacaaaccgagatggctagctccggaaagttactcgttaccgaacttgacaatatctggtccgaagaataccagagcggcttctatgatagttgcaagaatgtcaaaaacggtgcttccggaggcaaagcggttgacttcatcggcggcggcgcgaagaattacacacaattcctgaagttcttgggtgacaagaagctgcttggaagtcctttccagattcaactaccaaacagagccctcatcacctga

SEQ ID NO: 17965 - DNA, 867 bp, A.fumigatus
ggcagaagtcaaggaattcaagttacaggtatgtcgtgttgtcgtctaccatgcgacggctcggtaactgactttttctctcccttccagcttgaaactgttcaatcgagtttgcaggtagatccagacaacacggaactgcagagtcttaaaactgagctggaagaactcataaatctcacggaaacatcaatcgccgaactcaagccgcttgctcctcctccgtctgctgccaaaccttctcccccgccagcaaaggataaatggtcaaaggagaaccaccctgcttatcaggctgggtatcgcagacccgctgccgaaattccggaggaagcccccacaccggtcacgtactccgtcaatgaccacgtcctcgcgcgatgggtttcgggcgacaactctttctatcctgcacgcattacttccataacaggctcatctgccaaccctgtctacttggtctcgttcaagtcgtacggaacggttgaatctctgacagccaaagacatcaagcccatctccaacgctgattcgcggaaacgtaaggctgatggaagctcaggctactcttcctcccagaccccaaccccacaaccccttcattctagtgttatctcggccgcggcagatatcaaccctgcattggcaaatcaggcgcgcaaagagcctagcaaggtcggcgacgcgtctgcacgcccttcgaaggtggcccgaaaagtcaaggccactcgcgagcttgaggccggtaagatgaagtggaaggattttgctagcaagagcaagctgggccggaaagagagcatgtttcggacaggggagggtattaactcccgaggtaaggcaccattatctaaggtcccagagtga

SEQ ID NO: 17966 - DNA, 351 bp, A.fumigatus
agttcgaagatatttctgagtatgtccctagtcgttcccgtcaatgctctattgcagttaggactcacatgccacagatatgaagccaagaaggtcctcaagagccagacagataccgacgacagtgagattcagtttatactcgaatactattcgctcgtccgtgagggcaagacgaactatgttgcaacgaccgcattccgcgatgtcacttcggatgagccccagcagccggtagacttcttccggtcatattttgaggagtttgctccgaagaaaggcgcgaagaagaaggaaggtaagatggaaagtgagttcgaggaaggtagatggtgtacgttgttctggtag

SEQ ID NO: 17967 - DNA, 186 bp, A.fumigatus
ctttttcccacaatgtcctcggatcgcacagcggccctcttcatgtatcttagtttctccttcagcaactacaagtgtgcgtggaagaaacgacagcaggccgagactcgtgaggattggggtcaagcgaagtccccgcatcgtcgggacaaagggtggatgacgactccggtgtcaaacacgtag

SEQ ID NO: 17968 - DNA, 189 bp, A.fumigatus
gaacatatgcggaagatgagagatgcaagtgacagcctcattaaaaaatgtttcccctcaaagtgggcgatgcatctacatgaccaacatctggcaaaggttgcacataacacctatgttcctctgttgcagaaaaccagaagaccctatgatgaaaagattgccattagaatagagcataacacgtga

SEQ ID NO: 17969 - DNA, 303 bp, A.fumigatus
gtcgcctttccaagaaatctcagacggcgtattcatcggctccagatcaaggtcaagtccgacagccgcctcgtgtcgtacgctgaagatggtctcctattcgaggatggaacccatttgccggccgatgtagttatctatgccaccgggtatacaggaaacctccgcgactcggtgcgagaatacttcggtgaaggaatctatgcgcaggtggaggattactggggcattaaccaagaaggcgagcttaaaggcgcttatgtacctaccggacgtatgtttcccgaaaggtgcgtgcactag

SEQ ID NO: 17970 - DNA, 312 bp, A.fumigatus
tcaataaagcgtatatggacacgcagtgagctacaatccggtacgtgggacgactcgcacgcacaatggaccttgaaggtcagacagaccacagcaggttccgaactcatcaaaatccttacgtgtcgccatgttgtacttgccactggtggaccgtgcaataaaccacacaagcctttctatcctggtgaagagagattcaagggagttgtccggcattcggcgagatatcataacgcgcggaactggaaaggtcagcgaggtgtcgtggttggaacggccaacactggtgagcaacggacaaagtcatga

SEQ ID NO: 17971 - DNA, 297 bp, A.fumigatus
ggactctcccgcgctcgaggttgccaaaggcgaacgaaacttttcaatcagcgtcatcctactccaatttgctggcagatcttcacctcgagcatctcacacaccaacggaacgatgccgtcgatcgatctggggcaggaggataaagagtggaagattttgttgcaaaagcacacgcctgattattctgatgctcgtgagttctggctagatttctattctctgtctaagtaccccaatttggatgagcggggaatggatctgctgaaggatcaggacagtaaaaattttgcatag

SEQ ID NO: 17972 - DNA, 711 bp, A.fumigatus
cctcgaaccatgacgcaaaagagaagcaaagacattcttcctagcttacttgacgcacttccatctgcaataatccctgacgatgtcgacgttgcatccattgccagttcctttgctaactctcttgcgcgcttgtcagcatccgattttgccgaggtcgctatctggcgagattgtttcgcattgactggaactttgagaacattctatactcctcggacagtttccgaggtctatcgcaaccggtgtttggcgcgacgagcccaattgttcatcgtacaagcagacgaagcacatgttgtgcgtattagcccatcgtgtagctggatcgacgttcctttccgcttcgaagccaatgccagccctgcggcatgttgttctggtgtgctctccttgatcccatcgggcgaaaatggcgattacagaatctggatgttgcagactttgctggatcgatttagggagtatcctagtgtcgacacgcttgatacaacgactcaacgcccctctgtgggtgattccatgactgactttgactgtctaatcgtaggggctggtcattccggcctcaatgtggccggccggctgaaagcactaggggtgtcttatctcgtaatagacaagaacccacgtgtgggcgacaactggcgtcttcgatatgactctgcaaaatgtgtgttcttcaggctcttccacgggaatgtggcttaa

SEQ ID NO: 17973 - DNA, 1509 bp, A.fumigatus
tcaatgccaacccaccaatgggagtctagtcgaccacgtgacttcagagattgtcttgcttccccgtcgctaaattgcgacgagtacccaccagtagttgatctcgagaaatcgatctatagtctggcgacaactggaaaggagacgaaaaagatgaagactattcagctcggtcagctgtccgatttcaagcagtcgcgctacgtgattcatctctccgatggcaagcgtttggtgttgttccgcttgcccactatcgaatcttccaaaggcagcagccccgcggcaaatgaaaccgaggatggctggtgctattatgccatggaggccgagtgccctcatgctggagggcctatggaagactctcacgtggatatcgaggattccgcctacattgcgtcatgtccgtggcacgcgtacgactttaatgtcgagactggggagtcgagcgtgggcatcaaagcatgcacgttccctgtgaagattggtgatgaacaggtcactttacagtatccgggcgatgcttccctggtacggctcgaccccgtcagcgagaagatcaagctgaagaaaggctctgtttcggagcgtccaaccgtacagcccgtatcgcaacagacgacaccggccaagtaccttgacgaggacgccacattatgtgactgggcggctcatatcctgaatacatcaaatcacgaacacaaaatcgaattaactgcccacttatacgctacattcaccgaaagagagaggactccttcgccaatgcctatcggcagcggctcggtcacgcctcctgatcaaccgccgcgagacggtttggtgactgtggaacctcgatcgatgccccgtgccggaaaagggggaacgctgaaaagccgcattgcaatgctgcatgctctggccaacattgaactctgggcgatcgatctcgccatcgacatatgtatccgattcgcaagcttccaaacacaaccgcaagtaggagacacgccccgggaactccctcgaacgtatttccacgattggctgaaggtagccaacgatgaagccaaacacttctcctttctgcgcactcgcatagaagagatgggatcctactttggtgcattgcccgtgcatcacggtctgtgggattccgcaatggccacggcccatgatctgcgagctcgaatttccatcattgcactggtacatgaagctcgcggcctcgacgtcaatcccatgacgatcgacaagttccgtcgagcgggggacagagaaagtgttgatgcgctggagatcattcacaacgacgagatcacccatgtaacgacgggccatcgctggttgacatggatttgtcagcaagaaggcacggacccagtccaggtcttccgcacgaatgcacggaagcatttccgaggggccttgaaggagccgttcaaccatgaggcgaggatgcaggccggcctaaatcggcaatactatgagaatctgatgggacagcgtgacatcgctgtcagctga

SEQ ID NO: 17974 - DNA, 552 bp, A.fumigatus
ggcacggaatccgagaccattcccatcggccttggtggcaatgacctccagcccttgacctgccccgacggcgaaacctactacaagtggcagggcaagacaacttctgcccagtattacgtcaaccctaaaggcgttacccctgagaaaggttgccagtggggcgatggcactcaggctatcggtaactgggctcccgtcaaccttggtgtcggcctgaacaagggcaaatggctctccatcttccagaacagccccacaacttccgaaaagcttgactttaacattaagattaaaggtgataacctcagcggctcctgcaagtacgaaaatggtgtcttctactccgagaccggtagcagcagctctggatgcactgtaagtttgggtcaccctactacgttgagaatagtggacttacaaaccgtctccaacaggtccaagtcatgtctggcgatgccacctttgtcttctactagagtgcgaagttgtccagctccaatggtagtgcgtgctgccgttgcgcgtaaatgtaacggccacctcagataa

SEQ ID NO: 17975 - DNA, 873 bp, A.fumigatus
  unsure (314): Identity of nucleotide sequences at the above locations are unknown.
gattaccgacattgtgagcgcagtattagggacgtgaacacaatgaagttcaataccgttgctcttactctcgccacagcgggttccctggtgaccgctcaacatcaccaccagcatcgtcaccaccagcacaagcgcgaggacgtggtcgaatccagtgccaccgtcgtgcaatacgagctggatggaaagccgatttctctcaagcaggtgtgcgccggtctggctgataacacactcaagtttgccaacaacgaccatcctaccggcatttgcgacaacctgagcagcgccgctgctcttgcctccacgcntgaggtcacctcggcttttgccccagcccaatttattgagctctcttccgttgtcacctcggccaccccgacctcagcttcaagctcagagacggtccagacccctgccgcctccagcagctctgcttccagctcttccactgcgaccggtctggatgccgacttccctgatggagaacttgactgctctaccttcccatccgagtacggcgctattcccctcgactacctcaaactcggcggatggtctggtattcagtatgtctcctacgccggcaactttatcaacgatatcgtgacggccgtcgctggtgatacctgcaaagatggtgccatgtgttcgtatgcttgcccgcctggttatcagaagtctcaatggcctagtacccaaggcgccactggccagtctgttggtggtattgagtgccgtaacggaaaactccaccttaccaatccttctctctcgaagaagctctgcattccgggtgttggaggtgtccacgttcagaacactctgggcgaaactgtggctgtttgccgtactgactatcctggttag

SEQ ID NO: 17976 - DNA, 1146 bp, A.fumigatus
gtcgccagagcttcttccgcactcttgaaacacatcaagtcgaaacaggaagagcaggaaaagagagcgacaaaaaagacacttattggcgacgatgaagattccgaagaagacactccgctgaaaaacgaggcgatctggcttgtgctcaccacgaagaagcatgttgtcgacaagaaccgtttaaagcccggaaaaatcagcattccacactccctcaatgcctcgccgtcgttaagtatttgccttatcaccgccgatcctcagcgctcggtcaagaatatcgtcgccgatccttccttccctcagcatctttcctctcgcattgaccggatcatcggttattcgaaactcaaggctaggtatcagagtttcgagagtcgtcgtcagctactctctgagcacgatgttttccttgcagatgacaggatcatcatgcggctggtaaatactcttggaaaggtgttctacaagtcgagcaagcggccaattcccattcgtattgccgaaattgagaaagtggacggcaagaaggtcaagaaagaccccaagaagaagtcaaaggacgatgacagttctttcgcgtccccagcaatagtcgccaaggaaattgagaagacgttcaactgcgccgccgtacaacttgcgcctgataccacggccgcaattcgtgtgggctcatctaaatttactccagagcagctcgccgagaatgttgaagctgttgtcaagggtttgacggataagttcattacgaagggttggaggaacgtcaaggctcttcacatcaagggcgctaatactatggccatgccaatctggctggcaagtgaattgtgggtggacgagggtgacgttgtggaagatgttgaggaagatctcaaggctatcgagggtacgaagaatggcaagaagcgcaagcaaattgaggatgacaagaagttactcgaggacaacaagaaggccaagaagccgaaggctgatgaagatgacgatgcgttgtccatggctgcaagaaaagagaagcttcagcggcagaaggctaaggcgttggaggatgggaatgagtcgggtaacaagaaggtttcaaacgcagagaaagtggcatcaggactttcaaagaagaagagaaagtcgatttcataa

SEQ ID NO: 17977 - DNA, 228 bp, A.fumigatus
catcgcgcagcctcactgaaaggccattccaaattatgtgtcacacagcataactttcgtctagattctcaagccaagcaaaagatagaaatggtgaagcatgagctgatagagaccatgcctcaatggctcatgcctgcatacgttatctgtgttgtgtatgcaaaaggcgcgtccgccgcgtctagcctcatgtgctcccgcgttctatggttcgagtccccgtga

SEQ ID NO: 17978 - DNA, 195 bp, A.fumigatus
catcgtgcgcgcaatagtgtgtacgaagcatactacaagaatactctcctccggaacgaaagcaactccaacatcgcatggattggatcattacaagcttttttcatgtacgccagcggacttgtgtctggtcccctcatggatcgatatggaccaagagtaagggtgataaccttgcgaacagacaattactga

SEQ ID NO: 17979 - DNA, 963 bp, A.fumigatus
gttatactggtcccctgctcgatcgtcttcgttctctcggtcatgctcaccagtctctgcaaagaatactaccagttcatcctggcacaaggcgtccttggcggcgtcttcaacggcctgacatacactccaactgtgactgcggtgaaccagcacttcttcagacgcagacctcttgccttggggatcgcttccagtggctcttctctcgccggcatcatcatccccatcgcgctgaaccgcatgttcaatcaatcgtccctgggctttggctggtccgttcggatcctcggattcatcatgctcgcactcagcgtcgtcgcctgccttgccatttcatctaatgcacccaaacgacgcaccggtgcgccattctttctggaagcatggaagcagcctgagtacactgtccaaatcatcggtgtatttctggttacctgggctctcttcgtcccaatgttttacatcccaagctacgcacaatccatcgggatcggcgtcagtttgtccaattaccttattgcgattctgaacgcaggctccctcgtcggtcggatcctcggtggcgcgctcgccaaccgtctgggtcgattcaataccctcgccgctgcgtccgctgcgtgcggcatcctgatcctatgctggctgcgtatcaagtctcgtggcgggatggtcgtgctctcggtgctgttcggtttctgctcggggattgtcatcggtctgtttgcggctacgattgccgtgacggcgccgaagcccaatgtgatcggatcgtatctggggatggcgatgggtgtgctaagtctggccagtttgacggggactccgatcacgggggctatgatcagcacctatgggacttacgacgcggcaatcatctttgcgggggtgtcggctgttttaggtgctgtgatcatctttgtcgctcgggtggtatatgcgggctggagactcgttgcctga

SEQ ID NO: 17980 - DNA, 450 bp, A.fumigatus
acaacaaccattccacaaataatcacaatgccccgctggctcatccaacacagtcccaacaccctcacccctgaggagaaatcccacctcgcccaacaaatcacccaggcctacgtcggcttcggcctcccagcattctacgtccaagtgcacttcatcgagcaaccagccggtacatcctttatcggcggcgagcagcaccccaacttcgtcgcgctgaccatctaccatctggcgcggacgatgacctccgacgagcagcggcagggattcctgaaacgcattgatgcgttcttgacgcccatgttcgagcccaaggggatcgactgggagtatttcgtgacggaggcgccgagggatctgtggaagatcaatgggcttgcgccgccggctgctgggtcggaggaggagaaggtctgggttcgagagaacaggcctgtgaggttctag

SEQ ID NO: 17981 - DNA, 327 bp, A.fumigatus
tattatgctagtatccaatacacacttgtcaagaaatatcctttccctataatcaccatgcacttggatcacaagctcccctggaatacagtgtcagcgcactttgctttcacaaaggacaaccaagacattcgcagaaacgatttcctcgtccatgatcgcttagttgatcgtcaatccgccgatttcaagcacttcacgcagactcttatttccaccattgaggagttttccgccactgaacgagccaaatatccacctcctgccgccctgccgaaatccgggcctctatatgacgcagcgattctatctctccatctgaagtag

SEQ ID NO: 17982 - DNA, 684 bp, A.fumigatus
aagtatcaccttggaccacacgcgaccaactccgcggtatcaaatccactgagtgaggagtttcaggatgtctactactggatcagccaagccccctatagcacggccactgcgcaccttgccgatgcagtgaagatgctcattatctcgaatgagatgctcgctctgttacgcctcgcaaaccacgagaaaatcccactaatggatctgaaccatcttagctggggccacagcttcggtgtcacgcatgttgctgacgtggctctggagatctacatgctgctgaatatcgcggcttctgtcaaggccaatgcaaaaccaggatctgcgaatgagactggttgtctgacggagacgcggcggttccgaagctttgctagttggggactgggtgatttcgatttcccagctcaaaacatcccccatcggttgttttggaatacaaagtgcatcactgacggactggagttttcaacgtgggaccccttgcgcctagaaagtgacgacgagaggaaggagatgaatgagtacttgaagatgtgctttgagctgttgtatcgatacgatctattgttgaatgataatggcggggatccggactggaatgacaatatcctatgtatactacatacatggggttgcaagtgtattgccttaagccagtcagggttctgcttcatttga

SEQ ID NO: 17983 - DNA, 240 bp, A.fumigatus
aacgactttagccaggctcatcgcgttgctgcaaagattgaagcaggcattgtttgggtaaacggacaccacctgaacgatccatcttcctcttggggtgggttcaaggaaagtggtatgggaaaggagaatggcatcgaggcctatgagagctacaccaaggtcaaaagtacagtgatcaactatggggtgcagcctgtatggtttgatgacgagcccgccaatgcacggtatggctaa

SEQ ID NO: 17984 - DNA, 513 bp, A.fumigatus
atcttctgtgttttgtcttttacgtttgtgctaccaatctcggtaacctccctcatcacaatgggctccgcgaccaacaaccctgtggactttggcggcaactatgccatcctcaacctggactggatgtccctgctgatcaaggccgtggaaaacacccctgagggccaggcaatgatcgcgagctgctccagatggaacgtggccgtgcaccagaaatcccctcgcccccttactgtcttctccacactctccttctctccaggccagccggaggtccagcccaactcgccatttgcagacttgcttcgcccgtacggcgagtttgcacaaggtacccctcctgtggagatcgacgagcgcttccaccttgatgagaaggatctggtcctgcacaagacccggtggtctgcgacttcagggaatgccctcgagcaaatcctcaaggcgcagggtatcaagacagttgtcattgtatggaacacgcttttcttgaatatgacagtatgctaa

SEQ ID NO: 17985 - DNA, 261 bp, A.fumigatus
cagtatgctaactacggcaacagtttgggcttgagcctttcaggggtggtgatgtcgactatgtaccggttgtttgatctggactatgatatgtacgtgatcagagacaatgtggtggagttacctcccgcccagaacacggcgttctcaaacgtccttctcgacatgctacttcctaagatgggtttgaaagtgatttctctggaggatgcactggaggcgctgagtcgttcggaaaaaagtgcggagcggacagtctga

SEQ ID NO: 17986 - DNA, 345 bp, A.fumigatus
cttcgcgaagactataaactgtcgaccactgtggtctccttaatcttcgtgaccccatttgccggatacgcaattgccactcttgtcgtcaacaagattcatatgacgcttggacaacgagggattgcgatcattggtccgctatgccacatcgctccgttcgtgatcatggccatccacccgccctggccggtaatgttggccgtctacgtgatcgttggcttgggcaatggcctcattgacgctgcatggaactcctgggtcgccgatatggccaatgcaaacaccatgacggggctcctcggggcgttttatggtgtggggtacgtcaaacatgtgcgatga

SEQ ID NO: 17987 - DNA, 198 bp, A.fumigatus
ttgctaagtctgacagtgtcggtgggtggctgggttgtcgatttcatgattcaggaacgtaacggaaagccattcgaatcgggtctggttccaactggcttttgggctggcgtcactgtcgggcgtctggttctgggcttcgtgaacgactggttgggcatgtatcccctctacgcagccctagcgattgaatgctga

SEQ ID NO: 17988 - DNA, 378 bp, A.fumigatus
cggggctcctcggggcgttttatggtgtggggtacgtcaaacatgtgcgatgaccgttacagcaatactgacggtcgacccagggcaacactgagcccaacaatcgcgacgcagatgatcaagtcgggcctgcactggaactatttctactacactcttcttgggggctccgttctggaactgttgaccagcgtggctacattctggcaagaaaatgcagttagctacagagccaaaaaccgcaggagccccgatagcagcggtgggagccgaaccacggaggcaatgaaaagtcccattacctggctgatcgccagctggctgtttgtgtacatgggtgtcgagggtgcgttgtctgaccttctctggagcaaatga

SEQ ID NO: 17989 - DNA, 183 bp, A.fumigatus
ctacatctacagacatatgtggctatcccccagtgggcgctctaccaccgcgagcaatacttcgctgagcctaacgatttccaccctgagcggttcctgggtgatcctaagtttgcgaatgatcgacgagatgcgctgcagccattcagtgttggcccacgaaactgccttggacggaagtaa

SEQ ID NO: 17990 - DNA, 258 bp, A.fumigatus
gtggtctgctatgtaatcacccaagccgtctataacgtgttcttccatcccttaagtcgcttccccggcccactattgcacagggcgtcgcggctggcatatgtctatcggttgatcggagggacgcttaccttggacgcactcgaaatgcatcaacgctacggagatattgtacgagtcgcccctgatgagctctttttcgcccacccagatgccctggtccgacatccacaagaagactgggagggagatggataa

SEQ ID NO: 17991 - DNA, 192 bp, A.fumigatus
ttgaccatatttagccttgcgtacgcggaaatgcgtttgatcctcgcccttgtcatttttcactttgacatgaagattgatcctgactgtcgtgactggatccagcagagaaatttcaccctctggcagaagcctccacttaaagtctacctgaagccagttgcaaggaagtcagagcctaatcaggtgtaa

SEQ ID NO: 17992 - DNA, 276 bp, A.fumigatus
tctactcaagacttcaactacccaaatcggtgcatttctagtctgaagaagcctgcagtgacagatcctcctgacactaccgttgccaagatgggcttgatcgaggggctgcaggcggctctggactatctcgagaaccctactgcactcactgcaacgagcgtcagcatgtgtctatgctggcttgctacttacgctggaatggtccgcaaatcgtttcaggaccgttcctacagcatgccattgatgccactttgctgccatatcgcctttgag

SEQ ID NO: 17993 - DNA, 690 bp, A.fumigatus
tcggagggacgcttaccttggacgcactcgaaatgcatcaacgctacggagatattgtacgagtcgcccctgatgagctctttttcgcccacccagatgccctggtccgacatccacaagaagactgggagggagatggataaagccgcatggttctaccggcctttagaacagagcccacgatgcattgtggacgaaagccacgagcagcacagccggctgcggcgacaaatggcgcctggattctcagagaaatctatgcgagaccaggagccgatcatccggggttatgtagacctcctgctgcaaagattgctggaaaagagcaatgacggtcagcccgttgtcatctcagactggttcaactacactacgtttgatataattggtgacctggtcttcggggagccttttgaatgcttggggtcttcgaagtatgatgggtggatcaagagtatttttgaatcccttcgccccttaacaattgtgcaagctctctcgttctttccatggttgaaacgaattgccctagacacggtcccgaagaatctgcaaggagatatcaagcaacaacaacagcagacagaagccaaaatgcggcgacgcatggctgtcactgcaagtcggggggatctgatggaaggattgctcaagaagaaagacgaattagttagtaatttggcgctttga

SEQ ID NO: 17994 - DNA, 378 bp, A.fumigatus
tacaggaatcgcattggcactaacggccgtccactgacaaacttacagcacctgagcactgaagagcttattggtaatgctcaagtcctcatcctcgcaggttcagagacgactgcatccctcctcagcggagttatctatctactgctccagaatgcggtggcctatcggcagttagttgatgaggtgcgctcaacttttaacagcgagaaagacatcaactttgtcagtgtcagccaactgtcatacatgctggcttgtttgaatgaagctttgcgcatctatccaccagtggcgaacggtctgccgcgtgtcgttcccaagggaggagctcagattctgggacagtatattccggaacaggtccgaagacattga

SEQ ID NO: 17995 - DNA, 1590 bp, A.fumigatus
gtagcaaatgcaattgaaatcgcctcgaatccgtccgcagacccagcccttaagacgcaagccttcgatttcgtgaatcagcttcgctccgacccgtcgggatggcaggtctgcctttcactgttcacacaaactccccagcgctcgggtatcgtgaggcatgtggctctggaagtggtcaatagcgctgcacagggcggtttgatagacttgcaggccctagcgtatgtcaaggatggcttgttggcgtatctccggcaggtctatggacaggacgcaggagcatccgacccgccgaacatccagaacaaaatcgctcaaaccatcacctttctcttctctgcactctacgccagcgggtgggaatcattcttcgatgatctcctcggcttgacccagaaaagcccctcgagcacgacgcgcgacaacgcatccggaattatcttctaccttcgggttattaactcgatccacgacgagattggcgatgttttggtctcgcggtcccgcaatgaacaggacaaggcgaatgcgctcaaggacctcattcggcagagggatatgcagaagatcaccagctcatggcaacagattttgtcggaatggcgggacggcaacgatgttattgtggagatgtgcttgaaggctgtcggcagctgggtcagctggattgatatcggtcttgtggtgaaccagacaatgcttgatcttttgttccagcagctgggccgggcgcagaaagaggatttgagacaaggagaagagaaggtgcgggatgcggcggtcgatgtcttcacggagatcatcggcaagaagatgaaaccggaggacaagatcgacatgattatcttcttgaatctcgatactattgtttctcaactctcgaatagcccccctctgcacggaaataggttcaccttcaaatatgacacggatctggcggaaaccgtcgccaagttagtcaatatcaccgtcattgatattgtacgggcattggaacaggaaggtgtgtcgaccgagtgcaaggagaaagccaatgggctgcttcaggctttcctgccacatatcctgagatatttctccgatgaatatgatgaagtctgctcaaccgtcattccgtgcgttagcgacctcttgacctatctaagaagaatcgccaaagtcaaccctgcccttgcttcccagcattcttcgatcctccttccgatcctaaaggctatcattgccaagatgcgatacgacgagacctcctcatggggcgaggaagatgagcagacggacgaggcagaattccaagaacttcgcaagagacttggtatcctccagcaaatgattgcttcgatcaatgaacagctgtacatggaagttgtgtcggagatggtagcaactacttttgagaacctgcggcagtcgggctcccaaatggactggcgtgacctagatcttgccttgcatgaaatgttcttgtttggagatctcgccgtcaaggccggaagtctctacaccaagggtaaccccaacaaccaggctgccgaaaggctcatcgaaatgatgctgaggatggtcgagtccggtaggtacatcaagtag

SEQ ID NO: 17996 - DNA, 1071 bp, A.fumigatus
cgtttagacattcgttcattcacccatccggcaacgcaattacagtatacggaaatctgtgtgcgctatagctcattctttcatcaccatacccatctgattccaggtgtgttggagaacttccttcaactggttcaccaccccatcaagaaggtgaagactcgttcttggtaccttttccagcgattggtcaagcaactcagacagtacgttggcaacgtcgcgcaaaccgttgtggaagctctgggcgaccttctcgtaattcgcgccgaactgccttcggaggtatctgaaggtgatgagatgtcctcggaggaccacgaattagccgacgccatcttcaatagccagctgtatcttttcgaagccgtcggtatcatctgttcgactcccaccatctcaccggataaacaggtcctctatttgcaggcggtgctcaatcctatattcctcgacatggaaaagaatcttgaggcggcgaaatcacaggatgaacgagccattctgcagattcatcatgatatcatggcgctgggaacccttgcccgcggattttcagactggatgcctggaacgaacacgcccgctaccctacctgcacccgaagtctcagcagcgttcaatcaggtggcagaagctacgctggtggccttggagtcccttaagtcctcattcaatgttcggacagcggcccgatttgcgttctcgaggctcatcggtgtcctcggttctcgaattctgccacagttgccaaggtggattgacggccttcttactcagacttcttcgcgcgatgagatggccctgttcctacgtctcctagaccaggttattttcggattcaagggcgaaatcttttccatccttgacacactactcacccccttcctgcaacgagtgttctccggaatcgccgatcccacaacgggcacggatgatgagattcaactggccgagctgaaacgggaatacctgaacttcttgctggccgttctgaacaatgacttgggtgctgtcatcatcagtgaacgtgagtctcagaatcaacagtcaatccttgtttcagtgtaa

SEQ ID NO: 17997 - DNA, 507 bp, A.fumigatus
gctaaccctgttccaggaaatcaacccatttttgagactgtcatctctacgattgagcatttctccaaagatatcgatgactttaccacagcgaagatggctttctctgttctttcgaagatgagcagctcgtggggcggtccggatgtgatcgcggaagcttccaacgggacccctccatcgcaggctccgctgcctggttttggccagttcatgattacaagattctcgccgttatgctgggcgctgccgtccacaccttttttcaactccaaggatgcgcaggccaagcaggttcttgccgaagcgggcgggttacagcgtacgatatatgccaaaaccggcatggagtacctgacgtatctccgtgaccgtgaactgcccggcatgggtatgggtggagaattgattgaagagtttgtgggtgctttgagccggctggacttgaaggggttccggcaattctttccggtatgtctttccaacttccatattctctcaatctga

SEQ ID NO: 17998 - DNA, 360 bp, A.fumigatus
cttgacaactccgtccgagaacaaggtcacacaatcatgtccgtcaccacaaaagccacaattgcctcgtttggcggcaagctgctcaagctgagccatgccgccgcctccacaaaatgcgagatgaacttcaacctctacctgcccccccaggccttccaggacccctcccagaagatccccgtcctcatctacctgtccggcctcacctgcacagccgacaactgctccgagaagggcttcttccagcacggcgccagcaagaaaggcattgcggtactctacccagacaccagtccccgtacgttacagccccaacccctagccccccccccccccccgggcactggccaagaataa

SEQ ID NO: 17999 - DNA, 300 bp, A.fumigatus
agaagtggaaggggcggttggatgtcctcattgacgtggttagtcttcttgctttcgctgtttgactttggaggaggactggggggagagaaaaagactgacagattgcctcagggtaccggcgataatttctacaagcagggccagcttctcccggagaacttcgagaaggctgccaaggaagctggcgtcgagggcgtcaatatccgctaccagcctgattatgaccatagttactataccatggcgacgttcgcggatgaccatgtcgagcatgcggccaagtatctctttgcttag

SEQ ID NO: 18000 - DNA, 648 bp, A.fumigatus
caactccgtccgagaacaaggtcacacaatcatgtccgtcaccacaaaagccacaattgcctcgtttggcggcaagctgctcaagctgagccatgccgccgcctccacaaaatgcgagatgaacttcaacctctacctgcccccccaggccttccaggacccctcccagaagatccccgtcctcatctacctgtccggcctcacctgcacagccgacaactgctccgagaagggcttcttccagcacggcgccagcaagaaaggcattgcggtactctacccagacaccagtccccgtacgttacagccccaacccctagccccccccccccccccgggcactggccaagaataacactaatattgaacaaaatgatcgaaacaggcggcctggacatcgaaggcgagaatgactcgtgggacttcggcaccggcgccggcttctacgtcgacgcgacaaaggctccttacaacaaggggtacaacatgtacacctacgtcaccgaggaactccccaagacggtctttgcggcgtttccacagcttgattcgagtagggtcagcatcacgggtcacagcatgggtggacacggggcgctgacgctggtaagttctgtccagagcgatgttcgagagtggctggactga

SEQ ID NO: 18001 - DNA, 243 bp, A.fumigatus
caaaaagtgcccgcgctgaaacagtacctccgtaaccccggcaaatacaaatccgtctctgcctttgcgcccatcgcaaaccccatcaactgcccctggggccagaaagcgttcgcgggctacttcggcgaagaccagaaagcgaaatgggcggagcacgatgccaccgagctggtgaagaagtggaaggggcggttggatgtcctcattgacgtggttagtcttcttgctttcgctgtttga

SEQ ID NO: 18002 - DNA, 339 bp, A.fumigatus
gttataattacctccttccttttcccggaaggaaagttctctcttgagcgattgcaatccgttctcacggctctgggaggtgacaaatccaagctggtcttggatctcagctgccgcaggaaggacaacacatggttcgtggccatgaaccgctggcagactatcacggaaatggagattaaccagggtatacttcagttcaattttgtgcttctcactgcaccgaagctaaccctagcccagaatcaatctcaatgcttgagccgtattgctccgagttcctcattcatgctgcagatgtggaagggctacagcaaggtattgacgaagagcttgtag

SEQ ID NO: 18003 - DNA, 462 bp, A.fumigatus
gataagcacagcccctcgtcctaccaaagacgactgtggggtgttaccattattgccagaaaccttttgtgggaacagattgaagttgacaagatgaccaagtttcggccttgtattgaccttcattcgggtcaagtgaagcagattgtagggggcaccctgagcgatagagactcggacctaaaaacgaattacgtatcaaagctccccgccagtcactatgcagaattatatcggaagcatgagctgcgcggtggtcacgttgtgatgctcggacctggcaacgatgaagcagcaaaagaagcgctccgtacgtggccgggggggctgcaggttgcagggggaataaatgacaagaatgctcggtattggattgaccagggtgcagacaaggtaggttttcttctcactccggctggctgtatatggtcgagccatctgtgctctcgcttagtacaatga

SEQ ID NO: 18004 - DNA, 345 bp, A.fumigatus
ccagggtatacttcagttcaattttgtgcttctcactgcaccgaagctaaccctagcccagaatcaatctcaatgcttgagccgtattgctccgagttcctcattcatgctgcagatgtggaagggctacagcaaggtattgacgaagagcttgtagcgaagctggccgaatggtgctcaatacctgtcacatacgctggtggggcccgaagtctgcaggatcttgaaagggtccatgtgagcagtaacggaaaggtcgatttgactattggtagtgctttggatatctttggtggcttgggtgtaacgttcaatgagtgtgtgcggtggaatgaacagcattga

SEQ ID NO: 18005 - DNA, 210 bp, A.fumigatus
aatctcacctccattttctcttacagaccgattgccgatcgttgtgaggataagtcgatctctcagctaaaccgcagtgctttgacgtctatcaatcacttatcgcacctctggtcacgacaacgtcaaaatgaagcccgttgtatcggtgctaaatgcctgttcctgggtaaggtcattgtccactcccaaaacagaattacatactaa

SEQ ID NO: 18006 - DNA, 561 bp, A.fumigatus
gctctacgaacctatcagaccgcaaagccacctacattgtctacagagtcgacaaccacaaaacctgcttccaaaaaggccaagaacaaaaaggaggaagacgacgacgatgatatggatgcggaacacctgaagaatgatcttgccttgcaacgattgctcaaggagtctcaccttttagactccgcatcggaacttgcgccaaccggcaaaaaccgcctgaaagctctagacctgaggatgcagtctctcggggccaaaacatcgctttatcagcagaatatgccttcatcgctccgtagggggatcaaagctaaggcactgatgaaggaggagaagcgacgacgtgaagctaaggagaatggaatcattctcgagaggccgacgcccaaatcgaaagtcactaaggggcggcgagaacgtggcatcgcaggccctggcatcggaaagctctcaggtggaactttgaatttgagcaagcgagacattgccgtggttcaaagcgctcgccgctcaaggagaggaggcagaggaaaatcgaagacaaggggacggcactaa

SEQ ID NO: 18007 - DNA, 471 bp, A.fumigatus
cttgtggggccatcatatttggcttgctggttgctacaaagcgcgaacttttacgcggcagaagtactccataagactctggcaaggcaatcaggagacccctccacccagacgaggtttcagatcggccgaggaaactccagcccagctgctgagacttcttttttagtcttgacttactgcattatgatgacaaacatgacattggtactccgtattttcgccccgagttccaccgccacgaagtatcttgactcgaggttcgagtccaaggatgacctagatagtgtacgaagtaaagttacatggtctcttgcgactttgcgagctaccaggacgggtatgactggtattgccaccgcaatgctccaaaaccgagaaaagactggatcctccccagttctggctatgtctgtgccctcgttcgccaatcgccagcaagtactaaatctagaccacttaattgagtga

SEQ ID NO: 18008 - DNA, 885 bp, A.fumigatus
tctgcctattttctgggtaaaatttgcaaacaagttcttgttatgtcaagtagtatatgtgtcgcgtcctcaagactcagtcttcccaccctactgcgaaatgtctgtcgttctgagttcaccgccgatcttggacctcgttctgagtacaaaagtttcttcgccatgcaacgagcagccttggcctatcgcaggattagaggtcctcgacagttcagctcgctgactctggccgacgatatacctactacatccaaacaaccaccttcgcgcgctgcaaacgttagcagtgtatcacagccgggcgaaccaaccaagactggcgccggcgaaattagagcgtctagccatccctctgaggttgtcagttcttctcctcgtgccgattctgcgaagcgtaagaaagcgtctgccccggaagcaacggccggagcaaagccagctgcaaacgagtcttcggataagaaacgctcagaagcccctcgaaaatccagtctttccattctctccaagtcgaagaaaaagaaagagccatggcaaatccaaaaggaggcactgaaaaagaaattcaaggagggctggaatccgccgaagaaactatcccccgacgcgctggaagggattcgacacctacacgctgttgcacccgatcgcttcactactcctgtactagctgagcagtttcaagtttctccggaagcaatcagacggatcttgaagagcaaatggcggccttcgccagaagaaatggagaagagacgagagcggtgggaaagaagacacgatcgcatttggagccagatgaccgagctgggtctcaggcgtccaaagcgtagcgcagaaaagttttcggacgtaaaggtgttgtatgataagcctgtttga

SEQ ID NO: 18009 - DNA, 1401 bp, A.fumigatus
tcggctcgcacagctttcctcctcccactccgcgaaataaccaaaactccgggcaccagcacaagcgctccgtgtctatactgtcaattgaaagtgaaggaactggggataaaacctcgaggtcgtcgttccagttcaatcgttcccggccggggaagggtcatggtcgttctgccagcttgcaagtcgtacccagaaggtatgaggggtatgaagatagcttcgcaaaaggtgaggctcaaattaccttacctgatgattgatgatactcatatattccgcttcttagctgggcgaaacaccgtccgtggcatttccgaggctggcaccaaccaattcccgggtaatctgaggccagacctggaaggacccagagtcagtcgctccggatccaacgggcagagacccattcagcattcaggatcaccgcgtacacctggacgcaggcctcaactgccgcctatggatttcaaattcccgcctgctcccacatccgatcctagcaatcgccctgccctttctcctgcggcaacatccattgatgagaatcccggctccgtgtcgacgggactatcaagtgggaaagaaagcccagcaatacctccacttggtcacctaccccagcttacacgaataatctcgacatccagcccgagtggaagtcacaggagtagcggcgagttctactctgctagcgacaactcctcagagacacttcaatccgaatacacgaattactctgcaaatacccgacgcccgagtggtcctcgtcacgcgcgtcatttctcgagtgtggatacgggaccgaaacgacccaacggccaaactctcctcatgggctatgcccaagtcagcgcatcctttaccgtcgatggctcgttaatcaaccaggcagcgtttgaagaagttaaacgtaaaggggtcgttggcagtcaaggtaatgcggctggtacgctcggtggtggatccgcctccatcagcgacaaaagtcgtaaaagtggtggattctggggcgctttcaagtggaatgcgatagaggagtccataagcggtcttctatccaacaacgaactcgatggtctccgtgatatgcgtggcgttacatcgtcacgatcgatacctttattatccactccgcagtctcttctctttgtggatctgcgactggcaccaggagaagaacagtcatattccttctccttcactcttcccaaggggcttcctgcgagtcataagggcaaagctatcaagatatcttataatctagtcataggtactcaaaggccgagtgggtctaacgaacctcagcgcgtgaatcgcatcactatccccttccgtgtcttcagtggagtcaacagtaagttctctcgctcgtcctccctccttgacacatgtgactaa

SEQ ID NO: 18010 - DNA, 900 bp, A.fumigatus
tttctcctaggtcaaggagagatccttgggcataacctgatgagcccttatgtcattcttcgagacgaagccagagtccagaaagtaggctctacctccccaccgccagtgtcaaagaataagagcattagcgggcatgtatggacgtcagcgccagaatttctttcctacgtagatgaactcctcgagcaacaatctcgcaaaaatttactgcagccaccagaccttgtcagcgcaagacgctcctcaagttatgaagcgttggccggtccgctttcctgcaaagacgcaatagacttggccatcctgcgaagcaatcaagccatcagtaaggcgcgcagtcctaaccggtttgaaattgcccgcaatgggcgtcggatcgctgtggtggtgctgaatcggccagcacatcgactgggcgaaaccatcactgccacagtgaatttcacggatgtggcactcccatgctacgccctgcgggccacactggagtcgtttgagaaggtcgcatcctcactggcagttcggtcaaatgctagcatccaccgagccacgcgacgtgtgcatgcatccttcttcgaaaatacgctttactccactcgagttgttttcagccctgcggtgcccgtctccgcaacgccgactatcatcaccaccggagtcaaccatgaatgggagttacgattcgagtttgttactaccagtttgcaccatgagctggggacgggcctttccggtgctaggctgcttgaagtggtttccgaggacgaccgtgggcaggttatgtcaggcctggagaacctcggttgtgagtcctttgagatcgcaatccccgtcacggtatacggggaaactgttcgggagaggctcccggaagagaacgagggttattctatctag

SEQ ID NO: 18011 - DNA, 216 bp, A.fumigatus
aactgtgatgtcagacttgggtatcaaatatgtgcggtctatcaaatactaatttcgacttatttgagcgttaatggaattctgagagtatatcacgttggtgaccgctaccaatacgagtatcataagaagactctgatggaacgaatcccattcatttcaagcgcaatgggtatgatcaacgctcatgaaagcagaacatatgcctctagatag

SEQ ID NO: 18012 - DNA, 333 bp, A.fumigatus
ggggtaagctggagcttttacagtgaagcgaaccaacagatgggtctcatatctaactctggtttgcacttaggtctgcgctcaatgtggactgcctgcaactgggccgttggggtgttcgctatcacctccctcgcagcccacgaattctgccagaggcgacgagtccaggagttggacggcatgaagcaagccgtggaattgatgaaggaactgaagctcaagaaacaacgagagaaggaaaagcagatggcggaagaggctgcccgcttagccgaagaagagaagaaaaggaagagttggacaaacctatcgaattataagttctggtag

SEQ ID NO: 18013 - DNA, 189 bp, A.fumigatus
gcaaacaaggtgggcctggtggcatggatgagtaatgcagttattacgtgtaaagggctacaagagacatgtcatgcttgcaagatcgaagcaattatgcctaaaatgtactcaaataaattcaataattatcacctgaaacgcttgacctcgtattactcgaacttcatctgcttgaagggaccttag

SEQ ID NO: 18014 - DNA, 204 bp, A.fumigatus
  unsure (43): Identity of nucleotide sequences at the above locations are unknown.
tgccttgtgaacccatgctacttggcgcagcaaatcccaaacnccacaagctgtaagctacccgcgattcgagctcggataccattcattacttacacgacaaaggtgatgattgcccgcgccgctacagcacaagacgatatactgggtgatggaacgacgtccgttgtcctggatggtcggagagctcttgaagcaggctga

SEQ ID NO: 18015 - DNA, 1227 bp, A.fumigatus
ttccttgaccagtttaagattgagcgcaacattgaccgtgaattgttgctctctgttgctcggacgtcgctcgccacaaaattgaacagcgcccttgctgaaaagcttacaccggatgtcgtcgatgcagttcttgccattcaccgagcccctgagaaacccgatttgcacatggttgagatcatgaccatgcagcaccggacggcgtctgacacacagctcatccgtggtctcgctttagatcacggcgcaaggcaccctgatatgcctaagagggttgagaatgctttcattttgactctgaacgtcagtttggaatatgagaagtcggaaatcaactctggtttctactactcctcggccgagcagagggacaagctggtggagagcgagcggaaattcgtggacgctaaactgcagaagatcgtggaactgaagaagcaggtctgcggtactgaccccaagaaaggttttgtcgtgatcaatcaaaagggtattgatcctctgagcttggatgtcctcgtcaagaacggaattctagctctccgaagagctaaacggagaaacatggaacgactccaactggtttgcggtggtgttgctcagaacagtgtggatgaccttactcctgatgttctcggatgggccggcctggtttacgaacaccagctcggagaagagaagtacacatttgtcgaagaggtcaaggaccccaagtctgttaccattctcatcaaggggcccaaccaacacaccatcgctcaggtcaaggatgcagtccgcgacggcttacggtctgtctacaacaccattgtcgatggctgcgttgttcctggtgctggcgcttaccaagtcgcttgcgctcatcacctgtcatctgaaggtgttcggagatccgtcaaaggcaaagccaagtggggcgttgctgcttttgctgatgcccttctggttattccgaagaccttggctgccaattcaggccacgacatccaggattccctggctgctctgcaggatgagcgtgcagagggtaatgtggtcggattagatttgacgacgggagagcccatggatccagtgcaggagggtgtcttcgattcttaccgggtcttgcgtaactgcatcgcatcgagcactggtatagcctctaacctactcctgtgtgacgaactgctcaaggccagacagatgagcaaacaaggtgggcctggtggcatggatgagtaa

SEQ ID NO: 18016 - DNA, 327 bp, A.fumigatus
atttccagcaattatgaggttaccgccacaggtgcctgctatcgaacagagattgctgcttgtctgaaatacatgacaagaagagattggcggaactatgcccttggttattctacaaagagcttcgatgcccagaaatctaatgcaatcatccaagaatggattcgcgcatatgcgaaggaagcagacacgacaatcgccgctctagaagctcttagccccagaaaaacagatcaggagtacactgggaaattgagcacgctgctcaggcgttggaagcagatcagatgcctctgcgacaaagctctggaagcggtatcctgctga

SEQ ID NO: 18017 - DNA, 297 bp, A.fumigatus
attgactcgccagctgagcgtcgttccgcgatcctgaaccaaatccttgaacccgaagctgccgatcgactaggacggatccgtcttgttaaagaatcgcgcgccattgatgtcgagaacaggctcatcatgcttgcccaaacaggacaaatccgccaaaaggtcaccgaagaacaactcaaagaattactgaacgccattgcggaaaatcaaaggaaggacgaggaggaacagaagatcgttatctcacggcgcaaaggcggctgggatgatgacgacgacctgctggacttataa

SEQ ID NO: 18018 - DNA, 681 bp, A.fumigatus
tgctgggagaggctaacacagcctcctcgttcagatctcattgcggctttgggcgaagccactgctactccctactttatatatagactccgcgatgcaatgctatctgatcccacgggccgacgtatccttcgtgaccgcccccgcatcacctccgaaaccctgaaactgccctacctccgcaccttgcccgagaactctgtggggcgtacctatgctacatggcttgatcgggaaggggtctcccctgacacgcgcaatagtgtcaagtacattgatgatgaggaatgcgcatatgtcatgcagcggtatcgggagtgccacgacttctaccatgcggtgactggactccctacctttgtcgagggagagttggcgctcaaggcgttcgagtttctgaatacactcattcccatgacggggctgagcatttttgcctttgtgcgattgaagcccgcagagcgggagcgatttttctccctacatttaccatgggcggttcgaagtgggcttgccagtaaagaactgatcaatgtatactgggaggagatcttggaaaaagacgttgacgagcttcggaaagagctggggattgagagacccccggatctacgagaaatccggaaattgatgcggcagcagcaaaagcgggagaaggagagactccaagggaaatcgtga

SEQ ID NO: 18019 - DNA, 318 bp, A.fumigatus
agatgcgccttgcctgaattgcaaggtattcctggcattgaaaaccgctttgcaccagagcggcttcgatcgatggtgacgaagcttgcaaatcagactgccaagaacaccagctccatgctggccgatgtgcgatctggaaaaaccacggaaatcgagtatataaacggctatatagtgcgcaggggggaggagcttggcatcaagtgcgcggttaattacatgatcaagcatctggtgctcgccaaacaacaaatggtgaagcaaagagtgtccggagctatcccaattgacattttggaaggctctaagttatga

SEQ ID NO: 18020 - DNA, 417 bp, A.fumigatus
ttatccaatttagatgtttttgttggagaggcgggtagtatatggagagccaacaagcacatggaactgtccaaatgcatgtgcacagaagagacagggtgcgacgagaactgtcaaaatcggtacatgttctacgaatgtgacgatgggaactgtggactgggccctggctgtggcaaccgaagctttgaggagcttaagcaaaggacaaaggctggaggaaaatacaacattggcgtggaagtcatcaagacagccgaccgcggatacggcgtccgcagcaatcgcacattcgagcccaaccagattatcgttgagtatactggagaaatcattactcaagccgagtgcgaaaagaggatgagaacgatatacaagaacaatgaggtacgtcacttgatttatgccgtcacctga

SEQ ID NO: 18021 - DNA, 1395 bp, A.fumigatus
ataatctcgaatagtactttcccccagagttctgctccacaggaagaagctcctccatcgcgaggaaccgagtttacggatcccataatcccagacagaaacacatcgaacgccagtcccttcggaaatacgacgtcaagaagcgtgggcgagagtgcgaaacttttgcacgatcgggacagagtgtataaaattacgccacagcacctcgatctgggagcgaatcataacatcgaaaaaagcgatccttcccaacgatcccctctgtcgtttctgtcgctacaaaacggaaatactgcgccagaaccccgcgataatcgtgctcatgagcgattgtcatctgcagattcatctcctggatccatccagaagcaacatcacgcaccaactagtgctaacttgggcaagaattatgagtacttcaccggtaacaccctgttctttggcggcggtcggttccagaattctagagacaagcccatcaacattgcaactggcatctttgtggttctgccttccgctttgttctttgcatattcggctccttggctctggcatcatatctcacctgcggtcccgatattgtttgcctatctcttttacatatgcttttcttcattcatacacgcctcggtcgtcgatcctgggatcattcctcgaaaccttcatccaatgccaccgccggaaccctcgggcgacccattgttgatcggaccgcctaccaatgactgggtgatggtgaagctggcaacatctgatgtcgcggcaatggacgttccggtgaagtactgcaagacttgcaacatctggcgcccgccgcgctgctaccattgccgcgtatgcgacaactgcgttgaaactctagatcatcattgtgtttggctgaacaattgcgttggtcgccgtaactatcggtacttctttgctttcgtcagttctgcgaccctccttgcgctgttcttgcttggagccagccttgcacatgttctggtgtatcgtgctcgcgaaggcgtttctttcggctccgcaatcgacaagtggagagtcccttgggctatggttatatatggagcactagcagcgccttacccggcttcattatgggcatatcacctctttttgatagggcgaggcgagacgacaagggaatacctgaactcgcacaaattcgctaaagcagaccgccatcgtcccttcactcaggggaacatattccgaaactggatatctgtgctagcgcggccccgccctccgacctatttgcagttcaaaagacctgatcaagagggtgatcagcgcctgagcgctatgaaacggaaagatcggcctcgagatgttgaagctcaagcggacattgagatgcagcatgttcctccgactccacggcagggttaa

SEQ ID NO: 18022 - DNA, 1329 bp, A.fumigatus
ttttactctagcctttatctgcgctctcgattgttccagcagcggaatcacgtacacatcgttctcaaggcaatcgagatgggaaagcgaactagatcctccgtcgcgtcacccgcgacacccgcgaccctctcagacctccagaagcacgctcacgagcacgtcgacgagacaataggtctagaagtgccagaacaacttcttacgcctgagaacagccgctccgaaacctctagcaacagcgagaacgcgtgccctgaagaaaagcctacgctgcgacgtacatctacacgtgtcacgcgctcttctctacgggcttcgggcacatttgagtccaaacctgaggaagaagatgcaatcctcccgtctttgtctggtgaaatggaccctacgaattctagcgggaacctagccaacgatgtcacaaaactcaagcggtcccagtcctcccacctgcggcacagcatagcggtcatggaaaccgccgtttggagcgagtcaacgcttacacgacatatcatggaggctgaggaccacctactaactccagatacgcctgtctccaattcgtcccaagagccacagctagatgatcttaactcatcactaccgcagcgctcactgaggaagcgcgtggaacgggcattgaccaaggaggatagctacaaccggaagaaggatgaatcggcggcccgtgttgatggtcccctgccaaggcgctcaactcgtctgagtttattggaaaaggcatcggattgtgtcgagaaggcgggcagcgtcctgggcaaaaggtcaaaggatatgatggagaaagggcaaattcttgaccgcagagccagtctgcggcctcgtagcgtggttgcgcccaaggaagaacccgcttctctcacgtcaagcgagccttcggctgtgaagaaacgacgtgtttctgaaagtgacctgccgtccaagaccaaagctattgacgagtccactgcgcaaagtgacactgccgccaaagagcccaggttcaagcggaagcgctggctatctcatggactgtacactgggcaggagtatacgaccgcccggcccagccaaaacagaaataagaacgcgaagaggcgatctcaaggtgttccctcgcagcgaagactgttgccaatgccaatgttcgcaggcgaccgactgctacaattgggcagggatttccagctgccgttcgatatttactcgcctcttccgcccggtcaacccaaacctgacgaatggaggaaaaccaacaaaagttcgttgactactgaatgcgcacttgttgaaagaaagagccgtactaattatccaatttag

SEQ ID NO: 18023 - DNA, 204 bp, A.fumigatus
tgctattatctcatgtactttgatcaaaacatgataatcgacgctactcgaggctcaattgctcgcttcgtgaaccattcctgcgaaccgaactgccggatggaaaagtggactgttgcaggcaagccacgcatggctctgttcgcgggtgaccacggcattatgaccggtgaagaattaacctatgactacaattttgagtga

SEQ ID NO: 18024 - DNA, 237 bp, A.fumigatus
gacaggcagcacgagcttacttccccagcaattgcaacctcaacctttggtgtatccttccctttgctttctggtgacagaatccccaacgaagcagccatgcggcctcaacgatcgttgcaaacctgcaaactacccgatgacaagtacatgaagttttttcgcctgactgattacgccattcgccaggaggttgtccgtgcgccgactactcaatatggtggaatgtgcggataa

SEQ ID NO: 18025 - DNA, 1776 bp, A.fumigatus
tccgtacaggtcaacacggacactcctgttgagacgaacaagttctattgtgggctcttcttaggaacgcaaaccaacaatacgtttacgcacccctacagcgttgcctgggtgaaaggaggtggaacgtcacagagctatggcatggcgatctcccatgtcgagagtaacatagtcgcgcatggcccggtcaatacagcaattcctggtagccccatatcatattatgtcaatccgatcggcatccattccgttattctttcagcaagtgaactggggccatctaccgtactcaccactgaaaatccgcttcccttctcggcaaacgcggttctacgaccttccgctagctcatctcagagcatcaccattcctgtagtgcagggtatgggatttgtgactggcatttacagcaacttgcaacccaagatccagagtggcgtcttcttcaccaaaatggtgactgctggatccccacgtactggtatattcaaatacagcctattcctcgaagatggaacatcatggcttctctacgcaacccctgacgatgggtctgatccgcagctacaattggcgtcaaacagcgagatcattgggccggcgggctggtcgggcacgatccaggtggccaagaacccggctggcgcatctggtgagaagttctacgataactcttcaggtgtttatgctgtcgagggcgcggtcatgggttcagtatctgagagcactggaacatacagcttgatgtgggctaaggcaggaaaggatgcgcaaaacacgccgctgctgatgtttgctctcccacaccacatggagtcgttcgacgccagtacccaaagccgagcgacgaatatcacgcttagaaccaccaccaaaggccaggcgaccgcggtcattggggaatactggacaatggtcgagcccgagctccccatttccatgggttttgccccatggtcggtatcgggaggcagcattgacaagatatcgcccgctgcgcaacaggtcatcctggctgcagctcccacagagcttcaacaagatatggatgctcagaccaatctcaatagcatgtatttcagcggcaaggccctgagcaagtttgccactctattgtacacggttgacaaactggggggtaacagcactcttgcggccgagggacttgcgcggttgaagcagtcctttgcccgtttcattgacaacaggcaacagtttccccttgtctacgacaatgtctggaaaggagtggtatcctctgctagctatgccactggtgacgtgggggctgattttgggaatacgctgtacaacgaccatcatttccactacgggtacttcatccatgctgccgcaatcataggatccatggatccgcaatggctggaaaccagcaaagattgggtcaatatgcttgtccgtgacgctggaaactcagctggaaacgatccactctttccgttctcgcgcgggttcgactggtttcatggccattcttgggcaaagggtcttttcgagtcctttgacggcaaagacgaggagtccacgtcggaagatgcgatgttcgcgtacgctctgaagatgtggggaaagactattggggatgttagtatggaggcgcgaggcaacttgatgctgggcattttgcgccgaagcatgcggaactactttttgatggagagcaacaacaagaaccacccggcgaacttcattgccaataaggttacgggcattgtacgtcaagcattgtcaccgtatgtcttgtggggttga

SEQ ID NO: 18026 - DNA, 183 bp, A.fumigatus
aacaccaagtatatggcgactcaacttcctcatcctttcgagaccaaggcacagtacgaaagatcattgcgcctccccattggccctgaatggtctaccaaggagacattgcaaaacgcaaccaagcctcgcgtgatgatcaaacagggcatcatcaagccgatggagaagcccatgatttaa

SEQ ID NO: 18027 - DNA, 327 bp, A.fumigatus
agtgggccagtcctactcaagaatcatgatcttgtgaagagagcgttcgatggagatgaggtagtccaagagttcgagcaagacaagctcgaaaccatcgaagaggagggtgacaaggtcatcgacgagacccttcgtggatggggcagctggaccggtcaaggagtcagcaagagggagcaaaggcgacagaagaaggtcctgaccaaggttgaaggtgtcaagcatgagaaccgaaaggatgcaaagctttctcgggtcattatcaacgagaaacgcatcaggaaggtaagcaattcctatttccaccgattcaagagtgattga

SEQ ID NO: 18028 - DNA, 285 bp, A.fumigatus
cgcaggatccatatgctacccatcctcccgtgttctgcgttcactcgcagcaagcagtttgtgaaggaggaatgggatgccatgtttgcaagcaacggcccagacccagccgagaacgtggtaggtggatggaagggcgtactgtacgccaatctcgccctggtggacccagccgcttcgtggaactttttcacacagccaaacttcgactacagctggattgacggaggagcaagccggacgtggtaccttgcctatgcagcaggtgagttcattatcgattga

SEQ ID NO: 18029 - DNA, 201 bp, A.fumigatus
atgctaggggtaaaacgcctacttctctgcgatggatatggatcctatatgacctatgaattcatcgatttctgtgagaaaaacaatattctcttatacttcctccctcctcatataagccatattcttcagccgctggatgttggtgtattccatgcctataagcactggcatagtgaagctattgaggatgctacctag

SEQ ID NO: 18030 - DNA, 372 bp, A.fumigatus
ttgaacgaggtcgtgcacatcaaacatgcccaacttcccatcgacgccagtctcggcagagagcctgagatccttgctgaagacagtgatttcctgcatgctcatatcactgagcagtgtcacagtatcgtctttaacctgtaccaccatacccagctcatcctggtatcgactgccgccaatgactttgacatggtcaccttccctaaagcgcttgcgaagagatttgactggagcttcaatcatctgaccggccagttcaccttcagttacctgcaaggtaacaatgtctccacgggtcgacgtggtgcgaccgaccaagccctgctgctcgcctcggaacacctcgactgggtcacctggaagatatga

SEQ ID NO: 18031 - DNA, 285 bp, A.fumigatus
gacatcttgctcatcttcgtcttcatcttcatcttcgtcgtcctcatcctcctcctccccctcctcctcgtcatcctcgtcatcctcgtcattttcaccttcttcctcgtcttccccctcgtctctctcgccgccagcgtcagcctcatcggcatcaatgtcttcctttacgtcatcttcgctcccctctcggtcggctctctcaggcttaacatcggcatggtcgtcgtcttcctcttcctcgttgatacggccgcgactcgtagactattgcaaagtgtgtaa

SEQ ID NO: 18032 - DNA, 210 bp, A.fumigatus
  unsure (155): Identity of nucleotide sequences at the above locations are unknown.
tccagattgggcaatcagcgcgaagtctcgtctcaccagacaactgttacttgcaataagactgctcaggagcacctcccatgtgaatccgctcttaaattctattcggctcattttgatgatcaactcgttcggagacatgggtcttggattangatggctctcttcagccaggtctatgtcaccaggatttctcgatgcgctcgttaa

SEQ ID NO: 18033 - DNA, 474 bp, A.fumigatus
aactgccatcagctcggtaaggaagctacttcacttaccgatgagacatcttgctcatcttcgtcttcatcttcatcttcgtcgtcctcatcctcctcctccccctcctcctcgtcatcctcgtcatcctcgtcattttcaccttcttcctcgtcttccccctcgtctctctcgccgccagcgtcagcctcatcggcatcaatgtcttcctttacgtcatcttcgctcccctctcggtcggctctctcaggcttaacatcggcatggtcgtcgtcttcctcttcctcgttgatacggccgcgactcgtagactattgcaaagtgtgtaagcatttgtaccaatcccagccagtcgacctattagacacgcacctgtggcttgacatcctcttcgtcagagtcttccgcaggcgcgggattgaagtcatcgtcttcttcttcggacccaaagtcctcgttcagaaaattccgtga

SEQ ID NO: 18034 - DNA, 1485 bp, A.fumigatus
ggccgtccgagaaaacgaaggaagagattgggcggtgtgcataatttcatcgatacggaggctggtgtcgacgaagaagaggacgaggctgaagatgaggaggatgaaatggagtttggcgcagagatgcacccggacgatctggatgcgctccccgctggcgcggatacagacgaccgccggcaccgacaactcgatcgccagcgtgagctcgaggcgagtatggatgctgagaagcaggcgcagttgctcaaagaacgttatggtcgaaatcgcgccgccgccaccgatgccgtcgtcgtgcccaagcggctacttcttcccagtgtcgatgatcccagtatctggggtgtccgttgcaaagctggcaaggagcgggaggtcgtctttgcgattcagaaacggatcgaagagcggccgcccggctctcggaaacccatcaggatcatttctgcgtttgagcgtgggggtgccatgagcggttatatctacgtcgaagcgcgcagacaggctgatgtgatggaggctctggaagatatgtcaaacgtttatccacggacaaagatgatcctggttcccgttcgagagatgcccgatctacttcgagttcagaaatccgaggagcttaaccctggcggatgggttcgcatcaagcgcggcaaataccagggtgatctggcccagattgaagaagtggacacaaacggcttggatgttacagtacgcttggtcccgcggttggattatggcttgaacgaggacagtggagctcctgtagtcgacatcaagaggaaacgacctggcatggcttcgggaggtcctcggcctcctcagcggctgttcagcgaggctgaagcgaagaaaagacatggaaagtacttgtcagctacgtctggcctgggcggaaagtcgtggagttacctgggtgagacgtatatcgacggtttcttgatcaaggacatgaaggtacagcatcttatcacaaagaacgtcaacccccgtctcgaggaggttactatgttcgctcgaggctctgatgacggtacctccaacttggatctcgcgtcacttgcggagacgctcaaaaactcgacggccgaggaatcatatcttccaggtgacccagtcgaggtgttccgaggcgagcagcagggcttggtcggtcgcaccacgtcgacccgtggagacattgttaccttgcaggtaactgaaggtgaactggccggtcagatgattgaagctccagtcaaatctcttcgcaagcgctttagggaaggtgaccatgtcaaagtcattggcggcagtcgataccaggatgagctgggtatggtggtacaggttaaagacgatactgtgacactgctcagtgatatgagcatgcaggaaatcactgtcttcagcaaggatctcaggctctctgccgagactggcgtcgatgggaagttgggcatgtttgatgtgcacgacctcgttcaactagagtaa

SEQ ID NO: 18035 - DNA, 423 bp, A.fumigatus
ccaagttccaggacgatcatcctggtggaaagaagagtacgtcgttgtcacatgttactagattcggacattagcggcatcggcgctgacagtgcgcatctagttctctcgcgagtggcaggcaaggatgcttcgaagcagttttggaaatatcacaacgaggggatcctgaagaagtacaaggcccagctgcagattggttctctagattcgaagaaggctgtcgccgcccctactcctgctaagaaggaggcgccccggcctcaggccgcagcgccggttgatgttgctgctgcgaagtccgacgagcccctggagccttacggtgaactggttcccttcgcggacccttcatggtaccaaggtgtatgttcccttggcaagaatccttcttactgcccgcttctgaaacggccccgctga

SEQ ID NO: 18036 - DNA, 783 bp, A.fumigatus
taccactcgccctactttaaccagactcacgcagccctacgcgccgaggtcagacaatgggtggagactgagattgagccctacgtcaccgaatgggatgaggccaagaaggtgcccgacagcgtttacaagcagatgggtgagagaggataccttgctggtttgttgggaaccaagtaccccattcagcacactcgcaacagggtccagtcggtggcacctgagaattgggatctcttccacgagatgctgctcacggacgagttgtcccgcgctggcagtggtggcttggtttggaacttgattggtggtttcgggattggttgcccgcctctggtgaagttcggcaagaagcccctggttgacagaatcctgcctggcattctggccggtgacaagcgcatctgtctcgccatcactgagcccgatgcgggtagtgacgttgccaacttgacatgcgaagctaagctgtctcctgatggcaagcactatattgtcaatggtgagaagaagtggatcaccaacggtgtttggtccgattacttcaccactgctgttcgtaccggcgggcctggcatgaacggcatcagtgttctcttgatcgagagagaggcgggtggtgtcagcaccagacggatggattgccagggtgtctggagcagtggcaccacgtacgttaccttcgaggacgtcaaggtgcccgtggagaacctgatcggcaaggagaaccagggcttcaagggtgcgttgttacatcttaagtgcccccaacacagatactga

SEQ ID NO: 18037 - DNA, 573 bp, A.fumigatus
tcggcaaggagaaccagggcttcaagggtgcgttgttacatcttaagtgcccccaacacagatactgactacgttctagtgatcatgaccaacttcaaccacgagagaattggtatcgtcattcagtgtgtccgattcgctcgtgtttgctacgaggaagccatgaagtatgcccacaagcgcaggaccttcggcaagaagctcatcgaccaccctgtcattcgcatgaagctggcgcacatggcccgccagatcgaagcaacatacaactggctagagaacatcatctatcagtgccagtcgatggaggagaccgaagcgatgctcaaattgggtggtgccattgctggtcttaaggctcaagcaactaccactttcgagttctgcgcccgagaggcaagtcagatcttcggaggtctgagctacagccgcggaggccaaggtggcaaggttgagcgcttgtaccgtgatgttcgtgcctacgctatccccggtggaagtgaggaaatcatgttagacctcagcgttcgccagagcttgcgggtgcaccagctgttcggcatgaagctatag

SEQ ID NO: 18038 - DNA, 759 bp, A.fumigatus
tccagtgcctccactgttgcttgcgttgtcaaagtcgatcgtgagtcgttgagggttatagaccagaacgggtctatccgcaccgttcttccgtcacagatcgcaaataaaatcacgcctcgtcgggacgcggtggctactgatcgcaatggtgctgaaatccgaattggcgatactgtgcgggaattgtatggagaccagaggagcggcgtcattcttcacatttaccgctcgttcctgttcttgcacaacaaagcacaggcagagaattcaggtatcgttgtggtccgtacgaccaacgttgtcactgtgtcggccaagggtggcagatccaccgggcctgatctcaccaagatgaatccggctttgatgagaagcggcattcctggtgcttcaatgggtcctcccaaaagtttcggccatgaccggctgattggcaagactgttcaagtgcgcaaggggccgtacaagggtctagtgggtattgtgaaggattcgacagatgtacaagcacgtgtggagcttcactcgagaaataaactggtgacgatccctaaggacgtactcatcgtcaaggaccctgtcaccggccaaacgctggatatgtctcgaaagggaggacagcgtgtcccatatggtgcttccgcagcgccgccatccggatggtcaggcggacgcactcctatggcagcggcggattcatccagaacgcctgcttggggcggtgcatcctcggctcgaagtaagtatttattttaa

SEQ ID NO: 18039 - DNA, 606 bp, A.fumigatus
atggataggactgtgactaactggtatttagcacctgcttgggcaggcatcagcggttctcgcaccccagcatggaagatggacggatcgcgcacatcgaacccctacgatggaagtcgaaccgcatatggaggcgctggctcacgcacaccagcctggaacgctggcgcacgaacaccttatgactccggctccggatcgagtggctttgatgcatttgcggcaggctcacgaacgccagcttggggcggagcgaacgctggcggccgcacgccggcctggtctgcgagttcctcggcaggaagcgggaatagagattctcgcggctacgacgctcccactccaggtggggcctattctgctcccaccccaggggcatataccgcaccaacccccggggcctcggcacctacgcctggagcctgggctgacagcgccccgacaccgggggtgttcaacgcaccgacccccggcggcctctcaggtcgtccgtacgatgcacccacgccggcgatgggtggtgcggcagcgaccccgggcgcaggagcatatggggatggtgaggatggcgggcctcgttacgacgaaggaacacccagcccttag

SEQ ID NO: 18040 - DNA, 1932 bp, A.fumigatus
cgagcggccatcgctcaccaagttacacgctgtttgaccgagcccctatttccaagcgccatacaacgggcccaacagctggacagcattctccagcgcacagggaaacccgttggccccctccacggactgcccgtctccgtcaaagactgtttccgaatcaagggcgttgactcatgcatcggcctgactgcgctggcgctcaaaccgtcaacctcccatgcgcggctggtcacaatgctcctctcactaggcgccgtgatcattgccaagacgaatgtatcgcagggcatggcagccccagacagctacaaccacgtcttcggccgcacgttgaacccgctcaaccaccagcttacagtgggcggcagctccggtggcgaggcagccctcgtcgcgatgcgcgggtccatggttgggtttgggacggatattggaggcagcatccgcgtgccggcgatgtgcaccggcctgtacggattcaaaccgagtgtcggccggattccattcgggggagtggtgaccggtcagccgcccggcctcggtcgggtttcgctccagggtgttgctgggcctctggcgcggtcggtggcagatttggggaccgtcctgggcgcgattgtccccatagcggagcggtttggcgaggattgcatccctgcacagtgggagagcgagtcgccggtgtcagagaggcagacacgagagtttaccgtcggggtactgagaacggacggactagtcacgcctcttcctcccgttgctcgagtcctggatgaagtggccgagtctctccgtcggactccgggtgtccgagtagttgacgtcccagtgccaccaggcttgagcaaatgtcaggggatcgcagggcggctgatgagcgctgatggagggggaagcctgctagatctccttcagagcacctcggagccactgatcccgtggctacagaagagaatcaaacgaagggaggcattaaccctggagcagctggtccacttacaagaacagagatctgatgttgagaaggagttgctcggcatgtggacagtggacggggattgcacacgccgcatcgatgcaatcattactcccgtcgccccccatccggtgcctgagattgatcggttcaatgctatcggctacacggccagttttgttcttctggactacccggctgggacgatcccggttcgcaatctcacggaatcagatctcgacagcgaccagggtatgaactcgccggaactgggaagctgggatagagtgaaccgcgatctgtgtatgcggaccgattgctttctccgttgcaaatgttcgtggctgactgggtgctacagggcaggggcaatctgtcgaccgccgcgtatatctggactcgcctttgagcatccaggtggtcacgccgaaacaacacgactacgaactgttccaagccatggaaatcatcgatcgagccattcaatcgcagaaaggagcgaggtgatcaaaatccagaccacagcaagacctgtcatgcgtcgatatcctccgctcctcaccggatgttcgatagttagcatgaattctattgataccaaagtattatctgtagacggtagaagcatggtgcagcacacttcaacatttctccttcacagtagcttcagcccttttctcccttcggacctcacaaaatccaagcagagtagatgcagacacagcaatactggtgcagtattccctccatgtggccggtcagagcatagtgatatgcaagcagcaaacagattacatcccatttacggaccactcgctcatacaattcatgcttcctctgggaatggccacatttgcctcgcttcctcaggcgaccattctccagccgtccgctcgaggaacgtagacagcaatgcccggttctgccttcgtttttcggtgatgtccagttga

SEQ ID NO: 18041 - DNA, 1365 bp, A.fumigatus
agtacagtgtgtttcctctctcacaccagctgcttagttcgaaagcataccggcatccctgttccacgcgttcttgcgtggtcctcggacagttcgagtccggtaggtgccgagtacatagtcatggagaaggcagccggggttccactgtttcagcgatgggccgacatggcggaaattgaccggttgcagctcatcacgaacttgacgaagctggaggctcagttatcgtccatcggatttcccgcgtatggtggtctataccttcgagcagatacaggcgcccagcaatccaattatcaaatgctcaatgagagtattgatccgtcacacacgttttgtattggcccgtcttgtgatcgttcatttgacattgatccggacacagccctcggacagtcaaaagggcacttgaaccaaggaccatgtgagtaccgtggatcctggcagtgccacaagctaacccattgcacagggaacacgatatcagatgttgggatatgtatcgcaaagcgcgagctatccccgctgtcgaggaagcgcttggataggccaccaaccttctatcaagggagtgttgaagaacaggccaaacttttacagtccacaatgagccttatgcccctgctggattcccatccagctctagacaagtcgggccggcctatattgcggcacaccgatttgcacatggggaatatatatgttgcgcctgatgaaagctcccagatcgtatctctcattgattttcaatctctatcagtgttgcttgcgtttcttcaggcacagtggcccatatttctgaagcccccgcccaattacccaaaggggtttgtccaaccccgactcccagacgactttgatgaactggatgaagaaagcaaatcacttgctcaacaggaatggtcccaggcgaagtgggcaaaggcgtacgaagtttccacctacctggaagacagatttgcctatgatgctatgaacgtgccgcgagtcttccgagagcttttcattcggtgtgcagaggtctccgaggtgggagttgttccacttcgagcatgtctcatagagatgtttcagaattggtcgggcctcggatttactggacaatgtcctctctcctttaccgaagaggaaatcaagacgcatgagcgccaattcaccgaatatgaagcttggcatgaagtccaacgcctggcatgggaatgtctagatactgacgctgaggggtggattgcgcctcaactggacatcaccgaaaaacgaaggcagaaccgggcattgctgtctacgttcctcgagcggacggctggagaatggtcgcctgaggaagcgaggcaaatgtggccattcccagaggaagcatga

SEQ ID NO: 18042 - DNA, 210 bp, A.fumigatus
atattcaacggtcaaccaggatctcaatgttttctatcctcagaaactgtgggaaaatgcaccatcacccaccaaaagcccagttgtccatattctgtcaaggtaaccgaaaagcaaacaaacaaaggaaaggcctctaactaccaagccaggcagaccaataggtcgcgaagaactctttgcatatacaaatggccatttccttattga

SEQ ID NO: 18043 - DNA, 552 bp, A.fumigatus
tacctccgtttatgcgaatttacgattcagtgtcttcatacgtcggtgtatcatctcaacgaacgcgatcaacggctgccagcagacaggccttacactaacggctacttccttgatctagtcgcacagattcgccgatatgcagctatgattaatgagtctcgaagcagcatgccttctaatagagaaccagcacagaacggtgcaaaagctagtgctccgaagtatgttgtctccccgccctcccggtggtttgcaaggtttaacattgtccgcagtgaacatattaccctggagggtggattatccaaaaatggacgacctgccgaactcgtggttcacaaggatggcgagatgatttcgctccgtacgggcaagccctacgaggagaatgccgttcctgcgatgaagcgttctctcagccttggctccgtcgacgagggcgtcgagcgatccatggctcgccgcaagaagaatgcacctcccatggatattaaccagaagtgcaaagactgcgacaaggttttcaaaagaccttgtgatctcacgtaa

SEQ ID NO: 18044 - DNA, 1158 bp, A.fumigatus
gtacaatttcttggatgcaccttgctgaccggttctaggaaacatgagaagacgcactctcgtccctggaagtgtaccgaaccttcctgcaaatatcacgaaattggttggccaacggagaaagagcgagatcgtcatatcaacgacaagcactccaaagcccccgctttgtacaagtgcaaattcgcgccatgtacctactcatcaaagagagagagtaactgcaagcagcacatggagaaggcccacggctgggattacgttcgctcaaaacataatggcaggaacagcaagaaggcgtccaacggagctacgccccagactcccagcattgctactcctagctcgaaggctcagggcattacaacaccccttactggctccgaaccttcgccgttcgaacccgtcactgcttaccctccgaacccaccgttttcatttgcggatcctcctacccaaacaggtagcggcgacttccctcttttcactacgaatagcccatttgaggatttagccgctggtgtaaatgatttcagtccgctgccaaccacctcgttggacttccaagcgtttcagtcccagctcgaaggggctgaccctaatggcctcattcctctgactttcgatcgtcaatcatttgactccgggtctccagtgccagacttgatcaatgaaactatgggcttcgatacgtcaccagttgcatccaccgacagcagcagcctcaatttcgacctggcatggagccagcttgacgctcaaaatgtcgaggaagagtttacgactctgaccatgcagatgctcacgccagagcactcggtgtcgatgagtgccttgaactccttttctcgagacccctccatctcgaacccctctccgctcccggtccagaaagtagagaattcgctctacacgcccgactcttgccatgttgatgaaggcgtgtcggatcttttcgattccggctaccagcataaggcagatttcatgcttttcgaccagcataccaactttggggcgagttctgtcaatatgtcgagtacttgtcaactttcagcgctccacaactcgaatcagatgttcccctctctcaatactccggacctcaactatatgacccagggatggccccaggatatggagatggaacatttctaa

SEQ ID NO: 18045 - DNA, 717 bp, A.fumigatus
gaattgtctccgtttggttatgttatggccgaagaggacttatcgctaaccggtacagatctgaagcgcgagttgatcggccgtcaagtgcgcaacgaaattaccgagctgaactcccctactgccctccaccgcttcggcgctccattcaaatcggaattcggggaggttgcccctgtggattctgaactaccgattctgcgatacatttttgtgcatcatgtgcgcaagttccctttcctcgatcaggcgcgtgagaaggagttttggcaggataagttgcaggtggtaagtaatttgcaccaatttgagttgtctgcggtagccggagactcactgcgactgacttatttcttcatgcagttcctcgagtcgttcgctaacaagcatgtatcgtcctcggaagaccggttggaggagaccaagcgcaggaagctggcgcgaaaagctgaaaagcttgtcgagcttatgatggtatcgggaatccctacggcgtcggggtatgaagagcggatatcattttcggagatggaggtcgtcgatcgcggcgcgaacgagaagggccttctcgtgaatatgccggagggacatgcgatacacggctgggatgtcaacgttgcagcggtacgggttaccttcgtcaaactgacagtgcgataccataaacatgcggtcagtgatagggacaattacacactgacgacgatcactttagct

SEQ ID NO: 18046 - DNA, 228 bp, A.fumigatus
gaatcacttcaaaaagcgaatatcgaggataggagggagggccaagttgagcatacaggtaagggcaatgaaaatgtgatgataggaataatgatcgttatgacggatttgagggaagacgatagcctatgtctgggacgacaggctgacatcgacgattatggaggatgttcgtccggcccggatctgctgggcccgcaagctgaggtggtttcgatgtctgcctga

SEQ ID NO: 18047 - DNA, 246 bp, A.fumigatus
ctcagactcggagtcctcgatagcattttcactgcgttcaatgtccacagccactgtgtgatcagtggtagtgctgacattgtcactcgcggccgactgtttgttgtcactcccgtgctctttacgactctcttctatgcctttcttgaggcgtgcaatccttttgatttcggacaaaaacctgtcgagaagagcctgagtggtgacattgacgtctctgtttgggtcgccgaggaactcgattaa

SEQ ID NO: 18048 - DNA, 420 bp, A.fumigatus
gctcgggtttggcgtgatggtcaaaagaaagattgttttgtttatcgtttcattgcaactgggtcgattgaggaaaagattttccaacgtcaatcccacaagcaatcactctcgtcatgtgtcgtggattcggccgaagacgttgagcgacatttctcgctggagtccctccgcgagctgttccaattcaagccagaaacgcgaagtgacactcatgacacgttcaaatgcaagcggtgcagaccggatggaacgcagtacattaaggctccagccatgttgtacggtgacaccagttcctggaatcattttgtcaatgatggcgagaacggccagctcagtaagatccaagatctactgatacgccaggagacgagtgaaaaagatgtgtccgccgtcttccaatatattagtcattaa

SEQ ID NO: 18049 - DNA, 186 bp, A.fumigatus
gagggcgttgctccatatctcaaagagatcgtgccaccggttcttgcctgcttttccgaccaagatgcccgagtccggtactacgcatgcgagagcatgtacaacattgcgaaagtcgcgaaaggggaggtccttctttttttcaatgaaatatttgacgcgctgagcaaagtaagccgttcctag

SEQ ID NO: 18050 - DNA, 732 bp, A.fumigatus
actaaaattcgactccagttagcttccgattccgagctttctgtcaaaaacggtgcagaacttctcgatcgacttgtcaaggacattgtttcggaatctgctgcctcctacatttcggttttgcaattatcagagaagcatacagtagaccctgatgcgcaggaagaggtcgagcttcccactgcgttttcgttggccaagttcataccgttgctgaaggaacggatacacgtcatcagtccatccacacgcacattcttggtgtcatggttgaccttactagacaccattcctgacctggagcttgtgtcatatctgcccgatttcttgggagggttaatcgagttcctcggcgacccaaacagagacgtcaatgtcaccactcaggctcttctcgacaggtttttgtccgaaatcaaaaggattgcacgcctcaagaaaggcatagaagagagtcgtaaagagcacgggagtgacaacaaacagtcggccgcgagtgacaatgtcagcactaccactgatcacacagtggctgtggacattgaacgcagtgaaaatgctatcgaggactccgagtctgagtcagacctcgaggaaaatgacttacaagctgacggagactggatcccggggcaagatgttcacattgactatcccaagattctggacatccttgtgggattcgtcgatacctcattcggtgagcaaactggatggtgcattatgccgtag

SEQ ID NO: 18051 - DNA, 1152 bp, A.fumigatus
aagagagtcgtaaagagcacgggagtgacaacaaacagtcggccgcgagtgacaatgtcagcactaccactgatcacacagtggctgtggacattgaacgcagtgaaaatgctatcgaggactccgagtctgagtcagacctcgaggaaaatgacttacaagctgacggagactggatcccggggcaagatgttcacattgactatcccaagattctggacatccttgtgggattcgtcgatacctcattcggtgagcaaactggatggtgcattatgccgtagtcgcatactaaacactgagttagatgaggagatgcagttaactgcattacgctggattgacagcttcttcgagattagccctgaagatatcctccctttcgtcccccgtctcttgacacaggttctcccagcaatgtctagtggttcagaccaagtgcggcaggccgcaaaccgggtcaacacatcattgcttgagtacatcgtctccttgtctgacgatagcaccgaggaaacacgacagagtcccccttccagaccaatatctactgcaagcaaagagcttgtggagagaagagcatcgacaccaagtggtcgtcaatctttcgaaacgtccacgagtgagtcaaaaaagcaagcctctcaacaagagctctccaatgaacaggcatctcgtagcagtgtgatacctacgccggttcctccggcggatctggattatgccgcagccgtcaactcgctgactttgcagttcctgaacgagaacgaagccacaagggtggctgccctgtcttggttgattatgttgcatcggaaggcgccgaagaaggttgtggcattcaacgatgggacatttcctgcgcttctgaagacgctgtcagaccctgcggaagctgttgtcacaaaggacctccagcttctttcacagatctcgcgaaacagcgacgatagctactttacgtctttcatggtcaatttactccagctcttctccaccgataggcatctgttggaagtccgaggcaatttaattattcgacaactctgcatgaatttaagcccagagcgcatctaccgtacactagcagactgcctcgagaaagaagaagtcagtatcatccattatgcaatgtttccaggtgctgactga

SEQ ID NO: 18052 - DNA, 444 bp, A.fumigatus
caaagaatcagtacgagcatggtgtcttcctcatcgtcaggctatgaacgtgccactggcagtcgactgaaaacccgcgaggaaaacaccatccggtgggtcgaactcctcgacaagttcaagtccgtccaggagaaagcccgtcgcacgcaccgtgcctcacaacggcagttcgaccaggacggcagcaccacaggactaagaaacccctccctcacggccgccctgtccgccgcagcaaccgcggacaggggcaaggaacgtggcctgccggactcgcctcgaggtggaagaccggacataggtggctctggtgggcgcaatagtcccggagactctggcacacctaatcgcggctcgctcctgagtggtacacagaggaataagtcggggcttcctaatctcggccgtttaggtatcgggagcaggaggtccaagcgttaa

SEQ ID NO: 18053 - DNA, 567 bp, A.fumigatus
tcacagcacgagccggccatacacattggcaagatggacgccttcgagtataatgcaaatccgggccgtgtcatcttcggcagcgggactattcaaaagctccctgatgaaattgcgcgactcaacctaaagggcccgctggtcctgtcaacaccgcagcaggtcaagcaagcggagactgtcaagtcggttctcaagggccaagtagctggcatcttctctgaagctacgatgcatacccctacccatatcacagataaggcagtcgactatgcaagggcccacggagcggatttggtcgtctccatcggtggtggaagtaccattggtctgggcaaggcgatcagcatccggaccggccttcctcatatctgtatcccgactacatatgctggtagtgagatgactcctatcttgggagagacggcagacggactgaagaagactcgctcggaccccaagattctccccgggacggtcatctatgacgtcgatctcaccatgactctacctgcggcgatgagtgccaccagcggtgtcaatgctattgcccatgctggtcagtaa

SEQ ID NO: 18054 - DNA, 597 bp, A.fumigatus
aatcgtacttctgtgtctatgacattcgaaaggctaatggtcatgatagtcgaggcgctgtatgcccgcaacacaaaccccgtcatcaatctgatggctgtcgaaggtacccgggcactggcatctgcccttccagagatcatcgagaacccctcctcaaaaactgctcgctcgctggctctgtacggcgcttggctctgtggtacttgcctgggtagtgtgggcatgtctatccatcataaactctgtcacacgctcggtggcagcttcaatctacctcacgccgagacgcacacggctgtcctgccacacgctatctcttacaacgctcccaatatccctgaggctatgaaaaagctcgcagaggcgcttccggacagcaacggcgatgctatccaaggccttaacgtcttgctcgacaagctcaaggtcaagcggggcctcaaggagtttggcatgaaggaggaggatattgacaaggctgcagacattgctgtaagcaatccgtactggaaccctcgaggcattgagcgtattcctatccgggagttgatccggagggtatgggccggcgagccagcgagagcagatctctag

SEQ ID NO: 18055 - DNA, 1704 bp, A.fumigatus
tcaaaaatggctaccgaaatgcaggcggcacctgttctctcaacgccagattctctcatactcgaggccaccgaaccagtcgcccgccagaatgcgactcgcacgctgtcggacgaagagctctccatcacctacgacatcgagcgcacattgcaggaaatccgccaggcacggtacaagcgcattgccctgcagttcccggatgatatgcttccggatgcacctcgtgttttccagcttctcagccgaggtcttgcgtgccgcgacgtcgacaagatcaccgtcgaaaagaacggtaacggaacgggcggtgtggaatcggagaagctagctcaggatgtctctcaactgagtgttgatgataagccggagccggagcccaaattgtacattttggcggatacatcttacgggacctgctgtgtcgatgaggttgcggcagaacatgtcaatgcggacgttgtcgtgcattacgggcgctcgtgtttgtcgcctacggccagactaccagttatctatgtcttcactcataaggaattgcctatcgagccggtcatccaggcgttcaaagcgacttacccgtatcaggccaccaagatcatactcgcggccgacgtgacctactgcgaccatattcctgccgtgtatgcgcgcttaatggaggaaggatacaccaacctctatgccacggagttgatccattgtccatcctctgccatccccaatcggacggtgccggactcggtgcgtgaaaaccccgacacgctgtcggaatggcagctcttccacatctccgatccgccgactgcgctcctcctgacgctcgcatcccgcgtggctgcgatccacatctatccaaccaccgacgcgccgagtgacaatgttaagccgctgcctgtgtcgacgtcggcggccttgggccgtcgctacgctattctgacaaggctcagcaccgtccctattttcgggatcttgatcaatacgctcagtgtgaaaaattaccttcatatcgttgagcatgtgaagcaaaagatcgcagatgcaggaaagaagagctacatgtttgttgtaggcaaactgaatgccgccaaggtggctaacttcagtgaaatcggtggctgggtagtgattgggtgctgggagagttccctcgtcgacagcaaggatttctggaaaccagtgatcaccccgtttgagttggagcttgctctcaagggtgaccacgagagggtctggactggagcttggcagagtgactttcagagcatccttgaccaacctgccgaagaagcacaaacagctgaccacgaagaatcaccaaacgatgacgatgacatgtcggaacccgagtctgcacctcccgagtttgatctgcgaaccggccggtatgtctctcacacacgtccgatgcggaatcctgcaccccgcgtttccgctcagagtgatgatgcagtctctgctgccagtggaccggccgctgcccgggccctagccagacgagctaaaggtgagttagccatgatcggcgggactgtctctccaggggcagaatatctacggtcgcaacggacttggaaggggctgggaagcgacttcgatattcagtacgacgacgaggatcctagcgatagcactttggttgtcgaagggcgcaagggcattgcaaggggatatacggtgggcgattcgatagaaaaacactag

SEQ ID NO: 18056 - DNA, 261 bp, A.fumigatus
acccacaaaaccataacaatgtcatcgacagatctcgagcaagaccccacgcccaaggacatcgcccaacgcgaactcgaagaaaaagagcgcaaggccaaggaagacgcagagcaggcgcagctgccctacaaatggacacagacgatccgcgacgtggacgtgacgatccccgtaccttgcgaccatcaaggttcgggatctggactttgtgttggccaaagaccaagatcaaggtcccattcaaggggccaggaggcg

SEQ ID NO: 18057 - DNA, 1848 bp, A.fumigatus
tcctcagcagcagcgtgccagaggggggtgaaaaggcagagaaaagattccgctgccatgtctctcctatgtgagtctccgggctgtggaccggaggtgaaaagtcgcgatttagatgagatggaggaggatacaggttcggtcttctcagagtccgcatcggagcagtctatccccccgactcagcggtctctatcgacgtttgaacgagtcatcaccacacacgcgcctatccttgaatctcttctactccagactcccaccgatgccatcctcaagctctttcatacctcccgctaccttcgatccttcctccaaaattacccaacggcatggaagtacctctcgttccgcttgttctacccttccggcagtcagttcccgctccggattgtattccctggaggaaccgagtcggcgatgccacgccaatcgcggtcatattctctcgatcaactgttgatgaacgtggtggttccgttcagtccttgtctgaagagtctggagctggataataccgcggtctcagggcagatcttaatatctactgttttgcattcgcgacgagaaaccctggagcacctttctgttcggggctgcaagaatgtctcgctcaagtaccacatattcccctatctgaccatgttcgggctccagtacgacgtggacatggaaaggaatatcggcagctcctcgtcgacgaaacgtcttgcgctcaaaagtctctacacataccgatgtcggcatcatagacgcaggccttatctctcatcttctctctcgcgaaaggattctgactccgagcctacgcatgaattggtcagcctctgtcacaaactagggatctggactgacactgcgtggtgttctactcctgctggaagatgcttccggagaagaagttacgtttcgatgagggttcctcagggctccgccgaagtatgggtggtttttgaccgactgtggaggtcaaagaattggattggcccagtggaacagggaggtcggccaagtcagagagatgggaagttgtgggaacacgacgaaacgggctgcaatggcgagccactcggcaccggggaaggacagggactgggcgaaggcaagatgatgcctgcccatttgcgttcgagtcatactcgtttcgtcgacaacatccgctgcgataattgtttcgaggagatttctgagcgatgtgagcaatgtagtatcttgatgcactgcgtcgggtgtcgaaagaccctgtgtgcgagctgcgcgtttgaccgaccctatctccacaaccgcaggagtgcgtcaactccagaggatgccgcgaaaagcttctggtgggcacctggtgctgttgtgtccccgtgcctcatgcaggatcctctccgaaactcgacggacaacgtctctgtcaatcccaatgacccagtaccttatccgaacctaaaatttcattggtgttgtaccgagcccatattttccggaggcggcggcatcagcatcggcaccccaaaccgggacgtggaccaggtgcgagcagctcctttaccccgtggtcaaggctgggaggacttggaatactcagccaacgagtggagcaagacttttccaaagtatgcttacggtgacccccgtaaaccggactactcccttgagacggggcatatcgccatgatgaaatggctactgggaccgcctgaccgccagcctacagcatgtcctcggaatctgtgccaggaatgttacgacgctcctcagtggaaagttcattgtaagagttgttcgaaaccactatgcattgaacacgacctgcggggtctccgtcttcgcatctgcggttatcgggatttggcttaa

SEQ ID NO: 18058 - DNA, 1560 bp, A.fumigatus
gcgtacgttgggatttttctgttgaccacggcggcactgatgaacttctcttatacagatggagcgatgctccaggaagcggcaacaactgccagccattttttggagaaatcgagagcccctgcacaggtgtgcgacagatgtcacgacttaatccaccacaataaagctgtttccgtacccacgcctaccatttactcaattcaggagtatttgaaagagtcgcctcaccgagataaccgtatttaccacgtcattgacgcagcagactttcccatgtcccttgtcgacaatatttacgatgcgttgtctattcaggaaccacgctcgaaaaatcgaagagcctcgaccgagaagtatcggtgggggaggaagttaccaaccatatcgttcgtgataacgcgctccgatctattagccgcgaccaaggaacaagttgactcgaagatggagtatgtgcgatcggttctccgagacgctttgaaattgtcctcggaacattttcggttgggcaatgtacatatgattagtgctcatcgaggttggtggactaaacaagtgaaggaggatatcagagagcatggaggaggtatttgggtagttggcaaggccaatgtcggaaagagcagcttcatcgaagcctgttttcccaaggattctaggaacctggagaagattgcagaactggttgaacgccgggctgtagagtcggacatcaaccaactcaacgatgtctcattgggttccgacagcatactgccgccggcgcctagagaagacctctaccctgttctccccgttgtttcgtctgtgccaggcaccactgtctcgccgattcgcatccccttcggccacggcaaaggcgaaatgattgacttgcctggactcgaccgtggtcaactactgaaccacgtccttgacgagcacaaacgcgatctcaccatgactaaacggaagaagcctgagcgcctcacggtgaaacccgggcaatcactacttctcggaggaggcctcgtccgaataacggctgaaaaccccgaccatgtcctgatggcggcctgtttcgttccaattgaaacccacgttaccaaaacagaaaaggccgtggagatgcaggcaggtcagcgtccttatcccggcgagcagatcatgagagaggaagccactgcttcgatctcatctgccgggattttcgagttgaagtgggatgttactcgttcacacctgccgacctccatcgccaaggcagtagaagaccatggtataccgatacctcgactaccgtacaaagtgatgtcgaccgacattctgattgaaggttgtggatgggtggagcttaccgtgcagattcgagccggttcaaaatcggaggaattggagtcctcgcgttccgtgcctcgagttgaggtcttcagtcctaacggacagcatatcggatcgcggcctccgatcgaatgttggaacttcatcgccgcgaagcgcgctgctgataagcgcaagagaccctccagaggacgacagaacgttggtctgaaaagacgagcgcagcaatctcgatag

SEQ ID NO: 18059 - DNA, 987 bp, A.fumigatus
ccgcataatcattcaagtacactaatttcagtggcagttggatacccaacgaccagtatggcagcacaaacagtgaacgtactcctttcatccttcccaggactttccctaccttcgacagtctcattctccctcccatcaacatcgacaatctccgatcttaccgacagagtctccgcatacttaccgtcgtcgataccgcttcagtcccttgtcttgaccacaacgagtaacaaacaacttgttccatcatgtgaacgtttattttctctatttggcgcctccaaaggcgaagttgcaacaacatcgaatctcctccccctccggttgactgttcccctgcgtggaggcaaaggtggttttggttcccagcttcgtgcggctggtggacgtatgtcgagcaagcggaagcgcaatcagggggacgacaatggctctagtcgcaaccttgacggtcgccgtattcgcacggtcaacgaagcaaaggctctggccgaataccttgcagtcaaaccggagatggatcggaaagaaaaggaagagcggcggcgccggtggcaggctgttgtggaggctgcagaaaagcgccaggaggaattaaagaacggtggcggcaaacataaaattgatgggcagtggatggaagacaaggaggaaatgaacgaaaaggccagggaagctgtcttggcagcaatgagggatggagtgtggacggataacttacgcgacacgatcctgggcggatctagtacgagcgccagtgctagtgagggtagtgggcaggagacacagaacagctcagaggaagagagtgatgaagaacaagacccggcggatgtacccacaccgtcagagccggctgtcaagtcagcgccgacccgaaaattcattggatttgatgatgacgacgagttcatgagtgattctgaagacgaagaagtcgagcaaattgacaatccaaagggcaagggaaaagcaaaggcttga

SEQ ID NO: 18060 - DNA, 321 bp, A.fumigatus
gacatcgttgagttggttgatgtccgactctacagcccggcgttcaaccagttctgcaatcttctccaggttcctagaatccttgggaaaacaggcttcgatgaagctgctctttccgacattggccttgccaactacccaaatacctcctccatgctctctgatatcctccttcacttgtttagtccaccaacctcgatgagcactaatcatatgtacattgcccaaccgaaaatgttccgaggacaatttcaaagcgtctcggagaaccgatcgcacatactccatcttcgagtcaacttgttccttggtcgcggctaa

SEQ ID NO: 18061 - DNA, 606 bp, A.fumigatus
cctgagacaatccattatgctcgcttcccggaggtccccgagccctccgttgagctttcggctgccctgacttatgttcgttccacctcttctagcatcacgtcggctgaggctggattcgttaagaagctttctaagggcaagacgatgtttttcgaccctcgcaagcccaagaagcttaccatctacgccgcgaagaagtaccctgcctggcaagagaaatacatcgaccttgtccgggaagcattcgatgctgtcagcctctctattaacgacaaggagctgaacgccaaggttggcaagctcggtgagatgaagaaggctatgcctttcgttcagaccctgaagacccgcctgatcaagtccaaggaggctcccgagaacgttttctcgcggaagcttcccttcgatgagttagctgttctgaaggagatgcttggtatcctgaagcggacgactggttgcaaggaaatcgaggtcattgctgttgatgaaggtggcaagaccggtgaggtgctgggcactggtgagaagagagaaggtctgtcggctgaaaatgcggttcctggtcagcccacctttggctttaccaatatcgctgagtag

SEQ ID NO: 18062 - DNA, 285 bp, A.fumigatus
attgatccgcatctgatttcttctatccagggtcttgactacctccgcgagtggctccaccttcccgccgaggttgttcccgctacccacatcaagcagcagcgttctcacgctccccctcgcggcatgatgggtggtgaggagcgcgagcgtcgcccccgtgctccccgtgagggtggctaccgtcgtcgtgagcaggagcccaaggagggtggtgcccccggcgagttcgcccccagcttccgcggtggcttcggccgtggccgtggtgcccccgcttcttaa

SEQ ID NO: 18063 - DNA, 249 bp, A.fumigatus
ttgaaacctgatcaccgctttgacttcccctccgaggtgacgactggtgacggaatcgaagacgccaacttcgatgagaatgtctcaaacagcagtattctcattctcttcacgctcaacgagtggattgaggagactgtcaaggacagctccctgcgcacagattcggaatactctttctgggacaagctgttcgataatgagatgaatagcctagttcgtgaggccatcaagcactacaaaaagtga

SEQ ID NO: 18064 - DNA, 216 bp, A.fumigatus
ccccatctcagtaccgatttcaagctcgccctgaaatctgctctctttgacctgaccaatgctcgtgacgtctaccgtgaggccgcagtttcggctggtgtcggaatgcaccgtgacgtggtcctgcgctatgttgaactccaggctctgatgatctctcccattgcgcctcattgggctgaatacatctggctcgaggttctgaacaaggtttga

SEQ ID NO: 18065 - DNA, 756 bp, A.fumigatus
ctcagatgcatccgtggcaagattgaagaagtcactctgcctgtttcccatgtcgacattatcgtctccgaatggatgggctattgccttctattcgaggccatgtttgactcggtcatttacgccagagacaggtatctcgctccaggaggactaatggtaccctcagacgccaccctacgtattgcgccgtttgccgattccgagttcatctcgtcacacatctcattctgggacgatgtgtacggtttcaagatgggcagcatgcgcaagaacatctacgacgacgcgcttgttcgtagcgtgcagcctgcggcaattcctggtgattctgatgtcttcctagaactgccgttgcataccatcaccgtggaggagctctcattcctgaaggggttccaagttactctgaaggaagatatcgatgcccttgacggtttcgttatctggtttgatattttcttcatgccctctagggattctactgtcccgaagaacgccgttccttcagaaatgaagaagaaaggtttcgtcgcctttactacaggccctcacggaccggagacgcactggcaacagggcgttctcctgattgatcgcgagagaaagaagggagtcgccgtaaagaaaggtcaggccatcgctggcaaggtcggttatcagaagagagaagaagggtcacgatcgctggacatcacagtcgagtgggatactcaagcgggcgagcagggggcccaaaaatgggtgctccaatga

SEQ ID NO: 18066 - DNA, 276 bp, A.fumigatus
attgcccttgtccagactcgacttgagtcaatgtctgcaacaatctcctcagatcgtcgcgtaagggaccaagatgccctctcgaccacctcctcagacgattcggatatcagcaacgaagagggatgggaagatgttgagcctgacgacgagacacagccggtaattggcctattttccgataaggtctaccctgatgtacagtcaatgctccaggagtctaaagacaagcatggctttgacttgcggaagattcgaaaggaccttggtgtgtga

SEQ ID NO: 18067 - DNA, 990 bp, A.fumigatus
aactcccaatatgggtatgatcatgactatttgcgagaaatcccagctaacttattccgtttcacatcagacttggattttcttggtactatcagattagtcaattatgtccggtctcaagtcaaagctgggaacacaaccccggatgtgtcttcgaaagatagatttgaggacgatgcttacctgaagccggttcttgaagatgacgcccttttatatagcttggacgatatcgaagacgaacattccgcgacagccggtaccactgaggcagagcgccgcgtgatcgagcttcaggaggaccttgaacgccttcagagccagttcactgagtacagaatggctgtacaaaagtcaatggaagagcagttgtccatggatgatgaaaaattgagatcatcgcccagcggcccgtccggcaagaagatgagcaaggttgaggaggcagacgcagattacttcgtctcctactcgtacaatggtcagttctccacagggtcccgagctggatatgccttttgcgctaactgtcatatgcttgaagccattcacgagtctatgctgaaggacactgtccgtactgactcttatcgtgatttcatttacgacaacaagcatctcttcaaggacaaggtcgtcttggatgtcggatgtggaacgggcattctttccatgttctgcgcgaaagcaggtgccaagaaggtcatctcagtcgacaattccaatataattgacagagccaaggaaatcatctacgaaaacggttttggcgacgtgatcacgtacgtatttcgctccgcgtacgataataatctaccagaatctaacattagctcagatgcatccgtggcaagattgaagaagtcactctgcctgtttcccatgtcgacattatcgtctccgaatggatgggctattgccttctattcgaggccatgtttgactcggtcatttacgccagagacaggtatctcgctccaggaggactaa

SEQ ID NO: 18068 - DNA, 603 bp, A.fumigatus
aaaaaggaaaaaaatgggttatcacaacagaacccgctggttgccccgcccgatgctggctgggtactttgtttatcggctctccgcctcacaacagctgatagggcagataacaagtgggagctgagacgaacctcattatcatcaccatcatcgtcatcaccagcaccatctccttctccctgtctatttcttttctccttgtacaggctctccgcttccttcagtcgagacagggaagtgttcaatcctcattctgctagggatcaattgcttgttctgcatcatttacatgtactgaatagctcattgcctctgatcctttcctgtttcttctgcatcaaactttcctgtccaatacatattaaaccacttatatcaaccgaaatggctttcctctggaggaatcggcaacgacctccttctgatgtcgtccgaacaatcaaggagctactgttaagactaggagaagctcccgcagctgccaaggtcagcctcacaggttcactctacttgtttatgccacaaattgtacgaatatgcagcttgctgacagcttcaaataggtcgaagatgacctggcgaagcaacttgcgcagatga

SEQ ID NO: 18069 - DNA, 516 bp, A.fumigatus
ctgcagtctgctttagaaactgagacgactccggagcaagtacatgctctcgttcaagccaccgtccacgaagatctgctatacgaacttgcacgcaacctccgtcatcttccctttcaagccagaaaagatgcgcaaaccatattctctcagatccttcgttttcgacccgcccaaaccaacagtggcgaccccccggtcatttcttatattgtacacaaccgtcccgagatcattgtcgagctctgccggggatacgaatcgcccgagagcacaatgccctgtggcgccattctgagagaagcactcaaatttgacgtgtgtgcggccatcatcctatacgaccagtctatcgaaggtcagcccgcgatcagattgacacaagtcaacccggatattccccagaaaggcaatggcatcttttggagatttttccattggatcgacaagagcagcttcgaagtgagcgccgactcttttacaacatttagggtaagtcacgactggtatggttga

SEQ ID NO: 18070 - DNA, 240 bp, A.fumigatus
gtattcgtcgcaaatcctaacaaatcggtcgcggtgcaacggattctcatcaataatcgggaccgtctgttaaaattcttgcctagattcttgatggaccgcacagatgacgaccaattcacggacgagaagagtttcttagtccgtcaaatcgagctgctacctcaggagcccattgaaccaacacgatcagcgcaggagtcatccagatcgcgagtcaacaccgccgcggcggcctaa

SEQ ID NO: 18071 - DNA, 639 bp, A.fumigatus
  unsure (16),(17): Identity of nucleotide sequences at the above locations are unknown.
gcgtctcgatggtccnncgcccgcctcgtagaaaacgaggaccagtaccggatgcgcttctcgaatgcggcggggtatcgccagtctgctggccaaatgccttggtactcttcctccagtcgtgatgctttggcgcctgatgctatgcctgaaaaggatgtttggggtaatgaggatccgatgagacaggagagggagaaagcccggctagatgccaacgatccacttatggcgataaagaggggagttcgccagttgaagtcggtcgaacttgaacgtaaaaagtggaatcaggagagaaagagagaattagattcactgaaagaggcagaaagacatcggtcgcgtcatcgcagaaggagatcaaggtcaagatcaaaagcgtcggactctggggacagtcttgagaacttcagccttgacgcacctgacaaacatcaggataggaaacacaggagctcacaccgacatcgctcgcatcgccgtgaaagaagtcgcagccgttctcgcgatcatttttgcgaacaatcccggaagcgacaccgtcactcccattcccactcccattcgcaccgtcatcgtgatcaccatgatcgagggggcgtttgcgaggtgcagtcgcccagacgccatgtgtaa

SEQ ID NO: 18072 - DNA, 297 bp, A.fumigatus
gacattctcactcgtcacaagagtcttgtgacctcatacctcaccaccaactttgatctcttcttttcgcgcttcaatacactcatccagtcgagctcctatgttaccaagcgccagagtataaagcttcttggtgagatcttgttggaccgagccaattacaacgtgatgatggcatacgttgaaagcggggagaatctgaaactctgcatgcaattgctcaaagatgatcgcaaaatgattcagtacgaggggttccacgttttcaaggtattattttctatttcttcggcgtga

SEQ ID NO: 18073 - DNA, 213 bp, A.fumigatus
gttccctatgccccgcccaatgtacgagctaacgtatggttttctgcgttttctagagtcaacttcaatacctctcctccttacaatgtccctgctggttcatccgtggacctgagtgctgttgttgctcattacgagcagcagaacaagcagatggaagaggcccgcgtcgctcggatgaaggacggcaaagttgtgtctctatatgactag

SEQ ID NO: 18074 - DNA, 501 bp, A.fumigatus
attggtattgccaattgtatttccgcaaaacatgtctttcgccagacagtcagtcgcttcggcgcggcagctgctgcgcaatcagcagcctcgtcgctttgcgtctcatgccgctcatgccgagcctgtgaacgagagcttcggcgtatgttcgacctcccacgacagaattcatcctcgtcactgactacaactctttcatctctacagcgcagcttctatgttaccatcggtgcatttgcctccgcttacgttctttaccgcctgagcaagtccgctgaggaatcgggctcacagtcgtggatctccaacctcatccaaaagtggactccttcggagaagctgtttgaggagaggaacgctattcacacagcacttatggagaaggccgctcaggatcgccacctgcttcagtctcagggccctcgagccactttcgaattaaagcagcccgagtatgttcatatgagttccctatgccccgcccaatgtacgagctaa

SEQ ID NO: 18075 - DNA, 528 bp, A.fumigatus
ggcgatcgtacgaacgaaaagatgctaatgtttcgtagtgataactttgagcaagctgttgcggccctcgaacacgcaaaatatgcactggccttctcatccggatcggcaactacagctactatcctccagtccctagctgcaggctctcacgtcgtctcggtatccgatgtctatggaggaacccacagatactttacaaaggttgcctcggcccacggtgttcatgtaacattctcgccttgcattgaagttgatgtggaggcattgatccgccccggcgagaccaaactggtctggattgagactccatccaaccccacacttggcttggtcgacattcgcaacgtagctgctgttgcgcaccggcatggcatcatcgttgtggttgacaacacctttatgagcccctatgtccagaatcccttagatcacggagccgatatcgtcgtgcactcggtcacaaagtatatcaacggtcattcagtaagttgtgacgcatcgtttacgggcaagacggtttactaa

SEQ ID NO: 18076 - DNA, 291 bp, A.fumigatus
atctacaagcgcgcaatgacatcagcgttcagctttggtttctctggggatgacattgacattgacattgacgaggacgatctaagtggaattgatgagagagatatgaatgctgtggaggatgccagcaagcagctcactggaagattaatggaaccccaaagacatgatatgggagaatgggtaagttataagtcactcttgggaagttgggtagctaccgacgggtcgcgctcgaagacaacggatgagatgaatagggagagaggaatagcagacgacgaaggataa

SEQ ID NO: 18077 - DNA, 582 bp, A.fumigatus
gacgttctcatgggcgtcgcagccttcaactctgacgctctgaaggatcgtctaacatttctgcagaatgccattggggccgttccatctcctttcgattgctggctcgctcaccgtggcctcaagacccttcatctgcgcgcccgtgaagcgacggctaacgctacagtcgtcgccaaggctctcgaggcgtcgcctcacgttatctctgtcaactacccggggcttgactcacacccccatcgcgccattgctattaagcagcaccgccagggaatgggtggtggtatgctgagcttccgtattaagggaggccagaaggccgctcaccttttctgtcaatacaccaaggtctttactcttgctgagagcttgggtggcgtggagagtctctgcgaagtgccttcaagcatgacacacgccggaattcctaaggatcagcgcgaggctgctggtgtctttgatgacttcgtccgcatgagttgcggtgttgaggatgccgaggatctcaaggccgatacgctccaggctcttgagaaagctgttctcgctagccagcagttggagaacggatcttcttaa

SEQ ID NO: 18078 - DNA, 651 bp, A.fumigatus
ctcggtgctggcacttcggtaccgtcactgactctcttcgcgcaagcactgcgtcgaccggactcagcgacgaacaaaatccatttcacatttgcagattacaattctgccgtcctccgcctagtcacgcttccaaatctgcttttgacttggaactacatagtcatgcatcgggatccgccttcggctgaggacacttcgcccagagaccagcctgatgaagaagaattagacatcacgcctgagctcctggagagctttcagaaagatctcgcaaacaagaagatcaccttcgagttcatctctggtgcctggtcctccgcctttgttgacctggtgttctccagttacggactgggcaaagggaaaacattgattttagcgagtgagacgatatactctccagcatctctggagcccttctccgagacgttgattgccttgcttcgccggtctgaaaccgaacaagagcggagcaaagccctcatagcggcgaagaaggtctattttggcgtgggaggtggagtagacgagttcctgatggtgttgaaaaatgtcaatggttatgacctcgatgtgcaggaacaggtgaacatcaactcggaaggtgtcggtcgagtgatattgaagattacgctcaggagtacataa

SEQ ID NO: 18079 - DNA, 501 bp, A.fumigatus
tccggacctgtgccatcttcttactcctactttcctctctcattgctcacctctcccgctctctttcctacccatccaggtgtctacttctggtcttacggactgctcgatccactgcactattccttttttcatcatcttcgtcctctccatgttcgtttcgcattaggtctttcttacgtcctccgggctggtcacgatcgcctttcctccctcttcttctatcctctttcgtttctacttctttcctcttcacgcaactgccttgacctttctgcctttgccttgcgtcctcgaattcgttgtctctttcgtcggcgctgttctatccactcatacatctccatcaccatggagggtttcgatactatggccatgccgtatctggccagtccgttgtcactgggcaatatgcagggcgccgactaccttaatgccatgcctggtattgatctacccgaccaacgctcgaatttcgactccgacacgttcgttaggtaa

SEQ ID NO: 18080 - DNA, 183 bp, A.fumigatus
ggcctttttcgacctactctctattgctctcttgcgcttccggatcgttcttctcgttgtcttttgtggactttccgttttaagtcttcgatcgcctccactacccaaggcactaactacaccactactactattaccactgactgcatctatctactacatatctacaactatttgcagtaa

SEQ ID NO: 18081 - DNA, 924 bp, A.fumigatus
gtctttcttacgtcctccgggctggtcacgatcgcctttcctccctcttcttctatcctctttcgtttctacttctttcctcttcacgcaactgccttgacctttctgcctttgccttgcgtcctcgaattcgttgtctctttcgtcggcgctgttctatccactcatacatctccatcaccatggagggtttcgatactatggccatgccgtatctggccagtccgttgtcactgggcaatatgcagggcgccgactaccttaatgccatgcctggtattgatctacccgaccaacgctcgaatttcgactccgacacgttcgttaggtaagtccatcctcgctttgcgctcacaaatgatcattctgaccaaagcgcactggaacagcggcgaggatatccctcccttcactcagcacagtttgccgaacacgttgaaacgtttctcttcggggtacgacgatcccttcacggaaatggtgaccccattcgaccccgcaccctccgaacaacctccagactcgtctattgaccacaataacaagttgctgagtttctcaatgcccgcctataatttcactctccttgattattcgttgcggcggacgtcgttatcgctatcggcccagttacatggcatgttctctctcgccgaatcgccttggaccacatccccgacggaaaacgcaccgccccaacaaggggcggagttgacatgctaccggcgcaacctgttccagatcacaggctccgtgaccctgcctcggagtctacggtacatcatgaacgagcagggcgaccgtttacctatccttgcgcaagaactctgcgtttccgccactgaatctgtggaagggcattcggtcaagatcatttcagtggcctggaaaaagcccgctgcgaaaggggattctaccgactga

SEQ ID NO: 18082 - DNA, 1062 bp, A.fumigatus
ccacgatacaggagtattaagcgcattatcttcgagaccctagttaaaagggtcccggggggattagtgaggctgtcagttcccgagatcaagcaaattggaggtcgggctggccgttatcgcccggctgcgcagcaagacaagaaaaataacaacgactctgactcaaatattggcttggtgacatgcctggaggaagtcgatttgccatatattcgcgaggcaatggagactgaaccaccaccgcttacggctgccggcattttccctcctgatcctgtgttccaaaagttctccgcctatttcccgcgggatgttccttttgagtaccttatcaagcgtctgctggaagtctgtgaagtcaatcctctgtttttcctgtgtgaccctcgcggtcaacttgagaatgcggaaatcatagacagtgtggttggcctacctatagaagatcaagtgacttttatggctgcgcccatgtacacccgggatagaaaatcacgcagcgttgcttgcgcgtttgccgaatgtgttgcagagcattcaggtggcagactgcttgatatccctgacctgaatctggaaatcctcgaggaaccggtgtctggaaacaaggactatctgcatgagctagaaggcctacacagatcggtcatcctatattcttggttaagctaccgatttgggggtatattcacggatcgcactctcgcagctcatgtcaaggagatggtggaagagaggatggtcagggcgcttactgaattctctgccaacaagaagctaaggaaagatgcatcactgcgccgacagatcgctttgcagaagcagattgcggagcagaaacgggttcttgctgaagcaaacattgaaggattcgaatatggagtggacggagaacgtgtcccagttgatgtctctgcggaggatggttctctggagcaagagggtcaagagagttatgatccatttggagacggccaggaaggggacacaattcctgttgatgtatctgctgaggatagtcctctggagagagcagcccctgctgcgcgtggggtttga

SEQ ID NO: 18083 - DNA, 1188 bp, A.fumigatus
cagatcctaacatacaccttcactcgtactctttcattgttgacaaggttgctgattcgtttgtttgccatacagtcttggaaaaagaaggcactggcccgtagacctctgagtcaaccctttatcattcgcgacttcgcctccatcgtcgagtccgagctagcagatttcaaacagagcttaaaagagtcatccgatccggtcttggcaggatgggaaagattcgagcgttatgttctgaatgcctgcaagctggaagaccggtcgagccagaaagtttttggccctttacgccatgtcaaaaccacacttcagaaagcctatctcagctccggtatatcgggtctgaggagtgagctgaggtatcttatgcacgccgaagagattactgaaaagtattctgctccccttctggaacaacaaaagaaggttgcggacttgcgctatccggcagaatggtaccctcaagctcgagcgctgcaacggacaatccacttgcatgttggaccgacgaattctgggaagacttatcatgcgttacaacggcttcaagcttccaaaaatggcttctacgccgggccgcttagactccttgcccaagaggtgtatcatcgatttcaagcgagcgggatcccctgtagccttgtgaccggggatgatgttaaaataccggaagggcaaactccgtccattgtcagcaacacagttgaaatggtcaatctaggacagccgtatgacgttggagtcatcgacgagattcagatgctcgcggaccctaaacgtggctgggcgtggactcgtgctgtccttggtgcgcgggccaaggaacttcacctttgtggcgaaacaagagccgtgcccttggttcgagagcttgcggctctcacaggtgatagactcgagatccatcggtacaaacgattgaatccactcaaagtcatggatcagagtattagaggcgatttgaagaatcttcagaaaggagattgcctagttgctttctcccgcgtcgggatccacgcactgaaagcagatattgagaaagttacaggcagacgagcagcgattgtgtatgggagcttgccagcagagattcgtacgcagcaggccaaactcttcaatgaccccgacaacgattatgatttcctggttgcgagtgatgctattggtatggggctaaacttgtaa

SEQ ID NO: 18084 - DNA, 567 bp, A.fumigatus
attgtcgccgaggacattaagaaggcagctttgttgcccgagggtgtttggcgctctctcgcacgtgagacgctatcaatattatatcttgtttattcgatacttcttttcacgagttcaggttttcgcttttggtggtttcgctctccattgcaggttatggacgacctcgagtccctggagctcttttcgctcgtttcgcgaatcacgggtgagctccagaatcacttaggcgtcagtgacaagacactcgctgagtttgtgatcgatcagcatctatcatgtggttcgttcgacgagttcaaggggaagttggaggcgatgggtgcggagttcccgcagagcttgatggagagtatcgatcgcctggttcttacgatgcacccaaaatacaagtcgaagaaagcaaacgtgacccaggagaagacggaagcggagggggatatggatgtccttgatgctctggagaagaaggcccgggtcttcaagggacttgctgttcctgataagcaaccacaatgggatgaagacgacaactttcgaaacccggatgttcatgaccgttga

SEQ ID NO: 18085 - DNA, 270 bp, A.fumigatus
gcaatctcctttctgaagattcttcaaatcgcctctaatactctgatccatgactttgagtggattcaatcgtttgtaccgatggatctcgagtctatcacctgtgagagccgcaagctctcgaaccaagggcacggctcttgtttcgccacaaaggtgaagttccttggcccgcgcaccaaggacagcacgagtccacgcccagccacgtttagggtccgcgagcatctgaatctcgtcgatgactccaacgtcatacggctgtcctag

SEQ ID NO: 18086 - DNA, 222 bp, A.fumigatus
cttgagttcgcatcggctaatagtccttttcctcaagatgtcgagcagatcgagcataggcgaccgcccaatcccgatatggatgcgctgtatatcctgtcacctcaaacacatatcgtcgactgcctaatggccgattttgaacggaaaagatacaggcgagcatggttggtctggacatcaggtcagtcatttgttctgatcggagactcgacagtgtaa

SEQ ID NO: 18087 - DNA, 504 bp, A.fumigatus
attcttgtgagaactacactgactgttgtcgaggttgtatcactgtgtgtgagtttaggagaatacccgataatccgatactaccggcccagaacccctacccacgaagccagcgtcttgtgttcccacctcgctcgattcattcagaacgaattggaccagttcgctcaatctcagagagactttcctcctccttcgccgagacctcgcggtgttcttttgctggcagaccgctctatggatatggttgcccctctcatccacgaatttacctaccaatcaatggtgcatgatttgctacccatcaaagacggggataaggtcacctacaccactgttatcaacactggcagtggcggcggacagaaaaaggacatggagatcaatgaagaggacaatgtttgggttgaatatcggcatcagcacatgaaagatgtgctggagaagctgggtcgagactttgcgaaatttagggaagcccatcctcagttcgcggaagagtaa

SEQ ID NO: 18088 - DNA, 720 bp, A.fumigatus
tatgagaatcgttccggcgcctcccatctgctgataaggctaacggtcatgttagtggcttatcggaattacattcaagatactgctattgcgcatggcgctgactttaggaaagacctcacgaagagtgtgacccatctgatcgcgcgcaatacagagggccaaaagtacaaattcgcaacacagtggaacattaaggttgtaacgatgaaatggttcacggacagcatcgaacgtggcatggttcttgaggaaactctataccaccctcttctgccacaagaacaacagggcgtgggcgcgtggaatcgcacagcaccgccagccaaggagaaagctgcagacgccgagaattcatccaatccccggcctaggaagctgcgcaggatcgcaagcacgaagctcgttgaccagaacgaagggatttggaatgctatcgtgggtgcgggattcgaaaacaacgagctgagactgtcaacgaacagccaactgaagaatgaagatgtcacatcctcgaaaatcacgaggaaggcatccgttgtacaggaagctaagtcattcgctagcgagacgacgtttgcggaggcccagggatctcgtcaagacacttctgaagtgagacaagctagcaacaatggtttcctggatggctgttatttcttcatatatggattttctcccaagcaggtttgtaccgctagcttctctccttgcttctga

SEQ ID NO: 18089 - DNA, 207 bp, A.fumigatus
gagcagacgccgcaagttgttaggcccaaggattttgacggcactgagcatgctgtctacccagctgcctccgaaggctcgaccaccgagaactgtcacggcagtcatggcaattccagtgccagccatcttctcctgtcgttcccacaaaccggtaatatcaaagaagtcccagatctccacctcagtgtcgacctgtctagctag

SEQ ID NO: 18090 - DNA, 312 bp, A.fumigatus
actgagctggctacaattgccagtcagatgggagcagctcacaagttcgacctcacatctgacgtcacacatttgcttgtcggcgagatcaatacagcgaagtataagttcgtcgcacgggagcgaagtgatgttgttgttctcaaaccggaatgggttgaggcagtacggcagtcatggatgcagggtgaagataccgatattcgggcgttagagcagcaatatagactaccaaccttcatgggattggctatctgtataacaggctttgaggatagtatgagaatcgttccggcgcctcccatctgctga

SEQ ID NO: 18091 - DNA, 1176 bp, A.fumigatus
  unsure (715),(716): Identity of nucleotide sequences at the above locations are unknown.
ggattccatgggatgaaaatttgctctaccgggttttctcgcattgacctgctgcatttatcaaagctagttgacttaattggtgagccattagattcgtcagctttaaccgatactgactatgtaggcgccacatatgacgagtacctgacgccgaaagcgtctgttctggtatgtaataactcgggctcaataaataacgaaaagctgcgacacacttccgagtggaaaatcccagcagtcagagtagattggctctggtcatccatcaaatcaggacagagaaaggcattcgaaccatatattatacagaggttgtcgcaacatgaaaagagcttggaagtgcgagccggctcccgcactgagcagaaagatgtatttgagtcctctgataagcccaacagatctgcgaagtcagactccggcactagggaatcaaagaaacatggtataaacgggtccaccaagagcactcctgtcgagaagccgtccaaaccgagtagtgaagatgaatcagtgaaggcaccacctccatacaaacgaccatcacagtcagcatcagtctcgcctaccaaagaaaccagaccaccaaacacagcctcgccttcaaacaagcgaaaagcgccagaccatgtcacaacctccgcacaagccgcaatccaacttgccgtaagcggatttctcaagcaagcacgaacagcaaactcgcgctcannatctgataccacagaccaagaaagcgatagtctccgccgaaggcgccggaaaccactcctcggacgagcaccatccgactcctctgcacagggcgtgttctgccgagccagctcaattgacacactcaatgaagacggatgcggaagtgccgcggagagcatcggcgcagaaggcttcaactcgttccttacaggcgggcgattcgagccatcggaatctcaacgtcgcattgaggatcaagagaatgaggagcctgcaatgactcaactgaactatgaggatccagatgccgtcaaaatgcgcgaagagctctttagtcacgctggcaaactgtccaataagacaaaatcttccgatcagggcgtgatcgtgggtgaggtcagggaattggaggatattggctggggtactggtcggagaacgaggaaggcggttaaggattcggaggctgagttgtaa

SEQ ID NO: 18092 - DNA, 375 bp, A.fumigatus
ctttcaacaacagccgtcttgactacagcttacatgctttcgtcaatcccgcatacacttccccctcgtctctcacgcaagcttgccgctactctgtctgaaatggactatgtacactccaatgccactcgtatctcgactgaggtccgtcgcatcctccgtatacccgcaggcaatttgcagactagcctcgctcaaggcattgaagacctcgcaaaacgcaagcaggaggtcagcaagacgaaacatgagagcgaggttgcaagcaaatacttctcaaacctcttccgggatagtggagagaaccgacggtcagttgaggatattgatcttgacgcccccttgcctggaggtctggccgccgtgcaaggctga

SEQ ID NO: 18093 - DNA, 2187 bp, A.fumigatus
gcgatttcccgaacgattgatacgttgaaggagcttcaggatatgaaccgccaatggccagcacactatccatctgtacagagcgctccgggtagccccggctcggattcgcaaagacccggtctacgacagagtcagtcgtatttcgaaagtgagcataatcagtcggagcctttaccccggccaggacaaattcgacgcgcagccacgatgtccggaagcgacgacttggcggagtcgagtgcggctgccgaacgccgaccttctccagaaccaagattgatgagcccacagattgcgcaggaattctcgattttgaagttggatttgaagcttggtgctctgtcacaagccgagttggtacattcgctggagaaggcctcgattgcatcacttttggacggaaaaattagccagagcattaaacaccttctttccctgcgtgacagaatcgaggatacatcaagcaaggtgctaatcacaggagacttgaatgccggcaaatccaccttttgtaatgctttgctgcggcgcaaggtgcttcccgaagatcagcaaccctgcactagcattttctgcgaggtgctcgatgcgcgagagaacagtggagtcgaggaggtacatgcggtacacaaggacaagcaatacgatcgcaacgacgaaagtacctacgatgtgtacactctcccggaactggaaaacatcgttatcgacaactccaagtacatgcaatgcaaggtctatgtgaaggatgtccgaacgatcgatgaatccctcctcaacaatggggtggtggatatcgctttgatcgatgctcctggtctcaactcagactcgttaaagacgacggccgttttcgctcggcaggaggaaattgatgtggttgtttttgtggtatccgccgccaaccattttactctttccgccaaagagttcatcttgaatgctgctcatgagaaagcttacatcttcattgttgtcaatgggtttgatcagattcgtgataagcaacgttgcgaacgcatgatcctggatcagattggcaaactcagtcctcgcacgtataaggaagctgctgagctggttcattttgtttccagtaatgccgtcccagtcgcgcctcccgtccaaatggagcagtctggtggtggcagcggtggaggttctgatcctcatggagatgatgatgacgaccattctgacaatagagggaagggcaaaggaaaggagagggagaagattcgagattttgagaacctggagggttctctcagacgttttgtcctggagaagcgcgctcgctccaagctggcgcctgcgagaacgtatcttctcaatcttcttgcggatatcaattcattagcagctgtcaatcgtgatatcgctcagtcggaactcaagcgcgttaccgatgagctcgctgagctcgagcctgcctatgaaaatggcaaaaagaaacaggtcgagctcggtgaagaagttgaaaaatgtattgatgactcatgcgaggatgtctacaaccatacgcgctcaacattgacggacaccatctcgcgagtgtctgaggcagacctaggtgttgagtaccctggcctgttctctgcattccagtacgctgaggatctcaaactagcaatgctggagcagatcgctacatccgtcgctgattgcgaggactacgcacgggcaaagactgcacaaggagtgggattcattcagaacattggtcttctgcatgtcggagaggacaagtttgctcccttgaacttccgtgctgatgcaatgttccgccgtggtcgtcgccacaccctagctagacaggtcgacactgaggtggagatctgggacttctttgatattaccggtttgtgggaacgacaggagaagatggctggcactggaattgccatgactgccgtgacagttctcggtggtcgagccttcggaggcagctgggtagacagcatgctcagtgccgtcaaaatccttgggcctaacaacttgcggcgtctgctcctaccaggtattgtcgctgctggtaagtttcctgccgttttcaattctgctatacgcgattttgagctaactttcaacaacagccgtcttgactacagcttacatgctttcgtcaatcccgcatacacttccccctcgtctctcacgcaagcttgccgctactctgtctga

SEQ ID NO: 18094 - DNA, 357 bp, A.fumigatus
ccatccatcagcgcaaaacgctacgaacgcttgctcaaggcctacattgaatcagcgaacactggcgcaactgccaaggctggtcctcctaagaagtccaaagcaaagggggcaggcgagagttcgggttcgagttcacccgcgaagcgtaagcctgcaggggagagtagtaagggcagagccaagaaagcacggatgttgaaggagggggtccttgagagcgcacacagaatgattgagcagagattgagtcctgtgaaggaggaagaggggtccgatgccgaagaggagaaggctcaaggcgctaacgctgatgcgactgctgtcgatgatgagacgctgttgggccaattttga

SEQ ID NO: 18095 - DNA, 636 bp, A.fumigatus
aaatgtccgccaaccccgagaccaacggtggggacatcagtagtgccgatgcccatttcatcattgaatgcctcaaaaatctcaacggatctaagcaggtcagtcaacagagttcctcacgtttttatcctctacagagatgcaatacccctaacaacacaccaggtcgacatcggtaaagttgccactgtctttaagtacagcaatgtgctgtcagcccgcaaccgtcttcgcaacctgagcaagcgctatggatttccaaacctggagtgcagatttccctctacccctactaaggccggcaaagctggtgctattgtcgaggctgccaaggatgatactgcgggcgatgatccttcttcttccggcgagactgtccagtccactccttccaagcccgctcgcaagcctgctggacgcaagggagccaaggtcaactcaaagccgattcccgccacgggcccggtgagcgccgatggctctacctctccttcaaaaaagcgcggtccaagaggcaagggcaagctagctgttgcccaagaggccgccgtcatggagtctgttgagattccagtcaagaaggacaatggaaacgtgaagatggaggatggtggggctatcaaagttgaagcttaa

SEQ ID NO: 18096 - DNA, 246 bp, A.fumigatus
ctagcgataggtcttgaatgggctttttacaaattctccacatgctatcaaacagtcatcaatgaactgtcattgtttcctaatatgatggtacctattcttaaacctaatgacgagttccaaacaaattcaatgcttagaacatctccgtggggagatagtaccgcaaaaggaaatatcaaagctcaaatcaaaccatcgttctctcagcttattgctcgtatcctccaggttcctaaattctaa

SEQ ID NO: 18097 - DNA, 246 bp, A.fumigatus
gatatgatgactcagcatgacttcgtcactttacgacttatgattccctttcctgtttatgttttctatctgtatctaaggatcatcacaatcaatcatcaaaatccattcgttaaatcatcaatttccttaccgaacgtttcagtacttaagactggaatctttagactagctggttcagccattgttgacatggaagcacatgactacgtcatgtctcctgtttgtaatgtttgcacgtggtga

SEQ ID NO: 18098 - DNA, 594 bp, A.fumigatus
  unsure (307): Identity of nucleotide sequences at the above locations are unknown.
gtacattccctcacaacgacatgtatgtctttcttaccagcgactaggagttctctttttgggttctttacctttggaatggccataagctctgtgcaacttgccgcgaataatctgacaacaattgagaacctcaaccgccgctcggccgtgtggaccttggcaatacgcgtgccaaggcacatcctcagcaaacgctgggcaccaaccttccgtacaatcacataccctctcccgcctgttcctccggctgagtcggaagtcgcgcgggaatccccaggcggagaacagcatgtgttcgcaattntacagactctaccaggggaaaatccatttgaccttggaagtccgctcaagaatatacagcaggtaatgggtttctctctgctcgagtggcttctccctatcaagcaaagtccttgtgcggaccacagtagtaacgagagcgcgtttgccctcgggcccgttgtgacgaggttgaagaaagaggctgggttagaagtttccacggagtcggagtcggcggaccctgtgggtgccgcagagacaccacagcatgaacaaagacgaggaaaacatagacggcgtaactga

SEQ ID NO: 18099 - DNA, 558 bp, A.fumigatus
aaaacagtcgactatctcatacatcctgcccaccattatgaccgaaggtctcggagtggcgctggtgccgctattcttgccatttattacgtcctgctgattcctgtgttggccacctatctccggcttctgtataacgttgtcttgagccctggttacctgccgcggggtacagcatgtacccagaaccagaccggcagtgatgggtcaaagcaccgtcatcgaagacatcgcaggaggaaaagcggacatcatctgtccaaaacgacggagaaaacggatagatctgacggaggcgatgtcgaacgaggacttgagtacagtgcgagagcaaaggcataccctctagatgcggaaggattggagagcttctacacgaaagatgtctttgtatgtcaaccggacgggagaccagtgtattgctccacatgctgtcagttcaagacagacagagcgcaccactgtcgagaggttgaccgatgtgtccgcaagatggatcacttttgcccgtggtatgtcggaatcatacacgggcttttgcaatggcaaggagactaa

SEQ ID NO: 18100 - DNA, 552 bp, A.fumigatus
  unsure (348),(536): Identity of nucleotide sequences at the above locations are unknown.
aaccggcagctggagcacagaatatggagtatctcgaaccgtttaatgcattccaaattctcttccctgaacgcggacaacacggggttctcccacggcgcgtacaattctaatcttcccgtccagggtttcgcggatcggaacgctcgtcgtcccaacatccctcacatcaatacctctaacccggcctcgacccgctcggacggcatggcaaactccggcacggcatttgacatgaacttcacgcctctcctcccttctcagcttctgctgggcagtccatcccagcctggaactccctcagccttcgcttcgccgcagtttgctaatttcggtggcttctcccangccagtgcctccgcacatgcacaaaatcatcaaacccagttgggaaagccaacccaggccgcaccgaacgccggtttgtatcccgggatgatggcaaccgaacgcttgggcgaactctcacttgttgaacggcccacagtctccaattggtggtctggggagggcctggtaatgcaacaattggggantcccggcagcggcaac

SEQ ID NO: 18101 - DNA, 222 bp, A.fumigatus
aggttgattcgctgcagacctggggcgcatttgaatgtcccgggcttttgcctgggagaagccacactgtgcccttgtgagctgccttgcccattgttggatgtgattcatgtctttctcatcatctcattctttgtcttttatttaaacatgctccaatccctcatgatggacactctttcattcttcatcattcaacgcaacaagcattcaactatatag

SEQ ID NO: 18102 - DNA, 441 bp, A.fumigatus
acctgtcttcaaggctctcagaactgtcattccttctcctccatcgtcaggatcattcgctcaaacgtgtcttccatcccaatcatgcctggctcctggtttactgaaggcatggacaaaaccctgaacattaacatcaacgactctctatccggctgccacgacatgtcttcctaccacgccgtcactgtctccagcagacagcatctacacatcagtcgtcaagccagtctacagagcccctcgatgctttacgaggatcttccggagacctactttgccggccactcaggtcgggcgacaaacatgaacaaagtctacagccagacctacatgtacatctgctgcaattgcggcgacgggccgaaagtatacaatgtccagccgagatgcacagagtgcaaccacattgtgtgcggcagttgcaagcctgtcaagtag

SEQ ID NO: 18103 - DNA, 960 bp, A.fumigatus
  unsure (948): Identity of nucleotide sequences at the above locations are unknown.
tatactcatagcgtggatcctgcggcccgcttggtgaagaccctgttcctgacgagtgtgattattttcaccttctttgccctggtggtcatgatcatcgtcctgctgatgaaagtggtctgcgcggtgctggcgaagaaggggcgaacgggtcccgcctggggccacttcctcggtgaatgggacgtcgtcgcccgcggggtgctgtaccgtctggtctttatcggcttcgcgccgctgagcaccttctgcctgtgggagttcacgcagcgtgactcgccggcggagatcgtggtggcggccatcatcctggcctcgatcagcggggcgctggtctgggccgcggtcaagatcatcctgctcatgcaaaagtccatctcgatgcatcgcaacccggcctacgtcctctactcggacaccacctgcctcaaccgctggggcttcctgtacgtgcagtaccgcgccacagccgccagcttcatcctcgtcgtgatcggctacctgttcgtcaaagcgctgttcatcagcctcgggcagacggtgccgatcgtgcagactgtcgcgctgctcgtgctcgagggtctgatgctgatcggggtgagcgtcgtgcgcccatggatggacaaacgcaccaacacgtacaacatcgctatcgcggcggtgaacttcctcaacgccatctttgtgctttttttctccggcgtgttcgaccagccggggatcgtctccggggtgatgggcgtgtgcttcttcgtgatcaacgcggccctaaccctcgtgttgatactcttggtcatctacgcgtccgtcatggcggtcatctccaagagccccgatacgcactacaagccgatgcaggatgatcgcggctcgttcatccagtcccaggcacggctggggccggagctggatgacctaagcgctgtggctccgaggggcatggtcganaccaagtattga

SEQ ID NO: 18104 - DNA, 585 bp, A.fumigatus
agcccatggacgccggtgtccatgcctaacatcaagtcactccacaaactgacagacaaacaaaccgacagcaaaatgcacttcaaactctctactgccgtgctcgccactctcgtcggcgtggccctctcaggccccctcgtggcccgcgacgccgccaccatcctcagtgacctcagcaccatcaagaccgacatcaacactctcacccagcacttcaacgagttcaccggcgacctgttgcaggccctcgccgcccaggccgtcgagcagcagctggaaagcgacatcgaccaggccaccgcggatgcaaaggccacttcggccctgtccgccgctgacagcaccagcgtcaccaatgctcttctgggcttgaagcctgatatcgtcacttctctggacgcgatcgttgccaaggtactcccatcctttctttgtcgatggtgtatcaacgagactaattgtgtagaaaccgcaggtcgactccgccggcgtgggcagcttcgtcctctcggacctgaatgccctgcagagcaagacggatgccctgtccggcgcgcttcaggatattgccactgcgactga

SEQ ID NO: 18105 - DNA, 189 bp, A.fumigatus
aaaccgcaggtcgactccgccggcgtgggcagcttcgtcctctcggacctgaatgccctgcagagcaagacggatgccctgtccggcgcgcttcaggatattgccactgcgactgacaaggataccattgcgtctggcacccaggatattgatgcggcattttccagcgccattgctgtcttttcttga

SEQ ID NO: 18106 - DNA, 876 bp, A.fumigatus
  unsure (109),(165): Identity of nucleotide sequences at the above locations are unknown.
cccgggagattaaagaaaagggcaagggggtatccaccggacggccagggaaaacagggttggtgcggcattctccttcaaggggggcatgacccagcaccctcctccntgatggcatggcggaaggagggcgaaatcgtgacttccttccgcttcagctcgggntatgccatgccagacgtgtacgccggcaacgccaccctcacgcagatctcgtcggccgtcaacgccacgcattacacgctgctcttccgctgccagggctgtctcgcctggaaccacaacggggtgacggggtcggcgccgaccagcgccaagcagctggtgctcgggtgggcccaggcggtcgcggcgccggggaacccgtcctgcccgggggagattacgctgcagcagcacgatgcgcaggggatctgggtggcgaagcttgatgcgtcagcggccagcgcgtcctacgaggcgtgggcggcgctggcgaacaagactgttcctggccattgctccgggggcggcgggggcacggggccggtcggggtgccggtgccgcctggaacgacgtttgattatgtggttgtcggtggtggtgcaggcggcattgtcgtcgcggaccggctgagcgaggccggtcacagcgtgttgttgatcgagaaggggcccccgtctacgggccgctggggtggtaccatgaagcctgactggctggtagggacgaacctgactcggcttgacgtgccggggctgtgcaatcagatctggcatgattccgcggggattgcctgcgacgatatcgaccagatggcgggttgcgttctgggcggagggacggcggttaatgccgccctgtggtggaaggtaacgtcttctcttccgttgtga

SEQ ID NO: 18107 - DNA, 297 bp, A.fumigatus
gcgtttgcactgaagcatgaatggcgaaaccaggctgacaccccatgtgtagacgccgtcgtcatgagccaatacctcggccggggctctacctcccgcggacgcatgaccatcaccgcaaacttggataccgtcgtctcgacgctcccgtacctgcgcgaccagcacgacgtcgacgccgtcatccagggcctggtcaacctgcagaatgcgctgaagggagtcgggctgaactggacctatcctgcgccgaacatcaccgccgaagaatttgtcaacacggtatgtcgcgtctga

SEQ ID NO: 18108 - DNA, 333 bp, A.fumigatus
ttaccgctcctacgcaaactacaaactaactcctacagatggaaatcactgcgagcaccagacgcgcgaatcactggctgggtagggaaccggactcgttttggggaatcatctgctgaccatgatcaaccagggacttgcaaaatgggcaccgacgacggaagaacgggcggcacggcggtggtggataccaataccaaggtctacggcactgataatctgttcgtcgtggatgggagtatcttcccgggcatggtgaccagcaatccctcggcgtatatcgcgattgcagccgagcgggcggcggatcggattcttgcgttggctacttag

SEQ ID NO: 18109 - DNA, 483 bp, A.fumigatus
cgttcgcccacggcgaccaggataatccacccaagtgggacaaactgcaacaatggtatattaccttcttcgtcagtgtgctcaacgccctcacgtacgtttcctgctccattttgcataccctgtgtgacaacccaccagctggtggtgcgccgaaggcatcttgtcggcagccaccggcatcgccgaggattccatttctccttcgaagtcaccacgctttgcgtctcgctgtacgtgctagacttcgccatcggtcccgtcctcctggctccgctctccgagtacttgggccgacaactcgtctacgtcgtctcgtggttcctcttcatcttcagctgccgcttgccctcgcccccaacatcggcaccatcatcctctgccgtttcttggcaggtcgtgccggtgtggacggcgcggttggaggaaaggggggggggggggggggctctgaagtctattctggttaggtgggtgatttaa

SEQ ID NO: 18110 - DNA, 576 bp, A.fumigatus
cgggcaacaaacaaaaagccatatcccctcgactggacctacaatttccccgcgggctggcaggcggaggacatggtctccccgacaaaccgggtcttcaaccgcattccgtggactgttcgtccttccgccgacggaaagatctatatgcagcagggctacagtgtcatcgcgggcggcctgcaagcggccggctggcaggaactgacgctgaacgacaacccatcggcgaagaaccatacctacggccatacgccgtacatgttctcgcacggcgagcgcggcggcccgctggcgacgtatcttgtgtctgccagtgagcggaacaactttaagctctggatgaacacgaccgtcaagcgcgtggtccggacggctgacggacatgtcactggcgtggaggtggagcccttcctggacggcggatacgagggcgtcgtcaacgtcacggcgaagacgggccgtgtcgttctttcggcggggacgttcggttcggccaggatcctgatgcgaagtacgtgccttttgtttcttgctttttggttttgtctttttttgtctcatggattgtgctaa

SEQ ID NO: 18111 - DNA, 225 bp, A.fumigatus
tggtcccgtcctttcggggacggcctcggcctcttttgggtcccggaggaggtggtggctcctgaccaggcggatactttctgggacgacctcttttcctgggctcgcccgtgtaaggatcaattgcaggctaaaaacgaagagtcaatattagtgcatgttcatcccaagtttttatcgcccttttccggtagcctgagtgagcaatcgtatttctatggatag

SEQ ID NO: 18112 - DNA, 222 bp, A.fumigatus
ccctgccaagaagatccgtctgatcatggcccaccccgcctccactggccggtaacaccgccgaaggtcctccgtgtggttgatgccctccagaccaccgacaagcacggcgttacctgccccatcaactggctccccggtgacgatgtcatcattccccctccagtctccactgaggatgctaacaagaagtttggcgagatccgtgaggtcaagccgtaa

SEQ ID NO: 18113 - DNA, 252 bp, A.fumigatus
agcgccaatggcaccgactcccacaaggcctggatcaaggacatcgacgaggtcaatggctccaagctcaccttccccatcattgccgaccccagccgcaagattgcccacctgtacgatatggttgactaccaggacactaccaacgtcgacgagaaaggcatcgctttcactatccgttccgttttcattattgaccctgccaagaagatccgtctgatcatggcccaccccgcctccactggccggtaa

SEQ ID NO: 18114 - DNA, 264 bp, A.fumigatus
ttatttctttcccatcatcccgtgaacatccttgagcacagttctcagctcatcacctcaagcttccaggaagaaattaaaatgggccgaaagcgcaagtccgaaggcgctgccgatagcaaccctccaaagagagtgcgtaagcctaatttcaatgcggatttcctcttcattggtctctccatcgattccaagctgcccagcgcgtcatgcgagggccatagttgccgtcaatccgcgaatgtgcgattctcggcagcttga

SEQ ID NO: 18115 - DNA, 294 bp, A.fumigatus
ctaacgtatactttggcgcatcatacagagtctgcattcgaccctgctcacccgtactacgacccaaagtcgaaaagagacaacccaaaatgggaagtcgttcacgtcgagttccgtcgcaaattcaagaagatggtcacactcaacgacctcaaggctcacgcgacgcccggcggtcctcttgaggatctacaagttctgaagcagactcgactcagcgtttcctctgtgacgccagcacaatggaagttcattctggggttggcgggcgagtcatcagagtccgcggaataa

SEQ ID NO: 18116 - DNA, 282 bp, A.fumigatus
ttaattaaaatagcttcaaatatcaaaatatctaaaattagtggttacggtgcaattggtggttacggtgcggcgcaccctcaacgcggaagcggtgagggtgcgtatggcacggatactacttactttagtgtggtgcgggcttcgaagcggtcgctcgttcaaatggtccaggcaatcaggcactgcgatccaatgatatggatggagaacattgtggggatactattagcttctgtctatttacggactacagagttctgtcttgttcgattgatttga

SEQ ID NO: 18117 - DNA, 663 bp, A.fumigatus
cgccgtgcttgtcggtggtctggagggcatcaaccacacggaggaccttcggcggtgttaccggccagtggaggcggggtgggccatgatcagacggatcttcttggcagggtcaataatgaaaacggaacggatagtgaaagcgatgcctttctcgtcgacgttggtagtgtcctggtagtcaaccatatcgtacaggtgggcaatcttgcggctggggtcggcaatgatggggaaggtgagcttggagccattgacctcgtcgatgtccttgatccaggccttgtgggagtcggtgccattggcgctctagcggaatgtcagcgaacctattcatgtcttgggaacccctggatccagcttacaagaccaatcagcttgacattgcgggcagcgaactcgggctcgagcttagcgaaagcaccgagctcggtggtgcagacgggcgtgaagtcatcctattccattagagatcagccttctttctttcaatcgtctgggctattcttgcacgcggcgatctgggagatcggaggtactaacagggtgggagaagaggatagcccagctgtcgccaatgaacttgtggaaggagataggaccattggaggtatcagcttcgaagtcaggggcagtagagccgagacggagactgttggatga

SEQ ID NO: 18118 - DNA, 348 bp, A.fumigatus
aattcttctgtgagactgactgcgcctgaagccccaaattcggcacccgaaactccccagggcccgaagcgaccagtgggaagacccaggaaaaaccccgtacagaacggaaccgagacaccatcgcgaccgatactctcagaatcggaagagccgaagattgatgatgaggagagtgaccggtcatattggttgatgaaggcagagcctgagtcgcgcatggagaaaggagttgatgtcaagttttccattgatgatctgcaggcggctgagaagccagagccgtgggatggtaagtctctggattctggtccccttcaatacaatggaatgctggatcggagctga

SEQ ID NO: 18119 - DNA, 1128 bp, A.fumigatus
ccaagctgttcatcgagagaggcgctgccggaatccacattgaagatcaggcccctggtacgaagaagtgtggtcacatggccggaaaggttctcgtccctattagcgagcacatcaaccgtctggttgccatccgcgcgcaggcagatatcatgggtgagtagacacatgcagattgcccattccaccagaatctcagctgacaagaccgcaggaaccgacctgcttgccatcgcccgtaccgactctgaagccgcaacactcatcacctctaccatcgaccaccgcgatcacgccttcatcgttggctctaccaatcccaacctgcagccactgaacgacctcatgctggctggtgagcaggctggcaagactggcgaagagctccaggccatcgaggatcagtggattgcccaagctggtctgaaactgttcgacgatgctgtcgttgacacaatcaaggcgggcgtgcacgtcaacaaggatgccctcatcaaggagtacctgactgccgctaagggcaagagcaacagtgaggcgcgtgcgatcgccaagggcatcacgggcgttgacatctactgggactgggatgctccccgcactcgggagggctactaccggtaccagggaggaacgcagtgcgctatcaaccgtgctgttgcctatgctccgttcgcggacctgatctggatggagagtaagctccctgattacgctcaggcgaaggagtttgccgacggtgtccacgccgtctggcccgaacagaagctggcgtacaacttgtcgccatccttcaactggaagaaggctatgccgcgtgaggagcaggagacttacatcaagagactcggcgctctgggctatgcctggcagttcatcaccctggctggtctacacactaccgcgctcatctccgaccagttcgccagggcctacgcgaaacagggaatgcgcgcgtacggtgaactggtgcaggaacccgagatggagcagggtgtggacgtggtgacccaccagaaatggagtggtgccaactatgtggataacatgttgaagatgctcaccggcggtgtcagcagcaccgccgccatgggtaagggtgtgacagaggatcagttcaagcactga

SEQ ID NO: 18120 - DNA, 237 bp, A.fumigatus
ctcagctcctgtcccgcccatccccgccctgaaattcctcttctcagttgtaacttgtcacccttcaacttttaccccttttccatcatggttgcgtcggacattccccctcttcaatttactcctattgaagatatccaggagcgcacctcaagactgcgcaagtcgtttctagagcacaagacgcgcgatgtcgaatttcgtttgaagcagcttcgcaagctctactgggcgtga

SEQ ID NO: 18121 - DNA, 876 bp, A.fumigatus
agtgcattcaacttcccctttcaattgactcttggaccggtcattggcgctattgctgctggtaatactgtggtaatcaagcctagcgagaattcccccaagtgcgccgccgtcatgcagcagattgtggaggcttctctcgacccgtcatgctacacgctggttcaaggtggacccacggaggtccaggccttgcttgctgaacgatgggacaagatcttctttaccggaggcgccaacgtcggccgtatcatcgccaaagcagccgctcctcatctgactcccgttgtgctggaactgggcggcatcaaccccgccatcatcaccaagaatgccaaccctagactggttgcgcgccgtatgctgtggggtaaaacgttgaatgccggccagatttgcacatcgcagaactacctcttggtggacagagccatcttgcccgctgtggttgaggagttcaagaaggcctacaaggaattctacccccagggcgctaaagcatcgccggattactctcgcatcatcaacgagggtgccttccgtaagctgaagtccatgatcgataactctaagggaaagatcctcatgggaggaaccatggacgagaacgaaaggttcatcgaaccgacccttgtccaggtcgattcgcccgacgactcgctcatcgtccaggagagctttggcccattgattcccatccttcccgtcgacaacctcgaggaggccgtcaatatcgccaacagcatccagagcactcctctgggtgtataccccttcggtaacaaggccgataccgacaagagtaggtccaccacactttcccgtaggcaaaaccctgcaaccatacttgacacaggaccaacccatctgacgtga

SEQ ID NO: 18122 - DNA, 375 bp, A.fumigatus
tctacagtcctttccatgactcgctccggcggcgctgccgtcaacgatgccgccctgcacatccccacgcttcccttcggtggtgtcggggagagtggccacggcgcctacagaggaaaggccagtttcgacgtcttcgtgcaccgtcgccccatcaccaccagccccggctggctcgaggcgatcctctcgatccggtaccctccgtatgccggaaaacttagcaagttcaaagtcgccagtaccttggtgcccgatttcgatcgcgacggcaataagcttcggttcggctggctgcgcacaatccttactctcggcgggggaaccgcgaaggctggtgccggcagggcagcagttgttgcagctggtgagtaa

SEQ ID NO: 18123 - DNA, 306 bp, A.fumigatus
cagagcaacatcactgacctttctcctctccagaaaaaagttgccagtttcacctatggctgtctggaaccaacaatgctcacccagatggccaagtacctcgacaccgtctacgtttccggctggcagagctcttccaccgcctcgtctaccgatgaaccctcccccgatctcgctgattaccccatggtaagctcgtatttagcctcgaccctatgctctgttgggctcgtgctaattccgtattgcgcagaacactgtccccaacaaggtaaaccagctgttcatggcacagctgttccatga

SEQ ID NO: 18124 - DNA, 381 bp, A.fumigatus
accatccacccactcatttgtttttggggcttctttctaataaatcatgcctttcttttcagtatcaaggaccatgaggagcagatcgtcgaggccttggcccaggatctgggcaggccacgtttcgagtccgaagtcgccgagagtttatggatggagaatgacatcgtgtttgtgagccggaatcttcacaaatgggttaaggatgagaaggccgaggacatcgacttcaactacaaatttatgaaccctaagatccgtaaagacccgctgggttgtgttctggtcattgggtatgagctagcgatttgcgacttgccagactatatactaacgctcggcggttcgaataaagtgcattcaacttcccctttcaattga

SEQ ID NO: 18125 - DNA, 441 bp, A.fumigatus
aacctcttcatacctgtcacaatgggtttccttgaagacgaagaccagaaatactgggacgacgtccaagccgtcaaggcctggtggaaagactcgagatggaggtacacaaaacgcccgtacactgcagagcagatcgtggcgaagcgtggaaacctgaagatccattacccctccaatgaccagagcaagaagctttggaagatcctggaaagcaactttgaggtacgcaggtttgaacgcagtgacagagcaacatcactgacctttctcctctccagaaaaaagttgccagtttcacctatggctgtctggaaccaacaatgctcacccagatggccaagtacctcgacaccgtctacgtttccggctggcagagctcttccaccgcctcgtctaccgatgaaccctcccccgatctcgctgattaccccatggtaa

SEQ ID NO: 18126 - DNA, 366 bp, A.fumigatus
ttccgtattgcgcagaacactgtccccaacaaggtaaaccagctgttcatggcacagctgttccatgaccggaaacaacgcgaggaacgcatcacaacccccaaggaccagcggagcaagctgcctaacatcgactacctgcgtcccatcatcgccgatgctgataccggccatggtggtctcactgctgttatgaaactgaccaagctgttcatcgagagaggcgctgccggaatccacattgaagatcaggcccctggtacgaagaagtgtggtcacatggccggaaaggttctcgtccctattagcgagcacatcaaccgtctggttgccatccgcgcgcaggcagatatcatgggtgagtag

SEQ ID NO: 18127 - DNA, 936 bp, A.fumigatus
ataccccaacgtccgaattgtgcatggagacctcgactccgccgatgtgatcgaggaagaagtcaagaatgcagatatcgtcttccgtacgtgaacatcctccgctaccagcgaactatagactcacttcgttcagattgcgccgactgcgaccacgttgcttccgccactgctatcgcaaaaggcgctacccaccacacacctgaaaagcctctctggctaatccatacatctggcaccggcattctgactgtcgaagacttccgtgccaacacttggggaatcgagcgtaccaaggagcataacgactgggacggagtggacgagctgatgaacctgcccgacgactccttccaccgaaacgtcgacaagatcattatcggggccggccagcgtgctcctgacagtgtcaagacctccattgtttgccctcctaccatctacggccccggccgtggtcccggcaaccagaagagtgtccaggcctactggctagcttctgccgtcctgaaaaggaagaagggcttcctcgtcggcgagggcaagaatacctggcaccaggtgcacgtccaggatctcagcaatgtgtacctggccctaggggatgccgcagcggcaggatgcggcaaggccacctggaacgagcaggggtattacctcgccgagaacgggtcgtttgtctggggcgatatttcccgtgctgtggccaaggtggcatacgagaagaagctcattccgtctcctgatgtcgagccattgtcagacgagcaaatcacggagctaaatcagtgggggctgtatgcatggggaagcaactcgcggggccatgccatacgcgcgaggaagctgtttggctggtcgcctcaacagcctagtttgatggaccttatccctcaaatcgtggagattgaggctaaagctttgggactaatgtaa

SEQ ID NO: 18128 - DNA, 270 bp, A.fumigatus
ccgcgatcctcgcattgctgcttggaattacgttttgctggagctctctgcggttctttgatcgattcagccaacaacacaagacgacaactcgtctccgcactatttaccaccacaggtcgtcctctccatcgtatattccttttcgtcccatatatacattctccttttagttgttggtttgacttcctggcatgtactgacagttttacttacaaagaccgctacatgagttgcgacctgtcggaaatttcgcggttttctctatga

SEQ ID NO: 18129 - DNA, 1764 bp, A.fumigatus
  unsure (1761): Identity of nucleotide sequences at the above locations are unknown.
ggtgctagattggacgaagctgtcatggctccaggtgccggaggaaagaggaagagaggcgacagatcgtggtctggcgactccggcaacgacggactacggccatccccccaccgaccgggcaatctcaacatggcgcaacacaaccacggctcgcattcaaatcaccctcgcgactttcccgaaacgcgcggtcgcgtacgaagacaggctagtcgaggcgggaggaacagtaataaccttagccgacgacctagcaatgacattccgaacgtcaacactggacagaaggattcgcccatgtctccgcctgccagagatgtacctgattcgagccagacaaatgggtttccaccgacggtagctgcagctagtataccgccctcgccgtctcctgcgccgactgtacagcagacgcccgcacaagcgcaggcatccccgaagcctcagtcacagtcactgccttcgcctgcgcctcccgtcaggcctccgccaggtccaccgccgccttacgattacgaatatgtcactgagagtgtagttgaagattggatgtcaacaggaagacagaaggtcatcaaggatggcgtgcaggctagggaccaggaggatgcgtcgacattggcttcgatctaccaggaaatcatcagagctgcattctacggccgtttgtcgcccacagacgccggatcggtgatcaaggagattattggtgaagaggttgcagctcaagatatcgatatggttgacgaccggcagccctcagcagctcttgacacgcgctctttgttcttggacaccctgtctattcttaccgatgccgatcctagcaatcctgccctgaggccgctggttttctccacaggaatcaatgctgcccttctgcgcctccaactcgaaactcccgtccttcagacgctgggtcttgttcgtgatacctttactcgcatcggcattcgtaaacaaaccaatcttctgtaccgacagtccaactacaatttgctacgggaggagtcggaagggtactccaagctgttgaccgagcttttcactactagcaacaatgaaccacccaccagcgaggtcgtagaagatacctttgagagggtcaaggctatgattggagcctttgatatggacgttggccgagtcttagatgtcacgcttgatgtcttcgccgctgtgcttgtgaagcaatatcgcttcttcgttaagcttctccgagttagttcctggtggcccaaggacgatatttcccgcactcttggtggaaatgaccgagactctggtctaccgaattgggcactaccaggttctgcagggtgggttacaacggacgaggaacgagccgagatcatgcgagccaatgagcagcgagaccgcgaattttggaaccgagtcagagagattggtattcgagcatttttcgaaattgggaggaagccgatatccgaagaggagagaaagcggatatttccagagagcacgactctgtcagaagaagagatggaaacacggaaatggatcgaagaaacaggaactctacccccaaaagggaacagggtcgcagcgcagcttcttggtttcaagcttcgcttctactcgtcgaaagcgcgggacaagtcagatatcctccccgacaacctcatctatcttgcagctcttctgatcaaggtcggtttcatatcgcttcgcgacttgtaccctcatctctggagacgtcttcaccacgggggccgaaggatccgcgctagcgtctantaa

SEQ ID NO: 18130 - DNA, 1020 bp, A.fumigatus
  unsure (53),(60),(71),(130): Identity of nucleotide sequences at the above locations are unknown.
catctcatggactattcggccataactcaggacccggatcatccctcgggcantgatccntgggcatctcntcgagcgactcagtcgtcttacactgcatctaacaacaacgatattcccccttcgccgntacccccgcaccatcagcccagttacaatggcgatcaggagggcgatgactttggaccaagatcgtccgagaacggagcccccgactcgcctgatctatctgcgcgacttcaaagtgcgcaattaggagaccctgactatgctgttgagcagccaccgtacgcgacacaagcccagtatacgaacgagcctcggtctcagcttcccgggcgctctcaaaccggagccagacagaatgctaaaaatgggcctgcgtataagatccaagctaagattacgggactggagaggacgggaaagaaggatcctatcctacggtttgatgttcatgtaagcggtgttcttgtggcattcggttcgcctgcggtaaaacaaactgacgtcggccatcagacgaatgttcccaaattcaggacaacacagtaccgcgatgttcggcgtacccatgccgagtttgcaaaactagcagaccatctgatctccgcaaacccggaggttcttgtccccgcagtgccgcctccattgacgcccgccggtgccgggaccgaggaggacgagatccgagtcaaggcatcgatgcagcggtggctgaacattgttatgagcaatgagattcttatgcaggatgacgaggtggttctgtttgtcgaaagcgactttggttatagtcctgtcgttcgaatgaagcagcctgcaacaggtgttcggaggaaggtcctgaagcaattcgccccgccgcctgatgatacccctgaactgcaggatgctcggcctattgtgaagatgttctaccttggaactatggatgccagccataaggttgaccgcgtggttaaggctcgtcgaggtaggtgccttgatgtctctttgggctggaagagaattcactaa

SEQ ID NO: 18131 - DNA, 885 bp, A.fumigatus
tacaaattccgctcaggactcggcctcgctgaatccgatttcggcgtcaaattagggcagatgcacgtgcaggagacacaccccggcctagctaatgcctataagaaattgggaaaggttattcaaacggttggagactaccatgcggtccaggcgaccgccgaggcgactacgcttgaagatcccttgagctatcactcctcagatgccttcattgttaaggaaacactgactaatcgtcacatccttctgcgcgaactcatccaagctcagcaagccacacgcagcaagcgtgcagctgcggaccgactgaaggtcagctcgtccgttcggccggataaggtcgacgaagccatcaatgccctggacgaggcacagagccatgaggattatctgaccaagcggacacaacgcgtcacttcgaaccttcttctggagaagcgtgcctggttcgagcgtacctcgaacgatatgttgaacagtctgcgcgagtatacccttcgccagatcgaagcggagcggagaactttggcgactctcgagagtgtccgtccggacattcggtctatcgactcatccggtggacttagccgcctaggtcgtgaagcacacccggctgtccgccgggcaaacctcgcttccagtcaaggtcctaagggagacgcatggagtgggattccgcgccgtagtgacagtctcggacgcagcttgagtggtagcttcgttgcgccagcagtagatgaggacgatgagactaacaggtcaggcacagccaaaggacgattgcggtctcccagcggcgttggctcgatcgtggtggacgatgacgaggatcggctcgatgccaagaatgccgccagccgattagccaccagcacattttga

SEQ ID NO: 18132 - DNA, 243 bp, A.fumigatus
tcatactcacatttgacctcgttttccagcacaggtgttaccgggtacattggcggagacgtcttctacgctgtctcccaagcacatcctgactggcagatttccgtcctggttcgcaacagagagaaagcggctcaacttgccagtaaataccccaacgtccgaattgtgcatggagacctcgactccgccgatgtgatcgaggaagaagtcaagaatgcagatatcgtcttccgtacgtga

SEQ ID NO: 18133 - DNA, 732 bp, A.fumigatus
  unsure (15): Identity of nucleotide sequences at the above locations are unknown.
aaaggagtgcttgtntggacaacattgccattgcatccagtgctacctatcatcgacagatatgggatgatccaaggatgtcagaatactctgtacaacacgagaataacccctcatgacgtcgtccatcacagtaatcagtttgacaaaagcaacatcctccaagtcaaccccattgaatcttacctccacggttcaaatgtagataatccctacttttatcaccaaccgagagtacagcacagaacaacactccaagcttctcacgaaatggcatccgacctcatcacaggtagctgcgcctgccgccacatctcctacacggccagccagcccccgtcagacgtaacaaattgtcactgcaccacctgccgcaaacaggccggcgcaccataccagagctgggcgacatttgccccaggctcactcacctgggacaaggacaagctgccctcagtccggagatccagtgcctttgccacccgcgggttctgtccgaaatgcggatcgagcgttagtatgaagtatgactacgagccagagcttctcagtgtgactacggggactattgacagtgcgcatcaaggaaagatcccgaagccgtcttgttatctctttctgcaggagaaggtggcgtggtttgatatgcctgatgatggcgttgagcggtgggatcggttttcgccggacatggctgaaagtttggagaaatggcagacaatgtcgagctga

SEQ ID NO: 18134 - DNA, 240 bp, A.fumigatus
caaattgtagttggactgtcggtacagaagattggtttgtttacgaatgccgatgcgagtaaaggtatcacgaacaagacccagcgtctgaaggacgggagtttcgagttggaggcgcagaagggcagcattgattcctgtggagaaaaccagcggcctcagggcaggattgctaggatcggcatcggtaagaatagacagggtgtccaagaacaaagagcgcgtgtcaagagctgctga

SEQ ID NO: 18135 - DNA, 684 bp, A.fumigatus
ggagatcccattgctagcggatcttccctctccatgtcttcccacaccaagaaagatgatttctgcctcgaatgtcactgggaggcctttcatctagatggtaaggactcccaggacggcgcggaggcctccgctcaaccgccagaatggagttgtctggacgaggaccatcatcacacctcgctggcgcattgtgctacaattgacgaggcgtgctgtgatgtggatgactgttccgttaactgtccttccgtctgtgacggcttcagagaatgtgatgaggcaactgcttgttctttatcgcactgtgacgacaaggattgcaaaagcacggacgcagtctgcttcgatgaacactgctttagctttgccgaccataacggacaagccgccgatcataacaatctagactcaatgctgggactggcgcagccactgtcactggaagcctgcggcctacttccgtcgtcgaccatcgatcagaatcaaatgcaagtgccatccaagcgtacagagaatgccacatcgggctttgtcaacacatcacagtgtgcggacgcccctgtttccttttccaacaacgtttcatcattgtcatcgttcatatccccacttccagtgccatcctctgcccggagattcacacaatcaccttgggaatgtgccatttcccctgccgaataa

SEQ ID NO: 18136 - DNA, 1011 bp, A.fumigatus
  unsure (1007): Identity of nucleotide sequences at the above locations are unknown.
attccacctggtgccggtaaaccgagtacaaccttgagtatatacatgatggccaaaccaaccatcgtcctcatcggtacctgcgacaccaaatgggacgaactgtgcttcacacggtcccaacttctcattcacaacacctgcgccgtcctactcatggacatcggccgcaccccgagcccacatcgctccatcgccatcaaacatcccgacttaacaagcactgatactgacactcacaatgcccccaaactatcgaatctcccccgctcagaatacatccaccggatgaccagccacgccatcacggctctcacaaacctccatcgcaccggctccatccacgccgtgctaggtataggcggctcctgcggcaccgccctcgcagccgccgccatgcgcgctgccctgcccgtcggcttccccaaactcatggtctcgaccatggccagcggcgatgtatcgccctacgtcgaggagacagacctaaccctcatgtacagcgtcgtcgacgtcgcaggcacgaaccgcatcctgaaccgcattctaacgaacgccgccgcagccgcgacagggatggctgtgtcgtatgcgtcgcacgcgcaagcaccctccgacactagccacagcaagacacagatagccatcaccatgtttggggtaacgacgccagcagtgaacaccattcgtgaccgtctgcagcagacgatcaactgtgaggtgtacgtgttccacgcgacaggagccggcgggaaagcgatggagcggctcatccgcgagggccagctcgacgccgtggtcgatctcaccacgaccgagatcgccgatgagatcgtcggcggcgcgctctctgcggggccgcggcgtctcatcgcggcggccgaagcgggcctcccgcagattgtcagcgtgggtgcctgtgacatggtcaattttgggccaagggagacggtgccggcgcggtttcgcggtcttcaccacggggctggaagaacgagcgctcaatnggga

SEQ ID NO: 18137 - DNA, 423 bp, A.fumigatus
ttctacctctttttctgtctctcacctatccttgcacataaaagtagcaaaaaccaactggaagcaaaaagaagttgcatcaaaaatgccccgtccaacaacccgtcaagaagtgctggctcgactccgccagaccatcgccgagggctcaatcatcgtcggagcaggagctggtgcgtcccacagccattgacctacctccagccaaagcaactgataatacaatacgcaggaatcgggctctccgccaaattcatcgaaaaaggcggcgcggatctgatcctcgtctacaattcgggccggttccggatggccgggcgagggtcgctggcaggcatgatgccgtactcggatgccaaccaggtcgttgttgagatggttcgtctcctacgtacgttctgcatattgcacttacatggctaa

SEQ ID NO: 18138 - DNA, 966 bp, A.fumigatus
tcagacactctgaataacaatgttgcggcctttggaaggaaaattcggtatcgtcactggtggctcacggggtatgtcgacagtctacacatctacacttcaccatcacaggctcagctagatgaaacaggcatcggcgaggcaatcgcccggaacctcgcggcaaaaggctgctctctcctcttgaacttcacctctgagtcctcccgcgcccgtacagaggagctctgcgcctcgctggcctcgacgcactcgatccgctgcgtcgccgtgcaggccgacctcctccatgccgaagaagccgtcccccagattctagcagccgccaaacaacacttcacctcgcccgagggcaagttccagatcgacgtgctcatcaacaacgccggtgtcagcgccgaccgcttcctcaacgaccctgtcaaggggcccatcgaccgcgagtatttcaactggcactacagcatcaacgtgctcgccccgctgctgctcactcaggcctgcgccccgttcctccccaccgatcgctccggccgcatcgtcaatatctcgtccgtctcctcgagcattgggttcacgggccagagcgtctacggtgggaccaaggccgcgatcgaggctatgacacgcacctgggcgcgtgagctcgcggaccgcgccacggtcaacacggtcaatcccggccccgtcatcggggacatgtattttgcgaccggggaggagttctggaagcagatgcaggggttccaggatgcgacgccattgagtaagatggatgaggatgatccgcagttgaaggagttgagcgaggagcagatctgcttgatcaaggagaagatgggtgggcggcggccggcgttcaccagcgagattgcgggggtggtggggatgctgtgtacggccgatggtctgtggtgtacggggagtgtggtgtgtgccaatggtggtatgaaaatgggattctag

SEQ ID NO: 18139 - DNA, 702 bp, A.fumigatus
tgccgtactcggatgccaaccaggtcgttgttgagatggttcgtctcctacgtacgttctgcatattgcacttacatggctaacaatacgtgccaggcaaacgaggtccttcccgtagtggaacatacgcccgtcctcgccggcgtctgtgggacagaccccttccgcgagatgcgctcgttcctggcccagctgcgcgggctgggcttcatcggcgtgcagaatttcccgacggtcggcctcatcgacgggaaattcaggcagaacctcgaggagacggggatgggctacgaccgggaggtggagatgatcaggctcgcgcacgagatggacctcgtcacgacgccgtacgtctttaccgtcgatgagggggagcgcatggcgcgcgcgggcgccgatgtcatcgtcgtgcatgttggactaaccacgtcggggaccattggggcgcagacggcgctgtcgctggatgagtgtgttggtgtggtccaggcgatccgggacgcggttgtcagggtgaatcctgaggtgattgtgctgtgtcatgggggcccgttggcgggtcccgaggacgcggagtatgtgctgagtcggacgcggggggtgcatgggttctttggggcgagtagcatggagaggttaccagttgagctggcgatccaggagaatgcgcaggcatttaagcggttgaagatccgtcagtga

SEQ ID NO: 18140 - DNA, 237 bp, A.fumigatus
tcaattgatactaaagacaatgacctccctccgactcaatccgtcaaccctccgcttaaccccccaactcaccaaacctctaccctcccgtatcctccgcgcctccatcacatcatctctcgccctcaggcctctatccgctcatcccctgaggcgatcaccactcgcacctgtaccttcgttcaagagaattcctccatcagcaagccccttctcaaccggaaaatcccaagctga

SEQ ID NO: 18141 - DNA, 357 bp, A.fumigatus
cgaaacagctacgaaaccgccaaagacgaattcgagatcgctaccgacagcaccgccagctccaccatctacgccgcctcggaccgcgagtccgcccgcgatgccctgaaccagttgcttgccgtgtacagcctctacacgaccgatatcgcggccacggctgagtcgcatgcaccgcaggagttgcagcagggtgatgatgctgctgacgagaggggccagttggtgaatacggatttcgatccgtcggagatcccggcccccgtgcgcgatgaggtgcggagacgggttgggcagcgggtgcgggagttgagtaatgcggtggaggcgttggaggagagggctcatgttgaatag

SEQ ID NO: 18142 - DNA, 216 bp, A.fumigatus
  unsure (210): Identity of nucleotide sequences at the above locations are unknown.
cttacccctgcaggtcttatctacaatcccttgggtgcctggcttcatgacaaggtcaactcgcggcggggtatgtacatcaccggtttcgttggaatcataatcactacttcatgcttggctgcaatgaccgccgaatatgcgggcacaacaaacaaggccggaaacgcctttggcattctgttcatatatctctacctggcgttccangggtaa

SEQ ID NO: 18143 - DNA, 525 bp, A.fumigatus
aaacgctacgcgtgctattatgccaaggacattggctcgttcggctggaggttcccgctggcccttcagtgtctgccacctcttgtgctcctcgtcggatctccatggcttccgcgctctccgcgttggctcatctcaaagggcaagcacgaggaagccaaggtcgtcttggagcggctccgtcagtcccccgacgacccggacaacctcgtcgcgaaggaggagtattatcagactgcagaacagattcgcttggaatctgagaggctgtccgagtacggcaatgtgtggaaagcagtcgtgaagaagaagtcgtacagaaagcgaatggtcatcgggttcctaactcagtggggagcagaatttggtgggcccttgattattgttagtatcctgcttgtcaaggttgaatcaagcacttacaatctgacagaacaactacgcggttttgctatactcaaatctcggcatgaagggcggtatgcctttgcttctgagcgcagtgtggctgacaacagctggtga

SEQ ID NO: 18144 - DNA, 297 bp, A.fumigatus
gatcttcccaacggagatcagacccatcggcatgggattctccctttttgggcagtttgccggtatgttcatcccggttgtatggtccgaacagcaactaacatggatgcagctaccctgatcttgcttgagactgcccctatgggcttcaacaatattggctggaaatactacctggtcatcatctgctggtctgcattcttcattcccggtaagacggacacgcaagtgctcgacgaaacttccactaatgcctccaagttatttacttcttcttcccggagactgcacgcttga

SEQ ID NO: 18145 - DNA, 384 bp, A.fumigatus
cacaggcaatcagacaagctatcaaaaatgaagctcaacactgtcctctctctcgctccccttctcggcgccgcaaccgcccaaggccagcacgaacaggaaccattcaccctcaacgtccgctggtccaacagcatgggaaccctcgagggcctcctgaacgccaactccggcgccttctggagcggcaagcctaccgtctcctcgtgcccggagaacgtccaggactgcccagccgtcaacaccacctccttcgtctcgcagggctcgaagctgttcctgaatgttgctgtgcccggcggtcagcagggtattgctcgccttttcttttcttttcctttccttccccccagtagtatttttttttttgggcgacagcggtag

SEQ ID NO: 18146 - DNA, 309 bp, A.fumigatus
tatcttttttgtggtacagtctacatctcccccgagggccagctgacctacacagtcccgcacagcggatacatccccgacggctcgctcgccgacctccccatcatgaaggacggcttcctcaaccccttcctgacgctgtggttgtgctccgtcgacaaggacgccaagcagtggaaggtgtgggccgagtacaccaacggcacgacgggtgcgatcaccaacaatggctccaatgggcagagtgcctgcacccgatttgcgctcgaggcccagccgtacaagggagataaggcttgggagttctga

SEQ ID NO: 18147 - DNA, 201 bp, A.fumigatus
tcgccgttgatttcggcaatactagatgcgcgttcattcaatgcacgcttgagagttggggtaatgtcagggttactgacttctgggcaatcgcctgtgatctatcgaatcgctcttctcaaggcatctaaagcattgttcatgacaatgggtaacgcccctcagagttcttttctctctgcactgatcgcatggaactga

SEQ ID NO: 18148 - DNA, 270 bp, A.fumigatus
ccccaaggttcggcatttcataaactctttcgctttacaaggctaaccgcagtgtttcgtcaggaacccaaactctggtacggaattggtatcttatatgatcgctatggctcccttgaccacgccgaggaggctttctctcaagtcatgcggatggctcccgactttgagaaggccaatgaaatctacttcaggctcggcatcatatacaaacaacagcaaaagttcaaccagagcttagaggtacgctcatcagtctcttatctataa

SEQ ID NO: 18149 - DNA, 387 bp, A.fumigatus
gcaacagaaggacgtaagttgtatcgcatcctcattcggctgctcatatataggctgacaacattacagtttgactccgctcaggcagcctataggagggtcctggaccgtgacccgaaccatgcaaaagtactacaacaactcggttggctataccatcagcaaagcaacagctatgctagtcaagaaaaggccattgaatatcttgaaaaatcagttagcgcaggtaagacgtcagctcacgtcctcgaccctgagcaagcgctaatcctgcctttttttagacaacaccgatgcacaaagctggtaccttcttggtcgttgctacatgtcgcaagccaagtatcccaaggcgtacgaagcatatcaacaggctgtttaccgtga

SEQ ID NO: 18150 - DNA, 369 bp, A.fumigatus
  unsure (189),(333),(358): Identity of nucleotide sequences at the above locations are unknown.
tatgaatcctgcaacaaccagattgcggatgctcttgacgcttatggccgcgccgctgatcttgatcctacaaatgttcacatcaaggctcgtttgcaactgctgcaaagccagctctcaggctccaatcagaacagcgctcctgcgcccgctcctcaacctcaggacgttcatccacaggcttaccangctcctggtgtgggcgctcctccagctccacagtggggagcgccagctccaaatggaggcccgcatcccccagcatccggatcttccaaggcagatcgccgattggaatcgcggcatcaacgaagtacaatttcagaatcaggngcagccccagccagccaacggtttngatcaccgtga

SEQ ID NO: 18151 - DNA, 282 bp, A.fumigatus
ctggccgtttttgcaattataggtagtcttactgaattgatgggcgatcttgatggtgccatgaatgcttatgagcaagcgcttcgccacaaccaatggtcaatccctgctatgaacgccatatcttgcatccttcggaccaaggaacaatttccaaaggcgatcgagtaccttcagaacatcctcaaattagacccgacgagtggagaaacctggggtagtttaggtatttggaaccctttcaagatcctgatatgtttattgtctcatcacggtgactga

SEQ ID NO: 18152 - DNA, 1803 bp, A.fumigatus
  unsure (524),(668),(693),(950): Identity of nucleotide sequences at the above locations are unknown.
tcctgcctttttttagacaacaccgatgcacaaagctggtaccttcttggtcgttgctacatgtcgcaagccaagtatcccaaggcgtacgaagcatatcaacaggctgtttaccgtgatggacgtaatccgactttctggtgttcgattggtgttttgtactatcagatcaaccagtatcgcgatgcattggacgcttactctcgagcaatccgcctgaatccttacatttcggaggtgtggtacgatctgggaactctggtaagtcaagttgcgaggagtttgtttggggataacacgcgagagaccgaagtcgctgaccaccgctcttgtagtatgaatcctgcaacaaccagattgcggatgctcttgacgcttatggccgcgccgctgatcttgatcctacaaatgttcacatcaaggctcgtttgcaactgctgcaaagccagctctcaggctccaatcagaacagcgctcctgcgcccgctcctcaacctcaggacgttcatccacaggcttaccangctcctggtgtgggcgctcctccagctccacagtggggagcgccagctccaaatggaggcccgcatcccccagcatccggatcttccaaggcagatcgccgattggaatcgcggcatcaacgaagtacaatttcagaatcaggngcagccccagccagccaacggtttngatcaccgtgaccaagttcgtggacccgtcgtttttcagcaaccaagcccacgacaagagccgggtagggcattccctgatggtgtgcgtgctccagcagctcgttctccaaagactacggttacgggctctggtgcatttgcacctgcacacgcattgccccaattgcccaacccaccaccgccgccacatgatcgagctcccaccggtagtactcctttcggttgtgatacacgcggacccttgccacccgctcntaattttgctgcaccccccactggcccgactgggcctaacggtgcccctgcttctgctggacctctgccaccataccctcgcccattcaccccgccgacagagatccggcccattcgcgaggagagaccatcatcacccggttctacctaccctcatcagcagtatcatcatggcccgagcgtgccaattcagggggccagtagcactggcatcgcaggtggtgctcctgctccagcttctgcgatcactgctgccgaagccgctgcaagagaacgtgaagatcgcccaacctcagcaatgaagcggggtcgggaatgggaaggggagtccggcccttcaaagaaggttgccaatgaggaaacccgcgtccgcttggatgatcaagttgctcgccgtgtaacccctccgaaccgcatgccgtcgcctggcgagatgcagcgtcgtggttcctcggaggctcgacgcgaggatcagcgtcgcgtgaacgagagctaccacccatcagaggctgctcaccatcctccaaccctcccatccattcagcacatgcctcaacacgcaaccggttcgagccttcctcccatgaacgatggccctgctccggcttccaacgggcctcaggcaggtgctccatcagcccaggtaaaggaagaaccggctcgcaatgagcaagttccagcccatgagcctgctgcgcgtaagatggacgtcgatgagaactacgatgacgatggagatgacgagaagagaaccagcactgccgctaagggtagtcctgctgccggtagcaacagcaacggggtgctgagcaatggcgcccagacttcccagtcgaaacaggagtcggcctga

SEQ ID NO: 18153 - DNA, 4290 bp, A.fumigatus
  unsure (1015): Identity of nucleotide sequences at the above locations are unknown.
ttcaatatggccccatacatcggtacgcaagagggttctccctcgtcactaggcaccttttcacatgtccagctttccaaagataccaatgttgcatcccagtactgggaagagctctttcacagtgtcggatcacaaccgcggctggcatgcgtgcctctggaccaccaatggcctcgtgcggaaacgacagtactggcctccgacggcctgctggaggcagccacgacgttcagccgtacacacaatatcagcctggcggacttgatatacgccgtatgggctatcgtctcggcaaggcaaacggtgagcggccaatccacggccctgtttaccgtcactggccgcagctaccccagcgccaaacaagacacgccagagaatggaagagccgaacaggactaccccctgcttctatccgtgcctgaggatgtcgatgtgctctcgtgggttcgaagcgtgagcaccgctgcagccaccgcttctgccctgtcatatattggatatgatcggatcatggagaggacctcggggatgcgtccccaagtgaaagtgtcagtcactttcgaggttgacagccacgacacgatggctccagatgatgacttccccttggtattcaacatcatcgcctctgcccgcctgcaactcagcatgcgacacaacgctaccgtcccaaggggcgatgttcgagcgctactggatcgctttgctgcaacactacaacgggtgacagcgaaccatgacgccacagtctcgtcagtggatatcatgcccccagccgaaaggcagctactgctcgactatggcaaagcccctctcaagccgaaaagcggtatggctcattccctgattgaggaacaagcgaaagcccggccggatgcagcggcagtacagtatgaaacagaaccccccctcacgttctctgccctgaacacacgcgcaaatcagctcgcccgccagatccgcccatatggtaccaagtatattgccgtacacctgcgcatgtctaccngattcatcgtggcacttctggctattctgaaatctggggcagcatacgtgatcttaaatcctgatgcgctggcggccggaaatccgtcatcctcgaagaactccagcctgggctgggtcctggtcgatatcagtaccgccggtgagctggctaacgaggtccagctgggaagcctgctgtctcaggcatcgagccatgatactggtgatctcctgcatgtccaggacccaagcagcgttgcatacgtgatttacacctcggggtctacggggaaaccgaaaccgacactgctcgaacaccaagctgtcttcaacgggcttttggcctttcccccaattgaaggtcttcgccagttgctcttctttaatccagccttttcagcggcgcagagatccatttgggccactctcgctgtcggtgggtgcctgtgtctcgcgagcaaagaaaatctaaccgtccacacggcgaagatgatcaataccatggacatcaattcggtagatatgacttcgtctgcggccgcgttaatatcgccggatgatgtgccgtcgctgcggcgcatggtgctgggaggcgagatggtcaatcccgctgtcattcagcgatgggaacatcgagtcgaacttctttcgtcgtacggcctcagtgagtgcacacagctcaactggcgccatcgcttgcaatccaatgtcagctcccgcttgatcgggcagccatatgacacgacgacctcctatatcctcctccctggcaccaccgaacttgcacctctacttgttcccggggagctatgcctcggcggtgctcagcttgccagaggatatctgcaccgccctgacgagacagcgaagcggtttattccaaacccatttgggaaaggcaaactataccgaacgggcgatatggctgttcgccacgctgacgggtcggtcgagctgatcgggaggatcgatttccaagtgaagatcaatgggcaccgggtcgatcccggagagcccaattcaatcattcaagccatcgaggaagtcgaagactcggccgtcgttccggcttcagtgaacaataggacggtgcttgtcgctgcggtcgtcagtcgtcccgacacggagtgggaggctcttgtccgaaaacttcggccattcctggctgccaggctgccactgtacatggttcctcagttctgggtgtccatgcccgccttgcctgtgaacgcaaacggaaagattgatttggtggcaatccgtaggacggtggaggccctaggcgagtccggccagctgcttcccgaacggtcgtccataggatccagggaagaacgcgacttgacggacagcgagaaggtcgtgcggagcctgtgggccaaggttctgtcgctctcggagtcggagatttccctcgaagactccttcatctcactgggtggtacgtcgcttgaagctattcaggtcgtgtcacaactccaggtgctccaccaactcagtctccgggtggaggatatccttcttggtgagacgctgttccaagttgcagccgcggtgcaaccacagcctgtagaggggaaacctgataatgataccatctctgctgcgctgtttgaagtggcgccgtccattgagagcgttggtatcagcatctccagcatagaagacgcctttcctgtgacaccttttcaagaagcggccattgcaaacacgatgatgggcggtacaagttatatctaccgtcgctcctacagcttcgagggctacagcccggacgatgtcaaggccgccttcgagaccctgatgaagtccgacggttggctgcgtacaacctatgtccctcatggaacctccttcctccaggtggtgaagaaaactgccgatctcccttgggagacgtctgacatggacgtcaccgagtacctgcagaaacagacgtcgaaggggatgtaccctggggagctttggtggactgcggcagccttgccgaacaacgtcctcgtcatcaccgcccatcatgcgttgtttgatttttggtccaacgagtttctgattcaggacctgacctcggtgttgcaagggacgccccggatccagcgacgtgggttccgtccctacgttgagtatctccaacaacacgaccccgtcgccatgcaagagttttggcaagggtatctcgaaggtgctgtgcctagccaccttggttcccagattgccccagaaaacacggttgctgccgaggtacactgtgacctgaagcgcaccgcatcgcagcgcagggtcacaccgggcgttcttctgtacgccgcgtgggccattgttctcggccttgccaactcgaccgaggatgtggtcatgggcgtgaccttttctgggcgagatgctccccttgcaggggtccttcaaatgagcggccctactctcatggtcgctccgctgagggtcaaggtcaacaaggttacaccattggacaagcacttggaagatgtccagtctaatctctgggccgtcgccaggaatgcgccgtatgggctgcggaagatcctcaaggccagtggccaggcgaaagatctttttgacacgatggtcaacttcttgatcaaaatccccacctctacgcctgctggaggattaaggcagctgcccgagagcaatcttggaacggtcgaatataccaggattgaacttcgtaacgagagcttgaaccgcgtcacgctgacatccacattggaaccgcgatatgcccaggctctggcagataccctcgcggctattttgggcgcagcctctgatcaaccgctgaccaaacttggggagttcagattggtgcagccggtgccacgactcatggagaggctcgatgatcccgtgggcagtgtgcctgtctctgcggtgcacactatccaggccgaggaccgggtagagagtcctggtggtgagctagctcactcggcgctgcagacaatggccgtctctcatccgtcccggacagcggtcgaggacatctcgggagcgcggatcacgtatgccgggttagcaatcaaaatgaaccagcttgcaggcttgttaagagaaagaggcctggagctggagcagatcgtccccatcatgctcgaaaagtcgattaacaccattgtcgccatgtttggcattctcgtcgcgggaggtgcctttttgcccctcggcccaaaaaatcccccgggaaagaaacttgggaatcctcgaagactgcggtgccaaactggtcattgcggatcagctgaatgcagactttttccacggcacctcccatga

SEQ ID NO: 18154 - DNA, 1068 bp, A.fumigatus
ggggggtacggaagtgcgcgggcgttttacatcaacctgtgcgtcggcgccgtctgtgcccccgtctacctcttcctgcttcccaacaaggatccccgtccgggagtcagtctgcaggagcgcgccaacaccatggaccatatcggaggtatcctcaccatcggcgccatggtgaccggagtgatggccgtgtcgttcggcggtgtgatgtatccatggaactcgggccgcatcattggtctcttctgttgctcgggagccctcttcatcctgctcggcatacagcaggtcttcacgatctacaccagcgttgcccaccgagtggtccccgtcgagttcttcaagagccggacggtgttgattctcttcgccgccacggccgccggaggaaccgccattttcgtccccgtgtacatggccccgctgtatttccagttcacccgcggcgactcgaccctggagtccggcgtccggttgctgccgttcatcatcctgatgatcgtggctgtcatgaccaacggcgccctcctctccaaattcggcttgtacatgccgtggtacctggtcggaggcgttctggtggttatcggcgccgccctgatgtacaccgtcggcctcaccacctcggtggcacatgtgtacggctataccatcctcattggggttggcgtgggtttctttgcccaagcatcattctccgtcgcgcaagccaccgtggccccggagctggttccctctgcggtcggttttatctcgctggcgcagattacgggcatcacgctggccctcgccatcgccaacgcagtgtttttcaacgaaagcgtgaggtccttgaagacgatcctaccgggagtggatcccggccaaattaaggatacaatctcaggcacccggtcggagtttttccagagtctggagccaggcgtccgcgagcaggtactggaggcgcttgtggacgccctcagcaagtcttatattctggtcatgactgctggtgcgttggtggcggtgctcagcctcttgatgaagcgtgagaagctgttccttgctcctcccggagggtcttga

SEQ ID NO: 18155 - DNA, 285 bp, A.fumigatus
gtgcgagtgaagctcaacaatgtgccttttcagaaacagcttctgatgatattactcgccacaggcaacaagtatcataaggtgctgtcaggtgacaactgctgggccattgcaaaccagtatggaatatctttggatcaattctactcgtggaaccccgctgtgaagccgacttcatgccaatctctattaccagattactacgtctgcgtcggtgtcgctggtatgttactttcccgcagccactattcacctcatctagcgatgtacttgttatctgactga

SEQ ID NO: 18156 - DNA, 1551 bp, A.fumigatus
agatgttgtggacaaagcattctgattggtcatattgaaaggaatcacgtgctattgtacgcatttgtcatgtttgtagcttcatcatcttcgccttctacagcaccagggcataatttggggctcattctgaaatcagatggctgtcgaatggatcgcttcatctcgagaaagcggcctcggccgagtccgtcggctggacagcagacgccggcccccgatgaggactccaccgatatgaagttggcgatgctcctatcactctttccagacatagaacaagatgctttactggacattctcatttcaagtggcgggtcggttgaagacgcgtctgctgtgattacagctcaacgcgcatataaacctgtcaaaaagagagcaggtggtgtaccagcgatccagacatctatgacctcacatatcacaactgaggcaggactgccaccaaaaaggcaactcacccggaaaggaaagacgttacatcttttttctccagaagatgttgctgctcatactccgtgttccatcatccataatttcttgcccccagatgaagcagatgcgctgctactggaacttttggatgagtcgaaacacttttcaaggtacaggtttcagctgtttgatcgtacagttgaaagcccgcacacaagcagcttgtatgttgcgactcctgaggaaattcgccaacaaacatcggaatacacctatgggggcagataccgttcgaacgttcgccagcttacgccgtacttgcgcgccgtctctgccaaagttcagcgcgccgtgaacgacgaggttcagaagcgtatacgagcgtgctacccaggtgggaaaaagctcaagtatcagtcacctaaggaatgggtgccgaatgcagcattcgtcaactgctatgatggtccagcagaaagtgtgggctatcactcggatgagctgacttaccttggtccgcgagctattattggaagcctgagtttaggcgtggaaagagagtttcgggtacgacgcatcgttgcgagcgatgacgatgcagagaacaatagtgaggtgtcattcatggtgtcaacagcggattctccgtccagacggaaaaccacgtcgaaagggatcgatggtcgcggtgatgcacagggtcaaatttccatacaccttccgcacaattccctccttgttatgcatgccgagatgcaggaagaatggaaacatgctattgtacccgcgcagactgtttcaccacatcccttgtcaggtaaccgccgtatcaatatcacctatcgatggtatcgggattctctccacccgcgtaacattccgcggtgccgttgtggcacacacgcaatcttgcgatgtgtgcaacgcaaacgtgagaacaagggtagatatatgtggatgtgctatgcgggacatgaaccagggaagaaaggttgcacttttttccagtgggccgaatttgatgacgatggtgaacctctctgggaaatcaagcccacggaaggcggagctcccacgttgcgcaacttcatcgaagaagacgacaaacaatga

SEQ ID NO: 18157 - DNA, 378 bp, A.fumigatus
cctagaggggtacttcgacatttcaagggaagagctggtgaactgggtaagtgctggaccacacatgtgccggttcacaattctgacggcaagtttaagaacccttctctcaaggagaactgtcggcttcagaatggccattcctactgtgttgctgcatcagatttgacgacgcggtccacagattcagccgaagaagcgagtcgtatggacatggcaactggagttgaggctgccgatctgccctctcccacgcagggcggtttggctgccaactgcaatgctttctacaaagttaaaacgggagacagttgctggtccatcataaacgattttggtaacttttcgatctacgatttctaccgctggaatccgtaa

SEQ ID NO: 18158 - DNA, 342 bp, A.fumigatus
tatcagttcgaatatctccttcctgtgaccagtaacagcaaggaatccaccacacactgtatgatgtctttactccattctgaatggactgcgtttctcgcgcagaatccaacagtcagccatgacgacgaaagcagaaacaggcgcttcctctcttccccagaaggtcgcgtccttgccgaacaagtatcaagtgttgacacgactgtccctgccagggacaatcatctgatccctattcggatttacactcccaaagaccactcatctgatgcagtcgtcatattctaccactctggaggcttcgtgcaaggctctctcgacacggaagatagtatgtga

SEQ ID NO: 18159 - DNA, 264 bp, A.fumigatus
cctaccctcacccacagggtaaataagctgaccgaaataaaagtctcgtgcaggcacatggcactaggtggacccagcaccgtcatcagcgtcgactatcgactcagcccggcgcatcagtatcctatccctctcaacgatggatgggattcatttgaatacataataaccaaccttcccacccttctgccgaagcacggcgcttcggcaagggtggtgatcagtgggacgtcatcgggcggacagatcgccgccattgtctcg

SEQ ID NO: 18160 - DNA, 576 bp, A.fumigatus
gctgacgccgaatggcatcgtacctgccaaatggtatgtctcattgtcgactattcacagccggaactcaacattgacaaggtgatcaggtttactacacaggattctctttacgatctagcctggtccgaaatccacgagaatcagatcctcacagcctccggcgatggcagcattaagctctttgattgcaatttggaagacttccctgtccagaattggaaagaacataatcgcgaggtcttcagtgtccactggaatctcgtagccaaggacacattctgctccagcagttgggacggcaccgtccgcgtctggtcgccgcatcggccgcattctcttctcaccctccccacacacagctgcacctactcggcggcattttcgcctcattctcccgatatactctcctgcgtcacctccgactcatacgtccgcatcttcgatcttcgcacacccgcttcagcatctaaccacctcaccctccagattcccatccacgccgcaccggcatcgccgattcctggtaaagcgtcttcaccgcccggggctggaagcaaacgcgctacggctaag

SEQ ID NO: 18161 - DNA, 279 bp, A.fumigatus
ccggtcctttcttcggtttattttaattgttctttccagaccctatacccggtattttgcactatgcttcatttccgcaccgagggctacaacggctgtgcggtcaagtactccccattcttcgacaaccggttggccgtcgccgcatctgccaattttggactggtaggaaatggccggcttttcatccttgagctgacgccgaatggcatcgtacctgccaaatggtatgtctcattgtcgactattcacagccggaactcaacattgacaaggtga

SEQ ID NO: 18162 - DNA, 342 bp, A.fumigatus
aggtcagaaaaggtccactcacgtacctactgtatctctgcctcaggttactttctaggcctcagatctctctttttcgcctgtgcatctcagccctggatcagggacagcttctcttattttcttacctttctagctgaaaacaacgcatgcgacatcgcctttctttttatcctcgactccgccattatcattatttacattcagcttcattcatcatatcctccaatcaggaggaatcaggaacttggtgtgattccagaagaacctaaactccctgcagtctggttttcagcgcccatcccaccaccaacgccgccaccctcatcacatccgtcttga

SEQ ID NO: 18163 - DNA, 555 bp, A.fumigatus
gcattagtgactaataccctgtgtagtgcacatgagatggagaagcaatattcttgccagttctgcaataatcggttcaagaataagaacgaggctgaacgtcatcagaactctcttcacttgcggcgtcattcctggtcgtgcgccgccttgccaggatatcaagccgcgttccacccttcgacttccccaacagcgcaaacaaattcgggtccttctcacgatgcttgtggctactgcggcgaggagtttccaaactttccgcagcccgattgggatcgcaggtttgaacatcttacttcagtgcacaagttcggtgagtgcaacaacggaaagaaattctatcgtgcggatcattttcgacagcatctgaagcacagccacgccggtacaagtggtaaatggaccaacgtcttggaaaacgcgtgcatgaaggaagaagcgcctccggaactcaaagacaccacacgcagcagtggagctggctctgctgcgccagaaacgacggggtcgctcacgtcaaataagattagtgaggttctgagcccgtgttga

SEQ ID NO: 18164 - DNA, 1656 bp, A.fumigatus
ttacgctggaccatggactttccgcgactctccccaccattgataaatgtgcatgagatcaatagtggtgggtatgaccaatctcactctaccgacggatcgccaaaaaacatgtctggacagtcctactcacccctcaggccgatgcctataccggtaaaatcaataactaactttgctccgccgccacttcctccaccgacgcatatcactgacctcgaagatggccatgatgccggttggctctttgcgaacgccagaaatcatcctgggtcggcgaaacttgcgccaatcaatcccggttctagcctgtttggaggccatcgtcgtttggaatctgtatgcaagactgatcgaatggcgttggatgaactggacggaagacagagcggcttgcctgtctcgacaagtccgaaggcgcatataaagatagaacctccgccagcgatggaagaaggatttcgcaattccattaccatcaatgcacccggctccatattgaagggcgagcgagatttttccagacgaagcgtaaaggattcgtcagacgcgtacgaccaacatctgctttccaagatcggcaaaccgctctctccccgacaatcaatcagccttggcaacgagaccaaggcctcactgtcgacgctgcccattcctccgagaaattttggtgggttgccatctcctggggtttccgatggaccaacgctcgacgtgcggtggccaagcaactctcaatctggcgcaatctctcctggtaccaaggtcggttggagagattatctcggccaccgaagccccagtgttgagagtagcgccccttcttcagcggtggagtacgaccactcggcctttctgcgtgacgtatatcggcgccggggaggtggtacaacgccacaaagtgaagaaactctaagcttgccgagtcgatcaaaccgcggaagttatgaccaaggcgttttctcggatatcgaaggtgatttttccaccgatgagtcgttgccctcacgatatttcaacctccgtgaagcaacgccaccctatttggatgcttcgaagtcaggtactaaaagaagagcctcctcaccaccgcgcgagccagtgcaagacgatagacatgcgccccatgttaccacatgcaatggcgatctttctcagcgaagaacatctggacatccgtatgccaacaccctttcggtcaatggtggctatatacaaagccatggaactctgtctgccgcatcatcattaagtttgaggacttcagggacgtattcgtcagcggccatgtccatcggaggaagcagtatgacgagcatgtcgacatttgatcgtccttcccccggggggctgtcgccaagttcggatttcgacgccctcaatgacagaccgccaatcagttcaacttctcccggaggactacctagtcatcaaagtgtgaggaacgcacaagtccctgacgcatcagagctacgaaacgcggatagcacgacaaaattgtctttgcagactacccttaatgtgccaaaatcagctgcgcctaagatggctggactgtatatctgtgactgttgtccgaagaaacctaaaaagttcgacagtcctgctgaactacggtatgatttgaccattctatctgctgtgactgagcattag

SEQ ID NO: 18165 - DNA, 186 bp, A.fumigatus
tatctgctgctttataggtacgtcctcggccatgaggctatgaagcgaatgagttcttcaaatgttcttgttgtcggtatgaagggtcttggtgtggagatcggtaagcacaatatctggtttgccaagtacggtcaacgactgacgagctctttcagccaagaacgttgcccttgctggggttaa

SEQ ID NO: 18166 - DNA, 246 bp, A.fumigatus
  unsure (196),(228): Identity of nucleotide sequences at the above locations are unknown.
cgagctctttcagccaagaacgttgcccttgctggggttaagtccctcacgctatacgatcctgccccagtcgttatctccgacctatcctcacagttcttccttcaaccacaagatgtcgggaaaccaagggccgaggtaacagctccgagggtcgcagagctgaactcgtacgtgcctggtactgttggacctnttctccacgatggaccagagacgcgatattgnttatgggtgcccaaggga

SEQ ID NO: 18167 - DNA, 186 bp, A.fumigatus
agaataaagctcggcccatgtgtgtgccagagcatgtacaacatccccatctttgacgacaagcccttcaagctccgtttgcgctctgacccggccagcgaggagctccggtattcgatgtcgctcactcaatctggcatcagcatgagacacaagcgcagtagcgaattctccgcgccccagtag

SEQ ID NO: 18168 - DNA, 2412 bp, A.fumigatus
tggactccaggcagaatgctccacgagatcctactctcactctcaggccaaccgtcccctctcttcgctttcaatacagaagaagatatcgtccctgaggatgcttttccactgtcccctccggagaaagccctcctcacatcgctcgcccgtttgagtagactccatgccaaacttcgagaacagacgtctctaatatcatcttcacatccttcgatcatctgccgtgctgtttcctcagctataaacgcacatcatctaggaggttttcagaggaagattttggaagtcgagaaggcaatcttggccgaggatagtgcatatgttggcggttatggcatcgtaccgttgtcaaccatcgttggggagttttcgccttggacgaggcgattagaatggctttgggatgttacccgcttcgttcttcccgaaaacaggactagtagtgcacatggttgtacaggctccgccctgattgattatcttcgaacagaatcccaaacaggctatcttgacctcgaagaaatcgcgctgcacctgatcactgtggccgaatccgcgtggataaggcagctatcgacgtggctactgtatggaaatctgccgatctttgggaaggacgactttttcattcagaaggataactcgagccaaatggatgattcgtcatccatcacgaattttgtaatgcagacaagcctactcccaaagtttgtttcattgcacacggcgtcgtcaatcttatttatcgggaagactttgagtcatatcacggcgaagcggaaaggtgccacaatgggatttgattctggggcaccgccagtaactcttcagggagagcatattgcgcacctcgcgtcgttgggatccccaatatcagcctcaaaactatccaacgcggtagattctatccgcttgtccttgtcacaaagtgttctttcgaagctactgccgttacccaagatcctcgagattctttctgtgctgcatgattttcttctactggggcgcggagaattcgctactgcgcttgtgtctcatgctgatgccagattgagtgagcgacatcgaataccggagctcctcgctggccgggtcagagcgcaaacggagcttgaagggcttgtcgtcaaagatggggatgttgtacatgctctggcacacacatgggccgagctttattctttacaaaatgaggaagaccctgtggatgaatctcttgatcttgcccgagaccttgttcgcttatccatcactgacagtaagaatagacatacagttgcaacgcactcagacgagattggaagtgatttagtagcggagctctcggacgtctcatttgaggacctactttttccaacgcgaacttccatctcggttgaagtacgtgcgccccttgacctgtttctatcgacgtccgatatcgctgtgtactcaaggattcattcatatctattgggaattcgacgtgcgcaaatacgaataaatgatctctggaagcactcttttcttcgaaaaagttatccttctccatggggcccaccacgaagcaacactccctttggacagagtaagcttaagctgggaaggcagagagacaatatccggcttagtcaaatgagaccagtatgggcaacgagtagtgctgcgctcttcgtcttatcagaaattggtagttttttccagggtgaagttgtcaatggttgctggcagcattttcgtgagtggattcaaggtggactggccactgccacgtcctcgacgagctctcgacctgaaacatctgcgtctttgaaaagcaggtatagcgacagtccgattgagggcagagtgggtatcgatcagtcaagtcactctgcgccgcaacgactcgatcccgaaactttgacagtcgcccatcatcgctatctattttcccttgttcagtcactgtttttgacagataaaccatttaccgaggcccttcgctcgctgcttagcttgattgatcattttatcgcacttattattcgcctagaaagtgtccagaagaatatggacttggaaacagacgaaggtgtggtagacgccttggccgactaccccagggaggagacagaattattggaagcattaaggaccgcgcggatggaggtcgaaaagggaatcagggacgtcgtggctcgcctgcgagacattgatgacagtcgatcgggagagggacgaaagatgcttgatcttttaaagcatgcccgcgctactccgctcgctgacagaaagaatggcagcggcgtgaacgctcaaatttgccaatacttgccgcgaaaaacagctggagttgatcaacttctcatgaagctggactttgggcatgccaatggaagcctcggaactacagctcctgtgttaggcgactcctttgatttggagtag

SEQ ID NO: 18169 - DNA, 1011 bp, A.fumigatus
tcagctatttggatcgaagcatctctcccctccatcccacaatgcaacccagtagaaatgaaccaatcgccattatacgcatgggctgccgtttcccaggtgaagccagctccccctccaaactctgggacctcctccacaacccgcgcgatgtcgcccgtgacatccccattcaacctcgaccgcttctaccacccaaccggcagccatcacggtaccaccaacatccgccaggcctacctcctttccgaagacgtgcgcgcgttcgatgcaaaattcttctccgtccccccaggtgacgcagaggccatcgacccgcagcagcgcctgctcctcgaagtcacttacgaggccctcgaatcctcaggccatacgctggccgacctgtccaactcgaatacgggagccttcgtcggcctcatgtcccaggactacttcgcgcttaatggccaggatgtggactccgtccccacttacgctgcgtctggtacggcggcgagtaatgcttccagccgactctcttactttttcaactggcatggcccgtccatggcaatagataccgcctgctcatctaatctcgtcgctgtgaatgaggcagtccaagcccttcgaaacggcacgagccgcgtcgctgtagcttgtgggacaaacttgtgtttgtcggcgttcacgtttatcacattaagtaagctcagtatgttgtcaccgacctctcgatgtcacatgtgggacgccgacgcagatggctacgcccgaggtgagggtgttgcttgcgttgttttgaaaaccctcagcgatgcgatttcagacagggaccctatcgaagccgtgactcgggaagtgggcgtgaatcacgatggcaggacgaaggggttgacaatgccaagtgctaaggcccaggcggcgctaattcgaaacacttatgcccgcgctgggctggatccaacgaaggaggctgatcggtgtcagtatttcgaagcgcatggcacgggaacgaaagctgggtag

SEQ ID NO: 18170 - DNA, 306 bp, A.fumigatus
gtggccccattttgggaccctcaagaagccgaagccctgatgagagcgttttttccacagtctgactccgaaggcgaactcttcgtcgggtctatcaaagccgtgatcggccacaccgaaggcacagcgggactggcaggtcttatgaaggcttgtcttgctcttcgcaatgcaaccttcccccccaatttactctttaataaattaaaccctgaccttgaactgttcacaagtcatctccgtgttcccacggccaaccaaccttggcctgaattgtcagatggtacaactcgcaggctaggttag

SEQ ID NO: 18171 - DNA, 957 bp, A.fumigatus
ggcttccatctctcggtcagtccggagcagcgcgaggcccttccatggtatcggcaggctttgctgaagaacgctgagctgttattacaccttgtcaatgacgggaaacatccgtttgccccgcagaattgggtgagtgataccagagaggatatattcaagatgatggacagctatcccacgacagacgccgatttcaacctgaccaaggccgtcggcgaacatcttcttctgccttcggtgctgaatggagatacaagcatcctacaatacatgaccaaggataactaccttgagcggtactacgtagatgccattggattccagctgcttaacttcttgattgccggggtgatggaaccgctttgcttgaagtctccccgaatgaacttccttgaagtcggagccggaactggaggcgcgaccaaggcgatcctggagaagatcggttactcctatgcgtcttatacatataccgacatttccagtgccttctttgaccatgatgcgggccactttcaatcccacgccagcaagatgattttcaaggccttggatatcacaaaggaccccgccggacaaggcttcatcccgcagagctatgatgttatcgttgcctccaatgttttgcacgcgaccgagtcattgagatccgcccttgaacatacacgaaggctcttgcgtcctggtggttatcttgtgatggttgagatcatccgcaacgacgtaatgcgccatggtctcgtcatgggcggccttccaggctggtgggtcggtgagaacgatggccgttacggaggcccgagtattactcttgatcaatggcataaaatgcttcgagagaccggctttagtggtatcgagactaattcgcccatgagggacccagtcggcgtgcccggatcgattatcgtttctcgggctaatgggctgaaactgatctcgtcacccagttga

SEQ ID NO: 18172 - DNA, 396 bp, A.fumigatus
catccccattcaacctcgaccgcttctaccacccaaccggcagccatcacggtaccaccaacatccgccaggcctacctcctttccgaagacgtgcgcgcgttcgatgcaaaattcttctccgtccccccaggtgacgcagaggccatcgacccgcagcagcgcctgctcctcgaagtcacttacgaggccctcgaatcctcaggccatacgctggccgacctgtccaactcgaatacgggagccttcgtcggcctcatgtcccaggactacttcgcgcttaatggccaggatgtggactccgtccccacttacgctgcgtctggtacggcggcgagtaatgcttccagccgactctcttactttttcaactggcatggcccgtccatggcaatag

SEQ ID NO: 18173 - DNA, 558 bp, A.fumigatus
ttgtgtgacaatagtgtcaacagctttggccttggaggtaccaacgctcactgcattcttgaaacatacaatccaccaacagccagtgacccagtcattgaaatagacatggccgcatcaggaacatgctgtattccatctgtattctctgcagcatctgatagatcattggcgacactcttgcagtcgacactaaaattcatggacgaaaataccgacgttaacatgagtggactggcatataacttgagcaccaagcgatctgccctgcagcgaagagttgcagtctccgctacatcgatcgacgaacttcgcgacaagatcaagtccacgatagaagccgcgtcagagaatgacgccactttgcactccacttctgctttacccgaacctgcttcattgcttgggattttcaccggccagggcgctcagtggcaaggcatggggtcccagctgatatcgtcgatcccgttagcccgaagaaccgtcgaagagctggattcatctctcgcaagcttaccatcctaccaccgcttatcctggaccctagaagattga

SEQ ID NO: 18174 - DNA, 552 bp, A.fumigatus
gaccccccttttatgaacccccgtcgaccttccagccccgtggtgaagactcttgtcgttacggctcccagccggccttggccatgctctggcaacatctgttcgcgcacggcgtacttaccgctagtgattttgtatcttagcataaccagccgctttgatagcattgctgtattatgctgtatatataatgtgagaattgtagagaagtggtttgacagtcaggacacaggatttcactcaattttgttgatcagctatttggatcgaagcatctctcccctccatcccacaatgcaacccagtagaaatgaaccaatcgccattatacgcatgggctgccgtttcccaggtgaagccagctccccctccaaactctgggacctcctccacaacccgcgcgatgtcgcccgtgacatccccattcaacctcgaccgcttctaccacccaaccggcagccatcacggtaccaccaacatccgccaggcctacctcctttccgaagacgtgcgcgcgttcgatgcaaaattcttctccgtccccccaggtga

SEQ ID NO: 18175 - DNA, 1125 bp, A.fumigatus
aagattgacagcactacccccgtcggtaaagcctctctttcgcagcctctctgcacggctgtccaagttatcctggttgacatgctccgcgctgcgggagtcaagttccaggccgttgttggacattcctctggagagattgctgctgcctatgcggcaggctttatatctgcatgggacgctatccgcattgcggactaccggggattctacgctgaaatggcggcagcgcctggtggggaaaagggcgcaatgctggctgccggcacctcctttgaggatgctagcgacctttgccagcttgatgactttgccgggaggatctgcgtggctgctcataactctcctagcagcgtgactctgtcgggtgatatcgacgctatagccttggcacggagggtgcttgaagaagaggagaaatttgcccggcgattaaaggtcgacacggcatatcactcgacacacatgcataaatgctctgtaccttaccttacggcattgagaaactgcaacatacaagtgcagcagcccgggcccgatgcaccgcagtggtttagtagtgtccgaaacggtcaggtcatcagcagcatggaaagcttggacagtcaatactgggtcgataacatggtacagcccgagctattctgcccagctgtccaaacatgcttgaagtatgtggacaaagccatcaactgcgttgtagaggtgggaccgcatcctgctttgcagggacctgcgaaggattctattcttgccgctgtggatcaggagatcccatatagtagcaccttgaaccgtggaaagagcagtacggtggcattttccgacacccttagattcctttggtgtctgtttggctctgctgatgagacgctcagagcgttccagcaaacaaattacccgcatactccgactacaatgacccgcggtcttccaacatacccatggagtcatgacagggggtactttgccgaatcaagactcatcaagacctttcacaaccacccgttgcccttccatgacttactaggaatccagacggcagatggagcaagggaggaatgggggtggcggaatatcctgaagatgaacgaactcaagtggctgtcggaacactcggtataa

SEQ ID NO: 18176 - DNA, 621 bp, A.fumigatus
  unsure (116): Identity of nucleotide sequences at the above locations are unknown.
ggccaagtcgtctttcccgcaacagcttacatttgtcttgccatggaagcagcgctgcaactggcccaagggagaccagtgaaatcgatcgatctcttcgatcttgaaatccacanagctatcgccagccatgactccacaggcaccgagctccttacatccatgaccaaggtgtctgccctcgacaccgagtgggaagaaataaccgctgacttctcagcctactccactataagcaaagacgctgccaaccttgggctgaactgctgcggtcgtgtgcgtgtgcttctaggagagggcgaggactcgccttcccacttctcacctagacttcccccactcggaaaactgaccgcagtagacgtggatagcttctacaagatcctgcgcgatgacttcggattcggatacgagggccccttccgcgcgctcacgaatatgtcccgcaaaaccggcttcgcaacaggcacagttcggtgcgagaggttcgacgactctgaaacgtctctgctcttccatcccggtatgctggatagtgccttgcagggtctgaacgctgcccatagcgccccaggagatgaccggctctggacgatcgtggctccgaccttctgtcgttga

SEQ ID NO: 18177 - DNA, 243 bp, A.fumigatus
cgagaggatcaatatgttccggtctctgttgagccggttacgcaacgtggtgatctgttccgtcctgatcgcacctactggctagctggtctgaccggagacactggacgatcactggcggacttcatgattgcccacaatgctcgcaatattgtgctaagcagccgtacgcccaccgtctacgaggactgggtagagtggcacaagtcaagaggtgtttcagtgaggtatttcggagggtaa

SEQ ID NO: 18178 - DNA, 477 bp, A.fumigatus
  unsure (334): Identity of nucleotide sequences at the above locations are unknown.
gcaaaagtactcgtccgcttgaaacttatcatcgcttaccagcctttcttacttagggatatcaccagctttcagtccgtgaaacagatccatgacgctatcaaggagtccatgccgcccattggcggcgttgcaaatggcgccatggtgctgcgagacagttccttcatgaaagtgagctttgacgatttccaagcggtcttaggtcccaaagttaaaggcacaatcaatattgaccggctcttctccgatcccaaccaactgctcgactggttcattgggttcagttcagttgccggcactgtcggcaacccaggacaatcggggtacacanctggaagttgtttcatcaaggcacttgtcgaccggcggcgtaagcaacgcctggctggatcagtcattgacatcactccattggtggggttgggcttcatcgaacgtgaaagccatggccgtctgaacaaaggacccctatag

SEQ ID NO: 18179 - DNA, 966 bp, A.fumigatus
tacttgactgttaactatcgttcaatggtcgaacttaggtcactgtgtgtgtactgtgtgtgtactgtgtgtgtactgtgtgtaggtaggtacataggaaaactcttttgtctatctatccagataccccgtctcttcccaatccccatcgacccacctcccgcatcgcctgatctcctccctcgaccagccggccgtctgcattggattcattcgcactgccaagcgctccggcgacgcactcccatccgctgcgtccgcccccccaccgcagcacctcgttcttgtaccgctcgcccgccgcgcggtcgaccgcgtggcggcccgccccaaacacatcgacccagagtttgttggcgatcgcccgatcgaagatgtagctgtagtacgtggccccgtagccgtagagatgcccgaaaaacccttgccaggacgtcggcggcgtcgtcgcatccgcgggctccggcaggctcgagtgctgctgcgagacctgctggtagagggcggtgctgtcgatgcggccgccgtccgccggccgcgagtggtacgcctggtcgaccagcgccatcaggatctgcgcctcgttctcgaccgcgccgtagatcgacccgtgggccgtgcggtcgcgctccatgctccgaatcatcccttccgacagcggctcgtctgtccgccagtgccgtgcgtacagcgccagcaccgacggcgccgtcgcgaagtgctccatcagcaccgacggcagctccgcaaagtccgtggcgcaccgcgtccccgagatcgattgcagtcgggtctggcccaggatcgagtgcaccgcgtggcccatctcgtggaacagcgtgcgcacgctgtgctcgctcagcagcgacggccggcccccgccgttcgtcccgggctccgggaaatcgcacaccagcgcgatcgtcggcagctgccgcagcgtctgggtcacgtcttcacccacgg

SEQ ID NO: 18180 - DNA, 441 bp, A.fumigatus
caccaccctcgcggaggtccaggagcagcttgcgcatgcccgtgctgcgatgcaggacacctctttgatcgatggtctgagggcgacggtggccgatctcgagcagaagctgatggacgcggacatggccgtggctgccaaggaagcgctggctcaccagcacagcaccgcgctgacccagctggaggcggagaagaaggagttggaggcccgctatgcggcggtgagcagccaagtggacgagttgaccaagtcggctgctgcgtccgagagcatcaagacggagctggagcgggtcctgaaccagctgtctgcatcgcgagaggaagtgtcgcagctgcaggccagccacgaagcggtcaatggcgagctggagcagttcaagtcacagacgcgggcgatggaggaaaaactggcgcagggcgagaaggacctgaatga

SEQ ID NO: 18181 - DNA, 2481 bp, A.fumigatus
  unsure (33),(267): Identity of nucleotide sequences at the above locations are unknown.
tttttggggggggggggagaaaaaaaggggganaaaaaaaaaaaaaaaaaaatttttttttttttgggggggaaaaaaaaaccaccccccaaaaaaggggggggctcccgggggcccccccccccaaaaaaaaaaaaaagggggggaaaaaaaaccccccccaaagggggggggaaaaaaagggggggggtttttttttttccccggggtttttttgggccccggggggggggccctttttgggagaaaaaagggggaaaagggggnaaccgcggggggggcccccccccaaaaaaggggccccccaaaaaattttccccccccaaattttttctttttcccccccgggggggccccaaaaactttttgggggggggggaaaaaaaaaaggggaaaaaggggaaaaaaaggggggtttcccggcccgatctagcggccaaacttgcccaagctgaatccgccaggagccaaagcagtgaggagactagtcttcggcttgccgagaaggacaaggaagttgctgagctcaagcaagctgttgcaaagtcacaggaggagcttcaggcggcccgggaggctgctgccaaggaattgagtgagaagattgctgagttagaggctgctcacgaggccgcggtcgccaagctcaaggctgaacacgagggggctctggcctcggccgccgctgcccacgcccaggaattgagtgttgcgaagcaggcggctgaatctgccggttccatgcactctgaggagcttcagaagctgcgcgaggaattggatgctgccgaagccgcagcggaaaaaggcagggaagaggccatcagtgagctcaacgcggcacatcaagccgaattgaaagcccttcaagacaagctgaacgcatcggagcaggcgctgggtgaagctcggcaagcgctggaagctagcgtcagctcagcccaggccgttgccgtccaagagatcgagtcgctcaaggagaaggtcggcgccttggaggcgcagctgtcgaccggacagggcgagatccagtctctggttgaggaggtccagagcaaacaggcagaagcggaagccttgcaccagaacctcactgactttgaaacccagctcaaggctaaggacgccgagaaggatgagcagctgagggatctgaaagagaaggcggctgcttcggaaaaggctcttgaggagcaactccaggaggcggttgccgtggccgagagacacgcacaagccttggaggcgctgaaggcggagcatgctgcggcgctcgaaaaggccaagagcgaggcggctgggtctcatgagagtgcgctgagcgcgctccaggccaagcatgatgagctgctcgcagctaaccgggatctggaaacggctcacgctcaaaaggttgcaaagctagaggcggaactgcagagcacgttggaacgccatgctggcgagatcagctcacagacggagctgcgcgagaaggaaattgcggatctccggaaggactttgaagagaccaaggccaagctccttgcggagctcgaagcatcgcaggcatccaaggctgccgaagctgatgccgagcacagcaaggcgattgaacagctgctcactctccaggaagagaagctgtccagcctccggtccgaactcgaatcctcccacaaggccaagttggatgagctgcagaagttgcatgacaccaccctcgcggaggtccaggagcagcttgcgcatgcccgtgctgcgatgcaggacacctctttgatcgatggtctgagggcgacggtggccgatctcgagcagaagctgatggacgcggacatggccgtggctgccaaggaagcgctggctcaccagcacagcaccgcgctgacccagctggaggcggagaagaaggagttggaggcccgctatgcggcggtgagcagccaagtggacgagttgaccaagtcggctgctgcgtccgagagcatcaagacggagctggagcgggtcctgaaccagctgtctgcatcgcgagaggaagtgtcgcagctgcaggccagccacgaagcggtcaatggcgagctggagcagttcaagtcacagacgcgggcgatggaggaaaaactggcgcagggcgagaaggacctgaatgaccagatcgagcgcaacttatcgctgctgaaccagctgggcgacgtggactcgaccatttcggccaaccgtaagcgcgtgcgtgaactggaggccgaactggcagcgctcaaggcggacaaggacagcggcaaaggcagcgttggcctggaaggaagccgatgggcgggggaagatggggcgaacccaaacaacaaaagtgaagagagtggtccgacagccgctgcggaaggtgaggaccttggatcatccatagagggaacggtgggagacccgttgtttactcggggcatccacccggggtgtccgttccccgtgtttgacgtgatactaatgcggtggacctag

SEQ ID NO: 18182 - DNA, 366 bp, A.fumigatus
atcgacccgtgggccgtgcggtcgcgctccatgctccgaatcatcccttccgacagcggctcgtctgtccgccagtgccgtgcgtacagcgccagcaccgacggcgccgtcgcgaagtgctccatcagcaccgacggcagctccgcaaagtccgtggcgcaccgcgtccccgagatcgattgcagtcgggtctggcccaggatcgagtgcaccgcgtggcccatctcgtggaacagcgtgcgcacgctgtgctcgctcagcagcgacggccggcccccgccgttcgtcccgggctccgggaaatcgcacaccagcgcgatcgtcggcagctgccgcagcgtctgggtcacgtcttcacccacgggg

SEQ ID NO: 18183 - DNA, 456 bp, A.fumigatus
tggcgctggtcgaccaggcgtaccactcgcggccggcggacggcggccgcatcgacagcaccgccctctaccagcaggtctcgcagcagcactcgagcctgccggagcccgcggatgcgacgacgccgccgacgtcctggcaagggtttttcgggcatctctacggctacggggccacgtactacagctacatcttcgatcgggcgatcgccaacaaactctgggtcgatgtgtttggggcgggccgccacgcggtcgaccgcgcggcgggcgagcggtacaagaacgaggtgctgcggtgggggggcggacgcagcggatgggagtgcgtcgccggagcgcttggcagtgcgaatgaatccaatgcagacggccggctggtcgagggaggagatcaggcgatgcgggaggtgggtcgatggggattgggaagagacggggtatctggatagatag

SEQ ID NO: 18184 - DNA, 240 bp, A.fumigatus
ctgcgagcagctcatcatgcttggcctggagcgcgctcagcgcactctcatgagacccagccgcctcgctcttggccttttcgagcgccgcagcatgctccgccttcagcgcctccaaggcttgtgcgtgtctctcggccacggcaaccgcctcctggagttgctcctcaagagccttttccgaagcagccgccttctctttcagatccctcagctgctcatccttctcggcgtccttag

SEQ ID NO: 18185 - DNA, 747 bp, A.fumigatus
agacgtgacccagacgctgcggcagctgccgacgatcgcgctggtgtgcgatttcccggagcccgggacgaacggcgggggccggccgtcgctgctgagcgagcacagcgtgcgcacgctgttccacgagatgggccacgcggtgcactcgatcctgggccagacccgactgcaatcgatctcggggacgcggtgcgccacggactttgcggagctgccgtcggtgctgatggagcacttcgcgacggcgccgtcggtgctggcgctgtacgcacggcactggcggacagacgagccgctgtcggaagggatgattcggagcatggagcgcgaccgcacggcccacgggtcgatctacggcgcggtcgagaacgaggcgcagatcctgatggcgctggtcgaccaggcgtaccactcgcggccggcggacggcggccgcatcgacagcaccgccctctaccagcaggtctcgcagcagcactcgagcctgccggagcccgcggatgcgacgacgccgccgacgtcctggcaagggtttttcgggcatctctacggctacggggccacgtactacagctacatcttcgatcgggcgatcgccaacaaactctgggtcgatgtgtttggggcgggccgccacgcggtcgaccgcgcggcgggcgagcggtacaagaacgaggtgctgcggtgggggggcggacgcagcggatgggagtgcgtcgccggagcgcttggcagtgcgaatga

SEQ ID NO: 18186 - DNA, 210 bp, A.fumigatus
tttcagacacgagacttctcttcatctggacgcatcaagtatgaacagggtatcctgagcatcgtattacatacatacaaccaaccaatcagtacaaaggaaaatagtcccttccgaaaactcgtccgtcctcgcgcccattcaggacgatcgctccccactgcggctctcaaagctgctcagtcgttccagctgaggcgtcgacgctag

SEQ ID NO: 18187 - DNA, 429 bp, A.fumigatus
  unsure (163),(397): Identity of nucleotide sequences at the above locations are unknown.
atcgggccgggaaacccccctttttttcccctttttccccttttttttttcccccccccccaaaaagtttttggggcccccccgggggggaaaaagaaaaaatttggggggggaaaattttttggggggccccttttttgggggggggccccccccgcggttncccccttttcccccttttttctcccaaaaagggccccccccccggggcccaaaaaaaccccggggaaaaaaaaaaaccccccccctttttttccccccccctttggggggggttttttttcccccccttttttttttttttgggggggggggcccccgggagccccccccttttttggggggtggtttttttttcccccccaaaaaaaaaaaaatttttttttttttttttttntccccctttttttctccccccccccccaaaaa

SEQ ID NO: 18188 - DNA, 852 bp, A.fumigatus
cccgtgggtgaagacgtgacccagacgctgcggcagctgccgacgatcgcgctggtgtgcgatttcccggagcccgggacgaacggcgggggccggccgtcgctgctgagcgagcacagcgtgcgcacgctgttccacgagatgggccacgcggtgcactcgatcctgggccagacccgactgcaatcgatctcggggacgcggtgcgccacggactttgcggagctgccgtcggtgctgatggagcacttcgcgacggcgccgtcggtgctggcgctgtacgcacggcactggcggacagacgagccgctgtcggaagggatgattcggagcatggagcgcgaccgcacggcccacgggtcgatctacggcgcggtcgagaacgaggcgcagatcctgatggcgctggtcgaccaggcgtaccactcgcggccggcggacggcggccgcatcgacagcaccgccctctaccagcaggtctcgcagcagcactcgagcctgccggagcccgcggatgcgacgacgccgccgacgtcctggcaagggtttttcgggcatctctacggctacggggccacgtactacagctacatcttcgatcgggcgatcgccaacaaactctgggtcgatgtgtttggggcgggccgccacgcggtcgaccgcgcggcgggcgagcggtacaagaacgaggtgctgcggtgggggggcggacgcagcggatgggagtgcgtcgccggagcgcttggcagtgcgaatgaatccaatgcagacggccggctggtcgagggaggagatcaggcgatgcgggaggtgggtcgatggggattgggaagagacggggtatctggatag

SEQ ID NO: 18189 - DNA, 798 bp, A.fumigatus
ttccattcctctatactccgtactctacactttacacgataccgccacgccctcaccaggtctagaaaaggagaaagaaaggggaaaaaaatgcctgaaatcctcctcccagacacctcgtccatcacctcctcaaccgcctcgtctctcctcctctacaccgaccaccaacaccaaacagccctcgcccgacgcaaatccctccctctccgtcgcttatcagtctggctctcccgccgcacctccaagcagggattaaacgccacggacgataatggctacagccaccaccaccaccatcaccctcacactctgactcaaggcgaaaactaccccgactatgacgcccaacgtatcacatccgactttaacctccaccgtcaacgtgaacatgaacatgaacagggccgccgcaaccgcaaattcaccgactccgaggccgagcgccatctcgccgagtcctatgcggcgtattgtcgcgccttcacgtccgcgggcgagcatctctatcaccagaagcgcaggacgtggatgatgcacggggaggtggatcttccggtgatgaccgaggattctgcccatgtacatgcacatcccgaggaggatgacgctgatgggaaacgggagggactgaacccccccgacaccgagccatcgccgccgcctcatattctcacgccctcgctgtacgctgaaatgcgtcgcgtggccagcgatcagaaacgagccaggaaacggctccgggaacgccggttgtggtcgtggttcgcctggattcgtccacgcgagtctcattga

SEQ ID NO: 18190 - DNA, 570 bp, A.fumigatus
gtccaccgcattagtatcacgtcaaacacggggaacggacaccccgggtggatgccccgagtaaacaacgggtctcccaccgttccctctatggatgatccaaggtcctcaccttccgcagcggctgtcggaccactctcttcacttttgttgtttgggttcgccccatcttcccccgcccatcggcttccttccaggccaacgctgcctttgccgctgtccttgtccgccttgagcgctgccagttcggcctccagttcacgcacgcgcttacggttggccgaaatggtcgagtccacgtcgcccagctggttcagcagcgataagttgcgctcgatctggtcattcaggtccttctcgccctgcgccagtttttcctccatcgcccgcgtctgtgacttgaactgctccagctcgccattgaccgcttcgtggctggcctgcagctgcgacacttcctctcgcgatgcagacagctggttcaggacccgctccagctccgtcttgatgctctcggacgcagcagccgacttggtcaactcgtccacttggctgctcaccgccgcatag

SEQ ID NO: 18191 - DNA, 462 bp, A.fumigatus
gccagcgcttccttggcagccacggccatgtccgcgtccatcagcttctgctcgagatcggccaccgtcgccctcagaccatcgatcaaagaggtgtcctgcatcgcagcacgggcatgcgcaagctgctcctggacctccgcgagggtggtgtcatgcaacttctgcagctcatccaacttggccttgtgggaggattcgagttcggaccggaggctggacagcttctcttcctggagagtgagcagctgttcaatcgccttgctgtgctcggcatcagcttcggcagccttggatgcctgcgatgcttcgagctccgcaaggagcttggccttggtctcttcaaagtccttccggagatccgcaatttccttctcgcgcagctccgtctgtgagctgatctcgccagcatggcgttccaacgtgctctgcagttccgcctctagctttgcaaccttttga

SEQ ID NO: 18192 - DNA, 438 bp, A.fumigatus
gacccagccgcctcgctcttggccttttcgagcgccgcagcatgctccgccttcagcgcctccaaggcttgtgcgtgtctctcggccacggcaaccgcctcctggagttgctcctcaagagccttttccgaagcagccgccttctctttcagatccctcagctgctcatccttctcggcgtccttagccttgagctgggtttcaaagtcagtgaggttctggtgcaaggcttccgcttctgcctgtttgctctggacctcctcaaccagagactggatctcgccctgtccggtcgacagctgcgcctccaaggcgccgaccttctccttgagcgactcgatctcttggacggcaacggcctgggctgagctgacgctagcttccagcgcttgccgagcttcacccagcgcctgctccgatgcgttcagcttgtcttga

SEQ ID NO: 18193 - DNA, 561 bp, A.fumigatus
  unsure (294),(528): Identity of nucleotide sequences at the above locations are unknown.
agctcctcctgtgactttgcaacagcttgcttgagctcagcaacttccttgtccttctcggcaagccgaagactagtctcctcactgctttggctcctggcggattcagcttgggcaagtttggccgctagatcgggccgggaaacccccctttttttcccctttttccccttttttttttcccccccccccaaaaagtttttggggcccccccgggggggaaaaagaaaaaatttggggggggaaaattttttggggggccccttttttgggggggggccccccccgcggttncccccttttcccccttttttctcccaaaaagggccccccccccggggcccaaaaaaaccccggggaaaaaaaaaaaccccccccctttttttccccccccctttggggggggttttttttcccccccttttttttttttttgggggggggggcccccgggagccccccccttttttggggggtggtttttttttcccccccaaaaaaaaaaaaatttttttttttttttttttntccccctttttttctccccccccccccaaaaaa

SEQ ID NO: 18194 - DNA, 261 bp, A.fumigatus
agtaggcatttttacacgagctacaccatgaacgacccggtaacagagtcgattcatcagaaaggcgccatgcctgaggacaagccgttcagcgagaccccacggagggtggacggagtctcccagttgtgtatgtcctgctctatgttcctgctcaagggagatatcggtgctgatgtttctatccagacgagggcaatgtttttgatgcgacaccagacgaccgtcggcagatcggcgtcgtcagtgcgtcttttctga

SEQ ID NO: 18195 - DNA, 240 bp, A.fumigatus
ttttctcccaaggacgaagtatgttcaagctcgttgcccctggtgttgtatcaagaactaacaagttcggcagttgtccaagaacttggccgtgagggtgttttgcccttctcgaggctttgggcgagtaacaagccgttccactcgccagctgctggtctgtttgagcactgggtcgtctcaatcatcatcatgctggctcccccgccgggtgatgcatacaatttcctgctcaagtga

SEQ ID NO: 18196 - DNA, 438 bp, A.fumigatus
ctctcatcctcttgttccgcccgtttttctccttttctccctctttcctctctgtttcttccaccggcggggttcatgcgtcgattctcctctgcgcggttaccgctggttctgaactcagcaaggccaccgctttcctcaccctctacaaagcccctcctactcctctctcgatccgcctctctcttctcctcctccccatcaacgtccgtcaatcgaatcgccccccgtcgttttcccctttcccaagttgccaaacgctactgctcctatcgaaggatgtgcatgtcccgccgaaccgacgtgccttcgggctcgaccaacgtcacccatggccgtgaggtcttgcctaccaacgtcaagccggtgcactatgaccttactcttgaacccaatttcgagaagttcacatatgacgggaacgtgatcattgagtag

SEQ ID NO: 18197 - DNA, 255 bp, A.fumigatus
tccagaaacagcagaagcaactccgagacccgattcccgatcgggagccactgtgccaggcggtacagagcgcgaaagagagggtccgtctttgccaaagagggatactggtcttacgcagcggcccccttctcaaaaccagagatttggcacaccccagactacaacacctatgcgccgaataggaagcggggacaggcctccatctactcccaaagagtcaacgccgccgatgacttaccctcaaagacctag

SEQ ID NO: 18198 - DNA, 519 bp, A.fumigatus
tccccctgcgtgtatgtggattccaccatactcatcatgactactaggaacggcggcgagaagaattacctcgaatacgtctacagaaaacccaagttcctggctacggccatgtttgctgcgtacgctgtcttgctgggctgggctgcgagcaacagtgtcgtgtttggcgagtatatcctcaatgctgccgatgtggaggtcaatcggtggaatcagcgcggtattggattggcttgcgtcacagctgccttcctcatccacgctcttgctgtgaaatggggtctccgtctccagaacttgcttggtgtggtcaagctggtcattatcctatttgtcattgttgctggttgggtggcgctagccggtcacaccgaggccgagacgcctcataacttcaaaaatgcttttgagggcacaactggcagcggttatggtattgtcatggctttgtacaacgtcatctggtcgttcatcggatactccaacgccaactatgtgagtcattcgcagtcgtga

SEQ ID NO: 18199 - DNA, 2307 bp, A.fumigatus
tctatgcgcggtccggcactccgaggtgaagacccccgtctaaaaattgcggactttggattcgctcgatcacttcctgctacatcactggcggaaacattatgtggttcgccattatatatggcccccgagatcctccggtacgaaaagtatgacgctaaagctgatctctggtccgtgggcacggtgctgtacgagatggttgtaggcaagcctcctttcagagcgacaaatcatgtggaactgcttcgcaagatcgagaaaggagaggataggatcaaatttcccgaggagaacccggcatctgatgaaataaaggcgcttattcgggctcttctgaagagaaatcccgtcgagagattgaactttcccgacttctttcaaaatggcgtgatcacaagtcctattcctggcttggtggctgacgatcagccatcgataccccagggcccccctgctgatccagaaacagcagaagcaactccgagacccgattcccgatcgggagccactgtgccaggcggtacagagcgcgaaagagagggtccgtctttgccaaagagggatactggtcttacgcagcggcccccttctcaaaaccagagatttggcacaccccagactacaacacctatgcgccgaataggaagcggggacaggcctccatctactcccaaagagtcaacgccgccgatgacttaccctcaaagacctagtgctgtcagccatgcaactgccccaggacgacaagaacttgttgatcgcaatgctacatttacagccatggaacgacagaagggtcggaatacattctccgaaggttccccacagatagacagacaggcggacaaattgagagaagaaagagaacgggcagcacaagatgttgctttcgagagggactatgtcgttgtagagaagcgtgcggtggaagtgaacgcttttgcagacgagttggcgcatagcccccgcattcagggcaacatttcaagaggtgcgcagacgggcgccttgtcccgtcggtcgacagtacacggcccgacgccatcgaacccatcaccacctcaagctactgtcggcaaggccatgcaggtcctttcaggacgttctcgtgctgattcaatgcacaatcgtcagggctcatatgagcgtcgatacgggcagagtcccacctctgcaacgtctgccatttcgaaggcgctcaatatggccagtggacgcttgtttggcatgggattttctccacccctggctattacgaaggggggacggtcgcctcctcttgcttacaatccatttcccgcatatcccgcgcatggaagcttgatgattggagacggggcgaagagtaatctggctctggacgaggatacaaagactgtccaaattctggaagaatgtgctactcgcagtgacgtcgtatacggatttgctgaagtcaaatataagcagctcgttccccttgcgccgtcggtccagaccgatccatcatccaaactcaatctggccggagagagggagaatcctgactcggctgatggaggtctcacggtagatgctattgtgacattgtcggaggaggcgttggttctttatgtcaaagcgctctctttgctagcgaaatcgatggacatagcaggagcctggtgggcacggaagaatcgaggagatggttttggggattcagccatgagccgagccagtggagcgagtacacttgctggaacccgcatcaacaatgtcgttcagtgggtacgaaaccgattcaacgaagtgttagagaagggagaattcgtccgtctcaagctaatcgaggcacaaaaacggttgccacctgaccaccctagtcacccggacaaccactcggttggctcttcgctggggtcaggtgcgtctgtagacgtcgttgtgagccctggcgtctccgcagagaagctaatgtatgaccgtgcactggaaatgagtcgcacggcggccattaacgagctcaccggcgaagatctgtctgggtgcgaaatagcgtacgtgacggccattcgaatgctggaagctgtactggagaatggtgaagtgccgcgatttggacaagacaaggacgacacgtccaaggatagcgacaaaattgtgcttgatgctgtacaggctgacgaacggcaagtggtgataaagcgtgagtcgctcccgccgagcaggaaaccaactagtgctgacgatccaggcagttgtcgccagcatccggagtcggctagcagctcttcgcaagaagctggcgattcttgcgaaacgagcaccgacaccttctgctaa

SEQ ID NO: 18200 - DNA, 291 bp, A.fumigatus
tgtttctatccagacgagggcaatgtttttgatgcgacaccagacgaccgtcggcagatcggcgtcgtcagtgcgtcttttctgatcttcaatcgtgtcattggtaccggtatctttgctactccggcaacaatcttgggattgtgtggtagcgttggtctatcgctcttcatgtgggttgcgggtactgctatcgccatggcgggtaccgcggtgtacttggaatggggtactgctattccgaagtatgatccccctgcgtgtatgtggattccaccatactcatcatga

SEQ ID NO: 18201 - DNA, 396 bp, A.fumigatus
gtcattcgcagtcgtgacttgtcttctctgactggtattctgactgcaagacaggctctgagcgagacgaggaaccctgtacgcacgctgaagatcgcggcgccgatcgctatcggatccgtgggcattctctacatgctgtgcaatatcgcctactttgctgccgtgtccaaggaagatatgctctcttcgggccaaacggtggcagccaaattcttcgggaatatgttcggcgcgcgtgcggagaaggtgatgtccgtcttcgtggcattgtcagcttttggaaatgtgttgtccgtgattttctcccaaggacgaagtatgttcaagctcgttgcccctggtgttgtatcaagaactaacaagttcggcagttgtccaagaacttggccgtga

SEQ ID NO: 18202 - DNA, 420 bp, A.fumigatus
ggcgctgctaatccgtcaagcctgatctcgtatcctctatccattgtgaacgtcttcgtatccggcggtctcatctatatttacctcacgcgttcaacacgctttcctgactgggctcccgggatccgcgcgacactcccagtcaccatcttcttcttcctatccaacatatacctggttattgcgccatacattccgccctcggagggacagagtgtttacgaagaacttccctactatcttcactgtgtcgtggcgctcggcatctttgccttgggcgcaatatactacgtggtgtgggctattgtgatgccacgctttggtcgctacatgctggtaaaagaaaccgtggttgacgctgatggctggtccagaagcgttttcactcggctgccgctcgcggaagccgagcgagtttga

SEQ ID NO: 18203 - DNA, 456 bp, A.fumigatus
cagaaggtgtcggtgctcgtttcgcaagaatcgccagcttcttgcgaagagctgctagccgactccggatgctggcgacaactgcctggatcgtcagcactagttggtttcctgctcggcgggagcgactcacgctttatcaccacttgccgttcgtcagcctgtacagcatcaagcacaattttgtcgctatccttggacgtgtcgtccttgtcttgtccaaatcgcggcacttcaccattctccagtacagcttccagcattcgaatggccgtcacgtacgctatttcgcacccagacagatcttcgccggtgagctcgttaatggccgccgtgcgactcatttccagtgcacggtcatacattagcttctctgcggagacgccagggctcacaacgacgtctacagacgcacctgaccccagcgaagagccaaccgagtggttgtccgggtga

SEQ ID NO: 18204 - DNA, 186 bp, A.fumigatus
catcctacccgaatggcagtggagctctactggccagacctgaaagtccgcgacagcctttttctacgagaagggggctgcaattctgtctcccaaagaaatacgtacgacaagatgtgtctgattattatgcagatttttgtagatgctccgagatgggtatgttcatccttcataatgcagtaa

SEQ ID NO: 18205 - DNA, 189 bp, A.fumigatus
cactttccaaagtcttttttttctcatcatctcatccccccaagacgctcaggaacggttgcgcggacttactcaaacaaatcccactcacgacgtcaccttagctgtatgatcgctacctactctcagctcaagtgcgctatgtatgtgactacagagcactatgtaccacgaatcaccccaaggtag

SEQ ID NO: 18206 - DNA, 252 bp, A.fumigatus
ccaacttacgcaagtatttctgtcttcctgggattcatttttagaggctgctttaagtgctctgtgtggaacccgtatggatccacttaccctgtcacaatttacctaggtcattgtttttgtttacaaggtaactatacttccttaggtaaggtacctacagcattcctgttattttacacagcgataaaatatattgacatctcaatggtccaactttctgatatcgtaccactatgtacggagtattga

SEQ ID NO: 18207 - DNA, 222 bp, A.fumigatus
gattgcacaggttcagaagtttgccgaataaggggtgaacacggacggcacacaaaagcaggggtgggaatactatatctcctaatctacacttgccaagatttcgccatggttttcgacttgagttttctgctgttggcttcacttgcatcgccagttgcttccgctatcacctactgctcttccgtgaacactggttcttcgtactctgccagtaggtag

SEQ ID NO: 18208 - DNA, 189 bp, A.fumigatus
tccgacaaatccaaaacagagaccactgactctaaaacaactaccacagcacctacaactactcataatactgtctcgattcagaccgttgctggtattgtgaagactataacagtcccgggtacggaaccaagtgcgacaccgacctcagctttgttacaagcccgccgggatggaataagagggtgg

SEQ ID NO: 18209 - DNA, 408 bp, A.fumigatus
gtagccctgaccacctctctctgccaccaagtgatatctaatctttttcttcttacagacatcagcatttatcagtcgaatggactctgcacggacacctgcaacgctgattatgccttcgcaatcctccaggggaaacaatgctggtgctcgaacatagcacccaacaaagctacgaacaccgacatttccgattgtgccgtaggatgtccgggatatccgacagacagttgcggagatgcctctaagggcctgtatgcttatattcaaatgtctttacataatccttcgggcacagcagctgctccatcctcgacagactcgacaaagtccacggtcagtagcctttgcctcgaacttcgtccccacgcgactcatttattgccaaccggcccaataagccattga

SEQ ID NO: 18210 - DNA, 234 bp, A.fumigatus
cattgcctatcagccgccaaggtgtcctctcacgtgattattccgcatgctctggacccaccaaaaagcggtgagagctcagatgactttggcctcgctgggaagtatatatgtatgccctccgccaaatttggactttggacgctcactaactgtactttctctgtttcggaaagatcaaaagttactgttaagactcgccgctacgttgttgcttcgctattatgggcctga

SEQ ID NO: 18211 - DNA, 198 bp, A.fumigatus
ttcctcacatttaataaacatctctcacttgagtacaagttcactagtcttattcatcagctactctctactattgagtatatgtacttaataggccttgcttctatctctactgttattgttcttgtgttacctgtggttgtctttaatcctcagttggatcatcatatcattgcatcactaaggctatctgcttga

SEQ ID NO: 18212 - DNA, 225 bp, A.fumigatus
ttgggagatctccactgcgttggttccgtcatcctcaacctaagtgggatcttgctttctttttataagcttcatttcatttgtaacaagtgtaccacactttcaattcatacgaagaaatttcaagtcatctgtaatttctcattcaactacagtttgctaattaccaccatcgccaatatgacagaactcgccccattatcattatgtttctttgcagagtag

SEQ ID NO: 18213 - DNA, 1002 bp, A.fumigatus
agcgtttgctggagagtatgtactgactgtaaatttgctggatctagggaccatctaccaactataagtttcttcacaaaggacggatctggatatacctcgagaaactcgaccgtctcatcaccaacaccactcgttagtccgactaccatgtatcccagccaaccttcgccttactcctaccagccttctgcggctagcgcacctccacagcccggatatatctccccccctgaatcgaggcgggcacttgaggaagagaaggagaaacaattgcaaccgcagagacaatcactcccttcaattcacgaggcgttaaggaatgatagccctttaccataccctgctccgcctacgtcgggtcccctgccgcaagctcatccccatcctccacatgctctcgtcggtcgatcagcaggggatggcccggccgggccccccaacccgttctccaacggtgcaccagcaggcccatacacgcgcgaacctgcttattctcagctgcaaacggaggcgtcgcggtcaagcctcgcatctatcaccacacaggaatcgaggaatccctcgctacagtcgctcaactcgagcaaatcacctacccacagcgccaagactggcttgacttcgatcgcgggctcgcagacgggatcggggtacgaatatagtgctcctacttcggcggggagtatagcctcacccaatggatacactgcatattcgcagccgttcacttttcagtcacaaccaccaccaaacgcaccgacatacccactagcccatcatgatacgaggccttatgctgcgacgccctggaaacccggcgcaccagaaccaccacgtgtcgaggaattgaaaaatgggctggcagggcgtcctgcggttccagtacaacctcaaggcgactctgccaagcgccacttggacatctacgaagtggagacttcactcaatgaggtatgtattttgattacgaggaccatgtttatcggcgttgttcgctag

SEQ ID NO: 18214 - DNA, 231 bp, A.fumigatus
  unsure (59),(70): Identity of nucleotide sequences at the above locations are unknown.
ccaagcatcgttatagaaaaccgcccctcccggttcgttgccacagttgcaacgagccngaaactccagnaatggcgtcgtggtccagatggcgctcggacattgtgcaatgcctgtggcctacactatgccaagttgacgcgcaagatgggcgctagcaaggctgcttccctgggttccaatctgaagcccaaagccgcactcgatcccacgcctcccggtacccgatag

SEQ ID NO: 18215 - DNA, 486 bp, A.fumigatus
  unsure (147),(318): Identity of nucleotide sequences at the above locations are unknown.
atcgtcgaactgagtacgcggaccttggacttttcccggcactatgctactagagcgcaccatactcaacggtctgggcccatgttggggactttgcctcccctccacgagattgaagacatgatccatttgcaacatcggaatcangatgctttgatgcggttaccaaacgctgttttgaaccaggagcatgccttggcggagcacatggctcagagaaaagctttcaacgcagggcgagtccatgatagtgaacatatggcaatgtaccaagaaaaatttaagggccgtggcggatttgctgggccaaatacgaanaaaacaaaaaggggtaattctactctgttcttggccatcttcttacacctttgctttggctctggcacgattctttgcagcagtctcggacttttccattactttccggagcgtcatttcccccgcttgggcaaagactttatccacgctaaccaagcatcgttatag

SEQ ID NO: 18216 - DNA, 387 bp, A.fumigatus
gtctcctcatttcgtacaacatcacccaggaccaccccaactatggtgactcgctcccagcagctcacacctgacgatgagagtcaggacagcgatgccagttcctccgtcagcgagattttttcagacggtgaatctgatagcgactccaacagcgacctggaacttgatagcgaggactctgacaacgaagatgattctcctgaagatttctccaatgacgatggccagctcccgccagagtactacttggaacaagcagagagcctggacatctctcagcttcgacagaagcggtacagcgacggcacccaggaaaagctagacgagacccgtgagtactggaacaggttggtacccattttgacccttaatatatgtcaatag

SEQ ID NO: 18217 - DNA, 210 bp, A.fumigatus
atcgtgagagaaggggcgaaatattggaaaataggcgcaacaacgcttggaacccaagggattcactgcaatgggctaaaaaaccaaactgcgttgaactgcctgtccatcctgaacaattttattttattggatgcttctagaaacatttacacaggtagcatcctgcttacgccactatctcggaataaccaaataactgtagattga

SEQ ID NO: 18218 - DNA, 228 bp, A.fumigatus
ccatggtgcaagattctcaatatctctatatacgtggggaacggcctcgagcagaacaaactaccctttggtcaacatgaacgagtctgtctctaccggtctgtgccagattatgatagcatcatctctctcgaggcatcaggtgaccaaatcgagaggctgcctaacatccgtgacgagcacggtcggacgttggtaatgggtaaggttctcgttttttacctttga

SEQ ID NO: 18219 - DNA, 729 bp, A.fumigatus
cgcttcaaaaccctgtccagattttcacgcttttccagcattcttaccgtggaaacatttgcaggcccatcaatcccatctattcctcccacgtccgttgcccccctaccgacgagcgatccgttaccgtcgaacaacatttactaccctccagatgccggccttgaatttgaccaggcaatacagggtcatggcagtatggacccaagtatgtctccctcggtgccgattacagacaatgtgggttctcaagtgatggcttcgctaccatctgttgataaatcccctgggcctgactctggcccttcgtcttacccaacaccctctactcatcatgtcaacactccggcagctggcgggccactcatccctccgagtgcttgctgcagtccacaagtctaccaagcagtcagtacaccacagtcggtcagtaccccttacgcaaaatctgcagcgacacccgttggtttgagtatgcctgggtccgatgcaggtgcttcttcttatccgacaccttctactaattatgcaaactctcctcgattggatgagccgcaacagcaggcgcgggaccagccgattgtcggattattgcaatcgtgtacattcacaaacaagaatgtgcgtcttaataataaccagatcgaggaaattatcgaagtgggagctagccttctcccacgggaacctttcgagatcctgctgcccgtcctcgaacaacgcgggtaa

SEQ ID NO: 18220 - DNA, 285 bp, A.fumigatus
tttcagctgctgctggcccttaccatccagaaccccaaggctgtaaagcttttctgggcaatccagcaccggtccgtttgtagaaatagtcttaaagcccttaatgtggaagagcatactgagcaagcatacgtgcggactaaggaccagagttggatcaaagataatttcaggaatcttaaactcgttcctatcagatacgctcagttcgcctcactcctcaggtacccgaaaggtaaaattagagcacctacgcagccttctttccaaggaacctcttcgtga

SEQ ID NO: 18221 - DNA, 651 bp, A.fumigatus
tcccacggctctcaggacctctatcccaccatgctgacgaaccaattccgcttctcctccaacgccgtcaccgtcacccaggtcgtcgccaacctcggtgccttgtccggcggtaccctctgcggctgggcgagtcagatctttggccgccgcttctccatcatcgtcatctccatcgtcggtggtgccctgctgtacccctataccttcgtgcacgacaaatccgtcatggcggctgccttcttcgagcagttctgcgtgcagggcgcatggggcgtcatccccatccatctgatggagctttcgccgggttcgatccgtacctttgctgtcggtactgcgtaccagctgggtaaccttgtttcgtcggccagctcgaccatcgagtcgacgatcggggagcggttccccctgccaccgacggagaaggtcaagcatcgctacgactatggcaaggtcatttgcatctttatgggatgcgtctacgcctatgtcattattgttaccttctttgggccagagaagctgggccgtcagtttgatgtcgcgcatgaccgcgatatggagattgtgactgctcaccgtggagccgtcgaggaggatcctgagaaggctacagcggctcacatcacaaggactaagtgtttctag

SEQ ID NO: 18222 - DNA, 528 bp, A.fumigatus
tcggcgcatagtgcctgccgtgctctcttcggaatcgccatgggtggattatacggcaacgccgcggccactgccctcgaggattgtcccatggaggcgcgtggtattgtgtccggtctcctgcagcagggctacgccttcggatatctacttgctaccgcttttgcacgcgccctcgtcgacactaccccgcacggctggagacccttctactggttcgctgcttgccctcccgtcctcatcatcgccttccgtctgtgtctacccgagaccgaggcgttccgtcagcgccaggccatccgcgctgaggtccggggtggcgttacttccaccttcttcgaggagggtaaagtcgcgcttaagcgccattggctgctactcatctatctcgtcctgctcatggccggtttcaacttcatggtacgtatcaaccgtttgcgaacagcgaatccgattcagccacggcgaatccagctgacatggtcaaatagtcccacggctctcaggacctctatcccaccatgctga

SEQ ID NO: 18223 - DNA, 279 bp, A.fumigatus
ctcgttcaggtcgcctttttcggctggacatgggacgccttcgattttttcaccgtctccttgaccacctcccaactggccaagcaattcgataaatctatctccgatatcacctggggtatcacccttgtcctcatgctccgatccgtcggctccattacattcggtatcgcatccgatcgctggggccgcaagtggccattcgtggtgaacaacatcctcttcattgttctggaactcggaaccgctttctgccagacatacaaacagttcctgtaa

SEQ ID NO: 18224 - DNA, 309 bp, A.fumigatus
aagaaggatatgccagatggagggctttcaccaacttcacaagaagagcaaactaccgaaaacaccaacttcgaacatatcacacgcaaaggccatcactatggcaaatctctcatcacgactgagaggggtcaggggtgggtatacaacgaagccatctatggcaatcatggtgagtctcacaacccttttatgaataatggattaatactgacagcatctgcagacaatgttaatactgtggatatcattctggagcaatataagcatgacagcagccacaatagcatacgcagatttcctccttaa

SEQ ID NO: 18225 - DNA, 225 bp, A.fumigatus
agatttgcctgcaacaggctagtccgaacacgcgataccctgtcaaacggctttttacagtggaaaatcagtatctcacgcgcatccgacctgcacattggcttcacaatggcgaccgtggagaatggacacgcctcggacggcattgtcaagtcggtggagcttcgctcccgaccgagaaagacgaatcctttcagatggacatttggtctggtggtgcggtag

SEQ ID NO: 18226 - DNA, 210 bp, A.fumigatus
cacatctgcacggtgcacaggagccccgggctcaggccgtggacggtcgtcattcctatttggacggttattcgctatcatctgcactgccgcttcgcgttcaccatcagcaatattggccattggctgctgttgaacaacccattctcggatcagaaagacaagtataaacgaaaggacgacgagcagcgtaataagctgcccctctaa

SEQ ID NO: 18227 - DNA, 2454 bp, A.fumigatus
  unsure (1884): Identity of nucleotide sequences at the above locations are unknown.
cgaaaagttctcagttctatggatcagcagacgcaatctgccgtcgcatcagctgagaagagcctggtctttgaatcgaccatgacaaccactgcgactgtgggccctgtgacccaccccacactgtcacctgccgagcagaccgcgcaagctcgcgaaaagattgcctcagaccttcaaacatggcagagaaggttcgccactgccgtggaaaagggttctgaagatctcgaggaacgcgtggaagagatagtggaaagctacatcagaagcggtgtaaacagtcatggcgagagtcttataacagctctagaaactgtcgtgcaggatgagatctcgtctgtcaaactccgtattaacgagttagccgaatcgctcccaggcgaggaggcgcccgagcaggagggaaaggtccaggatgaacttttgaaggagatcagacgggctgccatttctgtcagagatcgcgcacatgcagtacgagaatggcggaactctttcgaccaagaattaaccaggcgtacttcagcagcagtcaactctactctcgatgttctggacagtgtgcgagacctgggtctccaggaaatcggtatgcgatgggcatggatggaaggcgtcacatacaaggattgggccaagtaccatgccctcaaagctcaattcgaagactggaaaaatgatatcttcaatgtcggaatgcagcatgtgaaagtcgaggaagctaaggaattggccaatgatattctggaccgtggcatggaggtcgcagaagatgctgcaaaggagctggccaggctcaaagacgttggcagatggaaaatcgcggctcgcgaagcaagtgatgattttgaaacaagaatcggggaccctcctccactaccaaaacgcagcaagactgacgaggagtcgaaaagtgccgaggctaacatcgccgatactgaaaaccatcaatccatggagggctctgagcaagctacatcaggcacagtcctggattctgaaggcacagctgctcacggcaaaggggattctgaaaatgacctatgttttgatgatgatatcccattgacccatgataaattatctgtatcgcacgatgatagtctgccaaaacactccagagccagtgacgtatcatctgcagcagacggatttagtcccgcatcggtgccagaagcagacccaagtgaaagcgttgagccagtcaagatggccttgggtgtcgctgcggctgagtctgtgccgaaacaagatgcctccgaacatcatgtctttcccgagcaattgcacgagcttgtcagccaggctgatgaccagttcgcgaaagtaacaagtgccgccggccaagcttggtctgatggcagcgtcgcgtccttggctcaccaggtcgcttctagcatcacctcaatggcagcagacgttacgccacttgcatatatctcgtccgtggcttcctcgaagctgagcgaaggccttagtctcgcctcagcccaacttgacagagtccgagcgacggcaactccaacaacggctgttgagcagaaccgtatccttcttgatgcacaaagacgttactacgaggctgttggtatggcacatgaccattactctgcattcgtgtcctctgcctctcgagcggtgtatggtgctcctactccgacaggacaccttgaacagatggctagtaaagcatccgagaactgggagagtctcgtttccgcggctagcgaacacttttatggctctcgatcgcactacacccccccggctttgagtgatttggttcttcaatatgaggccatcgaacaattagtatctgagctgatagttggcaaagaaccttcttttacggagaaagccctaagcagattgcacgccatntacgaaaccccatacccagtctccgcgctttcagcagcttcgagttatgtcattggggagcatactgctaccgcttctgctccatttggctcggacacgaacgttccatcggttgagaacattttgcataatgccaacgaacagttccagtcggcgatcaatgccgtgagtgttcagctgtatggtaccaccaagggtcccttcgaaaaggccacatcttcagcgagcagcgctatgtcagcggcctccgcccacatcagcgaagccgtttacggaactgaaccaggatacttggaagccgctcaggaagcccttgagcatgcatacgcatctgccgaatccgccatcagaaacgcagtcttccagtcagctagtccaaccgaagctgaacaaggagcttttgccagcgccaccagcaagctggcggaggctgtagaaggagcacagggccaacttgcaaacctggcttcgagtgccagcagcctcgcttcggctgcggtagagactgtcacatcaaaagtggaggtcctcactagtgacgatgacacacctgttaaggacgagttatag

SEQ ID NO: 18228 - DNA, 504 bp, A.fumigatus
aaagcagccaagacccttgccgcccggcaatgcttccttcctcttacgcacgcacataatcgccttctgtctgcattcccatcttcttgctcctgcaagtggaccttcaaccgtccacgctcgttaaagccatatttcttccttgcatgtccgacactcgccatcgaattctatcttgaacgattgggccgtccaagctacaaccctgctgacggttccctaaggtctcccggggaagacctcggagcttctggtctgacggagtacatgtgggatgtcctctactggacctggggctgtatgggggcggcttgtctatttggagatcgcgcctggtggctgtggatcgttattcccatatattctgtttggttggcctataccaccttcaccgggatgaagagcgggttggccggaatgggtggagcggacacacccgtcgcagaaagtaagagacagaagaagatggagaagcgtggaggacaacgcatgcagtaccggtaa

SEQ ID NO: 18229 - DNA, 1434 bp, A.fumigatus
gaatcgtcggatagacgttggaaacaacactattcaagtatggatttctcacaggggcaccaccaccagtatgcgggccccacaaatttcccggacctgatgaacgattctgcttttgcgatgaacaacaaggggaaggaaagagattttgaagaaccagatacatgtcggatttgtcgcggtgaaggaacactggaggagccactgttctacccttgcaaatgtagcggcagcatcaagtttgttcatcagccctgcctggtagaatggctgtcgcattctcagaagaagcactgcgagctttgcaagacgcctttccgatttacgaagctatacgacccgaacatgcctcgaaacctcccggcgcctttgtttttgaaacagctattcatccatagcttccgcactgttgttacatggctacggttcattctggttgcttttgtctggctcgggtggcttccatggtcgatgagggcaatttggagagcactgttctggcttgcagatggccactggtccggtggtgacgcctcccaacagcttcaagctcggcaatctgctgggaacgaaactacttcccttgcagccggagtgactacctcagtcttgcagactcccagtgctgtcttgtcaaatacgacgaattcatcatcattttatgccccagtgtcatccatgttcactttcccctctggtgacccgcttctgcttacagtcgctaagaaagtgatatccgcactattctcttcagccatcccatcggggaatggttcatcgaactcgcgaccgttgaacgtgactacgggactgtacaagcaccgtcacccctcgtggctgtcggacgtgaagttgctcaactccttgacctcatcacccaccatcaataatattatcatcgacacgttagaggggcagcttattacgctgctcgtcgtcctttcgtttatacttgtctttctgatccgagaatgggttgttcaacagcagccaatggccaatattgctgatggtgaacgcgaagcggcagtgcagatgatagcgaataaccgtccaaataggaatgacgaccgtccacggcctgagcccggggctcctgtgcaccgtgcagatgtgttaggggacgagggagagcatatggcagagcatggcatcggtggtgatgacgttggtatacatgatattcattttcttcggccaactcgcaggcgttctcttcaaggtggcgaaagcgctgatttaccagctgccgagtctgtggaaacagctggtttcgcaacatttccagaaaatgacagtgatagcgacaatggagcgaatgccgaccatttggcgagaagatcgcctactcgagctaatcagggaggttgggctggcgtgagactttcagagacctctggtcccgcggcaatggtgacccggagcagattctaa

SEQ ID NO: 18230 - DNA, 252 bp, A.fumigatus
ctacatgtaccttatggacaaatcaatgccttctcgcgcatgttgatcggcgagggaacatgggcccccattcaaatggtcgagaagctttcaagtgtgacagccaatgatatacgcttgtactttcccgaactgctggggaagatgcacattgagatcctcattcacagcaacttgtgtaaggaggacgcactaaacattacaaaacttgtggattccacactcctcccatgtcgattgccagagagctag

SEQ ID NO: 18231 - DNA, 336 bp, A.fumigatus
ttcaccatgaaggctcatctcctcgcattagcctctgtcatcccttcagcccttggctgtcttcactatgttggtcaaatatacttggcgcccggtgggccgcagctccagaccgcttggattattgacgatgggacccttgtgtgtgacgcagcttggggccaatcacgtactatggcgggttacaagataaactgcaagaatggttactccctggaggtcggggccgatggtggccaggcttggtacggcacgccacacggcaactttcgctggacccagggctacgaccgtagtgataatttcattgtctgggacaattggcggtattgctaa

SEQ ID NO: 18232 - DNA, 231 bp, A.fumigatus
ctaaccgggttccagcctcaattcagcagcacgaccgcgaacgaggagggatctcagccatggaagatgatgcaggaaatccaaaacctgttcaagccggagatggctgccgctcttgaagccaacgccgagtccaacgagatggacgaagagtctttggagctcgagctggccaggctccaattcaatcccgcgagacccaacattgtgaatgcggaggagcaatactga

SEQ ID NO: 18233 - DNA, 336 bp, A.fumigatus
agtatcagtcgcgtgctcattgtcgaagagccagcaggaggcaacgtcaagggtgcagcatttaacctgccggtagacatcaacagagacactagtgcttgcccagcctgctatttcttctctaaggcgattcgatacccgagagaggataccgtcgagggtctgagagttgagattgtacgaattggaatagggatgggaaaacatacgtttacgctttctgtgcttgtcgttatctgtcatagtgactctaaaactgatcctgcacccggtgagacatcgactgtgtcatttgattgggaagttgctaagggcccaggaaacatactcgtctaa

SEQ ID NO: 18234 - DNA, 414 bp, A.fumigatus
gataaagtgtttgagaataagactgttgcatctacgatgacatacactgatacgtcacttgtttacaccagcctctttgtctgcccagaagtatggagcaccagcagctattattatgaacatggcaacaattccactacttcgtgccagaacagaaacttggcccaggccatcaaggacctcagccacaatttcacctacagcctgctcagcctcaatggcggaaacaccaccgtcgacatgacggacttgacctgccgcaactactattcctacggcagtacggccctgctcggggtttacttgagtgcgctggccgtcatgattgcgtgcgtcgtcgtaggcttcctcgccctgcgacgaaacggcgtttcgtacaacaactcgttctcaggtgtcttgttgacgacttag

SEQ ID NO: 18235 - DNA, 201 bp, A.fumigatus
tgtttagcagtttttgaccgtcctaaagcttccatctacacagaagacctgtccagagccctgcgtgtctcagcccgcctcagaactggtacagttggtatcaacaaaagcttctctcccgaggttgagacccctttcggcggggtaacattagtggttcaggatgtaggtcaggaagaatgggtctatggaatatcttga

SEQ ID NO: 18236 - DNA, 1164 bp, A.fumigatus
  unsure (56),(1070): Identity of nucleotide sequences at the above locations are unknown.
gtcagcatgccccaaatggggttgagggcacccaatggtaataaaactcgaacagncgaagtcattaccctgggcagatttatttcagaaatagtcaatcttcgagatgatcaaggggacacagcacttaaccttgccgggcgagcgcgctctgtcttagtgcctcaattactagaagttggtgctgaccctcatatacctaatcacactggtctctgtcctgctgactatggcgtcggcgtggatatggttgaccccaatgctcaatcccagcaaggcggaagcaagaatgactctttcattgatcatctggccaaaacaaagaaagaaatttttgatggtgcgggacctctccaaaaagctattgaccaagatatactaacaacttttaaagcaacaatggcccagatcagcgcaatagtacaggagacattaggtgggatcgataaagaactagccaccgacttgtccaagaagcaagagaagtttgaacattggcattccaaaatacgcgagactgccaaagcccgccaaatagaacagaagagactggacgacctcaagagcaagtcttcgaatcgggtcgaactaagcagacggatcaaaaatttggaaaggtcatcggaagatcttctcgtgacgctcaaagagatacatggtgggaacttcgagccttccaagatgacgatagttggagatgcggatcaagattccggggtcgacatgacggaattcgatgcccttttccccgaaacgttcgatcctacatcagggttttccgaaaagcaggaagcctttctcaagtctctgacttctcctgagattctgcagcagcgcatcaaatgctatcaagacttcaatcaagagatacttgccgaggtggatcgcttgaaatcgaagaacgtggtgttgggtcagaactatcgtcgaatggttatggcctgtaccggctggacgggcgaacaggttgatgaacccgcccgaaggttaacgccatgcgttaaagatttgaatgaccatcctgttcctgaggatgaggctatcgacaatctcatgaaggatctacgtcnggaatgggtacctgtgactggtccaaataatttttcctgtttttgcgccaccagccgccatctccccggaattggtcccattcctccccccggg

SEQ ID NO: 18237 - DNA, 1425 bp, A.fumigatus
caattcttcttgttcaaggctgtctattccaacgtctcggtctacgaaatggaagtaaacggcgttgccgttatgaaacgtcgttccgattcctggctaaatgctactcaaattctcaaagtagctggcgttgtcaaagctcgaagaacgaaaactctcgagaaagaaattgctgcaggcgaacatgagaaagttcagggaggctatggaaaataccaaggaacatgggtcaattatcagagaggtgtcgagctttgccgtgagtatcatgttgaggagttattgagaccgcttctcgaatacgacatgggacccaacggcactgcaaatgctggcaatgacactctagacactcctacaaaggagcaagcgatggcagcgcagaggaagaggctttatagcggtgtggataaccgcgggatgtcgcaaccgcagcaaggcaccttcttccagaatatctcccggaccgctgcaacggctgtcaacgctatcagcaaggctcgattcgattcacctgcagcaaggaacgccgatagtaggcgctcgagtatcatgcgaaagtcgtcacatcagatcggcagccaggagtctcaactccccaccttcagtagtcagcagagcatgtacagcgtggcctccgacagtggatttggcagcaatgcacagagcaatggccgattcaatggccctgatgtcgccactttcgaaacggaagagtcgatcgagccacctcggaagcgtatcaggtcgtcttcaaaccagatgccatctttcgggcttcaacgggagcactcttccttgtccatgcaagagcctaccccgacggaaccgaacgactctttctaccaggaaatggatgggcccgcttctatggcggatggcaacaggcatggtacagaccctctgcctcctgccacaactccagaaagatttcagaagatgaagctcatcatgaccttgtttcttgacaagaggaccaaggatttctccaaccatccggcgttgttgcaactcactggtgaagatctagaaattccacttgacgaataccgcaacaacgctcttcattgggcggcaatgcttgctcgtatgcctcttgtctatgcgctcgtcgagaaaggcgtgagcatctatcgtttaaacggtgcgggcgaaactgctttacaaaaatccgtcgggacaagaaacaacctcgattacagaagctttccgcgcttattacaggtgctggctcccaccatagacatggttgactatagtggacgcacgatcctgcaccacatcgcagtgatggctgcgactggtggtggtgggcatgtgtccgcgaagcactacttggaggctctcctggagttcatcgtccgccatggaggcacgtccataagtcagcatgccccaaatggggttgagggcacccaatggtaa

SEQ ID NO: 18238 - DNA, 366 bp, A.fumigatus
attgatagcgacgatgagcggctaaactacatcgagtggaactgcgaccaagttcgtcgacggattcgctccttcatcgaaagcggagagatgaaaattggcgaattccaaaatgcaattggcgtctcgtcgcgttcctacctggacttcatgggccagcacggccgcgacaagggctctggatcatcgacatatatcaatgcggcgcgtttttttaagaaacgcgaattacaaggcatcaagccactccggaagaagagggcagccaaggaatcgcagaaaaatgtggccgaaaagtacgatgtgtctagtattcatcttgacggagagtcggacccagagctccccggttggggacacttgtga

SEQ ID NO: 18239 - DNA, 321 bp, A.fumigatus
cttgccgcgtgggagcagcatcgtgccggaggtgatgaccagggcgcggtctccgcctgcagcggcaagggaggaccccatggcgctaatggcggcgcggtctgtggcgcaggagccggcgtaatcggtgaagtcgtggttgaaggcgaggtggatgacggcgtcgcattcggaggcggctttcttgaggatatccagctgttcaatggtaccgcgtatggcctcggcgccttggttttcaagctgttcgactccactctcactgcgagtcaggccgaggactttatgtcccgcagagaggagttctttgacgacggctga

SEQ ID NO: 18240 - DNA, 234 bp, A.fumigatus
cgacttcgcggtagttttcgcaaaacctcagaaaccctatcagtcgtcagcgtgtttatgagtctattcagtccgctcaagtccgacaagctcgatcactatgttccagaggacacagagatcaacagtctagaatcacaaatcgtgcggaaacgacaagcaaagacaacaatggcctctggtcgaaagactccactgcaacctagtctgaaagtggtgcaacgcaccctttga

SEQ ID NO: 18241 - DNA, 564 bp, A.fumigatus
atggctattggcatcctgctagaaaccgcagctttcctgggagcgtcttggagcaacaagatttggcaactctatctgagccaaggcgtctgcttcggctggggtctggggctacagtatctctcgaccacatatctgatcccccaatggtttagccgaaaacgcagtctagcggctggtattgcgactggtggcagtggaactggggggctgatatactccctggccacgcatgccatgctggcgcggttcagcatcgggtggtcctatcgcattctcgctatttgccagctggtcgtcaactcattctgcctactggttatccgtgaccgaagtgctcaggaccactccagctcgcggacattgaagatcaacttcagcctgtgcgcccgatacgagatgtggctgtatatcggctggagcttcctcagtgttatgggatttatggtgatctggttctccctggcaacatatgggcgaagtgtgggtcttacctccacgcaaggtgctgtcgtcaccgccgttatgaacattgggcatatgttcggcatgcctgccgtatga

SEQ ID NO: 18242 - DNA, 963 bp, A.fumigatus
aaaccttcctgtcacattcaaattcctagtgtatttcacttcatcatgcgcgtctttgtcactgggtccaccggcttcgtcggctcagccgtcgtcaaagaactcctctctgcgggacataaagtcctcggcctgactcgcagtgagagtggagtcgaacagcttgaaaaccaaggcgccgaggccatacgcggtaccattgaacagctggatatcctcaagaaagccgcctccgaatgcgacgccgtcatccacctcgccttcaaccacgacttcaccgattacgccggctcctgcgccacagaccgcgccgccattagcgccatggggtcctcccttgccgctgcaggcggagaccgcgccctggtcatcacctccggcacgatgctgctcccacgcggcaagctaggcgacgaggacgatgcgccggacatgacccacccgatggctgcggcccgcggcgcgtcggaaaaagtgtgtcttgactttgcgaagcagggtgtgcgagctagtgttgtgcgacttccacgtacaacgcacggccttgggttctcaagattcacgggctcgtttgtgagcgttgcgctgcagaagggcgtcgcagcatatcttggcgatgggcagaaccgctggtgtgccggccaccgggacgacgcggcgaggctgttccgactggcggcggagaaggccacacctgggtcggttttccatgcggtgggtgaggagagtgtgccgaccaaggagattgcgattgcagttgggaaaaagctggagattcctgttgttagcattccgccggagaaggcagaagagcatttcggttggttctggtttggtgtcgcggctgataacgttgcctcgagcgcgaagacgagagagcggttgggttggactcccgagggggcaacgttgatggaagatatcccggctattgttgactttataaagtctcaagcagtgtaa

SEQ ID NO: 18243 - DNA, 1167 bp, A.fumigatus
gttaagtgcggatcctgccaggcccgtggtgaagacaagtttgacggcgaaaagtgcgtcacgacttctctcgagcagccactctgcgaaacctcactggagctccgcgacggctactgcatatcagaagagacgcccatctgcgacgtgggagtatggaatggacagtactgtctgttcgatgaaacaccgcactgtccgtctcctactcggttcaatggtgtggaatgtgtctccacgcagcccccgacctgtccgccaggctcgcatgtccacgctaaccagtgccgtggcgacaagccagcgagctgtccacctcccttgcgactagtgaaagatcactgtgtggacgccacacctccagagtgcccgaccggcttcactctcgtagggactgtctgccgctcggtcaagccgcctcattgccccgacggtcaaatgtactataatgggaactgcatcatcccaaccatccctcaatgcccggacggattcccacccgtgggcgacaagtgccttgcagacgtccagccggaatgtcccccaggcttccgagtcgagggcaagaactgcgtttccaccgagaaccccgaatgtcccccggggctcgatcgggtcggcgcagactgcgtccatcgaggctctccttcctgcgctccaggtacagtgccagacggaaaccgatgcatctcgctggtcccacctcaatgtcccgacggtctcgtcccgcgaggcagcgaatgtgtggccaacgataaccccgaatgtccaccgggtttccgtttcctcgacaatcactgtgtctctgagaataagccccaatgtccaccgggatctaccttggtcggcgaggaatgtgttgttgagaaggcccctgactgtccgcccggtacggaattccactctgggatgtgtgtctcgacgaagcggccggaatgtcccccgggcctggagttgaagaataataagtgcgtcaggacctcggagcctgagtgtcctcggggccagaaattcaatgggtccttctgcgcgtccacggatgatccacagtgtcctgaggggacaagctatgatggagcgaggtgttccgtcaacgccaatctttcttgttatgagcttcaatactgtcctcctactgctccgtcccggaacgttttggtgaagtaa

SEQ ID NO: 18244 - DNA, 627 bp, A.fumigatus
  unsure (158),(374): Identity of nucleotide sequences at the above locations are unknown.
gtggaaggggtcaatgcattcgactacatggttctggctcggatgatccacttcttcgtcccggatcgtcgaataggcatcttcaaaccctccatgctcgccatgatctttgtcgtcctggacctgggatcctttgtcatccaattgacaggaggtancatggctggtgcgggggcggaccacgacaccatgatgaagggaattcacatctacatgggcggcatcggtatccaggaattcttcatagttctcttcctcttcattgcgatccaattccaccgccagatgctccatctcaatcggcatggaagactcgttggacccaaggcaaaatggagaagcttgctatacgcgttgtacgcgagtctgctgtncatcacggtgcggatcatcttccgcctggtggagttctcctcggggaatgacgcgtcgaatcccatcctgcagcatgaatggtacatgtacgttttcgacgccgtcccaatgtggtttgccattgtggtttggaacgtggtgcatccgggggctattatcaaaggccccgacgcaaagatgccgcctagcccccctgcgcaagatattatgctgcgctttttgttgttccggctgcagaaagaggaagaataa

SEQ ID NO: 18245 - DNA, 231 bp, A.fumigatus
tgtcccgcgcacgttcggggcaagctgaccacctgtagatgtgtggatttcacaattcctctcggacaggtggactatgactcgccggtgaccatggtgacggagcagtggccggtgacgatcaacatcattgctcgccgggggtgcgactttatgctgttcaatatgatcaagcagctggctgaagaaggtgtgcttcgatctgtcacgactggaaggacggctttgtag

SEQ ID NO: 18246 - DNA, 528 bp, A.fumigatus
tttgaaccagcagacatccatggcactggtggaatccggccccatccagggagccatctggaatgccatcgtcgaggtgtctgccgcagccaaggtcgatcctcggttgatcctggcggtagtgatgcaggaggtaagtccgagcctgtactctttctaactattgctaacacctcccagtctagcggtaatgtttacgttggctgcacgaataacggcgtccaaaattgcggcctgatgcaggcctacgcggggtctgtgtcgttcaaccccaacgatccacagggaagcatcacccagatgatcatcgacggtacacaaggcacagcacaaggcggtggtctcgttcaatggttcaacaatgagaatgttggggcaaacaccggtggtaatccgtacaatgtgctccggggctacaactccggcagcatcaactttaatgatctggacgatccccaaggcgctactgcttcgtatgtcagtgatgtggccaacagattgcaggtgagttctgtctgtcaaaattaa

SEQ ID NO: 18247 - DNA, 1926 bp, A.fumigatus
ggaccgaccacagtctttaggaaccgccaagttggttcttacgaggagcgtcccttcaacatgaacccttggaaatctgtttttgtcaaatgcttgtttttctgtacggcggtatctggaatatccaacagagagattcccatgactgatgttcagccatccgctcaaggtattacatacgaactcggcaatgtcacatactttgccaacatcgaacatcccagggcaattttcgacttggactataccactacttcccgacttgtgccatcagcagtccttctggtgaaccagagtctggtcaccggcagctatttgaagtctaccatctccagttaccttaccgacgatgatgtcttctcggccgatttcttgcacgcaatctatttcacatcaacagtcccaaggtctagattggactcgacggcagaggaatatctcaggagcctcggtgtggctggtctgctattcaatgcgagctcttttgatcgtatcccgagcaatggatatgcgctgaaggaggaccatgacgcacccctcccaccaggtccgtttaccattctcgtcaacaatgggtccatctcttttcttgatacataccgactgtatgtcgacaactttcgcacctttgtcacgggtgtatattcttccaacgacggggttggttcatttgctgcgctacctgcgatgaatccacggctcggggggccactgattcctgcccccagtcggattcattcctggaatgacgatagaccactggcagggaagcgagttgcggtgaaagacctttttgatatcaaaggccttcagacctcagccggcagccaggcatggatccatgtcacaccgattgccgattcgactgctcctgccattcaacgcttgatcgaccttggagcggtgatagtaggaaagtccaagctagctcaatttgcatcggctgcagatccgtggaattggactgatgaacaggcccccttcaaccctcggggtgacgggtacctgacctgctcggcctcatcctctggaggcggatgcggaatcgctgcgtacaattggtttgacgcggcaattggaacagatacgggttcgtcgatgcgtcgtccagcgtcggtatcggggacgtttgggaaccgtcctagccagggtatgatgtcgcttgagggtgctgttccgctgaatgcaggagaggatacggtcggggtcttttctcgtgaccctgtggaatgggccgagtttgccaaagcctggtatacccctagcctgcatcaagatccctccatcaacagtctgccccctctatcggtaccagatacaacagcatttccgaagcggatcttgtatccagtggagtatcttcctctggcgaatccagcagcgcaggccatcctcgagaagttccttcacggcatgataagggtgtttaacatgacgatcgagcggacgaatttcaccgcgaccgcgagcaacgcatccatttaccctggggccgctggggatgccatggtcaactggaacctcttatacgacgctggggcaacgctacagctgtggacccagtcaaccaaggtctacggaccgctgatctccacctgggctgcgaggaatgacggtcgtttccctcccgtcgacgcgcagtggagggaggcatggactagatatgatgccagtcatatcacgcagtccgggtacgagcaggccttgcacacgaaagctgcagccgtcaactggtttcaggaagaagtcttgtacgagacctctgactcatgctccgaggctgtgatgatctgcgacggaggcaccggaggattgccgagtttccgtgagcaggcgttgaacaatagccccaacgccactttcatgagcgtgtttccagagcatgcagacgtgtcttgcagcggtatctgtactttatttgggtaa

SEQ ID NO: 18248 - DNA, 642 bp, A.fumigatus
  unsure (30): Identity of nucleotide sequences at the above locations are unknown.
tgtccacgtacttggcgttcggcggtgaanaacatcgggggctccgccacactgttcctctatggaggctgcgtctggacgtttttcaaccacaatggtggatgtaacggggactgccaggcgaacgccgttcgtatcctgtcgtccgctggctcggtgtatctctacggcaccaacgtcaaggcgatcagcaacatcgtcctcgagaacactgctgccgctgccaaggaaagcgacaactctggtggatggggcggggtcgtcgctgcgtatcttcacaatgtgggctccggcagtcgcacgcgcaggtccagcaatgcgaacggtgccgcggtcaccggtaacgggttaaactggtatagctcttctctgaccagcggcgcatccggataccaggatcctgaatactactactgcttccgcggatcggctgctaacttcccgccaatccagaactggatgggcttcacggcgatgtttgatttgaaccagcagacatccatggcactggtggaatccggccccatccagggagccatctggaatgccatcgtcgaggtgtctgccgcagccaaggtcgatcctcggttgatcctggcggtagtgatgcaggaggtaagtccgagcctgtactctttctaa

SEQ ID NO: 18249 - DNA, 276 bp, A.fumigatus
agaaggtgtgcttcgatctgtcacgactggaaggacggctttgtagcaaggtctaaagactctgttttcattctaactaccaacgaggacaatgatttgatcctaggctacaagaggaacaggcgcactagacagtatctagaattgatgacttgcatagtatgtagttatttcctagagcgcaatgaaagacgacaaatgactgaatcactcactcagaacgcgagctaccaaaaggacaataagccaaatacacgtcacagggatgccgactga

SEQ ID NO: 18250 - DNA, 402 bp, A.fumigatus
ggggggggggggacgcgttaccttccagccccggcgttaagactccggagcgtcgacgaaaccgacaccaagctgtctcgcgagccacgccgcattcgaacaatatccgagtcgcgcccaactggctccctcatatcacggaagtcgcgcggcggaggcggcggcgaacgggagcgaccacggccaaaaccgatccgcgaatctcgaggatcgaagtctcgctcgcgtcggggccagtcccggtcaatatctcgacgaaaaggtgggggtccatcgcgaggatctcgaaaatcccggtctcgctccctgtcccgatcccgagggtcacggtcgcggtcgcgaaactcagcccgaccagggaagcctcgacctcgaccaccaaagggagcgccacgaggatga

SEQ ID NO: 18251 - DNA, 924 bp, A.fumigatus
tgtggacagcgagcatatcgtcaccctgaaacaggagagaaaaccacgatattcctcgggtatacctctaatcttatctcctccggtctacgtgacaccatccgctatctcgtccgtcaccgccatgtctctgccatcgttaccacagctggaggagtcgaggaggatctgatcaagtgcctagctcccacatacatggggagcttctcgacaccaggcgccggactgcgggccaaagggcttaaccggatagggaacctcatcgttccgaacagcaattactgcgcgtttgaggactggctaattcccattcttgacaagatgctagaggagcaggaagaggcgaagaaaaaggcccttcggacaggagacgaggaggatgaactacactggacgcctagccgcgttattgaacgcctgggtcgcgaaattgacaacgaggactcggtactctactgggcggcacggaacaacatcccaattttctgcccggcactcacagatggttcgcttggagacatgttgtacttccatacctatcgatcttccccgcagcgattgcgtgtggatatcgtcgacgatgtacgccgcatcaacaccatggccgtgcgggcagcccgtgcaggaatgatcatcctcggaggtggtgtgattaaacaccacattgctaatgcatgcttgatgcgtaatggtgctgaacacgccgtttacatcaacaccgctcaggaatttgatggcagcgacgccggtgcccggccggacgaggctgtcagctggggcaaaattaaggctgatgctaatgcggttaaggtgtatgcggaagcaacggtggtcttcccgatgatagtgggccgcctcttttgcccggtccagcccaactccatcggccgaagactcggacaaccacaactgagaagacaatga

SEQ ID NO: 18252 - DNA, 261 bp, A.fumigatus
ctttctatctcctcctcaaagatgacaaactatcactcagggtcagcagaggctttgcctccgtcatctgccaccaatgccgtccttgtcgcctccgaacccgtccccaaagggtcacacgaggttcgcggcgtcgactttgatcgtttccaagggcgagatattactgttgcagaactggtcgacaacatggtgcatatggggtttcaaggaagcgccgtcgcggaggccacacgtattatcaatgacatggtaaaatga

SEQ ID NO: 18253 - DNA, 624 bp, A.fumigatus
  unsure (611): Identity of nucleotide sequences at the above locations are unknown.
gtctttcgtcgagtttctgtggttcgaggacgaagcgagatggagatgctgaccgtcgcagacgattactgggagaagaacttccacccagatctcgacgatccagagtatcggcccgttgaaaaaggccgcctgacatggaagatcaagggcgtgcgagggaccaaagacgcgcccaaccgcagcaagatcatgcgttcccctcctgcttacatcggcggttactggtggacaatcaagtttttcccacgtggtaacaacgtgggttccctgagcatctacatcgaatgttccccgactttgcctcagcctgacaagacactgccagagaccgagatcaaagtgatgcggggaccggccgattcggggctcaacaacgccgctcccgagctggacatgaagtttgctcgaactgaagacacggcaagttggcatgagcagttcacggcacagtatcccgcagcggctgccagcaggcaagatcctccaaaggacacctggagagtgtcggcacagattggtgtcattttgtacaacccggacgagcctcgcacgggttggatgcagtcctcgtgcgaccaattcaacccgttttcacagcgacggtcgcnggacagtagtaat

SEQ ID NO: 18254 - DNA, 420 bp, A.fumigatus
atacggattttaccctcttccgcaatggatactcgcatggataccgcggttaccgtggagcagctcccccccgcggtcacgctgagtgtcgatgctccctcgtcagaaacagtcactgttggcacagagcttccggagcctaccagcgaaaacaacgttacagagatccctgaaaatactcctctagataacgtccatccgcagtcacatgaaccatcagatccaattcctgcaccccaaccgccgcaacctgagctcgagcatgcatactgggccgaaatcgaggaggacacgtcggtacctgatgaggcggagatgaaggaaatcgagtcgacagcggatggggactatagtgcttacgagtgtaggtctttcgtcgagtttctgtggttcgaggacgaagcgagatggagatgctga

SEQ ID NO: 18255 - DNA, 642 bp, A.fumigatus
aagtctccaacaggcttttgtacaagctcacacctaacctgttgcaggctgcctgccaggttaccttctttcaacctctttagttatgacctggtgatgtcttcgcgatatcctccatcatctgggttcaattcccgtgaccgttctccccagcgttttggtgaccgtcgccctcccgctggccctcgtggctccgacgatgcaagcctggctccattgggcagagagcccccgcgcggccccaaggccctgatcgatcatcctcgtggcgctccctttggtggtcgaggtcgaggcttccctggtcgggctgagtttcgcgaccgcgaccgtgaccctcgggatcgggacagggagcgagaccgggattttcgagatcctcgcgatggacccccaccttttcgtcgagatattgaccgggactggccccgacgcgagcgagacttcgatcctcgagattcgcggatcggttttggccgtggtcgctcccgttcgccgccgcctccgccgcgcgacttccgtgatatgagggagccagttgggcgcgactcggatattgttcgaatgcggcgtggctcgcgagacagcttggtgtcggtttcgtcgacgctccggagtcttaacgccggggctggaaggtaa

SEQ ID NO: 18256 - DNA, 330 bp, A.fumigatus
tgctggggagctgtttatattgcaatgacaatgttccatggcagatatgccgcccgcccacgtgagagaacctcccgctttcagattggcgataaggatcagaaggcgatgggtttcctttgtcgatcgaggtgtagcacacagtcatgtaagataataaatttccttttctttttcagcgagtcggctggtgagaagtattatataggagtcaacgtgcttgattcgaccctgtccttgcagtcaaagcacatgcaagcatattctacatcatttgcggagaacatctacacgccgcgcgctcttgatttctacccgcacgcggtgtag

SEQ ID NO: 18257 - DNA, 576 bp, A.fumigatus
atagagtctggaagagcagcattcaaggtaaacctaaagatggcagctgcaagaagaatgtttggcggccggaattgtcgtgggccccagccaatgaggcgccccgtgattccgatcgcttgtcgtagaaagctctttcgacccgtatgccgggcctccgttcaacctcatcgaattcctcccgtcgtatcattcaattgctctcttcccccctcaactctcctcccctccacccacctccccgcaatcattgcgattgatagtctcatcatgtcgctttcctccgcctcaagcactctgctgcgcgcttgcgcccgccagcagctgcccaccacccgcgctgctgtcgcctcctgccagcaacggagaggactgtctgaggcctccaagtcctcctccttcgatagccctttcggcaactcccacgagtaccagtcgaccctgaagattcccagtttcagcaaatacgcttccaacaagccccctcgctcgaaccaggttttctcctacttcatggccggagccctcggtctcggatctgctgttggtgccaaggctactgttcagggtaggtga

SEQ ID NO: 18258 - DNA, 216 bp, A.fumigatus
acggttactgatagcgaattgctccatcgtgaaggtgtctgcactcaccttggctgtgtccccattggtgaatccggtgacttcggcggctggttctgcccctgccacggttcccactatgatatctccggccgtatccggaagggtcctgcccctttgaacctcgaggttccccagtacagcttccctgacgagagtacccttgtcattggttaa

SEQ ID NO: 18259 - DNA, 321 bp, A.fumigatus
cgaatgacagctaccgccgtttctcgaatcgataatctggagtttcttgccgacgtgatacccaaaacaactacctataaacaattcaaagagaagaaagaaaaagaagccaacaaagacgccgctttcgagaaaggacagcgcacattgaacggcacaatgccttcgatgatcaaagaaaacggcgagggtggtcaacagaaagcggataagccttctataagccctcgagctccgtctctcagtacgttgatggctgatcgcactgtcgaggcgcaaacaggagaaaacgaccgtgatgtcgaaatggtagaccaatga

SEQ ID NO: 18260 - DNA, 246 bp, A.fumigatus
  unsure (130),(225): Identity of nucleotide sequences at the above locations are unknown.
aagtcgcttcggaatacaatcgcgggcgattcggcgattggggtcatttggtatcacgtggagcaggttgctgatatgcaatttttccttcagaatttctttgtgaacatgtccgcctccgccgatgtcntggctcaggccaaggttgaaatcggtctcgattcgatccccgagggcaagaacgtacgtgtcccgtttattcgccaagcatcacgcacacttcgntactccgaaaacccatactga

SEQ ID NO: 18261 - DNA, 366 bp, A.fumigatus
cctaccaatccacaggtcattatcaagtggcgtggaaagcccgttttcatccgtcaccgtactcaggacgaaattcaggaggctcagcagattgactggaagactctccgtgatcctcagcccgatgaggaccgtgtccaaaagcctgagtggctggtcatgcttggtatgtcgtcacgccatctgattttgctctatgcttttgaacggttactgatagcgaattgctccatcgtgaaggtgtctgcactcaccttggctgtgtccccattggtgaatccggtgacttcggcggctggttctgcccctgccacggttcccactatgatatctccggccgtatccggaagggtcctgcccctttga

SEQ ID NO: 18262 - DNA, 963 bp, A.fumigatus
ttattcggacgaacagaggaacgactccgagaagcccgtcaacgggtccgagaagcgaaaaatgcctacgcagcagccataaaccgacgttctgcctcgcaacgcgaagtcaacgagctcctccagcggaaacacgcctggtctgccgctgacctagagagatttactcacctttaccgcaacgatcacaccaacgaagtggctgagatggagacacaggaagccctgtcggccgcagagcgcgagtccgaagaggcagcggcgcaattgagcaagagcatcctctcccgctatcacgaggaacaagtctggtcggataagattcgccgaatgagtacgtggggtacttggggcttgatgggtgttaacgttctcctctttcttgtcttccaaattgctgtcgagccatggcgtcgcaaacgactcgtgaagggcttcgaagagaaagtcattgaggctatcgagaaggagaaagccatcaaccacatcgagatattgaaacctcagcctgctcttacatccacatcgccctcgtccaaggaggaagcagcggagccaacacctacttcaaccgctgctggagacactccaaccaccgatgaaagcaccccagctgctacggatgaaactatcacatccgaacctgttgtctgggactccgatcctatacccaccttcgttacaaatataaccgctgaaatcgcaacagaaacgacagaggacagcgctcccaagagcgcaacgatcaatggcgttgagccccgcaaatctcaactctcccgcattcttcctccacttcctcctcctacctccctcgactcatggcgacacaccctcaatgaactattcagtgatcgcagtatggtcattacacagcgggatttgaccactgtcgctcttcagagcgctgctgcgggtgcagcgatcatgggtctagtgattgctttgattcggccccggtga

SEQ ID NO: 18263 - DNA, 579 bp, A.fumigatus
acagctccccagcatcacgtccacgctgactatgctcttaccgcaaaagagaattgtggtatgagctcgatgcctggctcgtcgaccgctccgcgctcaccctcagtcctgtctgagcgtcggagttggagattatcaggcttatctgtcacctcgcctgttgaccctagcccacccgacgacaatggccatccgaacgcgattaccgatgagatcagggaaataaagcgatatgaggattttacaacgattgattgggtccaagatgctatacaggaacaagcgcgacgaagggcgaagcgacgagatgggtctgggttctgggatcaggaaggcacatttggttggaggcgcaaagtgagcgagtcttatcacgctgggcaagcttggctcgtcattacaattgtcggcgccgctatcggattgatctcggctgtattgaacatcatcactgagtggctgtcggatatcaagttgggtcattgtacgactgcgttttacctcaatgaacagttctgctgctggggtgctgaaggaggtatgcatatcgcttatgctctatattcatggtggagctaa

SEQ ID NO: 18264 - DNA, 480 bp, A.fumigatus
  unsure (66): Identity of nucleotide sequences at the above locations are unknown.
ggtggtttccaagcatatttggcaccaattaacaaattgttttcagtgggattcaaagtaggattntgcacagccgactcgatcatcaaccttgcactttgctgcctaggctatgttcccggtcttctacacgcatggtacatcatactcaagtaccccgaaccagactatgatgatccgaactacgagcccattcctggccatgccggccggagacaggacactgaaagtggtcgtgtgacatactactacgtctctcatcagcccatccagcatccatcccagagaagttatggcactgttacaccgcaaaatcaaccagcgccgagtcctgctcctaaacctcagcagcaagctcccaagccgcatcatgaggaaggacagggaggaagcagtgaccatgctcagggtgactcccggccaccaccaacctatgccgaagctgtcaagggagaccacaaggtgcagacgcatgattga

SEQ ID NO: 18265 - DNA, 579 bp, A.fumigatus
ttggccatgcagcccatgccactgcttttgaggcagtcgcttaggtcatctgccaattttgcgaggacttcgctcccaatacggccacagtttctacccgccgctgggccgaaccttcaacctgcacaagagatacagcggagcttctcggtctgtgtacgatgccagttcaggtcgcaatcgccgttatattcatctcctgagaaagacacatcaaaagacgacgcagctactcagcagtcaaaagatggaagttcaacgctgacgcccggcgatgaatcggcaaaggtagagccggatgcagaaacccaacggccttctccggctgcgggagagcaggacactttacaagggttctatcaagatgcgaagaacgaaccgaaacgtgaatcagcagagaagaagggactaccttcgtacctggaagaacgccggtcacaattgtccaaacaatttaccgagatgatggataacctccaatccaacattttcgtggctggccagcgattgaacgatttgacaggctactccgccattgaggcactcaagaaagatatacaattgcaaggtgggttttga

SEQ ID NO: 18266 - DNA, 738 bp, A.fumigatus
atcttcgatccccagtctgtactaatgaacagtccaggtgggcgaaaccctgagtttttccaatcactctcgggtctgttcacttctagatcagagagacgtcgatccattacttcaactacagtcaatactgatcgggcagtcgagcaatttcctagacaaagccaaaatcgtcgcatttctatactaagaaggctggcggggccacgggagaacgcaaagcgcttcctccgcttgggcgcgccgcccagtaactgctcaccatcgccgccacttaccaacactgcttccgctaccgctacccacctgatgtctcggacagtgcgaccacgtcctgtgtccgagataatagtttctcctcatgacgcgcaaattttagtttctgcagcagcggcgaggaggatgcgatccgattcttcctctacggtgtctatgagtttaggtcctgcatcggggcaagatactccatcagcgtcggatgcaacggcgtcgttccctgctctccgccatgagaagattgtcgcaacggggagcggtatcgctgttgggattgctctaacagagcccgtcttgtttcttcaaggttatgatcagaatgacccgagtactaagaaatccgccatactgcgcgggcagctgcacttgaaaattaccaagagcgtcaaagttaaaaagatctcgatatgcttccgtggtcacgctcagactgactggcctgacggtatgttttcctcgtaa

SEQ ID NO: 18267 - DNA, 345 bp, A.fumigatus
ttttcattcacgggttcaaggttcgttcgcttctcgaatgttttcgttgttttcccgtgttatcaaaggttgggaaactcgatcaggcctcatactaaacatctgtttcttataaagggcgatgacaataccttcgccaattttccagatcgtctacgtgctgtagttgctcgtgcacttcccgcaatcaaggtcactaccgtggtgtatcccaaatatgagactcgtggtggtctgaaggaatgtgtgggaaaattccgggaatggtatgtctatgtcgagatgacgggcttggactgctcactctttatttgcgatctcgctgacaccactctccttgagtag

SEQ ID NO: 18268 - DNA, 255 bp, A.fumigatus
aattctttcctaggaattccgccgaagaagatccattttcatgacaagaaagacctggtcactcacggagtgatatactttaaccacggggatactgccctcatgcagaacgattacggagcacatttctaccaacacactaaaccggtgacctcggtgacaggtaaagatgggtcgacaacaacaacccgggaactcttctccaagagtggatcgtccccgtccctcaaccagtcgaccgcgaaagagctctag

SEQ ID NO: 18269 - DNA, 834 bp, A.fumigatus
cgcctctccttacaggccaaccatgcatactcgcgcagctttggaaagaacgaaatgccgtccagcaatcagtcgcatcaccagcgcaattataggatgttccccattggcgactacctgtataactttgaatttcccatcgatggctctcttcccgagacgattaagaccgatctaggctttgtcagatacgatctagaagccattgttgaacgtgcaggcgcattccggccgaacctgatgggcaccttggaagtacctgtgattcgcaccccggccgagggatcgctggagcaggttgagcccattgcgatttctcggaactgggaggaccaactgcactacgatattgtcatatcaggaaagtcttttccgctaggctctcaggtgcctatcgccttcaaattgacccccttagccaaggttgagtgccaccggatcaaggtttacgtgacagaaaacattcaacattggacggcggacaagagcgtgcaccggctgcagccagcaaagaaggtgttacttttcgagaaacgagcggattccgccagtgtgagcacctaccctggcagctcgatgcgtgtcactgcaggtggcggcattgattgggatcatcgtgcggccgctgcgagaggcgaggagatagtggatcgtaaccggacgaatctactaggaaatctggcaaatgattcaggcgttggcccgaccgaaatggagttcaacgttcaacttcctagctgccacgaaatgaagaatcgggatgaatcgcaacgattgcattttgacacgacgtacgagaatattcaaatcaaccactggatcaaggtaagatag

SEQ ID NO: 18270 - DNA, 651 bp, A.fumigatus
attgtgctgcgtctttccagacttgatgagcgcgacccaaataagcgtagacacttcgaaatctccattgattctcccttccaccttctctcctgcaaggccacacaagccaacatctacctccctgcgtacaccactccgagctccgagccgggtctgcctgcgcaagagtacgaatgcggctgccctggagcggcaatggtcaacaggaacagctcgagcagccaactgctagtgtctgatcgggaagatgcaccaaatggcggcaccgtatctcgcagcttcaccaacggatctgggggcttggctcgtcctccgcaagcccatctcgcgcatgaagcgaatgagcgctttccccgtcctatgcatcttcttcgggcgccatccttcgctcctcctgcgtttgaagacgttccacctccgccgccgctaataaccccacccccagagtacaactcaatcgtgggcaacaacgacagagatgctgtcctgcaggactatttctcgcgactatcattctacgaggaaggtgacggagatgagcgtggccgtggccgtgtcgacgtacccctcacaccaggaggccgcgtgaaccgcagcatggatgttcctcgggaatgggtgcgacttggagaacccgctgtccaatag

SEQ ID NO: 18271 - DNA, 261 bp, A.fumigatus
ttgggcgacgatcaagtgtatcttctcgagagaggctcccgaccggatgacattgataatgacgtcgacgtctgtacaattgccgtgccgaatggctgccagcagctgctgcacaaattcgcgatagtacgccaactcctcctggatgcgatctcgcgcaaccttacgacgtttgtcggcatactcgtcgacgatgcaatctcggccgtggagggcgcattcggaacatggggcaccggtcgagtttgcactgcactttaa

SEQ ID NO: 18272 - DNA, 300 bp, A.fumigatus
gttccagatcatgaatcattattcaggatcgcactcagcccagcatcgggggacgattccagaggcccaccatttggctcgttgacaacgggagacgcttccgcagatacgccatccggctctttcgcatcgggagacgagttcccagatacgccatccggctctttcgcatcgggagacgagttcccagatatgccatccggctctttcgcatcgggagacgagttcccagatatgccatccggctccttgttcggatcgcagaccctgatctcaaggccatcggcctcgttggtatga

SEQ ID NO: 18273 - DNA, 213 bp, A.fumigatus
cattgggttgtaattaaatgcgggatatcgagttgcgctgaatacctcaatgccggctgctcaagatcaggtctcctagtcgaccaccccgtcacgtgctcctcggtcgacgccgaagtctcctgcaactacagcttcaaagtcgcgaaggaagagtttacagatcgatggtggaaaatcaagtccacagcaaagttccagtctgtgaattag

SEQ ID NO: 18274 - DNA, 597 bp, A.fumigatus
atacaccattctgacatgctgctttctctactcgttttaaagtgcagtgcaaactcgaccggtgccccatgttccgaatgcgccctccacggccgagattgcatcgtcgacgagtatgccgacaaacgtcgtaaggttgcgcgagatcgcatccaggaggagttggcgtactatcgcgaatttgtgcagcagctgctggcagccattcggcacggcaattgtacagacgtcgacgtcattatcaatgtcatccggtcgggagcctctctcgagaagatacacttgatcgtcgcccaatcactgagtcataccaacgaggccgatggccttgagatcagggtctgcgatccgaacaaggagccggatggcatatctgggaactcgtctcccgatgcgaaagagccggatggcatatctgggaactcgtctcccgatgcgaaagagccggatggcgtatctgggaactcgtctcccgatgcgaaagagccggatggcgtatctgcggaagcgtctcccgttgtcaacgagccaaatggtgggcctctggaatcgtcccccgatgctgggctgagtgcgatcctgaataatgattcatga

SEQ ID NO: 18275 - DNA, 582 bp, A.fumigatus
gtactctatatgaggaacagaggcctggcgacccaggagaatttcgcaatgaaaggtgagcctctacggactcacttccttgtctacaaatactcagaaactaccagcgaacgatggtatgcagcgtccagatgggtctcttctatggaatccggacccccgcggttggagagtgtccaagcacgattaggtcaatgtctctacttactctcatcatcgcgggccaatgaatgctggtataccttcggcacggctctccagctggtgacggctctcggattgcatcgaaaatggccggcgaaaatgtccaagcatggcaactcgtacttggagcaacaactccgcaaacggattttttggagcgcctatacgctggacaaatacctcagcgtcatgtttgggagaccacggttgctgcatgatgaggataccgaccaagaacttccggacgaaatcaatgacgaggatatatcagaggaagatccgcggcgccggaccggttcaccagattccatgatgattgcgtccgtgcttcattacaggtttgtcaatcgattttacgctatctcttcatgcaactga

SEQ ID NO: 18276 - DNA, 267 bp, A.fumigatus
gtcataccaacgaggccgatggccttgagatcagggtctgcgatccgaacaaggagccggatggcatatctgggaactcgtctcccgatgcgaaagagccggatggcatatctgggaactcgtctcccgatgcgaaagagccggatggcgtatctgggaactcgtctcccgatgcgaaagagccggatggcgtatctgcggaagcgtctcccgttgtcaacgagccaaatggtgggcctctggaatcgtcccccgatgctgggctga

SEQ ID NO: 18277 - DNA, 216 bp, A.fumigatus
gcagccggcattgaggtattcagcgcaactcgatatcccgcatttaattacaacccaatgtcaccagctcccgttttttctttttttaactggcatgggggatttttcacggccctcgccactggcagcggtggagtaccgtcatcctctcaagtcaccaaccccgcacgtctccaaactttgaccaaggcactaagactaagaaagagacgatga

SEQ ID NO: 18278 - DNA, 981 bp, A.fumigatus
aaaaccgacttgtgccgagtccctgtctcactttccggaccaatgagggcttctctaatggacggggtacatacgcacctctcacccggaaacggcaccgtcgtcggaatgagcacagatggggcgtaccttgctggccggaagcgaaaggcatctgactcgtcgtcgccagcaaccaagggccctgtgcaacgccagaagattacacgagcatgcgattactgcaaggagaagaagacgcggtgtacggggacactgccgtgtatgagatgcacccgccttgcgctacgctgcgaatacaatgctgcgtactcgcgaggcttacccccggctccgttaccggcgccgccgtcgtcgtcattgctggtgaactatgcggatgaggaccatgcgcggggagatactcgtactgcgcggaggtccgtctctcagcgatcgtcgagagagtcgcccaggactggcgtgggtttgcgatcgcagcatggcagagctggttcggaggcgtcactgcgtgattcgccggagccggttgtcacggactttgagggtaactatctcgggccggcgtctggagtgtcgttcttgaaacgcgtctggagtcgccttcatcaggatgagtcgtcggctatccctggcgaactgcaagatgaaaatgtctccaggaatacgtccgttttcaagttcggggataagccttattcgaactaccaggaggctggctttacgttaccatctttcgagaaagctcgggagctggtgggcatttactttgacttttcgatagtgacttaccgtttcttgcatagaggaagcgtggaggaatggctcaagcaggtttatgcagacaatatctgttttgcgaatccgcctaccggcgttatggtagcccggactgccatcatccttatgatcttcgcagtaagtactctatatgaggaacagaggcctggcgacccaggagaatttcgcaatgaaaggtga

SEQ ID NO: 18279 - DNA, 1170 bp, A.fumigatus
tcactcttgcgagatactctatgcatgctgacaggttctgattctctgcagccccaacggattcgcgtccgtacggacgagaatgctcccgtcgccctgcctggcaacaaaacaatccatcaccgaaacaagtccactcccgccttatcagcggcctttcagaatggcacgactagaaatggtctcagaagggctgcatttggcgacgtcagcaacactgccaatctcgtcaaaggaagtcgggatgatgcctcccttgcgggaaagaaacaagtcaaagtcgtggagaaggcgcccgcagttgtcccagccagaagaacgaccattctctcgcagcctgcccagcgtcctatgtcgatgactagtctgaaaggtttggtgaataatgcctccaacctcaaagctcttgagccgtctgccaagcagatgggtattacccagcacgctcaaaatacccggaagccgctgaacaagcgcaacacagtcttcaaagacaccctagaaccactggccgaaactaaggaatctgcatccaaggaacacgtcactgaagtgacagacgacaacgagggtaccactacttcattgccggctacagggcagggcatcaccaaagacgatgctcggttgatccaggattcgaagatacagtcggacgacacagaggaatactccattgtgaactctgacgacatcgacagggcaaacagagacttatacaaggccgatgacgacaactgcaaggtgcaggtcattgagcagctgcatgaacattgcgcaaacaccagcgaagcggacgacctcccaaagagccaccgcgaatctgcctcaagtgcccacctagcccagtcggagccggaggagtactgggatgaggaagatgacgagaacgaagaggatgacgggtatgtcactgcacgctcttaccgttctcgtggcgataacacgaccggaggagcgaccaccattttgttcccgaaatacaattctcaagtgcgtcgcgagctggctttagccaagcaggtcgtcgaagctaccagaacagcggaagacatcgaagatgaatactgggacactagtatggtcgctgaatatagtgatgaaattttcgaatacatgcgggagcaagaggtatgttgttccatcagtttgacagatcttgcgtcctga

SEQ ID NO: 18280 - DNA, 567 bp, A.fumigatus
atcaggatgctgccaaacgcccattacatggataatcaagcagaaatccaatggtccatgcgctctgttctcatggactggcttgtacaggtccaccatcggttctcgctgcttccagagacacttttcttgtgtgtgaactatatcgatcgcttcctctcgagcaagatcgtgtccctgggcaagttgcagcttgtaggtgcgaccgcaatcttcattgctgcgaagtatgaagagatcaattgcccatcagtccaagagattgtgtacatggttgacggaggctatacggtggatgaaatcctgaaagccgagcgtttcatgctgagcatgctgcagttcgaattgggatggcctggaccgatgagtttcctgcggaagattagcaaggctgacgattatgacttggagactcgcaccttggctaagtacttcttggaggtgactatcatggatgagcgctttgtcggaagtcctccgagctttctggccgcaggtgctcattgtcttgccaggctgatgctgagaaaaggaacttgggtacgttcactcgccctttcgcaatag

SEQ ID NO: 18281 - DNA, 462 bp, A.fumigatus
accccgtcccatgtccactatgcaggttacacttactctcaactctatcctctggtctcactgatcctcgaatgctgcgagattccacgcaaacatcactcagccattttcgagaagtacaccgacaaacgtttcaagcgtgcttctctgtttgccgaggcgggaatcaaagaagggttctgtctgcctgaagtgacaaaagaagctacctccaacgagcgcaactcacattacgagccagcccaccacttggaaacgagtctaagctgtgttcactctcttatttacgaacccctttatctttctacgtattcgaagcccggcaattccttaacgtccatatccgcctttcagagagcattcttctctctactttcctctctcgagcccaacgtccccaaccctcagttggccatttcctgcagctacaacgacatcattacgtggatgacgatatcgtga

SEQ ID NO: 18282 - DNA, 225 bp, A.fumigatus
cacgatggtccaatatcggcgtgttgccgattcgtagacgggtggctgcggcttcgcggttgggcccgcatcggcgttctcgtctcgcgactgcgtctcatgctggatgaaatcatcgcggcgcgcattgacaaccctggttttagtcccgcatcgaatgatgtgggcgacagggtgattgagattgtgaagaaattggtcgagtttaatgggttggatcagtag

SEQ ID NO: 18283 - DNA, 564 bp, A.fumigatus
ggtatagatgaagtggtgatgatatactacgtttatgaacagtgggcaatggacatgataccgagacatcctccaagcttcatacgaaagtcaacgtctattggacatccatcccccgctgcaatgacgattccagatcgttcacatggccgcccgcggcgtgcacctcctgaggcttgggctcctcctgcttccagcctccctgctggtggtcagggatgggaacgttggtctgctgagcaatctgctgttgctgttgctgcgcggcagcggcggcctgcgcctgggactgctgccggacgaggttgcggaagcgcaccacttcgtcgtaaatcatcttgcgcatctcctgcacgtcgtcgacgacctcgaagtggaagtcgaatgtcgtcgggcaggtgggctcgtcggaggcgtcgtgccagatgtgcaggtacgggtgctccagcgcttcctcgaccgatatacgcgacgccgggtcgaaggccagcatgcggtcgagcagatcgagtgcgtcggggttggcgttggggaacaaacgctggaaggggatcttgggcatga

SEQ ID NO: 18284 - DNA, 318 bp, A.fumigatus
gatttgttcggcattttcagctgcgccttttgctccattgagatacccgcttcgtcttcactctcgttggcactgaagcattgcgattcgaatttccaccccggctacacacgacactcgtctgtcgattcctcgcctcggcctttatcgtcgatcataagccggtcgctccattacaagacaaagctgtcggttttgatcatgtctgatctacagggtcggaaggtcttcaaggtcttcaaccaagactttatcgtggatgaacggtacaatgtgaccaacgagctgggccagggtgcataccgtatcgtttggtag

SEQ ID NO: 18285 - DNA, 372 bp, A.fumigatus
ttttatgcagagttgatggaatgcgatctggccgctatcatccgctcgggacagcccctgaccgacgcacattttcaatctttcatctaccagattttgtgtggactcaagtatatccattccgccaatgtcctgcaccgagatctgaagcctggtaacttgctggtcaacgcggactgcgagctcaagatctgcgatttcggtttggcccgtggtttttcgatcgaccccgaggagaacgccggctacatgaccgaatatgttgcgacccggtggtatcgtgctcccgagataatgctgagcttccagagctacaccaaagctagtatgtcatacctgattttggttgcaattagagcgccgatatgctga

SEQ ID NO: 18286 - DNA, 1452 bp, A.fumigatus
atcatcatgcagcgccttcattcgtttagccaattgcgacatgcatccccactcaaactttttgccctcgctgccgccttcatcttggtgtccgcctccctcgtgttttactccagacctgctagtccctctgatgttgacctcctcccctcacaaccttctaccggcaacgaaatagaaaacaaaggcacttgctatgtcgacctcgatttcttgagatctcagggatacaatgaaactgcgaaatacgcacggctcgagatcgccgtcaggcgaacagcgaacttcacgggattctctgacaccttgcccactcgattccccgcttatcagaagattcgtttggacacagctgaccacgaagcaccgttgtcaccagagacatgctctcccgcagtgactattcaagctccgttacctgtcgcaccacccaacgcgtcccacattctgttcggcgtcgcgacaacactgagaagactagatgattccctgcctgcatttgcacattgggcggcgggaacgaacgctcgcatatatgcttcggtggactccgacacaggctcgccaataaggagggtggagcaacgagccaaggaattggatgtccgtttgactataattcaatctgatgaggagcgactggatcagtacttctctctactccgggttctgctcaagcaccgtgatgcatcgacgcagtgggctgttttgatcgacgacgacactttcttcccttctatgcggaatctggtcgacagactcgcaacctacgacgcgacgaagccacaatatgttggggctgtgacggaggatctcgcacaggtgttcagttggagttatatggcctttggaggtgctgggatcttcctctcaataccactccttgagcaactcgacaaggtgtatgatgattgcaacagcttcaaaaccactggcgaccgaagagtcgccaggtgcatctactcccacacacacacgaaactcacctgggaccgcgacctatatcagttggatctccgaggggatgcgtctggcttctacgagtccggtcgcccgctaccgctgtcggtccatcattggaaatcatggttccaggcagatatggttgggctcggtcaggttgcggccgtctgcggtgacgattgtcaactgcatcgttggcgcttgaaggacaactggttcctcgtgaacgggttctccatgatcaagtatacttcagccagaaatgttgatctgatggagaagacctgggaggatagtaaatacagaggcggggatggcttcgcgttcagtctgggtccatttcgcccaaaggataaaggcaaggtgtcctttcgcttgcggaacgcaactcaacaggcagggtctgttcgacaggtctacattcatgactcggggccagacgagcctcctgaagtactggaagtagtctggaaacctacatctgggtga

SEQ ID NO: 18287 - DNA, 672 bp, A.fumigatus
agcgccgatatgctgacgactatagtcgacgtgtggtctgtaggatgcatcctggccgagctgctcggcggccgtcctttcttcaaaggccgggactacgtcgaccagctcaaccagatcctgcactacctgggtacccccaatgaggagaccctgagccgcattggatctcctcgtgcgcaggaatatgtccgcaacctgccgttcatgcccaagatccccttccagcgtttgttccccaacgccaaccccgacgcactcgatctgctcgaccgcatgctggccttcgacccggcgtcgcgtatatcggtcgaggaagcgctggagcacccgtacctgcacatctggcacgacgcctccgacgagcccacctgcccgacgacattcgacttccacttcgaggtcgtcgacgacgtgcaggagatgcgcaagatgatttacgacgaagtggtgcgcttccgcaacctcgtccggcagcagtcccaggcgcaggccgccgctgccgcgcagcaacagcaacagcagattgctcagcagaccaacgttcccatccctgaccaccagcagggaggctggaagcaggaggagcccaagcctcaggaggtgcacgccgcgggcggccatgtgaacgatctggaatcgtcattgcagcgggggatggatgtccaatag

SEQ ID NO: 18288 - DNA, 231 bp, A.fumigatus
gactttttctatatctgtcctgtccatctacaagataggcatttctgctctcctatcgtggactcggaacaggcggcagccaatgcaaagcaggaagcattggcgcgggaaatcgagatagtgaaaaaggagtatgaagagaagcagcgacggaagaaggaaaaagagaaggagaagaaggccgatgacgagccgaagaattcagacaagaagtccaagaaatcggactag

SEQ ID NO: 18289 - DNA, 324 bp, A.fumigatus
ctcattaatcgctcctctcatagactgggatcattgctgatggacctggatgccttggcgggcatcatcgcgtacaaacacgccggtgactcagtacctactgtgaccgcggcagtggatcggattaccatcgagcatcctctaatggagatttgtgatcttgagctgagcggtcaggtcacgtatgccacgggcagatcaagtatggaggtgtcccttcaagtgaccagggtccctgccgaaggagaaccggtaaaaccggaggacgtccttatcacctgcgcctttaccatggtctcgcttgacccagccaccaagaagtga

SEQ ID NO: 18290 - DNA, 237 bp, A.fumigatus
gtgctgagtattaagatgtgggaaacgagcactgacatccccattaggcccgttcctattgcacctttgcttgtggaaaatgcggaggagcgtcttctcttccacaagggcgaagagaattatcaagccaagaaggctctgagaacgagaagtctcctggagaaggcgcctgacgccgaagaaagtaatttaatacataacatgtggacgaaggagatggcatatttgagtgagtga

SEQ ID NO: 18291 - DNA, 603 bp, A.fumigatus
gtgagtgacaataatcccttcagctgttccaacgctgatgctaacgcgggaacagatcctgaatcacctgcccaaagacctgacaatatggtcttcatgagcgacacagtactgaaatccgccatgattatgcaaccacaggatcgcaaccggcacaactttatgatcttcggtggcttcctcctcaaacagactttcgaactcgcattctgctgcgccgcctcattttcccacgcccgtcccaacttcatctccctggatcccagcactttcgaaaaccctgtgcccgtgggaagcgttctgtacctacgggctacggttgctcacacagaaccgctgcagagagacggcaccacatacaccaaagtgcaggtccgtgtcgattctaaggttagggacgtggagcacggcagcaagaaatccacgggccagtttaactataccttcttggttgagaaagatattcaggtcatgccccgaacttatggtgaatttatgctctggaccgatgcgcgcagacgagcacagaatgctgccgccatggtgactggttctaaggagcccagtactcttcgcaacatcaaggatagtgtgaccgagtag

SEQ ID NO: 18292 - DNA, 192 bp, A.fumigatus
tggagcaattttcagtttgcaccaggaagcgtatacttttaccaggaccagggacctaagggagttcccttagcttgcctcatgtcatcgaaccaagagccagcggctagtggcctgggccgcctgtcagcattcatccaggattcagggcttaaaacccacatccccacgaggctgttggggggcccctaa

SEQ ID NO: 18293 - DNA, 201 bp, A.fumigatus
ctgtatgagcactctctgttctattaccgtgccattgatgtgccagatcaatcagcctacacgatgagtgaccccaacaatcccaacattgagcagagatcaacgccccaatgggctctctatcagcgggaaaacttcttgaaagcaagagagggcaagactgtgcctttcaacaccggtatgtttagtctaacaaagtaa

SEQ ID NO: 18294 - DNA, 864 bp, A.fumigatus
  unsure (540),(711): Identity of nucleotide sequences at the above locations are unknown.
aaagctcagccaaggcggctggtatgtccgcaaggccgggtctcgatggataagccagatactaaggcacttcacaggtactatgcttcctcgaatgcaggcatgtccaatacccacctagccaaccgacaagccttctaccgccaccgcattgtcccccggcagcttgtcgacaccaacctccgcgacacaacaacggagatcttcggccacaaggtctcggcacccatagggtttgccccaattggcatcaacaagatctaccatcctgccgctgaagtcgccgtcgccaaggtcgcgcacgagctcaatctcccgtactgcctctccacagccggcagtacgccaattgagaaggtcggcgaggcgaacggatcaggcccgcgtttttaccagttgtacatgcctcacgatgaggagctgatgctgtcactgctcaaccgggcctggaagtccggattcgacgtactggtgctcacgacggatacatggcagctcggctggcggcacgacgatgtcgccaactcgaattacgcgttntaccgcggcattggcgctgatctggggctaacggaccctgtgttccagaagcgctgtcaagaggccggcatcgacattgaaaagacgtcgtggccgcttcgaccaagtggatcgactccgtctggcatgggccgggcctggtcctgggacacaatcccctgcctgatcggnaagtggaaagtcatttccggtggtcggccggtcgtcatcaaagggatccagtccgtcccggacgcgagaaaatgcgttcaggtacggggtgaccggaatcgggggaacaaccttgccgccccccaggttgatgggccgaacgtttgccttgtg

SEQ ID NO: 18295 - DNA, 345 bp, A.fumigatus
ggctcccatctaatctttcttttgcctttgaaaaatctctataactccattctagtactcgaagtaacctattgcagctgtgctgatgctgctgtcatgggatttattgccggctgccccgaggcaggatgcaccatatccaatcaatacaactatcaacctgatgtgacattcagcaggacctaccactcctgcaccccctccctcctaatggcccttccaacctcagtatctctatctccctccagtactgaccgaataaatggtccggccacgtcggcatcttccgccccgttcttcttcatctcctccgctgtgccacctcccaagccagtcgccaggtaa

SEQ ID NO: 18296 - DNA, 369 bp, A.fumigatus
ttctcatatttaattccaaggtctggtctgcgaccatggatatgtcaactcgacatccattcaattggctgtggctctctgcgacgtatagtctccctggctgcgaccagaaacttaccttgcacggtcatgacggaatcagaaagcctgggttctcctgaaaagggggatcctactgcgaatctgtcagatataaacaacacgcagcgcagtgagaccggcgatgatgaggaaatcaagcgtgccaagagcgaccaggacgacgcatatcaagaacaatcgaccaccaaggtcgtacttcttcttgtctcgatcatgatgaccatgtttctggttgctctagatcgaacgatcatctcaacggtatag

SEQ ID NO: 18297 - DNA, 318 bp, A.fumigatus
ctctggacgaaggcaatccctcaaatcaccaatgaattcgactccctgtccgatgttggctggtacggaagcgcatatctgctgacctgctgtgcattccaactgctattcggaaagatctacaccttctaccccgtgaaagcagttatgctgagtagcatcctgctgttcgaagttggctctgtcgtttgcggagctgcgcccaactccacggctttcatcgttggccgagctctcgctggtattgctgccgcggggatctttgctggatctgtgagtgatccagtttccttgaaagtgcaagtgctgacggtctag

SEQ ID NO: 18298 - DNA, 396 bp, A.fumigatus
gtggtatgcatcgtctatgcagttccgctcgagaagcgtcccaaaatccaaggacttttcggggccgtcttcggtctggcctcgattgtaggcccgctggttgggggcgcgtttacctcgcacgtaacatggagatggtgcttctatatcaatctcccgtgtgggggcctggcgatggctgccatccccttttgtctcaaagtgcctgacaggaatactaccaaggttacatggacggagaagctgaagcagcttgatgtgcctggaatgtgttgcttagtccccggcgtagtctgtctggtgctagccctgcagtggggtgggcaaaaatatgatgtgagactttcccagagaagagggtgtttgacaccggtactaacagcctcagtggaataa

SEQ ID NO: 18299 - DNA, 687 bp, A.fumigatus
ctagtctacttcctccccatctggttccaatccatcaaaggcgtctcggccgtggactcaggcctcagactccttcctttgatgctctcgatggtcgccgcgtccattctcagtggcgtcaccacccagaaggtcggatactacaccccccttgcaatcatcggaagctgcattatggcgatcggtgccgggctcctgacgacgctgcaaatccacaccggccacggcaaatggatcggctatcagatcctgtatggcttcggcatgggcatgtgcttccagcaacccaacctcgcggcgcagaccgtcctgccaacgaaagatgtgcctgtcggcatcgcagtcatgttcttcagccagctgcttggtgctgcggcgtttgttcccgtgggcgaaaacgtcctggccaaccagcttatgatgaggttgtctgggattccgggcattgactccgatattgttacgtcgggcggtgcgacgtcgctcttgagcttggttccatcggatcttcgggggacggtattgacggcttataacgaggcgctgcggaaggtgttccaaattgggctgatcgtggcctgtttgaccattctagggactgcctcgtttgagtgggtgagtatccggaagaagtcagaggctagttctggtgttgggaatggtcatgcccccaaagaggagcaatag

SEQ ID NO: 18300 - DNA, 744 bp, A.fumigatus
  unsure (62): Identity of nucleotide sequences at the above locations are unknown.
gcggacgatctccagccaaagtccacagcgccattcgtgccattcagagtgaattcacaaantgccaaagccagttttacccccttcagatcgacctcgaatccgacgactcgatcaaacacgcctccgaagacatcagcaccaagttcggaagactcgacgctctcgtcaataacgccggtatgtcttttgatctcttctgtccgaggtatacatcttaacgtcccaggtgcgtggttcgatgcccaagccaacgctacaatgaccgaacgtcaaatgtgggcgaagacatgggacgtcaatgtcaccggcacacacctcctcacctccgccctcatgcctctcctcctcaaaagccccgaccccagactcctcttcgtgacatctggcgcggccagactcgccggcaccgacgacctccgtcttccaataaaccggtccccaccggctggctggcccaagcccgctgggatgactgccacagcgtaccggagcgcgaagaccggtctcagcatggtcctgcgcgagtgggggcggatactcaagaacgacggcgtgaaaatctggggaatcgcgccgggttacctggcgactggcttgggaggtggcacagcggaggagatgaagaagaacggggcggaagatgccgacgtggccggaccatttattcggtcagtactggagggagatagagatactgaggttggaagggccattaggagggagggggtgcaggagtggtag

SEQ ID NO: 18301 - DNA, 477 bp, A.fumigatus
acaactgcgggagaccccggaatgaatgagaagtgtggcctgcccggtaaccaaggcgattccgctgctgaacatccaggtaactgcacacgcactgaaccagacgaaggcagacaaaagaaactggaagatgaaatcggtacaactatcaaagttgctgctgaacggcaagagagaactgcagagaatccacatcttctaccagagactgtcaaggttactggtgtacacgcttccgcggctgcagcaacagggccaccatactgcatcctgtccgaacgcaaaaagatcttcgtcatactcttggtctcattcgcagccatcatctcccccatctccagcagcatctattttccggccctgaacagtctcgcaaaggacttgaatgtctccgtctcgctcatcaacataacgatcacaacctatctggtacggcatccgcgcattgacgggaagcagtccacagagtcgagctga

SEQ ID NO: 18302 - DNA, 669 bp, A.fumigatus
  unsure (356),(359): Identity of nucleotide sequences at the above locations are unknown.
atattccaaggaattgcgccgtcattcatagcgaactttgcagacacccacgggcgacgccccgcctacctgatttgcttcaccatctacctagctgccaatatcggtctcgcggtccaggatagctatgcgtcactcttggtcctgcgttgcctgcaaagctcaggcagcagtgggacgattgcgctaggaagcgcagtcgtcgccgatctatcaacccgagcagagcgaggcaagtatatcggatacgccagtctaggcgttgacctcggccccgccttgggaacaatcatggggggtttactggaccattaccttggctggcgggcggtcttttggttcctggtgatcttaancantgtcctcggggaccgtcattgctatcatcttgcccgaaacctgccgcgcggtggtgggaaacggctccgtccctgctgccaagtggaatcggcctgcatggcagatactgcggcagaaccggagggctcaaaggcaaacgccaacgccggactatcacaccatcgagaaacggcgtcgacgcgccaatccgatcgcatctgccctgatcgccaccgacaaggaagcactcatcattctgatctacagctcgctcttgttctccggctacatggccgtcttgagcaccttgacttcccagctgcaaagtag

SEQ ID NO: 18303 - DNA, 879 bp, A.fumigatus
  unsure (1),(4),(824),(864): Identity of nucleotide sequences at the above locations are unknown.
ncantgtcctcggggaccgtcattgctatcatcttgcccgaaacctgccgcgcggtggtgggaaacggctccgtccctgctgccaagtggaatcggcctgcatggcagatactgcggcagaaccggagggctcaaaggcaaacgccaacgccggactatcacaccatcgagaaacggcgtcgacgcgccaatccgatcgcatctgccctgatcgccaccgacaaggaagcactcatcattctgatctacagctcgctcttgttctccggctacatggccgtcttgagcaccttgacttcccagctgcaaagtagattccacttcaactccattcaagtcggactctgctacctgcccattgggatcggcagtctgagttcccgatggacagtcgggcggattctagactggaacttccgccgagaagcccgacggcagggcctcgccatcgaaaagaaccgacagcaagatatccgccatttcaacatcgaggctgcccgcttggcggtgacgattcccctagtctactgcgcctgtctgtgtatcgtagcctacggctgggtcatggagtataagactgcgcttgccggcccggtggtgatgctcttcttcatggggcatctgacctccggggcgttcagctcgctgagtacattgattgtggacctgaaccgacagagccctgccactgcagtcgctgcgaacaatctgttcccgtgtctgttgggtgccgggagtcttgcggctgcggatccagtgattcagcacatagggatcggctggacagccacgctgattgcgtttctgtgggtgcttttgagccncgcttatgtgggctggatctccatgggggcatggatgganaagagaacgtattaa

SEQ ID NO: 18304 - DNA, 489 bp, A.fumigatus
gcaacacattccaggcacatcaagctgcttcagcttctccgtccatgtaaccttggtagtattcctgtcaggcactttgagacaaaaggggatggcagccatcgccaggcccccacacgggagattgatatagaagcaccatctccatgttacgtgcgaggtaaacgcgcccccaaccagcgggcctacaatcgaggccagaccgaagacggccccgaaaagtccttggattttgggacgcttctcgagcggaactgcatagacgatgcataccacctagaccgtcagcacttgcactttcaaggaaactggatcactcacagatccagcaaagatccccgcggcagcaataccagcgagagctcggccaacgatgaaagccgtggagttgggcgcagctccgcaaacgacagagccaacttcgaacagcaggatgctactcagcataactgctttcacggggtagaaggtgtagatctttccgaatag

SEQ ID NO: 18305 - DNA, 339 bp, A.fumigatus
  unsure (180): Identity of nucleotide sequences at the above locations are unknown.
agccagctaaatacagtggcttccaaaatcgtcctcatcaccggcgcgaacaccggaatcggtttccaggtcgtccgcgcgctctgcaactccacgcaaacctacagcatcatcgtaggcggacgatctccagccaaagtccacagcgccattcgtgccattcagagtgaattcacaaantgccaaagccagttttacccccttcagatcgacctcgaatccgacgactcgatcaaacacgcctccgaagacatcagcaccaagttcggaagactcgacgctctcgtcaataacgccggtatgtcttttgatctcttctgtccgaggtatacatcttaa

SEQ ID NO: 18306 - DNA, 318 bp, A.fumigatus
atacttgtcccttgcttggaaggagattattacttacaggcacgttgtattgttcattctacacgagcatatatgttttggatcatgtttactagttttgtccataagcacctcgtgatgcctggccttgatcggcaaatcatgtatactacatgtcttgcagaaatcctagaatatctacagagtattctcgtagaatttcacactttagcttccatacctatccgcactgccacagtcaccgcctccataggtcagccccctaataataatagtttgacatggcatgatgtcatcgaacacatgcgcggaatgtag

SEQ ID NO: 18307 - DNA, 453 bp, A.fumigatus
agactactctcgtctgcaacatcgattctaaatcgtcagtcttctaacaacctccagacgagagaaactagacgcaatatgtctctcagttccattaaaggattgctctccaactactcgccagtgagcgagtcgctggacttggagaagatatatcactacccacttcgaaatgcatccgaagatctggaatctgccagcgggagtgaagcaaacaagccaattcaaagggaaggtggagagaagaaagagtctaaaatcatcgatgggcggacagtttcagatgcaattatcggtctatcggatggcttaacggtcccttttgctctcactgcgggattgtctgccctgggagatacgaaagtggttgtcttcggcggtcttgcagagcttattgctggagctatttctatgggactgggtggatatttaggcgcaaagagtgaagagtga

SEQ ID NO: 18308 - DNA, 549 bp, A.fumigatus
  unsure (472),(475): Identity of nucleotide sequences at the above locations are unknown.
tgttttacttccagggaatcttaccgagctactctcaaagagactcgaaacaaagttgttgcagacccatccgctacaacagagaccatctccgaaatctttgcgccttacgacctcccatctgaactcgtctcacaactcaccgatcacctgtctgcctctcccatgctcccttcgtttcttatgaacttccaccacacacttcctgaaccgtccggctcccgagcactcatctgcgctttgaccatcgcgttaggttacttcattgggggtttcgtgccgcttcttccttacttcttcgtcggaccgcacgacgcattcattgcgctgcgctggtccattgccaccatggctatagcactgtttctcttcgggtacgggaagacgtgcttcgtgagcggttggagggggagacagaatatccgacgagggttcatcggcggtatgcatatggtccttgtggggggtgtcncanccgggtcagcaatgggactcgtcaaaggattccaactgctcgcatccatcggcgaaggtcatggggagcaataa

SEQ ID NO: 18309 - DNA, 237 bp, A.fumigatus
ccctgtcgatttcgctcccagcggggagttgatccaagatttggttggtatgcctcatttatcctggtgcctagtggatctttggaaaactgctccagtcgctcgggactgaattatgggtcagccacaaaatgccacactatggctgcaacaataaaacgcggaacagccattattactagattgttaattgtttgctctactagccaattgctctgggaagggaccgcatgttga

SEQ ID NO: 18310 - DNA, 813 bp, A.fumigatus
tgccgtagctgggattctctcagacgctcgcagattttaaaagttgagaacattgttgacatggcgctgctccagcggtacagctccggcctgattttcacaccacaaaaagcattgaatagagggaatttcgtgagaaatcctcctgattggttatccaaaggcccaaaagtggaagagaattggagtctagaattgcaaaccttggagggcctttctcattgggtttggtctgtcactttttcacaagatggccaacttctagcatctggctctgatgacagaactatcaaactctgggatcccaccactggcgccctcaagcatactctagagggccattctgattcaattcggtcagtcgccttctcacgagatggtcagcttctagcatctggctccgacgacgaaactatcaagctctgggatcccaccactagcatcctcatgcagactctagagggccattctgattcagtttggacagtcgctttctcacaagatggccagttactagcatccgggtctcacgacaaaactattaagctctgggatcccaccactggcaacctcaagcatactttggaaggccactctgattgggtccgatcagtcgccttctggaaagatagccagcatctagcatctggctctgatgataaatctaccaagctctgggatcccaccactggcaacctcaagcatactttggaaggccattctgattgggtccaatcagtcgcgttctctcaaaatagttctgggatctcaccactggcgccttcaacgtactctgggtgttggcggtattaa

SEQ ID NO: 18311 - DNA, 183 bp, A.fumigatus
atctcttgcagatcttcaaataccagaaggcaatatcacccgtcacctggacttatttcattcagttttgaccgtaccagtgaatcctatctacccaagcaggctctacagttttcctttcgtaattacctggtggacaaccctacaaaaatcaaaaagttctacatcccaataatagcttaa

SEQ ID NO: 18312 - DNA, 183 bp, A.fumigatus
  unsure (166): Identity of nucleotide sequences at the above locations are unknown.
agaaagataaagtcatgcattcaaacgactgttcgtgcccatgtcctatttagcaaccctatgctgaccggaaattttacccttttccctttttgccctttttccgtttccccccttctcccgtcttttacctccccttgcagtcaaattcaggtccttggcgcantgatggcaggctggatt

SEQ ID NO: 18313 - DNA, 750 bp, A.fumigatus
gcacatcgcctcttttttcttctcgtttgcaatatggccgccaagctccagtttctgaataacctgccacgagaaatctggctctctattagagatcttgttcttccatcagcttctgcaaacgaacttaaaatagctccggcattatggagtagcatattcaaaagcgaccgctggcttaacatggcaacgagagaattcaaatgtagcccgattcttatcggctgtgacctgagtgcttttcgacctcacagggtttcaaatcgaatttaccttgctcttattgcaaatgactattctggagatctgaggtttcgccaggatgagcttctggagacttttcaagatggcgccaagtttgacgctgacacctacgaggtgaagcttccgtcagggattgtggttaatatctacgaggtcattactggatctgaaaccgctgaactaccattagaaaaattattctctcgcgagaattcaggtgtgcacaccgagtattgcttctataccaaaaaggttataggatcacttggacctgcagacattattggacttcatgggccgtgtcacaaatggcgggattttaaatatggtggtgctatcagggtgccatatggcggcaaggtcaagcaatatttcatacaggcaaaaggaaagagggaactgtgggtagtgaaacgggacgatgagtcgaaattagtttcgtctttctcaaaagagcccaggaatgagcagggattactgtattaa

SEQ ID NO: 18314 - DNA, 222 bp, A.fumigatus
ccagctcaggtctcttctatcttgcatcctgtatctgacctgtcactgcaagctttttctaaaatttcatgcacttgctttcttaacacaaactactctctctgtttcccagacaaggcttatgaagcaaccacaaacaagttatattatatatggcaagtgaaattatcaacgaaatggaacgcaacctttagggtggaccccaacagccagagtatgtga

SEQ ID NO: 18315 - DNA, 231 bp, A.fumigatus
atgacagtcataaaagtgaacaaataccgcgagactcgttggaccattttcgcactcatcagccaagctgatcactcatggcagatccagtgtaatgtcttagatatagcagctaaatccattacagggattgcagcagttaatctaactgaatttacagaacccacgagtgcaagatattcatttccagtgtgggtgacttgttacatgatcacacaatcactgtactaa

SEQ ID NO: 18316 - DNA, 237 bp, A.fumigatus
gaatactgggtttcagggacgtatagatgtattagtgaaaatatatatgtgtcaataatcagaataaactacttagtctcccccaagctgttcagaactcctatttctactaagtgcattcagaatcaggtatataattacctaagcaagagggggcttgctgctggtggcttactaggcttatattattccaagcatataacaactacccccccccttcagagaggtttatcctga

SEQ ID NO: 18317 - DNA, 219 bp, A.fumigatus
tataataataaggaagtcctgtatcctattatattcttctctaagaagctcttagttactaagtataactataagatctataataaagagttactcaccattattcactattttaaggaatggcgccctaaactagagggtatactattactaattaaagttataactaattactataacctagaatattttatgtctactaagctgcttaatagatga

SEQ ID NO: 18318 - DNA, 228 bp, A.fumigatus
aaaaacttagggctattctgtattaagaagattattagcctgcatgcctataagctagatctactagcttctataaagattcaccctgtgtttaatgttagcttactatgttctattgctaaagaccctgttcctggacaaagacagccaccactactactagtagaggttgatagtctagaagaatggattattaaggatatcttagattcctgctgggaatactga

SEQ ID NO: 18319 - DNA, 420 bp, A.fumigatus
gcacatctcaccctgtcattcttttttgtctttccttcatttaactctgtcattcgttctgtgcctacttccaggatgaagtacgctgcttttcttcccaccatcggtgcgctggtctcccaggccattgcgattggcgtccaaggcaccgccgagggttttgcctcgtccgtgactggcggtggcagcgctacccccgtctatccttccaccaccgacgagctggtctcgtaccttggtgatagcgaggcccgtgtgattgtgctcaccaagacctttgactttactggaaccgagggtaccaccaccgcgactggctgcgcgccttggggtactgcctctggctgccaggtagccatcaacaaggataactggtgcaccaactaccagtcgagtgctccctctgtctcggtgacctag

SEQ ID NO: 18320 - DNA, 561 bp, A.fumigatus
accgcccgcatcggccgccaacactacgtcctcggcaccgaagccagcaaccgcatcaccctctccaacaactacatcgacggcgaatccgactactcggccacctgcgacaaccaccactactggaacatctacctggacggctccagcgacaaggtcaccctgaagggcaactacctgtacaagaccagcggccgcgcgcccaaggtccagggcaacacctacctgcacgccgtcaacaactactggaacgacaactccaaccacgccttcgagatcggcgacggcgcctacgtgctcgccgaggggaacctcttctccgacgtgactgccgccgtcgagtcctctagcttcacgggtgagctgttcggctccgcgagtgcttcctcgacctgccagtcgtatattggccgtgactgtgtggccaattcgttctccagctctgggacgctctctgggtcgaatgttgatgtgctgtccaagtttaagggcgagactgttgcctcggcgagtgcggctggtacttctcctgcttcctcggctggtcaggggcacctgtaa

SEQ ID NO: 18321 - DNA, 420 bp, A.fumigatus
acagtcgctatgcccattgagccctttgtctcggcaacaccgctgcgattccgtgggattcccgattctctcgcagtatttcatctggagggctctgaatgttgcttgatccatgcggataatcctctttctggacatcagggcgtctacctgaatcccaaggtccgggttggttacaacggccccgcatacgaagcagtccaccctgctggctcctggctgtctccacaatatattgccttggcactgtgggagaacagattccgacgttgggcaaccacgaccctcttcaagaagttcgtcgttcgacgcagacttgctcaatggaaggcgctctctagcggccgacatgaacctggcaagttctgcttgattaacgagatgcaggtgctcgtcgcgaatggctgggcccatgtatag

SEQ ID NO: 18322 - DNA, 306 bp, A.fumigatus
cgagggaatgacttctcaccctgtggctgcccgcaggtggatgacgttattgaactgcttaacacaaacgagggagtatacgccgcggcctgctctatagattattcccgacctccgttgtattatgatacttttgctttgcgggatagttatggcgacgagcatgtcatgcagacgtggccctatttccgttctacagtatctcggcatgcgcttttcaacatgtcccctgttcccgtcaagagttgctggaatggcatgggtaggcttatctttcctttttcccactccactctatgctcgtag

SEQ ID NO: 18323 - DNA, 1440 bp, A.fumigatus
cagtattggagcttgcttccttcaacactggcacatttcttgtactccagcctaattcccgtctcatccctaatactcacccagtcacattccaccagcatatcccagttccccccgtacccgaatatgttgcctgtatttcacgctgataacttcaagacatggactccccctttccgcataagatcctcctccatgcgctcacgcctacaccctccttccaataagtctcctgccatcaaatttcgtcagtcacccctccctcaagcattgccattgcccaagcatcagctcccggcgcggcccccagccgaggtttgcattcatgcaagtgctgtgacgccatctggcacctcccgggacccccagtctccgtcccgggagtcatttaggctgcactctgccacgacgcctgcccggacgcccgccatatcatccgacccgcagcacgcagagcggttggaacagtctctgagaaacgaacctggtccatcatcagctccggatttagccacatcacgcagagttcacgatgccattgatgcctcaattgatgcgcccttttttccagaggacgccctgagatatatatcgtcacccagtgtatccagctcggatgagagctggcaggagtttccccaagcagcagacgaacaaaatgacattctgatcgacccggtgatcctcaccaacaatggcccctgggagacagaagacgaatgccagcatattcacgcggacggtgatgcagtcaactcggagaccatttgtcaatatcccgaccctccactacttctccgcgacacgcgtgccgagaatagaaactctaacgcatatcctgaagcgcaggaaggaaactctcggttggatagcctgctacacagccagtcacacgcacaagtgtctaccgataacaaacccgaagcccacattcgtgcgtccagcaaccccctcgaggtcccaaacagcggccaacagtcgaaaacccgcaagcgaaagttgcaaaagtcgcatggacaaccacaactgtgcaaatgggtcagaggttcttctgctaccgcctcgaaggagaattcattttcatcgcttcgttctcacttcacatctgtatcggtcgatgaacgcctacaatttctgtcgtggctgttcgagggcgcactaccacgctgtatgtctgaatcggatctgggagtgtctacgcgtatcgcacaaccgacacattatgagtctcagccagctgattccactgcgcttcctgagacctctcggaaaggcatgccgtggtcgtcagaagagaaggaccttctattaaggctcaggagagacgagaaacgaccttggtcggacgtggtaaggctattttcagaccagtttccgggtcggagccccggctccattcaagtattttggagcacgaccctcaagaatagagcacattaa

SEQ ID NO: 18324 - DNA, 396 bp, A.fumigatus
gttcatcttcgacctttattctcgtcggcaatactaagcccgagtggctgtctagatctaaagcttgagaacatcatggtctcattcgaggacccaaccgtgcttgctgatttcatggatcctcagcttgcaagaccgacgcctttcaagattgattcggcggggcgaccagtgtatcaatcccgtaatgacttcgggccactcaaaagcctgagaagtataccacagcttgtcgactttgggttggcaaccagactcgaggaagacgacgactggggcgtttggccaattcagccagaccactatcgggcaccagaggtgatactgggtaatggatggcaaatgcctgcggatatttggaatcttggtgttctggtgcgttccgttgttctctag

SEQ ID NO: 18325 - DNA, 390 bp, A.fumigatus
caaatatacaggcatgctgaagagccagagagaatcgtggcactgaaaattgccaataataatgcgagttccgctggtcatgagcgcgaagttgaagagcatatttccatggcagacccgtcacaccgcggtcggtcagttattcgaacattactagactcttttgaagttaaaggcccagaaggttcttatccgtgccttgtatatccgcctatgagggagtcattgtcgatgtatcagcggcgctttaacgacagaaagatgccactgcccctcattaaaacatacattcgtgctcttcttactgggctcgattatctgcataaagtatgcaggacagttcatacaggtaggttcatcttcgacctttattctcgtcggcaatactaa

SEQ ID NO: 18326 - DNA, 312 bp, A.fumigatus
tcttcttcaacaaccactgacatcacattctcccgtcggcttacgggaagtaactctgtaatggacactataaagccattcatttctcgtttctccgccttgcttcgcaagaaaccgtttcccatgccttttcccgggccacctttaccgcccggcatactcgtcgatgaagagatctcgccagtatacgattccaagtacttctaccctgcgaagcctggagaggtgcttgccgatcgttaccaaaccttggtcaaggttggctggggcgtgtcttcaacagtatggctcgcgcgtgatctgcaagggtag

SEQ ID NO: 18327 - DNA, 909 bp, A.fumigatus
tggggctcggactctgacaagactgcccttaccaatgatttcaagttgcttcgaaacaacttcaccaatgtacccatcatcctcggagagtacgacgcatctccgacgaacaccgagccagccgcacgctggaagtacactgaccttttagctcacgctgctgcccagtacaactttgctgctattctctgggacaacggcctcgaccaccttgaccggacaaccggtaactggcgtgaccctacctccctccaaatcatcaccaaaacaaagtcctccaccaaaaacagcttgcccgacagcaccacagacgcttccgcgacaagccagtcgtcttccgcctatatcttccaccaggtcggaacaccagtcacgagccagaccctcccatttatcttcaatggcaatacactccggtccatcagggactccagcggtactaccctgaagcaaggaacagactattccgtctccggctccaacctcgttttcacggcgtcgtacctctcgaagcacttctccgcgtctacaaagcctggcatcatcgccgacctcaccctcgtgttctcctctggcgcctcccccgttgtccagctcgtgcaatggcagacgccaacactgggttctacgtccgttgccgcatcgtccgtctccggtgatctctccatccccattacatggggtggcgtccctaaggtcgcggccgtcaaagctctgactaccagtggcaaatacctcgttgatgactggacacaggtgctgggcccgttgcaacaggcgagaacggtgcgtaactttttttttcgtgcaggaacatacctaaccgctgactctcttctgtgtccagacctacagcaaccagtggaagttcgagggctcgaatgtcattttaacgtctggggctattga

SEQ ID NO: 18328 - DNA, 186 bp, A.fumigatus
ccgctgactctcttctgtgtccagacctacagcaaccagtggaagttcgagggctcgaatgtcattttaacgtctggggctattgatgctgtgaaatctgtgggtcagactacggtgtttacgtttgagttctatcctcgtgtggctggtggtgtgaatacggtcaacttcaccgtgacggtttag

SEQ ID NO: 18329 - DNA, 192 bp, A.fumigatus
tacggtaaaaatcagtcgacagtcgctgatatcgacaactcagtcaagcaaggggtgagtgcttgtccaagtataacgttcaaaccccgaacggatgacctgttctcattccaatccatactcgagctctcggacccgaagattgattgcctctcttctaaagcgaaagaagagtggacttcagtgatgtaa

SEQ ID NO: 18330 - DNA, 210 bp, A.fumigatus
aatcagaatctaaaagcccaaggaagcaattccctacatatagctcgtgtgcaacccgccactagaacaagcggaccgtacggcgcgttggacctgtcattcctgtcattctgcatgtatggtacaggcttcccagttgccaaattgtgctcgaacgtaaaccttcgtgtgacagaaatgccaatggtgggccatgcaaagcccaggtag

SEQ ID NO: 18331 - DNA, 231 bp, A.fumigatus
tgtatgttcaaaaagccagccacggtgagcatggaagagtggtatgttcctatcacagtattatcgcaagtctactttatccctatgcgaatatatgtaagttctgagaataccgaggtatatcctgtaaggtctgctggcatccttaggtcgctcactggaggatatgtcttttacgagtccggaacccatcttatgaatgagatacgtagtctccaacatagtgtttga

SEQ ID NO: 18332 - DNA, 696 bp, A.fumigatus
gtacctttttcgaccgctccccacgcctcctttaccgacgctgggcatccctcagcggaatcggctggggaaacgtgttccctgtattcaccaacatgggtgtcatcggtacgtttcggattcttttaccgcgcattcaacccctcaaccccaccactaaccacaccctcctccagccctaacatactcctgcatcgcccccctgatcctcggcttcgccttcgtaggcctctacctcgtctatcaagcctaccgctacaacttcctcttcgtctacgacatcgaaatagacacaaaggggcttgtctacccgcgcgccctccagcatcttctaacaggcatctatctcgccaacatctgcatgatcggcctcttcgccatacgcgccgccatcgggcccttgatcatcatggccctcttcaccgtccttaccgtactagcacacatgtccctcagcgaggccctagccccactctacaccttcctcccgcgcaccctcgacacagaagaagagcagcagtcgaaagaagacgagacgcaggccctcctgcgccatccccgcaaccgctgggaggcagcctggaaatggttccacccgaacctgtacagagattatgcggcgctgcggcgcaaagtgcgccgggaccatgtcgagatcagatactccgaagaggaggagcggaatgcgtactttga

SEQ ID NO: 18333 - DNA, 732 bp, A.fumigatus
ccacaccctcctccagccctaacatactcctgcatcgcccccctgatcctcggcttcgccttcgtaggcctctacctcgtctatcaagcctaccgctacaacttcctcttcgtctacgacatcgaaatagacacaaaggggcttgtctacccgcgcgccctccagcatcttctaacaggcatctatctcgccaacatctgcatgatcggcctcttcgccatacgcgccgccatcgggcccttgatcatcatggccctcttcaccgtccttaccgtactagcacacatgtccctcagcgaggccctagccccactctacaccttcctcccgcgcaccctcgacacagaagaagagcagcagtcgaaagaagacgagacgcaggccctcctgcgccatccccgcaaccgctgggaggcagcctggaaatggttccacccgaacctgtacagagattatgcggcgctgcggcgcaaagtgcgccgggaccatgtcgagatcagatactccgaagaggaggagcggaatgcgtactttgagccgtgtattcgggcgcgcacgccgacgctgtggattcccagggacaaatgggggtttagtcaccaggagattatcgagacgcacccctccatcccgattacggatgagggggcgcatctggatgaaaagaataagtttgtctgggataagtatgatccgagccttccgctttgggagttgaaggttctgtattga

SEQ ID NO: 18334 - DNA, 1800 bp, A.fumigatus
ggcaattgcagtgaacgaagtccccagttgcccagaggcttcatcaactggtttgggcagtttctcaagatatctgatgcgcatgttctacattcctcctccatggacggatacctctttctgcggttccttagggtgctgtgttctacttgttttactggttgcctcgtcacatggcctatcctgataccgattcacgtcaccggcggtgcaggaaacactcagctagacgcactcagttttagcaacgtcaaagacccgacccggtactatgcacatgctatcatggcatgcatctttttcagtatgtgcttctgggggctcttccaagcaaaatcactaattagggacactgcagcctatgtcttctacgtggtcactcgagagagtctcttttatgcgaatttgcggcaggcgtatctcaattcccctgcctatgttcgtcgtatatcatcgcgaacggtgctgttcatgtccgtgccagaagattacaagaacgagcagaagttgcggcaagtctttggcgattctattcgaaggatctggatcacttccgactgcaaggagctcatgaagaaagtccgcgaacgggacagtttagcttatcggttggagaaagcggaaaccaacttgattcgaacagcaaactcggcccgtctctgcgcattcaagaagggagtgatcacttcagacacgtgtttggactgcgagagcgggacacatagctggcgtaagaagattcgcagaccgagtcaccgtgtgaagttgtttggacccaaagttgactccatctgctggttacgcgacgagctcgtgaaagtatcaaaggaggtagagtaccttcaggaacagcacaagaatgggaagatgaagaatctttcggctctgttcatcgagttcaactcccagtccgatgcgcagatcgctctacagacgctctctcatcaccaaccgctccatatgacgcctcgttttattggtatctctcctaaagaggttgtctggtcgtctttgaacctgagctggtggcagcgcattgtgcgcaagttcgcggtccagggtggaatcgctgccttggttatattctggtccatcccctccgctgctgttggggcgatctcgaacatcacctacctgaccagccttctacctttcctgggcttcattgacaagctaccttcatcactgaaaggagtgattgcgggactgctaccgtctgcagctctggtccttctcatgtcatttgttccgatcatctgtcgctgtatgtccccaagactaaagtccaacaggaataaaagaacattgctgacacttgtcgattcagtcctcgccagacgagcaggtgccccatcgacagcccatgtagagctcttcacacagagcgcgcacttttgcttccaggtcgtccaagtcttccttgtgacaaccctgacatcggcagcatccgccgcgacagcccaaatcatcaagaaccctctgtcagcaaaagatcttctcgcccagaacctaccaaaagccacaaacttctacatatcatacttcttgctccagggcttaacaatgagctcgatggcagtggtgcaggtcgccggcgttcttgtatttaaattcctaagtacctttttcgaccgctccccacgcctcctttaccgacgctgggcatccctcagcggaatcggctggggaaacgtgttccctgtattcaccaacatgggtgtcatcggtacgtttcggattcttttaccgcgcattcaacccctcaaccccaccactaaccacaccctcctccagccctaa

SEQ ID NO: 18335 - DNA, 411 bp, A.fumigatus
ccccactctacaccttcctcccgcgcaccctcgacacagaagaagagcagcagtcgaaagaagacgagacgcaggccctcctgcgccatccccgcaaccgctgggaggcagcctggaaatggttccacccgaacctgtacagagattatgcggcgctgcggcgcaaagtgcgccgggaccatgtcgagatcagatactccgaagaggaggagcggaatgcgtactttgagccgtgtattcgggcgcgcacgccgacgctgtggattcccagggacaaatgggggtttagtcaccaggagattatcgagacgcacccctccatcccgattacggatgagggggcgcatctggatgaaaagaataagtttgtctgggataagtatgatccgagccttccgctttgggagttga

SEQ ID NO: 18336 - DNA, 309 bp, A.fumigatus
gtaaataatgctcgggatctacgtttactggaaggatcacaatgtaactccgtattgactactgatatcacatacataggactatcagattacccgcacgctacgactcgcatacatgccaattacaataatggaaatgcgcataagactgtgttccaatcagaaaagtcatcaacttctattattaagttgataatttctattacaatcaccgcaataagattaattaccacaatccatgttttcctcaatttctccagaagactggaatgtcttaatctcctccaccatcaccaatcaatgacctga

SEQ ID NO: 18337 - DNA, 504 bp, A.fumigatus
attcgggacacgaatatcaacgcctaccctttaaaattgggcgctgaccccacctcctgcttccctcctttcgtcatgtctgctcaagacgagttcaacagccttgttgccaacaatcaggagaagttctccacccatcctgaggatcgagataactctgatcgcgactctgagcctgcctctgacaacaacaccaaccacgacgaccacgcacacttttcagactcggaagactttgacgataccgccatgggttcacggacaaccacatatcaggttcccaggaccaagttcgacgccaacaccgggcccaagggcgtcattgctgatgcccaggccttcgaacgtgcgcgcaagcgctccttccgcaaaaccctacttggtgccgcggggatggactataagcatcatcgctccaactccaagtcgatcacagatgatgccaatcttcttcagaactcgtcttcaaccacgggggtcgaaggatcagcgctaagcgtaaaa

SEQ ID NO: 18338 - DNA, 252 bp, A.fumigatus
cgtttgcaggtctgggatgttcttcgaggtgacaaggtcggctctttgagtggccacgaaaaccgtgtcagctgccttggagtcagcaatgacggcatcagtttgtgcactggatcctgggattctcttgtaagtgccttgaaagcgattaaatattccccattgttatttcggtttattgtttttcttgtcttcatttcacaatcactaatatttctattcgtggtaaagctcaaggtttgggcctggtaa

SEQ ID NO: 18339 - DNA, 456 bp, A.fumigatus
ctctcgctccacaccaatcaaccccctcgtcccgcagctccctctctctcaactcttcctttctgtctgttcctttcctactgccgtcttcccgcctcctctcctggtcatcccaatccgatcccctgggattcacagcgccgcctccttcgacatcgtttcacatcctcgcccgcctattctcatttaccaaacctgcccataccagggacctcctttctggtcgaaatggcagccgatatgagcggcgagcaaatgcaggccaagattaccgcggccaggcgcgaagctgaaggtctcaaggacaaaatcaagcgcagaaaagatgagctggcagatacaacccgtacgaatcctttaagccattaccttttgcaaagtttcaattcctggaattgcagcggcttgtttactgccattgctttgcaaatgtctatgttccatttcggctactga

SEQ ID NO: 18340 - DNA, 600 bp, A.fumigatus
acagttcgtcaggttgcgcagaaccagaccgacgccctacctcgcatcggaatgaagcctcgacggacgctcaagggccacctggccaagatctacgccatgcactggtcaactgaccgtcgtcatttagtgtccgcctcgcaggacggtaaattgattatttgggacgcctacaccaccaacaaagtccatgccattcctttgagatcatcgtgggtgatgacctgcgcttatgctccaagtggtaactacgtggcgtgtggaggtcttgacaacatctgctctatctacaacctctcctcccgtgaaggcccaacccgtgtcgcgcgggaactgtcggggcactcgggctacctctcgtgctgccgtttcattaacgatcgtcgcattatcacctcctctggtgacatgacatgcatgctgtgggatattgagtcacgatccaaggtaactgagtttgcggatcacctgggagatgtcatgtcgatcagcatcaaccccacgaaccagaacatctttgtttcaggcgcctgcgacgctttcgccaagctttgggatatccgtaccggaaaggccgttcatacttttgccggacactaa

SEQ ID NO: 18341 - DNA, 462 bp, A.fumigatus
ccagagaagtcattgcctggtgtcttggttttgtacgcccaaagtacgggggtggggaggggtagtatccgtgatctagtgtacagtagtctcacactagcgattaactgcggatggctcgtgcttcctcagtgggtgttgctctcccctccaacgtcaatctccagtctattattcgatcgttgcccttacggaggaagactgcatgcgactgcactactgatggttcttgataatttaaccctgttttctggtgactttgagctcaaatatatggtcaaaaccaacttccttggaggagcgtctcttagcaaaccccgtatcaccagctacggagtacgggagtaccaaatcctacgttgggcgactttctcctctcccataaggctgacctgccgcttgcagccagaaatgacttctatcgcttactccagtaccgattctctattattggtgctttga

SEQ ID NO: 18342 - DNA, 213 bp, A.fumigatus
aaatggttggcggcaagcgggacccaccccccccttcctgtggaagagaatttcccccctttaaatctgaaccaattgaaagtttttttcatccatgggaacttacgggtttcgagggtaaagccccccgtaagtattagtcatatcgctcatctcacagtcattaccaaaacgggtggttcctacgtgggcatggagacctcactacagtga

SEQ ID NO: 18343 - DNA, 1749 bp, A.fumigatus
ctggagcaggttgaggatctattctataatgttcctacaagacgccgagccttccgatctgcaagcgaagagtacgccaagattctcgatgttgtcggtcggtacgctgttcactgttctgggatagcgttctcatgtcgaaaacacggcgagtcgggtgctggtatctcaacacctacggcagcgagtactgtggaacgaattcgccagattcatggtagtgcagtcgccaatgaacttgttgaatttcaagttgaggattcaaagctcggttttcgctcctcaggcttggttacgaacgcaaactatcatgtcaagcggacaaccatcctccttttcatcaaccaccgctctgtcgagtctactgcgataaaacgcgcagtggagcaaacgtactcgagttttctgcctaaaggcggacacccctttgtgtatattgacctggaaattgagccacaacgcgttgacgtgaatgtgcacccaacaaaacgcgaggtaaacttccttaatgaagacgagattatcgaatgtatctgcgatgcaataaaatcaaagctggcccaagtggattccagccgaacctttctcacgcaaacacttcttcctggtgtcacgacaatcgagccgttgaatcgcaacaatccggccactggtctgtcagttgaaagtgacagccaagttcctagaacacctgcgccaacgaagaagccatatgagcatagcctcgtgcgtacggattccagagtccgcaagatcacgtcgatgctacctcctgcgatacaacgaacgccctccggtcctgaggcggcggagtccgacccttctcaagtagttgaagagggattgcagtacgagactacagaccgagaacctcttcgtattgccctgacatcagtcaagaatctccgcgccgccgtccggtctaccatgcacaacaatctaacagagatgatcgcatcgcatacatacgttgggttggtcgacgaacgacggcgcatcgccgctatacagtcaggagtgaagctctacctagttgattacggtatgatatgcagtgagttcttctaccagatcggtctcacagatttcggcaatttcggaatcatcaaactcgacccagcgccgaagctggtggatctgcttcgaattggggcagacgcggagcgagaagcacatatcgcttccgggggccccgtctcgagccaagagacaacacagcctgagcaaacaggcacggccgaggaaagtgagatctttgccaatgcaccgaacatagtcgcaaaaacactcatcgacagacgagagatgttgaacgagtacttctctcttcagatctccgcagagggcgacctcctcactattcccctcttactcaaaggctatctcccgtcattgggtaaattgccacgtttcctgctaaggcttggcccgtacgtcgactggacaagcgaagaggaatgcttccgtacgttcctaagggagcttgcggctttctacactcccgaacaactgcctcctccaccgcctgaagggtcaaatgcctcagaccacaaagaaattccagagtcgccggaagagcaaccggaagatgcggttttgaggcaccgtcgactgcagatagctcggatgctggagcatgttgttttcccagcgcttcgggctcgtctggttgccaccacacggtttctccgcggcgtagttgaagtggcggatctcaaaggtctataccgtgtgtttgagaggtgttaa

SEQ ID NO: 18344 - DNA, 201 bp, A.fumigatus
gtcaagaggatgccacacttgcgggtcggcatcacgtgtatgttgttttgcatttatctcgagtatggcttgttcatcaatgcaatttccctggctattgaggcccattcgagttctcttttgatggttttattgcgtctctgcagtagctgctcttcccacttaaggagctcatatctgagaaatcctgttagccagtga

SEQ ID NO: 18345 - DNA, 858 bp, A.fumigatus
tcgctagcgaccgtgcgcctttgtatcaattcccctgatcggaacatactttggactcgtatatacactcgaactgcacagctgtcattgaatatggctacggtgttggtacagcagcaaacgctgcgacatgccacccctccgccagcgggaatctcctcgtccctgaatctcaccagaaccccgtcgccggtgccaaacaaacatttacctgtgtgtccgccggggacttcgacagcagctttgcggactgctgtacaatcaactaaagaggataagaaggtcacgtcgcttctctatcctcccgacacgttcttgcgtgtaaacaaatccccctcgatatactcgatcgacattgtaaccttagccgccgccttggattattgggcttctcaacccttgccagatcccagccaggtatttccttggctccatggacttcacccggaaaatcatctacaactggggtttttcacaaaccggagacgttctcttcgccggattcctcaatgttggaggggcatcacgatcgttaaagtcggtggtgatcttagtacatccagactcaaaggtgccgtgtctcccagtgagatccttgccccgtccggctgggatttcattccaagcgaccccaaggagggattctctgttcgcaattttcagatacaaaccccaaagttggctactctatcagacattgttgtctacggccaagacggtgtccataaaaagcagctcttagaagttgctgagaaaatcgccactgcacagtaccgttggagaaataagaatgacccagatggcttgcttccaacctaccatacattcatcctctcaagtcagtccttctcggcttag

SEQ ID NO: 18346 - DNA, 231 bp, A.fumigatus
tcggaacatactttggactcgtatatacactcgaactgcacagctgtcattgaatatggctacggtgttggtacagcagcaaacgctgcgacatgccacccctccgccagcgggaatctcctcgtccctgaatctcaccagaaccccgtcgccggtgccaaacaaacatttacctgtgtgtccgccggggacttcgacagcagctttgcggactgctgtacaatcaactaa

SEQ ID NO: 18347 - DNA, 954 bp, A.fumigatus
ttttttttcgggtgggaggataggtctaacacatccccagttcactgggagcggctcgaaatgtgcgagatgaccaaagcttctgagatctctaaaaatgtctggcaagggccgactcctgattacatattgcaatgtggatcaggcgactccgtgcatgtcgaagattttgaccttttgattgagacaagtgatcttgccagcatccctggccctcgatacctggctaaactcaataggcagctggatgatgacgacggccctctgcggctagaattcccgtcttccgggtcgcttgtcgtcccatccgctgaaacaagagaaatagacgacctcgtaagcactgtacgatggatctattatctagcgaacccagacgagccggaatctcccacagatgttggtggagatattgctatgacgcttcttcaacggaagcctcgcaggattcttatacactgtccagacggctatactgagtcttcactattggtcatcgcttacttgatgtttgctgaaggtataccggctcatgaggcatggctgcgacttcattgcgacaggaagcgtaatttcttcgcatacccgtctgatgtcacttttctgagcaccattcaaacaagacttttgcatgagagtcctgcgacgcactcagagagtctctcgagcgttccagatccgccatggttccggtactgtgatggatcacttcccagtcgaattctcccatatatgtatcttggcaatctgggccacgccaacaatcctgaaatgctctgggctcttggaattcggcgcattctgagcattggagagtcagtctcatggagagattttgacgttgctcggatgggcccagacaacgtgatgcatataactcaggttcaagacaatggaatagacccgttgactcaggaattcgaccgatgcttggaattcatcagtgagttctga

SEQ ID NO: 18348 - DNA, 243 bp, A.fumigatus
ggaatggacgtactagaggcaaggtcgaaggcgcctattgccggcttggtggccagtccaagtacacccttgccgacacccttgatgaaaccttggagaccttctttctccgcaccctgtagcgggtggcgagcaagtcctccaatgccgcttgctaagctgtttgcgaatgcatttccaccggcggtgagaccatacaatgcatgctttggccgatttcgagacttcgacattcgtcgctga

SEQ ID NO: 18349 - DNA, 1356 bp, A.fumigatus
  unsure (1234): Identity of nucleotide sequences at the above locations are unknown.
ccactggagggtgacgccgactcggtggtgagagtcaagatgaagagtatcgaggtcatctataatccgagtttccttgtggagattgttaaattcttcgagccccctgagcgacacatggagtccattggagccttcttggactcggctggagcgactgtcgaggaaatccgccagcaaacccgagcaggcttggagtttgccctggaggagcacaagaaggtcgacgctcacttcgacatacacgcacccctcattatagtgccagaaagcattacacaagaaagctccctctgtctcatcttggacgcaggtcacatcagtgtcaatagtgaactggtcgataggcagaccatgcgagacctccaggccaagcagaagcggcaatacgttgaaaacgactacaaggaactggagcacttgctatacgatagattccttcttaagcttgactccacccaggtcttgatcggccccggagttgagagtaccaaatcgcaactcacgtccgaggtcaagaaccgaaactttcatattatcgatcgtataaacgtggactttgtcttggaactgtgtataataccgaaaagcaccgagctcaccaggactcgaatatcaggccatctgccggagttacacgcttcgatgtctgacacaaagtacaagggtctgatgaaattgattgacatcgcgattccacgatttgacgagggaggtgtttccgattgtccgcccgcgaagagctcgagtgaatcgacaacaacaagtaatagagcaagatcggcttccttccagccctcagtacccagggaactgccggtcgtcgacgaagattccgattccgagacagatcacgagcagacaaagaaaagtgtcgatagactactcaacattcaccgcaaagaatttgagtttaagttcacggttggctgtcttcgtggctcactgttccggtcggatccagatgaccagtttcgagaccaattgttggtagagcttgttgctgaaggtttcgaattagactattacacgcgaccgttcgatatggtcgcagagatcgttttgcagtctctgagcgtggacgactatatcgaggaaaaccccattcctgacttcaagaggatcatttcttccaagggattcgacgcagacgaagataaggacctctttcacctcaaatttgtacgagtcaagcccgattcacccgagttttcgtctacctacgaaggtatancaatgaaccttgatatgtccatatctaccataaaccttgtggtcactaggaagacacttctcaccctgctggattttgttctcctcaccttcacaagcccagagcagcccagaaacccataa

SEQ ID NO: 18350 - DNA, 4470 bp, A.fumigatus
accttgtggtcactaggaagacacttctcaccctgctggattttgttctcctcaccttcacaagcccagagcagcccagaaacccataaaccgtcctccgacgagactgtccagaacaccactgttctcacccaggacacagaacagccgggaaaaattcggatcaaagctgacttgaagagcatcgcccttattctaaacaatgacggcgtcagacttgctacactgagtcttaacactgcggacgtgggacttaatattgttggccgctcaatgcttatccagtctcgaatcggtagcttaaccctcattgacgatgtcaataccggcgcctcagccacctccgacctgcggaggcttctaaccattgagggtgataacttcgctgatttcaaatacgagacctttgatcccgagagcacaaattatcccggttatgactctgaggtctatctgagatcgggttctatcaaaatcaatttcctcgaagaaccatatcgcaagatcatcaatttccttgtcaaattcggcaagatgcaggctatcttcaatgctgctcgccaggcggcggctagtcaagccaaccagctgcaagagaatgcatctaagatgcgatttgacgtcgttgtcaaaactccaatcttggtatttcccggtgccgtgagacctgatcgaccccgcgacacagtcactgctcatcttggagagatttatgctaagaacactttcgttcctctggatgaagatgcggaaagtcccgccgttaacctgatttcttcaggtatacgcaatatccgtctaacatccaagttccacttcgaggaagatgtagtcgaagagctggagatgattcagaaagtcaacttggagttcagcatctgttatcttgagcatcagaatgataatccacgtccagatatggaaatcgaagggtctatgtctcccataaacctcagagtgtcgcaaaagcagctcaaatttttgctagagctctcgaaaactgtgcccggcgctttctcaaccgactacgagcagcaagaactcgaggcctttgaagatcttcctacgtctgtaacagacacaagcaaaggagcagattggaaactcgcgcagaccccccaggaacatgaaaggatcgctgaaggatcgggttcggacgacgagacatgggctaagctggatatgcttttcaaggtagatagtgtcggcctggaacttattcttgcaaaggacgacgagccagtgggtgatctggagggctcgagcctgtcgaagttttcgctgaatgacacccaagtcaagttgcgcatgcttaccgatgggtctctggaatccgagctcttgattcactccctgtctgttcgcgacagccgcaatcaggacacgaacaaattcaggaagatcatgtcactgatcaataacgatgtgcaacagcaattcatggctagtctctctatgtcgcctgggccagagaaacatcttattgcgatgttgacgatcgacagcccacgtatcatactggcgctggactatttgtccgctttgcagtcatttatgaactcggttttcactgcagaggagccgattgccgtagaagagattgaggaggctgatgaaacatctgagccaagatccagttccacagaaagtccagaccaaactgccaccgccaccccaggcgaggactcgacaagctcggccgccaagacgacgatttcattcagagtgaaccttgttgacgcccaaattatcatgattgccaaccctgccatcgcacataccgaggctatagtgcttggtacaaagcaagtactcttctcacagcaaaacgtctctacactgcagatcaacaaagtcggcatgttcttgtgtcgcatggacaagttcgagaccagtaggctgcggattttggacgattttacactggagctgtccatggatagtcggccacaggagaaaggcccatcgttaacttccatagacgtgcacattgaaccgttggtgctgcgcctttccctcagagacatcttgatggcactacagattgtcaataaggcctccgaaatgagagcaaacaggtcacaggaaatagaaagcggcgacgtgaagagagtatcagatggtagacaacccagcgcaaagtccactcgaaggagatcaagcgctgcgcggtcgtcacatgctcctgccttgaaatcaaggcgagcatcgggggcaagcggcaaaccggctagccaaagagctgcttcagaacgctcagctatactgaagcgcgaagaactgagcgcgcagatcgacggcgtcagagtgattctcataggggacttgcatgatcttccattactcgactggagcgtcaaaaaattcaccgtcgatgttcgcgattggtcgtctgcactgaatgctgacactagcttcgataccttcatcaacgtttacaatttctccaagtcggcctgggaaccgctcattgaaccctggcaactcggctttcacgtcgccaaggaggtcgacccagaagtcttttcaatcgatgcctactcacataagaacatggagctcactgtgacctcggctacaattgcattggcatccaagtccttccaatttctttcaactgatcaagatgttctttccaagccccgcggagccgacgctccctatcggattcgcaatcataccggcttcgatcttcgtgtctgggcggatgtcagcaccggagaggaaggtccggctgctaagctctctgacggcgaagaatacccttggagatttgaagactcgactgcggtacgtgagactcttgcacctgaaggccaaggcggcgttgtcggggtgaaactcgaagggagcggcttcgagagcatcaaccgcattcctgtggctagggagggtgaattcttgtatagcctcaaacccaaggcagatggtgttctccataggcttctagtcgaagttaaactgggtaccgacaacgtcaagtatattaccttccgctcgcctctggttttcgaaaacaacactcaaataccagtagagctgggtatcttaaatcacaaggaaggacatctcctcaagattgagaagattcttcctggggatgctcgacgtgcacctgtaggcgccgcctacttgcattcagtcctcatccgtcctgaccagggctttggatatgaatggtcaacagaaccgctgcactggaaggatcttctgcggcgacctactcgcacaatcaagtgcatcagcgaaagcggacagcaggctccgcccttctacttccaaatgaatgccacctacaactcaaaagattccttgacgaacgtctatccttacatgcgtatacgtattttcgctccggtggagattgagaatctactaccatatgatttcaaataccgcatttacgacaagaacacaagaaaggattggacaaatttcctaaggaagggtggcgtcagcccggtccatgttgttgagctatctcatctactcctcctcagtatcgacctagaggacaccgtcttcaggcaaagcgaattcgccataattaacggaaatgcacaagattatcgaagggaacacatgctctcactcaaggatgaacaagggattccattaagactaaagctccattacttcaacgttccagatagtggaggcgctttcaaggtgtcgatctacagtccgtatcttatcttgaacaagacaggaatgccgatggagatccagagcaaggccttcttgcagtcagcacgctccgcagctggtgagggcctgaaccccgacccaagacatggcgggcgggctctcccatacatgtatgcttatcaatcggatgatccgaagaaccgatctatcttgaagataggagattccgcctggagcaagccacagagttttgaggctcttgggagcaactttgaagttgtcttgtccgataggcaagggaagtccgagttccatgcaggggtgtctgttacggaaggtgaaggtaaatataagatgactaaagttgtcactatttctcctcgcttcatcctgaaaaacaagctgagtgaagaaattctggtccgcgaacccggctcatcaagcgtgcttaccatcaagagtggcaatttggtgcccctgcatttcctgcgccagattgcagagaaacaactttgcctgtgcttccccggcgttaacaatcagtggtcatctcctttcaacattgcagacgttggaacagtacatgtgaaacttgccaaggcaaatcaacgtcagaggcttatcaaggttgatatcatcatggaaggcgctacactttttatccacttgagtttggaaactcgaaattggccgttctccatgcggaatgagagtgattccgaatttatcttctaccaagctgtgagcatctctgcgcgatatatgactcgtatacatgctaacacacagactgtctttatagaatccatacgtggaggatga

SEQ ID NO: 18351 - DNA, 2130 bp, A.fumigatus
aatccatacgtggaggatgacgaggacgatagaacaagtggctggcggccaattcgctaccggctcccgcctcgcagcatcatgccatatgcatgggattatcccgctacgaagaacaagtctctcgtcttgacatgtaatggaaaggaaaggcatatcaggctcaccgagattggcaacctgataccgatgagaataccgccttcacgacctggggagccgcaaaagattgttgatattaacatcgtggctgacgggccgacccaaaccctcgtcttgtcaaattttaagcaatcccgaagtctttataagcaacagaaggcacagacatcccagactagtgtgtcaacaggctttgaggtaaaggaactggactcggacgtcaatttcaaagctcagctacgtctggcgggtattggggtctcgttgatcaacaagaacctgaaggagctgctatatctcactttccgcgaaatcgagatcaaatttagagaatcaagggtttaccagactttgaacacaacgatcaaatggatacagattgataatcaactttatgggggcattttccccatattgttgtatccaagtgttgtgccaaagaccggaaaggagatggaggcacatccgatctttcacgccatggttacacgcgtaaaagacgactcttacggtgtactttacattaagtatgccacggtactacttcaacagataacacttgagctcgatgaggacttcattttcgccatgcttgattttgcaaaggtccctggtgcctcatggtccgaagagcaggaaggaaaactctgcgatgaagatctaaaaatcccagaaccgcaaaatgaaagtgctagccaagatgtttactttgagctccttcatttgcagcctatgcagttggatatctccttcatgcggacggagagggttaatgcggagaataacatgcagccctccaaccccctcatgttctttgtcaatgttatatccatgtcaatgggcaacatcaacgacgcccccgttcgtctcaatgctcttatgttagagaacgctcgtgtctcttttggaatccttctgaacaatattcagagtcattacactcaggagttccttcgccaagtccacgtcattcttgggtcggcggatttcctgggaaatccagttggtctgttcaataacgtcagctctggtgttgctgcgatcttctacgagccgtatcagggactggtcatgaccgatcggcctcaggaactgggcatgggtattgcaaaaggcgctacaagttttgtcaagaagtccgtctttggtttctcagacagtatggccaaattcaccggaagcatgtccaagggacttgcggtcgctacgctagacaaagaatttcaagatcagcgacgaatgtcgaagtctcgaaatcggccaaagcatgcattgtatggtctcaccgccggtggaaatgcattcgcaaacagcttagcaagcggcattggaggacttgctcgccacccgctacagggtgcggagaaagaaggtctccaaggtttcatcaagggtgtcggcaagggtgtacttggactggccaccaagccggcaataggcgccttcgaccttgcctctagtacgtccattcctcaagaaaatgaagatgttcatgctgactgttgtctaaatctcgccgagggcgtccgaaacaccacgacagtgtttgacgcggaaggtcttgaccgtgttcgcctaacccgtttcattgccacggacggtatagtgcggccatactcacagcgcgaggctttgggtcaattttggctcaagacagccgacgacggcaagtatttcaacgaagattacattgcgcacttggagctgccaggcaaggacatgctggtcatgttgacgtacgaccgaataatgcttgtgcgcagcaagaggcttcgaacagaatgggatatccgattaacagacatccaaaccatttccaaggaacggactggtatgagcattacgctgaaaggtggcgcaaacggacctttcattcccgtgcaagacgaaagctcgaggaattggctgtaccgtcagatcgccattggtagtcttcccccgataacctgcagagtgaatggttgctaa

SEQ ID NO: 18352 - DNA, 498 bp, A.fumigatus
agacatctgttcaccatcacaggtcctgccggtctcgcagcagctatccgactaaaacagctagcaaacgaggctggaaacgaggagtttcgtgtgattttgctggaaaaagcgggagagctgggcgcgcatatactttcaggcaatgttcttcaaccaactgcaatgaatgagcttctgcccgattggttgtctgaggagaatccgtcgcgatttgagggtgcaacaccagcgcgggaggacaagatgcgctttttgaccaagaacttgtcgttcccgatccccgccccaccccaaatgaacaaccatggcaactacattgtcagtctgaacgagctgacgaagtggttgggtgagcgagctgaggagttgggtgtcgagatttaccctggatttgctgctagcagagttagtctacaattcggatggctccgtcctcggcgttgcgacgaacgaccttggtgttggacgggacggcaaggccaaggacaattttga

SEQ ID NO: 18353 - DNA, 351 bp, A.fumigatus
gccgaacgggaacgaaccacgaggaggaccagcctgtccatttgcaggtcgctgattgggacaagcatacggacgtcgcttggcccaagtaccggggcattgaaaacagattttgtcctgctggagtctatgagtacgtcgaggatccaagcaagcagcacggcgttcgcttccaaattaatgcccaaaagtaagtcttggttcttacgcgcatttttctttttcctcatgcagatgctaaccacacacagttgtatccattgcaagacgtgtgatatcaaggtaccgacacaggatatcaattggcaaacaccccagggcggagaaggccctaaatacttcaagacataa

SEQ ID NO: 18354 - DNA, 354 bp, A.fumigatus
ggtttcctccacccgactttatctcgggaatcttccccgcaatggtatgcaggtcttcatcatcaaatctaccctttcctaggagatatccccgtctgtttcaacctggattctgtataccgtcaactcgcgccttccaaaaccactaggagagaccctttttggactacttggtcttcccataactctcatgaatctcaggactgtttcctgggatcttccttcgtccttggacatggggatgtgagggcgaacaagcatatccctcatcctaagtctccatatttcccggcctgcagcaccccgacgactacggatatagctttctttggcagtttaaccttgtgcttttag

SEQ ID NO: 18355 - DNA, 528 bp, A.fumigatus
cgaagtggttgggtgagcgagctgaggagttgggtgtcgagatttaccctggatttgctgctagcagagttagtctacaattcggatggctccgtcctcggcgttgcgacgaacgaccttggtgttggacgggacggcaaggccaaggacaattttgagcgaggtatggagttccacgctcgtgtaactctcctcgccgagggctgccatggtagtttaacgaagcatgtaatcaagaagtacgacctcagacgtgatagtcaaccccagacttatggtatcgggttgaaggaggtgtgggagattcaaccggaaaagttcaagtcgggagagatcgtgcattctatgggatacccactttcttcggacacctacggtggtgcctggatgtaccattttggagagaatctggtcagcatttggctggtcgtcggcttggacttttcccaacccgtggctttcaccttacggagagttccagaagctcaaacaccatcccctgttcagggaggtcttggagggcggtaa

SEQ ID NO: 18356 - DNA, 246 bp, A.fumigatus
cttttgccgatggcgcccgtgttggcgtcgttgttgctttttttttcagtgactaaacaggacatcgaggaacactttagtagccatggctccgggaagatcacagagatcaagttgatgaacggattcgggtttatcgagtacgaggatgcgatggatgctagagatgtggttcctggtaagatatccctgggcagccctgccttgacttcggacaggatcatctggctgacaatcaccatctag

SEQ ID NO: 18357 - DNA, 402 bp, A.fumigatus
ttatttgcctccagattcaacctcatgacgaccgcattttccgtgatccatatcggtcccgctcaccccgccgcagttatcctcctatcgatgagtatgacaggagatttcccgcgcttcgcggttacagcccccgcgcccattacagggaacgctcgcctgttccgctccgccgcgactattatgaacgtgatggctacggccgtcgcacccttcttcgacctcggattgaagactatccccctcgtcgtccttacgatgacccctatgatgcccggcctccaccacctcctcgccactatgatgacccatacatggcaccgagaccctacggacgtcctcggacacccccaagaggcgactatccaccttatgaccgccgtggatactggtagaatttaa

SEQ ID NO: 18358 - DNA, 918 bp, A.fumigatus
aggaggtgtgggagattcaaccggaaaagttcaagtcgggagagatcgtgcattctatgggatacccactttcttcggacacctacggtggtgcctggatgtaccattttggagagaatctggtcagcatttggctggtcgtcggcttggacttttcccaacccgtggctttcaccttacggagagttccagaagctcaaacaccatcccctgttcagggaggtcttggagggcggtaaatgtatctcctatggtgctagggccctcaacgagggtggcttccagtcgattcctaaatgtgcttttccaggaggcgctctcatcggtgacactgctggcttcctgaatgttcccaaaatcaagggcactcattcggctatgaaatcgggcatgttggctgcggaggctactttcaatgctttgcagaatgacaacaatggtactgtcttccttttcgactacgaggatgctcttcgaaagtcctcgatctggaaggagctgtacgaagtgcgcaatatgcggccctcgttcaaatccccgctcggactttacggcggtatcctctactctggcttagaagccttcctgttccgcggcaaaacaccctggacactcaagcaccacggtacagatgcagcatccaccaaaccggcatctgaatgtgaaaagatcgaataccccaaacctgacggcgtgatcagcttcgatatcctgaccagtgtgagccgaacgggaacgaaccacgaggaggaccagcctgtccatttgcaggtcgctgattgggacaagcatacggacgtcgcttggcccaagtaccggggcattgaaaacagattttgtcctgctggagtctatgagtacgtcgaggatccaagcaagcagcacggcgttcgcttccaaattaatgcccaaaagtaa

SEQ ID NO: 18359 - DNA, 504 bp, A.fumigatus
gcttatgtcttgaagtatttagggccttctccgccctggggtgtttgccaattgatatcctgtgtcggtaccttgatatcacacgtcttgcaatggatacaactgtgtgtggttagcatctgcatgaggaaaaagaaaaatgcgcgtaagaaccaagacttacttttgggcattaatttggaagcgaacgccgtgctgcttgcttggatcctcgacgtactcatagactccagcaggacaaaatctgttttcaatgccccggtacttgggccaagcgacgtccgtatgcttgtcccaatcagcgacctgcaaatggacaggctggtcctcctcgtggttcgttcccgttcggctcacactggtcaggatatcgaagctgatcacgccgtcaggtttggggtattcgatcttttcacattcagatgccggtttggtggatgctgcatctgtaccgtggtgcttgagtgtccagggtgttttgccgcggaacaggaaggcttctaa

SEQ ID NO: 18360 - DNA, 402 bp, A.fumigatus
gccagagtagaggataccgccgtaaagtccgagcggggatttgaacgagggccgcatattgcgcacttcgtacagctccttccagatcgaggactttcgaagagcatcctcgtagtcgaaaaggaagacagtaccattgttgtcattctgcaaagcattgaaagtagcctccgcagccaacatgcccgatttcatagccgaatgagtgcccttgattttgggaacattcaggaagccagcagtgtcaccgatgagagcgcctcctggaaaagcacatttaggaatcgactggaagccaccctcgttgagggccctagcaccataggagatacatttaccgccctccaagacctccctgaacaggggatggtgtttgagcttctggaactctccgtaaggtga

SEQ ID NO: 18361 - DNA, 498 bp, A.fumigatus
aggacagcttcatcctctcgtcatctgtcaagaataggtggccctgcagccgtctccaagctggctcgttgcgcattgactttccgggcaggccctcaggccatggatacggtcccagcaacggctgtggctccagcttccgcccgacgatcaaataatgagtctcggtccgtgtatgcttggggtccttcgatacgtagtcgaacatattctcaacctcaacggcaaaaccagcttcgcgcagtagattcagccaggccgtctgggagaagtacagctcagacaccggcctctccatccacgtcgccttacacctcatacagtcccagacgagatcatgtacgtccgttcctcccacaaggcccgaggagggcgacaccccaagtaccaggatcccatccgccttcaaccactcggcgaaccgatacaccattttatgagtgtcgcttgggtggatctgaaaaagcgagtagattgcaaacaccgcgtccattttga

SEQ ID NO: 18362 - DNA, 930 bp, A.fumigatus
tatccccatctgatgcacgcgatcctcgcgctaggagctacgcactactccctcgtctcgcctaatggatcagaatactcctccacggcgcttgtccaccgaggcaaggcactgaaagagttatcggcggcgataggaaaaggcccagaatgcacaacaaccgacatggacgtcatcctagccacctgctatgcgcttgtgttccaggcgtaccacatgcacgatggcctcgtcgactttgcagtcatggtccgcggctgcggagtcatcactaactgcatcgtggacaaataccaaacaagccagctattccacttgcagacagaggaggaggcggccgaggtggccttgtcacttgccgacgaacccgtcagcagtcctctcctagtcgacagccttctcgcggcaatcgacaggttacaaccactttttcaaagcgccatacatcaccgcttcttccgggcgctacgggagacacttgccggcctcgcaatctcccagcgggcagcgtttgtcaggctcacccggatctatgccgtgtggtacaaagccgacaatcgagagtttctcacgttcatcgcgcctgcgaaccacgtttcgcgcgcgttgttcatgtatttccttgtcatcgagctcgttatgctgccggtttatattaggctgcgcgagttaagtggcactacattgataacaacagatctaaccgtacgtcagtgggcggatgccatctaccgcgagctgccatcgtcgatacgggagttggtggagttaccgatggaaatcatagctgcagacgagaatactgcgagaagcactcgcggtacgcggtctgacagtgtcttccccaatctgcatgctcagttctttgacatggagacggcagcgtggttagggtgcgcaaagcctggaggagttggagtattagaatga

SEQ ID NO: 18363 - DNA, 759 bp, A.fumigatus
atcgcatatcccaggaagagaggactgagaatgtcccctgtcgttccttctcttctctcttctcaatattctcacctgctcgttcgccatcgcacgcccaatcagccaggtgataacccaacgaaacttatatcgcaaagaccgtcccccacaatcaccatgcagttcagattcaaggaaagactctcctaccaaggcaacccacaagagcttgagacgttcatgaagcgaaagctcgagcgcagcaccagcgctcaggaatcccctaagcccgaggaccccgagaagcagactcgccaggaacgaactgctctccacgacgcagcagagttcggatatcccaactttgctctcacattcatcgagcaaggcaatgatatcaacgctgtcgatgcaaaaggacgcgcgcccctccacgttgcggtgcaagcaggacaggaagaggtggccaacctcctcatcaagaagggtgcagatgtgaacgtccacgacaacgatggactcacccccctacatttcgctgtcgtgctgcgctcggtggctttggctcgcctgctggtgcaggctggagcaacaccacgcgctgagaatgcccatggaaataccccgttcctctttgcttacttgtttgaggaagatgagattctcgagtgtttcgccgagacgagccgtccgaaagctgaagcagtgccctcgagcacgcttcgtggatatctggtcaacatgcgatcttgggccaagatgagatctatgctgtga

SEQ ID NO: 18364 - DNA, 618 bp, A.fumigatus
gccacaaacgcattctgccatgaatgccacatgctgaccctcgcagacttccttgacaaggcatcaacagcaaacaagtcggtggagactttggctcccctgtgcaacaatctcccatacgcagatgcccagtttgattgtgtcattgcagccctggttctcgactctgttgacgatctccgcggcgtcttgctagaagtcgtccgcgtggtggacaagtcctcctcgaatgcacgggtcattctggtccaaggcgcaccatataatgaagtccagaaattagtgaacgccgtctgtactccattgagcagcaagagcatcggaccagcccatcagggcctgctgcttcactctgccatgaagatattggccgatatcggattcggaatgacttccctccatcctctcagtacttcgtattccttcgacgacaagagttcatccgaccggagcaacgaccttgccgagatgctgggcaacgtttggtttcctggcgaagaaaagcttgcgcagatgaaacagcagctaatttccccgatagagaacctcctgcatgaccatcccggcttcctccagaatgaactagtgatcctggaggccgtattgcatgctcattaa

SEQ ID NO: 18365 - DNA, 918 bp, A.fumigatus
cggtcatactatgaaccccataatcgtaatccagccatggaagtcgacgctgcaatcctcttcaacgaacttggaacgcgttatgaagacgcctatgcagatagtcccgggctgctcgaagtcaccgaatatgtggtgggcaagcttccacgcagcagccatgtgctcgacgtgggttgcggaaccggcaaacctgtcgcagcagcgctcgcatccgccggtcacaccgtctacggcattgacgtggccgagaatatggtgagcattgcagccagccaggtgaaagggacattttcgagggcggatatgcgaacctatactcctccggtcaaaatggacgcggtgtttgcaatctactcgctttttcagatccacccaagcgacactcataaaatggtgtatcggttcgccgagtggttgaaggcggatgggatcctggtacttggggtgtcgccctcctcgggccttgtgggaggaacggacgtacatgatctcgtctgggactgtatgaggtgtaaggcgacgtggatggagaggccggtgtctgagctgtacttctcccagacggcctggctgaatctactgcgcgaagctggttttgccgttgaggttgagaatatgttcgactacgtatcgaaggaccccaagcatacacggaccgagactcattatttgatcgtcgggcggaagctggagccacagccgttgctgggaccgtatccatggcctgagggcctgcccggaaagtcaatgcgcaacgagccagcttggagacggctgcagggccacctattcttgacagatgacgagaggatgaagctgtcctctatgctggagggccatcaaaggatactggatatcgggggtggattggaaggtgagccacaaacgcattctgccatgaatgccacatgctga

SEQ ID NO: 18366 - DNA, 186 bp, A.fumigatus
tgcccaaggtgttccgagcttgccaaggcacatgtctggcagcagcatactttcattatcggcactaagaggttcgttacggatttccgcggcaagcgacactacgatcgtgggctctcctatcgcgcccgaagctcgaacatcgcgaacaagccgcagttcaaccgcatggtcacctgtacttaa

SEQ ID NO: 18367 - DNA, 711 bp, A.fumigatus
  unsure (711): Identity of nucleotide sequences at the above locations are unknown.
ctgcaattcccagaggctatctggggtgccgatcccttggaattttatggtggttttcataacctttcttttgatgcaaatgcaagcttcaacagcgctctagcagtcaatgggagcgtcaaatggaaaactgcccgagctctctcacacaactttgctccagggaaaactagaacggagctccatgtgagctttccagaaatagactggaagttcacgcaagctgtctatggatggtctgctctacaatatcaggcctgggcgcgcggatcattgaatactggccattgggcccctcagtctgtggcaatattcacaagcgggctccttgagattgtgattgatggcaagcggcatttcggaggagacttttataactatggcacagtacccatcattattgatttaagtacaggtgaccatgcggttgaactgcggcttgttcgcgatgttcgagcttcgggcgcgataggagagcccacgatcgtagtgtcgcttgccgcggaaatccgtaacgaacctcttagtgccgataatgaaagtatgctgctgccagacatgtgccttggcaagctcggaacaccttgggcatcaattaacctacacaataacatcgcggatcggatcacgattcttgctatcagctcaattggtgtcagtgctaattctctgcctctttgtagatacgaaagaagagtgacacgtctgtan

SEQ ID NO: 18368 - DNA, 1416 bp, A.fumigatus
tcgccgcggcaccagtgtcgggctactcatccattgagagtatgtcgagaacatcagtttccatggttgagagtgctaatacaggtagaatatgtaccttacaacctgtggcaggatttcgagcctctgctctcattcgtgctctcgaggtcaaggtcaagctataaacacgagttgctgctaagcaacgttgcgggtatcccgatattacaacagcacggctcgattgatgacaatgtccctgtgtttcattcgcgcttgatgcatgaattacttggacagacccagtggcgatcacaatatgatgaattgcaaggccagaatcactggttcgatggcgtattgaccaccccatcccttctggcattctacaatcaaagtgccaccttccctcgtcgacccaggcttcctttggcattcaccatcactgttccgtcctcggcaaatattgcaaagggtgggatttatgtcgatcaattgcgatcccctgacagaaacggagtagtgcaggtcattagagatgcgcgtagcggtatctggtacgtaaatacgaccaacatacatcgcttccacctttcaccaagggtcttaaatttcacaatgccctctgcgctagttttggacggcagagattgttttgaaatgggttacatccggcctgaacgcatgtggtttctgagagattctcgaggaaggtggactgtctcagagagagaggattggcgtcaattgaatgagcggtatggtcgtcagctcggaactgtggatgccattctgcgcaccaaaggccccttcaacatcaacatatgctcagctgggcttgagcacatagctgtgcaaatcagtcgtaattttctacaatatttcgctgcagactcccaactatcacggcaatgcggctccctgatttaccccgacaacaatcagaaccgtgttgtcgatagcgggaatgttgtcacactcgccctgggcaacgaactaccttcatcgaagcttaaattatttccgattcgcatacagggccaaggtctcagtctcttccagggctgttgctggcctcgggcagacacagaagcaagccctcagtccagcttgaatcgagagtgtaatgaatatgaattccccttcgagcgaggcatgggcgccctcttcctccgccctttggagaatgagagactcgagcttgttgtttggggagcagacttgtctggtctcgagcaagctgcacgctttgtacctaccctcacaggtgttgggcaaccagattttctcattcttggcgatagttgccgttggcagggacatgctggagcatacgcagctggttttttcgatagatcttggcagatatcgtccgggtcttatattcgcatagatgccagcgtgaatgagcaaagattaagaaacggtgcttga

SEQ ID NO: 18369 - DNA, 312 bp, A.fumigatus
tactcgacagttgctggagatcaatatgggaactatctcatccagtggatcttgatgaatgctgcacctcatcagcgtgaattggtcgcaagccacattcggtattgccttgcctctctgtacctttaccaatataacgatgctcatgcgatgatcataggaagcacatggtttctttgcgaggctccaaatttggttcacgcgtggcaatgctttgctgcaacccatcccataccacccgtcccggacccggggcgggcatgcagatcggccgtttcagcaatctcaacgatgaccggtatcatctggtag

SEQ ID NO: 18370 - DNA, 657 bp, A.fumigatus
gtcggcgcaaacactttgcagacctatatttctcctcttgaaccactaaactaccgtcggctcctcgataaaaatgtgtcttgcgactggaaatatatagtggacaaaattatctgcaacaacgaccagcaagcctccatctttctgcaacaaaagctcaaagttggaacagctgaacaaaaatatgatatcattgaagcaatcacacatcaggcgtatccgctcatggtcaatcgttttggtaactttcttgttcaacgttgcttcgaacatggaactacagaacaagtcgttgccatagcaaacgccatcaagggcaacacgctgagccttagcatggatccattcggatgtcatgtggttcaaaaggcttttgacagtgtcccggaagaacacaaggctgtcatggttcatgagcttctttgcagaattccagaaacggttattcatcgttacgcatgtcatgtttggcagaagcttttcgagctgcgttggagtggggagcctcctcagattatggcgaaagtcaatgaagccctacaaggaatgtggcatgaagttgctttgggcgaaaccggcagtttagtagtccagaacattttcgagaactgtgtagaggatgagaaggtgacagttgccccagtccctcgctcataa

SEQ ID NO: 18371 - DNA, 321 bp, A.fumigatus
cgtccggctattgaagaagtaatagcaaagatcgatgtgctcgcccatggtcaattcggaaattggtgcattcaacacatctgtgagcatggtgctcctcaggacaagacacgagccattgaacacgttctcctttggtcagtcgattacagtatggatcagtttgcctctaagatcgttgaaaaatgtctcaagataggaggctctgaatttctggatcgctacctctctcgagtctgcactggccgtactgagagacccagaatgcccttgatcgatagtgagtttcttcagactgttcaaccgtacaccaccgactga

SEQ ID NO: 18372 - DNA, 879 bp, A.fumigatus
caggattatcctgccctttggctttgtcacgattgcaaccggtgctgtaacttatggtggcatcatggtacgcgctttctctatcttccagtttctccgatgtatgattgcgctaatcgagttcacctgcagcggggaagcgaagtcttcaacggtctggcgcacttcatcaagggtggaatctttttctggtacggtctgttgaccctgggccgttggatgggctgctgggcagattttggctgggcgtggaacatcaaaccctcgagctcgatcgtcggcaaatggaaggcgaaaattccttctggcgagtttaccgaatctttagtcattttcctttacggggcaagcaacgtctttctggaacatctggctggctggggcggcgcatggactgctacggaccttgagcatgtgtcgatttcgatcatgttcttcggcggtggcctgtgtggcatgctattcgaatccaagcgcatcagaggctggttgaacagcactgttctaccatctcccgctcatgccagcgtacatggttccgcagaccctgcttggcagacccccgatacgcaaggcgtctccctcaatccaatgccggcgcttgtcatcctgcttctgggaatgatgatgggatctcaccatcaaacgagcatgatgtcgaccatggtgcacaagcaatggggaaatcttcttgttgggttctccttggctcgtggcatgacatatgttttattatacctcaagcctccgacctcctatcttccgtcgcgcccaccaactgagattgtggcatccttctgcctgattgctggcgggttgatcttcatgctaagtgtaagtgtcctgtgtccttcgttgtccttgaagaattgttactga

SEQ ID NO: 18373 - DNA, 237 bp, A.fumigatus
ttcacctggttttttgggcttagcgccgccttcatgactacggtgtttttgtttctccgcagcgcctggatatcaaaatcaacgcatatgaataagcgacgaacgacctcactcacatggacaacggccaatgattgcaatggaacttatactgctgaatctagctacataaaacagttgacatactttctaggcttcgcaactgcatatccggagccaatgcggatgggtggttag

SEQ ID NO: 18374 - DNA, 267 bp, A.fumigatus
agagagtggaaggggaaaaaagaaaaatacaaaaggaaaatcggcctcggatcctacctcctaatctactcccgcctcccctggctctcatattacatccttcttcctttttcttttccttcgactatctcctcctatacttcattcagccctacaaacatacctaacgtaattattattgcgcgccaccccggtagcacctcagaaccgcatctcgtacagttgcggtttcgcgcaatcagaaaatctcacaggccattgaaataa

SEQ ID NO: 18375 - DNA, 1368 bp, A.fumigatus
attgtcgcaaatctgacgcgtctgcttactacaggtctgcgacgatatgcgctttcgacactggtgaacaaactccttggtaacgacaaaccgataccattcgagtttctgatcaacggtacatttctgcgaacttcgatcgatgaatatctaacagccaatggtatctctgccgagacgactttggagattgaatatgtcagagcattgatccccccgctgcacatcgcatccttccagcacgatgactgggttagctccactgatgtgctctctgcaacctctcccgctgccacctgggcatctgcgacaatctctcaaggtcaagagaagatcctttctgggagctacgacggcttgcttcgggtatggaacatgtcatctcagattgttgcgacttccccggcggccgccgatggggggcatacggcatccatcaaagcggccaaattcgtcacaccgaaccagatcgtatcggcgggtcttgatcgtacagtgcgtctgtggaaatatgctgagagtgatgaaggattctcgggcacaatagctccccagctcgagctgtatgggcacaagtctggcataaattctctggccgtgcacgcgctctcgaaccgtatactatccgcctcctcagataatagtgtcggcttctggtcgacgaagaaatcggacgcccccgccgcgccagacgacctgctgccatcggctgcatcaaggagctctaagaggagaaagctgaactcttctgtgactgttccccagcgagggccattggcactcttgtcctcgcacaccgcacccgtatctgctgctatcttcgatgcgaaggactcgacagttggttactcggcttcttgggaccattcaatgcgcacatgggaccttgtcacctctgctctggtggacacccggacgacgtctcactcgctgctttctcttgagcatctcccggagctcaacctgctcgctgcgggaacatccgcgcgccacattactctcattgacccccgcgcatcagcgacgacaatctctgccatgacattgcggggtcacacgaacgccgtcgtctcgttggctcgcgaccctcacagtacatatggtctgatcagtggaagccacgacggcacatgtcgcatctgggatatccgtgccacgaagaccgataaagacggtgccgttggcgagagcgtctactccatctcacggaagagtctggaggagcaaggaaggtcagatactaagcgcgttggaggcgaaggtgtcaaggtcttcagtgtttgctgggacaagacagttggcatcgttagtgcgggagaggataagagaattcagatcaaccggggcgaaggcgtattgtccgcataa

SEQ ID NO: 18376 - DNA, 423 bp, A.fumigatus
gacgctttttctccatcccggcgtgtacgacttgttgcgcagcacgaaaacactaggcccttgcagctgaaggtcgaagacgcctctgcgaaggttcgattaattcagacagagattgctttcaaccaggccgtgactaggacactcgaggaggtacgagagctttgccagcgactcgatgcaggacggagaaaccttgaggatggccgtatcatggccgccattgacacggtggacgcggtggaacactctgtacaaaaggatagtcttttcgccaacactaatgtaaaacacatcttggtgcagaatgttgccgaactaagaaaccagattgcggaggatctccgagctcgctggaacaacctactgaaggttgacaaacaggccggcagcttcgaagtggccaaaaatgacagtaagtag

SEQ ID NO: 18377 - DNA, 1029 bp, A.fumigatus
cggcgaataggtgccttgctggatgatacaatagctgccacggctcgattggacctactcgtcccagcaagccagaaactacagaaggatcttctgttagcgatagtggaacctatattgcttcctaatcaggacggctatagccgtccgatccatgttgcagaaggctcgattcatgtgcagccagaaccagccataaccactgttccgcagctgctccatcgtgtctccactgccttaggttttctccggcaatgtctaccttcgtccatttcagattccttctccgacactttcgtacccactctggcctccaaaatcatatcatcttggctttcatctgcaatcccgacagatcttgcaggcctcgctgactttgaagcgatcctggatagtgtgttgaaatttgctcagacaatcgagacacttggatggcacgggcaggaagaacttgtgtcttgggtgaatcaagcaccccgcctctggcttaccaggcggcgagccgactccctcgatcaagtccgtaaagttcttgcggggagtcatgggatgacaaagcaagtggaaagggttgaaaaggaagaggtatctcgagcagatgaagtactgttggaaaatgccacttccgacgactgggatgctagttgggacgacgacagtggggacgagtccaaggaaatcccctcaggaacccaagaaggtgaggatgatgtcgcggcttggggtcttgacgacgacggtacagaggaggtagtggagaccaaagtcggtatctcagaatccgccgatgacgacgatgcagacgcatggggctggggtgacgacgaagacggagatgagcgtgttgagaaccaaccagcccaggagactcataaggccactcccgtaattggaagagatatcggacatcgtgccccccgggaagttactctgagagagcactacactgtcacggatattccggactccattatggcgatcgtccgacagcaggtcacagatgtggaagccatatcacagcctgggtaa

SEQ ID NO: 18378 - DNA, 954 bp, A.fumigatus
gagagcactacactgtcacggatattccggactccattatggcgatcgtccgacagcaggtcacagatgtggaagccatatcacagcctgggtaagttggccagtatttatgatctgtacatgcgcttacaacaacttagtcatgatcatacgcgtattatctcttctccggctggtcttcttgcacttccgacattaatcctggctatgttcaaggccacagcaccatcattctacagtctcaaattcaatgctggacaaatgtacttgtataacgacagtttgtaccttgtcgagcagctccggactatggttgaggaacataagctgtcgcgtctcagttcggatctggacgcacttgaaaagttcggcaagctcgcctatagcaaggagatgcagactcaacgcactatagtcaccgacttgctcgatggtgcccagggattcagtcagtgttcagaacagccgttccttggggagtgcgaaaacgcaatatgcgccactgttgacagaattcgcgatgtctacaaggaatggcaaccaatcctgtcacactctgcgcttcttcaatcgattggatcattggtagcctccgtcatcaacaagatcatcattgatatcgaggatttgggtgatatctcggaagcccagtcacagcgcctagtgtctttctgtaatcaggtctctcaattggaggatctgtttatgcctccgtcagctgaagctgaacgtgtgccaattaccgcggtgtacgtgcgcaactggttgaagtttcaatacctgataaatatactggaaagctctcttgccgacattaaatttttgtggacagaaggagagcttcggctcgaattttcagcagacgaggtggttgatctgatcgaggctctctttgcggagtctgactaccgacggaaggcgattgcagatattcgacgacagtctcggggataa

SEQ ID NO: 18379 - DNA, 432 bp, A.fumigatus
ctatgctctgtttccttcaaattggctgactgggtaacagcgaaactccgcgcactgcgcaagtggccgcatcggccgccgtatttttttcccttccctctacggttgacggagcaagtgtctggtatcgatgagaattttcaaacacgcttcttctgggatagttactgtccagagttcaatatgaacgacggctcaaattctgatgctactgcaacctcgtctgctgcccagcgacaggtccgcgtgcagctcaccagcaaacaggaagatattgcgctgccagataacactggacccatcttggttcctacaagtaggtcatttccttctggtatcattcgactaaattgtcgcaaatctgacgcgtctgcttactacaggtctgcgacgatatgcgctttcgacactggtgaacaaactccttggtaa

SEQ ID NO: 18380 - DNA, 225 bp, A.fumigatus
caaaatcatgcttgtatattggaaagagacaagaataactccaacttttcgtactccactaagaaaccaaaagaatatgtgcgatacatattatgcggacaatacgccttcgccccggttgatctgaattctcttatcctctcccgcactaacgatgccaactgtcttgtcccagcaaacactgaagaccttgacaccttcgcctccaacgcgcttagtatctga

SEQ ID NO: 18381 - DNA, 1155 bp, A.fumigatus
ttgagcgcatgtcaacctcttatcgtcatactcttgttaacactattgcgtcgcttgcagtatgtgacttcgatactccagaatgtctactacggaattacaatccgcgccggggagccacgaccccagccaccatcaccgcggtatgctcggcaccgccgtcgcatcttcatcctagtcgtcacgagctatctcctgtacacactctacgaaacatttcatcaggtccaggttaccggcgatttctaccgcgctctcggtgtctctcccctggccgacgagaggactatcaagtcgagatttcggcggcttgctgctcaacatcacccggacaagcgcggctacggggatggtgacccatccgatgattactttgtgtatctgaagctggcacatgatacgttattggaccctgcaaagcgattcgcatacgaccggtttggcccatatatactgtcctggggtgatcggaagacaatgcaggactttctgtttgctgggctgcatcgatcagtaccgcagtatgtggttggattagtgactatcattattctgaattttacttattggtcaaattggggtcgctatgtaagccatcaaccaaggtctttcctgaagcaatgggatcagtctactaacttgaatcagtggcgcttcttcacctttgctgcgctcatcacgctcgaagcagccctgatcactcgccctaaagcgcttttcatgcctggattctatatcccaccggccatccgaagcttgctgggaatctctcccactttctacctcttaccgttccagatcctgactcttgcgcagcgcgcttcggtcactctacatatattcatctcccagctgacgccgccagaagtgagcaagggatcttcatctgcgccaggcgagcgtatccatccacagacgatgcaacggctcgcgcagctggctcaactctcccgggctacggacggcgaggctacacggcttcttcagctgggtcttgctcccttccgaggagaccgggaagggattgcaaccttgcgaaagggaatgaaggagggtcttgtgctgagcagtgtgagagctagtccagaagttcagcaggctatcgcgcaggtaatggagcgcaagaagccggaaaagaatagcaaggctgattga

SEQ ID NO: 18382 - DNA, 387 bp, A.fumigatus
acgagtgaagaagaaaaacacacacacaaaccaaccaacaatgaaaccaccacacagcgcctcgacatccccatccctttcttccatcccccgtccatccttccttattattcctccctcaccctcctcttcctctctttctctacttccccaaatatcatcaccaccacaaccaccactaccgcctcctcggactatgtcacctctgcttcacccttgctaccgacctcagccctgccagacttttgcctcgccctgaccaagtgtcgccctccgctttcgaacgtcttggaaccaactagctcagcccaacctacgcaatttgtccatctgacactcacatcacgatcacatttacatcctaatcatcctgcgtcacacatttaa

SEQ ID NO: 18383 - DNA, 489 bp, A.fumigatus
accaaggggaaagcctggcccgaagaagaagcccagactgtacgtccttgttccctcgccgtccctctgtcttttaccaccttgctaactctggcattctacagtgacgatggtactggcgattctgtcaaagtaacctcctcccggttgggacccaaagccaacatgggtgccatcaacgccggtcttcgcgccttggatcgatctggaaccccttgtcgcaaatgggaacggaaggccctccagctgaagagcttcactggtgttcagtggcaattgccatcatggcgggctcctcgaccacaaaagatcgagacaaacgacgaggtgaaagaagccactctcgataccggtgatagcgacagcaaggccaaccagagtgccagcggtgcgcccagcgagaaaagcaactccggtgatacggagctgactccggtccctcctaatattaccgaagcatcttcaccagcaattgttatgacggcatag

SEQ ID NO: 18384 - DNA, 549 bp, A.fumigatus
ccacagcctttgtcaagagtaaaagtaaaagaaaagaaaaatcactgttttacctcccaagagaaaggcaaacatctctctattcagatgaaatcaatggcggctgctacatccaccacaaacggccgttccaaccggtctgcggcccccaaggcaatcgtcatcctcaggttgtcgccggaactgctcagtcggtttgctagtccggatgtgaaagaaaaagcgaccaagaaaaatagcaccagcgcgagtccacccgtcaaggagaaagagccctcatctcctgcctcgtcctctgcagaccttcccgtcccaccatcgtccgtcgacaatgcttcagatgccgcatctactcctgctcctgggacatccgccgcagatacccctcgtcgcaacggtttaccggctcccaagtcgggaaccaagcgaagcgctggccaagcgaccgaatctttctctagaccaaggggaaagcctggcccgaagaagaagcccagactgtacgtccttgttccctcgccgtccctctgtcttttaccaccttgctaa

SEQ ID NO: 18385 - DNA, 972 bp, A.fumigatus
aaaagcgaaaaaaaagttctcgacctccgccaagtcgatcttcaacactccgatagattggacttggggcgttcccattgcacaatgactgtcgatgcaatggatgtagactcgagccctgcgcctgcagcagtggccgagcctgagcggaagcgcaaacacaagcacaaggaccattcctcgaagaagaagcggaagcacgactccaacctgatcgccgagacaacagtccacgagacgacaagtaaaaagtcctccaagagcaaagagaagagcaagcaaaagtcgtctgggaacgcaccattaccctccggctcgccgtatgttctgaccaccgccactctttaccttccgctatcgcccatctccatctcacccacccatgcgctggcctctctgctggcagagcacctctcgcctctcctcctcacatactattcgcctttacagggtgtaatcctggcctactccaacgcctcgatatcgagcgaaccgccgagcgcgtcttccccgtcgtctgatccccaagacaacccgcagccgttgacgcttgcaaagtcggcagacgagtacggcgtcctgtacgtctacctgacagctacattcctagtcttccgcccgcagcgcggccagatactcgagggctgggtcaacgtccagtccgagggcttcctgggtgccgtcgtcctgaacctgttctctgtcggaatcgagcgcaagagactcccctcggactggaaatgggtcccacccggcgaagaagaagagggaaacggattcaacagcagcggaaagccaaagaagaaggtcttctcctcgaccgaagatgaagacgactcggaaccctcgtcccacttcgacccggaaaaggagcacttcaagcccatctcgctcgcctccgacgccaaccccttttccgaaaccatggaccctaacaatggccccgcagccgacgacgacgacgacgactag

SEQ ID NO: 18386 - DNA, 1038 bp, A.fumigatus
aggatcgtgttctctcggagaatagggttcactgccgatgtcttcggaaaatggattcagagcacaattctgagtccctggaagacgctccctctcctgttgctggcccagtataccgcgaagggccgccaactcgccgccgagcgctcgcgatcctttcaggtcctccagctcctcaccttgctcgctgtcctccgccatgttaacgcctggctcaatacccggaccctgaacaatggcgtctcggatcggtacgactgggatcgcgaggtggttgtgctgacgggtggcagcaacgggataggcagacgaatcgcgcagctgctcggcgaccgcggcatcaaggtcgccatcctggacattcactcaccacaggaggaccagggccaccttccgcccactgtccgcttccacaaatgcgacatcacctcgccctccgccatcgcggccgccgctgctgacatccgcgcaactctaggcgagcccactgtccttatcaacaatgctggcgtctgcagcggcaagaccatcctcggcggcacggaggcagacacccgcatccagttcgaggtcaacaccctctcgcactactggctggcgcgcgagttcctgccgcacatggtcaaacgcgaccacggcatggtggccaccgttgcctcgctggcgggatataccaccacccccaatatggtcgactactccgccaccaaggctgcggcgatttcgttccacgaggggctggcggcggagctggtgacgaggtttcatgccccgcgggtgcggacggtactgctcacgcagggattcacacagacggcgctcattgggcagttaaccccagaggatacgtggtttaatccgctgctgcagccggagacggtcgcggagcagttggtgagacagatcctcacggggaatagtgggcatgttgttgtgccgggttcgtcagggtggctttctcggaatctgaggagctttccgccttggttccagcattcgatgaggtcctggttggagagattgatgcgtgctgattag

SEQ ID NO: 18387 - DNA, 2271 bp, A.fumigatus
tgcgatattacgacacctgttgttccttcccactctcgacagtcacccagccaccagctccgcctccaaaccgtcgcaaaattctcaggctcaacattccaattcccatatggttgtctgagccgcacggagcatcatcttgatcgctctcttcagcccaccatgttcagggccttgatgggcgggggccgttcgtccgatagccgtagcacaacctccagctccaagagcagtagccgccgccgaaccaactccaaggcttcttcgacagtcagccgcaagtcctcacggggtgacgaccgtgatcgaggcttgggcgatctgtcggcctactcttcttcaggcagccgcagcaagcgatacgctcccagcgcagcgggcgattctgtcgcttcgagctatgcgacggcagaaccgggcatcgcggtcgagcacgatcggataattattgaacggacactcaaacgcagagataccgatgaagaaagcggtcgcgatcgatattccgagattcgcgacagggatgggcgcagttctcgcagacgcgaccgggaccgatcgcagagccgtgagcgtgaacggcccaggtcggagaggattgagcgggcacaattggaagacgacgctgtagagtctcgcgaccgtcgtcgggaacggtcgcgaactcagcctggcgatacgtacttgccgcctgtttccccatcgatgcccattcagccaaattcccccttggtctatgaccctcatgtccagcagcagttccccggtcagttccctgcttatgttgccgagccatatcggcctccgaatcccgccggcgaagcagccgattattatggcgatcagggccagtctgttgcggaccagccaggtgtgcgtccgaaacctccacctattattcccagcagccaggcgcatctcatgactgcgtcgcctgtcgccaatccgccaccggagcccagcagcatgggccaggtgggcgccgccgctgcgtactttgcagatgacgccgagctcgaggtggatccagcaccaggacgaccggaccgtccaactgctggaacaacctctgaacctcccaagccatctaacactacattcggcatttcggggatagctgctggagctgctgcctatggagcaggaggcagccttcccttgccggccagcccgacatcgcccccggaacctgtcccgatgactgctccatacgctcctcctgtgacatccagcaccaccaaaccgccccacacccatggtatcggagcctcggttggagcggcagcagcaggtgctgcagcaggttacatgcttggccaccaccagcaccattcgatgtcgagcgccgaccatctatcccagtacaccatgcagaattacgacgagtcttcccagtatgggctcggaattccaggtccgacagtttacaatgcaccggccaacgcagagtggcacgctgctgggacaggaacagccgtgccgtatgctgcaagccctctgcatccccaccatgctgctgtccaccacggggctcccttcccctcgggaagcttggcattccagcagcgccaacgtggcccgcttgataagtttatcgatttttggcgggatcctgagggtgttggtatgtttgaagagtatactgaagccataggcgtctgcaaatactgcttcgaaccgggcacttcctcgcgtgacgcacctcgtaaacatcactaccgccaacgccgttcgtctggcgagcgctacgccagtgggtcgcgtgtgggaaaggcaagccgttatacatcctcggaggatgaaggtcgccggcggaagaagtcatcacggaattcctggttgctgcctggactcttgggtggaattgcggccaaagcgctttttaataccaaggattttgaagacacctatagcgtccgttcgggccgagttatgaccgtcaaagacactgaaagcgtctcgacagcacggcgaagccagacctcgcgtggcgtctacaggcgtcggagccagtctcgagaccgtgagtcccgcatcatttactcagactcgaaaagccagtatgaggataagcgacaccgttctcggtccagatcgcattcgtcctcgcgaaatcgtcgccattcagcgctcagggatgcagctgtaggcgcggctgtgggttcaggagctatagctttggccaagtctcgcgatcgaagccgcagtcgcagccgcagccgcagtcgtttcccaaagaaagtccaaggggagaaagtcgtcgacctctga

SEQ ID NO: 18388 - DNA, 1062 bp, A.fumigatus
ctttggccaagtctcgcgatcgaagccgcagtcgcagccgcagccgcagtcgtttcccaaagaaagtccaaggggagaaagtcgtcgacctctgactcttcctcttttcttgatatctcccaacctgctcgaaagtctgttggcggtggcattgcttctttcttcacggcttcttctgaaaaccgaggaaagcgccgagtcaagaaacgcaggagtatattttcgttcaacaactcatcttttttttcgcttgatgcggacttggcatttgtacccggattcgcgcgaaaacatgctcgcaagtcgaccaagaagagcagtaagaagaaggaccgtgacgtagatgcagctttgctgggattaggcgctgcggccaccgcattagctgctacatctcaccgacgaagtcggcgggctggagagatcctcgtggcgaaggagacacggtcgcgacactcagattacgcatcatcggtcaccaacgatgagggctgggaggatctggactcaggggaccagtcttcctccagtgtcagttcggcgctcgcgttcggtgataccggcttgttcggtagcgatgaatcccagtcgtctgactctggcacttcgaaatggggttggagatggggaagcaaaaagaataagaaaaagaaaagggctagctcccctcaaggcagattccccacgggtgctgctctcgctgcaggtgccctaggaacggctgcgttggcgtcgactcaggacagagactccagactacccaggcagcatgcgtcaagcagctccggaagcttgcagcatgtggcccccgtgccaactaacgatcctaccctcgtggatgcggtcagggtggcatctctgccacatgctgaacccgcattcgttcgacctggtcccattccattgcagcaaccgcaacccatgacgccagtctcccaggcggtttatgccacccagggcgcgtcgattccgacctacgctgctccaatggcgccgccggcctttccccccgacatcgtacgttttcaacacgccgcacgaaggaaagatgtaccccacccc

SEQ ID NO: 18389 - DNA, 1149 bp, A.fumigatus
ctaatatttctccatttcggcaggactcgtttgcaagaattagacctgagtcacaaccggctggtatctgttcggcacctcgactccctcccatccttgtcaaagcttgacctgagcttcaaccagctgaagcacatcgacgtatcatcgcccttgcggatgctacgatcactaaagcttgcaaataaccagcttcagactctcgatgtcagcatgttttcgtctctgaaccttctctacattgatcagaattttctgtctacggtatccggtctagaacggtgccgcgccttggagattctgtcagttcgtgatcaaaggtcgggcaatgagaaaaatacatacctggacatcgacctaggaaaagtcaaagacatccgcaaggtatatctttcttcgaacaaactatcgacgcgggctctctcaccctccgctccacttttgggcttacaacttctcgacgctgcctcatgcaacctccagagtctacctgtagatttctcctcaaactttcccaacctaaaggttttgaacctcaacttcaattcgttaagcggcgtcactgagttggtgggcttgaattgcctttcccggctagctattgctggcaattctatcgtacgaatgagaaggctctgtcaggttctgagtcgaatgggaagaaccagacagggacaaagttgctctcttcaccaggtcgacctgaggggaaatccccttacattgcggttctatccaccggctctgactgggaacgggaaagaagttgaccaaaggaggataagagcaattccggaagaacgcaagaagagagcagcaggtggcttagatcttgcctctgcactagctgatgcagggtcgcatgaaagagatatgcgtccaacgctttgggcgacaactgccgaaacagagcgagaaatcgacgacccatacactctgccaaccgcagatgcgcaggcagaccagaaatacctctcccatctggacgatgcaacacgccttcgccgcaaaatatttgagctcatgctgtacgctggaaccggcggttcgatcaagttcctggatgggttggaatttcggcctgtactaaccgaaggttccgatatggaccatgcatggtcgaaactggaagcaactccgggttgctga

SEQ ID NO: 18390 - DNA, 3828 bp, A.fumigatus
ttactcaagcgcggatccgtccagccccgtggtgaagacgactgggaaagcgtttttaagcctccaacgccaggctcagatacaaaacagaaagatgcctttgcaaagatgaaaccagccgatgatatgtgggattttacaaagagcagctccgcgcgcagacacaccagaaagcccagcaaactttcgatcgagacgtccggagcgaatagcgaagattctctggaccaggattccgagcggtcagatggagcagcgacagtgcagcgtgataaccaaggaccaaccggaagctctacaccgtcttcaactggaactctggacatcaagaaagggccagacaacaacgcacacgatcacaataaaagcagtcatggtgcatcccggaatgaaagccagatacgtactgcaagcggcttggaggatcttcgcaatgaaggtattacgccgatcgtgttctcgcgggtcaacactgtggaaggacaggccacgtccgaggtcataaagtcagccttgaaacaagtgacgaacaagcttgaaagactttcggtgggtgcacgggagcgaccggattctagagccagcgatagcgccttgctccatcaacaaagtgagcttttagactctcttccggaagaagacctacttgataccacaagtcattctttacctcaggacctttccactggcactctggactaccaaggacgcggcgcttttgcgaacgtgcgcggagagcaatatctaaacgacgccctccttccgcagcgacggttttctccatcctcctttctctctcaacgtctttctccatatctgccctcaaactcaagaatccgcagctcgcctcccttttataacaagatttctcgtgctaccgagcctccaactttaccaagaccttcttctgcctacgctagaccacccagtggtgagggaaatcccattgccatgccctcttctgggagccctctcaaacttttcggaaaccatgataccttcaccaacaacaggcttctgcgccgaatgagccagtttgaggaaacatttggcgatctgtccgaggaagacgagccggtttcgccttccgaagaggccaggcgcaaaggacagagtcgaaatttcttgcatgtgaggcaggaaacgcctggcgatcgctccatgagaagacaagaacgcccacgttcccgtaacatgatgaagcctagaattagccgatttggtgatggtgaactcgaccattttgatttctcggacacaagcccgtatgagcccaagtttttgaataatgacgtcgaagagtccaatttccgcccctcttctcgccgaaagccttctggtagacggcaacaccctcgacgtagtgcttttggaaaccctagccgcgacactgagatacataggcctagctccagccgagaatcaagaaggccgcagcccagcgttggtcagatggacaatccaaacgaccaggaaaaccaatggataagggacaccccagccaaggatccgaacccgaaaaggcgcagaaccattctcagtcttgacatgacgggaggagaatcttgcggggcaggggaggccaccggccaacctactgataatctgtccctactgcagagaagcttgatccaacatggcttagatcatggtaacgaggagtcccttcttccacaagaatcaacaccgagacccaggactccaaccccaagtcaaacaaggtcctcgtggaggaagagatcttcgtcgaacagagagggcgatccaaacgcccgcatcggcgcagggtctccccaggaggcgagaataccgatggtgaaggtgacaggcgtcaatgaacagatccgaaagggttcaatcacgacacaggactttctgaacgaagcgacaaaaattatggacataatccgagcaaagggcaagcccgctggcggcctctcgagtgtcgaggagtctgattccgagggtgatggtgccgagacttatgaagatgagtcaactcgggaagaattctcgcgccccccaagtcgtgaaggtgtagatatacgcaaattacgagagcctaaagagcctaatcctcgaatcttgagccatctcaagagattccaggaacatgatgacccggaatttggtgtcaactcttccgtcatgtctctccacctggagaaaggtgaaagcaaaggaggagagaatgttgagcacccaaaacggaaacaccctggcaatccgaatgaggaacgaagtactgaagtgggccctgccctgacgatggacactcatgtttcctccaaaagcctgagctcacgctcaatacccactgcctcttctttcagctctcatgcgaagggagtgttatcttccgatattgtatcgcgtttgatccctgaacaggtgaacgggtttacttatgatcgttccaagcaccaatgggtcaaagaaaagcacgaacagtcccaagagaagccgaagggtgacgatagtgaggaggaccctttcaaggatatccctgacctcagcgtcgacgaactacaggaaatgatgagggtacacagtctatcctcactcgacaaaacaaaaagttttcctcctagtcaaagaggtggaaatctcacaagttccgtcggtaccaaaatatccgacgcgaagtctagctctgactcacagccagctattgttcaaccgccggctagcggtagtactcttcgttccaagtcgactcgattcacttctagcgcgccgaatatagatacgggagcgaatccatggggtacggacgagctgaaagacgctgaaacttcaagtgaagttgagcacgagatccagctccatgaagggcgattatcaaagcccccacgacatgatcgagacattcatcatcaggcccgggtcgtaacgatcagcttctcttctcctctggtttcccatattgtctacaatgatggaagccaaacaggatccgtacgtgacgcggcgaatacgatcgaacaaggtgctcaaactatagcacaagggccacacggccgcccacggccttctcaacttatcgcagaccgtggctctctcgagacacagactctcctacaacatttgctctccaaaacagaaaataagagtgaaattgtggacaatgatcccagcatactccgacgagagtctgggaacatagagtcaactcctgacaaggatcatccagagaactccatgatgtacctcacacaaactggctcggatacaacatatagttttcatctcagtcctcttcctgactttaccgttgacgggattgaccagccattacaccttgaactgagttatgtcgctcagcgcacgcgctctacatccttgcgccaaatccatgggacgtttgctctggcgactgaggatctggtcaagcacttgaccgaagcggaaccttttgaaccgtactgggatcatgtacggcgcttggtccttcgagacaaagggctgataacgctgcacaaattgagtgagttctgtcctcgtctagaagaccttgacgtctcggacaatgagataggccagctgggtggtgtgcctgcgagcttgaggactctcagaataccgcgtaattgtctttcgaacttgactgcgtggggccatttggttaacctacagtatctggatgtatccaacaatgagctggacagcctggatggcttcggtagtcttattcatctgagagagctcaaagcagacggaaacaatatccggaatattgatggtatacttgatctgaacggccttttgaccttgaagctgagtaacaattcactcgcgacgattgattttgccactggggaaatgtga

SEQ ID NO: 18391 - DNA, 321 bp, A.fumigatus
accatcataggcatcttcctcacttcttgtcatctacggagtactccgtattcctcccctcaatcgagcttggaagcagcatccaaccagtactcccttcttgtccgttttctttggagctgcatttactcggtcatccgctgcctggttccaaccaataattataacaccaagcctacatgtaaccttctagctccaatccccagcttcccctacttgaaggcatacacaaattccacacctttttgcaaccgcttgtggctccgcctccccctttctgcccccacccccagacaatccatggattgctgccatcattga

SEQ ID NO: 18392 - DNA, 1671 bp, A.fumigatus
  unsure (1562): Identity of nucleotide sequences at the above locations are unknown.
tttacagccggcatagagcttgagttcaagcctcttaggaacgatccaactaacgtcactcctagacccggggcatctcaaacggttacacataagaccggtatccctatagccgccctagacatctctccgcaacggacgcacgccgtcattggtggaaaggaaatcttgaagaccattcgcgtctctcccgatcgtctgtcagaggaattcaatcttcgcaatgctatcatcagttactcctccacgcatcatggtgggagtgggctttccgcgcgccacaaggaccagctgaccgtcagggacgtgaaatggtcacatggcaattatgaccgaaccatcgccaccgctgtggctaatggtcgcattgtcgtctatgatctcaatcggactggcttggagttttgccgctttcaaggacacagccgtcaggttcatcgcctagcgttcaatccctacgctccggcattgcttttgtcggggagtcaggattctacgatccggatgtgggacttgcggacagcgtccgccgagcgtggagtgtctatgtgcgggagtaaggaacagtacgttggcaacagtgacgccgtccgtgacatcagatggtcaccgagcgaccgtttcgtgtttgcgaccgctacggatagcggtgcgattcaactgtgggactcgcggaaaaactgtgctcccttaatgaggattactgctcatgatagaccatgtttttcagtagattggcacccggatggacaacatgttgtcagtggcggcacagacaggcaggtcaaagtctgggacttctcctcgactgctgagcggagacaaaagcctactttccaattcaggacaccccaggccgtcctcaatgtacgatggcgcccgccttccacagataaggaatccggcgattggcagtcctgccaggtggtcacgtcgtacgacaaagaagatccgcgagttcacctctgggaccttcgacgaccccatattcccttccgggaattcgatcggtatgacgctcacgcttcagacctgctctggcattctaaggatcttttgtggacagtaggcgaaaccggtgctttcacacagaccgacattcgttatgctccgcatgtgatccatcagcggcccacgtgcgccgccgcttggagccctactggagaggtgctcgctttcgttcagaaacgagctcggcgaagtatatcgggtctcagtgcaaccgacttcacagatcgtctagagatggagcacagtagcggagaacttctcggccagagtccgacggaagaggtccttgatgaaccttcgtttatctccgttcgcgctcgacccagtaagcccagtagcactcgtcctcctaaatccttgagcagtaccccgccggggcctcccgaaaatcctcccgtccttccgttgggagagacgctatccaagattcccccacctggaccacgccagctcggtgtagtgggtagcgtttccggagccacttcggatcctgtggtcttccgattcctcgctcgccactattctcccttactcgaagctcccgaggatanctgcaaacatgcggacttacttcgcgccttgttggactcgttgactcaaaattcagagcgcgcagaaaatgtgtccctgacccaggctagcacatacttgggaagatag

SEQ ID NO: 18393 - DNA, 321 bp, A.fumigatus
ggctggcagtcaacgatcttcacaaacaaagccgcatgttttgattgcagctcggacccattcatctctcgaagtaagcagtcaaaatttagtacgtatggtatattgaagatctatcttgacctgttccacaacgatttcctttcgcctgctgaccagtcatctttctgtttcatcctagagtctagagtgtcctctgtctcccgacaggttggactacgagcactacttgcgtcattgaagttaatccctgacatccaatctcctcccttctaccccatcatcactcctccccatcggaagggtcattctgctccataa

SEQ ID NO: 18394 - DNA, 183 bp, A.fumigatus
ggcggctatagggataccggtcttatgtgtaaccgtttgagatgccccgggtctaggagtgacgttagttggatcgttcctaagaggcttgaactcaagctctatgccggctgtaaactaatcggcggtggagtggtgaaagtgaagccaagcaagggaagtaggtgtgacaatgaacgataa

SEQ ID NO: 18395 - DNA, 732 bp, A.fumigatus
ttacgtaagtgcggtcctgccagtcccgtggtgaagacagaggctccactgcctcctcagagtgcgcgcatgtcaggatacgagagaggacattcacccccgccgttgacgaaacagcatgatgcggcaggcgctcaaacaatctcccatagacatggggactcgattgacagcaggagtagctacggaacgtccgccgggagtacccgatatggtgaaaacagctccaagcgatcgactgccatgtccagtcgacgaccctcattcgcaagcattgctcaagagtcacatcaatttaccgaagaggcatcatctggcggcgccattcatctagaacctttgatggagcatccaccatcagccgagcaatcagctggtacggagagccagaagcatggcggaaagggcggcagcttcagcgggttcgatttcggcgtagcaaccactgagaaaccatttcctgatccattgcgggtctcgtcccatacgaattcagaccggcttagcagcacacgaggctccgctgagctcttcttccgaagcccatcgcaaagctcgtttggctcacccgctgattggctggatcctgatgaaacccgatcgtcgtctgcgtcctccgccaacgtgtcatacaaaagctttcgacccttggtgtcagacatggaaccacccagtgcctcgcaatctgagccaaaggatgtaccgagggaaaggcacagattcgagcagtga

SEQ ID NO: 18396 - DNA, 1464 bp, A.fumigatus
caaccactgagaaaccatttcctgatccattgcgggtctcgtcccatacgaattcagaccggcttagcagcacacgaggctccgctgagctcttcttccgaagcccatcgcaaagctcgtttggctcacccgctgattggctggatcctgatgaaacccgatcgtcgtctgcgtcctccgccaacgtgtcatacaaaagctttcgacccttggtgtcagacatggaaccacccagtgcctcgcaatctgagccaaaggatgtaccgagggaaaggcacagattcgagcagtgaaagcaatacatcagtttccaagtttgctcgtgctctaggccttgatttcccccatcatgcgacggagaattcgacttcttcttcttccgaatcgtcgccctctgaagcacggagcggaacctcaatctctagtcttccctcggaggcgagtctgtcaagaagaaagccatcggagacgagccgactaggagtcgtcaaagagcagccggccaatggcaatcagcagccagtgctgccagaaaccgagcagacggaaagtcccgctgatcttgaacccccgcgaatccctgcttcatttctcagtcccgactccccgacggacccggctatcaataaaggtagtctgtccttggtagtagacaaggcaaccaccactcctccacagccgagcgagccgagcgagcctcgcgtccctctcgtacgtcaagaatctcacgatcctcaaaccgagcccccggaacggcccacaatcactcgatcggcgacagagtctcctgttcgtccgccacctcgtcccaaaggacgttgtcggggatgcggtgaggcgattttggggaagtctgtctcgtccaaggatggccgcctgactgggcgataccaccgcgaatgcttcgtctgctgccattgccgatcgccattcgagacggccgatttctatgtgctgaatgaccgcccatactgtgcacagcactatcacgaactgaacggatccctttgcagtgcatgcaacaagggtatcgaaggccactatctcgaaacgaacgagagaagcggcccggggccggcggatcacaagaagttccaccccgactgtttgacctgtcgaacctgtgggattcccgtaaagggcgagtactacgaatggaatggtcaggtatattgcgaacgcgacgctcgccgggccgctgcatccatgtcgcccaatcgaatgcgccggccgaccttgccatcgtcgcctttggccgctcgtcccccgaactaccccccgatgcctcctgggtatccccgtcgccccggccctggccctgggcctggcgggcctggctttggcccgggtcctggtcctggctctcgtcgtccttccggaatgttggatataccacgcgggcctcccccagctggcgcccgacgattcccggagaggcggacgacccggttaatgatgacatga

SEQ ID NO: 18397 - DNA, 663 bp, A.fumigatus
ggtatgtaccacctctctagtctactctactctgctcttattctattctaccctttgggggcaagggaaaacgctatagctatagatgatattaacggaaataagctgggtaatctccccgaacggatcatcccgcttcttgcggaggcgctggagtccgtcccgtcggctacgccgtggtcgaaacggctcgtcctcgggtgctggtctgccgcgttcttcccgctttgtgagagctacctgcctgggtttgagaccgcgttgatcggcttcgatctgtggtatgcggcgcgcgtgctgcgggggagcccggccgcggtgaatgttaatcagaaggtgttgatggggatgggaagggggtttctggaggaagcgcgggccgcgggtcggcgggtgtttgtgtggacggtgaacgagccgagtttgatgcgatggtctattgagcagggggtggatgggattatcacggatgatccgggacggtgtcggagtatggtcctggacgcggtgaaaggggcgagtccggggactcgacacgacgagcgagtcactgtctcgcagagggctcaggcgtgggctgtgtcccttctggtggtcatgtttgggtggctctttcgacgaaagtttctgtatccgctggagaagcgagataagagcgagtag

SEQ ID NO: 18398 - DNA, 864 bp, A.fumigatus
ccgggtcgtccgcctctccgggaatcgtcgggcgccagctgggggaggcccgcgtggtatatccaacattccggaaggacgacgagagccaggaccaggacccgggccaaagccaggcccgccaggcccagggccagggccggggcgacggggatacccaggaggcatcggggggtagttcgggggacgagcggccaaaggcgacgatggcaaggtcggccggcgcattcgattgggcgacatggatgcagcggcccggcgagcgtcgcgttcgcaatatacctgaccattccattcgtagtactcgccctttacgggaatcccacaggttcgacaggtcaaacagtcggggtggaacttcttgtgatccgccggccccgggccgcttctctcgttcgtttcgagatagtggccttcgatacccttgttgcatgcactgcaaagggatccgttcagttcgtgatagtgctgtgcacagtatgggcggtcattcagcacatagaaatcggccgtctcgaatggcgatcggcaatggcagcagacgaagcattcgcggtggtatcgcccagtcaggcggccatccttggacgagacagacttccccaaaatcgcctcaccgcatccccgacaacgtcctttgggacgaggtggcggacgaacaggagactctgtcgccgatcgagtgattgtgggccgttccgggggctcggtttgaggatcgtgagattcttgacgtacgagagggacgcgaggctcgctcggctcgctcggctgtggaggagtggtggttgccttgtctactaccaaggacagactacctttattgatagccgggtccgtcggggagtcgggactgagaaatga

SEQ ID NO: 18399 - DNA, 486 bp, A.fumigatus
tactctccacacccaaacctcacacagccaaacatgaacccatcaaaatccaaaccccagactatcgcccaccgcggcagaatcaaacaccccaccgcaaccaacccccgctcctgccagtaccccgaaaacaccctcgagagcttccgtgccgccgccgccgccggctgcgacgccatcgagacggacctccgtgtctcccgcgacggggtcatcgtgctctgccacgaccgctcgctcgagcgggtttacggcgtgaagcggctcgtggacgaatgtacctgggccgagttgcagtctctcaaaaccacccaggcgccgcacgtgcggatgccgcggctagtagatttcctggcggtactttgtgagcctgggtgggaggagatgtgggcggtgttggatattaaggtatgtaccacctctctagtctactctactctgctcttattctattctaccctttgggggcaagggaaaacgctatag

SEQ ID NO: 18400 - DNA, 300 bp, A.fumigatus
agtcagctccagtgtagaccggaaaccgagcaggtgatgcaggagatcattctggcagagttcagacactacacaattattgcggtgaggcatcggttggagatgattgtggactttgatcgggtggtggtgatggatcgcggggaggtggtggaggtcggaaatcccgcggccctgaaagagaaggctgggagtccgtttgggcagttgggggctgctgctgctgcgtaccaactttgcgcaacttctgttcagtactcgttctacccctacttaatctcgatggaaatatatttatga

SEQ ID NO: 18401 - DNA, 789 bp, A.fumigatus
gagaccatcgctgaccatcgccctgcaggtgccggacagggtggtttgacagctgctgcgagactgaagatgctaggtgtggattctctcatcatcgacaaaaatgagtcagtcggagacaattggcgtcttcgctatcgtcagctcgtcttgcatgatcctgtgtggtacgaccatatgccctatgtgaaatttccagcccattggcccattttcacgcccaaggacaagctggccgaattcttcgagtgctatgttaagatgctagaacttaatgtttggaatagaacgactatctctcactgcgaatgggacgagcaaactaccacctggaccgtgtcgctctctcaaaagcaaagcgatgggacctgccaagtcagaacattccacccgcgccatattatccaagccacaggacattccggcaagatgaagatgccctatatcccgggtatggaaaacttccagggtaaacgtctctgtcattcctcgcaatttcctggcgcagagaaaaatggttctggcaagaaagccattgttgtgggctcctgtaactcagcccacgacattgcacaggattaccaagagaaaggctatgatatcacgatggtccagagatcaacaacctgtgtcgtttcctcggctgctatcactaagattggtctaaagggcctttacgaggaggatggtccgccggtggaagatgcagaccttctactgcacggtacccctaacaccagtcttgaaagtgcttcaagctcacatcacttcaaaagaagtcgagcatga

SEQ ID NO: 18402 - DNA, 813 bp, A.fumigatus
agctcctgctcggtccttgcgcctcgtgatgaagacgagaccgccctcggggcgatcgcgagactaaaaacctttaacgaggctgtcatgccggaggaccgcgacggtcctggagaggaggacatcgttccagacacgaactggccggatcgcggactggttaagttatgcaatgtatccgcccggtacatttccacaaccgtgtctaataccgactctgagtctgactctaactccgtcgttcatggcgccgctaagccacccctagccctcaagaacatcactctaaccatccacccaggcgaaaaggtcgccatctgcggccgcaccggcagcggcaaatccagcttcctcgccctcctgctgaaactccttgatccactgccatcaaccagcaacaatcataatcatgaacctccggtcttgattgacaacattccgctgcaccgcatccaccgcgcgaccctccgccagcgcctcatcgccgtcccccaggaccctgtctttcttcctgatggcacgtccttccgcgcaaacctcgacccaaccaacactgcgaccccggaggagtgccagcgggtcctcgaagcagtccagctgtgggggttcatccaggaacaggcggaggggctgcatgcacccatcagagcaggaaccttgagtgcggggcagaggcagctcttctcattagggcgggcgatgctgcgcgtgccattatccgcctgcgttcgacgtcttcctcctataaggaagggtccaagagtcatgatcaaggagggatcctcctcctcgatgaagtcagctccagtgtag

SEQ ID NO: 18403 - DNA, 609 bp, A.fumigatus
agggcctttacgaggaggatggtccgccggtggaagatgcagaccttctactgcacggtacccctaacaccagtcttgaaagtgcttcaagctcacatcacttcaaaagaagtcgagcatgatcgggagcttctggatggacttgaaagggctggattcaaggtcgatcatggccctgatggctctgggctactgatgaagtatttccagcgtggcggtggctactacattgatgttggtgcctcacaaatgatcatagacggcaaaatcaaggtgaaacaaggccaggagatcgccgaggtgctgcctcatggcttgaggtttgccgatggatctgagctggaagccgatgaaatcatcttcgccactggatacgacaacatgcgcacgcaaactggcatgcttttgggcaataaggtcgccgacaaggtttctgatgtctggggctataatgaagagggagaaatcagaaccatgtggcaggatagtggccaccaaggattttacttccatgggggcaatctagcaacggcaagatactactccaaggtgttggccctccagatcaaagccctcgaggaaggtatccatcggtatggggaaatctga

SEQ ID NO: 18404 - DNA, 249 bp, A.fumigatus
cgccataataagacagtactggtcaagacaaactgtctatcgtcggaaacctccactaccaccacggggtcctcctctgccaccacctctgctcccaccacggaagccgcctccaccaaaaccacctcccctaggtcctccacgtcctcggggggcgccgcctcggccaccacgaggtgcaccacgtccacctctggcgcctccgcgaccacctcggccaccggcggccttcttcggtttcgggcctag

SEQ ID NO: 18405 - DNA, 405 bp, A.fumigatus
tggcatagtattgttgcaagcagacgaacttggacgcgcgctgtatatttttacaacatcgtagcaattgaagcagcaaactttgatatgcataataaaatatctcgaaaaaaaaagttcctgcaagagctcccgttttcccataacgccataataagacagtactggtcaagacaaactgtctatcgtcggaaacctccactaccaccacggggtcctcctctgccaccacctctgctcccaccacggaagccgcctccaccaaaaccacctcccctaggtcctccacgtcctcggggggcgccgcctcggccaccacgaggtgcaccacgtccacctctggcgcctccgcgaccacctcggccaccggcggccttcttcggtttcgggcctagacaaagttag

SEQ ID NO: 18406 - DNA, 741 bp, A.fumigatus
  unsure (201): Identity of nucleotide sequences at the above locations are unknown.
tgtcacgtgcttcaccgccttccttcccctcaccgttctgaattattacgactctttcgcattggccgaagaagagtcatcgttctgagcctgccccctacttattgtgcgcgtctcccgaaccgctggtctgaacttgcggatacagccatggcttctgaagaatcgaaagaattgccagtgcggcctgcagaaggccangacgccaatgccaccgccccgccaaaggctgcaaaagcaactgcagcctcgaataatgactctctccccgatttcataattgaacggaacaagctctttgaagagttgtggcaacagtatcttgaagagctcaagaataagcctcacccggaaatcaatgtccttcttgatctcggcgacgggaacccctctcctgtccccgctaaagcctgggagaccaccccaggatcgtttttgagagacgtccccaaggatatcagcgccaatgtcgtactcgcgaaaatcgatggcaaggaactctgggatttgaaccgtcctctagagcgcgactgcactgtctcttatgttccgttcgacagccccgaaggtcgggaggttttctggcattcgagtgcgcactgcctcggtgaggcatgcgaatgcgaatatggatgccttctctcccacgggcctcccactcctcaaggtttcttctacgatatggccatgccggacaagtcagtttgccactcctactttttccctacgtgtgccttgtga

SEQ ID NO: 18407 - DNA, 300 bp, A.fumigatus
tggaataagagtctgactctagagaatagtcgtgttgtacgagagagtgactggccggccctggatagcagggcgtcgcggatcttcaaggaaaagcaaagcttcgatcgattggaggtcacgaaggaaaacctcaagaaaatgtttgcctacagcaaatacaaattgcactacattgataagcttgtcacaggagaaaagagtacggtttatagatgcggtaccctggtcgacctttgcagaggcccccatatccagaacactggaaagatcaagaccttcaagatcatgcaggtatga

SEQ ID NO: 18408 - DNA, 711 bp, A.fumigatus
aactcttccgcatatttccttggtgaccagaataacgactctctacaacgtattcgtggtgttgctttccccgataagaagcagatgcaggaacatctgaagttcttggaggaggcggaaaagcgcaatcacttgagaattggcaaggaccaggagctcttcttcttcgatgaagtttctccaggctgtccgttcctccttcccaacggaactaagattttcaacgcgctccaagctcttctacgggctgagtaccgcaagcgcggctaccaagaagttcagactcccaacatgtacgacgtcggcatctggaaaagatctggtcactgggcgcattacaaggatgatatgttcaaactcgacgtggagaagagagaatgggctctcaagcccatgaactgcccgggccatttcgtgctcttcggccaccgcgagaggagctacagagagctcccgctgagaattgcggactttggtgttctgcaccgtaatgaagcgtccggcgcattgagcggattgacccgtgtgcggaagttccagcaagacgatacccacatcttctgcacccaggatcaggtgagaggggatcttacactatcttttacatcttattgtcaactaaccccccccaaaatcgcctccgagattcaaggtctctttgatttcctccagtccatcctacggattgttcggggtttactttccagctga

SEQ ID NO: 18409 - DNA, 261 bp, A.fumigatus
gcaaaatttgatccgacgctgactagatctcaaacagtcatgtccgtattctcatcaatgcgttactgtctaggagacccacatgatcatggtgctctttgggccgctcttggtttcatgccctttgggttattctttgattttatggatggcaagatcgcgagatggaggaagaagtcgtccctcatgggacaggagctggactctctggcggacttggtatggcaacttcgcactcctgagggcagcagacgcagctga

SEQ ID NO: 18410 - DNA, 219 bp, A.fumigatus
tccccgtcagttgtcgcaaacttccagccaaacctacagataaaagacaaggttgacgacttgtacgcagggaacaccacaaacctgacccagaaggtccagatgggcgcgaggttgcatggacgtcaggtatgggatgccgaagccggttctctggttgtcaagcagtacagtgaggcaacagcagcttactttttcccaatcttagctacagtgtaa

SEQ ID NO: 18411 - DNA, 183 bp, A.fumigatus
cgacactttaccgtttcgaggctcccaccatttgaaaacttctccggactccgaactccagacatctccatcaattccaacaccacaatcaagatgtcgtttcgtggaggtggccgtggcggtttcgcctcaggcgccaaccgtggtggaaactttggtggacgtggtggtgagttcgagtag

SEQ ID NO: 18412 - DNA, 219 bp, A.fumigatus
acttacccttcacctcttgtcgcaaaccgagtgactgaccctcttcatcagacccctattggcaaggtcgacgaagttctcgggcccatcaaccaggtctacttcaccatcaagcctcaagagggcattgtcgcgacatccttcaagcctggcgacaaggtctacatcggaggagataagcttcttccgcttgagaagtacgttctgcaacacctttga

SEQ ID NO: 18413 - DNA, 369 bp, A.fumigatus
atctccttcggtctcgcaccggccgcatgcgcattcgctctaggagcccgcaccctcgtcgaccatcttctgttagcgttcttcgtcctttgcggtctgacgcggttggcccgattcaacgttaccgtcgctgtccttcccaaggataagaccggcaagtccaagtactttgaaggcacaccgattccaacgacattgggcatcgcttcgctcatggcctactgggtatctcagggctggattctcaaggatcttcctcttggactagccgcccagggcacgccatttgaatttcaccccgttgtcctgctgtttgtcctgcacggctgcatgatggtcagcaagtcgataaagattcccaagccatag

SEQ ID NO: 18414 - DNA, 1080 bp, A.fumigatus
gcttctcaatatccgcacgctcttctgtgcctgcttcccaagatgtggcttgatcgcatatcaggtcactccaccccctcctgtgtccctctcgatagtcgcagcaattcacctgcaccccgaagatcttcttccctcctctcgcctgctccaccgaacaaccgtccaagtccgaaccggcaaggctcctcgttatccgttctgctgacaccaagtgactcaaccacctctctgccggcaaccgcacgcggagtcaatggttcggttctcaaacaaggcgctgcaaggtcccgtccttctgatgtagctgatccgctcgaggtgctgaaggacattattggaaagcagaaggctgacgtagagacaaatgagtgtctgaaggcgtcagccccggaagcaaagccattacacttggttgagaccatagacttcggagaccttagccttgaggagttcgtatctcaggtaggcgagccacggagagctacctctgccgatgttagtgcacaaacgctccagcaatttgagaaggaaagagataagtaccaggaactacatgctgccatcacaagctgtgatgatgtctcaaaatctgttgaggtgtatctgaatgacttccaaagtgaacttggtgctgtttcggctgagatagagactctccagactcggtctgtacagttgaatgcgatgctggaaaaccggcgcaaagtagagcaacttcttggacctgctgttgaggaaatcagtatctcgccgagagctgttcgaatgattgccgagggacccattgacgagaattgggtcaaggccctgaatgagatcgaagcacgtatgacgagtatagaagccaaggtttctggtagcagtagcacaaaggcaattgaagatgtgcgaccgcttctgaatgatatcaagaacaaagtcagtatcatttctattggcccaaactttgagtccgtgctgacgagagtggcaggcagtggaaaggatccgggactacctagtgtcccagatcagagcattgcgttctccgaacatcaatgctcaaatcatccagcagcagcgcttggtcaagtttaa

SEQ ID NO: 18415 - DNA, 1002 bp, A.fumigatus
  unsure (987): Identity of nucleotide sequences at the above locations are unknown.
tttgaattcttgtcgtatttctacgcatatggcctaacgcgatcgttgaattgtcaggtaatccatgcggggatctactacgggaccgactccctcaaagccaaactctgcatccgcggcaaacagatgatgtacgacctctgcgcaaaacgaggcatcccccaccgcaacacgaagaaatggatcgtcgcgcagaacgaagagcaatgggctgccgcgctgggcacacacaagctcgcgcagaccctcggcgtacccacccggctcgtcggccacgaggaggcccagcggcgggaaccggaggtgcaagctctcgccgggatcgtggagagcgacacgacgggcatcgttgacagccacgcgctcatgacatacctgcagggcgacttcgaggaccgcggcggggactgcgcgttcctgacgaacgtgacggggatcgaggcgctggatggtggccgggccgggtacagaatcacggctgtgtcggcggacggggccgagacctccatcacggcggagacgctcatcaacagcgcaggaaacggggcttgcgcgatcaacaacatggtcctgccgcgggagcggcaccgcaccccgttctacgccaagggcacgtacttctcgtactcggcttcgtttcccaggacttccgtactggtttatccggatacgctgccgggccatggggggctggggacgcatttgacgctggacctggggggtcggatccgcttcggaccggacgtcgagtgggtggatgatccgacggatctgaagcccagtcccgcgagggtgcagcaggccttgccggagatcaaggcgtacctgccgcgtgttgccccggaagccatcagcctggattactgcggcatccggccgaagctgggccgcggcggcgccgtcaacacgggcaaggggttccaggattttgttattcaggaggaggcgggatttccgtcttctaccacaggcggtcggaaggatccngagcataggtgtgga

SEQ ID NO: 18416 - DNA, 405 bp, A.fumigatus
cgagagtggcaggcagtggaaaggatccgggactacctagtgtcccagatcagagcattgcgttctccgaacatcaatgctcaaatcatccagcagcagcgcttggtcaagtttaaggacctgtacagttacatctcgcgagctcatcctcagcttacgggagagattacgcaggcatacattaacactatgcgctggtactatctctctcatttcagtcgctatctgcaggcccttgaaaagatcaaagtctatccgagtgatcggaacgatatacttggaggagacccttccgcgccgaagacaggttcgtcattcttgtccagttgctcttctctgcagtcaaggcttatgtttcatagggcatattatctcctcgggtcgctctgggtccgctgcgcatga

SEQ ID NO: 18417 - DNA, 1179 bp, A.fumigatus
tgtcccagatcagagcattgcgttctccgaacatcaatgctcaaatcatccagcagcagcgcttggtcaagtttaaggacctgtacagttacatctcgcgagctcatcctcagcttacgggagagattacgcaggcatacattaacactatgcgctggtactatctctctcatttcagtcgctatctgcaggcccttgaaaagatcaaagtctatccgagtgatcggaacgatatacttggaggagacccttccgcgccgaagacaggttcgtcattcttgtccagttgctcttctctgcagtcaaggcttatgtttcatagggcatattatctcctcgggtcgctctgggtccgctgcgcatgacccgttttcgctggggagacgtattgacatacttcggactagtaaccacatggcgttgtcagcatatctcgctgaagaggacaatgcgttccatggaatcgaagtccctttcagaaactttaacctggctttggtggacaatatatcggctgaatattctttcatgacagagatgttttccactttgtcctttcaccagatttctcggaaggccgtcgagatattcgaacctgttttcgctctggggcaaggtctcacaaagcaattgatcgagaactcgacagactcattgggggtgttgatctgtgtacgactgaaccagcaagcggcattcgaactgcagcggcggaaagtgcctgttgccgattcctacatcaacggaatcaacatgcagctttggccccgattccaagttatcatggaccttcaccgggagtccctgaaacgagtggcgtccaacaccggtcggagtgctgtttctgccctgtcattagctggaggcgatgacttgacccaatcttcagcacctcactttctcacacagcggtttggtcaactcctgcacgggatattagtgctgagcagcgatgctggggatgacgaacctgttgcgaacagtctgaagcgattggtcgccgaatttgatggcttgttgaccaaacttagtcgcagcgggggtgacgcaaagagaagggagaaatttctgttcaataattattctttggtgttgaccatcatcagtgtaagccgaatcatccactccggaatgtgtctgatctctgacagggagcacaggatacccatggcaaattag

SEQ ID NO: 18418 - DNA, 522 bp, A.fumigatus
aacggggtgcggtgccgctcccgcggcaggaccatgttgttgatcgcgcaagccccgtttcctgcgctgttgatgagcgtctccgccgtgatggaggtctcggccccgtccgccgacacagccgtgattctgtacccggcccggccaccatccagcgcctcgatccccgtcacgttcgtcaggaacgcgcagtccccgccgcggtcctcgaagtcgccctgcaggtatgtcatgagcgcgtggctgtcaacgatgcccgtcgtgtcgctctccacgatcccggcgagagcttgcacctccggttcccgccgctgggcctcctcgtggccgacgagccgggtgggtacgccgagggtctgcgcgagcttgtgtgtgcccagcgcggcagcccattgctcttcgttctgcgcgacgatccatttcttcgtgttgcggtgggggatgcctcgttttgcgcagaggtcgtacatcatctgtttgccgcggatgcagagtttggctttgagggagtcggtcccgtag

SEQ ID NO: 18419 - DNA, 288 bp, A.fumigatus
tccaaatccatgctgggaagctgcatacctgtttctgttcggttgctaatttgccatgggtatcctgtgctccctgtcagagatcagacacattccggagtggatgattcggcttacactgatgatggtcaacaccaaagaataattattgaacagaaatttctcccttctctttgcgtcacccccgctgcgactaagtttggtcaacaagccatcaaattcggcgaccaatcgcttcagactgttcgcaacaggttcgtcatccccagcatcgctgctcagcactaa

SEQ ID NO: 18420 - DNA, 498 bp, A.fumigatus
ttcactgtgtactttgctgcgtttctactctcaggctgccccgcatccatgcacatgtcccctcttctgcttcatacctcaaccatcgagcgaccaagctacaactgtcttcaactgtcatcttattcaggctgggcactatcaactgacatttgttcttttcagcatgagaccttcgagtccgccgacgctggtgcgtctgcgacctaccccatgcagtgctccgctctgagaaagaacggtcacgttgtcatcaagggtcgtccctgcaagatcgttgatatgtctacctccaagactggcaagcacggtcacgccaaggttcacatcgttgccctcgatatcttcaccggcaagaagctggaagatctttctccctccacccacaacatggacgttcccaacgtcacccgtcgtgaataccagctcgtaagtcgacctgccaaagccatgtcaatctcacctccagatgtctcactgatatgcttcgcagcttga

SEQ ID NO: 18421 - DNA, 204 bp, A.fumigatus
  unsure (158),(196): Identity of nucleotide sequences at the above locations are unknown.
agctggggtaaccaatggtatgtatgcgactatatggctggctatcaattggatacttgtgttgctgtgttttgtttgatgatgtctacggagggttacttcaagccacgcattctgaagccagctgatctgttacttagacatgcgcattgccttgnatgtcgcgtgggctgtgaatctgtgcgtgtacagacgncattctaa

SEQ ID NO: 18422 - DNA, 705 bp, A.fumigatus
gtcaatccgcatatcaacctcttcttcttcaattcgcgaggatccgtcggccggcctgtcacccatcgtaaaggccgcgggtggcgcggagggtttctggggtccgcgatcgagcaatatatcaaactcgatatgaataagtggcttagagtcctccgccatctcgagctcatgccccgaccgttgggccaggactggagtgagatctggctgcagaaattcagcggcaccattacgatctggcccaagagcatcccctccgacttttaccatatactatcggaccttagtccagagcgcatagcacgcatgcttcacgtgggcaagcaaagtgctttcccgaagattcaatttatcaagaatcggctcaaaatcgaaaacgcgattatgcagggcctgcagcagtgttcctccggcggaggaagggtgatgtcaccgattctgtcgcgccgacgccaggaccgtgcacaggaacatgcagaccggatggtcgagcgtctcgaccagagcttccctgagcgccagtcggattacaaagacgagtcccactacgcggaggtctcagacagcctgtctgcgacttcgtcccgcccacacaccccggacgcgcgacgaagcagcatgttcgaggaaatgcggcgccagtcagctgttttctttgacgatccagacatgtacgccgacgaggatgcagtaactacctag

SEQ ID NO: 18423 - DNA, 1632 bp, A.fumigatus
cctggagttgggattgtggcttgtttgccgatgcgtggggcggtgacaccatctgacgtcgatgtcaagctactcgcggcttccaaacaggctttgggaatagcatctcagcaacgtttcttctcccttctatatatccactatgaatgttatccaacaatgacatcggatgaaaagtctgccactcgcgacatatacgatcccaatacgcttcccgactatgaccgggagtttatcgaaccggatgacctccgccaattcgagaaggcgctgaatgcccccgaagccgctcctctcgttgcgctcaatgactggcgtccagtcaatcaacgagttcggaaaagccgtcgaaccaaaccgaggagaagcaaagacgaaacgcgagaaggtgtactctacacggtgttgaaatggccattcctctttacggtttttgcatggataacggtcctcggcttcgcctatacactgacgcgcttgtatatcttcctatatgagcaatttgtaacatggagaggcaagagggagcaactaaggagagagctgtccatgcaaaccaactatcaggactggctgaaagcagcacaggcactcgatacttacctcggaaatctcaagtggaaggaaacggacgaatatgcatactacgaccatcttaccatcaataaagtggttgcgcagctgaaacaaactagaaaggcagccgagatggagatgcaaaatggacgcccaggcctgagtgatcctcctgccgtcgaagagctttgctttctgctcgaagcatgcgtgaagaataacttcgcaggcgtggaaaatcctcgattgtatagtgaaacatattcaggaacgaaggatctcgtgcaggagtacatggacgaagtccactcttgtatccggctagtccgggatagtaaacagatctcgaatgaggacaagtatcagttcttcaagcatctggacaccaactttggtcgcacggctctctgcctgtctggcggtgccacatttgcctattaccattttggtgtcatccgggcgctgctcgataacgacgtcttacccgagatcattaccggaacgtcaggaggtgccttggttgccgctctagtcgctactaggactgatgaggaactgaaacagctgctcgttccggccctggctcataggattagggcgtgccatgagggcttcacaacgtgggtgcggcgttggtggcgaacgggggccaggttcgacactctggattgggctcgccagtgtagctggttctgcaggggctcgaccacatttcgagaagcctacgagagaaccgggcgtatattgaatgtctcctgtgttccgtctgaccctcattcaccgacgattcttgcgaactatctcacctcgcctgattgtgtcatctggagcgcagtccttgcatcggccgcagtccctggtattctcaacccagttgttctaatgaccaagaagcgtgatggaacacttgctccatattcttttggacacaagtggaaggatggcagtttgaggacggatatacctatcaaggctttgaatctgcatttcaacgtgaattttacaatagtatcacaggtaagttttgctttccattgggtcactagttacaagtaa

SEQ ID NO: 18424 - DNA, 210 bp, A.fumigatus
gttttgattttcctctgggtcagggacccgccgtactggggctgtcgcgatgcactaggtacctacctacactccatggtatggtacggtacgatggtggaatactttgagtacctgagagttgtaggcatacgttattttcttcccgttattttctttctcgctgccttcttctactcttacaatttatgtaaaataataatgtcgtaa

SEQ ID NO: 18425 - DNA, 207 bp, A.fumigatus
tacaagaggaagccgatctactctaggggtatgtcatacgccaacgtcacgcaccacgttcaaaagaaatggcactatgcgaccgggttcccttcgtctttcgcgaagatccccggagatcgactgcgcatggtgacctggcgcctgctaacaccgttgccgactagccaccagccatccatgcaggcatccgaaaacagaaattga

SEQ ID NO: 18426 - DNA, 447 bp, A.fumigatus
  unsure (90),(91): Identity of nucleotide sequences at the above locations are unknown.
gaaccgttcaccccatgggcttcaagggcttttttttcggtcatgcggacttgcattttcgcccatgtcgggatccggaaaacacgggcnntgtgggcagccgagattaacaaccttgccaagtcggtgcctggcgccgtcgggtcgatctggctgcgtctctcgctcttttacatcttgggttcgttaatggtcaccatcaccgtcgaccccaaggacccagacctgttcggtgcatccggtaccaatgcctctcccttcgtcattgcctaccggaacgcgggactcgtcccactggcgcacatcatgaacgcggtcgttttcatttccgtggtctcgaccggaagtatccaggtgtatgccggctctcgcacactgatgggtctcgcgcatctgaaaatggcaccaaaggttacttgttccacccctgcgtctcccgggtcctag

SEQ ID NO: 18427 - DNA, 582 bp, A.fumigatus
ctaaactcgtcacagttcttcggcaaagcagacaaagtcggccgtcccgtcgccggtctggtcctcaccctggtcatcggcggtggactggcctatctaaacgtgagcaacagcggcgccgaggtcttcacctggttctccaatctcacttccctccttaccctcttcggctggggcatgatctgcctgtcgcatctccgcatgcggtacgcctggaaggtccagggccggtcgccgtcggagctgccgtggaaatcctggacgtaccccgtcggtgccatctggggtctcttctggtgtgtgctgctcatcgtcgtcgagttctatctcagtgtgtggcctcttgatgggaagccgacggcgaagggcttcttcgcgaactatgtcagtgtggtggcgattattgtcatctacattggatctatgatttattacaaggggccgctcctgaatgacgcgagaagcattgatctggatcagttccgtcggttctatgtcgatccccgggatgaggaagccaaggctgagaaggcaggggtgaagaagtatttggctaaggggattggttttgtcttcaactag

SEQ ID NO: 18428 - DNA, 210 bp, A.fumigatus
tgctggctggtatttagacctgcctccatgccctccttccattcttctctccatcgcacgcagccttctctggccaaagatggacctaaccgtccttcgctccatgtcgtcgcggtttccgtggcctctttccctttcctccttcctatccccccgcaaacctcggccatcggcgttggtgtcggtctcgacgcagactgtacccaatag

SEQ ID NO: 18429 - DNA, 1503 bp, A.fumigatus
ggttttggaaaacaaggccaaactggtgtggtcagaattttcatcacacctgatgctggctggtatttagacctgcctccatgccctccttccattcttctctccatcgcacgcagccttctctggccaaagatggacctaaccgtccttcgctccatgtcgtcgcggtttccgtggcctctttccctttcctccttcctatccccccgcaaacctcggccatcggcgttggtgtcggtctcgacgcagactgtacccaatagccgaccgccatctgtcaaggttcacacaccgtctcccgaggaagaattacatgctcgtcgggagatcgcgcggagtgatgcggaggactggctacagagcctggttggccaggacaatatcaaacgtcgcttaaatgagattcaaacatggatcaccatttgtcagagacaagggaaagatccaaggcaggaatggtacaacattgtcctcgagggcaatgaagggacgggcaaaagtactgtcgcccgcgtatacgccaacgtcctcttttcgaccggcatcaccgacgtgctgacctttcgagaaatctctggagccgcgctggccgcgcagggatgcgaagggctgaagcatctgatcagtgacatggttgatacagcatccccctcggcacagatagttggagtgttgctcgtcgaggatgctcacctgctggtaacgtcctcctccactcgcactcaggagatctttaatgctctcttcgaggcgatggagcgtacgaccggacgtgtcatcgttgtcctcagcggccatcctccgcatatggagggtcttgttcggtctcacccccgacttgaaagaacaatctgttgtactctgcacttcgccgactttacttctaatgactatctcacgatgttggctcagtcgctacgggagcgttacaacggcaagctcgaggtggccggtggccttgacggtcccttcatgcagatggccgctcggcgacttgcccgtgcggctgccggaaacggcccgagaaatgtgcacgcagtgcaacgtcttctggacaccatcactcttcgccaactccaatcgcatatgacccaagaggaggacaacctggaagaggtcgatacatttttcttctcgccggaagatatagtcggcctccggccggccgatgttctggccaaaagtcgcgcttgggcagacttgcagaagcttgttggacaggaagcggtcaaggcatcagtcagtgaactgctggacacgattgaggagaacttttggagggaagcccgaaatcagagaccgttctccgttcgagtcaaccggattttcgttggaccaccagggactggcaagtccacggtggcgaggctgtatgggcacgtgttggcagatgtgggtctgctgagcagcggcaaaggtgagttgtcaatatttgaaactgaaaccgcagcactaacaacagcagtggttgagatgcgtgtctcgcagagacctgacgtctaa

SEQ ID NO: 18430 - DNA, 1428 bp, A.fumigatus
gacctcctggattcctccatcggcaaggtgcttttggtcgacgtgtcagaccttgatgagtcgtctcagatttggctgaaaactctcatctctcaactgtcgctcattcctcgccatgatcgctgtgtaatcctggttggaaccaacagcagcattgaggcgttggttcaggaaaaggacctgttgaagcttttcagacagcatcacatcgttcagttccattctttcaccaaagcacagctgcgtcaaatccttgaaatgaagctgcacgacgacgaagttcatgttacttctgaggcgctggataatgctgttaaacttctcgaagtcgctcgcatgcgcaaggacttcaacaatggcagagcaattgctcacctgctcgggtcagctcactctgcgtacgaacgcagtcggtcacagggtgaaggtacccagtcacaactcgcccggattctcgtgcctgaaaatttcgaagatgatctttcgagttgccgatcaaagttggatttccgcgaggagttgaaatacaccctcgtctcggacgacctcattactttgctggaacgctaccggcacgacctcaaagcggcgtggttgctgaatactgaccccactcggcgggttccccttgcgatggtcttcaaaggcgccatcggaattggcaggagaatcttcgcacggctgatcggccgcctatactatgacatgggtgtgctggactctggcaaatttatggaatgctctgccaccgatctagctctgaatgcttgcaacccatcgactccaacacgctcgctgctggaacgggcacgcgggggtgttttgttcatcgaagatgctcatcggctcagtgagatcgaatccgctgctcggactatcaacgatttggtctacctcatgcccaagtactctcgcgacactgtggtgattctcgcaggctctggccctgaaatggacctgttgttgtgcaaccagccccgcctttccagccttttccaggaagaggtcgtcttcaagagtcctacacctcgagagtgcctccgtctgcttgaccagcgcctccaacaggaaaagatccctggctcgaggcctttcctcactgacactcggaccgaaacataccgcgagttcacacgcgccatgcaaacgctctcgttgttcccttgctggagcaatgcccgtgatattgacgtcctggccatgtggatggtgtcgtctgttttgcgcgcagtcccgctggacggcgactcgctatgtgctcctcagttgacagaggagcaagccatggcatgcgtgatcaagatgtataatctgaagcgcgatcgccttcgtttcaaccaggaccctaaggtgaaatcgctgccacgcaacctttcgcagccgaggtcctccccttccattcggagcgccgtcaggtttcccgtctag

SEQ ID NO: 18431 - DNA, 339 bp, A.fumigatus
cccgagcaggtgagcaattgctctgccattgttgaagtccttgcgcatgcgagcgacttcgagaagtttaacagcattatccagcgcctcagaagtaacatgaacttcgtcgtcgtgcagcttcatttcaaggatttgacgcagctgtgctttggtgaaagaatggaactgaacgatgtgatgctgtctgaaaagcttcaacaggtccttttcctgaaccaacgcctcaatgctgctgttggttccaaccaggattacacagcgatcatggcgaggaatgagcgacagttgagagatgagagttttcagccaaatctgagacgactcatcaaggtctga

SEQ ID NO: 18432 - DNA, 627 bp, A.fumigatus
atttaccatggcgaccggttccaccttatgcctatcatcacccctgcgtatccatcgatgtgtgcgacgcacaacatctcaatgtccacaaaagcggttatccttcgcgagctccaacggggaggtgatattgtagacaaaattttcctgaagcaattaacttggaatgatctctttgcgcggcactcattcttcacgcaggattacaaatactaccttagcatcactgcctcaagcagaactaaggaagcggaagcggtgtggtctggtcttgtcgaatccaaaatcagacaccttgtcggagcgttggatcgcaagcctaccatcgcagtggctcacccatttccaaaaggctttgagagagtgcatatcgtctccaacgaagaggaagcagaggccgtaaagaacggttctaccaagtatcaagataaaggtacgaagacggagaccacagatgaaaggaaagatgctgcacaccaagccgcagctctcagcggagttgagaacgccgaggttgagcctgtcggtgagaagagcgtaaatggtgatagccatatcatttacacgacgacgtattatatcggcttggagttgaagccattggagccaggtatgtatggcgcctga

SEQ ID NO: 18433 - DNA, 210 bp, A.fumigatus
ttttggtcaactccagctggatacaagatgtcaacaccaccagttcgtcagtggggagttactcctcctatctcgacagcgctcccgactcccgaagaactcgctgccaacgatgatttgatctcggagctcaaggcccagaacaacttcgaaagtcccgcggagacagagcggaggtgggatcaacctggctacatctctctttgttga

SEQ ID NO: 18434 - DNA, 192 bp, A.fumigatus
tgttttgcgctgacaccatgtctattatcgggtagaaaacaagttctccagctccttcaacgcgtaacccatgagtttgtcaaggttgtcagtcgaaagaaggggctgtcccctgcagcagtcgaggcagcaggtggaaagattttcacttatggaagttatcgcctgggtgtctatggtcctggtcagtag

SEQ ID NO: 18435 - DNA, 465 bp, A.fumigatus
cacaatcgtcgtgatattgacaacgcgataggctcggatattgatacacttgtggtcggccccaaacatgtcctcattgacgatttcttctcagactttcccccggttctggagaagatggctcctcccggggcgatcgaaaagatgacaccagttcccgacgccttcgtcccgatcatcaagctggagttgtccggtatcagtattgatctcatctttgcccgtttgattgtgtcatcggtccctcttaatctcgacttgaagaataatgattacctcagggggcttgacgagaaggaggtgcggtcactgaacgggactcgtgtcacagacgagattctggaactcgtcccccagcaaaagacgtttcgtcttgctctacgcgcaatcaagctctgggctcagcgtaaggacatcccatctgtgtctctctctcctctcatcatctctcggcaaccatgctga

SEQ ID NO: 18436 - DNA, 417 bp, A.fumigatus
caccgacttacaggccgggctatttactccaatattgtaggtttcccaggtggtgtcgcttgggccatgcttgtagcacgagtctgtcagttatacccgcacgccaccgggtctgtgatcgtcggcaagttcttccgcattatgaacaagtgggcgtggccccagcctgtcttgctaaagccaatcgaggacggacctctacagatgaaggtctggaatcccaaggtaagggcatcgaaggcgctgcactgcattcttcgcgatattgatatcaatgatagatttaccatggcgaccggttccaccttatgcctatcatcacccctgcgtatccatcgatgtgtgcgacgcacaacatctcaatgtccacaaaagcggttatccttcgcgagctccaacggggaggtgatattgtag

SEQ ID NO: 18437 - DNA, 513 bp, A.fumigatus
tctactagcgcggaggctggcactcacgtagtgaagacggacgaggacaaagtcctgaatccgaaaaagtatttcatcatcatacctgcgctctttggaaacggccagtcctcatctccatccaaccagcccaatgctggcccatttccgaaatgctctttctacgacaatgttcgcgcccagcacaagcttgtcacagagcactttggaatccggcatctacgtgcagtgatcggctggtcaatgggaggagcacaaacctatcaatgggcgactcagtaccccgagttcatggatgtggcaattcctttttgcggatccgcaaaaacatcgctgcataaccaggtatttttggagggcgtaaagagcgctttgcttgcagcgaagcacgtcccatcagcgggttcggggaagattggcgatctaaaggccgatcagactctggggacatggagtgctgaggacagagagattgggttgagagcttttgctagagtgtatgctggctggtaa

SEQ ID NO: 18438 - DNA, 888 bp, A.fumigatus
aaacgtgttggaagcagccaggtccacgtctcagaccgtcgacatcgtcctccgaggagacagtacattgcgaggccacttccccctagaagcagacgtcgcgcagtccgtgttcggccctgcagatgcatgggtgctggcccccttcttctttcagggcggacggttcaccatcaacgatgtacactatgtagccgagggggagaatctggtcccagcgggcttgacacagttcgccaaagacgcgacctttgggtacaaaagctcgaatctgagggactatgtcatggagaaagcgcctgggcggttcgcccccgagcaactgcactcgatcacaatcgaggatatccgaaccggcgggcccgatggcgtatacaggaaactcataagtttccccaagggaggcgtcgtcatcgtcaacgccgcagcggagtcagacatgcatgttttcgtcgccggtttgctactgggtacgtccgaacgctttctgtcgttgatccaatactgagtaagaacagccgaaagcaaaggaaaacacttcctctaccgcactggcgcagccttcgtctcctcccggctaggaatccgctccatcccacccatcacagcccgacaactggctctcccctcccctcgggaaacaggcggtctcatcctcgccggctcctacgtccccaagacaaccgcccagctcaaagtcctaaccgacacccgcggcgcaaccggcaccctcgccatcatcgaaatggacgtcgcggatctgatcgcctcccccgaacgcgcggagcgcgtgatccgccgcgttgttcagcaggcagaaacgcacctgcagtccggcaaggatacgctggtcatgacgagtcggaagctggtgacggggcgggatga

SEQ ID NO: 18439 - DNA, 849 bp, A.fumigatus
aaatatctctttttgtatactaagtcaacatgtcatccccaaaagaaatatcccgcactgcctcgcgaaagtaccttggcacagcttccgccggaatatcccgcagacgcccaggaacagatcgtacagctcctctcgacatcttcattgaatcgtttggttgtgctggacgatgaccctacaggcacccagacctgtcacgatatccctgtactcgccgtctgggacgtcccgacgctgattaaggaattccagcaagattccccggggttcttcattctcaccaactcgcgcgctcttcccccacttgacgcggagaagctcatccgcggcatatgtgaaaacgtgttggaagcagccaggtccacgtctcagaccgtcgacatcgtcctccgaggagacagtacattgcgaggccacttccccctagaagcagacgtcgcgcagtccgtgttcggccctgcagatgcatgggtgctggcccccttcttctttcagggcggacggttcaccatcaacgatgtacactatgtagccgagggggagaatctggtcccagcgggcttgacacagttcgccaaagacgcgacctttgggtacaaaagctcgaatctgagggactatgtcatggagaaagcgcctgggcggttcgcccccgagcaactgcactcgatcacaatcgaggatatccgaaccggcgggcccgatggcgtatacaggaaactcataagtttccccaagggaggcgtcgtcatcgtcaacgccgcagcggagtcagacatgcatgttttcgtcgccggtttgctactgggtacgtccgaacgctttctgtcgttgatccaatactga

SEQ ID NO: 18440 - DNA, 516 bp, A.fumigatus
gtaagaacagccgaaagcaaaggaaaacacttcctctaccgcactggcgcagccttcgtctcctcccggctaggaatccgctccatcccacccatcacagcccgacaactggctctcccctcccctcgggaaacaggcggtctcatcctcgccggctcctacgtccccaagacaaccgcccagctcaaagtcctaaccgacacccgcggcgcaaccggcaccctcgccatcatcgaaatggacgtcgcggatctgatcgcctcccccgaacgcgcggagcgcgtgatccgccgcgttgttcagcaggcagaaacgcacctgcagtccggcaaggatacgctggtcatgacgagtcggaagctggtgacggggcgggatgagctcgactcgctggctattggggctagagtcgcagaggcgctggttaaggttctgcagcagatccaggtgcgaccgagatatatcattgcaaaggtaggcaatcgtgcattgcgaagtgagaatccttcccgctga

SEQ ID NO: 18441 - DNA, 273 bp, A.fumigatus
cgcagcgatcaacggcattcttcagatcatcgtaccttgcggacatcaaccggggcaaagccgatgactttggctcctggtgaagcggtggcaatgtcactggccgccttttccgtcttctcaacgtttcggccgacgatgcaggcgtccgcgcctagatggacgagagcgcgaacctgcgcactgcagatggtgcctgcgccacctgtgcagaagacgactttgtttgctgaaggtcatattagcggattagttgctatgagtccattttga

SEQ ID NO: 18442 - DNA, 555 bp, A.fumigatus
tcgtgcagaccgctgcggatcgcaagagctgcttcaacagcggtggagcgggctgtttcgctcaaccacaagagtactgtcgtatgtgtctcggactctgcctgtcaatctacaaaatacttaactttctgttactgcgcagaaatccttgctacactgctaaacaacggcacctcacccatcaccggcaagcgaatcctcgagacaaccacagtcgacgagatgttccgcaatcagatccccaacctccccaattttgccgcacaaggcatccctccttcgaagcctgacctcaccaatgaaatagctcatctgtacccatcgccgacacctcaggggtggggcctcacctttatgctgacgggagggtccactggacggtctgaagggacggcgcactgggcaggacttgcgaacctctggtggtggtgcgatagggagaaaggggtcgcagggatgatttgtactcaactcttgccctttgctgatccccaagtttggagcctttggctggatgtggagtctgccgtctaccgtggcctggctcaggattag

SEQ ID NO: 18443 - DNA, 519 bp, A.fumigatus
gagactgacagaacctcgcagggcctatcttactccgcttccgcagtcaccatcccttccttgagccttctccccacctcggccaacgccctccgatctctcaacgaagtcaagcgccttaatcgcaaacatggtttacgactgacaaacatcgccaacgcctgcctcatctttgcatactccgtctcccccaagcaccgtaaacacccctacctgatctggatgtgtgttgcgtccattgtcggctcatacggaatggacttttggttccaccgggaactcggtctcaaggcctgggctcggagtctcatccgggactcgggatgcatgtccttctctcgtggaaactccaccaagaaggacgaggatcttgttgttgtcgaggccgaggagtcggttaatggcgagagtgtccgggaggagatggctcgcgagagacggctgcagtgtgctagagcggtgtgctcggggcttgcgcttgcaatgggtattgtcggactttggggcgataggaagtga

SEQ ID NO: 18444 - DNA, 219 bp, A.fumigatus
cagccagttctgacagggaacatagctgggtttggctatacgtttttcaatgagaagctgcgagactacagcaagccggttggttacgacgaattctcaggacacatctacgacatgctgcagccgttggttcatcagcctggggaaaagtgggaatatggggtgcgttcgtcagctagcaacgctattttctatgatcatttgctcattgtggtttaa

SEQ ID NO: 18445 - DNA, 417 bp, A.fumigatus
  unsure (42): Identity of nucleotide sequences at the above locations are unknown.
gggcgcgttttcgcatgggaaatggccaagttgggagtccgntggaacaccttgagcgagcccgtctttggaccccaggcctgcgtgacttgcacccctgacgcgccagtgccgataaccgcgcagcgctttcttcggacatcgatggtgtgctcgcccggccaaaaggaggagtggtggacaatgccctggaatgtatccattcccggccactcggggatgtaccgctttgcagagaacccggcggcgataatgaggtacttggacgacgccgttctcccatcggccgttttgacctgccagcggccttcgtctgtgtcaaagcgggcctccaccaccacgctgttgaaggcgcagtccttctttacctggagcacctggtcgacgtggtcaaagtatcgcctcagctcctcgtag

SEQ ID NO: 18446 - DNA, 459 bp, A.fumigatus
tttgaccccatcaccgggtttctacgtctcacaatgacttctctctctccacaagcggtaactgccctcaaagcgcgggtagacgcagcctgcgcggaccagcacaagggtatccccggtgcggtagtggtagttgtcggcaaggatggcaaggagcattttgcgcatgcgagtgggaagcgcgggtacggctctgaagaagcaatgacgctggacagcgtcttctggattgcatcgtgcacgaagacgattacgggaattgcgtgtctgcagcttgttgaacgggggcgattgagcctggacgattcggaccaagttgagacgatatgccccgagctgaaagaggtgaaggtgttgcaggacgatgggactttggtagagaagcggaggggaattaccttgaggatgttgttgaaccataccggtgagtggacgtcgcctcgtgacagccagttctga

SEQ ID NO: 18447 - DNA, 696 bp, A.fumigatus
ctgggtttggctatacgtttttcaatgagaagctgcgagactacagcaagccggttggttacgacgaattctcaggacacatctacgacatgctgcagccgttggttcatcagcctggggaaaagtgggaatatggggtgcgttcgtcagctagcaacgctattttctatgatcatttgctcattgtggtttaaggtaaacatcgactgggcaggggtcatggtcgagcgtgtcaccgggcagtcattgaacgagtacttccaccgcaacatcttcgagcccctggggctgaataacatctcgatgtttccgtcggcgtcaatgaaggagaagttggcatacatgaatcaaagagacgcgcatggccacctctccagccgagaccacctgcttcggcggccgctgatcgtgcagaccgctgcggatcgcaagagctgcttcaacagcggtggagcgggctgtttcgctcaaccacaagagtactgtcgtatgtgtctcggactctgcctgtcaatctacaaaatacttaactttctgttactgcgcagaaatccttgctacactgctaaacaacggcacctcacccatcaccggcaagcgaatcctcgagacaaccacagtcgacgagatgttccgcaatcagatccccaacctccccaattttgccgcacaaggcatccctccttcgaagcctga

SEQ ID NO: 18448 - DNA, 1320 bp, A.fumigatus
  unsure (323): Identity of nucleotide sequences at the above locations are unknown.
agaaggactgcgccttcaacagcgtggtggtggaggcccgctttgacacagacgaaggccgctggcaggtcaaaacggccgatgggagaacggcgtcgtccaagtacctcattatcgccgccgggttctctgcaaagcggtacatccccgagtggccgggaatggatacattccagggcattgtccaccactcctccttttggccgggcgagcacaccatcgatgtccgaagaaagcgctgcgcggttatcggcactggcgcgtcaggggtgcaagtcacgcaggcctggggtccaaagacgggctcgctcaaggtgttccancggactcccaacttggccatttcccatgcgaaaacgcgcccttagcgccgaggctcagcaagaagccaaagcgctctatcccgaactgttctcgttccgtgagaaggccttcgcggcattcctgtacacattcagtgaaaagagtctctgggaagacaacgaagaagaacgggaagctttcttggagaagttatgggccgaagggggcttccgcttctgggtcgccaattaccgcgactacctcttcgacgccgaagccaaccgcatcgtgtacgacttctggtgcagaaaggtccgccagcgcatcggcgacccaaaggcccgggagctgcttgcgccgcgcgagccaccgcactacttcggcgtcaagcgtccttgtctcgaagaaacctacttcgagcagttcaaccggaagaatgtcgaggtcgtggatatcaagaataaccccgtcgtggcgttcaccgagaccgggatccagctcgaagacggcaccgtacacgaggtcgacgtcgtctgcgtcgcgaccgggctcgacattaccactggcggaatgaccaatatggggttgaccagcatccatggcacgacgctcaaggacgagtggaaggacggcgcgtacacgtatcttggtttgacggtcagcggatacctcaatatgtttcatctgtatggaccacagggacctacgctgctgagcaacggaccgacatccgtagaggtccagggccgctggattgcagacgcgatcaagcagattgagcgccaggggatcaagtatattgaccctctcccggaatcagctcgcgcttggaagaaacggatcaatgagctttcggacctcaccctctttcctaccaccagatccacgtacatgggtgggaccatacccgggaaagtctttgagcagggaaattataccggtggtataccccagtatttggcggagattcgcgctgctctcccgaagttcgatgggttcactactgtcaaatattaa

SEQ ID NO: 18449 - DNA, 831 bp, A.fumigatus
  unsure (277): Identity of nucleotide sequences at the above locations are unknown.
cacagacgaaggccgctggcaggtcaaaacggccgatgggagaacggcgtcgtccaagtacctcattatcgccgccgggttctctgcaaagcggtacatccccgagtggccgggaatggatacattccagggcattgtccaccactcctccttttggccgggcgagcacaccatcgatgtccgaagaaagcgctgcgcggttatcggcactggcgcgtcaggggtgcaagtcacgcaggcctggggtccaaagacgggctcgctcaaggtgttccancggactcccaacttggccatttcccatgcgaaaacgcgcccttagcgccgaggctcagcaagaagccaaagcgctctatcccgaactgttctcgttccgtgagaaggccttcgcggcattcctgtacacattcagtgaaaagagtctctgggaagacaacgaagaagaacgggaagctttcttggagaagttatgggccgaagggggcttccgcttctgggtcgccaattaccgcgactacctcttcgacgccgaagccaaccgcatcgtgtacgacttctggtgcagaaaggtccgccagcgcatcggcgacccaaaggcccgggagctgcttgcgccgcgcgagccaccgcactacttcggcgtcaagcgtccttgtctcgaagaaacctacttcgagcagttcaaccggaagaatgtcgaggtcgtggatatcaagaataaccccgtcgtggcgttcaccgagaccgggatccagctcgaagacggcaccgtacacgaggtcgacgtcgtctgcgtcgcgaccgggctcgacattaccactggcggaatga

SEQ ID NO: 18450 - DNA, 210 bp, A.fumigatus
ccttcagcaaacaaagtcgtcttctgcacaggtggcgcaggcaccatctgcagtgcgcaggttcgcgctctcgtccatctaggcgcggacgcctgcatcgtcggccgaaacgttgagaagacggaaaaggcggccagtgacattgccaccgcttcaccaggagccaaagtcatcggctttgccccggttgatgtccgcaaggtacgatga

SEQ ID NO: 18451 - DNA, 318 bp, A.fumigatus
ctcggagtcccgtatgttatctacttgccggtttgggtcgcatctgactgtttcatagtgcgcccctcgccactcggcaccggcggacgcatcatcttcgtcagcgctacgatccactaccgcgcaatgcccttccaagcgcatgtggctgtcgccaaagccggcatcgacgccctgtctcacaccgtgtccatcgagtatggtccactcggggtgacttcgaatatcattgctcctgggccaatcgcttccacagaggtacacttccctccgtctgtcttcaccacggggctgcaaggagccgctgcatggcgatct

SEQ ID NO: 18452 - DNA, 732 bp, A.fumigatus
  unsure (687): Identity of nucleotide sequences at the above locations are unknown.
cgcaatcccaacatgcatatcaggaaggaacttagcgaatatgcctcccttcgaggcacgactggaccctacgctgataacctcagcgtcgatgtcgtcatcgtgggagccggcttcggcggcatctactgcctttacgagatgcgtaagctgggtctcaaggccgtcatatacgaagcgggcgatgatgtcggcggcacctggcgctggaactgttatccaggagccgcggtggactcggaaatcccagagtaccggtactctattcccgagacctggaaggattggacctggtcgacaaactaccccaactacgaggagctgaggcgatactttgaccacgtcgaccaggtgctccaggtaaagaaggactgcgccttcaacagcgtggtggtggaggcccgctttgacacagacgaaggccgctggcaggtcaaaacggccgatgggagaacggcgtcgtccaagtacctcattatcgccgccgggttctctgcaaagcggtacatccccgagtggccgggaatggatacattccagggcattgtccaccactcctccttttggccgggcgagcacaccatcgatgtccgaagaaagcgctgcgcggttatcggcactggcgcgtcaggggtgcaagtcacgcaggcctggggtccaaagacgggctcgctcaaggtgttccancggactcccaacttggccatttcccatgcgaaaacgcgcccttag

SEQ ID NO: 18453 - DNA, 228 bp, A.fumigatus
cagacagttcataacagcgccggtgcggcaggcaacttcctggcttcaatccagcagctatcggtcaatgctttcaagtcggtgattgatatcgatgtgctgggatcgtacaataccctcaaagcgacgattcctcacctcgtcgaatctgcgaagaagcacagggttgactcggagtcccgtatgttatctacttgccggtttgggtcgcatctgactgtttcatag

SEQ ID NO: 18454 - DNA, 396 bp, A.fumigatus
cgttcttcttcgcggggcggagattctctgcaatgtctagtaagtaagctgcgtatacgaattactcttcatttgctggtgctgatttcgtggagtcccgttgctggtgcccaggagaaaattgcgactctacgttatcgtcacgagctgattagtggttctattgctcaattagaagaccgagtagcgaggaacactgcagaattggagcagatgagccagtcctacggggaggagtacggcgactatgacaatcctaccaccgccaccctggaagtcacagacgccgatattgagcgagaaatggaggagatcagagagctcgaaaggcggaaacgagctctagaagcgcgagtaagcggtatggaaagggatttgggtggcttgataggctga

SEQ ID NO: 18455 - DNA, 2091 bp, A.fumigatus
agaaagatgccggctgagagacgttcgttgcgatcgaacagcaagtcagatacttcttcatctgctaacggtgaaaaagcgcgttccaactcgcagagctcaagttccaacaaggacaaggccgcgccaaaccgtgccgctgccaacaaggccaaatctcccacaccggcggcttcgtccaataacgtatctaactccggtatgggcgagcagcgtgatcagccgcataccaacggcgtgaacggttctgaagatattgagatgggagaggatacggcaggtgggcctacatcctcattcaacacccgtaaggatcggaaaggtgacgagaagatgactgttgtagtgcccccgtccaagggttcgaggttatccggagagaaagggcaggaccgggaggaagatgttgtcatggaggccgcagagactgattcccaaaagcccgagtcggaggttgatcccagagtcaaggccattcaaggttcgtttctttttcccgctgctgtcttgatggatgcatgcctaaccatcaccgttatcacttgggctatagatatcaagaccaacttcacacttctcgagcgagctgtagcccacttcgaccccagatttacactgcgcgttctcaggtcgatatcctcaatgcgcaagcacatcactgccgatgtgctggcagaagtaatcgttgagacctatccaccctcaagtgctactgcttttttcttactggaagctattgatcaatctggcgcatacgagagcgccattgctagttcgaagatggaggtcgattctgacaagaacaagtctgctcccaaagaaatactgccagaggttgatacctatctatccatcctcgttcagatctacctctacgacaagaaggatattcaagggggcgcaaagttctcgacagcgttgactgagcgtctgcggactcttaatcgtcgcacgctagactctcttgctgctcgcgtatacttttactactccctcttcttcgagcaggttgctcctcatcctccatctcctgctgcggcggttacctccatccgccagcccttgcttgctgcccttcggacagccgttctccggaaagatgtcgatactcaggccaccgtgatgacccttcttctgcgaaattacttgtctacatcccacatcccgcaggcagacttgctcatctctcacaaccgctttccgccttctgcatcaaacaaccagattgctcggtacctgtattatctgggccggattcgtgcgattcagctgcaatatacggatgcccacgggcacctgattggtgccactcgcaagtctccttcgagtcacagtgctcgtggtttctaccaggcttctcacaagctgctcgtagttgttgagcttttgatgggcgatatccccgatcgtgcaatcttccgccagcctgcacttgagcgcgctttgcacccttacttcttgctcgtccaagcggtgagcgttggagatttggatggcttcttgaacattgtaaatacgcacagtgcaacgttccggaaagatggtacctacaccctgatcctgcgtttgaggcaaaatgtcatcaaaacgggtatccggatgatgtcattgtcctactctcgcatctcgcttcgggacatttgcctgcgtttgggcctggacagtgaggagtcggcagaatacatcgtcgccaaagcaatccgcgatggtgtgattgaggccaccttggatcatgagcatggatacatgaagagcaaggaagtcggagatatctatgccactcgcgagcctggagaggtgttccacgaacgtattcgggcttgcttggctctgcatgatgaaagcgtcaaggtaggctctcggtctttctttttttttttcacggcccccctttcccccccccccccctttttttttaaggggttccgatcttccgaattggcttttgaattcatcactaacatctgcgtcttcttctgtgtaggccatgagatttcccatgaatcagcatcgcctcgagctcaagagcgcacaggaggctcgggaacgggaacgagagctcgccaaagagattcaggagggggatattga

SEQ ID NO: 18456 - DNA, 543 bp, A.fumigatus
atcgttaggactctcggctgctcttggaccttattgtatttgctttttttttttttttttaagattgcgactccttctgaaatcaactatagttactctcgcctgagcatgagagctcgaacagtttcggcctctggccttgtgctctcatctcgaagaacaccttccacctcgatatgctggcaatgcctccgcgatgacctttccaaacaattgcagacacacgctcgaaactatcacccaacccggcggaaagatgcctcccccttcggcgctgccgtctctgcagcacagacaatcttcaaaggtctaccaaaggctcctccggggatctcggtggacccattgaggattgtaggaaaagagctcaagttcctaacgaaaaatattcgtcaattgctcggctcgggacatccgactctcgataaagtggccaaatattatacccgaagcgagggtaaacacatgcgtccccttctagtgctcctcatgtctcaagcgactgccgtcttcaccgggggtgcaagagcatcatgtcaacga

SEQ ID NO: 18457 - DNA, 2184 bp, A.fumigatus
atctctcaagacccgacaatgagcagttcaagcgtttacgagccagatgaagacgaagaagcgtctgattccgatatcgaatccaggtactcaagcacaaaattctcagcctcgtctctttcaatcgatgactttgaacgcctagaatcgacagagtccaaagacgaagacgctcgggaggtaatacccagatcgacaagagggacacgggctcagatactggatactttacgcacatcactcggaataggatgtgtggatgcatactcagttgaacttacaggaacagcaaacaatacttcgttttcaactgttggccgcgaaaattacaatcccactcaaaatggcgtcgcaatctggacttcacaagagaaggagattctgttcagcatgctcgacaggaaagggaaaaacggcgtcgcggaaattgcgcaagcaattggctcaaaatcggagttggaagttcaggagcatctgaagctcttacacagaggtctggaacggcaacacgtccgagattcccacagcaggaccgtcgtcctcggcgaagttccagcagcactggagattagtcaggaatgttgcaaggcacttgatgattacgctgaactattagctcttgaagagcagcgggctgaggatgttgttgggaggaagttacatcagaacctgtggatcgtcgaccgagaagtcgcggaaatggttgaggaacagttggaggaacgagatcagacacctctacccggctcaagcgtatatgtcactgccgagattttcaacatcaataaatggatcagactatctgaaaggttcttcatgaacgccggtggtccaaggttagaggacaactgggtcaacgtcgcctgcgctgacgagaccccttccataacagcggacgctcttgcggatttctacgctctgaccgtaagcgtaactcgccgtctggtacattctaccctgttcttcgccatgtcaagactacggaacatgagggagaccggaaaccgcaaagcacgaatagtgagatcgcgtgatgtgaagactgcactgaatgtgctcaacatgcctcaggatcacttcgacttttgggtggggttagcccggcggtgcagcttgcaagttgcagacctccgccacaagaaaggatggcagtcggagctgatggattacgacgaagtggaagagattctttcaggaaaagctccggtcgacgaatcccttgatgcaagaagcgcttccaggcgcagatctgagagtcaccctccgcacgacacagaagatgatgatgatgacgtatctgacgtctattcctatgcttcatccatattgtcatcgcctgaggtggcccctatcgatgagccgtcagttaatctcgaagaggaacacgcggaagagattgaccagctgaacaatgccgcagaagaactgcggctttggaatttaatggggcagccagccccagctagaatttcgtcgttggcttccaacacagagcaaggtttcaagttgcgcaagccgattggcgagcgcaagacgaaagaagacttggtcaattggcgcgaccggactttgtaccgaagcgactgggaggaatacggacacgaggttcacgatctctacgaagaattgtcagagaatagacgaaaaaggaggcgtattgacagacacatggtctcgcgaggatctcccatctcagtagccagtgacagagatcatgaagtgggtggcaatgacgattcgcagggtccaaggcattacgctgttaagaaccacctgagagccgatgatgaccgagacagcgacgatgcaatacagattgaagaaacaaatgatgcaatggacattgaaggctccaatcacgcggagtcgggttctgcaggcagcagagactcgaagatgaatatgggaacagatcctctccatcaaagtcaagagtttagcgatggggaacaaaatcatcctccttggtcttgggaacctgaagtcaatgccactgcgtccgagcaacaagattcaatcccgaacagcaaggaggaggttgttgcagttgaaacaagaaaactgtcaaatattggagtcgagtacgactttgattccgatgcttccctttggcgggaagaagcgctttttaccagaaacgaacgtctttccgggcaaaacccaaggggtggggcctgtgattga

SEQ ID NO: 18458 - DNA, 1812 bp, A.fumigatus
tttttctctcaacgctggcaggtcatcttcacagagctaatcggtcgcatcccgtcacgcaatgagataggcgacaagtctttgattatagtgcatcgaaaagagcttgtggaacaagcagcgcaacattgccgccgcgcataccctgaccgaactgtcgagattgagatgggccatagccatgcctcgggagctggggacatcgttgtcgcctctgtgcagactctgacgcgtggaaatagactagcaaagtttgacccgaaacggttcaaactgttgctagtggacgaagcgcaccacatcgtcgcttcctcctatcgagaagttttgaaacatttcggagcggacgaaacctctgcggattctccggttctcgtcggtgtctcggctacattttctcggagcgacgggctaaaactgggtgctgcaatcgatcacattgtataccataaagattacattgacatgatcaacgacaactggcttgccaatgcggtctttacgactgtccgctccgaggcgaacctgtcgaaggtgaaaaaggatagctttggggactttgcaatcggccctctttccaaggctgtcaacacggagaacgtcaataacatcaccgtgcgtgcatggcttgctaacgcgcaagaccgcaaatccacgctggtattctgcgtggacgtcgcgcacacaaaagctcttacggagaccttccgcaactacgggatcgatgcgcggtacataacggcaaagaccccaaaagacgtccggatggagcagctgcgtgcattcagaaacggagagtatcctgtgctgctgaactgcggtctcttcactgaaggaactgacatcccgaacatcgactgcgtcctccttgctagaccgacccggtcgcgcaacctcctcatccagatgatcggccgaggactcagattgtaccccggcaaggaagactgccacatcatcgacatggtggcaaccctcaacactggcgttctctccacaccaaccctcttcggcctacatccggacgaaatcctccaaaacgccaaagccaaagatctaagagacatgcctctcgaaaaaactacgaccgggactgggaccgccctagccggggaagaaacggaggaaccgccccccactcctgacgacttagacgtcaacctaactttcacaaaatacgacactatctacgacctgatcgccgacctcaaatccgaaaaacacattcgctctctcagcccacatgtctgggtccgcgtcggcgatcaccgctacgtcctctctgacgcctcaggctggctcacaatcgacaaggaagaagacacaagtcgagcgtacagaccccgactcaaccctgacccgacctctattgccaacacacctgacgaaccttacatctttaccgtccgccacgtcgccaaattcaagaactccgatgacagcatcatgcatacccgtccgcgactcatcgccacagcccccgacttcgagaccgccctccgcgccgcagatacattcgcaaccaaagagttcgaggaaagatacgtctcggtacggcagacatggcggcagctccccgcgacggaggcgcaggtgcgcttcctgaataaagcgaaggttcggcacgggtcgatccaaaggaaacatcttactaggggccaggcggcggatctgatcacgaagttgaagttcggtgggaagcagcggttcgaggcgcgcagggcagagcgacttgctgagttgcggaagcaagaggagatcgaggagttgagaaaacagggcgatgtgagggttgggccggttgagatttag

SEQ ID NO: 18459 - DNA, 408 bp, A.fumigatus
tcgccgacctcaaatccgaaaaacacattcgctctctcagcccacatgtctgggtccgcgtcggcgatcaccgctacgtcctctctgacgcctcaggctggctcacaatcgacaaggaagaagacacaagtcgagcgtacagaccccgactcaaccctgacccgacctctattgccaacacacctgacgaaccttacatctttaccgtccgccacgtcgccaaattcaagaactccgatgacagcatcatgcatacccgtccgcgactcatcgccacagcccccgacttcgagaccgccctccgcgccgcagatacattcgcaaccaaagagttcgaggaaagatacgtctcggtacggcagacatggcggcagctccccgcgacggaggcgcaggtgcgcttcctga

SEQ ID NO: 18460 - DNA, 600 bp, A.fumigatus
caagaaacgtccactggagcctccgccatgatctccacttccgataactcaaagagcttcgatagctttgcggagtacctcaagactcaaatcggacacactctcgctgctgggagtgtcagcaggggtctcgcgaagagcccaggcgacgtcactccaccatcccaagccaataaacccgccacccttccggcgctcgaggctttccttgaggcgacttgtgtgctcccactgcttggcggcaacttcggctctttcgataaccttgttgggaataccacacatggatgcgcagtgcataccaaagctaccttcagcgacgccgtcctccagtttgtacaagaaagtgatacgtctttcctcatcatcgacatgtattttcatgcgtttgggcgtgatctcagggtgaccatcgaattccgcagcgagagaatgatagtgagtcgcaaagaagcccattgctccaatatgagtggcgacatgatgcagcactgcctgagcaacagcgaccccgtcataagaactagttccacggccaagctcatcgagaatgacgagcgatcttggtgtagcttcagagagtatcttcttcgtctctga

SEQ ID NO: 18461 - DNA, 225 bp, A.fumigatus
tatgttagtccgcaagccaacaacggccgtagagctatcatgcgacgaaccatcatcagaatagccaacctcatcaccttgctcgaattcatcttcgctctctggggaaaccttgcgtcttttagaggcgcgattgtttcgtctgttgggcccgaatatcacatcatcgtcgtcttcaccctcagaatcggattcgacatagctgatctgtttcttggcctatag

SEQ ID NO: 18462 - DNA, 195 bp, A.fumigatus
cgatgggtcaagcttaataaagcagcgttatgcgcacaagcacaggatcccccactgttcctatccatcaccattccaggacaggatgtctccgacagacctaaggagcgcactcccacctctggtggtcccggctggctgatgcctagttgcaaacccaggcttgagcaatttttgctcctccattgcagttga

SEQ ID NO: 18463 - DNA, 696 bp, A.fumigatus
acatgtatcgccgttatcatggctcaaatcggctgttacctgccctgccggtccgctcggttgacacctgttgatcgtatcatgtcccgtttaggtgcgaatgacaacatctttgcagcccagtccacattgttcgtggagctttcagagacgaagaagatactctctgaagctacaccaagatcgctcgtcattctcgatgagcttggccgtggaactagttcttatgacggggtcgctgttgctcaggcagtgctgcatcatgtcgccactcatattggagcaatgggcttctttgcgactcactatcattctctcgctgcggaattcgatggtcaccctgagatcacgcccaaacgcatgaaaatacatgtcgatgatgaggaaagacgtatcactttcttgtacaaactggaggacggcgtcgctgaaggtagctttggtatgcactgcgcatccatgtgtggtattcccaacaaggttatcgaaagagccgaagttgccgccaagcagtgggagcacacaagtcgcctcaaggaaagcctcgagcgccggaagggtggcgggtttattggcttgggatggtggagtgacgtcgcctgggctcttcgcgagacccctgctgacactcccagcagcgagagtgtgtccgatttgagtcttgaggtactccgcaaagctatcgaagctctttga

SEQ ID NO: 18464 - DNA, 2634 bp, A.fumigatus
gccaagaaacagatcagctatgtcgaatccgattctgagggtgaagacgacgatgatgtgatattcgggcccaacagacgaaacaatcgcgcctctaaaagacgcaaggtttccccagagagcgaagatgaattcgagcaaggtgatgaggttggctattctgatgatggttcgtcgcatgatagctctacggccgttgttggcttgcggactaacatactagtagagatggacgactttatcgtagcggacgactccgatgaggaagctaagccatccaagaagcgtaagaggccgtcaaatgcgacgactcgcaaggcgtcctctcctcccgctcctccttctccagtagaagacctcgacttgggtgttccagacgcctcctcaggcacagctctgaagtggacctatgatcctgagaatcttgaaccccgccagaaccgggaaatacaagctacacagaaaagtaacgccgctcctgccaagcagaaagtgcatctcaaggagcctgaagagcgctatccttggctcgcaaacattcgggacattgaaggacacccaccagatcaccccgactatgaccctcgtactatatatatacccccactggcttgggcaaagttttctccttttgagaagcagtactgggagatcaagcaaaagttctgggacacaattgtctttttcaagaaaggcaaattctacgagctgtatgagaacgacgccaccatcggtcaccaattatttgatctaaagctcacggatcgtgttaacatgcggatggtcggtgtgcctgagatgagcttagatcactgggccaatcaattcgtggccaaaggtttcaagattgcccgcgtggaccagtctgaatctgcattgggtaaagaaatgcgtgagcgagacggaaagaaggctggcgggaaagaagacaagattataaagagagaattatcctgcgtccttacagcaggcacattggttgaaggctctatgctgcaggatgatatgtccacctattgcgttgcgatcaaggaagccattgtagacgaccgccctgctttcgggcttgcgttcgtcgacacagcgacaggccaattctctctgtcagaattcgtggacgatgttgacatgaccaagttcgagacattcgtcgcacaaactcgtccccaggaattgcttctggagaagtccacgatttctcagaaagctctacgcattctgaaaaacaacactggtcccaccaccatctggaatcacttgaaacctggaaaagagttttgggaagcagatataactgtgaaggagctcgatgctagcgaatattttgtctctcaagatgacgataacttacaagcgtggccggagactctgcgagaggctcgagacaaggaattggttatgtctgcgtttggagccttggtccaatatctcagggtgctgaaactcgaccgcgatctgatcaccataggtaacttctcatggtatgaccctatcaggaaagcctccagcttggtccttgatggtcaaactctgatcaacatggaaatattcgccaactcatttgatggtggctcagaggggacactcttccagcttctgaatcgctgcatcacccctttcggcaagcgtatgttcaagcaatgggtttgtcatccattgatggatgcaaagaagatcaatgcgaggttggacgcagttgatgccctgaatgctgattcaagcgttcgagaccagttctcttcccagctgaccaagatgcctgatctcgagcggcttatctcccgtatccatgcagccaactgcaaagcacaagattttgtgcgtgtgctggaaggattcgagcagattgaatacactatcactctcctcaaggataacggctcttcgagtgaaggagtcattgggcaactgattagcgggatgcccgacttgagttccctgctggaatattggaaaacagctttcgaccgcactaaggcgaaggaaaatggcatcctggttcccaaaccaggtgttgaggaagacttcgacacctcccaggagcgtattgaacaattgcaccgggatcttgacaatctcctcaaacgccaacggcgtgagctggggtccacagccatatgctatcgtgacaacggaaaagaaatctatcagctcgaggtgccgatcaaggtgaagaatatccctaagaattgggaccagatgtccgccacgaaacaggtgaagcgttactactttcctgaactgaggtctctcattcgcaaattgcaagaagcccaggaaacgcacagtcagatcgtcaaggaagttgccggtcgattctacgcacgattcgatgagaactacacgacatggcttgcagctgtccgaatcatctcacaactggattgtctgataagtttggccaaagcctcgtcgtccctgggtcacccaagctgccgccctgtgttcgtcgaagacgaacgcagtgtgcttgaatttgaggagttgcggcacccatgccttctgtcgtcagtggaggactttattcccaatgacgtgcgtctgggaggcgaagtgccgaatatcaatctcctcaccggtgctaatgctgccggaaaatccacgattcttcgaatggtaagcaggcaaaaatga

SEQ ID NO: 18465 - DNA, 795 bp, A.fumigatus
tctctcacagttcaatacctcatcgcaaagcccagtatgactgactcgcagaccacagaacgccaacgaaacagcctatcaacgcacagggattcggatccccggcctccatatgactcgatcacaccacacgccatgccgccaacgccgccattgcgtcccggttcgggcttccacagtaatggccattctccctcgacatcatctgtctctgccgctagctccagtgctttgatgaaaaacacagaatcgtatcctcaggcgccaattgggcttcctagtccaacggatcgatcctcgatctcgagccaagggtccgttcagcatgccgccagcgctccatatgcttcgcctgctcccagcgtatcgtccttctcttctcccatcgagccctctgcaccatcaactgccgcttactaccaaaaaaatcctgcgccgaacaccttccaaaacccaagccccttcccccaaacatccacagcatctcttccctccccgggtcatcaacagatgatttctcccgtcacccccgcctggcaacatcaccactacttccccccgtccagttccacgtcttaccagcagaaccatgatcgctacatctgccggacatgccacaaggccttttcgcggccctccagcctgcgcatccactcccacagccacactggcgagaagcctttccgttgcacacatgccggctgcggcaaggccttcagcgtacggagcaatatgaagcgtcacgagcgtggttgccatacgggccgcccagttgctaccgccatggtccaatag

SEQ ID NO: 18466 - DNA, 183 bp, A.fumigatus
atgtcattagacgcgactgattgggtagatcatcgagagcaaacctcggttcattcgcctaagaaacctaaattctcactacagagtacctggtcttggaattctaagaaaacgactacagagtacgtacgcaagacggtgccactaaccgccggtcgcaccccttttagcctccaactttag

SEQ ID NO: 18467 - DNA, 225 bp, A.fumigatus
cctggcgagacctcaatcgagttactgaagctcatagctaccaccacaaaaatatcaaggtccccgtgggcgtattccacccgcacaaagtatctacgaaacgtctgtatcctgtactccgcgtcaggaaccgactttactccgaccattgttcaaaccttccagaacatactccgtaacgtaaagaaagagctatcgcacaattccatagagactgagctttga

SEQ ID NO: 18468 - DNA, 279 bp, A.fumigatus
caagctctgaagacgcttaaactcttgctcgtttatctcgtacagatggggactgtatccttccagaaccgtgatatcaagactgtttgtgggatcttcttgtatcagggaatgtcccactggtctctgcgttacattggccaatcccgcacgcacgagctgtgcttcaagctcaccggccaattctacttgcgcatagttagcaggatcaaggatgatacttatcttcagcgacttttcaaccgcgggcgtatcatcaacggcagtcgagagaattag

SEQ ID NO: 18469 - DNA, 192 bp, A.fumigatus
gtcgcgagctgttatatcggtatcctatatttgcggacagtctcgcgggagtccgcgaagtacctgaaaacactagggtgcacctgggatctgctaagtaattgccgtctcaagtctcattcagcctgtatcaagatggcttacgatgatctccagacgagctacaaaagtccaaatctgataccaacgtga

SEQ ID NO: 18470 - DNA, 1080 bp, A.fumigatus
cgcagatactgcgccggaggtctttcaaaacagtctgcgttgaaagtttcatattacagaggtttcttggcggcaaagcttgaaaagcttagttcaatgaaaggttccatgcttgcggtaggactatccaagaaggacaccgaagaatatatcaataggatccaagattcgacactagtcgtcgcctgtatcaacagtcctaaaagcgtgacagtgtcaggcgaagcagagcaaattgacaccctgcatgatctactacagcaggacgaggtcttctcacggaagttgatggtcaacgtcgcatatcactcatcccagatgcagaaactcgcagacgagtatcagtctgcaatgggaacgttggagaagccgagctgtgagaagaagaagatcccggtcatgttgtcttctgtaactggagattgggtctcaagtcttgagctgatggaccctgcatactgggtacggaatatggtgtctccagtgttgttctccgatgctgtgagccgcatctgttcttcttcaagaaagcagaccaggaaaatcgatcgaagccatcgctatcacatggctatcaatcatctcttggagattggcccgcacgcagcattgcaaggcccatgcagagatatactcaagagcatcaacaagcaagccgatatcccttatctttcagttctagtacgaaataaatctgctgtgaagactgccctggactgcgcaggtcgcttgcattgctacggatacccaatcaatctggcactggtcaacaaaactgcctacagtggaactaaccaaagacatgtgctcagtaaccttcccgaatacccgttcaaccattctgcatcatactggcgcgagagccgaaaaagcaagggctacagatgcaggagattcggccgtctggaccttgtcggtatcccagatccagatggcaaccccatggaagctacctggaggaacatcatccgagtctctgagatgccgtgggttcatgatcacaagatcaataatacaattctctacccggcggccaggcatgttggtcatggcggtggaagcgatcaagcagcttgttga

SEQ ID NO: 18471 - DNA, 402 bp, A.fumigatus
aaaacggttcctggtagagaagtacaacgttcccgagaaccatatcttctcgagtcgaagcacgctattcgccaaaggaatcaagcttcctcacaaacaacaaagggcgtcgatgtagttctcaattcgttgtcttccgaagggcttatcgcttcttgggagtcaatcgcaccgtacggtcggttcatcgaaattgggaaaaccgatatcttgtccaacgcaaagctcccaatgttgcaattcgagcagaatataacttttgctgcggttgatctgggccgcgatgacaatggatcgcccacacgttgtgacagcggcactggaaactatattgtcattgttaagggaggggaagatctcccttccggatccacttcaagtctatggcatatcagacattga

SEQ ID NO: 18472 - DNA, 861 bp, A.fumigatus
gacgctcatttagaaggcatatctttcgaatcctggaaagcttctaccacgcctaaagcccaaggctcgtggaatttacacgagcttcttccgagaagaatgaattttttcgtgttaatgtcatctgttgctggaatatacggcgcacgaggagcatctggttacgccgctggcaatacgtttgaagacggcctagcacggtaccgcgttgcaatgggcgagaaagctgtgtcgtttgaccttgggatgtttctgaacgttggtgtcttaaaagacaacttggcgctccgagaaaggacgttggcaagtactgtcttccagcagatcacagagtctgatcttcatgcgctgctggatatctactgtaatccaagtctggacgagattccattgttgaaaagtcaggtggtggttggaatgactccaaagctgcgggagaaaggcatgacaaccacggaatggatcaggcggccattttaccaacatatgacattggccgaagggacggacgctggcattcttgggaaggcggagcataccaatttcgctgctctcttcgcaagcgcaggatccgtagccgatatcactgcagcagtgacagagcagctgaagatcaagctctccaagatgctctcattacctcttactgagatcgacgttgacaagcccatacatcagtacggagtcgattccctggcggcagtggaactgcggaactggttctcgagagaactccgtgcggacatcgccatctttgacattcttggcggcgcgaacatcgcctctgccgttggacttgcagttcggaagagtgactaccgaagagcagagtgggatcttgaccgagctcaattgaagtag

SEQ ID NO: 18473 - DNA, 450 bp, A.fumigatus
aaaaaaatatcgaaaggcaaaatgacgtccaaatatcgagttctccatataggtgacaacatcaagtacaaccacgatgtttacgagcgcttcgcctcggaattcgaaatcatccagcccacggccgcagagcgcgaacggggcgaattcatgcgggccctgaaagagcgtcgctggggggactttcatgcaattttccgccccttctggaatacaggtggtgaaatgggccggtgggacgcggaactcatccccctcctcccgccgtcagtacgcatcatggcctccgcaggcgcaggctacgactgggccgacgtatatatcttcgcacagcacggtgcgtgcgctcccaacccagcacggaggcagaatcacctagctaacagcgatgataaggaatcgtatactgcaacggcgccgccgcctcctcagaatcagtcgccgacatga

SEQ ID NO: 18474 - DNA, 1698 bp, A.fumigatus
agactgccctggactgcgcaggtcgcttgcattgctacggatacccaatcaatctggcactggtcaacaaaactgcctacagtggaactaaccaaagacatgtgctcagtaaccttcccgaatacccgttcaaccattctgcatcatactggcgcgagagccgaaaaagcaagggctacagatgcaggagattcggccgtctggaccttgtcggtatcccagatccagatggcaaccccatggaagctacctggaggaacatcatccgagtctctgagatgccgtgggttcatgatcacaagatcaataatacaattctctacccggcggccaggcatgttggtcatggcggtggaagcgatcaagcagcttgttgagccagacaaagtcatcgtgggcttcaatatcaaagatgccgtgttttcatctgcactgcatatacctacacatgcggacggcatcgagacaaatttacacatgaagcgcgtcagagaaggaaaggcagatagtagcggctggtacgaattccggatatgttcgtacgacaacaacacctggattgagaactccactggctctattcaagctgcattcgagtctggcgagatgggactgaataccaacggccgagtggaacacgagtggcagaagggccttgtgcaatcatatcagaatgcagcatataaatgctcggaacccatcgacgcatcccagttctacgaagatatatttgcctgtggctaccattatggaccaaacttcaaggcaatcacagctctccggtgcgatggaaagcccaatggccaatttgtctcggatgtccgcacctacaggtgggtggaggacgcgagctcagcagttgctcagcctcatacaattcaccctaccacattggacgccgttatccacatgatggccggtatcgtgacgtacggaagccagaaaaagcctgtggctgttccgacacggattgaccaagcttggatatcgaacagcgggttgagccatccgacagcagatagtatcaaggtgcatgcgagttctcacaggtcagctactggggatgctcggtattcaatgactgcagttgattgcgagatgacgcgtgcactcctgaccatcagaaaccttagagtcacagcactggaaagctcagagggcgtttcagaagacgatcaactgcagacggagaacctgtgtcaccatatagaatggaagcctgacctcgacttgctggagaacgaggaaatccgagcattttgtggaagtggggagtcaatcagcgaagacccagtccagtactttactgaattggacttccttgttacaacatatgttgacaaagtgctgaagtcgatccccgacgtcaagatcgatcaccctccccatatgcagaggtacatggagtggatggtagatcagcaaagagcacttgagttaggttactctcccttcagctctgcaacatggaggaaccgcatgaaggacgagagcttcgttaacgacatacatgcaaaacttgagagcacgaacaagcgaggactacttgtgagcacagtctgtaggaatcttttcaagttcgtcaaaggagaaatcgaccccatggttctcctattccaagaaaacctacttgatgactcttattatgaaatggtaagccagggcgccacgatgacatttcgaatgacagccagatga

SEQ ID NO: 18475 - DNA, 1572 bp, A.fumigatus
ctgatatcatctcctacagtgggggaaagcttatactcatcgaaatcacccggccgggcgctatccggacgacgtttgtctttggcttgtttgaaggatggtggcgaggtacgtctttcccttctctgccctaaagctgaaattgcacaagcttctctgacactctcaggactcgagccctaccgtcagaagaatccatgcgcagacccagcccaatgggacagacacttgaaggaagccggattttctggctgcgatgtcgtgatggacgactatagccacggtgactgtcaggaggctagtctaattctctcgactgccgttgatgatacgcccgcggttgaaaagtcgctgaagataagtatcatccttgatcctgctaactatgcgcaagtagaattggccggtgagcttgaagcacagctcgtgcgtgcgggattggccaatgtaacgcagagaccagtgggacattccctgatacaagaagatcccacaaacagtcttgatatcacggttctggaaggatacagtccccatctgtacgagataaacgagcaagagtttaagcgtcttcagagcttgctatcttctacgaggaatcttatctgggtaaatggtgggggcggacaagaaccatgtcccaaatatcggctcgtggacggactgtttagagtcctcagagaggaaaaccacaggacaagactgaccatcctctccctggatcaaaaggcgtcgatcaagcaccaggcacaacagattgccaaactagcgatctctgctgtgactcatgatactagcatcgacacagattacacagagcttgacggcatgcttcacgtcggccgcctggtccacgccactggggtcaaccaggaaatttcagcaaagaagctccctcaacagaaagcattacgacagttcggtgctgggccccggctcagacttgagatcggctcccctggtctgttgaacactctccacttcgtggaggacacttcacaccggaagccactcaaacctacagaattcgaagttcaagtgaagagtgtcggtcttaatttccgggatgtcctaattgcactgggacggttggacagtgaggcactgggggctgaattcgcaggaatagttacaaaggttggaccctcatgccgcaagtttcaaccgggagacagagttttggcgtgttatcccagtcggcacgcaaactatgtccgtcttaaagaaaatatggccgtcataaagattccagacactatgctctccttttcagaagccgcagctttgccagtcgcgtatgccacagcgtggatcgcgctcaatcaaatcgctcgacttcaacaaggagaaacaatcctgattcattcaggtgctggaggaacggggcaagctgccatccaaatcgctcagctcctcggtgcgagtgttttcacgactgtctccaatgagaataaaaaacggttcctggtagagaagtacaacgttcccgagaaccatatcttctcgagtcgaagcacgctattcgccaaaggaatcaagcttcctcacaaacaacaaagggcgtcgatgtag

SEQ ID NO: 18476 - DNA, 210 bp, A.fumigatus
tctccagacgagctacaaaagtccaaatctgataccaacgtgaataaccccgcttatggccaacctatgtcgactgctcttcaggtcgctctcgttgatctgcttgacagctggggagttgtcccgtcggcagttgtcggacactcctcaggagaaattgctgctgcgtacttttgcctcccaatatattcattatttcaatgtgactga

SEQ ID NO: 18477 - DNA, 372 bp, A.fumigatus
cagccagatgaccatgatctgcaggttcactctctcccgcgtattcggcaatttgctcggtatttggatgctcaggctcacaagaatccacacatgaaaatccttgaagtcggtgctggaagcggcgccatgactcaattctgcctcaaggtcctttctacaaactcggaaaacgatgccacggtgcctcgctatggtcaatggaacttcacggatatatctgggtcattctttccgaaggcacaggacctgtttgcatctcagggcacgcggatgaggttcaagatgcttgatatcgagcaggatcctgggctggagggattcgaatgtggaacatatgacatggttgttgcatttctggtgagctcatga

SEQ ID NO: 18478 - DNA, 432 bp, A.fumigatus
accgtcctggaaacgagaccagagtacctgtttagtccgaatgaaacatatctcatcgcaggtggcctaggcggcttagggaggaacatcgctcgctggtttgttgagaggggagctcgaaatctaattctactttcgcgatcggggtctcagaacccacatgcccccgacctgatcagagagctagaagccaaaggcgcaagagttgctacgcccgcgtgtgacattacagacagggaatgcctgaaagccgtcttgtacgagtttggtcagacgatgcctccgatcaaaggatgcgtccaagcatcgatggtcgttagtgtaagtttgataagtcgatatccaagaacgttgactgacatctttgctttcataggacgctcatttagaaggcatatctttcgaatcctggaaagcttctaccacgcctaa

SEQ ID NO: 18479 - DNA, 540 bp, A.fumigatus
acttttccactaagttcagagagcttttccgcgcgcttgcgcaagagaactggggcgtacgtttcgggcaaaaacacacaaaggcatatccaaatgacacccgaaaagatggccaagaacccttccacccagcgccaaccagcaccagagccaaggaagcctccaatgattgggccgatagctggtccgcaaaggggtgcggcagagaagaggctgatagcaatgccccgtttggcggccgggaacatatccgcaatacttccacctgcattgccaaatggagacgatccgaagaaaccagccaagaatctcagtatgatcaatgtttggatattcccagagccggcacatccggcattgaagtcagtaagtaagcagaaagtgatcgtaaaaacgttgcggcgaccaaatacttcgctcattggtgcccaaatcagcggtccaaacgcaaatccaaggacgaaaagggatattcctagagtggtgacttctcttgaagagtccaactctttcataacctcggccatgcctcccgagtag

SEQ ID NO: 18480 - DNA, 1554 bp, A.fumigatus
aatatccaatcaaatcagaaatcgataggtgagtttatggactgtcaaaggtcgaatattaacctactacctttatgttatgcgggctctaacaaggaaattggtacagttgtcgcgccaactatggctggctttgaaggcgaggcaccccaagcctccaagattccatattggcgcttggtctttgatccaaaggtggtcaccgacgaagtgattaatcatccttacgctggaagaggtaccgatgatgatccctttgttgttgtttggatttctggcgactcgcgcaatccgatgaatttcagctcttttctgaaatggtcgctcacgatcctggtctccttgactacccttgcgattgcgctgatatcttctgcctactcgggaggcatggccgaggttatgaaagagttggactcttcaagagaagtcaccactctaggaatatcccttttcgtccttggatttgcgtttggaccgctgatttgggcaccaatgagcgaagtatttggtcgccgcaacgtttttacgatcactttctgcttacttactgacttcaatgccggatgtgccggctctgggaatatccaaacattgatcatactgagattcttggctggtttcttcggatcgtctccatttggcaatgcaggtggaagtattgcggatatgttcccggccgccaaacggggcattgctatcagcctcttctctgccgcacccctttgcggaccagctatcggcccaatcattggaggcttccttggctctggtgctggttggcgctgggtggaagggttcttggccatcttttcgggtgtcatttggatatgcctttgtgtgtttttgcccgaaacgtacgccccagttctcttgcgcaagcgcgcggaaaagctctctgaacttagtggaaaagtctaccgtagcaagctggacatcgaacgaggtaaactgtcgctgcagcagaccttgactactgcgctgtcacggccatggcgtcttctgttccgtgagccgatagtgtttctattttgcatatacatggctatcatctacggcatcttatacctttgctttgccgcctttccgatcgtcttccaggaagcccgcggttggaatgaaggtattggaggattggctttcctaggaatcctggtcggtatggtcatcgctgtcatctacacgtttccagagaacatgcactacgccaaattgtgcagacaaacaacgggtcgccttcctcccgaggtccgcctggcaccaagtatcgtcggtgctattgccttgcccatcggtcttttttggttcgcctggaccaactcgccctcaattcactggatggtctcgattgccgctggagcaccctttgggttcgggctagttctcgtatttctcagtgtattcaactatttgatagatgcatatactatctactctgcatccgtgctggcagcaaactccgctctccggtctctctttggcgcagcctttcccctcttcaccagctacctctactcagggctgggtgggtcacgtgatatcaccgtttgttga

SEQ ID NO: 18481 - DNA, 444 bp, A.fumigatus
ccactcgctaattgcttcgtagggattcattgggcgtcatcgattcctgcgttcctggcactagcgtgtgttccgatacccatagtgttttatctatacggcgcgcgcattcgaaagcgatgccgttacgcggccgaggccgacgcattcatgcaacgtcttgtacagagcaatcaacaggaagctcagcgcgaagagcctgtcattgagaaggccaatgctgcggtggagcctgctacggttgacgtggaaagagatagtgagactggcagtctctccactgttccatctgcgattgatatgagtcggaaagcgtcttgcgtgtcgaagatatccgggcgctggctgggtcgcacggcgactcagtatgaggagaatccgtatgatatcgatcgaataaacactcgcaattctgcgataagtggacattatcagagggattag

SEQ ID NO: 18482 - DNA, 273 bp, A.fumigatus
aaaaatatatatcaattgctactctgtagtttagcatcgattcagtacgtccatgtcaaggctactccgtattttcaacagcatactgtgctgaccgtgtcccaccaactccattggctctattcgcattatacagacgactactcccctatcctaaataatgatgatctctcttctgagttacaacactgttctttatcagaacacgtgatacacaccatcgcccataacgcgtgcgtggaatattcattccacccctttcgtggttcatag

SEQ ID NO: 18483 - DNA, 1281 bp, A.fumigatus
gggggagcggaaccctgttcccgattggacggctttgaagccaaagggagcggatcattcggcgaggtggcttggtttgacgggggagccacgacgtcggggcgttcaaggggttcaacccgggtgcaggaccgggcaaaaaggtcgtcgctggtggatgtggcttcgctcaggtccaagacaattagtgagcgcgacggcacggacggatggctggataacgtgctctccatggcgtacatcgggcccatcggcgagtccaaggaggagtactacattgacatctcggaccagtccggctgggcgcatctctggctgtttcctgtcgctggaggcgagcccatcgccctgaccaagggcgagtgggaagtcaccaatatccttagcatcgacaagccgcgccagctggtctacttcctgtcgaccaaacaccacagcaccgagcgccacctctactccgtctcctggaagacgaaagaaatcacccccttagtcgacgacaccgtccccgccgtctggtccgcctccttctcctcgcagggcggatactacatcctctcttaccgcgggcccgacgtgccctaccaagacctctacgccatcaactccaccgcgcccctgcgcaccatcaccagcaacgcggccgtgctcaacgccttgaaggaatacaccttgccgaacattacctacttcgagctcgcccttcccagcggcgaaaccctcaacgtcatgcagcgcctccccgtcaagttctcccccaagaagaagtaccccgttctcttcaccccctacggcggtcccggcgcacaagaagtctccaaagcctggcaagccctcgacttcaaggcctacattgcctcagaccccgaactcgagtatatcacctggacggttgacaaccgcggcacgggctacaagggccgcgcattccggtgccaagtcgccagccggctgggcgagctcgaagccgccgaccaggtcttcgccgcgcagcaggccgccaagctcccttatgtcgacgcacagcacatcgccatatggggatggagttacggcggctatctgacgggcaaggtcatcgagaccgacagtggggcgttctcgcttggtgtgcagaccgctccggtttcggactggcgattctatgattcgatgtacacggagcggtatatgaagacgctggagagcaacgcggcagggtacaatgccagtgccgatccggaaggtagcaggctacaagaatgtgcgtggtggggtgctgatccagcatgggacgggtga

SEQ ID NO: 18484 - DNA, 405 bp, A.fumigatus
aggaatacaccttgccgaacattacctacttcgagctcgcccttcccagcggcgaaaccctcaacgtcatgcagcgcctccccgtcaagttctcccccaagaagaagtaccccgttctcttcaccccctacggcggtcccggcgcacaagaagtctccaaagcctggcaagccctcgacttcaaggcctacattgcctcagaccccgaactcgagtatatcacctggacggttgacaaccgcggcacgggctacaagggccgcgcattccggtgccaagtcgccagccggctgggcgagctcgaagccgccgaccaggtcttcgccgcgcagcaggccgccaagctcccttatgtcgacgcacagcacatcgccatatggggatggagttacggcggctatctga

SEQ ID NO: 18485 - DNA, 336 bp, A.fumigatus
agacgctggagagcaacgcggcagggtacaatgccagtgccgatccggaaggtagcaggctacaagaatgtgcgtggtggggtgctgatccagcatgggacgggtgacgataatgtgcatttccagaatgcggcggcgctggtggacacccttgttggggcgggagtgacgccggagaagctgcaggtgcagtggtttacagactcggatcatgggattcggtaccatggggggaatgtgttcttgtatctgcagttgtccaagaggctgtacgaggagaagaagcggaaggagaagggtgaggcgcatcagtggagcaagaagtctgttctgtag

SEQ ID NO: 18486 - DNA, 2211 bp, A.fumigatus
tttgtacagcccggtcagaatgaaattaccatcattgggctcgatccccgggttgaccccgattccatccgtgtcgatggctccggttcagcaaccatcaccgacatccagaccgacaaggttcctcgacgggagagtttcgaggacgtttaccccgaagagtcggacagtgagctgagcgacgcgttagtaaccgactcggatgaagatatcggcgtcgacgattcggagctacaggcggtacgaaaagaaattgcagaggtggaggccgctctcgccaaagctcgcggcaatcaagtcatgtctgtcgccgtttcagacttcatggatgggtacgggaagaaactgagcatggagaatgcggacgcagcgaagttgaatgattttctccagctttatgtccagcagcactcagtcgaatgcgaccgctaccaccagtctttggtgcagataaaagaggcggaaaaaagcctagatcgcctcaatcgaaagcgagcacggctggaaattgcatatagcaaagccaaggaggcagctctgaaggatgttcgtaaagaacgcaaaaagcgcctgcgagagcgcgaagagaaaaagaagaaaaaacagcagttgcgatccgagcgaaagcagttctggacccagaccgtcagccaggtcatcgtccatctcgacagtcactcaatcatgactccgggatcaagccgacgcagctcgatcgtgggaaaggctggaagcgacgccgatgctatagatgtgacactgcgtctgacatatgtgattcccggtccttgctgggtgtctcgctacgatctcaggatcagcactccttcttcgtcggctcgtctgacctaccgcgccgagttccacaactcctgctcggagacatggcgggacacccaggtgattttgtccacctcccaggcttcattttcggggctcgaggagcgcattccgcaattgcaaggctggcatatcaagctggatcccaacagcacaggcctgccttcgtggaacaacatcttgcgcagcctcgatgaatcgggtcaacctcatgcgcaggcaaagttccttagacaacagcttgcagaaatgcaaaaggcaaatcaacagcggcttaataacatcccgcgagtaccgatgcaggcacaacaggctgcgcccgcctcactgtttggaggtgcacccgcaaaaccagcgtttggacaaccatcgttcggccaagctccagccgcatcagcgttcggagcgccaccgcgcgcggccgctgagtccagcttgttcggcttagacgcaccgcaacagcaagcacaaagtcagcaacaacctcagaccatgccggtgatcgagcggggcgagaggctggacagcctacctgcgtctggtttcgggatggccatgcagtcacaggcagcgccatctgggagctccaatttgaaccctggcaaccaagatgatagagaggacgaagacgaggacgaggatacccaaaccatcgcggcagcgagtctggaacaccaagactccgtcaaacaagactacggcttgactacaacgtatgacctcccagggcgccggacgctcgtaccgtcaaaggtgcatcgacgacacgtcctcgccgagctagacctaaagtccatgactcttacgcacatcatcgtgcccaagatccgcgcggcagccttcctgcgcgcccgcatccagaatacatcgtctgtaaccatcctccgcggccgggccggtatgaccgtcgatggcaccttcctgggaacgaccaacttgcccaactgctcgccgaatgacgccttcaatatctccttgggcgttgatccgtctatcctggtgacgtacgcgaagccgtccgtccgccgcgtcggaggcgggttcttcagcaaggagcatacggccgtcttccggcgggcctgctgggtgaagaacaccaagagcattgccgtgaatctcatcgtgtccgagcaggtgccgctaagcgaggacgagaagctgcgtgtgcagatcctggagccaagggaactggaaaaggaaggcgatcaggcgaagatggcgatggagggtaagggcagcggcagcgtatcactagccaagaatggcgaggtcaagtggacgttcaagctgcagccgggcaaggatatccgattgacactggaatatgaagccagggttcccccgggcaatgaggtggaggttgtcagatag

SEQ ID NO: 18487 - DNA, 336 bp, A.fumigatus
acccccttccagaccatcaagcgtcagcagcccagcttcatccaggccaacgctcgccaggtcttcgccaacgtccagtcccgccgccagtactcctctgaaatcgccgacgccatggtccaggtctcccagaacatgggtatgggctctgccgccatcggtctcggtggtgccggtatcggtatcggtctcgtcttcggtgccctcctcctcggtgtctcccgcaaccctgctctgcgtggtcagctcttctcctacgccattctgggtttcgctttcgtcgaagccattggtctgttcgacctgatggttgccatgatgtgcaagtacgtctaa

SEQ ID NO: 18488 - DNA, 642 bp, A.fumigatus
ctcgataacgtcttcatatgccgccgagggccaagctgttcccaatcctgcaatggctcccccgggtgcctttcccccaccgttcggattccctggtatgtaacatcaccttcacatgtgaacaattttcttctctttgtgtcaggaaaagcacttaccaatatccctggctcaggtcgccccggtcagctcccacctcctccattcggcattcctccccccggagggcccaatggagctccccccggcatgcccattcgtacgtcctcaccctctatcatcctatttttatttttccgctctaacactgacactccaacagcaccacctggcggtagaggcctcccctttccacctcctttccccccagcaccaggcggcgcccctggaggccttcctcctccgcccctcggcaacatgccccctggtcaaggatttcctcctgtcccgccacctggcggattcccgcctaattttcagattcctcctcccggcgctgggggattccctcctgtccctcctcccggccagcctggtttcagcccgagccctgggcccggtatgtcgggtcccccggcgccaccggggacgggctcctcgagtttgccggggcctcctccgggactaagtgaaaagcgatga

SEQ ID NO: 18489 - DNA, 321 bp, A.fumigatus
ctgtggattctgtgcacaggtgactactgtgatgtatatctcacgcacgactcgatgagcgtgcgtaaggcacacaatgcgggtcggaatcacttgaggaacgtggtggaatactatcaacgtacgcagcccctacccttccgcagccacagtctgtcgctgacggtgctgacaattggtacagagattgggcaggaaaaggcacaatccgtcattgactcgataacgtcttcatatgccgccgagggccaagctgttcccaatcctgcaatggctcccccgggtgcctttcccccaccgttcggattccctggtatgtaa

SEQ ID NO: 18490 - DNA, 234 bp, A.fumigatus
agatctaccgatatgaaagcccgaataacatcacaagtaatacgacacaatgaccagcccgaactcaatcatcgcttttcacttagtcccggaggaggccccggcaaactcgaggagcccgtccccggtggcgccgggggacccgacataccgggcccagggctcgggctgaaaccaggctggccgggaggagggacaggagggaatcccccagcgccgggaggaggaatctga

SEQ ID NO: 18491 - DNA, 582 bp, A.fumigatus
tcacttctggcaccctaccaatggattcgtcgagtgagtaaacgattttcggcctgcattgagctcgcgcttatgatgtacaggtatgtcgaccgtaaacaagcagagtccctcaatttgatacattctacaggctcatctgtaagcatcagagtcgacaacaaaacccgcgtaggctacgcgccccgaggcagaaagtccgtccgactcgagtccaagaaaggctacgacatgggcctattcatcttcgacattatccacacaccctacggctgcggaacctggcccgccctgtggctcgctgacacatacaactggccgctcaacggggaaatcgacgtcctcgaaaccacaaacagagctacagaaggcaacgtggtctccctgcacaccgataagggctgcaccgtcaaggaaagacggaagcagctgggcaacgcgcagtactcgacgtgcgatgataagcacgggaacgcgggctgtactgttcaagctcgccgggccacatacgggcaggagctcaatgaagatggcggtgctgtatggcttccgtcctctgcctttttaggtcaaaaatactga

SEQ ID NO: 18492 - DNA, 1131 bp, A.fumigatus
gtcatggtcattgtcgctctcttcaaagccgggtgtgagatcctcgccaagaatggaaggatgaagagtgacaagttttctgatttccggaatggctggaaagtcgtggcacgaggcattttgttccgactgaccctgattggtttcccccagatgtgcgtgctgtgtctctgggagtttacccagcataactcggccgctgagatggtactggcggttatcatgtttttgtcagtgctcggcgctctgggttgggctgctttcaaagtaatcctcctagccaagcgctcggttgtcatgcacaagaacccagcatacatcctctattctgatcccacatgcctgaacaagtggggatttttgtacgtgcaataccgtgcgactgcctactactttgtggtgccggtccttttgtaccttcttatcaaggccatgttcattggccttgggcaaccctctcctgttgtgcagaccgtcgccctggtcatcatcgaggccgccatgctcgttgccgtcagcgttctgcggccttggatggacaaaaagacgaacatctacaacataactattgccgccatcaacttcgtcaatgccgtcttcttgctgtttttctcagaggtcttcaaccaaccaggaattgttaccggcgtcatgggcgttgtattcttcgtttataacgcggttttctcgctggttctattgattctggtgcttatcgcatccatctacgccattgtatcgaaaaaccccgatacccgttaccagcccatgagagacgaccgtggctcgtttatcaaatcgcagagccaattgactacggaattggacgccctgggtgccactgcacgcggcgatgtcaaggacacgtcgtacaagtcgagtcccttcgacgacgacaatggctctttctcaagcggcaatggagccagcattggacgtcagaacctgcaagcgtctcatgatacgactccgcaccgccaagccccagtctctccagttgatccttcggtacctctatttcccagcgacggacgggggccgcctcattatggacgttcaccatcgccaattccctaccgcgcccagcacaatgccagtccatggcagagaggggccggatacgatcattag

SEQ ID NO: 18493 - DNA, 336 bp, A.fumigatus
tcccggaggaggccccggcaaactcgaggagcccgtccccggtggcgccgggggacccgacataccgggcccagggctcgggctgaaaccaggctggccgggaggagggacaggagggaatcccccagcgccgggaggaggaatctgaaaattaggcgggaatccgccaggtggcgggacaggaggaaatccttgaccagggggcatgttgccgaggggcggaggaggaaggcctccaggggcgccgcctggtgctggggggaaaggaggtggaaaggggaggcctctaccgccaggtggtgctgttggagtgtcagtgttagagcggaaaaataa

SEQ ID NO: 18494 - DNA, 393 bp, A.fumigatus
gctacgcgccccgaggcagaaagtccgtccgactcgagtccaagaaaggctacgacatgggcctattcatcttcgacattatccacacaccctacggctgcggaacctggcccgccctgtggctcgctgacacatacaactggccgctcaacggggaaatcgacgtcctcgaaaccacaaacagagctacagaaggcaacgtggtctccctgcacaccgataagggctgcaccgtcaaggaaagacggaagcagctgggcaacgcgcagtactcgacgtgcgatgataagcacgggaacgcgggctgtactgttcaagctcgccgggccacatacgggcaggagctcaatgaagatggcggtgctgtatggcttccgtcctctgcctttttag

SEQ ID NO: 18495 - DNA, 369 bp, A.fumigatus
gtcaaaaatactgacccgttccagatatacgcggtcgaactgcgagaagcaggaatccgagtctggggtttcccgcgcgactccatcccagatgacatctcgagtatggagcgcagacctgacccgtcctcttggggtccagctctggctgacttccccagcacacactgcgacatcccgtctcactttagcaaccagagcatcattgtcaacattgatctgtgcggcgagatgggcgcccaacgggaggagtacaatgatttgtacggttgtccggcaacatgtcaggagtttgtcgctcgtaacgcgcaaaatttatcgcaggcttattgggagtttcgcagttttcggatctatcagacgatgtga

SEQ ID NO: 18496 - DNA, 279 bp, A.fumigatus
tcctcaccactatcgtgctcacgtttcatgacgtcttccgaatttaacctagatctgcatgttctagctaagggctatactattccagaaactcaggaatggaattggatcttggggaccgcccgtttcgctcagtggattctcaccgtcagcgtggaaaacgaccacacaccacacccagtccttctggctcggattagagtcctccacaagccggcgagagtagagatgggctctgtgccatttatcatgtccgcaccggcagtcagtgccggttaa

SEQ ID NO: 18497 - DNA, 240 bp, A.fumigatus
tcatggcatacttggcgcatcgtctgggaccgcaccctttctacgtggcagtcggagactattacctggtacatggacggtcagttcttccaccagatcactggttcccagattggcgactcgaacgtttgggccacgctttgtcatgacccattgtacttcattctctacgtggccgttggcggcacctgggtatgtttagagattctccttgaattgtgcatccttccgaacgtgtag

SEQ ID NO: 18498 - DNA, 465 bp, A.fumigatus
atcaccgtggcagaccagttcttcgtcaagcacctctccctctctgctgaagatgcccacatgctccaccagaaatactacaaggagtacggtcttgcgattcagggcctcacacgtcaccacaccattgaccctcttgaattcaatcgtgaagtcgacgacgccctccccttggacaatatcctcaagccagatcccaaattgcgcaagttactcgaggacattgacaagtccaaagtgaagctgtggctgctcacaaacgcttacatctcacatgctcaacgtgtcatcaagttgttgaaggtggatgatctgttcgagggcatcacattctgcgactattcgcggccaccgctcatctgcaagccatcccaggatatgtatgagaaggcggagattgaagccggggtgccgagcacagagcagtgctactttgttggtatgctattttctttcgccctttga

SEQ ID NO: 18499 - DNA, 195 bp, A.fumigatus
gccctgtccggcaagctcgtgaggacacaagtgccactcggctggcggaacgtcaaaacactataccaccagtatatggatggcatcaagcctccgaccctggtatcagaggagtatcgtcagatgtacctggagactgtccaaagtatgtgtaatgaggcggccgttagcgatgagggagacgagaagttttga

SEQ ID NO: 18500 - DNA, 186 bp, A.fumigatus
tgttacggacttatcgcatatgccagagaatccaacctagatttacactttcctcatcttttccttatagactcttcaactctcacagtgatttcattcaccctcggagaacaatggcgactacggaatgtcccactggggcagtacctgatcctgactcacggccagttttcttctttgacatag

SEQ ID NO: 18501 - DNA, 1029 bp, A.fumigatus
ttgctcaacccaccccaccagatagctaaacgtcaactactccatccaaattattcctcggcaccaggagtactatctacaacaatgacaggctcaacctcttacctcgatgcgcttcagcgggatggcttcgtcgtcatcccctcgctcctcaccgcagaagaagtcgagcacttccgcgccatcgctacagaagcaacaaccctcgcccgcaccggccaatggcctcacttccgcaccgtccccaagcagttcccgccctggcccaaaaccgcacccccggcctccgaaggcggcatctggggtgtccagcacctcctgcacccgcagatgcccaaccgcaccgaatttgcccggttctatttctcggagaaggtgctagcagtcgcggaggaactactcggagtaaaaggcacgtcaaccgaggctacagagccactggtgatggagctattcaatctgcttgtcgcgccggaaacgaaggacttcgagctccgctggcaccgcgatgatattcccgagacggtgtcgccggaggaggagatgcggttgctgcaggccaagagcccgcagggtcggcagtcgcatgcgcagtataatctggcgctgtgtccggattcctcgctgattgtggtccccgggtcgcatcggcgggtgcgtacggagacggagcgcagtgccgggccgtatgagcctgagttgccgggtcagttggtggtggagcttcgaccgggggatgcggtgttctatgatagtaatattctccatcggggagtgtacaaggcgaagtcccaggagggtgaggaaacgaggctgacgctgcatgggagcattgggctgaaggtgtcggcgtcagggtccgacgcggacgagaaggttcgggctactgcggtactgcagcacggtgttggttcgtgggttcaccatgaggatgctgcgtttggtattggcgagcgagcaaagaagatgagggcgaacttgatagcgctcgggacaggtgagggcgtcggatattctctacagggctag

SEQ ID NO: 18502 - DNA, 228 bp, A.fumigatus
  unsure (150): Identity of nucleotide sequences at the above locations are unknown.
cgttccgatataagaacagactttttctggactatttacaatagagccgcagtcattatcatgaccatcacaagaccatcatcagctgttcgccggtcgtcgtccgtacacgttatggtacacaacgtatacatgtatatcggggcgcancaagtccgcgcgtactttatccacgtatttctgcgcatcttcaccactccagccgagcacgcgagtaaacaacgctaa

SEQ ID NO: 18503 - DNA, 1785 bp, A.fumigatus
catagttctggcagatggaaatctcgtgaatcagctttgttcattctcaaccagttgctgcgagacttcaacgaagtctcgcaacagatatctttcgagttggcgaatggcttccacaatttcgttacattcgctatccagcaagaagaggaatttctgcgagctcgtggttaccttatggcaggtgttttggctcaagttgcgagcgaagcgttccagcctaccgccatctcctacttcgaagcgaccctcaaggcgatcgctgaagacccctcggaggtggtcaaggtttcctgcattcgggccctgcaggatctcgtggcttctcttcctgcaagcactacagtcccacttcaggttccagttatcagtgccctgtcggagttcattgccgcgcacgacctccaggagccatctgaaagcgacgacctcaaggtcacgttagcggagacgattcgcgatactatcatggttaatccaagtgtggtcttgtcatctgttgccattgatgtcctgttcaacatagccagcaatggggctacgaatttccagctgacaatgattgttaccgaggcattcgaggatatcgtacaatctatctccgaacagggagctgacgctttcatccgtctttgtgaaaaagtactcccttcgctcatgggcgcgattgacgtgggaaacctcactcacgagaatgctctcacgaactttgcagctgatctcttgcgtgcgttgacggaaggagccctccagcctttgcctgccggatttgtagagactgtcatgcccaaacttaacaggttgctgttagactcttacgatgctgagctaattcgccctgccacggaagctgttcggcacattctttcacatgactttgatcagttcgtggcctggcgcgatccccagactggcaaggaagcggttgaagttgcactgataatcattgatcggctgctgggcccgtcggtcgacgataacgccgcaaccgaagtgggacaactggcagccgagctggtcgaaagagctggagccgagagacttggcccttatctgccacagttgctccgcgctgtcgctcagcgtcttgccacagctcaacaggcacaatttatccagagtttgatccttgtattcgcccgactgactctgataaacgctcgggaggtggttgacttcctggcgcaagtcgatatcaatggtcaaagcggactgccaattgttctgagcaaatggctcgagaactcggtcaacttcgctggatacgacgaaattaagcaaaacatcattgctttggctacactctacaacctcgaggatccccgccttgcccaagtgcaagtcaaaggtgacctcatcattcaggacacgggtcgcatcaagactcggtcgcagactcgcaacaacccagatcgctacacgacggtgtcggctccgttgaaaattatcaaagttctcgtcgaggagctggccgctgcatccggcaacaaggagattgatgcagctaccgcggccgctctagaggaagaggatagcgacgacgatggtgaatgggaagacattcccagtaataccctggatctcagcttgggcattaccaagcaggagctgatggcctttggcgaaggtggctctgaaggagtgtttggtgtacgcaagcgggatgacgagactcaggcattcttgctggacttcttccacaatgcgtccagcaagcccgggttcgatcaactgttcgccgccctaactcccgacgaacaggagaagctccgcagcttgggctga

SEQ ID NO: 18504 - DNA, 270 bp, A.fumigatus
ccgtggaagcggaactctatggctgctgagtgctggctgcacaacgtgcaagaaggagtaggcacttacgtagcatctgcatgcaagtccttttactgtctttgttctagtttggcttggcgcaggattattatgttttgcattgttagggagagagatggagctgcagacagagatgagggctacagtgtcgccctgttgaatggttatagccctagagacgctgatggaactgtactaggcacttcggaaacaaacatatggatatga

SEQ ID NO: 18505 - DNA, 1002 bp, A.fumigatus
tacaactcttgtataattacccctcatccgtcacgatttcccctcttcaactccccaaaaactcacgagctgaaactaacgactaatcgccagacgagcgatgaagactcactatgcgacgctcaatccatcattgactcaaatttcagtttagcctccacaacccgtgactacctctatgagaatggccgccgataccacgcctaccgactgggccactacccaatgcctaacgacgaggaagaacaagatcggctagccttcatgcatcatctcttcaaactgctcgtaggaggggatctctaccgcgcgccgatcctcaatgacggacgaccgaaacgcatcctcgacgtaggcacggggacaggcatctgggcgttggagatggccgatgacttccccgacgcagagatcgtggggacggatctaagtcccatccagcccaactgggcgccgcccaactgtacattcaatgtcgatgacgccgagagtgattggacgttcacgccagccgaggcgttcgactacatccatgctcggagtctcggcgggggcattggcgattggaaccggttcctgcgccaggcgtacaggcataccaagcctgggggttgggtcgagatccaggagtatgagacgtggatccgttcggatgatgggacgattcagcgcgcgcctatgctgctagactggcagcagaagattgatgaggcgagtacgcggtttggcaggccgatgaatgttgcgtcgagcctggcagggtggatgcaggaagtggggtttgtgaatgtcacggatgattcttacaaggtacctctatattctctctctctctcgatgtggctaagaagttgcgaacgactggttgtagtgcccagtgggctcatggcccaagagtccccggttgaaagaaatcgggagagtgggcaagatcacactgtacgaggccgtggagccgtatactttagcgttgtttactcgcgtgctcggctggagtggtga

SEQ ID NO: 18506 - DNA, 429 bp, A.fumigatus
cccgaaccttctcgtccgcgtcggaccctgacgccgacaccttcagcccaatgctcccatgcagcgtcagcctcgtttcctcaccctcctgggacttcgccttgtacactccccgatggagaatattactatcatagaacaccgcatcccccggtcgaagctccaccaccaactgacccggcaactcaggctcatacggcccggcactgcgctccgtctccgtacgcacccgccgatgcgacccggggaccacaatcagcgaggaatccggacacagcgccagattatactgcgcatgcgactgccgaccctgcgggctcttggcctgcagcaaccgcatctcctcctccggcgacaccgtctcgggaatatcatcgcggtgccagcggagctcgaagtccttcgtttccggcgcgacaagcagattga

SEQ ID NO: 18507 - DNA, 609 bp, A.fumigatus
  unsure (7),(8),(11),(12),(13),(14),(19),(20),(21),(22),(29),(31),(33),(34),(37),(41),(42),(43): Identity of nucleotide sequences at the above locations are unknown.
tggaacnnccnnnnaggannnnatgggangncnngtngtannnatatgagcggcactttccagccccgtggtgaagacattgccagcgccgatttccctgatgaatggccagagcttctcccgtcgctgcttcaggtcattaatgatgttaatagcagtgctggtacattgcacggcgcgttgaaggttctgttggacctcgtcgacaccggtttcagtgaggagcagttcttcggtgttgcccgcgacctggttaccactcttttcaatattgcgactaatgagtcaaggaagccgatgctgagggcattggccgttgccgtttttcgctcttgctttgataccctggagatggtgcttgagcagcataaggtggcagtcaagcagtttatggatgaagtcctgagcggctggtccccattcttcattgagacattgaaggctcccttgccacaggcccccagtgagcaagaggagtccaaagagggggaggtcccttctcaatggaggggtataattggactgaaactgcaggtggtcaaggtaggctgtctcaataacttggagacatctccaactcgtactaacggcataattcttcactgttag

SEQ ID NO: 18508 - DNA, 543 bp, A.fumigatus
acgcttatgaagattcgaatggtctttcccggcctcatgacagctcaaagcccggtctacttctcaactgtctggacagagctttccaacattcagtctgcttaccacgacttctatattcaagatgaacgacagggccgcttagaagatgtggacggactcccttacacgctggacttccttgtgctggaagagcttgatctgattcaagcccttctaaaagcaccaccagtcaaagctgaactccagcaacagttgcagaacgctggtcaggctgcagcaacagccagttggcttccagagatcttaaagctcgccagttcatacgcccagattacgactgaagaagaaggcctctgggacattgatgtgaatctctttctctcggaagagacctctgtcactgcgaattacacaccccgaacctgcagtggagacttggtcatcaaattgggagagtggctcaaggttacaactgttgaaggtctcctcgcctacatgaacaatctttttgccgactcaacatcgacgtatgtattctaa

SEQ ID NO: 18509 - DNA, 321 bp, A.fumigatus
aaccccacctacgaagatatgattctcctttcgtcgcttcttggacccgcgaagccaccggttgccacccaggacgacatcgatctcgctggaggactatatcgacttgtagagcttgcaggatcgctcgtcgcagaggctttggatggcgctggcacgatccaaatccctgatggcgaacgttgtctgatctgtctcggtgactacgaagccgcggaagagctcaggcaattgacaaagtgcaagcacgtctttcatcgtgattgcattgatcaggttcgtccccatcttcgcatgcgtttgtctgtgcaacctgcttag

SEQ ID NO: 18510 - DNA, 2409 bp, A.fumigatus
acaatcatcgccacttcccattctcatatcttcgtggctatgggacagtcctcttctacacaaaggaatcaacaccacacaactccctcagatcaatccaccttcctccgcaccgaccgcgatcaattgaatctcaatgaagacatgaatcaccggtcgaattctgatcaggccgaggacaccgcgctcccgtcaggagcagaaccgaatgacggcatctcccatacttctcatttagctcaaggcaatccaggggccgcgacatggcaggcaacaggtaccccaaatgccgagcagcctcatttgacaaggatggagagtatacacgaggaagatggttcacggcacgaaccggatcagcaagagtatcgctctgcgatacttgcgcgaatggccgcgcgacgtcagtctacaatgtcgagactaggttccaggattttacctaactcagttattcgtggcctccttaatagtgaagaggagaccccggcagagggacaggctcacaggcatggaattgtagcgagatcagtcccgagatccgactcttatagcagcagtcgctttagtcctttcacatcgctcagctcgagaagcatcgccaggcggcgattgatcagggtaccctattttattccccgcgctgatccgtccttgactcctgatacgcacaccagtttggcatccttggactcgtcatcagaacaagccacacaacctgccagaggatcgtggcgtcgcagtgcccgactgaaccgcgttcgaaattcattatcggcgcccatcacgcagatatttggccatccgtccatcgcagactctgagatgacagaacacccacatttccgggaggacctgggcgaccatcccgaaattcgtctgccaccactgagtgccatggacacgagcatggatttcggccacgctcatgaacttgattctgtggaagctgcagcgggtgataatcatctaccaatgccgccactcttctcacagtccactcaaaacgcttcagcctcacgtcaattaccgggcaccttaagtgcaagaccctccagagttcttcggcgtgatgagcacactcctctttcacgggttctgcaattggctgcggctgcgattgctgcccagctttctggcgctgcgggcccagtactgcccaacatccagtctttgggcaatgatggaatagaagggtcgctggaaaacttcatccaaagtctacagcatgccacatcagcacaaaccgcctcgaatgacaccccaagtgcctcaggagaaaacagccctccccagcccgttaactttttacgggttttcaggtttgccaactcagacaatccaagccctgcagcttcctcaaatcactcaactacggagccggattctgcaagtagtcgtggcgatggtatggacgttgacaatcccgccgggaataacgagggccgcaccgttactttggtagttgtgggcgttcgatctgttcccacaggcagtgggccgtttggcgatcaacagtcgaatgctgcgcccggcctggacgcattgttgcgacttccattcctagcgccaggaaatccaccacgagctcaggacaacagtcccgcagttcctcttgctgataatcggccacaattcgtacctaatcgacaacaacacggtgctcccggccctttgtcgacgaacattgaaacctcacaccagggccttcgaagcgcgcgaagattttctgacgctggatctcgcgttccgttccctccactcccttcgactctctcggagagtcctccgggtccccatccgcctccatcgacacctgccgagccaggcttatctgcagtatcttcaggcgcatcaacacccaatcggagactgtcctctgcctcggcgttgccgtcaaaccccttgcctcaagttgatgagcatccattgatgcaaccgtcagttgagcctgcacctgaatccactgcagacaggatcccgttccagccgtcacatcaacggcggcgcagtgattccgagtatgctcgccatcgtgagctaggctctggcgctgttcgacgcaatggtgttgtggaacctgacactccccctcctgcgggcagaagctggctgatttatgtcgtgggaaccaacctttctgagaaccatcctgcgtttgcaacacctagcctctttaccgatgtaagttgtgtttttggcatgccccgagactcaaagctaatacaatttatagaaccccacctacgaagatatgattctcctttcgtcgcttcttggacccgcgaagccaccggttgccacccaggacgacatcgatctcgctggaggactatatcgacttgtagagcttgcaggatcgctcgtcgcagaggctttggatggcgctggcacgatccaaatccctga

SEQ ID NO: 18511 - DNA, 195 bp, A.fumigatus
gaatggaagtcgcaacaatgcgtccaggccgggcgcagcattcgactgttgatcgccaaacggcccactgcctgtgggaacagatcgaacgcccacaactaccaaagtaacggtgcggccctcgttattcccggcgggattgtcaacgtccataccatcgccacgactacttgcagaatccggctccgtagttga

SEQ ID NO: 18512 - DNA, 567 bp, A.fumigatus
ccagccccgtcttttgcgagggctctttgctcttccccgccgtcgtgcctcaacgatgatgctaacaacgcaaagaaaggacccgtgtacctaacaccagaccaactcgccctctacaacggcaccgacccctccctccccatctacgtcgccgtcaacggcaccatcttcgacgtctccgctaaccggctcgtctacggcccgggcggcagctacaacttcttcgcgggccgggatgcaactcgtgcgtttgtgacgggctgtttccaggaggacctcacgcatgaccttacgggtgtggaggagatgttcatcccccttgagaatgaggaggaagacaagaagctgagcagtggggagaggaagattcggcgggagcaggataggagggtggcgctgggcaaggtgcggaagcaggtggctcactgggagaatttcttccgtaaccacaagaagtactttgcggtgggaaaggtggtcggcctggaaaatttgcccaaggagaagagggagctctgtaaggcggcgaggcagcagcggccgaagaagagggaggtggtgggttga

SEQ ID NO: 18513 - DNA, 186 bp, A.fumigatus
accgcgcttacttctgatggggcttcgccggtgagctatccgtgtctgaatgattttgacgtgtcgctaactctatccaggagcggcaagtcatccatcgccagcgttgtcttccataagatgccgccaaatgagacattatttctagaatcaacgacccgtatccagaaagattcgattcagtaa

SEQ ID NO: 18514 - DNA, 732 bp, A.fumigatus
gtactcccctgcactgccgtatcctgttcttacacagtctttagctctttcatggacttccaagtctgggatttccctggtcagctagaatacctcgaaccgtcatttgacctagaagctattttcggcagtttaggcgcgcttgtatgggtgattgatgcccaggatgattatctagactccgttgctaggttgaaccggaccattttgaccgttcagcaatactacccgaacatcaatatcgaagtcttcatccacaaagttgacgggctttcagacgaatatcgcacagataccttccaagacatagtccagcgtatctcggatgagttaagtgatgccggctacgagaatgccccggtacattactatttgacgtcaatctatgactactctgttttcgaggcttttagcaaggtgatccagaagctcatcccgaatctctctacattggaaaatctgatcaatacccttgcgaataattgtggtttcgagaagacatacctcttcgatgtcctgagcaaaatctacattgcctcggacactcgtcccgtcgacatgtcatgttacgaaatgtgctcggattacatagacgtaattgttgacgtctcagagttgtattcgtgggaccatccagaccgcaagcccaagggagatcagatacaagaggcggaaagtcatgttgtcttgcatgacgagaccatgatacatctgatggaaatgaacaagtga

SEQ ID NO: 18515 - DNA, 738 bp, A.fumigatus
tggcaggtgagtccaatgagcacacaccccaaatccagacagcttcataacatgatggcaggctcatcgacagctttcctatcggatgacggagcttttgcagctcaactcaatggcaaagacctcataattcacctcagtcccctatgttctgactttcaggaggtagaaatcgttaagctcaaagagacaccgattagatttttgagattttcgcggccgaaccaactcgcccagtcagataccatcaaccgccaaaaagagagcgcagaacgacgtatcctctgtgcgaccgatacccgtattctggtctgggaccttcatcccctgcagctgcacgctgagatcgagaatgtcgaatacggtgctctgaacattgactttggcgccgatgagaatgagattattgtattccatgcatggaacacaaagtttacgatccattcgctggacagtggtcgtagccaggtcattaaatctccaaaggtctcacattataatggctttggctttcgaccgcgaacgcgacagcttgctatcctactgaagccagaaacgtccgacgtgttgactatccatgaatatcggtcttacgagctggttaatcgagtcaacttgccgacgtcggatgctcagggcttgaaatggagcccggatggaaactggatcgccgtctgggatgcggcaagtgccgggtacaagactcttaatatatacagcagatggaaacctttttag

SEQ ID NO: 18516 - DNA, 273 bp, A.fumigatus
tttcactgtacagtcaaggacaaggcccagcacgccgtcgtccttgagaagcagaccgccgagagactccagaaggaagtccagtcctaccgcctcatcaccgttgccacccttgtcgaccgtctgaagatcaacggcagcttggcccgcaaagccctcgctgatctcgaggagaagggacagatcaagaaggtcgttggccactccaagatgaccatttacagtatgtgcccgcactgcttgcatttctataagtgtggttgtcgctgttga

SEQ ID NO: 18517 - DNA, 297 bp, A.fumigatus
cctgatcgtaaccatcatacacgccagttttgctataacatcaacccaccacctccctcttcttcggccgctgctgcctcgccgccttacagagctccctcttctccttgggcaaattttccaggccgaccacctttcccaccgcaaagtacttcttgtggttacggaagaaattctcccagtgagccacctgcttccgcaccttgcccagcgccaccctcctatcctgctcccgccgaatcttcctctccccactgctcagcttcttgtcttcctcctcattctcaagggggatga

SEQ ID NO: 18518 - DNA, 228 bp, A.fumigatus
gaccgtatctccgacttctccaccagttacctcctaggcgatggtttcacaattatggagcgcgacgtgcaactggtatataatttgaattcattcagagctgccgcctcagcattcaggtatattatctacatggtcacactgttggttgttctttttatcgcttcactgtactacgtccatctagctctcaactcattgagcagacacagcaccttacaggactag

SEQ ID NO: 18519 - DNA, 402 bp, A.fumigatus
cagggcgtaggacgacgagtgggcatggcgctcggcgccgccttcatcatcctcggcaccatcgtccaagcaacctgcaccaatctcgccggcttcatggccggccgcttcctcctcggcttcggggtcgcgacctccgccaccgcgggcccagcctacgtctcggagatcgcgcacccttcctggcgcggctcgttgacgggattgtacaacgtgctgtggttcgccggcggcatcccggggacgtttatcccctggcgcacgagtcagatcgaggggacgatgagctggcggattccgatctgggtgcagatggtgtttgcggggttggtgctggtcttatgctggacgattccggaggtatgtccgtccctgctcttttttttttttatctatctctag

SEQ ID NO: 18520 - DNA, 741 bp, A.fumigatus
gccttcttcggacaatggtccggcaacggccccgtctcctactactacccacagatgctggccggcgccggcatcacctccaacaccacccggctcctcctgcaaggcctgcagaacgtctgccagttcgtcggcgccatcttcggcgcgctcctgaccgaccggatcggacggcgcgcgcagctcctcacctccacggcgctgatggtcctcctcttcagcatcatcacggcgctgaacgccaccaacgtcgacccgcccgacgacgagaccggcggcgtcgtcgtcgtcgtcgccaagagcgccgtcgtggcgcgcgcgcaaatcgccatgatcttcatctttggcttcgtgttctcggccggctggacgcccaaccaggccatgtaccccgtcgagtgtctgcggtacgagtcgcgcgccaaaggcatggggatgaacaatttcttcatcaacgtggccaacttctacaatacgtttgtgacgggcatcgccttcacccgcgccggctggcggtactacctgctgtttatcttctgggatgtgctggagctggcggtgatctggtttttgtttgtggagacgtcgcgacgcacgctcgaggagctgactgccatcttccagtcgaggaatcccgtcaaggcgtcgttggcgcgcgacgaggtgttgatcccgcaggtggagcaggaggtcgagatgaggcggaaggattatgaccggaggaaagttgatttgacttga

SEQ ID NO: 18521 - DNA, 681 bp, A.fumigatus
tccgactccgcacaccgcttgtttatgattggccggtctttctaccgccttccttttgaaagatactgcccgtcttccgcttccggcaagaggcctcattcgctgcgacggtggtttcagcgcaatctttttttccgttcatccgttacaattgacagagtccaggttgcgcattccttagcaaccgcgccatccactgcccgagcccaattgccccagtacggaagacgtccgttacccccaactcccctcgcgcatgcgcacctctccggcgccgcagagcacaaacaccatgagaaccatgcgcagctacgacgacttcacccgcgacgccgacgacgccgacacagccatcgccgacccgaccgccaccaccaccgacgacgacgaccggcgcaaacggaccaaaacgacgcacgccgcatcccgcatctgctacgactggatgatcgtcttggggaactgccactacgcgcgcgaccgcgcctccttcacacactaccgggcgatgccgcgccggacgctcgtcaagaacaacatcttcaatccgcacgaggagctggaggtggctggggtagggaccgtcgagctacgcgtgtgccggacagtgcgggacgggggcgccagctcgcacgtgctcgtgctggaggacgtgctgcatatccccgaggcggtctgtaa

SEQ ID NO: 18522 - DNA, 306 bp, A.fumigatus
agcccccggtggctggtgtcccgcgacaagcacgaggaggccatccgcgtgctggccacgtaccacggcgacggcgaccgcaacgccccgctcgtgcagctcgagtaccgcgagatggtcgaggatatctccaacacgggggctgacaagcgctggtgggattaccgcgagctgttcaactcgcgcgagacgcgctaccgctcgatgctggtgatactcatgggtaaccctcgtccttcccaatccatgtcattcatgtcattccatgtcaattcatgtcaattcagacaaacggaacgatactga

SEQ ID NO: 18523 - DNA, 726 bp, A.fumigatus
cgatcggtaagccttcttcggacaatggtccggcaacggccccgtctcctactactacccacagatgctggccggcgccggcatcacctccaacaccacccggctcctcctgcaaggcctgcagaacgtctgccagttcgtcggcgccatcttcggcgcgctcctgaccgaccggatcggacggcgcgcgcagctcctcacctccacggcgctgatggtcctcctcttcagcatcatcacggcgctgaacgccaccaacgtcgacccgcccgacgacgagaccggcggcgtcgtcgtcgtcgtcgccaagagcgccgtcgtggcgcgcgcgcaaatcgccatgatcttcatctttggcttcgtgttctcggccggctggacgcccaaccaggccatgtaccccgtcgagtgtctgcggtacgagtcgcgcgccaaaggcatggggatgaacaatttcttcatcaacgtggccaacttctacaatacgtttgtgacgggcatcgccttcacccgcgccggctggcggtactacctgctgtttatcttctgggatgtgctggagctggcggtgatctggtttttgtttgtggagacgtcgcgacgcacgctcgaggagctgactgccatcttccagtcgaggaatcccgtcaaggcgtcgttggcgcgcgacgaggtgttgatcccgcaggtggagcaggaggtcgagatgaggcggaaggattatga

SEQ ID NO: 18524 - DNA, 249 bp, A.fumigatus
tacaccgtccagtcatcagcaagccatcgcgtcaaagatctccctcctctcctgcggcgtaatggacaaactcaacgtataatacctccccctgaatcaactccgacgctcccttgggattccccgcaagcaccaacctggtgcccccagcatacggcaccgcaaaccaaaccggctccccgcgccgatccgccctttcccagtactccatgttacacgacatgctactcccatacagcaacggattga

SEQ ID NO: 18525 - DNA, 720 bp, A.fumigatus
ccaggtctggaacaccaaaaacaaccacaaagaaaatacacttcctgttccatacgtctccatagggatccatgttctccgcgagatcccgtggatatcagtacttatgtccgtgtaccgtttcattggcgctcgagcatgcagttcgaggtcagatctacagaggactcggtaaaacatgagggcatacccaactttcctataaaatcccccagaagtaccctttcttaccccccctccccccttcttgtgccctcttttcctctccctctcctctgctcgttactctaccggtctcttccttccctttgtcttctccgctttccttctttctttctcatcgttccacctccctgttctctatcttctccctctcttctcctcctcccccctcgcttccttttttctcctcctctttccactcgcgatctctctctccttctcattagctctcttctctccctttctcactacccctgcttaacctccccctctcttctcggtctttatcaccttttcctccttctttccaactcctccgcttcctcttcttcctctctccctcccctactccctctatattccccccttttgcctctcctcttctctccttccccttcatcctttcctcgggcgaacaatctttccttcctctccccctcgcatccccctcccctctgctttcttccccgcctggcctttcattccacctcccttccc

SEQ ID NO: 18526 - DNA, 192 bp, A.fumigatus
tccttccgcctcatctcgacctcctgctccacctgcgggatcaacacctcgtcgcgcgccaacgacgccttgacgggattcctcgactggaagatggcagtcagctcctcgagcgtgcgtcgcgacgtctccacaaacaaaaaccagatcaccgccagctccagcacatcccagaagataaacagcaggtag

SEQ ID NO: 18527 - DNA, 279 bp, A.fumigatus
aatcccccagaagtaccctttcttaccccccctccccccttcttgtgccctcttttcctctccctctcctctgctcgttactctaccggtctcttccttccctttgtcttctccgctttccttctttctttctcatcgttccacctccctgttctctatcttctccctctcttctcctcctcccccctcgcttccttttttctcctcctctttccactcgcgatctctctctccttctcattagctctcttctctccctttctcactacccctgcttaa

SEQ ID NO: 18528 - DNA, 342 bp, A.fumigatus
atcaactccgacgctcccttgggattccccgcaagcaccaacctggtgcccccagcatacggcaccgcaaaccaaaccggctccccgcgccgatccgccctttcccagtactccatgttacacgacatgctactcccatacagcaacggattgaacccattacagaccgcctcggggatatgcagcacgtcctccagcacgagcacgtgcgagctggcgcccccgtcccgcactgtccggcacacgcgtagctcgacggtccctaccccagccacctccagctcctcgtgcggattgaagatgttgttcttgacgagcgtccggcgcggcatcgcccggtag

SEQ ID NO: 18529 - DNA, 315 bp, A.fumigatus
atcctcaatcccacccttgaaccaaaccccagtgagctcgctcgcttttacaattcatccatgtatctacagcaattcgtcaggactatggctctcttggctcgctccccggttgcctctactgcaataaagcaatgcataaaactcaattgttacatgccaatctcgacactatatctgtctctagacccctgccaaattttccagtacagctcaccaatttctcaacaagtctactctagtatctccttctccacgagtatgtcacttatatatatatattgtcactgccctattttttatggaataccctag

SEQ ID NO: 18530 - DNA, 624 bp, A.fumigatus
caagcaaggaagattccctactcagtcacccggcaggaaatcattcagtttctaggtcgtcaggcacgccttattactccgcaacagggctgcgcaatccacatcataatggaacgttccaccgctaagacaatggactgctatgcggagttccagtccgcgaatgatgctgaggagacagctactcgcattaaccgaatttatgagactggtcgcgcgcctcgtctgggtaatcgctctgttgatgttgaattcagtaaccaagacgctctgctcaaggacctgttccctcgtgccaagtgcatcatctggaaagatgctatgcctaccgccgtccccaatgatgaccccttttctactgggttctcgggctttttcaccagcgaggaaattgtcaatgccattcgccatgcagagatacctcaccgtgtaagtaaccttccctcgattcaatcccctgtgtgtctgcttgtttgttcaaagctaacaagattgtcagtctccattttgtgcgaagtgtcctcagcgcacctacgagtccaccatcagcacactctacaaggtaaacccctttcggctgatgccattgtgcgcagaacgtacatgagagagacaatatgctaa

SEQ ID NO: 18531 - DNA, 582 bp, A.fumigatus
ccatctgatctcactatggagggcaaggatacgaacggtcaagcctctggacatgagtccggatacgctttcacatctccttacccacagagctacaacatgcttccgttcggagctcctggcatgccgggctttgctccgcagcagggacagtatatgatggccccaggcaatccgaacccgtcccagccattgcagcggagaggccccttcatgtactctcctttctatggtatgcagagtatggctcacgctcttcctggcgtcataggacaagtccacgggatgcattctccgatgcctgcctcgaacactaagctccagctttcagtccgtcccaagcagacagggttcaccccaactggctctcactgggctccgggctcttctttgcaccagctcctggagcatgactctgcgagtcgtgatatagctacccaggcagttgactgtgagaagagtttcgacacggtggcccttcccgccgagatgccgattgggagccaagtccacaacagaatgccctctcaatggggagtggtaaagatcgcgaatgtaagtcaagccttcacatgtctctaa

SEQ ID NO: 18532 - DNA, 717 bp, A.fumigatus
cttgctctgaaaagaaaaacggtacattcaagggcaatctcttgtcttttttcgggtccaatgcctcgtcgatcgtctcgggccgttcccgcgcctgcggcagcaccagcgccgattccaaaaaggcgcgcgtctgacagaacctctgcagcctcagaaacagatctgaaaagacaaaagcacaacagcacgaccgccaagaaggtcgtcagatctaccgccagaaagagcaaatattttgaagacgagggaaatgaagaatcagaccctgaatctagtcatgcatccgaggtgggagaagactcggatccagcctacgaagataaaaacttatcctacccgtcaactgaatcggactccgaggaaccggaggtgctatctacaggcgaagagagaacgaaaagatcaacaagaaagactgctaaccctagtggaggtcggaaaataccagcgagaagaggtggaggaaatgaggcagaagaacatcctaatgaggacatagcagcttcgctaaaggataaagaactatggagagagggtgtcagcactggcttaggacctggaaaagaggtcttcatcagaaagcccaaagccagagaccccggagatataccctatcaggaccatacactgcatccgaacaccatgcttttcctgcaagatttggcgaaacataacgacagacagtggctcaaaggtattgacgacagaatatga

SEQ ID NO: 18533 - DNA, 561 bp, A.fumigatus
aacagaacgcgatatttcaaggtgatccagctgcagataaagagagtcataacacagaggcgagtcatgagcaatccggaggtatgcacgattccagaggtctttgaatctcgaaagcgcaagattctcgcggacttgtctgtcccagacacagagtatacggatctctcacccaaaggatcggtagatgagggcatccgcgacttgatccgcgatatcaacgctctgcctggtctggtgaccaccagtagctgttctggacgaattagcgtcttcttggaggggagaaaaaagcaaaatgaccaccagcaggaccaacggcagttcgcgccctctggaggcaaaggcgcagggaagtggctatatgtctcgcacgatcctttgaatggccgttggacaggtcgtgacaacgatgatttcaactcgacgcaaggtaaagattgtccgagaagcctgcatgaattgtttgggatggttcctggaaatggaaagcctccggggctgaaaggaggtcatgccccgcgtctggtgcgcttccactacgatcctatggtaggttga

SEQ ID NO: 18534 - DNA, 204 bp, A.fumigatus
ccagagtccacggatgatctccaacccaactgcggtgtcctcgtctgtcagtcgtccgcccagtgtccagtgttcttccgctctggcgagggtaacgagaggatcggcgatgtagaccttgaatcgagtatgcgcggggtcaacaaggtcgcagcaaagaaaagcagcatcgattttgctttgctggaaatgtgcttcgattaa

SEQ ID NO: 18535 - DNA, 1245 bp, A.fumigatus
ccacacaccggtatctcaaagaatgctgctattcatactttgcagcatttccacggagtgcaaaattggaactatatttcgcgtacgatttgtctacgttcgaaacttccatatgaaccgcgcaattttcttccaatctcacataccagctctctctcatcctatcctcctctgtcctattgtcatcatcctcacaacagaatgaagctccatcacttccttcttcctgtagcactcacagctactgcaggcgctcaaaccctcaacattgttgcccatgaagacgacgatttgctcttcctcagtcccaagcttctcgatgaaattcgatctggacggagggtccgcaccatcttcgttaccgctggagacgcgggcaatggtgcagactattggatctctcggcaggaagggtcgaaggcagcgtacgcccaaatgagcggcgacgaaaacgcctggacacagtcggacgctggcatcccaggcttcaacatcccgttgtttacattgaacaacgatcctaatatctcacttgtcttccttcagctaccagacggtaataacggaggagagggctttggatccggaagcctgcagcaactgtggcaaggaaccatacccgagctgacttcctggggcggatcctcatactccagggacgatttggtgaatgtgctgaggaatctggccgatgactttggatacgaccacatcaacacccaggactttgtccatgattatggagacggagaccatagcgaccaccacaccaccgcttattttgtccatgaagcgttcgctgattgtgccagcagcgcatccatcactggttacatgggctatcctgtcgtgtcgcaaccagctaacgtcgatggagagcttcttcaggagaagaaggctgtattctacaattatgctagccacgacaggaacacatgcagtagcgatgaggcctgccgaggacgtgatgaagctctctggattgaaagggaatacatcgtcagcgaaatagaccaatccccttgcaggaaagctgcgagcaaagccccagcctctactacgagtaaggcgtcggtctctactacgagcaaggcctcggtccctactgcgagtaaaggctcggcctctcctgcgagtaaaggctcggcctctcctgcgatcaagggctcggtctctactgcagtcaccccttcggcatccccaacccgtccacataaagtcatttcaaggccactgcaagcataa

SEQ ID NO: 18536 - DNA, 897 bp, A.fumigatus
  unsure (79): Identity of nucleotide sequences at the above locations are unknown.
ggggaacctaggttcttttgccccagttggtggcccccagtgcttgttcaaaaccggtcaccagggagagacgtgtacngatgcacctggggcggtaacatgactgtcgaaataagtcagaacttccagagatcaggatcgaggacgcgcattgcgtttgagccgttccgataccaggcgagtgtcgcccatgaccggttcaaccgcacctcggtcaatgcgttcttctctcagctccaattgctcgtcaaaagcgtcaacatagaactgcatcatttgcttagcgagcatctgaccctgacggccaaagacgagcgcaatctgaatgaggagcaactcacaaagtacctcacgaactttcaagtgaagacccagtatgtcgtggcgttggatctgagaaagaccggaatcgttgccaaggaatacttctttccggggatcaagtgtgcagccacgggtcagactggatccaatgcatgtttcggagcaatacgggcagtcgacaaagacggccacctggatagtttgtgtcaattaatcgaagcacatttccagcaaagcaaaatcgatgctgcttttctttgctgcgaccttgttgaccccgcgcatactcgattcaaggtctacatcgccgatcctctcgttaccctcgccagagcggaagaacactggacactgggcggacgactgacagacgaggacaccgcagttgggttggagatcatccgtggactctggtcagaactcgggattatccaaggtccacttgagccttcggccatgatggagaaagggctcttgcccattatgctgaactatgagatgaaggccggccagcgacttcccaagcccaagctgtatatgccactcaacagggattccccgaaaccaagatag

SEQ ID NO: 18537 - DNA, 1155 bp, A.fumigatus
gaggaatccttatcctcttgcccccttcctttcaaaatgatctattcccgcccttgttcaagctacacattcctggtggctgcagccatattcgccgttgtgattctttggagagaatatgcttggaaatttaaaagtcagctgctcctcaactgcagtgcccctccgacgtcaatcaatgtgactggttccgcgattccaaaccaagtccattatgtgtacattctacgagatgttgacgcggacttcgccttccaattcaaacactttctctctctctactcggtcttgcaacactggcatcccgacacgatctatctccacaccaacgctaatccaaagaccatcgagaatgctcgggccgggaagacgggaaagtggaaccagctgatattcaacactcccaacctgcgaataaaccatgttgaaccgcccactgttgcgggaaacggaaagcccattgaccagatcgagcacaagtccgactttgttcgcgtttctaccgtctgcgagttcggcggcatctaccttgactgggatgcacacccggttcgcgatatcaaggccttgagggagagcggcttcaattcaatcactggccgccaggctaacggtgagataatgagcggaaccttcatggccaagaaggatgcgctcttgctccagatgtggaaagccgagatgcacaaggtttacgatggggggtggacaacgcacagcaattcagtcgtgacgcgattgggccagcgtctggcgcggttgccgggggaagtcctaatcatggagcaggatgcatttgggccggggagctggaccacgcctgaaaacatcgtgctctatgggattcacaacgagacggtctcgaatctggagaacgctacagattgcaggtccctgccgtcatacgacgaaggagttacggatcgatgggacaggccgcaggactttccgtcgtgggagcgtgactactcacatacatacatattacatgcttttagtcctgctcggaatgggaatccggtcaaggacttcaaacatatcacgccgaaatacgtgctggaacggcagagtaatttcgcacgactgctatatcccgtcacgagggatatgtgtcgcgccggctttgtggaggtaaatgattcatatgccggataa

SEQ ID NO: 18538 - DNA, 579 bp, A.fumigatus
aatgactttatgtggacgggttggggatgccgaaggggtgactgcagtagagaccgagcccttgatcgcaggagaggccgagcctttactcgcaggagaggccgagcctttactcgcagtagggaccgaggccttgctcgtagtagagaccgacgccttactcgtagtagaggctggggctttgctcgcagctttcctgcaaggggattggtctatttcgctgacgatgtattccctttcaatccagagagcttcatcacgtcctcggcaggcctcatcgctactgcatgtgttcctgtcgtggctagcataattgtagaatacagccttcttctcctgaagaagctctccatcgacgttagctggttgcgacacgacaggatagcccatgtaaccagtgatggatgcgctgctggcacaatcagcgaacgcttcatggacaaaataagcggtggtgtggtggtcgctatggtctccgtctccataatcatggacaaagtcctgggtgttgatgtggtcgtatccaaagtcatcggccagattcctcagcacattcaccaaatcgtccctggagtatga

SEQ ID NO: 18539 - DNA, 513 bp, A.fumigatus
tttatgactgaatcagtcccaactatgttcccagctgatcgcgtcggtgtccccttaatcgggcagttggccctatcgccggccgccggaagaatgtcggtccgtctacgcatctatacttgcaccgttcctgaatcgcaaggtttatatgattctgcagctgcagaaagtgaaacagtctgtttctcaatggcatcgatagtgagccaaagattgttattaccgcaacgttgccggacgaggcattcggtatgcgagatttgtcggagtttctccagccgcgcccccttgctcgccggtcacaatcgatggtcgcagataaagcatgacaaggcgaagaatgacaaggcaaagagcagagagcgtcaaacaatcgcgaaggaaattagcagtgctacgcagagtgcgtgcttgactccgagtttgccgaggtcagcgcatgcttacttttttttttgcagtgtggggagccgatcccaagttcaacccccgattaactcttgcactctctaa

SEQ ID NO: 18540 - DNA, 240 bp, A.fumigatus
ttgcgcaaacacactctctccggcgactgcaaagacctctcccaaacagtgagccgcggcgaacttcgtcttgagctccgcctcatttttgcctgcattcagtatagcaagaaggtcggttactgtttcgaagagtatcccccgatcccctttgccaagtatagcgccaaaagagcggccaaggttgttccggataacacgagtgatcgttggcgacgagagggtcaatatcttgaatag

SEQ ID NO: 18541 - DNA, 666 bp, A.fumigatus
ctccgagtttgccgaggtcagcgcatgcttacttttttttttgcagtgtggggagccgatcccaagttcaacccccgattaactcttgcactctctaatgcgaaacgtgccggtataccgaagactgtgattgaagcagctattgccagaggccagggaataagtgtaaccggcgaggctctggagtcggtaacgattgaagctatcctaccccattctgttgcggcggttatcgaatgccagacagatcaaaaagctcgtgtattacaagacctccggtatgctattaaggacgccggtggcactgttactccaacgacatatcttttcgagaagaagggcaggatcatatttgagaagaaggacggcgtgaatccggatgattatctagaccaggtcatcgaggcgggagccattgatgtagcgacggatgatgaagaccggcttgtggtctttacagaaccaacagaaacgaagagtgtcggcgaaacgctcacaaaagtgacgggactcgctataaaggaacttgacataatctgggatccgaacaaggacactatggtggagttgaacaaggacgagcaagtcagggaaattgaggacattctgagtacccttcgagaggatcccagcgtccaagatatttatctgaacacatctacctaa

SEQ ID NO: 18542 - DNA, 1725 bp, A.fumigatus
  unsure (22): Identity of nucleotide sequences at the above locations are unknown.
aattgcacgcctcagattcacnggtcacagccgttccccatccctaagaagatgaagagacagtttaaaaagcccgcgccgagacccggagaggacgacgacgaggctgaagtttccgagccctcggtttccaaaaaggcagagcccggtttatacttcctcctgccggatcttcttcgccaactttccactcaatatatgaaaagcacaacgtccaatcgcgcacgagccggtattgctgcatgttacaaatatgttctgcgcagcctaggcgacaagctcgtcgaagagcgctacgggcagatcgcgaatcacctcctctttgaacttctgaaccatccaacagtaacttataaccgattccgactcctgatgacccggaggtttgttaaaggaattctggaggagacggtgggacgggaaactctgcgcgaaaatagccagctcaatgctgcgaagtggttaatcaacgaaattcttaaggactatcctcaggtccttcaagaacgccgcgagcccagcaaatacacacttgccagcactctgagtgcattgtcttctttgatatcgtccctaggttctgcattcggcgctatggcagaagcttgtcgcgaggcactgctccaagtcctccctcatcccagctacaccgtccaaattcacgctgcgcactgcttaaggaactttgttcttgcttgcccacatcagctcatatcctgtgtgaccatctgcctgaacagcctgagcagagagattgggcaactttctacgccccggcaggcgccacggcgctgtgttgggtacgccaacggactgtcggctatgttgagtacttctcgactgcaaccgctctacggctctgttgatgtcttctcccgcgttttcactcaggcgactgatctgctaaagaccagcggcaaatcagagcttcgggcagcgagtacacaggtgcaggtggcatggattttaatcggaggtctgatgccccttggaccaagcttcgttaagattcatctgtcccaactgatgttactgtggaaaaatgcgctacccaagcatcttggcaaggataatatcgctcagcgggggtatctagagatgagttttcttgcacatgtacgggaatgtgctttggggtccctgttagtattcatggacttcaacagcaaattgatcacagcggatggtgcgagaagaatcgctgctatgctacagaacacgatagaatttctcgatgatcttccgcggcagaagtctgttgcagatctttcgcaacgcctccaaccttcattgcaattgcatgatctgaccacaatggtccggcgacgggttctgcagtgcttttctaagctgattgatgtccatcctctcagccacgccgatgtcatctcccagactactctcttgagtctttctatctcttcctttgccgacccagaatacacccaacctgctccgctggaaagttcgatagcggctgcaaccgctcagtttgagactctctgggagctctgcgataattttggatttggtgtcactggcttagcccggcaatatatccgtgcaacactctcaggcaaacaagacaacgaaaatggtcctgcttggtcagctgtcgatttatcagatcaagatattgacgatgcagtgagtctttcatccaccagttggcacgcgcgttcggcactaacaatagcagttgacttttcctatctgccaagctag

SEQ ID NO: 18543 - DNA, 1335 bp, A.fumigatus
  unsure (1128),(1173),(1217): Identity of nucleotide sequences at the above locations are unknown.
aaattcgtcgttgacgcagatccaattgtccgaacaataggtgctgaagcacttggacgactctgtgacggtgctggaaacacacttatgactacacaggtcaattggttggtcgatactattgttgataaccgggagcctaatgcccgcgctggctgtgcagcagccttgggatgcattcacgcacaagtaggtggtatggcagctggcctgcaccttaagacgattgttggcgtcctaatgtcactttgtaacgatccccaccctgtcgttcacttctgggcacttgggggtttagaaagagtagccaattccgcaggcttgactttttcaccgtttgtttccagcgcgctcgggatgcttgctcagctatacaacgctgatactcacaatgaagaggccgcaagcttggcaacatcgaacatcgaaatgaccttcctcactccggtggtaataagtcgctgcgtcgattcactgatcaatgtcctcggccctgatcttcaagacatcaccaaaacacgaaacctgattctgacgctcctccggcaatttcaactagaggacaatcccgctttagtcactgagagctccaagtgcttagatcacatgtcactgtatgcgccgggatttgtggacttttcaggatttgtgacgcgtctccaaaatgaattatctgcaggcaaccctttgatgagggatgtggccattcgtgcattgagtaatctcatgaaacgagatgctacttccgtccttcgagcagcaacgccagatctcgaagagcagatatggcttgcatatgatgatacacctgataacctggtcctgaaaaatatgattctggactggctacagcacaccgcccttacagagaccgagcaatggattcagcgttgccagaatacgttgaccaagacccgactgaaagtagaggacatcccaccaacgtctgctgttaagacggctgtcaatgacatgccagacgacgaggttgcaggtttcgcatatgcaattgccggggcaggacaatcggagactgtaaacgaaactgttaccggtcaggagctgttgaaatggcaaactcgcaatttcgtgatgagttgtctgagtcagcttttggcgacagtccangaggctattttgcctgatcagacaattcctgctgaacttgccctncaacacaagggtggagatattgtccggatggcattctcagcgtncaccgcaaacgtcgtaaagctgaaagtctgggggcttgagaatatcgaacaggttctcaaggaaactgggctctcgctcttcttcaacagggcgatgatttggctggacttcggaaca

SEQ ID NO: 18544 - DNA, 1104 bp, A.fumigatus
ttgttacaggatattcctgcgccagtccagtcttttctcagacaatatctttcgtcttggaacggccgtgataacaaagaagaggttctcagtcttcttgagtacctgcccgtccaggactttgatattttacgagccaacttcctgactcccttggaggctgccatactgggcagtggtccattcactatgacagtcattcttgacctttattcttcacttattcggcaatggggtgtgaagctgaggtcttcaccttcagtctctgcagaatcaagaccgttgggtcacctaatcactcatgcggaactgctggcattgtcaatactagagagtctttcggtggcgtccaataccggcaataaggaacctcgcaaaccggccgccctatctgtcctcgagttctactgcgttttagccaacctattctcttatgcgcccgtgaatggccagatccgtctcactattcctctagctccgacagtctacactctcgtttttacacccattctctccagcatctccatcatcagctctgttcttgccagctacaaaatgtccttcgaaacatctctgacatccgaaattcttcaagtaccaggctctacaaattcgctgtatccgactgaattggtgggccagttcaacggctacgtcatggacgtctgcaatctggtttggcgaaatcgagggctcaatggcgatgatccaaacgcacttggctgtctgctgccacctgctacaacgagtgcgctcacacaatacattcgggaattgaacgaggcatcccgagacagaaagcgcgaggcttcgtttttcttcaacctgtcttccattttctctcttagttaccatgtagccctgtgcaacatgtcagccggttgcttcgctgacatagaggaagaaaacaacatcacggagggcaagcctagattgagaaaacccgtgactcagaaggcactgagtgcacttgagaaagacggtggtgtcaagttgacttggcaggagtacagggtgcgtatgcttgactggctagacgccacaggaagccgtgggattgggaacttgatgcgcagtacgatgaaagctttacgtaaggattga

SEQ ID NO: 18545 - DNA, 291 bp, A.fumigatus
tggtcatcaaaattaggtagatgtgttcagataaatatcttggacgctgggatcctctcgaagggtactcagaatgtcctcaatttccctgacttgctcgtccttgttcaactccaccatagtgtccttgttcggatcccagattatgtcaagttcctttatagcgagtcccgtcacttttgtgagcgtttcgccgacactcttcgtttctgttggttctgtaaagaccacaagccggtcttcatcatccgtcgctacatcaatggctcccgcctcgatgacctggtctag

SEQ ID NO: 18546 - DNA, 303 bp, A.fumigatus
accaatcaagggcgcagatttgggatactgccggtcaggaacgctaccctggccattacatctgcctattaccgtggcgccgtcggtgcccttcttgtgtacgatatcagcaaacaccagacttacgacaatgtcaaccgctggttgaaggaactccgtgatcacgccgactccaacatcgtcatcatgcttgtcgggaacaagagtgatttgagacaccttcgcgccgtgccaacagatgaggctaagcaatttgcgagtacgtttgttgtccaggcagctcctcagggattgatttactga

SEQ ID NO: 18547 - DNA, 240 bp, A.fumigatus
gtcgattcacccgccaacgagttcaacctagactccaagttctacccattggtgtcgatttcgcaacccgctcaatccaagtggacttttagaccaatcaagggcgcagatttgggatactgccggtcaggaacgctaccctggccattacatctgcctattaccgtggcgccgtcggtgcccttcttgtgtacgatatcagcaaacaccagacttacgacaatgtcaaccgctggttga

SEQ ID NO: 18548 - DNA, 207 bp, A.fumigatus
gcttgcttttcaaaacatcctcacaggttcgctccctctattcatgaccccttgtccaaatggactcacatgttgctagaaatttaccgcatcgtctccagcaaggctttggataatggtgactccggacaagcccccctcagcagcggccgcacgattgaagtcagcaaggctccggatactgagtcgaagcaaggctgctgttaa

SEQ ID NO: 18549 - DNA, 210 bp, A.fumigatus
gcaatttgcgagtacgtttgttgtccaggcagctcctcagggattgatttactgacatctgctcggaacacaataggcgagaacaacctctctttcatcgaaacatctgcgcttgacgcaagcaatgttgagcttgcttttcaaaacatcctcacaggttcgctccctctattcatgaccccttgtccaaatggactcacatgttgctag

SEQ ID NO: 18550 - DNA, 207 bp, A.fumigatus
tgtaaccccagaattatcaactcaacactctggcgcagacaatttgcacgcggcaccccaaaacactttgcgagaattagagcttgtgaatgtagctgtacaggaccccgcacaacaaaccggcgaactattatcaacatcgcaggttccattgccgaaacacagaactccgcaagcagcaaccgagacttcacctataacctctga

SEQ ID NO: 18551 - DNA, 1293 bp, A.fumigatus
acactctttcaaatttaccttcttctgctttgcggtctggttctgtttactcccgttgaaacgcttgttgctgatcgggatcagagaaacaatcataagtactccgatgcttggttagaagggttcgatgatacagagccgagcatctacagaattggggaagaacttcgtcgcaatgagcttgtggccatatcatatccagctccagacagcagaatgtcgaacgtgttacttgcctattccccgaagtcgtcagactttgcgtttctcaatgcagattctgcccattttagaacctctgaggacgttttcctaaatgtcgcagtccgaagccagttgcgagggtttgacaccatcactgctcggcgtgaaaggaaacggcttcatgctgggtcgcgcaagccagtacccttcgcgctcataaatacctcagatcctccaagcagagctactcccaccggggctttggctactcggccacgttctgtgggcgttcctgatgtttctgctccggaagccgcgagacctgtcaatgacatgtccaaccatcccattcatatatcgagggatagcgatgtcttgctaccaaaagcatctgcggcgccagacgtggcaaaaccgtccgatgcagcaaatcacttaggctcaacaaacacaactagtgtaaccccagaattatcaactcaacactctggcgcagacaatttgcacgcggcaccccaaaacactttgcgagaattagagcttgtgaatgtagctgtacaggaccccgcacaacaaaccggcgaactattatcaacatcgcaggttccattgccgaaacacagaactccgcaagcagcaaccgagacttcacctataacctctgaggctcgaacagcgccagaggcagcccctgggtttcctcgcctcggcaggcacgacgcgagtatggctcagtctattgcaggcaatgttaaatcgccgtcgcagccgtctgagaatattcttgatctggatgcggtcttcaaagaacaatttggtgttacttatgatctcctggcgactgtgaacgatgctgagaaacctacgaaagctcaagtattttatttgatgtttcctgccgggtccgaagtagtgcaggaagagtacgaagttatgcatgagtttctgagaaggcacaatgctgtgacttattcaaaccgccttccggaagattgggagagatttgcacgcactatacacaaaggggttgtcttggtcagtcaggaagtaccatttactaataatccaacagctgcgctgactcagtga

SEQ ID NO: 18552 - DNA, 1797 bp, A.fumigatus
gaaagaccatttcagcctgatgtcgacatgagcgacgatgatgatatctcgattacgtcaactgcacccagtgagcaggagtctgagtatgaagttgaaactatcctggctgagctcgaatttgacgatggtatcaaatacttggtgaagtgggccaattaccctattgaaagatgcacatgggaaccgcccgaatccttttgcaatgaacagacattgatcgactggaataagaagaaaaactcaattgctgaagggaagcgtccggcattcgatcttgtcagttttgaaaatcatctagctgcccttgagagggcgaaacatgacaggaagcaaaggagagccgcaaagaggagacgcctgggtcttgacggagccccgcaaagtcatcctgctgcggagagtccttcgagtaataacgtgcctgacccaagaattcctggtgatactggtttcaatgatatcgaagtcgacagatcaaaggcttcatccggacaaactccccgaacgaacgccagcacaggaagtgcgcaactacaaactcagcaacttccaaaaagaccacctccacctgttttatttggaactgctccggctcccacgcgcccgaaaaggatgaacagttctgagacgccaaagctgttcaatttgtcgacgagatggaagtacgagaaggcgaaaacttatgagccacctcctgatgtgaacaagctgcaactcattcgacaatctgactggccagccaggactgggctcaccgcgacaaagacagggctgtacagcgtcaaccggcctagcacggagaatgacgccaataccgcaaggctcggatctcataaggtggtttcacccacgcgggatgactcaagctcggcgaagctaggtacttatgacgctagctcgccaaatgagagtgacttgagtagcgtaaaggctggatcgcacgaccttaattcatcgaagcaatccaatgcaagtctggtgaacctaggcctatataatgtgagctctcctaagtcggttacttgggggagactagccacgaataacgtcaacgggtcacatggaatcagtgacagtgctttggatccacaatcgcaagatgttagttcgccaatggaccttgattcggataatgagactcaaggccagattagccaaactcgggaggattgggccctgagttcaccgaaacgcgtacaggatgggtcatacaagccgaatgacagcatcccagacacatacagaccagcgtgcggtgcggatacatggataccggcccgtccactgcaagatagctggtgtgcaagccatgacagtgtgaaacccaataccatccccccaatccatcgccaggaactcgaagactatccgatacgcaagcttccaacaagggaaccaaaaccgggcgcctacatcgtcaagagccaacaacagtacttctggaacccgggtgagctccttgtctatctttattacggccttgaaaagaaggaaatcggttcggccaggctatgcggtctgagtcctgagagtcgaagcaggctcatgtctaccaaaaggggcagccgaatcaatatctggtttcaacatacgtgtaacctggaagagtataatgtcctatgtgagaacacggtaagtcaattttttccgacttttcttcccattcgctcctctgaacactctttcaaatttaccttcttctgctttgcggtctggttctgtttactcccgttgaaacgcttgttgctgatcgggatcagagaaacaatcataagtactccgatgcttggttag

SEQ ID NO: 18553 - DNA, 612 bp, A.fumigatus
atcctcgccgctgccaacctcaacaacctctcaatgtcaacccccgccttcagcttcggcacggacaaccgcacccccgaatttctcgccaagttccccttcggcaaagtccccgccttcgaaggcacagacggcaccaagctcgttgagtccgacgctatcgcgcagtacgtcgccgagagtggccccgccgctgcacagttgctgggtaccaagcccgtcgagcgcgcggctatccgtcagtggatcgctttcgccgatggggagatccagagccctgtgattcccctagttctgccccgcattgggcttgcggcgtttgatgaggccgtcgagaagaagaacctggagaagttggagaggtcattggcgtacttggagggccacctcagcggccgcaactggattgctaccgaggagaagctgagtctggccgatatcactgttgtttcggccctctactgggccttctccactgtgattgaccgcgagatgcgccagaagtaccccgtcgtcgtctcttggtacgagaagaccatcgagagcgaaggtgtcaagcaggcctttggtgagaagaagttcatcgaaaagcgtgagatccccaaggcttga

SEQ ID NO: 18554 - DNA, 183 bp, A.fumigatus
tactctgtatccagcctcggccaggtttttggcagcaacactaccaccgcaaccgctccccactatcacaacatccgtgtctatggtttctggttcggcaccagggggaaattgcaggaactcgtattcgaaaccatccgccggtttgccgtggatggggacgcgggggcagccaacgactga

SEQ ID NO: 18555 - DNA, 234 bp, A.fumigatus
tgcttgcgaactagcccaaagcctggttcggtcccccctccaattattaggtttgttattggcgattccgagtgggctgattcagtgatctgtcagccccaggttctagttattgtactcttcgccgtctccaaccaggtctgtttcgagattcccgtagagcttgaaaccgaggcagtgaccatgatgttaccggagcttcagacactgtgggtcgaggttccgagagtctaa

SEQ ID NO: 18556 - DNA, 1113 bp, A.fumigatus
aacccagggatgagtcgcaatttgtcaaactgtttgcggacgcccaattctacacatgtacggagtccactgctacgtcctcaagaacaaggactgatcctcgcagtaccccgattgatgtcccagctattcgaatcccaaatcttcatccaaatcggcgaacgccatttccaaatctcgcgcgacatcttctccggacccggcgactctcccaatttcttctccctcgggttcgccatcttcttcgccaacccacgcgagctcttccccggcctcgaccgtcgcaatctgctgcgcccacccgcgatcgttcccccacgcgttacccaccgctccggcgacgtcttcgcagagctcctccacctccttcgtggataccctctccagatcaggaatgaggagcatcgcgccgaactccttcgcgactgccgctactttcaccttcgcggcctagaacagaaactcatccctcatcacatcagcttcaatcccattcgacaacaatcagagatcctcatccgcttagacgatgtacgcccgtcaggaatcagccatgcacgcgacgacagctccaagtaccccagctccacaactcgcgaccgggtgacttatgcgcggcctttcgtagacgagacgcctcacgacctgatcctggaaatcggtgacgaaagcacagttctcgatgcacgcgccatgcgagcggggttcctgaatctggcgaaagcccgcatgtcgagcttggctcaggtagttgccaaaagcgtcggccttgaggggccgctatacaggactggggaatccgcaaatttctctccaggcggagacagcttctcgatcaggttcgagcgggagacggcgctggtcctgaatgggcagtctgtcgattacctggatcttcctggcgggacagcagaatcttctgatcggccacctgcgaaacgcaagcgagcggaggacgacccagagtctgggagtatggtagtaaagaagggacagtggcgactagtggttgagtccggtcccgccgcgagcgcagagttggttttgatagcagtcaagctcgatatttacactgaggagagggcgaggaatcgctctacggggcctctatag

SEQ ID NO: 18557 - DNA, 1797 bp, A.fumigatus
  unsure (641): Identity of nucleotide sequences at the above locations are unknown.
acctctatactgagcagctaccacttttgggctgaggaaggaaagcatcaccaggacgttgtttatcatcctgccgccccgctgttgttcctggtgtttctgctccacatacaactgcggtcgattcttgacggccttgatcctcgtgtcctggttgacagcggttactctctgcaggcttattctacctatataatcctcattctcgaggcgactacttattactactcttcggctgtgttcatcatggctgagcaggctgtaactgcatacgtccccctggacgtgcctcttcctccgattcctgaaggccaagtcttttccgacctgcaatggagaacgttgttgtctctggcagacacagtgatcccttccattcgttctacatcactccctaagtctgtctctaccaaggtggtacctgaatcgacattcaaggacgctgtctcgactctggcatctcacatccacgaccctgacgccacacagattgctgagcaatatctagaggagaatgcgtccgccaatccccaattcgtggaagggctgcggcggcttttcgccgagtatatccatgaagaaaggaaaagcggaatcaatctcatcctcaatgctctcaagtatgtcgcccccgccatctntactttgtcgactgacctactaacaacttctagctccaaagctggttcgctcattctgactggctcgaccactcccatccaggaccagccgtttgaaatccgcgagaagatcttttcttcttgggaaacttcgcggatcaagcctcttcgtgccatctatagggcgtttacggccatctttaagaagacttgggccacggtgagccccacgatccgttcagtcgttggctgcccccgcgtccccatccacggcaaaccggcggatggtttcgaatacgagttcctgcaatttccccctggtgccgaaccagaaaccatagacacggatgttgtgatagtggggagcggttgcggtggtagtgttgctgccaaaaacctggccgaggctggatacagagtactagtcgtggagaaatcctaccactacccatccaagtacttccccatggatttcaacgagggatttgtcagcatgttcgagaacggcggagcgacaacgagtgacgacgggtcgattgccgtcctcgctggttctacatggggcggaggtggcactgtcaactggtcggcttcgctgcagacccagggctatgtgcgccgggaatgggcaagtaaagggctgccgttcttcgagtctcatgaataccaacaagccttggaccgtgtctgcgatcggatgggtgtcagtaatgaccacaccgagcataattatagcaatcgtgttctccttgatggggctcggaagttgggatatgcagcccagcctgtccctcagaacacaggcggatcgaatcactattgcggatactgcacaatgggctgccattcctgtggcaaaaagggcccgagggaaacgttcttggccgatgctgccaaagctggcaccacgttcatagaagggtttcgcgcggataagattcgtttcaagaacaccaagggcggacgggtagcgtgtggagttgagggaacctggacctccagagactcttatctgggaaccgctgggccggaccgcacgacccgcaaggtgatcataaacgcttccaaagtcattgtttcctgtggaacattgcacagcccgcttttgctgctgcgtagcggactcaagaacccgcaaatcgggcgtaacctctacctccatcctggtgagttttga

SEQ ID NO: 18558 - DNA, 819 bp, A.fumigatus
aatcgatattgcccgcctccaagactttcgctaacgactatagttgtcctgtcatgtgctgtcttcgacgaggaaatccgtccgtgggaagggtccgctttgaccatagtcgtcaatgagtttgaagatcaggacggccagggccacggagtcaagatcgagaacgtcgtaatgcttcctgccctttatcttccgacgttcccgtggcgagacggattggattacaagctctgggcagccaagttgccccgcatgagcggcttcatcgcgctgaccaaagaacgagacgcgggacgagtataccccgatcctgctgatggccgtgtccgaattgactacacagtgtcggcctatgaccggaagcacattgtcgaagctctgatcgcgacggcaaagattgcatacatatcaggggcaacggagttccatacatcgaaccgcgaaatgccgccatttatccgtcccacggaggcatcggatcccaatgcgcccgagggcgttaccaaccaagcacttcaggcatggattgccgtcctccgacgcaagaaccctgtcgaccccgaacgcacacagtacgccagtgctcatcagatgggtacctgccgcatggggtcatcccctaggacgagcgtcgtcgacccagaatgtcaagtctggggcactcaggggctgtacgtcatggatgcgtctgtctttcccagtgctagcggagtgaacccgatggtgacgaacatggcgattgcggactgggccagccggaaagttgtcaggtctttggagaaggcgaaccatggcaagaccgtgctggctcgtctctga

SEQ ID NO: 18559 - DNA, 276 bp, A.fumigatus
ttcgaacctcaccttcacaaacgaccgactgctcgaccaggaccagaacggcgtgatgatggcctgggagacggagatcatgtcccgatccgccaagaagctgctccccactacagggctgcgcgtcatgaacatcggccacggcatgggcatcgtcgacggcttcatccaggagcagtcgccggccgcgcaccacatcgtcgaagcgcacccggacgtcgtggcggagatgaagcggaaaggctggcacgaaaagcccggcgtggtgatccatga

SEQ ID NO: 18560 - DNA, 972 bp, A.fumigatus
gtgcaggagggcgcgatctggaatgacgtagatctgaatgacgagacgccagggcgtatcgcgcggcggttggggctaaccgagctgtatgagatgattgtggatgcgggtgtgcgggcagagctctttctcaaccggttggatgggtacgagccgctctctgatgacgaggacgatcaagaaacgggacaaggcgaggacgccgccaacgaacccgctgcagaagaggatcaggatgaggctccggaattagtcgagacgaccgcggccgacgccagcgccgccgaggcaagcacagaaggaccaggaccagacgtcacaagctcgcgctaccttgattcgaacctcaccttcacaaacgaccgactgctcgaccaggaccagaacggcgtgatgatggcctgggagacggagatcatgtcccgatccgccaagaagctgctccccactacagggctgcgcgtcatgaacatcggccacggcatgggcatcgtcgacggcttcatccaggagcagtcgccggccgcgcaccacatcgtcgaagcgcacccggacgtcgtggcggagatgaagcggaaaggctggcacgaaaagcccggcgtggtgatccatgagggtcgctggcaggatatcctgcctgcgctcgtagcgcagggcgagacctttgatgcgatctactacgacacctttgctgagtcgtatgctgattttcgggagttcttcagcgagcaggtaattgggttgttggagcaggatggcaaatgggggtttttcaatggcatgggggctgatcggcagattagctacgatgtctatcagaaagtggtagagatggatctttttgaagccgggtttgatgtagagtgggaagagatcaaggtgcccaagctcgagggagagtggactggtgtgcgcagaccgtactgggtggttgacaattatcgcctgcccttgtgtaagtttatggattaa

SEQ ID NO: 18561 - DNA, 255 bp, A.fumigatus
ctaaaccccctgacggattgtacattgtggctgtgctatgaatcaggcactcagacccatggaaacgacgtcactccacataataaggacagccaatcaaatgtcatcgcgagaaaggaaaacaatgaatccttgccttccttggaagctacagagcccgatcaatttaggaagtgcaacaagtgcaacaggtgcaacaaaggaaagaacaatcaatcgaccctcaaaaatgcctcaggtatctacactctgtaa

SEQ ID NO: 18562 - DNA, 3615 bp, A.fumigatus
attcttgctgtttttgcttctcaaaggcaaactcactcgtatctagtgagtgtcactgacaatgtccgtatcggtacttccgctaacattgggcttctccatagtcaacctagaacgtatttggtcccggacagagagcgcacaaaaccgtccccgccgggtttatttagctgggttgggcctgtctttcgcacctctagttccgaattcatccagaaatgtggcctggatgcctacttctttctgcggtacttgcgaatgcttctcaagatcttcgttccgctaggttgcattgtgttgcccgtcctattgcccctgaacaaagtcgatggaaaagaccggaacttcaaaaatgcaactggtacaggtgacacatggaatgtcactggccttgaccaattggcctggggtaatgtggctccagagcacgttcagcgctactgggcgcatctgattatggccatcatcgttattgtctatgtgtgcgccgtattcttcgatgagctgaaaggttatattcgccttcggcaggcctacttgacttccccacagcatcgacttcgagcctctgcaacaacagtgctggtaacagccatcccagacagctggctgtcggtggaggctttggagtcactgtatgatgttttcccgggtggcatccgaaatatatggattaatcgcaattttgacgatctgaacgagaaggtgaagcaacgtgatgcgctagcattgaagttggagtctgcagagacggacttgatcattaaatgcaagaaagctcaattgaagcaggcgaaggccgcagcgaagaagacaggaatgagtgccaaggaggtagaggggaagcagaagcaggccaccgacgagcatgcgctgcaactagctgcaggaggcggtatcagctctggtgatccgcaccaagctcacacattgaaccagattttgcatcgcgatgttcatgggaagcatcacgacgaacctggagagcctaaaaggcgcaagcctttcgacccagctgtggaagcggtagggatggtcggccaaggtgtcggcaagttaagcagatccgttctgggaactctaaaacgggtggagggcgacatcgacagcactctgactcggtcagggggctatataccagacactgggactactgcacctctccaacaaagagcgccggatgtcgaaacgaacaacgcagagcagcccgatccttggcgaccaagcaacgatagcatcgccccatcgattgagaatggaaatgcagcgtctatgaatgagaatggcgcaccatccaatgctcctcgtagcagatcggactccaagccaagacggcccttctggaaaagtcgagtttctagcagctattcgaaagcgagcaacaggacagaaccggacgagtttccactcacggctccagaggatccggccgaaggagaagcttcaaacgaagagagatcgcacaataatgaaaagcaaaaaggcaaggagcccagaggccggagagaaggcgacgaagtcgacggtgaggagtatccggtggcgtacaatgaagactttgacagtgaagactatggagagcctctatggaaaaagtacatccgggaaaaggatcgtgacacaatgaggttgccgatctttggtctcagttggatgccttccctctggctcattggcaaaaaggtcgacacaatagactattgccggaaagaagtcgctcgcttgaatctggagattgaaattgaccagcaacaccccgagagatttcccctcatgaattcagcattcatacagttcaaccaccaggtagctgctcatatggcttgtcaggctgtcagtcatcacctgccaaaacaaatggcccctcgcatcgtggagatctcgccggacgatgtgatttgggacaacatgtcaatcaaatggtgggagcgctatctgaggactttcgggattctcgcgatcgtctgcgccatggtggttggttgggcgttccccgtcgcgttcactggtttgctgtctcaattgtcttacctggaaaatgccttcacatggttatcgtggatctccaaactgccagactggctcatctctgccatccagggtatcttgcccccacttttcttagccatcttgatggcgcttctgcccctgattctccgatttctctgtcgagctcaagggttacacacaggcatggccatcgaacttaccgttcagaactacttcttcgctttcttgttcgtccaattgttcctggtcgttgccatctcgtccagtttctcgacgatcatcgacaatgtcacaaacgtcaccagttggccggaattattggcccaaaacatcccctcctcgagcaactatttcttctcgtatatgattctacaggcgctgtcagtgagtgcgggagctctagtacagatcgttagcttgttcagctggtttattctagcacccttactagataacacggcaagaaagaaatggggacgcacaacgaacttgaatcagatgcaatggggaacattctttccggtctatactactctcgcatcgatcggtatgtttaaccccacagggactacttctgacgtagctaatgcgcgaaacacaggtttgatctattgtgtgatctcccctttgatcttggtcttcaacgtcatcacctttggcctgttctggttcgtgtacagatataacacgctgtacgtcaccaaattccgttttgatactggcggactactattcccgcgcgcgatcaaccagctcttcacggggttatatgtcatggaactcagcttgatagggctgttctttttagtccgtgacgtggatggcaacgtggcctgcgaagggcaagcaatatgcatgatcgtggtcctgattctcacagtcgggtaccagatccttctgaacgaagcttttagccccctaatccgttacttgccgatcaccttggaggatgatgctgttcgtcgtgatgaggagttcagccgcgctcagcgcgcccgacttggctttcctgaggaagatcagacagacacgatcgagcatcagctggcagagcgggaacatcaagagcacgaagcagacaggagggcccacgagattgaattgaagaacattgaagcatgttctgggcgccgagcatcgactcagacagggactctccagaacaaccgccatcattcgtgggcagatcggtcttcaaaaacacgttccaaatattttgggactccttcgagcggttcagtgccaacattacagagagtccgtgagaagattgcgcatgatgccgaagcccaaggctctcctccgggtaacatcggccacgcattgtttgccggtattcatgatgaattggaggaccttacaccagatgagcgtgatcaactgactcagcgagcgtttcaacatgacgctctacgggcaaaacgtcctgtgatatggattccgcgagacgatcttggggtaagcgatgatgagatttaccgaactcaacggttcagcaagcacatctggatcagtaacgagtatcaggcactggacggcaagtgccgtactatcttcagccgcagtccgccggatttctcagaagttgacctcattcagttatag

SEQ ID NO: 18563 - DNA, 804 bp, A.fumigatus
actggacatcccaggccccgcaggaccgatgcatgcggaccaccatcttccgccccaagcaccatacccaccccatcgatgaaatccccggtatcctacacatccacggcgggggccttgccaccggaaaccgcttcctgggtttcaccatgctcgactgggtcgagtccctcgggcgccgtctgcctgacggccgagtaccgtctcgccccggagcatcaccagccagcccagctagaagacagctactccgcgctgcagtggatgagcgactacgccgccgagctgggcttcaacccgcgcaagctggttgtctgcggtagctcggcggggggcaatctcacggcgggggtcaccttactcgcgcgggaccgctcgggcccgcaaatccgcggccaggtgttgatctatccgtgggttgacgatggcatggactacgtgtccatgcggcagtatgcggatattgcgcctgtgagggacgtggacgccgccgtgttggctaattatgcgtttggcgagaggcgcgagcacgcagatatgtatactgtgccgatgcgcgcgacgaatttcgcgggcttgcccccgacgtttatcgatgtgggtgaggcggatgtgtttcgtgatcaggatatcgcgtacgcgtcggctttgtggaaggatggtgtctcgactgagttgcatgtgtggcctggcagttggcatgggtttgatgtctttgttcctgatgctcccattagtcggcgggcgagggctgctcggttggaatggcttcggaagttgttaagtgtgcctgacggtatctag

SEQ ID NO: 18564 - DNA, 2310 bp, A.fumigatus
tcctcgttcgctttttcctcactttcctccttccaaccatgcgagagggcacttatcaccaagatggaaggtaatagcaccgttgcccttcggcaactgtctctgagcacagtatctagccgcagctatcaagcgcttgggtattcccagaatgatctttccggggactctggcgcgtctcacaacgaagagccgccggcatattcgcacgtatctccagccgcgcaggtccctgggcgaggatacagtacaacgcttcatcgctcgccgggcgttttgctgcccacgcttctgtatgcagggttggcaatctatgcgtgggtggcgatcgtttatctttcctttcgtcccatgagtgccaagtcgtggggggcacttctcacagagaatcgtttgtattccgaatccgtggattacgcgcggaacgaaggcatttatcgctctgccgtggtaatctggaccctgatcgctatcatgactctcccttggctttcccctgtatgcgcaagtgcagcggtcatctatgtgcagaatcaaaagacggccgacagcctgcaaatgcgccaagtcacgaatctggccgaccgtcgatggctggacctcagcctgtacaaagcccttgtctctgggggatggaagaagcatggcagtacattcttaattctcgccatcgtccttcatctcgttgccggcttgacatatcccatccagtcaatcttcctcgaaaccacgacgatcaatgtcccccaggccatggacagggtggcgagcatagccgatcttcccagccttgaataccctgacgcggctatctcgctgataggcaatgacatcttggcggttcggcgggctctcagcgacgcggactccgtcaccgtccagccgttcttgtggcagaacacatctggagtccaactacataccttgagtgatattctatccttgaacgactctttctatgctcagcttccgactggattcaacacgggcgtcctgcgacagtttgcgccgcgcgtgaactccaccgccacgtacgagactatcctggccagcgaattcccgtcgaactgcgacagtactcctggctctttttattccagacactattccgaatacgcaatgtccgaatatcgtaggatctggggagtcacggcctgcatgccttccaactggactaaatcacagtggcagaagacgcgagctcgtcaggagttctccgaaacgctctacttgaatttcaccagctcaaagggaaattccggcgacacgcccgctgacggtaagttgtaccgggtcaccgtcagcactaccgcgggatacttcgagctgccaaataacatgaatgacggaaagcacggtccactcttggagcaagaccccgttggcctctgtggcgcagactgccactatcagacgtttgatcctgatctgagcctcagccggatccgtcgcgataacatcaccaccacagacacccttgacgcagtatcctgggacccacttgcaacggtcagtaaagggccccttctcacgacggcactcgcactgtttggtccaggctccttcctggacacattcgctgcgaagatctgggccatcaacgacagcttcaacagagccaacgtcacagcaagaatctgccttgacggccctccactcctcgacctgatgctgtatcaatcatacagcaccaagcattactgcctagacgctccgatggggactcgctacggggccagcgccgcggatcccctcatccatcagtggatcgactatttcctcaaggtcgaagaccgattccccatgctcttcacggcggccgccttcctatccaacaagcaactgctcgagtcagtgtctggccagtggtggatataccaggatctcggaaccgagatgatcatccctactatctccctcgcagggataatcgtcggctcgatcatgatggctctatacatcatcccgatggtgggactcgcgttttacgcggcgtggtatccacgatggacagaacggctggattccttcacgatgctgcgcctcggggccacgatcggcgataaactgctccctttgcgagcggccaagtccgtggatcggattccagtattggatgaaatcccgggtgttgtgagggatgtgtctattccggatgggaatgtggttctgccggtgggtactttgggacttggggatggacggccgttggaggggcagcgtcggtatgaggcttataaggagagcgatgagcctttgacgccgatggaatgcaggacgctgcagtcgagaatcaatgatgatccgtga

SEQ ID NO: 18565 - DNA, 189 bp, A.fumigatus
ttgcaaggctatgtaatgttacaagacggtggcagcggtctgcaaggagagaacaatagtactctttttcaaaatcacttagatttaggtttggatcttgaagccgtcgccttaggctttcaatgtgtccagttccgtggcgattttgtgctgccaggatacgtcgtgaagttaactttggctgaatag

SEQ ID NO: 18566 - DNA, 255 bp, A.fumigatus
ctaatgagatcaacgtgttggaggccgtggcagaaggcccaggtaccggctgtctcgcagcctaccgctgttgttaccgaggccgatactcctgacggtcctggattggccgaccagatcgacgccctcaatggaactggtaatcctgctgctcagccatcgcgcttcggtgaatttggtggacagtacgtccccgaatctctcatggactgcttggccgagctcgagcgcgggtttccaagaagctgtgaatga

SEQ ID NO: 18567 - DNA, 1344 bp, A.fumigatus
gatcaacgtgttggaggccgtggcagaaggcccaggtaccggctgtctcgcagcctaccgctgttgttaccgaggccgatactcctgacggtcctggattggccgaccagatcgacgccctcaatggaactggtaatcctgctgctcagccatcgcgcttcggtgaatttggtggacagtacgtccccgaatctctcatggactgcttggccgagctcgagcgcgggtttccaagaagctgtgaatgaccccaagttctgggaggagttccgctcttactacccatacatgggtagacccagcagcgggcatgtggccaatcgcctcacggagtatgtagggggtgccaacatctggctcaagcgcgaggatctcaaccatactggcagtcacaaaatcaacaacgctctcggtcagattctcatcgctcggagactgggcaaaaccagaattattgctgaaaccggtgctggacaacacggtgtcgccacagccactgtatgtgcgaagttcggcatgaagtgtgtggtgtacatgggtgctgaggatgtccgccgtcaagccctaaatgtcttccggatgaagctccttggagcctcggtcgtggccgtcgatgccggaagcaggactctgcgtgatgctgtcaacgaggcccttcgtgcctgggttgttgacctggacaccacccactacattatcggctccgccattggacctcaccccttccccaccatcgtgcgtaccttccagtccgtcatcggcgaggaaaccaagcagcagatgatggaggccatcggcaaactccccgatgccgtcgtcgcttgtgtcggcggtggcagtaatgccgtcggcatgttctaccccttcgccaaagacactagcgtcaagctggtcggtgtcgaggccggaggcgacggtatcgacacaaacagacactcggcgaccctgaccggcggcagcaagggcgtgctgcacggtgttcgcacgtacgtcctccaggacgaacacggccagatctccgagacccactccatctcggccggcctggactaccccggtgtcggccccgagctcagctcgtggaaggacagcgaccgcgcccgcttcatcgctgccaccgacgccgaagccctgatcggcttccgcaccctcgcgcagaccgagggcatcatccccgccctggagtcctcgcacgccgtctggggcgccatggaactcgccaagtccatgaagacaggcgacatcgtcctgaacctgagcggccgaggagataaagacgtccagagcgtcgcggacgaactaccccgcctgggtcccaagatcggctgggacctgcgattctaa

SEQ ID NO: 18568 - DNA, 528 bp, A.fumigatus
tggatcaggtcgcgctatagacaagggtcccaaggttctggcggaagattatctggatatcaacggtcaacctatcaacccctactcgcgagtatgtatccgaccttccgtcacggcaatgtcagggcttgcaagggtggtccagctaatacgtgggaactccaggtctaccccgaggaaatgatctccaccggtatctccgccatcgatacgatgaactcaattgctagaggtcagaagattcccatcttctctgcggctggtcttccccataacgagattgccgctcagatctgtcggcaggccggtctggtcaagaagcccaccaaggacgtccatgatgggcatgaggagaatttctcgatcgttttcgcggctatgggtgtgaatatggaaacggcccgtttcttcacccgggatttcgaggagaacggcagtatggaacgtgtcactctcttcctcaatttggccaacgatcctacgtacgtttgcctgtgcttgcttcgcttgtctgccctgtttgattaa

SEQ ID NO: 18569 - DNA, 483 bp, A.fumigatus
ctgctgtccagaatcgagcgtatcattactccacgtcttgctttgaccactgccgagtactacgcctaccagctcgagaagcacgtcctggttatcatgactgatctctcggcttactgcgatgcccttcgagaggtttccgccgcccgagaagaagtccccggacgtcgcggttaccccggttacatgtacactgacttgtcaaccatttacgagcgtgccggtcgtgtggagggccgtaatggatctattactcagattcctatccttaccatgcctaacgacggtaagcagatttgcgagcagattctcttgcggtcgcttagcagttctgggctgactgtgtctctagatatcacccaccccattcccgacttgacaggttatattaccgagggacagatcttcgtcgatcgacaattgtacaacaaggggtgtcagccccgccgattaaagtcctttccttctctatcacgttattaa

SEQ ID NO: 18570 - DNA, 375 bp, A.fumigatus
cgcgtacttcttctccggcgtgtagacgaaacgtgggattgtcctaccgcgtttgtgacggacaaaaggtattcatcctctttcgaactgctgctcattttcgcaaatttgtcttgcgaatctctgcagttcgctagttatccctatctattcgtggatttgaggggcggagagaacaagcgcttcttgtctacagctccattccgtgttgtggctcggccggagcagagcatcgtcagccaagcaaatacactttactggcctgtgaaggtctttccagccatccccgacttctggactggaaaacgcagagagcttctggtcctgaatgcggaacttgaatacgtatacaatcagccagaaaggcgaagctga

SEQ ID NO: 18571 - DNA, 1041 bp, A.fumigatus
gatcgagcgtggccgaaagaaggctccgaatgcaagcgatcaagcgccttctctagggcaggtagatggtggtacggatgggcgtatgtattgcttcatttgagaactctataccttccgcgtcctgacaaacatttcacaggcgaccgggggattgaggagaagttgaaggcgacgactctctcagatcagaagctgactctggtgcactccgctaagcagggtccgcatatgcttgatgttcatcctcgtacgagctttgatcccggctccgccctgagtacaccattcggatccgacgatgaagcggaattatcggatatcaagcgagctcagaaactcaccatgcaactgtccgctattgacacttccgtcccaaacagatcgattagaactatcattcgaggtgacttcactcgactacaggatgagagcgagggcggacgtcgccggcagcgcaagtatctagttgccactgacctcagcgaagagtccgtttacgccctggagtggacaatcggtaccatcctcagggacggggacaccatgtttgctgtctgtgcagttaacgaggagctgggcattccctttgggtcgtcggtgcaaatcggagagggcgcccaagcaatgcaggactcggcagcaattgttggttcccagacagaagaaacagtctttaagtcgtcgaatgattcgatcaccagtaacttgcctcgtgcgttgttgggtcgtctaggacagggcacggacagtaaaccaagctctgtcgatgcgcggggtgtgcccaaaggccaacaagagaggaaccgtgcggtggagattatttcgcaaacctgtgtccgtttgctcagaaagacacttttgcaagtccgagttgctgtggaggtgattcattgcaagagcccgaagcacatgatcacggaagctgtacgtactcgtcctgatgcttacgagtccgcgaccaacgcttgtccaaatacactgaccaatctaccgctagatcgacggactcgagcctacactcgttatcgtgggagctag

SEQ ID NO: 18572 - DNA, 210 bp, A.fumigatus
tgccgtaatgcatggcgggcgttttctcgtttctccatagtgatggagttttttctttttcccttgatattgtatgattatgatctactaccatggggtgccgagatgattttttccatctgcgatctgctcttgctggctctcttttaccttctctatttgagcaccacagtctattgtgtctcgactttttatgttgtcagagtatga

SEQ ID NO: 18573 - DNA, 318 bp, A.fumigatus
aactgcgggcgtggatccctccctcatcgatcacatacggacgaccacttggccccctcgtcaggagcagctcttcctgacctttcatcgccctctcctatagcttccttcagcgctcaacggtcgtccgccaaggatcctgcagccatgaccgaatcattcgtcgacccgaggatggccaacgtcaagcctcgcatccgttacaacaccatcggaggtatcaacggtccgctagtcttcctggataacgtacgtaattgggctgggtcgcagcgtcgacgcaaacctatctgcgacatgaatggaatgacatgctga

SEQ ID NO: 18574 - DNA, 255 bp, A.fumigatus
accaaagtcgagttcaccggccacagcttgaagctcggtgtgtccgaggacatgctgggtcgtgtctttgatggatcaggtcgcgctatagacaagggtcccaaggttctggcggaagattatctggatatcaacggtcaacctatcaacccctactcgcgagtatgtatccgaccttccgtcacggcaatgtcagggcttgcaagggtggtccagctaatacgtgggaactccaggtctaccccgaggaaatga

SEQ ID NO: 18575 - DNA, 735 bp, A.fumigatus
ttcgtccgcgacgctctggacgtctttatctcctcggccgctcaggttcaggacgatgtcgcctgtcttcatggacttggcgagttccatggcgccccagacggcgtgcgaggactccagggcggggatgatgccctcggtctgcgcgagggtgcggaagccgatcagggcttcggcgtcggtggcagcgatgaagcgggcgcggtcgctgtccttccacgagctgagctcggggccgacaccggggtagtccaggccggccgagatggagtgggtctcggagatctggccgtgttcgtcctggaggacgtacgtgcgaacaccgtgcagcacgcccttgctgccgccggtcagggtcgccgagtgtctgtttgtgtcgataccgtcgcctccggcctcgacaccgaccagcttgacgctagtgtctttggcgaaggggtagaacatgccgacggcattactgccaccgccgacacaagcgacgacggcatcggggagtttgccgatggcctccatcatctgctgcttggtttcctcgccgatgacggactggaaggtacgcacgatggtggggaaggggtgaggtccaatggcggagccgataatgtagtgggtggtgtccaggtcaacaacccaggcacgaagggcctcgttgacagcatcacgcagagtcctgcttccggcatcgacggccacgaccgaggctccaaggagcttcatccggaagacatttag

SEQ ID NO: 18576 - DNA, 897 bp, A.fumigatus
cttctcctgctaataatcgtcgcagctggggtcctgcttcggattcagcattgcccgtcggcctctggtgctccaggaactgcaacctcgtacgcttctttgaagagatttcccggtgaatcatcagaaccgtctgcagctcgcaggtcttcggacaattcggatcaaatctccatcggaaagaaaaaaatagtagaccgaaataaactcgacaataacgacatgccggtgttaccgaagcgtactatacaaattcagttaccggagaagcctccgagggaaccctcccaccaacataagccatcgcagaccaagagcaccatggccgcgatgatgtcgggatttgacttgaaagtcagtctcccaagttttgccagaggaaggacaccctcacgacagagctcgtcccggggggcgtcactcgactctcgggtcccccaacgacgtgctcggtccagctctcagaatcgccggcttggttccaatcagctgaatcttttatcctcctccaagccgaccaagccggcgacggtcaaggaaaaaccaccccccatgaacaacactcatgccactcactccgatcccgcccttccggagtcggtcagcaatggcaccagtgtgacctcgcccgataaggagagcgaatctccagaaccaggcattaacgccgctacatcatctgctggagatgagcgcttggccaaagatttgtatgatagcgagaacaacccaatggacagcagcgaagacgaacccgatgagtcatcgtcgaatgatgatgacagcgacggtgagatcgagcgtggccgaaagaaggctccgaatgcaagcgatcaagcgccttctctagggcaggtagatggtggtacggatgggcgtatgtattgcttcatttga

SEQ ID NO: 18577 - DNA, 297 bp, A.fumigatus
aagcccgtcgtcggtgaggaagccctttcatcagaggacaagctctccctcgagttcctggagaaatttgagcgcacattcatcagccaaggcccgtacgagtcgcggaccatcttcgagtccctcgacatcgcttggaacctgctccgcatctaccccaaggaactgctgaaccgtatccccaagcgtacactggacgagttctacgcccgctccgcacgcaagctgccggccaaggacacaagggacaactccgcggagaacgtggtgggcgctgctcctctcatcgagacctaa

SEQ ID NO: 18578 - DNA, 1692 bp, A.fumigatus
gccacagtcagaccaacaaccgccatcatctcgtacttcgcaaagccatcggccctggcgctcagaccttccatcgtcacgggtacttatccaaatcgagggtggatggagacgtatcacggtcacgtccgcactccggcggacgccatcattctcttcgaagcatgccgcatcggccttcttccccgagttcagagacgactttcagagaaagagcgtcaatctatccagtccggttcggttttcgtctgggacgagcgtgaagcgggtatgcgacgatggacagacggcaaatcatggagtgccagtcgagtatcgggcagttttctcacctaccgcgagatggagggcaagcgcgggggtaccgtcacacaaccactcagagctggtaaaacgcctgacagcagagggagcgacgacgaccgcggcgatggggctgacgatgggcctgacgggtatcgatataagcccgacggacttatgaagcagtccttcagcatcaccacatcgaccggccagcatctccacctcatcagctactattcgcgatcgcacccggctgccgccactctccaacaaccttccaccgaccctgcgttacggcatgtacgtcctcaaaagggtctgtatcctgaatcaactgtcaacgaccagcagaatctgccggtggtcactcgtggccccatggcgggcgccacttattctgtccctcatccgatgagtgcatatgtgcgcgctggagctacacatcctcaatcgtatactccgccctatgcgtggccgccaacccccctcgggactccgcccaccatcactctgccatatggcgcctcctacttgtccgccgtacctacacctaatggcccagccatcgcgtacgggcaaccgccgccacatcaccacccggctcttccaccaccgcctccgccgcaacatggactgcatccgcaatacgaccggtcagtacatccgggtcatccagcggaaagctcattaccacccgctattccaccaccaatggcgcaacatacacctcttccggcactcacaggacgctctcctcgcttggctcctgatgcgcgcgacaactaccaacgaagcccgcgagactacccaacaccctcagtagatccccgaatcccgtcgcctcgcatgcaggctccttctacctcgcatagcaacggcgtgggacagtctgggcgcagcccgcggacaataagccaggcaccgccaacctcattaccgcaagtctcgcccccgtcactgaacgggacttccaaaccaggcgacatccaatcacaacaacagcacatccactacctctgccaccaccgttcccagcatcggggcgctgatgaacggcgcctcgggtcccttatcatccatctcatccgcaccgtcaaacaaactcaactctcctcgcttgggcggcagtccccgcgcagaaagaccgatagatatccccagcgaaaatattgggtttgggggcgaggatatgcaggctttgcagcagctggatcgggtctttaccgcttacatctggatctcttttttcttttcattgtataccaactccgtctcgctgcttgtcggatgaggagcactgtcatctctttgattatcaggctctctctaaaaatgtccttacggcctgtcccggggaatagaaggtggaggccggcttttttttaa

SEQ ID NO: 18579 - DNA, 330 bp, A.fumigatus
acgggacttccaaaccaggcgacatccaatcacaacaacagcacatccactacctctgccaccaccgttcccagcatcggggcgctgatgaacggcgcctcgggtcccttatcatccatctcatccgcaccgtcaaacaaactcaactctcctcgcttgggcggcagtccccgcgcagaaagaccgatagatatccccagcgaaaatattgggtttgggggcgaggatatgcaggctttgcagcagctggatcgggtctttaccgcttacatctggatctcttttttcttttcattgtataccaactccgtctcgctgcttgtcggatga

SEQ ID NO: 18580 - DNA, 192 bp, A.fumigatus
tggattggtggaccatattcgaaggatctagcgcaaaatggcgtcagccattcctactatgatcctgactggtctggcattaaatttggaaatctttcattcaccgctgggtggacttacatggtaattattaggccgaggcgtaaccgctgcatagtaacatctaaacatctggcccagtttaaattataa

SEQ ID NO: 18581 - DNA, 216 bp, A.fumigatus
tggcccagccatcgcgtacgggcaaccgccgccacatcaccacccggctcttccaccaccgcctccgccgcaacatggactgcatccgcaatacgaccggtcagtacatccgggtcatccagcggaaagctcattaccacccgctattccaccaccaatggcgcaacatacacctcttccggcactcacaggacgctctcctcgcttggctcctga

SEQ ID NO: 18582 - DNA, 186 bp, A.fumigatus
aatttggccgcggccgaaattggaggctattttgaacccctaaaacatgattttattactaaatctagttattcttgcgctgcggacattgcaatcgcctatggcctagaatatggcagtcactgcagcgtgggggtgcccattgagggcgttgttctgtatctactacctgctctggagggatag

SEQ ID NO: 18583 - DNA, 726 bp, A.fumigatus
  unsure (605): Identity of nucleotide sequences at the above locations are unknown.
gtcttagtcaagttgaatctcctcaaggtttcggtgactctgacgggggccgccagaacaacagccccgcggatcaatcaaccctccagattattattactacgccagaggccgaattctgctgcccctcttcttcacttcaccacctcgcctcggtcctcctccgccgttcgtcgcccatttgcaaacatggctatcaactctgctcccgagtcttctctcctctcccttctctaccgctcgtacccggctgcagtttctcccgacgccacagagcttgatctgctccatgcctcccccaaaatctttcctcagacgactttctcccttgaggagcaggcttcgatcaagcaatggctggacaccatttctggtcttcaaaatgctttgaccaaagacgacaagtccgtggttatggccatcctcggacagctgaacagtcacctggcctcgcgcacaactttgctgggaaccaagccttccgttgctgatatcgccgcatacgctctgctcgctcccctcgttgagaaatggacccccgaaaaacgcactggtgagcaagggtaccatcacattgtgcgacacgtcgactttgtgcaaaatanccgcctgttcgctctccagatccccgacgaagagaagatcagcatccaagtgaacgaattgcgattcgttcccaacctgtgggacccgaatgaatacaaggagcccacgaataaggtataa

SEQ ID NO: 18584 - DNA, 864 bp, A.fumigatus
gcgagcggatcacgcaaccgagcggatcaccaaacgcgttttgacttctatttcaaaagctgcagtgctcagccagccactatgccaccaaaagcgcgtataaactcaaaaaattcagttgagcaggagggaagggtcctacttgcagtatcagctttgaaaaataaggaaattctcaatattcgtgaagctgcgcgtgtctataatgtgccttatactaccctccagcggcgcctaaaggggcatacttttcgagctgaattacgcgcaaatggccataaaatgactcagaatgaagaggattcacttattagatggattctatctatggatcaacgtggagcggctccccgaccgtcccatgtacgagaaatggcgaatatcctgcttgcgcagcgtggttcaactcctacccagactgttggagagaaatgggtatataacttcattaatcggcatgatgagatcaaaacccgattctctaggcgctataaccaccagcgtgctaaatgtgaagacccaaagattatcctggaatggttcaatcgtgtccagatcacaataatgcagcatgggattacactggaagatatctacaactttgatgaaactggctttgcaatgggcttagtagctactgctaaggtagttacaagagctgagatgcttagtcggcccttccttatccagccagggaaccgcgaatgggttacctctatagagtgtattaactctactggctgggtgcttccaccatgcattatcttcaagggaaaggtccatattgagggctggtatcaagatacagccttaccagcagactggcggatcgaggtcagtgagaatggatggacgactgattag

SEQ ID NO: 18585 - DNA, 540 bp, A.fumigatus
atctgcactgagaatgatatcattctaatctgcatgcctgtatattcattacatctcctccagcctctagatgttggctgtttctctcctcttaagcgtgcgtatggccgcttgattgaggataagatgcggcttggtttcaaccatattgacaagtttgatttccttgaggcctatccacaagctcgtacggcaatcttttcagcagataatattaaaagtggcttttcagcaactggattaataccactgaatccagatcgggtgctcagtcagcttaatatccagcttagaacacctacaccaccaggcagccgatcaactaattctgtcccaaaaacaccttacaatctcaagcagctgaagaagcaggaaactacgcttaagaagctacttagggagcgtatatacagccctcctacccctacaaaggctgtgctaggtcagattatcaaggggtatgagatggcaatgaataacgctgcccttcttgcaaaggaaaatcatgatctacatgctgcacatgaaaagcacctttaa

SEQ ID NO: 18586 - DNA, 228 bp, A.fumigatus
aagcagaagcgatctaggcggcagatagaaactgcagtgggattatctatccaggaagggcaggagatcattcaacgcagggatcaggctgctgaagctatcccaactatccctccagagcaggtagtagatacagaacaacgccctcaatgggcacccccacgctgcagtgactgccatattctaggccataggcgattgcaatgtccgcagcgcaagaataactag

SEQ ID NO: 18587 - DNA, 1566 bp, A.fumigatus
cccatctttagtaagccaattctggctgttatttatcgggcatatcatgttctccctcaatatgagttaccatcttcatccatcatgactaaggtcaatatcattttcgcactgttcaacctgatccccgccatcctggcaatatgctcgacccagtcccccttctacccacctccatcttacaaccgtcagtcctctgaagtatgggaagccctcggccttgtagaagcgtcgctgtcaaacttactccgcaactccaacaatctcaatacatcatcctattcgattgaaatcaccccatcacggtccaccctatggtcgacgttccataccgcaaaggataaaaacctaacgcgacctggagccgatagagttgatgagacaagtcgatatcgtatcgcaagtatcaccaaggtcttcactgtgctggggatactccaacaacatgccgcagggaacctctcccttgaggatatggtggacaaatacatccctcaactccgtagttcgcatcacgacgggaccagaagttctggtagtatccagtgggacaaaatatcactccgatctctggttagccaactctctggcctaccccgcgactgggtccagggggatttcctcaccgatcccgagtccgtcaacacaactactaaatgcgactctgacaacagccataggccctgcacagcggaggacttatttgacaacttacgaaggaggcgagcgttgtttgcaccgaacaaggagtcgacatattccaaccttgcatttgacctcctgggactcgtgttaacgaacgtcactggcaccacattcgaggaatacataccagcctcaatcctcgatcccctggggatggctcaaacatcatttgtcaaaccaccggacagtgtgtctgttcttcccaagggaattgcatggtactccgacgtcgacgagcctgtggaaaatcccacgggcggattatactcttctacgcacgacatgtcaattcttctccgctacatcctgagcaactacaaagatattgccgatgcaaaactgaattggctactacctgtatcatttacggctgggatggggagttattacggcatgccgtgggagattttccgcgcggacagaattcttctcccggatgataagcgaagggcaaggacagtgacctttttcaccaaagacggtggtgtccccaggtatcgatccatcatcctcatcgcaccggaatacgatttgggtatcacggttctcacagctggagacgagacactcctggaagtaatagtggacatggtcattgtgccgctgattcgtgcagctgatgcgcttgctgcacggcaggtcaaggaaacatatatggggaggtacacgtcttctcctaccaaggagcaaacagtcaactccacgttgacacttacttatacgtcaacccatggcctcgagatcaacgagtggatttcaaaattccacagatgtgctcggcttcatatccaagcactttcagtcccccgaaatcacaaagtttcacgctcagttgatcccctctggtctctacagagatga

SEQ ID NO: 18588 - DNA, 207 bp, A.fumigatus
acctatcgttcgtgcatggcagtcatgagcatccttggatttggttctattagatggcgcaagactaattctccatctcatagtacagcctgttatgccgtcgtgttctgtaatgagcagggaatcattggaaacatcagtggcgtcaaacactctgatggggccgcatttagcatggtatataaggtccgctgtagcaggaggtaa

SEQ ID NO: 18589 - DNA, 252 bp, A.fumigatus
gcagggtgtagtaacatggatccaaagggtaaccttttaagtaaagcgtttcaggaatttctaccatggggcatctctaagcagcgcaattataatggttatgccacccaacttaaagtctcaagcggtggttcctgttttctttgtctgccgcaatcgatatcctcgtatactaatccaccttccttccctcacgcaggagcatattataggctaatatttttactgactgttcaaaaatgccagccatag

SEQ ID NO: 18590 - DNA, 564 bp, A.fumigatus
gtccagagaacattgattgatatttcatctatacaacttcggatggacattccactcggttcttttgaccgcttcatcgtgtacaagacatggaagcatgacgacagcgtcatataccatctcgcgacttggacaaacataacagcctactttacaaatctgctgttcccctcttgtaaggtgactgtcattttcctgaaagttcagctcccagagtatcctgatgctttcaatgcattgggagacgaaggtgttgaactgagtgacaacgtcaaatatgggcttgacgatgacatcggtactgaattaaaacaaaagattgagatgtggaattctgtgtccagcgccgacatcaagcagttttgtgacaagcacatcgatcaagttgaagtgggcattcaagaggcaggatacttccgaattgtaacagttgtttgggaaccggaaaaaggaagcctacccagaattgctggaatgcacaagtttatcgaaaataattggatttggaaaaaggaggcaggagccgaaaaagtcttgaggatgccccttccggttcattactaa

SEQ ID NO: 18591 - DNA, 1623 bp, A.fumigatus
tcaaccaagattccggggaaaatggttgaagtatgcggtacaattcacagagacgggcaaccaatcatgcatgtcaccagtcaatttctataccgaggatcgtacctagattttgagaacactttccagcgcaaggatgaggttcccatgcaagttcaccttgcttcaagcagggacgttgcaattctacggtcgaaagagtggttccgtctagacgaacccgacgtcgaattgttaggtcagactcttactttccgtctccagagcttggtccggttcaaaaacaaatctgtattcagccacgttcagacggtcggccaggtgctgcttgaacttcccacaaaggaagtcattcaggttgcaacagtggattacgagaccggaacttctcatggtaatccggtcattgactatcttcaacgcaatggcacgtccatagagcaaccggtctatttcgaaaaccctattccgttgagcggaaagacacccctcgttttgcgcgcaccggcatcaaatgaaacatatgctcgtgtttcaggcgattataatccaattcacgtctctcgtgttttctctagctatgccaatcttccggggaccatcacacatggcatgtataccagcgccgctgttcgcagtttcgtcgagacctgggctgctgagaacaatatcggccgtgttcgaggcttccatgtgtcccttgtcggtatggttctccccaatgatatgatcaccgtgaagttacaacatgtcggtatggtggctggtcgtaaaatcatcaaggttgaggccagcaacaaggaaacagaagataaggttcttctgggcgaagccgaagtcgagcaaccagtaacctcctatgtcttcactgggcagggctctcaggagcaaggaatgggtatggagctgtacagcagcagccctgtcgccagggaggtttgggatcgggcggatcgtcatttcatcgagaactatggcttgtccatcattgatatcgtcaaaaacaatcccaaggagctcactgtctactttggtggtccccgtggaaaagccattcgccagaactacatgtcgatgactttcgagacagtcaacgcggacggcacgattaagtctgagaagatcttcaaagaaatcaatgaggatacgacatcatacacatatcggtcgccgtctggattgctttctgcaactcagttcacgcaaccggcactgacactgatggaaaaggcaagtttcgaggatatgcgctccaagggtcttgtccagagagatagcagcttcgctggtcattccctgggtgaatactccgctctcgccgctcttgcagatgtcatgcctattgagagtctggtttccgttgtgttctatcgtggtttgactatgcaggttgctgtcgaaagagatgaacaaggacgttcgaactactctatgtgcgccgtgaacccaagtcgcatctcaaagacattcaatgagcaagccttgcagtacgtcgttgagaacattgctgagcaaacaggttggctgttggaaattgtcaactacaatgtcgcaaatatgcagtatgttgctgctggagatgtaagtgttcaccctttcttcctcaatatctcagtattctaa

SEQ ID NO: 18592 - DNA, 495 bp, A.fumigatus
ctttgccagctccgcgctcttgattgccttacaaatctgctcaactatctgaaggctcaaaacatcgacattccagcattaatgcaaagcatgtccttggatgacttgaaggctcaccttgtcaagatcattcatgaatgtgtcaaacaaaccgagtcgaagcccaggcctattgtcttggagcgaggcttcgccactattccactgaaaggaattgacgtgcctttccacagcaccttccttcgctccggtgtcaagcctttccggtccttccttctgaagaagatcaacaaaactaccatcgatccgagcaagttgattgggaaatatattccaaatgtcactgcccgtccattcgagatcacaaaggagtattttgaggatgtgtaccgactcacaaactctccgcggattgcccatatcctggcaaattgggacaagtatgaagagggaggtgagaacacttcacgcgccacaggtaccaacacggcctga

SEQ ID NO: 18593 - DNA, 3507 bp, A.fumigatus
  unsure (60): Identity of nucleotide sequences at the above locations are unknown.
cccaaaggactggacgtcatccagtggctccaggatcgcgactcccagcccgacaccgantaccttgtggcagctcctgtgagtttgccattaattggattagtccaattggcccattttgtggttacctgcaaggttctaggtcggcaacctggtgagattctagagcggttcagcggtactacaggtcactctcaaggcgtggtcactgccgctgcgattgcctcggcaacaacatgggagagtttcgcgaaagcggccaaagatgccttgacaatgctcttctggattggtcttcgcagtcagcaggcttaccctcggacatctattgccccctccgttctgcaggattcgattgagaacggggaaggcgtcccaacccctatgttgtccattcgagatctgccgagatctgctgtccaggaacacattgataccaccaaccagcatcttcctgtcgatcgtcatatctctatctccctggtcaacagcgctcgtaattttgtggtcactggaccccctctgtccctctacggtctcaaccttcgcctacgcaaagtcaaggctcccactggcctggatcaaaaccgggttccgtttacgcagcgcaaggttcgctttgtcaacagattcttgccaataactgcgccattccacagccagtacctctacgcagcgtacgaccgtatcctagaggacttggaggacattgaaatatcagctaagtcccttgcgatccctgtgtacgacaccaagacgggtgatgatctccggcaaagtggcgacaccaatattgttccatctctggttcgcatgatcacccacgatgcagtcaactgggagaaggcaacagtcttccaaggcgccactcacatcgtcgatttcggccccggcggtatctcaggtcttggtgttcttacgaaccgcaataaggatggtactggagtccgagtcattctcgcgggggctatggatggcaccaacgccgaggtcggatacaaacctgagctgtttgaccgcgacgagcactctgtgaaatatgccattgattgggttaaggagtacggcccccgtcttgtgaagaacgcaacgggccagacgttcgtcgataccaagatgagccgtcttttgggcatccctccaattatggtagcaggtatgacaccaactacagtaccctgggacttcgttgccgcaacaatgaatgcggggtaccacattgaacttgctgggggtggttactacaacggaaagagcatgacagaggccatctccaagatcgaaaagaccattcctcctgggcgtggcataactgtcaacttgatctacgtcaacccccgagctatggcttggcaaattcccctcatcgggaaattgagggcagacggcgtacctattgaaggcctcacaatcggcgctggtgtcccttccattgaagtcgccaatgaatacattgaaaccctgggaatcaagcatatagccttcaagccaggctccgtggatgctattcagcaggtcatcaatatcgccaaagccaacccgaagtttcctgtcatccttcagtggacgggtggtcgtggtggtggtcatcactcctttgaagactttcaccaacccattttacaaatgtatagccgcatcagacggtgtgagaacattgtccttgtcgctggcagtggcttcggtggtgctgaagacacgtacccttatctttccggagcatggtcttcgagcttcggatatcccccgatgcccttcgacgggtgcctctttggtagtcgcctgatgattgccaaagaagcgcacacgtctaagaatgctaagaaggcaattgctgacgcccctggtcttgatgacaaagattgggagaagacttacaagggtcctgctggcggtgtggtcaccgttctttccgagatgggtgaacccattcataagttggcgacgagaggcgttctattttggcacgaaatggatcagaaaatcttcaaacttgacaaggcgaagcgcgtgccggaactcaagaagcagcgtgattatatcatcaagaaactcaatgatgattttcaaaaagtatggttcggccgtaatgccgctggtgaggcggtcgatcttgaagacatgacatacgctgaggtggttcatcgtatggtagaactcatgtatgtcaagcatgaatcgcgctggatcgatgcctctttgaagaagttgactggcgatttcatccgtcgtgtcgaggaacgattcactaccaaggaagggcaggcttctctgctgcagaattattccgagctcgatactccttatccggcaattgataacattttagcagcttaccctgaagcggcgactcaattaatcaatgcgcaggatgttcatcatttccttttgctttgtcagcggcgcggacagaagcctgtcccatttgtgccggcactggacgagaactttgagtattggttcaagaaggactctctttggcagagcgaggatttggaggccgtcgttgggcaagatgtcggaaggacctgtattttgcaaggtccaatggcagccaaattctcaaacaccatagacgagcctgtccaacaaatcctggatggtattcatcaaggtcatatcaagggtcttctccaggacgtctatggcggtgacgagtccaagatccctgtcattgagtacttcggaggccggcttcacgaagccgtcagtgagttagacatcgacgggctcacgatctctgaagatacaaacaagatcagctatcgtctatcatcctctccctcaggcgaccttcctgatcttgacctgtggttacgcctcctcgctggcaaatcatactcatggaggcacgctctcttcttggcagatgtctttgttcaaggtcaccgtttccagacaaacccgatgaagcggatcgtcgcacccaccccggggatgtacgtggaggtctcgtatccagaggaaccatccaaaaccaccatctgtgttagagagccttatcaatctggcaaactcgtcaagactgtggaggtgaaggtcaatgatcaaggtcaaatcagtctcacactcttcgaaggcagaacagcagagggtggtgttgtgcctttgagcttcctgttcacgtaccatcctgaggccggctatgcacccatcatggaagtcatggatggtcggaacgatcgcattacggagttctattatcgggtctggtttggtaccaaggatgtcccttttgacacccctaccacagcaacatttagcggtggtcgggaaaccatcactgcccaagctgtcgctgactttgtgcagcctgttggcaatactggggaagccttcgtcgacaggcccggaaaagaagtcttcgctcctatggactttgccattgttgttggctggaaagccatcaccgagcccatcttctctccgacaaataaaggggatctgttgaaactggtccatccttccccacggagttcaagtgggtacctggtgctcaacctttga

SEQ ID NO: 18594 - DNA, 351 bp, A.fumigatus
cggtgctggaagcggacccaaatggattttgaagaagatcggtttgcggatgatgaagagcacgatgatcttttcaacgaagacgaggagaccaaggcagcggaaaagcggatcaaacaggatcagctgaaggcaaatgtcttcgatttgaaggatgaaaaggattacgaagaagaggagctcagggaaaagaaggaacgggaagctcgccgaatactgggcaagaaggtccgcaaagccctcaagaaacgagagaagaattacgactatagcagtggctctgatgccaacccctactctgatgatgaggtgtgttcgttaggatctaatttggttacacagttatgctaa

SEQ ID NO: 18595 - DNA, 366 bp, A.fumigatus
agctctgatgatagcgaagctgaacgattacgggaagaggagcgaaaagctgaagaggacaaaaataagaaggattcggctccctcgacaaggggaaatgttaccccatctggccgtccgaagcacactgaacctttgaagaagggcccaggtgcagcgtcacggaaacggcttgggtctccaaacgtatcagatgcaagtggcacagatacctctcgcaaaaaggcaaagagcaagcattcttctcagcctacgccccagccaacttctcgtgccctttcgccaactgcgcctccaggacaggtgagttttttcaaccgtaactgtctgttcattgtactcatctccatcggtacaggttggtaa

SEQ ID NO: 18596 - DNA, 411 bp, A.fumigatus
tgtcgtatcctcattgatttctttgaagatcttctcagacttaatcgtgccgtccgcgttgactgtctcgaaagtcatcgacatgtagttctggcgaatggcttttccacggggaccaccaaagtagacagtgagctccttgggattgtttttgacgatatcaatgatggacaagccatagttctcgatgaaatgacgatccgcccgatcccaaacctccctggcgacagggctgctgctgtacagctccatacccattccttgctcctgagagccctgcccagtgaagacataggaggttactggttgctcgacttcggcttcgcccagaagaaccttatcttctgtttccttgttgctggcctcaaccttgatgattttacgaccagccaccataccgacatgttgtaa

SEQ ID NO: 18597 - DNA, 423 bp, A.fumigatus
tctcgggcgctttcaactcgaaggatttccagcggacgatccactacagcgagtacagccaggtcgaacagacgaacatcaaggcgaatgtgtcggcgatggtgcagattggttcggtcggtggtgctcttttgtaagttccgttttctactttggataagacaactttctcacccaaacagtgcgttcttggtctgtgaccgcattggccgtatctgggctactcgtcagctgtgtcttttgtggattcttgggattggcatcttcttgggcgcaaacggaagccttgccgccatctacgccggtcgcttcattgccggattgggtgtcggacagactgttgtggtgggcccggtgtatctcgctgagattgtgagtatcccttcgcatacggtcccgatgcaagctgacaggcgtggctag

SEQ ID NO: 18598 - DNA, 222 bp, A.fumigatus
gcccccgcgtccatccgaggtctctgcacctgtgtctttaccggtttcgtgtatcttggtatcgtcctggcctacttcaccaactacggctgccaggttaacctcggagacaacacgcacaagcgatgggtgagtgaagcagcaactgcgggagaatcgatcgcagctgaccaatcccgtaggaagtgccaaccagtctgcacatcatctttgccggcctga

SEQ ID NO: 18599 - DNA, 429 bp, A.fumigatus
tcagccgccgtcgcttcgtcgccccctccttcaacgacatccgcctcaccctcaacaccgcccagctcctcggcctcgtccgcgggcccggtctcgacctcgtcaccttcgacggagacgtcaccctctacgacgacggcgcctgcctcaccccggacaaccccgccatcccgcgcatcatccgcctcctgcaccagggcgtgcgcatcggcatcgtcaccgccgccggctacaccgagggcgcaaagtactacgagcgcctcaagggcctcctcgacgccgtccatgactcctcctccctcacccccgcccagaaagacggcctggtcgtcatgggcggcgagagcaacttcctcttccgcttcgactcggcctcgccgcaccgcctctcctacgtcccccgcccggagtggctcctcgacgaaatga

SEQ ID NO: 18600 - DNA, 789 bp, A.fumigatus
ggaccacgagtacgttgtgcaggagatcacggccatcgagcagtcccaccaggccgaactcgaggcgaccatgggcgctggctggctcggcatcgtcaaggagacctttttcatcccgaagaacctgtaccgcatctacctgacggtcatgtcgcagattctctcgcagtggtccggcgccggctccatcaccctctacgcccccgatctcttcaagctgctcggtatcaccgggtccaacgagagcctgctcgtgaccggtgtgttcgggatcgtcaagctcgtcgcagccatcacctgcgccctgttcctggtcgacgtgatcggccgcaagcgctccctcctcatcggtatcaccctgcaggccatcgccatgatctacgtcgccgccttcctgaccgacgtcccggagatgggcatcgtcgacgactttgtcctgccggagtccaagcttggcgtcagccgcggcgccatcgccatgatctatatctccgggttcggctgggcgctcggctggaactcgatgcagtacctgctcacggcggagctcttcccgctgcgcatccgggccctggcgacctccatcgccatgacgctgcactttgccaaccagtacggcaactcgcgcgcggtgcccaacatgttgctgcccacccagcacggcggcatcactcccaagggcacgttttggtgctttgcggcggtgaccatcctcggtggagtgtgggtgtttctcagtgtgcccgagacagccgggcggtcgctcgagagcatggatcggctgtttga

SEQ ID NO: 18601 - DNA, 204 bp, A.fumigatus
ctcactccgatagtcgcatcgtcgagaccaactggtaagttcttcacggcgcgtctcaacggccaaactaacatcttccagattgaatggatcaaagtgagtacggtcactccatatctacaggaggaagctcattggatagggccttctggcggtcccctttgtgctgcactcgcagcccaccgctgtctaccaggaacatag

SEQ ID NO: 18602 - DNA, 405 bp, A.fumigatus
acgcaacgccgccccgggcaagtccaaactgaaactcctcgtcccgaccgcgggctctttcttcagccggctcccgctcgaagacgccttcaaataccaagacgcaaaacgcatgatcagccgccgtcgcttcgtcgccccctccttcaacgacatccgcctcaccctcaacaccgcccagctcctcggcctcgtccgcgggcccggtctcgacctcgtcaccttcgacggagacgtcaccctctacgacgacggcgcctgcctcaccccggacaaccccgccatcccgcgcatcatccgcctcctgcaccagggcgtgcgcatcggcatcgtcaccgccgccggctacaccgagggcgcaaagtactacgagcgcctcaagggcctcctcgacgccgtccatga

SEQ ID NO: 18603 - DNA, 702 bp, A.fumigatus
  unsure (11),(49): Identity of nucleotide sequences at the above locations are unknown.
atgaacaaagncgaagacgctccgggggattcttcaaccccggtgaccntggccacctcgttcattttcttcttcaacaatatcacgtcccaaggcctgccttttttcgcaccgacgattgtcaggaccatttacccacacaacagcgtgtgttcccagcagctgcacactgttcctccatatgtagtcggggcgttcttcaccgtgttgttccccttcctcagctggcgatttgaccggcgcatggtcttcttcgtgattgggccccttctaatgatggcgggtaccatcatgttcttgcccaccactgacgccatgatccgctacggcgcgacgtttttgattgctagcggtgcgttcgcctttggcgctctgtgcaatgcgaatgcatcgaacaacgtggtatctgacactgcacggtcatcggctatcggaacgacggtgatgatgggtaacattggcggcttgatctcgacatggtcgtttttgccctttgacgctccgaattatcatattggcaacggtctcaacctggccacctcgtccatgacgatgcttctcggagcattgctctggggatggatgcggtgggacaacaagagacgcgagaaggtggatgttgaccaggctctggctggtctgtccctgttgcagattcaggatcttgattggcgcaatcctgctttccgctggcgtgactaa

SEQ ID NO: 18604 - DNA, 384 bp, A.fumigatus
agctgggaagtgatcgtctgtccatccctgtttggccatcaccctcctcaattttcttgctcttctctcctacctggtattctgaacacaaaggacgagacgatggcaggtggtccaaagaaacctgtcaacatcttccggttgaaaaaccttaacgaacccaaagaagtcttcaactggaggctatggttctccgttctctcattcggcctcatgggcgctgcccgaggtgtggatgaggggttgatctcgggcgctttcaactcgaaggatttccagcggacgatccactacagcgagtacagccaggtcgaacagacgaacatcaaggcgaatgtgtcggcgatggtgcagattggttcggtcggtggtgctcttttgtaa

SEQ ID NO: 18605 - DNA, 1077 bp, A.fumigatus
gaagtgccaaccagtctgcacatcatctttgccggcctgatcttcctcctctcctttctgcaatacgagtcccctcgcttcctgatcaaaaagggcaaatacgaacacgccatccgcaatctggcgcgcgtgcgacacctccctgaggaccacgagtacgttgtgcaggagatcacggccatcgagcagtcccaccaggccgaactcgaggcgaccatgggcgctggctggctcggcatcgtcaaggagacctttttcatcccgaagaacctgtaccgcatctacctgacggtcatgtcgcagattctctcgcagtggtccggcgccggctccatcaccctctacgcccccgatctcttcaagctgctcggtatcaccgggtccaacgagagcctgctcgtgaccggtgtgttcgggatcgtcaagctcgtcgcagccatcacctgcgccctgttcctggtcgacgtgatcggccgcaagcgctccctcctcatcggtatcaccctgcaggccatcgccatgatctacgtcgccgccttcctgaccgacgtcccggagatgggcatcgtcgacgactttgtcctgccggagtccaagcttggcgtcagccgcggcgccatcgccatgatctatatctccgggttcggctgggcgctcggctggaactcgatgcagtacctgctcacggcggagctcttcccgctgcgcatccgggccctggcgacctccatcgccatgacgctgcactttgccaaccagtacggcaactcgcgcgcggtgcccaacatgttgctgcccacccagcacggcggcatcactcccaagggcacgttttggtgctttgcggcggtgaccatcctcggtggagtgtgggtgtttctcagtgtgcccgagacagccgggcggtcgctcgagagcatggatcggctgtttgagctgccgtggtacaagatcggtctgtacggaaacaaggacgccgaggagcgggatcaggtggtgtcggagaagatgcagatggaggaggagatgcacgggactgcggcgcaccaggagacggtggagaagtcgcgggtgtaa

SEQ ID NO: 18606 - DNA, 1056 bp, A.fumigatus
ggccttctggcggtcccctttgtgctgcactcgcagcccaccgctgtctaccaggaacatagcgagaacctcgtggccgtagcagccgacacccatcagcgctacgcggagatcttccgggatgttgagaagctcatcgacgaccacagtaggcctcttgccccccctgttctcgcttcccatctaaccctgtcagtcgaccatgaacgcaacgccgccccgggcaagtccaaactgaaactcctcgtcccgaccgcgggctctttcttcagccggctcccgctcgaagacgccttcaaataccaagacgcaaaacgcatgatcagccgccgtcgcttcgtcgccccctccttcaacgacatccgcctcaccctcaacaccgcccagctcctcggcctcgtccgcgggcccggtctcgacctcgtcaccttcgacggagacgtcaccctctacgacgacggcgcctgcctcaccccggacaaccccgccatcccgcgcatcatccgcctcctgcaccagggcgtgcgcatcggcatcgtcaccgccgccggctacaccgagggcgcaaagtactacgagcgcctcaagggcctcctcgacgccgtccatgactcctcctccctcacccccgcccagaaagacggcctggtcgtcatgggcggcgagagcaacttcctcttccgcttcgactcggcctcgccgcaccgcctctcctacgtcccccgcccggagtggctcctcgacgaaatgaagtcctggaaccaggaggatatcacccagctgctcgatatcgcggagtcttcgctgcgcgcttgcgccgcgaaccttaacctccctgttgctgtactccgcaaggaccgcgccgtcggtgtctacccctacgaccggagcaagatccaccgcgagcagctcgaggagaccgtcctcgtcgtgcagaatacagtggaacgatctgtcgtcggctctcgactgcccttttgcgcgtttaacggtgcctccccttcctcccaccccctccgtcccccttccccagacttccttttcacgtgcatgtag

SEQ ID NO: 18607 - DNA, 324 bp, A.fumigatus
aactacgcaggcaagtcgcgcgacgagatagcagcggacccaatgtcggcggcggtcatcggtatcaagggctcgcaggtgttgttctccgctatgggcggcgaggacggtctggaggcgacggagacggattgggcacgccggcgtcccaagacggagttctggctggagcttcagaactatgttaacgtcctgtctggccgtgcttctgcgggaaagcccttgtggtcatgctatgagagtaagcacttccccagctgttgtcgcctttacaatactgacttgtctatagacattgatccttcggcgctcacttcatcttag

SEQ ID NO: 18608 - DNA, 864 bp, A.fumigatus
ctacatgcacgtgaaaaggaagtctggggaagggggacggagggggtgggaggaaggggaggcaccgttaaacgcgcaaaagggcagtcgagagccgacgacagatcgttccactgtattctgcacgacgaggacggtctcctcgagctgctcgcggtggatcttgctccggtcgtaggggtagacaccgacggcgcggtccttgcggagtacagcaacagggaggttaaggttcgcggcgcaagcgcgcagcgaagactccgcgatatcgagcagctgggtgatatcctcctggttccaggacttcatttcgtcgaggagccactccgggcgggggacgtaggagaggcggtgcggcgaggccgagtcgaagcggaagaggaagttgctctcgccgcccatgacgaccaggccgtctttctgggcgggggtgagggaggaggagtcatggacggcgtcgaggaggcccttgaggcgctcgtagtactttgcgccctcggtgtagccggcggcggtgacgatgccgatgcgcacgccctggtgcaggaggcggatgatgcgcgggatggcggggttgtccggggtgaggcaggcgccgtcgtcgtagagggtgacgtctccgtcgaaggtgacgaggtcgagaccgggcccgcggacgaggccgaggagctgggcggtgttgagggtgaggcggatgtcgttgaaggagggggcgacgaagcgacggcggctgatcatgcgttttgcgtcttggtatttgaaggcgtcttcgagcgggagccggctgaagaaagagcccgcggtcgggacgaggagtttcagtttggacttgcccggggcggcgttgcgttcatggtcgactga

SEQ ID NO: 18609 - DNA, 219 bp, A.fumigatus
atgggaagcgagaacagggggggcaagaggcctactgtggtcgtcgatgagcttctcaacatcccggaagatctccgcgtagcgctgatgggtgtcggctgctacggccacgaggttctcgctatgttcctggtagacagcggtgggctgcgagtgcagcacaaaggggaccgccagaaggccctatccaatgagcttcctcctgtagatatggagtga

SEQ ID NO: 18610 - DNA, 1215 bp, A.fumigatus
tgcgttccacatcaacatgaatcggctacattgagtccattacacccgcgacttctccaccgtctcctggtgcgccgcagtcccgtgcatctcctcctccatctgcatcttctccgacaccacctgatcccgctcctcggcgtccttgtttccgtacagaccgatcttgtaccacggcagctcaaacagccgatccatgctctcgagcgaccgcccggctgtctcgggcacactgagaaacacccacactccaccgaggatggtcaccgccgcaaagcaccaaaacgtgcccttgggagtgatgccgccgtgctgggtgggcagcaacatgttgggcaccgcgcgcgagttgccgtactggttggcaaagtgcagcgtcatggcgatggaggtcgccagggcccggatgcgcagcgggaagagctccgccgtgagcaggtactgcatcgagttccagccgagcgcccagccgaacccggagatatagatcatggcgatggcgccgcggctgacgccaagcttggactccggcaggacaaagtcgtcgacgatgcccatctccgggacgtcggtcaggaaggcggcgacgtagatcatggcgatggcctgcagggtgataccgatgaggagggagcgcttgcggccgatcacgtcgaccaggaacagggcgcaggtgatggctgcgacgagcttgacgatcccgaacacaccggtcacgagcaggctctcgttggacccggtgataccgagcagcttgaagagatcgggggcgtagagggtgatggagccggcgccggaccactgcgagagaatctgcgacatgaccgtcaggtagatgcggtacaggttcttcgggatgaaaaaggtctccttgacgatgccgagccagccagcgcccatggtcgcctcgagttcggcctggtgggactgctcgatggccgtgatctcctgcacaacgtactcgtggtcctcagggaggtgtcgcacgcgcgccagattgcggatggcgtgttcgtatttgccctttttgatcaggaagcgaggggactcgtattgcagaaaggagaggaggaagatcaggccggcaaagatgatgtgcagactggttggcacttcctacgggattggtcagctgcgatcgattctcccgcagttgctgcttcactcacccatcgcttgtgcgtgttgtctccgaggttaacctggcagccgtag

SEQ ID NO: 18611 - DNA, 312 bp, A.fumigatus
ctccaccgctacgggcgttttggcccctgtggtgaagagttggatggtgaatttgaacgacgggagaatgagaagaagaggcggcgagaggcgaaattcaagaccaagttgcaagatctcaaaaagcgcacccgagtcgaagcataccgtcggaaccgtcaaggcgcagcaggagggaattttggagatgatttggggaaaggtggtcgacatgtacatcaatggggtcgatctgtggaggatcctgagacgggtataggggtcaagaaatgtgtggattgtggcatggagatcgaggaactcgaattctaa

SEQ ID NO: 18612 - DNA, 1977 bp, A.fumigatus
tttacagcgcaacggtccaaatcccaggccgatctcaccaccgatattgacaccgaccaccaacttggcgtccgacaggagaacgaacgggagaagtcgcgtctgtatctgtcaaaatgctcgcaagaggttgcatttcacgttgtccctacttcgcatcctgctcccgatttaaacgacctggaactctcgaaccatatgtacgcgaaccacaacatgcctcagcagagtatagaggaagcctacattcaacagcagcgccagaagcagcagcagcagcaacagcaggcaaatcacatgatggcacgcgaggtagcactacaaaatcaccagcctattgtgactcattattcggacaattctaacgtgtctcgcgctcccaatcaattcctccccacggtggcacgagatatcatggacaaaagtccgctggaggcacagcagacccacgctactgctatagacaacagaagacaggcgtttgagtcaggcttatcggatgagcgcgctggtgctgcgaagcaacagtacgataacacacaggcagcggctaaggaggagactcaatcccagcaggaagatcaaatacaggatacagacgggtggaactttgatgaaaatccggcccaggagtcccggagtgcccacatcccacctcaccgaccagacatggatgcctttcccaacgcgaacttcgccgggccaaagtccccctcacgaggtggatcagtatcgcatcgaaggaagagctctggctccaaacgtaagaccgaaggtgccacagacgtcggagcgggagcaatacagaaacaggatcctattttcaaagtccgattcgctctccgcggccacctggatgtcatccgctcagtaatcttcacgggcggtggtagcccgtccgaacccgagatttgcacgtgcagtgatgatgggactatcaaaagatggatcataccagcatcgtacggtgcttatgggtcgcatggagggagctcaggcaacgatctggatataacgagttacttcacccatcgggggcatgttggagcagtaactgcactagctgcgtgctccccgtctcaaaatttttcaaatggtggccgtgccctgggtgacggatgggtattctctggtgggcaggatgccagcgtgcgtgtttgggaacgcggacgggttgatcccaaggccacacttgatggtcacactgatgctgtttggggcctttgcgttcttcctggcacggctggtactgtgtttggagattcgtccagtcactatggaggtcctgatcggatcttgctggcgtcgggcgctgccgatgggcgaatattgatctgggccgtcagtgcacctccccaggtatcgtcgccacaggccggttctaggcgagctggtgggagtcggcgggctaactcgatatcatctgggtctaatttcccatcttcacctcaacctagcaccgcaaccaccacgcctttccactacactctcgtccatcatatacttcgggccgactctccctcaccaacttgtatcagccctctgtctcttgcaggtgttaatttcgtcgtttcatacacggatgcctcgatccttgtatatgacacgagaaccggcgaggagattgtgggcatggcgagcttggaaacctacgatggcactccctcgacgggagtcaactctgtcgttgcaaccaccattggctttgatgggtctgcaggcctcgatcctagtcggacgttagctgatgaagaagttgtgcacggagctaccggctccagcgctgtggaaggagtaatcataagcggatacgaagacagatatatccgtttcttcgatgccaatagcggtacgtacgctgatatgcacgactttttgaatgaaagcactgacattttcttgtcctgttgtaggccaatgcacatacacgatgctggcccaccccgcggctatcgctgcactttccttatctcctga

SEQ ID NO: 18613 - DNA, 294 bp, A.fumigatus
atgaaagcactgacattttcttgtcctgttgtaggccaatgcacatacacgatgctggcccaccccgcggctatcgctgcactttccttatctcctgatggacgtgaactcgtgtccgcaggtcatgacgccagcttacggttctggaaccttgagaaacgtagctgtactcaagagattactagccaccggttgatgcgtggtgagggggtttgtgccgtcacctggagccgcgatggccgctgggtcgtcagtggtggaggagatggtgttgtcaaggtcttctcaagataa

SEQ ID NO: 18614 - DNA, 477 bp, A.fumigatus
  unsure (392),(432),(434),(443): Identity of nucleotide sequences at the above locations are unknown.
aaaaagaagacgcaaaagaaaaaaagtttggctttccaagatagcgacatattagtgacaacacaatttctgctttgcaccacacggtttgtcgcaatgggaaagggtcgccgtatgaagaagcagggccctccggccccgctggacgagtcaaaaattaccctgtacaagaagcgcaaggcaggagatgtcgaatcaaaagcagagtcgggcaagaagcggaggagagccgaagatgaagaagagattttgaaggctgtacctaagaagaaggttaatggtgcagttaaaggaaaggaagacaaggccgtggccaccgctgttagcaagaaagatgcgaataccaatagcaaacctgcggccaaaggaaaaacctacatttatggactcgngacgaccaaaatttgtccgatttccattacaattaagttnanatgggccangaatgaatttgattacttggaatggcctcagtga

SEQ ID NO: 18615 - DNA, 309 bp, A.fumigatus
gctcccgattgggtaatgagcacagttgatcaatcgactgtgacgacagccctctcatcttcctcctctaatcgccaccaaggaaacgacacctactcaattcccaaacactccgggaccacaagcactatcacgatcaccatgaacgaagtatcattcgtcaagtcttacctctcaacactcgactctcggcctatcaagctccgctccgaccatgtcttcgacccagaacaagtagggctacgggtcccagtacgtctacctcccatttcatattatctcagccatactcctagaatcatgtactaa

SEQ ID NO: 18616 - DNA, 591 bp, A.fumigatus
tcgacacagtatactctcccccgtctgcacgcgccccaccccgaaatgcccaagaagaccaaacaaccgctcgccccgggctcctcaaaatccataactgtgcacctcaaatccgcccgcaacccggccctcgagttctctctccccaacaccgctctcaccacaacctccgtgcaggatctcaaggacgccgtgcgcgagcgcgtgacagacgcccagggtaacaagatctccctcgacaagatcaagattctgtacaagcgcaaacccgtaacagggaagaccatcgcggaagtacttgctgatgaacctgggatgctgtctggggggaaggaggtcgagttcggtgttatgattataggcggggcgcaggttgctgtgagtgcgggggcgggtgaaagggcaggtgccgaacagaaggagagttatgagcctcccaagcccgctgttggacctagtggagagagtgttgtggcgacggaggccttctgggatgatttgcagggcttcttggagcaaagattgaaggactatgatgaggcgaataagctgagggtgcttttcaaggaagcctggaggtcgagtttttag

SEQ ID NO: 18617 - DNA, 192 bp, A.fumigatus
tccccctcttccccccttctcccttgtctctccctctctcttttcccctcccacttcaactttccttcccccatcttctatttccaactccaaatatttacctccaaaacttccaacaaccttgctctccttcccttcatttatctacttctcattctaaaaaaaaaaaaaaactcctatcaggccgtttag

SEQ ID NO: 18618 - DNA, 393 bp, A.fumigatus
ggttctcagactaacagcttcgcttcagagatggtcgagaacatgaaggttgtggcctcctccgatgtagagctcaccgtcgaggagcggaatcttctctctgtcgcctacaagaacgtcattggagccagacgtgcgtcgtggagaattgtcacctcgattgagcagaaggaggaatcgaagggcaacgagtcccaggtcgctctgatcaaggagtaccgccagaagatcgaggccgagcttgctaagatctgcgacgacatcctggacgttctggacaagcacctgatcccctctgctgcgagtggcgagtccaaggtcttctaccataagatgtacgtcgtctttatcctctctgccagattacgaagaaggtgggggcgaatgtactga

SEQ ID NO: 18619 - DNA, 507 bp, A.fumigatus
tttggaagtaaacctgagccccgtcgatccttccagccccgtggtgaagacttttataccacccgaataatccctcccactctaaggatagtaaaaacaagcagcaaatcacgtgtcgtcgaggagagagaggtcactgcattgttctcttggattctgttgtgcttctctcagccagacagcaagcagcctcatgaaaattattattcctactactaccgccaaatagtaactggagtagtaccagagccagccagcgccagcgccagcaccagaaccagcaccagtatcggcactcctgcttctcacctaccactatctactattaccaccaccgccgccgctagtccccctcttccccccttctcccttgtctctccctctctcttttcccctcccacttcaactttccttcccccatcttctatttccaactccaaatatttacctccaaaacttccaacaaccttgctctccttcccttcatttatctacttctcattctaa

SEQ ID NO: 18620 - DNA, 276 bp, A.fumigatus
atcaacaggaagggtgactaccaccgttaccttgccgagttcgccgttggcgaccgccgcaaggccgccgccgacgcctctctcgaggcttacaagaacgctaccgaagtcgctcaaaccgacctcgctcccacccatcccatccgccttggattggctcttaacttctccgtcttctactacgaaatcctcaactctcccgaccaggcttgccaccttgccaagctcgctttcgatgatgccattgctggtatgtcaactctatatccgcgataa

SEQ ID NO: 18621 - DNA, 258 bp, A.fumigatus
cacgccacagagctcgacaccctgagcgaagagagctacaaggactccactctcatcatgcagcttctcagagacaacctggtaagtttcctttcctttggacgattttctcatggagtatgtcctaacggacttagactctctggacctcatctgaggctgagcccgctgctgagtcgaacactcctgccgagaagaaggaggaggcccctgccgctgagggcgagaagcccgctgaataaacaaggaaaaacataa

SEQ ID NO: 18622 - DNA, 183 bp, A.fumigatus
gcaggaaacgacaaggctaaaccttcacagccattctacgcggatcgtcagtttgctttttcccaggaagccacagaccctctcaagagtcaacgacccccgccaccattgcggaagtaccatggcatctacgtcggatgtacacggatcctcgcctattgcaagtctaccacaaccccatga

SEQ ID NO: 18623 - DNA, 291 bp, A.fumigatus
tggtgtccgtgcgatatgttcaagggagagagaaagtgtgacatcacaacatgccatgtgttgctatggaattcgatccgccgccttgagtcgtgcatgatttctgccttgtatatccttgcggctgatcttgagacatgccttacctacactttactgccttgcgagggtttcggattacatcccgttccgttcttgggcagccttgactttattgtcgttattttcacttctttcccctccccccctttgcctcatattttctctctttcatttaccacggtggcctag

SEQ ID NO: 18624 - DNA, 198 bp, A.fumigatus
ggctcccattcgatacagcctgggcaaaaatatcgtgttttgcagccgattttttcaagattatggaatcaaggcagctggaagaagtcatggaatattgttgacattctgggctgcgctagcgctgcctcccttaaggagatccgttcatatgcgttgttggaaggtcccattccgacagacatgggaggggtgtga

SEQ ID NO: 18625 - DNA, 192 bp, A.fumigatus
gaagccatgaatccaaagtcaagtttgcggggtagcattcctggccggtcagccacgcgatctcatcaccggacgtatggaatctatgtggccgtgggcttgtttggctatgattggggaagggagggctccgagtatatggaatatgctcttaatctggaagattgcagtcataagggtcgctgtcggtaa

SEQ ID NO: 18626 - DNA, 429 bp, A.fumigatus
ccatatctctcaggctggggtcgaaagctatcctactgcattgccttctccatcgacggtgcgacagatgttacaagacggtatgtgcgaagcccagtcaagcatggcgctccgcgtaatcgtgtgccagaggaggtcctcgtctggatcattcatgagattcggaaaaaaagacgggagagtatgtcgaagacggatcaaagacgacttatgaaagaggatgagcgcgaagaaaaagaactccgtgcctgcatggcttccgcactggccgcggagatcaacaaccttatccctcgggaacagacaagtggtcggcctggcgagcaaaagacacctgcttcaatgcaggacactccggtagactgggttgctgctcaacagatgggtcccggccagtctggccctgatcgatctcaggacggccggtaa

SEQ ID NO: 18627 - DNA, 300 bp, A.fumigatus
cgatgtcccacttccccgccctccatggacgacgcctctccaacttgttcaaccataactgaagacgttagccctacagcctccaagatatatgctaagatcgtgaatataaagaaggggaaagcagacattatgcagtccagagagccctcccatgcaggctcatggtactctgacaatcgaagcactttgacccgccaactggaccagtggctcgcccatgtccccaacgaaatcgagggaatcggctccctgcccgtacctggctcccgagttatcattgccccgtatgtatcatag

SEQ ID NO: 18628 - DNA, 891 bp, A.fumigatus
ctgattgagactaggaaacggatcttcatcctaggtccatcgcatcaccactatctctcgacactcgctctcccccagcttacgtcctactacaccccgctttcagacgagcctctaccgcttgacactgagcttatcgctaagcttctttcggcaaaagcagtcaaaccgaacgggtcaacagtcagttttacaacgatgacccggtcggtcgacgaggacgaacacagtattgagcttcatctgccctatatccaccgcctcctacaattacaacatcccaccaaacgaacatctcaatatccgcccctggtaccaatcctggtcggaagcacttctgcatctacagagcaagcctttggagctttgctggcttcttacttggaagatccttccaatgtgtttgtgattagctccgatttctgccactggggccttcgcttcagctacacatactacgtccctcaagctcccaagcctggaccgaagcttcccctttccgccgatgctctgcctcagccgagcaatgatctggatgagtttgaagaaagaattgagctagtgtcagcgggtcactccctccagcggagagaccgtattaacagtcgtgagtcagcgattcatgagagcatttctgctttcgatatcgcaactatggctgccatagctacaggagagaccgagaattttcttgatgtcatacagagaacaggtaatacggtatgcggccgtcatcccattggggtgatcatggccgccattgaagcaaccaggacccaggaggacgggaagaagggcgccttccattttattcggtatgagcgtagctcggacgcagttaatgtgactgacagctccgtgagctacgtctctgcgtttgccgtcttgtag

SEQ ID NO: 18629 - DNA, 276 bp, A.fumigatus
gtctttcgaagctcccaacctttgactttggctaacagaaaatcagctgtctccggttggttctcaactcatttcggcggcgaggttccctatagcaagaattgggtctttccctcagatcttctctggtatgacagatggcaagagattctgaatctcgggccacggttcattgagatagtcacctggaatgactacggagagtcccactacatcggaccattgtcctcgcctcacacagatgatggtgcctccaaatgggtgatggatatgtag

SEQ ID NO: 18630 - DNA, 282 bp, A.fumigatus
tctctcaagcttctagtatcaatcaagtcatggacagatcgtacattaaactttaagcttctcttttcccagatgatgccgtcgtttgactctaatgttcccgtggcctttgctgaaacccgatcgattttagttcctgactggaacgtttccatctgtctgggcgccaaaataaacctggctattgggactgcccttaagcatttgagacaggacacttcagcccaaaaagagcgtcttgacaagattcgtgtgataccgttgcaaccattggcctcatga

SEQ ID NO: 18631 - DNA, 558 bp, A.fumigatus
atcggcatcacaagcaaccgccagagcgccgcggactacgatgatgacatgcaacgtgcgaaagcattgggaatagatgcattcgctttgaacattggcgtggatccgtacactgatacgcagctcaattttgcctacgaatcagccgcgagaaatgacatgaaagtcttcatctcatttgatttcaattggtacaacactggacaagccactgccgtgggacagaagatcagacaatacgccagtctacctgcacagctcaaggtagatggtaaggtctttgcatcctcatttgccggtgacggcctcgatattcctgccttgaactccgctgctggcaccgaagtgttcttcgcaccgaattttcatccaggggtgggagacttcaatgctatccaaggtgcacttaattggatggcttggcctaacaatgaaaacaacaaagcgccgaccccagatcataacgtgagcgttgcagaaggcgacagtaaatacatcgcggccctaaatggaaaaccgtatattgcacgtgagtctttcgaagctcccaacctttga

SEQ ID NO: 18632 - DNA, 633 bp, A.fumigatus
ctcttattgcctggtatagcgctgaccgcttctttaaggccgcacaatggatggctggaaatgtccaaacctttcattgctgcttataaggccggcgaaaagtccgccaacaattacatcaccgaagacaagttgatctactggtatagaccaactccaaaggacatcaattgcgactcaacggacactaccatgcagggaaatccaaacaactcaagcggaaacttcttccgcggacgaccaaacgggtacgagtcaatgacagatgaggtgtttgttgtctcattgctcaaatcacccgctactgttcaggtgacttcagggagcagtagcaagacgttccaagcacaggccggtgccagcgccttttcagcacctatgggcgtcggcaaacagcaattttcactcctgcgcaatggacaaactgtcatgtccgacacgagtctgaaagacattgtcgacagctgcatctgcggcatctacaactttaacgcctatgtgggcaccgtgccaccggaaaagactattgacaagctccaaccagcgggactgtcaatgctgtatcagggactgacagtgccatgtccgactaacactctaggactcagtagccctaccgccaccgctcaatag

SEQ ID NO: 18633 - DNA, 462 bp, A.fumigatus
aacattagctactgcgaatccatccacctgttgtacacgctcaatatctttgagttcagcaatacttggtccctaacctatctccttccaaccatccccgccgaattctgggactgcattcgtgcagttgaactgcgctgggcgttcccaggccactggctccccagtaaagaccctgtcaagacagtctatttctccgctggacgccagcagtgggtcgagacctgccgcgccctgacgcggatgaagggcctgcagtcgttcacactacagctgatggggaactggttctgcgaaccggtggagaagatccctgtgtttctagagccactgagggagttgagtctgaagaacaggtggaaattgcagttgccccggcagccgtactatatcaaggagattcggaatatcgacagagatctgcgccagaggggcattgactgttccgttcgagctgcgtga

SEQ ID NO: 18634 - DNA, 1047 bp, A.fumigatus
ctgccagcaggcgatcttgtcctccactgtgccctcttcgcaaagccaacggccgagtcagaacgactcgtcaagtacttggttcagcacgtccctcactgtctggaggttaaatccgttgatggatatacccccttgatgattgcattctcgcttgttcgtcctacttatgccaaaatcctcatcaaggccggggccgaccagaccgtgcgcgacaagaagggctgcaacatccttcaccacctgttctgcggtgtcagctccccctcggtcgagaggctggatgacttccagaagatgctcggactggttgacccgtctttggtttcctccctgctcgtcgagcgttcgtcacacgggcccggctcgctgacacccttggcaatgtggatgatgcgggccttgaacaccacgaatacctactccgtctatggcaatggaagcaactatgaaggcgataaccagatggaaactcttcgaataatcttggactttgctcaaagtaccgggcagaagcatcttgaactattgaacggggccggcaacagcatcatgcacgatgccgtgcggtgccagctcctcaaaacgctggagattttgttcgaacgccgtccggatctcctccaccgcgagaacgcttctggcttgacgcctgctgaagtcgccgaggcctcctgggtcactgaagttacatccaatcctcctggatgggagcggcgatacaggttcacgtacagcagtcagtatggagagagccttgtggatcgtcgacccgaatccttcgtcgaggagggtgatgaagccccaacgatgaaacggaggatctacgacttctgccgcagcaaggcagagactttgagagaaccggatgtgaagcgtagattggtcactctgtttgaggccaatgaagtcgccagaagactagttgccaaggatctacaggagaatcaaaatttcggcggtgcagccagaaggagaagatgggacaagcatgacgaaagagaatttggcgatgaggttcgggaatggcttccagaggtgttttag

SEQ ID NO: 18635 - DNA, 2865 bp, A.fumigatus
tcacatcagaccattccttatggcgaaagattccacgctcgaaagattgagaaattactctacactaaggatttgctgctcaatgcggaatggaacaaacccaaagaccgcgaggtcaacctgcatcggcatccggctttcttcggcaactttgaggatgtgatcgaggactgctgtggcttttgtcctgttcccatcactccggaagagaaggaactgaccgaggaggagagcaaaatttacgtctccggcagaatcaaattcctccaggacaaccccggccgccaggagattggcagtttcaaccctatcaccgaaaccgattggactggtcagtgtttcctgatcgcatggtgtccgaatgctaacgtgtacacagacatggcatacgtcggaaacacagcaggcctgtgtcaggcgatcgtcgacaacgacgtggaaggcgtgaagcagtggctctcgcccgactttgatgtgaaccgtcgcgactttaccggtcgcactccgttgcatctggcagtcatgacctccacacccgaaatcgttcagtgtcttgttgaccacggagctcgtttggtcgctcgactggccgacgggcgaacggccttacatctcgctgcggctcgaggtcacgtcgagataatcaggatcttgctgacgaagagcgaggagaatgaggatgaagaagctcgcaaagagcaggcgcgcaagggagtctcatccggtaaagaggcccacgatggtgaggaagatgcggaactcatccagcatccttccgctgagagcgaggcagatgctcagtcgtttgccaccggttcgtttgtcaaagtccacaaggatgcaaatagcgcgcaggactcggtgcccgatgactccagcgaccaggaccctgatgtctatgacatcaatgtgattgcttgggatagtcacgcctcccctctgcatctcgcgattttgaatgggcacatcgctgcggttgaggaactggtatcctctttcggcgcggatgtgcttctgccggtcaaattgttgcacgagtacaacaacagcccgcgagctgccatcctcactctggtcttggctctccaactgccaatagagcaggcgaaggcgatgaccacgaagctgctacaactgggtgcctcgccagcacaggcagatctggaccagaagactgccgtggctcacattgcggcgcttccgaaatacactgagttgctggactcgtacctgcagcatgaccgtccggcagtcgaacgggcactcaactacattgctactagtggttggcaattcagccccaatgcagagacggcgctgaaaacggcgatcaaatcgggaaatgtcattggagccttgaagttgctggacgccggggcgagcccgacgattgcctttgacgaattcatcaagtcagcgcaggtgcacatcgatggaatacggaacaactcctccgagcaagtgaagagaagattcgatgctaacgtaacccagcctatcatattgagtgtcctcaaagatcagccatccgtggccctgaagcttctggcccgaggcgcagatcctaatacactgacgaaggaagggcaccagatacagcatgaggttcacgctagggcctaccgacatggcaaatcactgctggattgtgtgcgggaaaagctgaatgctctgcgtgcgtacgagcccgagactgactccccggagccgcccagacccttggagcacgaggacagctactatctctcgccgttcagagaagacacataccagctgtggacggccaaagccgctctccgcagtgcacactccagtcttgaatcagagcagaagcgctatgacgacgacgtgaagtgtgccgcgaaccgcaagggtgtcgacgagaagaaggcggccgttcaactgacgctcggcgagtttgagaagcttgaggaggaattacttgcccggggcgccaaggagttcaagcagctgtttccggacattagaacgccttctgataacgacgggaatcattacggatcctgtgccaccaaatctgagtcgttcagggtgacctttgacttcaggaggccggatctcaacgacatcaccaggggaaggctatatccaactgtcggtgctcctccggttccttccgtgtgctgcccctcgcgtatgctgactgtgtttaggtttgaggcagcgtggtgtggtgaccttgagaccatcaaatcactcacccttgggacatggggtccagacaagcagagaccgccgctggagattgctacgaaggaccagagaaacttccacccgttcaacatcgccgtcctacgtggacatttggacgtggcgaaggcgattctcgccattgcacaagtgcagtacaagcctcaggacgagcaagcaaatgtgcggtataggctgcgagcaacaaccaatcatgacgatggttgttccagcgacgacgagggcgacgaggacgataacgacaacagtgacggtctggatatcgagaggcagatcctcgatgaaaaattcactatcgacaacattggtgaggtcaagacgcaggtcgaaagcaggaccccgcctctttcccttttggaggactgttgctcggctgaagatttcatagagacaagcctgccggaggaccgaaagccttataatcttgtacagtacgcaatctgtaaggatgatgttaggctactagtcttccttctggacctcggccgggagctgtctgcgaagtccggaagttctgagcagaccatctttacggttggacagcgggatcttactgtggcgatgcagctgggacgagtccgctgcctggccgaactcatcaaacgtatgggggctggcataccactggattag

SEQ ID NO: 18636 - DNA, 276 bp, A.fumigatus
atcaacaggctgtcggatgttaaagattttcccagcctaatatggaatgcagatgaagggtttgatgaggttgaagcttggggtctatggtttgcggagggtaccgcgcctttgacagagggatattttgaggggttggagacgataggtatacagagaatcgacactaactctcgtctttacatggatgatgaaactatcatctcagtgtttacggatgatatactattcctctattattgtaaaggcaaggagcatgctaataatctgaattaa

SEQ ID NO: 18637 - DNA, 1284 bp, A.fumigatus
ttggaggagagccccatggggggtctaagccaatcagacggatgttccccaggctcccgcctgctgcctgagaaacggttgcctttttcggaaatatccaaggcatcaaggacgccacaacgggaagctgcctggcgctctccacagctcgtgttcgtcgggatccacaaatttggagattgcaagaacttgaaatgcatgctgcagtcgtcttcagcactccttattctcactgagcattctgttcgcaaccaagttctctgcatccaaccattgcaaacgatcctttctctttctcaatatttcaccaagcaaaacatggccgacagttacaccctccctgccgtccccgcgaagcactccaccttcatcgactacatcaactctcgtcctcatgagtcaatcccggatcttgtacggccctacaacgagtacgatgcagtccttcgcaagatctacgcccaacaaccatcccaccccgcgattgcaaacaaactcattaatctggtgccgctgttcgatggcagtggctcagcggatcttcggattcgggcacgtgatctggcttcagagccggaggagctcaaggccaagtatttgatgccactaaaggatgaggatcgaaaagcgcatgggtccccagccgtggtatcctccttcaaacagttccagacgaacttcaacctgttctctgagagcgccctcagtgatctcgactggagcaatgtggtggccgcgggaagtgcagtgaccacctctttattacccgttccggaggagtaccgcgactcgaaacgcggcctgcgtgaatactaccatcagaaatttgctcctgcctcggatgtcgatctgtttttgtatgggttgaccgaggaacaggccattgagaagatcaagcagatcgaaacccgcatcaaagactcgatcctggccgagacttccaccattcgcacaaagaatgccatcacgatcgtgtcgcagtaccccacccgccatgttcagatcgtccttcggatttacaagtccatcgccgagatcttgaccgggtttgatgtcgactgctcgtgcgcagcctatgatggttcccaggtgtatctggcaccacgtgccgtcggcgcgtttgtcacccaaatcaaccatgtggatctgtccagacggtccccgtcgtatgagaatcgtctttccaaatacgctcgccgaggatttgaagtgttctggccactgttggaccgcaccaggattgatccggtatgccatttgaccgaacattacgagtggcgctga

SEQ ID NO: 18638 - DNA, 324 bp, A.fumigatus
gttcgagtcctatcgctgacgatcttttttacaccggttattgttttgtcctttttatctctgttgcagaactgtgcaatcattactgaagaggatattattatttcgctacttgattgttgtaatcctgctttgaaatcccgtgttaacaaccccatcggtgtcccgatcaccctagtatccggctgtgaatttgtcgaatcccgcaggcgtaccctgtacacgggactaaaaaatatattcaatcagtacaacacgctcattgccatccctcacccgttcgtcatcattcctgttttcatgaagtccactatgcccgagtag

SEQ ID NO: 18639 - DNA, 222 bp, A.fumigatus
tttgccatgtcggtaggccctagcgtgaacctcatgctgtatctggtgcccttccttcgtcagtgtattaggatctgcgcctcgggccagaagcttcagggccacggatggctgatctttgaggacactcaatatgataggctgggttacgttagcatcgaatcttctcttcacttgctcggaggagttgttccgtattccatcgatgtgcacctgcgctga

SEQ ID NO: 18640 - DNA, 297 bp, A.fumigatus
ctcatcactcgttttatcgtagattccaagcaaaacgcttttttgcctttactcataaagatccatgtcaccgcttccgttctcgatctccgccagcgcgtcgtcctcatccaccatttcctcgtcttcctccatttccacctcgtgattcggcagaacgtcgatgcgtccttcgcgcatgaccacccgggcaacctcgccgtcctggatactgccacgcaggatgagaacggcgagtttgttgaggacctcgcgctcgatgatccgcgccagaggacgggcaccgtacgctggtga

SEQ ID NO: 18641 - DNA, 936 bp, A.fumigatus
gtaccctgcctcgccgagataatccttgacttcctcggtgcactggatggtaacgttgcggttgttctgctcgagacggcgctgcacctcgttgaggcgcaggtcgacgatcttgcggatttccttcctggtgagccggttgaagatgacgatgctggagatccggttcaggaactcgggcaggaaataatcgcggagagcgcccatgaccagctcgcgggtctgagggtcaatgcggccatccttggtggtcgggcgcgagaggaactcggctcccaggttggaggtcatgacgacgatgcagttcttagcgtcgacaattctgccctggccatcggtaatccgaccgtcgtccatgagctgcagaagaacggtgagcacctccttggctgccttttcgacttcgtcgaacagaaggatggagaagggccgacggcgcagactctcggtcagctgaccaccagcatcgtgtcccacgtagccgggaggcgcaccaatcatccggctcagcgagtgccgctcttggtactcggacatgtcgaaccggatcatggccttggggtcgtcgaagaggaactcggcaagtgccttggtcaacagagtcttaccggtaccggagggaccgcagaagaggaagcttggaggcgagttggggttactgagacccgaccgttgcagccgaatggcattggagaccgaagtgacagcctccttctggcccacaacgatcttgccaaggtacttctccatgtgcaacaacttgtccctctcggtggtcttgagtcgggtgacagggataccagtccaacgggcgacaatctcgttgatctgatcgggtccgaccgcgtcggccagcagggcctcgccattgtcaccatgtcgagcacgacgttcctcgtctgccttgatgcgatcggcctcgagtcgctcgattaa

SEQ ID NO: 18642 - DNA, 579 bp, A.fumigatus
gacaatcgtgtccttggattcttcgatctccttgagaacgcccttcattctctcttcgaactccccccggtacttgctaccggccaccaacgagccgacatccagggaaagcagcctgcactgggccagattggccggaacatcggcgttcacgatacggcgagccagaccttcgacaatagtggtcttaccgacaccgggctcaccgatcagcaccgggttgttcttcgtccgtcgactgagaatgcggatgactcgacgaatctcctcctcacgaccaatgacaggatcgatcttgccctctctggccagagcagtcatgtcaatggtgaacttcttgaggttctcattctcgccctcagcgtcggccgtcttggagtctacccgccgtgtacctcggatctgttgtaccgcggtgtcgatcagcttgacattggggatgttcgcatccgccagtgcccgctgcacctgagaatcttgaacgaccgagaggatgaggtggtcaatggcaacgtagctgtctttttgcgtcttggacagctcggtcgacgcacgaatgactttggcaagggcgggtga

SEQ ID NO: 18643 - DNA, 438 bp, A.fumigatus
aacgctctgtcaagatgttgcccgcgaattttgggtgtaatgattcgcatgcacaaactgaatccacaaggcgtcagtcttcgcaacgttacttacctgatgcagggaaagagagttttcatcaaggatattatccattacattttgcctcccgacgggaagcttgccagcattgccccgtcactcaagaggatcaaacgcggcgtcggcaccaatggacaaaccaccggtgaagaaaacggcgtggtcaacgcccacgtcgaccagggcagcaacggccaggaccagaccggccagaacggtcactccaagtcccgggccagcgagccctacccgtacgacacggagcccgaacgtggcaatcccaccgtgatgccaaaggagctactgtcgcgcttccatttcgccttcatcatccgcgacccttttcacccctag

SEQ ID NO: 18644 - DNA, 513 bp, A.fumigatus
cagacacaatccatcgcgcagagcttatcaccacccaaacgcaacaagatccgcgtcgcagtatccatcgacctcgacgccgtctccggctggctaggaacaggccaccacccggacaacatcctcgccgactactccgccggcttcttcgccgccaaagtcggcgtcccgcggctgctccgcatgctcgcgaaactcaacctcgccgaccgctgcacctggttcatcccaggccactccgccgagagcttcccggacgaagtcgcgcaggtcgtcgcctcaggcgccgagatcggcctgcacggatacgcccacgaaggcgcctaccagatgaccccgcagcaggagcgcgacgtcctggtgaagtgcatcgacatcgcgactaagctcacaggcaagaaaccagtgggctaccgcgcgccgctctaccagctccgcgagtcgacgctcgatctccttgaggaatttggattcgaatacggtgcgttccctcccctcttccactacaaatga

SEQ ID NO: 18645 - DNA, 471 bp, A.fumigatus
cacccagatgcatccctcacagaccatgactgccaccccttcttcgccccgcgccgtcccgccctccaaccgatcgacttctcccagccggcgtctacctggatgcacccgatcccaagtgccggcgcaaacgcacgcgaagatcggcgccccctcgtctgcgtcccctgcaactggtacatggaagacatgacccccatgcaattcctgccgcacgtgcccaactcgcacgggtacacggatgtgcgggtgatcgagaacttgtggcgggatcggttcctgtggattcgggagaatgaggaggaacccatcttccctgtgctgatgcatccggatacgagtggcatggcacatgtgattgggatggtggagcggttgttggggtgggtgaaggggtggggggatgaggtggaattttgccagacgagggagattgcgaggtggtttcgggagaggaatgctacggagtag

SEQ ID NO: 18646 - DNA, 231 bp, A.fumigatus
gggtcaatgcggccatccttggtggtcgggcgcgagaggaactcggctcccaggttggaggtcatgacgacgatgcagttcttagcgtcgacaattctgccctggccatcggtaatccgaccgtcgtccatgagctgcagaagaacggtgagcacctccttggctgccttttcgacttcgtcgaacagaaggatggagaagggccgacggcgcagactctcggtcagctga

SEQ ID NO: 18647 - DNA, 507 bp, A.fumigatus
gtgtcaccggaccgttccgcttcgtctctcttgaccttgagtgagtcgagcttaatcttggcatcttggatcgccttgctgcgctgcttctcgctttcgtacttctcccgcaagggccgcaactcttccgtcacattggcggcttcttgcttggcagcttccaaccgggccttggacgcatcgtccttttcccgctcgagggcatggatttcaatctgcagctggcggagtcttctctcgaggttgtctagggcctcgggctccgactcgcgggtcactctgacggcggcagccgcctcatcgatgagatcgacggccgagtcggggagtcggcgagcagtgaggtatctggcagccaattcggctgcggtaacgatagcgccgtccagaatgttaacaccatggtggacttcgtacttttccttcagaccacggagaatggagatagtttcagagacggtaggttccttgacgagaacctgttggaatcgtcgttcgaatgcttga

SEQ ID NO: 18648 - DNA, 570 bp, A.fumigatus
ccacgagcgagcataggcttcagcagattggcggcatccatacctccctccccgctcgagcctgcacccatgagaagatggatctcgtcgacgaataggacaatcgtgtccttggattcttcgatctccttgagaacgcccttcattctctcttcgaactccccccggtacttgctaccggccaccaacgagccgacatccagggaaagcagcctgcactgggccagattggccggaacatcggcgttcacgatacggcgagccagaccttcgacaatagtggtcttaccgacaccgggctcaccgatcagcaccgggttgttcttcgtccgtcgactgagaatgcggatgactcgacgaatctcctcctcacgaccaatgacaggatcgatcttgccctctctggccagagcagtcatgtcaatggtgaacttcttgaggttctcattctcgccctcagcgtcggccgtcttggagtctacccgccgtgtacctcggatctgttgtaccgcggtgtcgatcagcttgacattggggatgttcgcatccgccagtgcccgctgcacctga

SEQ ID NO: 18649 - DNA, 3078 bp, A.fumigatus
ataaactcaggattcacctgcttgaggttagctcgttctttaagtgacagtcgatctgttgattatatcagctgctggcacgtgatggggatcgattgttctggaaggcggtggaacccactcgtgtcgtcatggggcaacagagaggcttctcgacactgcgaagaatgggctgatgatacccaactgcagctatatctagctccgctgtcatccgcgcaggctgtttcttctcttcttttgtgtttgttatcaccatcattatcattacctgacactcaattccgtttcacaatgaacggtgctcaattcacagacagagccaacaaggcgttattggactcgagccatctggccgagcaatacgcccattctcagatcctcccgattcacctcgctcttgctctcctcaatcctccaccagatgactcgaaagatcaacaaaccgccacacatccctcgcacgactcttccaccgctccgctcttccgccaggtcgtcgagcgcgctcatggcgaccctcagctcctcgagcgttccctcatgaagctacttgtccggttaccgagtcaagatcctcctcccgacacagtgagcgtctcacccgcccttgccaaagtcattcgtgcgtcgaccgagctgtccaagacgcaaaaagacagctacgttgccattgaccacctcatcctctcggtcgttcaagattctcaggtgcagcgggcactggcggatgcgaacatccccaatgtcaagctgatcgacaccgcggtacaacagatccgaggtacacggcgggtagactccaagacggccgacgctgagggcgagaatgagaacctcaagaagttcaccattgacatgactgctctggccagagagggcaagatcgatcctgtcattggtcgtgaggaggagattcgtcgagtcatccgcattctcagtcgacggacgaagaacaacccggtgctgatcggtgagcccggtgtcggtaagaccactattgtcgaaggtctggctcgccgtatcgtgaacgccgatgttccggccaatctggcccagtgcaggctgctttccctggatgtcggctcgttggtggccggtagcaagtaccggggggagttcgaagagagaatgaagggcgttctcaaggagatcgaagaatccaaggacacgattgtcctattcgtcgacgagatccatcttctcatgggtgcaggctcgagcggggagggaggtatggatgccgccaatctgctgaagcctatgctcgctcgtggtcagctacattgtatcggtgcgaccacgctcggcgaataccgcaagtacattgaaaaggatcaagcattcgaacgacgattccaacaggttctcgtcaaggaacctaccgtctctgaaactatctccattctccgtggtctgaaggaaaagtacgaagtccaccatggtgttaacattctggacggcgctatcgttaccgcagccgaattggctgccagatacctcactgctcgccgactccccgactcggccgtcgatctcatcgatgaggcggctgccgccgtcagagtgacccgcgagtcggagcccgaggccctagacaacctcgagagaagactccgccagctgcagattgaaatccatgccctcgagcgggaaaaggacgatgcgtccaaggcccggttggaagctgccaagcaagaagccgccaatgtgacggaagagttgcggcccttgcgggagaagtacgaaagcgagaagcagcgcagcaaggcgatccaagatgccaagattaagctcgactcactcaaggtcaagagagacgaagcggaacggtccggtgacactcagacagctgccgacctggagtactacgccattccagaaaccaaggccttaatcgagcgactcgaggccgatcgcatcaaggcagacgaggaacgtcgtgctcgacatggtgacaatggcgaggccctgctggccgacgcggtcggacccgatcagatcaacgagattgtcgcccgttggactggtatccctgtcacccgactcaagaccaccgagagggacaagttgttgcacatggagaagtaccttggcaagatcgttgtgggccagaaggaggctgtcacttcggtctccaatgccattcggctgcaacggtcgggtctcagtaaccccaactcgcctccaagcttcctcttctgcggtccctccggtaccggtaagactctgttgaccaaggcacttgccgagttcctcttcgacgaccccaaggccatgatccggttcgacatgtccgagtaccaagagcggcactcgctgagccggatgattggtgcgcctcccggctacgtgggacacgatgctggtggtcagctgaccgagagtctgcgccgtcggcccttctccatccttctgttcgacgaagtcgaaaaggcagccaaggaggtgctcaccgttcttctgcagctcatggacgacggtcggattaccgatggccagggcagaattgtcgacgctaagaactgcatcgtcgtcatgacctccaacctgggagccgagttcctctcgcgcccgaccaccaaggatggccgcattgaccctcagacccgcgagctggtcatgggcgctctccgcgattatttcctgcccgagttcctgaaccggatctccagcatcgtcatcttcaaccggctcaccaggaaggaaatccgcaagatcgtcgacctgcgcctcaacgaggtgcagcgccgtctcgagcagaacaaccgcaacgttaccatccagtgcaccgaggaagtcaaggattatctcggcgaggcagggtactcaccagcgtacggtgcccgtcctctggcgcggatcatcgagcgcgaggtcctcaacaaactcgccgttctcatcctgcgtggcagtatccaggacggcgaggttgcccgggtggtcatgcgcgaaggacgcatcgacgttctgccgaatcacgaggtggaaatggaggaagacgaggaaatggtggatgaggacgacgcgctggcggagatcgagaacggaagcggtgacatggatctttatgagtaa

SEQ ID NO: 18650 - DNA, 486 bp, A.fumigatus
accggatctccagcatcgtcatcttcaaccggctcaccaggaaggaaatccgcaagatcgtcgacctgcgcctcaacgaggtgcagcgccgtctcgagcagaacaaccgcaacgttaccatccagtgcaccgaggaagtcaaggattatctcggcgaggcagggtactcaccagcgtacggtgcccgtcctctggcgcggatcatcgagcgcgaggtcctcaacaaactcgccgttctcatcctgcgtggcagtatccaggacggcgaggttgcccgggtggtcatgcgcgaaggacgcatcgacgttctgccgaatcacgaggtggaaatggaggaagacgaggaaatggtggatgaggacgacgcgctggcggagatcgagaacggaagcggtgacatggatctttatgagtaaaggcaaaaaagcgttttgcttggaatctacgataaaacgagtgatgagctacgacatgttttttatatag

SEQ ID NO: 18651 - DNA, 366 bp, A.fumigatus
cattcctctcccgaaaccacctcgcaatctccctcgtctggcaaaattccacctcatccccccaccccttcacccaccccaacaaccgctccaccatcccaatcacatgtgccatgccactcgtatccggatgcatcagcacagggaagatgggttcctcctcattctcccgaatccacaggaaccgatcccgccacaagttctcgatcacccgcacatccgtgtacccgtgcgagttgggcacgtgcggcaggaattgcatgggggtcatgtcttccatgtaccagttgcaggggacgcagacgagggggcgccgatcttcgcgtgcgtttgcgccggcacttgggatcgggtgcatccaggtag

SEQ ID NO: 18652 - DNA, 420 bp, A.fumigatus
ccctcagacccgcgagctggtcatgggcgctctccgcgattatttcctgcccgagttcctgaaccggatctccagcatcgtcatcttcaaccggctcaccaggaaggaaatccgcaagatcgtcgacctgcgcctcaacgaggtgcagcgccgtctcgagcagaacaaccgcaacgttaccatccagtgcaccgaggaagtcaaggattatctcggcgaggcagggtactcaccagcgtacggtgcccgtcctctggcgcggatcatcgagcgcgaggtcctcaacaaactcgccgttctcatcctgcgtggcagtatccaggacggcgaggttgcccgggtggtcatgcgcgaaggacgcatcgacgttctgccgaatcacgaggtggaaatggaggaagacgaggaaatggtggatga

SEQ ID NO: 18653 - DNA, 1305 bp, A.fumigatus
gctgaacctcccactttcttccccgagtacacaggcaaggatggagccacatacgtttatcgacacctgagcttctggacgtctggcttctttcccggatccctgtacctgctacttgagcgccaggccaagaataacagcagtacagagccatgtactccccatcctctcgttttgcaacaactctgccagtggtggaccgtcaacttgcatcagaacgccaccctcaacacaacacatgaccttggcttcatgattgcgccctgggccatcaaagcgtgggagctacaccgggatgcgagggcgttcagcagcctggtgacagcagcgaatactcttgccagtcgcttctgtcccaaggttcagtctatccgcagctgggatacctgtgtgacgaagcggtattcattcacagatccttccagggacttccttgtcatcatcgacaacatgctgaacctcgatatgctgttctgggttgccaaggagacgggcaatcggcacctgtatgacgttgccctggcacacgctcgcacaacgcagagacaccatatacgggccaaccactccacataccacgtggtgaacttcgaccaagagacgtgcacgcccaaggagaagttgacgaaccagggctacagcgacgagagttgctgggccagggggcaggcgtggggtatcctcgggttcgtgcagacattccagtggaccggcgatccatcgttcctgcagacgtcacgacagcttgccgattacttcatcaaaaatctgcctggcgatggtgtgccgtactgggactttgatgcacccgtcacgagtgactcgccgagagatacgtccgctgcgatgatcgcatcgtgcgggatgctcttgatctacaaagccctcagagcgcagggcaaatacgatgaatcggagcattatctcgttgctgtcaagcgcattgtggaaggaacgttgagcaagtttctgaatcctccgaccttcaaattcattgtccagccttccaaccgaggtatcgagacatacgaggatggcctgccctgcgatcacgaggagaagccggaacctggattcttggctgtgagcgagtctgctgcgacgaatgggatgaatggcagaggggtaaatggcactgagagcaagaagccagtagcagagacgatcctcaccggtgccacaatcaacaactacgagtttgcccccagaagatgggccaaccacggtctagtctatgcggattattattttatgcttctggggaacatgttgcttgagttgggcttggtgccttcgttgccataa

SEQ ID NO: 18654 - DNA, 216 bp, A.fumigatus
cgactgcagacgtacttctgtcaagcactcgacaagggcacactcggctttgcttcgattatgggaatccagacagacgcacacctcgtcggaaatgagtatagttggctgggaacgattctctacattggtgtgttggcaggggagtatccgaccaattttctcttgcagaagctgcctgtgggcaaatacattgcgagcaagtacgtttgttga

SEQ ID NO: 18655 - DNA, 366 bp, A.fumigatus
tggtcggcggtgcgtccctggcgacctggaccaaacagactattcttaccatgcatctgtggactatgtaagttgtcctcccgggcattcgaaccaatctcactgtgtagacccgccatcatcggaacggccatcatcttcactatccctcccacgccgaagacccgtgctgggctactcatcgcattctactgcacacagttcatcctcgccgagggcaatctcctcttctccctcatctccagaaacgttgccggacaaaccaagaagtctaccgtcctggcagtgaccttcatcgcctggtccgccagcaacgccgccgctcctcaggtccgtctctcatcccctccagagggcagtgactga

SEQ ID NO: 18656 - DNA, 1074 bp, A.fumigatus
tcgtgcttcgataccccatggggtttgaaactggttcctgcacaacccgatgggcgccaggagaacccaaaaagaatatttgatgatcccctagaggatttacagagtctctttctcgccattcatgacaagcatcatgagtttccattgagactacgtccctctgtcccaatgtccccaaggccaacagcacccccgccggatctggaccagctggactgcaacaaggacaagatccctgcatgtcaatcctgtcggcgcaaaaaagccaaatgcgaccgggagcagccatgctcacaatgcgtccgcttcaatgtaatctgtctatacgagaacggccgcctgaaaccgggcctccgagccggggcggtcgaacagctgcaacgtcgggtggagacactggagaacatgttcatcggtcaggggattctgtggcaaaagatttgggatacagtcagcaactcagcagtcggtgttgagcagaacgacagagacttcgaaaggattggagtagatcaagtccgtcatcgtgtcaaggacactctactgcagctggcagaggataatggagggtgccttcgttcggtagtcgacaacgtcccagaggacaacattgagcgagacgcccctccagtgaaacgcagaaagctcgattctcaatccagcgcgactgagcgaccaagtccgtcgggtcattctgcgtcggctcctctcaacgcgcatgacctgccctctcgagacgtaatgaacgatctggtggaattctactttgcaaatgtccatcattggatacccattctacacgtgagaaaattccgggagcagatacagaccaccgaaggttgggacaaagcaatccacattttgcatgctatcgtggcgacctgtatccgcttcagccatcaccctggcgctggcaccatcgaggctcgtagggaaatggcggttgccagtcgacaaaaggtcatacttaacagtatggagtccttctcggtcgagaatttgcaggcgctggtcataattgccttcgatactgtaggtcatatcgctagctcgcacaacaggattcactga

SEQ ID NO: 18657 - DNA, 1635 bp, A.fumigatus
attggcagtggccgcgggccatcggcgtggtcgattgtcggtagtatgactcgcacagttgaacaacttcagctcagtgtagaagagtcgcagggtgatcggggatcgggggagggcgagttcctcattcagcgcatggtcttcctcaaaccctccaagttctggtggcaggccgaggagcgacggagggtattttggactgtcttcctgatggaccgattttgtagcgtgtcgacgggatggaatctcagcctcaccagtgccgatgtcaagcgtcgactgccctgcgaaggtgctctctgggaaaaggagtacgaagtgcgcgcaccattctttggcatctccgacaaaagcactttgagcagcagcagtccgaatatcgtcgataatgaccctgccaagggagacccggagcaggatgcgatcgggggattcgcatattgcatcgaggcgaccgagtcacttaccctcgtcattaatttctttctgcaacacgccttgaatctccagaacgcgcaaaaggcgcagctatggctgatgaagttcaaggagctcgatctacgcctcgtgcaatggaagctattcctgccaccgaaatggcgaacggcgtcggtcttgaatgaggatggagtgatggatccgaacctcactctggcacatatgacccacaacaccgcggttattctccttcatcagagcattgcatatccgccctcgcactggaaacagtgtcctgtgagactcccatccgttgcctctgcggaaacctgcatcgaggctgcggcggagattgccaccatcggccaacaattccttgatcattcacctatactcaccaatccgcaattctcgttctgcctttttatcgccggtcgcatgctgttgacacattccacatacaccaaaactgccattcctgatcaattggacagcattgccaccagtctctgggagatttcccgaagatgggctggcccgaacacacctggcctggaaaatctggcatccgtgttcgcaaaaagactactcaatgcgcgtaggcatgcgtctggtcggaccagcctggatatccggcgaactgtatattcggactccacagagcgcgcggacccagtgccggagcagaactcggacggcaacgaggggcctgccgattcgcaagctcggaccaatcttccacgtggctcattcgacggctcaggtcactcagcaagcccaaagcttccgacatacgcaggggattggagcaaccgtgaccctatgcagaatgggccatctccaaacggctcgctctataacgctcttagcctcgctttcccaccacttcctctctcgctgcagccacagtatgcgtcgatatcggaggcgcatatgctcgacccggctctcctgcccaaggatcatgtcccctctctgtatcccgctccgcctgtagaaacgttacatgcgcagccgctgtgggacccggtggcccagtcttataatgattgtaataataacccgaatcctgattatgcgagtcgtttcgtgaacttaccatccagtccagggcatcgaataagtcgctacggggatccgtccatgaacggcgaaaacattcctcccaacggcgaggtaccgggcaacatccgatga

SEQ ID NO: 18658 - DNA, 489 bp, A.fumigatus
atcggtggtctgctcgcctacggtgtcgaacactacaggggccactccatcaaatcctggcagcttctgtttcttgtgctcggagtagccacctgtgcctgggctttgttcatgggctggtatctgcccgacagtccgatgaaggccaagtgctggagcgaggcggacaagcgactgatggtcgagcgagtgcgcgccaatgagactggtattcagaacagagtgttcaagaagcaccaagtgcttgaggtgctcagagaccctgcgatctggctttatgctctattgcagatgaccagctgcttgatcatcggcggactaggtgtcttctccaacatcatcatcaagagttttggctttaccactttgcagacgcagctgctcaacatcgcacagggtggtgtcaccattgctgtgatggtcggcggtgcgtccctggcgacctggaccaaacagactattcttaccatgcatctgtggactatgtaa

SEQ ID NO: 18659 - DNA, 402 bp, A.fumigatus
ctgcagatcgaattcgaatttcaaacccgacgagagaaagcctacctcatcgccatccagttcaacaactgggttcttgaccttgatcttggtaccttcggtagccatggtgcgcgattggttcaaacggaacgaggttactccggaccagcgggaagaagcagggagcgaggaagaggcaagagtacgctgaggacgagatacagcagcagaggtagagaaagaagaagaggaagtcgagaagacagaggaagtagaagaggaaagggaagaaaagcgaacagcggaggaatagagaggggcagatcgaggaggggcacaggcgtggagggagcgtcgcgcaaaagcggaactgagacggagagagctcatattgatctgggattagggaattcgcaataa

SEQ ID NO: 18660 - DNA, 573 bp, A.fumigatus
tcctcaccaggttcagtaccggcaagcttcagcgccaatttatcagcgatgatagaactggcaccaatactgatgttggcgaagggcccggcgtggaccagcactggagttccctccaagctctgcatcaggttgggcttgatagcatccttcatcaaggcggccaaggctcctccagcgccgatatcgtcacaagtcacggggtccccgctcttagaggtggcaacaaccatgcgtcccaatctctcgcgcatgtcttcgagactgttgctcaacgcaaggatggccatacattcactggccacggagatgtcaaagcccgtctcgcgtgacagacccctttcagtaggggcctgtccgacggtaatgcctcggagatggcgatcattgacatccaacacacggcgccaggtgattgtctgcggatcaatgtcaaggcgcgcaaaacggcggatttcttcctcggtgagatcgtcagggttcgttttagtaatgccaagcttcttgagtcttctgaacatgatgggctggaattcgcgcttgccctttttgacagggaccagtcgcttgtaa

SEQ ID NO: 18661 - DNA, 252 bp, A.fumigatus
tcacgggagatggcaatgtcggaaggaacaggccggaccaccttgaggggaagcggcgtaacatgcctgtcccgctgcttttcaaagtatgccttggccgaagtaacgacgttctttagcagcatggcaactgtcatgggaccaacacctccaggaactggagtgatctgcgaagctacctctacggcggcctcaaaatcgacatctccgacgagacgctgtcccgacttcttcgaaggatcaggcttgtag

SEQ ID NO: 18662 - DNA, 810 bp, A.fumigatus
cagacccctttcagtaggggcctgtccgacggtaatgcctcggagatggcgatcattgacatccaacacacggcgccaggtgattgtctgcggatcaatgtcaaggcgcgcaaaacggcggatttcttcctcggtgagatcgtcagggttcgttttagtaatgccaagcttcttgagtcttctgaacatgatgggctggaattcgcgcttgccctttttgacagggaccagtcgcttgtaaagagcagcatccttctgggtggcttcatggaacatgcgagtttcaatggcggcagccagaaggttgttggcagcagtaatcgcgtgaatgtcaccggtcagatggaggttgaactcgtccatgggaatgacctggctgtagcctccaccggcagcgccacccttgataccaaatgtgggaccctgactcggttgccggacattggcaaacacgatccggttcaggtgtgcgcccagcgcttgagtaagaccgagtgtagtcgtggacttgccctctccaagaggcgtaggagtaataccgcacaccaggacataacgtccattacggcggtgagccaagcggtcgagaacactcaaactgatcttagccttggtgtggccgtacggctccagctcgtggggagcaatgccaacctccgcggcgacttgagtaatgggcttggggtactgatcacgggagatggcaatgtcggaaggaacaggccggaccaccttgaggggaagcggcgtaacatgcctgtcccgctgcttttcaaagtatgccttggccgaagtaacgacgttctttag

SEQ ID NO: 18663 - DNA, 615 bp, A.fumigatus
cagcatggcaactgtcatgggaccaacacctccaggaactggagtgatctgcgaagctacctctacggcggcctcaaaatcgacatctccgacgagacgctgtcccgacttcttcgaaggatcaggcttgtagttaatgccaacatcgataacaacggcaccaggcttcagccagtcgcccttgacgaactctgccttcccaatggctgcaacaacaatgtcggcgttcttcacgatgcgggggatgtccggcgtcttggagtggcagacagtcacggtggcgtctgcatttttcaacaggtagctgacagggcttccgacgatgtcactacggccaagaaccactgcctctttgccggcgggatttactccacttgccttgaggaggtccataacagccagcggggtgcagggaacgaagagaggatggccacctcgtttggccaactctccaatatttattgcgccgaaaccatcgaaatccttttcctcggcaactgcagatgtgactgtatgttccgacaggtggctaagaagaagaagttggacgaagatgccgtgcaccgaagggatccttgttacccctggttatttcctgaaggatcctcaggctga

SEQ ID NO: 18664 - DNA, 471 bp, A.fumigatus
tcccagatcaatatgagctctctccgtctcagttccgcttttgcgcgacgctccctccacgcctgtgcccctcctcgatctgcccctctctattcctccgctgttcgcttttcttccctttcctcttctacttcctctgtcttctcgacttcctcttcttctttctctacctctgctgctgtatctcgtcctcagcgtactcttgcctcttcctcgctccctgcttcttcccgctggtccggagtaacctcgttccgtttgaaccaatcgcgcaccatggctaccgaaggtaccaagatcaaggtcaagaacccagttgttgaactggatggcgatgaggtaggctttctctcgtcgggtttgaaattcgaattcgatctgcagctagatcgcttgcttccccctgttctttatataacctttgctgggtttcactgtcacaagcgcgtcggacgtgcattttcgtcatag

SEQ ID NO: 18665 - DNA, 705 bp, A.fumigatus
agaagagtatgctgtgccacctcacttcattcgaaccattctctaactagttcctcaagtgtggctgtctcccaacggtacaatcagaaacattctgtatgttgtccgcaatctactggtactccttccggccaaatgctaatccattgtagaggtggaacggtcttccgtgaaccaattgtcattccccgtattcctcgtctcgtccccggctggaacaagcccatcatcattggtcgtcacgccttcggtgaccagtaccgtgctaccgacattgtcgttcctgggcccggtaagctcgagctcgtctacacccctgagaacggtgagcctcaggccatcaaggtctacgacttcaccggcggcggtgttgcccagacccagtacaacaccgatgattccatccgtggcttcgctcactccagcttcaagatggccctgatgaagggtctgccgctgtacatgagcaccaagaacaccattctgaagaagtacgatggccgcttcaaggatatcttccaggagatctacgagtctacctacaagaaggagtttgacgccaagggcatctggtacgagcatcgtctcattgacgacatggttgctcagatgatcaagagcgagggtgggttcgttatggccctgaagagtgagttcgtcctggtgtcttcccattatgaatgtcttttactgattgacgtctga

SEQ ID NO: 18666 - DNA, 2463 bp, A.fumigatus
ccaggggtaacaaggatcccttcggtgcacggcatcttcgtccaacttcttcttcttagccacctgtcggaacatacagtcacatctgcagttgccgaggaaaaggatttcgatggtttcggcgcaataaatattggagagttggccaaacgaggtggccatcctctcttcgttccctgcaccccgctggctgttatggacctcctcaaggcaagtggagtaaatcccgccggcaaagaggcagtggttcttggccgtagtgacatcgtcggaagccctgtcagctacctgttgaaaaatgcagacgccaccgtgactgtctgccactccaagacgccggacatcccccgcatcgtgaagaacgccgacattgttgttgcagccattgggaaggcagagttcgtcaagggcgactggctgaagcctggtgccgttgttatcgatgttggcattaactacaagcctgatccttcgaagaagtcgggacagcgtctcgtcggagatgtcgattttgaggccgccgtagaggtagcttcgcagatcactccagttcctggaggtgttggtcccatgacagttgccatgctgctaaagaacgtcgttacttcggccaaggcatactttgaaaagcagcgggacaggcatgttacgccgcttcccctcaaggtggtccggcctgttccttccgacattgccatctcccgtgatcagtaccccaagcccattactcaagtcgccgcggaggttggcattgctccccacgagctggagccgtacggccacaccaaggctaagatcagtttgagtgttctcgaccgcttggctcaccgccgtaatggacgttatgtcctggtgtgcggtattactcctacgcctcttggagagggcaagtccacgactacactcggtcttactcaagcgctgggcgcacacctgaaccggatcgtgtttgccaatgtccggcaaccgagtcagggtcccacatttggtatcaagggtggcgctgccggtggaggctacagccaggtcattcccatggacgagttcaacctccatctgaccggtgacattcacgcgattactgctgccaacaaccttctggctgccgccattgaaactcgcatgttccatgaagccacccagaaggatgctgctctttacaagcgactggtccctgtcaaaaagggcaagcgcgaattccagcccatcatgttcagaagactcaagaagcttggcattactaaaacgaaccctgacgatctcaccgaggaagaaatccgccgttttgcgcgccttgacattgatccgcagacaatcacctggcgccgtgtgttggatgtcaatgatcgccatctccgaggcattaccgtcggacaggcccctactgaaaggggtctgtcacgcgagacgggctttgacatctccgtggccagtgaatgtatggccatccttgcgttgagcaacagtctcgaagacatgcgcgagagattgggacgcatggttgttgccacctctaagagcggggaccccgtgacttgtgacgatatcggcgctggaggagccttggccgccttgatgaaggatgctatcaagcccaacctgatgcagagcttggagggaactccagtgctggtccacgccgggcccttcgccaacatcagtattggtgccagttctatcatcgctgataaattggcgctgaagcttgccggtactgaacctggtgaggatcacgaggctaagactggtttcgtagttactgaggccggtttcgacttcaccatgggaggtgagcgtttctttaacatcaagtgccggtcatctggtctctccccagactgtgtggtcattgttgccaccgtccgggctctgaaggttcacggtggtgggccagagatcagccctggagcgccgctccacgagatttatcgcactgaaaacaccgagattctccgcaagggctgtgtgaacctcaagaagcacatccagaacgccaagatgtacggagtgccggtggttgtagccatcaatcggtttgagacggacacggaagccgaaattactatcgtccgcgaggaggctattgctgccggtgcggaggatgctattcctgccaatcactgggccgagggaggtgccggagccgttgaccttgccaagggagtgttggcagctagctccaagcccaaggacttcaagctcctgtatgacttagaaggtagcatccaggagcgcattgagcgcattggaaaggccatgtacggtgcggagaaggttgagttcagcgagctggcgcagaagaaggtcgacacctacacagcacaaggcttctccaatcttccgatctgcatcgccaagacccagtactcattgagtcatgatcccgcgctcaagggggccccaacaggctttacaattcccatccgtgatgttcggctagctgttggaggtggatatctgtaa

SEQ ID NO: 18667 - DNA, 438 bp, A.fumigatus
ttgacgtctgaagactacgacggtgatgttcagtccgatgtcgttgctcagggtttcggctcccttggcctaatgacatccaccctgactacccctgatggtagcgccttcgagtccgaggccgcccacggcactgtcactcgtcactaccgtgagcaccaaaagggccgtgagacctccaccaaccccattgcctctatcttcgcctggacccgtggtctaatccagcgtggcaagctggacgagacccccgacgtcgtcaccttcgccgaagagctcgagcgcgcctgcattgacgtcgtcaacgaggagggcatcatgaccaaggacctggctctggcctgtggccgcaaggagcgggaggcctgggttaccaccaaggagtacttggctgctgttgagcgcagactcaagtctaaccttaaggccagactgtaa

SEQ ID NO: 18668 - DNA, 195 bp, A.fumigatus
ctgttggaggtggatatctgtaagtgcttattttaccacatggctgcagcggatcaatcggctaaccagtggatgaacccccacagttacgcacttgcggcagacatccagaccattcccggattgccgactgctccgggttatctgaacgttgacatcgacaccgaaaccggggagattgacggcctattctag

SEQ ID NO: 18669 - DNA, 213 bp, A.fumigatus
tcgaagtcctcggcgctaatttcgttccagggtattgaataccgtgaccagaccgatgacaaggtcaccgttgaggctgctgaggccatcaagaagtatggtgttggtgtcaagtgcgccaccatcacccccgatgaagcccgtgtcgaggaattcaagctgaagaagagtatgctgtgccacctcacttcattcgaaccattctctaactag

SEQ ID NO: 18670 - DNA, 345 bp, A.fumigatus
cccaaaccacagcgtaacctccctgcccgcggcttccgacccatctactacctcgttggaatgcacctcttcatggcctacggctactacaagctcttctacggtatccgcgaacagcacgagctcgcccgcgagaaggtctggtcccgcctgcacctggtcccgctgctccaggctgaggaagaccgtgaccaggtccgcagacacttcgcggacaaggctcgtgagaaggagcttctgggtacggagagcaaagtctacaattccgatcggtatgtggaacccatgggattgaaagtggtgcggtacagttggctgaccttgtttctcttgcgtttgctttag

SEQ ID NO: 18671 - DNA, 411 bp, A.fumigatus
tcgtcaccatgcctcaggatatgcccccatcggggggctatgcgcctgtacagtacaaggcaagttctcaattactggttttcccaacgcagaacccaaattaccgatagaactaacccaaaccacagcgtaacctccctgcccgcggcttccgacccatctactacctcgttggaatgcacctcttcatggcctacggctactacaagctcttctacggtatccgcgaacagcacgagctcgcccgcgagaaggtctggtcccgcctgcacctggtcccgctgctccaggctgaggaagaccgtgaccaggtccgcagacacttcgcggacaaggctcgtgagaaggagcttctgggtacggagagcaaagtctacaattccgatcggtatgtggaacccatgggattga

SEQ ID NO: 18672 - DNA, 621 bp, A.fumigatus
catattttctgcagtaatgctcatgcattccacaatccggcgaactggggtggcctgcctcatgacatgcgaggggtcgtcgaacgtatcctgaccgaccggttttggcaagcaggcatatctactggcagccgcgacgagttctatgccaagattactgcgtcgcgatcttcgctcgaagggttcgcttcctccgttcgaggtaaggttcgggctgtccgggaatcctgctactcaatgctgttcagcatgagcagattgagggagcatttctatgggtttgcagaacttccaggtcctctttcgcaagctctcttcaaggactcaccacacttatcctctcaccaattctctgttctcctcaatatttccaggtgcttgatcgacgattgccccgtccgtttccgagcacagttccttcctcctatgttggcaacgctcttcaccaacattgacaggaaagttacagcggaatgggaccttattgagcaacgcaaagagggacttgcggacggggatttgactgacgaaatgaagtcagaaagtatcctccgccagttgacttattccgcggtgctcatggtagcaagtcttttggatccgcagagaggtggtgcgtga

SEQ ID NO: 18673 - DNA, 1434 bp, A.fumigatus
ttcggtaacatcacagtgagcaagttcctatttggagacacctctaaagaatccattattgagatccctcaaggccagctgtatttggtccgccctctttctccaaagggttactcagagctcatcttcaaagacgccgcggctactatacgacgcaccggtcaggagtttcagtatcagctcgttattcagcgtgcctatgaggaaggtgaggaagagcttgccgatgaggaggacgaacaagaccccagcaacagtctagacaaggacgaaaaggtattcctgcttgaccaaggcttgcacttccgtgttgaagcccgcgaagggggttcgaaaatactagcttggaacgatttgagtggtgacaccggtgatcttttcgagtttgtctgcgatccatctgtgccagcggacaaagtctccaccttcgagttagcagcgtggcagtgtcagtacgagaggaaatacaggaagagcgctcagcgagcaacagagcaagagcttcaggaattctcctttaagggagagaaaaccatccctgccgcaagtccaatttcctcgccagtcaaatcacgcacacactctgtagcttctgccggagagtccaacgctgccatggctcgtgacgtcgagtattcacggtcaaagggcctcataaaaccagtcggggaaggggaggaacgtacagtagcgccgccctctgcggcgcagccagtggccaaggagattctcgcgaaggaaaaggcggaattgcaccttttcgactttcccagcgggactttcattcttcaggatcccaatgtggttgccactgtgtctgaagtgggcacctggcagtattggttgcagatcagtggggaggataaggaatggcttggtcaagcggttgttgctgacatcaacccagtcttcaattttgaatacctgtcattcatcttcaatcattacggtgaagatggttccgcttactcatggctgctccggttcaaggaccaggccacagaagagaggtttcaagagggcctaatgcaggccctttgggaacagctgaatgaaatgaaatggaccaaggtcaaggagaatgatcgcgagtacgtgttggacgcctttcaggatcttacaatggaggatgcggagactgaagaacaggatgaggcggaggctgagtccgaggatgaagaggaggaagagcaggacgaaagccaacgcagcgagcactacgattcagacgaagagcaggaggatgtctctacgcgtgacgatgatggcaatgtcaattctcagctcgcagtcggctacaagcacgatcgatcatttgttgtccgtggatctaagattggggttttcaggcatacaccggataacaacctggagttttcgaccaatatttctaaggtcgagacgcctaaggggaagctcttcagtccgaagtaa

SEQ ID NO: 18674 - DNA, 195 bp, A.fumigatus
gtcatgttgcatgccgaggaccgcaacatgattctccagaatggcgatgaacctcactctctgtatcgtatggatctcgagtacggcaaggtagtcgatgagtggaaggtgcatgacgatatcccggtgaccacattcgcaccagaaaacgtaagtttacattctcgccttcgtttgacgcctatgtctaactaa

SEQ ID NO: 18675 - DNA, 723 bp, A.fumigatus
cccccgattgggcaggagccaaactgggttgatgcggacctgaaacagtacgcaagcaagaacgatttctccgcagtggccacgagtgagaagggatacattgctgttgcctccaataagggcgatatccgcatgttcgaccgcttgggcatcaatgccaagacacatatacctgctctgggagagcctatcatcggattggatgtgtctgccgatggccgttgggtgttggctacctgccgaacctacctgttgctcatcgactcgctccagaaagaaggcaagaacgaaggcaagcttggcttcgagcgctccttcgccaaagactcgaaaccacagcctcgccgtttgggtctcactccggcgcacgtcgcccagttccagcatgagactaagaagcccatttcgttcactccggcgcggttcaacaccggtgttgagtctcaggagacatccattgtcaccgccactggtcctttcatcgtcacttggagcttgaagaaggtcattgccggccggaaagacccctacaccatcaagcgatatgcagaagatgtcatggcggataacttccggtttggctcagacaagaatgtcattgttgcgctgccgaatgaagtcaacatggtcccgaagaggacattcccgaaacctactcgcgaaagcattgcaggacctccagtgaccccgagccgtcgtagtccccgatggggcagtcgattg

SEQ ID NO: 18676 - DNA, 720 bp, A.fumigatus
catcatgagggtttgctgcaggacataagactaacatccattgtagatccggacgacgagccagctgagcctagcgcaccgcagccacctccagcactttccgactcgattcggcactttgttctttcttcgccggaaatatttgaacccgtcatgctcttctgtacacatgcgcttcgcatgcgggatacgagatgctgtagcatcatcactcgtgttattcgatcaatcttgcaggacttcgcacctccaaatcacagcccgactatagtcacgatccgcgagttcatttcctcggaagttctcaaggcctgcattacatctgtgcatgagccttactttgttgacatgcagaaagacttagcccagctgatcgcctcgatttgggttctttatggctcgagtagcccaacaccacgctcggtgattctcagccttcctggaatggatgaacaacgggtcgcaagtacggaggccgcacttctacgatcaacggcagcgcggcagcaacgtgcgctcgtgttagaccttcttgaaggcctcaggggagtgagtattgcagagcaaggcaagatcttgggctcccgggaagaacgccgcaaggcacgcagtgccttgcaagagagatatatgagcaacgagatggaaggccaacaaatcagcaaagttgacatcaatgacgggcctgatttgggtggtgttgccgacatgtttggttag

SEQ ID NO: 18677 - DNA, 1029 bp, A.fumigatus
tcgaagatggaggatgacgatcggcctagaaaatatcccaaattaaaccatgacgaagtgcaggagggatcagagcctgtcatgaccggcgctgtgggagccgttcacgacgatgacgctgagagtgcggattccgacaaccgtgcgtcgccttcaaacgataggattgacaacgatgtaaagcaagcttgtgatgaagagggacaagacgcgcacggaaaggatggaccgcccacattgtccaagaatcaattgaagaaactcaaacgaaaagagcactgggaggcaatgagggagcagcgcaaagtgaaacgcaaagagaagttggtcgcaaaaagggaacgaagacgagccgctttagaacaggcgaaacaagagggcgcagaggctacggaagaaactcgaaaggcgttcgagtctacacaaaagaaattccaacgatcaactctgctcccggtcacactcgtgctcgactgcagttacgatgatttaatgctagacaaggaacgagtatccctcggtgcgcaaataacgcgatcctactccgataacagtagggctcccttccgctcgcacctggtcgtttcatcattcaacaagttgctcaaggagcggttcgatacggtgctgggaaagacacacgaaaactggaaaggcgttcggtttctgcaggaggacttcgccgaagctgccgagatggcaaaggagtggatgcaaggtcctaaaggcggccagctcgcaggagttttcgctgacaaggcggacgccaagcctgaagatggcgagattgtgtacctcagcagcgacagtcccaatatcttgacggaattgaagccctacagcacatatatcattggaggtttggtggacaagaatcgccacaagggcatctgctataaatccgcggtagccaagggcatcaagaccgccaagctacccatcggagagtatatccagatggctcatcgtcaggtactggcaacgaaccatgtcgtggagaatatgatttcgggggctggagctgggtga
